United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 30

SEQ ID NO: 1246338 - DNA, 21 bp, Homo sapiens
aatcttaatcgatgaatgtaa

SEQ ID NO: 1246339 - DNA, 15 bp, Homo sapiens
aatcttaatgttcct

SEQ ID NO: 1246340 - DNA, 13 bp, Homo sapiens
aatcttacaaaat

SEQ ID NO: 1246341 - DNA, 17 bp, Homo sapiens
aatcttacaaaatcctg

SEQ ID NO: 1246342 - DNA, 15 bp, Homo sapiens
aatcttaccagatgc

SEQ ID NO: 1246343 - DNA, 17 bp, Homo sapiens
aatcttaccagatgcta

SEQ ID NO: 1246344 - DNA, 19 bp, Homo sapiens
aatcttagtatagtagaaa

SEQ ID NO: 1246345 - DNA, 21 bp, Homo sapiens
aatcttagtatagtagaaaga

SEQ ID NO: 1246346 - DNA, 17 bp, Homo sapiens
aatcttataattgttct

SEQ ID NO: 1246347 - DNA, 12 bp, Homo sapiens
aatcttatacaa

SEQ ID NO: 1246348 - DNA, 13 bp, Homo sapiens
aatcttatacaac

SEQ ID NO: 1246349 - DNA, 17 bp, Homo sapiens
aatcttcacctcagagt

SEQ ID NO: 1246350 - DNA, 23 bp, Homo sapiens
aatcttcatggaattcacaaagt

SEQ ID NO: 1246351 - DNA, 22 bp, Homo sapiens
aatcttccaggtattttccact

SEQ ID NO: 1246352 - DNA, 21 bp, Homo sapiens
aatcttctcatcttttatcta

SEQ ID NO: 1246353 - DNA, 14 bp, Homo sapiens
aatcttgaaattaa

SEQ ID NO: 1246354 - DNA, 22 bp, Homo sapiens
aatcttgactacagtcaggaaa

SEQ ID NO: 1246355 - DNA, 18 bp, Homo sapiens
aatcttgactttctgatt

SEQ ID NO: 1246356 - DNA, 23 bp, Homo sapiens
aatcttgatcagttaagaaattt

SEQ ID NO: 1246357 - DNA, 13 bp, Homo sapiens
aatcttgcccact

SEQ ID NO: 1246358 - DNA, 23 bp, Homo sapiens
aatcttgccttctggtttcttcc

SEQ ID NO: 1246359 - DNA, 23 bp, Homo sapiens
aatcttgctgcaggccctccctc

SEQ ID NO: 1246360 - DNA, 12 bp, Homo sapiens
aatcttgctgtt

SEQ ID NO: 1246361 - DNA, 13 bp, Homo sapiens
aatcttgctttct

SEQ ID NO: 1246362 - DNA, 22 bp, Homo sapiens
aatcttgctttctttagaattt

SEQ ID NO: 1246363 - DNA, 22 bp, Homo sapiens
aatcttggcttcttaaaaactg

SEQ ID NO: 1246364 - DNA, 23 bp, Homo sapiens
aatcttggcttcttaaaaactgt

SEQ ID NO: 1246365 - DNA, 19 bp, Homo sapiens
aatcttggggggtttttac

SEQ ID NO: 1246366 - DNA, 19 bp, Homo sapiens
aatcttggttgatgccaaa

SEQ ID NO: 1246367 - DNA, 19 bp, Homo sapiens
aatcttgtaggtcattgca

SEQ ID NO: 1246368 - DNA, 13 bp, Homo sapiens
aatcttgtctaac

SEQ ID NO: 1246369 - DNA, 12 bp, Homo sapiens
aatcttgtctta

SEQ ID NO: 1246370 - DNA, 14 bp, Homo sapiens
aatcttgtgctaga

SEQ ID NO: 1246371 - DNA, 16 bp, Homo sapiens
aatcttgtgctagaat

SEQ ID NO: 1246372 - DNA, 20 bp, Homo sapiens
aatcttgtgctagaatactt

SEQ ID NO: 1246373 - DNA, 12 bp, Homo sapiens
aatcttgttact

SEQ ID NO: 1246374 - DNA, 13 bp, Homo sapiens
aatcttgttactg

SEQ ID NO: 1246375 - DNA, 15 bp, Homo sapiens
aatcttgttactgct

SEQ ID NO: 1246376 - DNA, 13 bp, Homo sapiens
aatcttgttttgt

SEQ ID NO: 1246377 - DNA, 22 bp, Homo sapiens
aatcttgttttgtttgcttcca

SEQ ID NO: 1246378 - DNA, 23 bp, Homo sapiens
aatcttgttttgtttgcttccat

SEQ ID NO: 1246379 - DNA, 16 bp, Homo sapiens
aatctttcatacatat

SEQ ID NO: 1246380 - DNA, 17 bp, Homo sapiens
aatctttcatacatata

SEQ ID NO: 1246381 - DNA, 18 bp, Homo sapiens
aatctttcatacatatat

SEQ ID NO: 1246382 - DNA, 16 bp, Homo sapiens
aatctttcatgtcttg

SEQ ID NO: 1246383 - DNA, 13 bp, Homo sapiens
aatctttccaaat

SEQ ID NO: 1246384 - DNA, 14 bp, Homo sapiens
aatctttctacctc

SEQ ID NO: 1246385 - DNA, 20 bp, Homo sapiens
aatctttctgtaaacagaat

SEQ ID NO: 1246386 - DNA, 17 bp, Homo sapiens
aatctttctttacctga

SEQ ID NO: 1246387 - DNA, 12 bp, Homo sapiens
aatctttctttc

SEQ ID NO: 1246388 - DNA, 22 bp, Homo sapiens
aatctttcttttgattcttcct

SEQ ID NO: 1246389 - DNA, 21 bp, Homo sapiens
aatctttgaaaggttagagaa

SEQ ID NO: 1246390 - DNA, 23 bp, Homo sapiens
aatctttgtaccaaaattttaaa

SEQ ID NO: 1246391 - DNA, 15 bp, Homo sapiens
aatgccagggcccag

SEQ ID NO: 1246392 - DNA, 23 bp, Homo sapiens
aatgccagtaacgcgtcttcctg

SEQ ID NO: 1246393 - DNA, 18 bp, Homo sapiens
aatgccatcagcccctgg

SEQ ID NO: 1246394 - DNA, 15 bp, Homo sapiens
aatgccatcatctcc

SEQ ID NO: 1246395 - DNA, 19 bp, Homo sapiens
aatgccatttctcacgccc

SEQ ID NO: 1246396 - DNA, 13 bp, Homo sapiens
aatgcccaaggat

SEQ ID NO: 1246397 - DNA, 14 bp, Homo sapiens
aatgcccatttttg

SEQ ID NO: 1246398 - DNA, 17 bp, Homo sapiens
aatgcccatttttgcta

SEQ ID NO: 1246399 - DNA, 15 bp, Homo sapiens
aatgcccccagctgg

SEQ ID NO: 1246400 - DNA, 17 bp, Homo sapiens
aatgcccccagctggcc

SEQ ID NO: 1246401 - DNA, 18 bp, Homo sapiens
aatgcccccagctggccc

SEQ ID NO: 1246402 - DNA, 18 bp, Homo sapiens
aatgcccgtaatgcttag

SEQ ID NO: 1246403 - DNA, 19 bp, Homo sapiens
aatgcccgtaatgcttaga

SEQ ID NO: 1246404 - DNA, 19 bp, Homo sapiens
aatgccctcctaaatgtca

SEQ ID NO: 1246405 - DNA, 11 bp, Homo sapiens
aatgccctctt

SEQ ID NO: 1246406 - DNA, 15 bp, Homo sapiens
aatgccctgctggcc

SEQ ID NO: 1246407 - DNA, 13 bp, Homo sapiens
aatgcccttcact

SEQ ID NO: 1246408 - DNA, 13 bp, Homo sapiens
aatgcctaggtcc

SEQ ID NO: 1246409 - DNA, 15 bp, Homo sapiens
aatgcctattgtaat

SEQ ID NO: 1246410 - DNA, 20 bp, Homo sapiens
aatgcctcaatgtgaccagg

SEQ ID NO: 1246411 - DNA, 18 bp, Homo sapiens
aatgcctcacgagatttg

SEQ ID NO: 1246412 - DNA, 15 bp, Homo sapiens
aatgcctcctgtggg

SEQ ID NO: 1246413 - DNA, 17 bp, Homo sapiens
aatgcctgctttttgga

SEQ ID NO: 1246414 - DNA, 20 bp, Homo sapiens
aatgcctgctttttggaaag

SEQ ID NO: 1246415 - DNA, 13 bp, Homo sapiens
aatgcctggagac

SEQ ID NO: 1246416 - DNA, 12 bp, Homo sapiens
aatgcctgtgcc

SEQ ID NO: 1246417 - DNA, 13 bp, Homo sapiens
aatgcctgtgcca

SEQ ID NO: 1246418 - DNA, 21 bp, Homo sapiens
aatgccttgacaacagactga

SEQ ID NO: 1246419 - DNA, 17 bp, Homo sapiens
aatgcgacaagtagttc

SEQ ID NO: 1246420 - DNA, 20 bp, Homo sapiens
aatgcgctttattgcccatg

SEQ ID NO: 1246421 - DNA, 23 bp, Homo sapiens
aatgcggttataaaaaatggttc

SEQ ID NO: 1246422 - DNA, 14 bp, Homo sapiens
aatgcgtaattaaa

SEQ ID NO: 1246423 - DNA, 19 bp, Homo sapiens
aatgcgtgcataccacttt

SEQ ID NO: 1246424 - DNA, 21 bp, Homo sapiens
aatgcgtgcataccacttttg

SEQ ID NO: 1246425 - DNA, 23 bp, Homo sapiens
aatgcgtgcataccacttttgtt

SEQ ID NO: 1246426 - DNA, 13 bp, Homo sapiens
aatgctaccagga

SEQ ID NO: 1246427 - DNA, 14 bp, Homo sapiens
aatgctcaaagaaa

SEQ ID NO: 1246428 - DNA, 16 bp, Homo sapiens
aatgctcaatttcagc

SEQ ID NO: 1246429 - DNA, 22 bp, Homo sapiens
aatgctcagggtcactgaacca

SEQ ID NO: 1246430 - DNA, 16 bp, Homo sapiens
aatgctcataaagatg

SEQ ID NO: 1246431 - DNA, 17 bp, Homo sapiens
aatgctcatgtccctgt

SEQ ID NO: 1246432 - DNA, 15 bp, Homo sapiens
aatgctcattttctg

SEQ ID NO: 1246433 - DNA, 21 bp, Homo sapiens
aatgctcattttctttaggac

SEQ ID NO: 1246434 - DNA, 12 bp, Homo sapiens
aatgctcccagc

SEQ ID NO: 1246435 - DNA, 11 bp, Homo sapiens
aatgctccccc

SEQ ID NO: 1246436 - DNA, 20 bp, Homo sapiens
aatgctcccccatcctcccc

SEQ ID NO: 1246437 - DNA, 23 bp, Homo sapiens
aatgctccttgtggcctttttta

SEQ ID NO: 1246438 - DNA, 16 bp, Homo sapiens
aatgctcgtgtgattt

SEQ ID NO: 1246439 - DNA, 23 bp, Homo sapiens
aatgctcgtgtgatttcctacag

SEQ ID NO: 1246440 - DNA, 14 bp, Homo sapiens
aatgctctatgttt

SEQ ID NO: 1246441 - DNA, 16 bp, Homo sapiens
aatgctctatgtttgt

SEQ ID NO: 1246442 - DNA, 19 bp, Homo sapiens
aatgctctatgtttgtatt

SEQ ID NO: 1246443 - DNA, 13 bp, Homo sapiens
aatgctctgtgcc

SEQ ID NO: 1246444 - DNA, 23 bp, Homo sapiens
aatgctctttacttcatggactt

SEQ ID NO: 1246445 - DNA, 21 bp, Homo sapiens
aatgctgcattttaattttaa

SEQ ID NO: 1246446 - DNA, 14 bp, Homo sapiens
aatgctgcctgcct

SEQ ID NO: 1246447 - DNA, 23 bp, Homo sapiens
aatgctgccttttctttaacttt

SEQ ID NO: 1246448 - DNA, 18 bp, Homo sapiens
aatgctgctgtcagacga

SEQ ID NO: 1246449 - DNA, 14 bp, Homo sapiens
aatgctggactgga

SEQ ID NO: 1246450 - DNA, 17 bp, Homo sapiens
aatgctggactggaggc

SEQ ID NO: 1246451 - DNA, 22 bp, Homo sapiens
aatgctggactggaggcccctg

SEQ ID NO: 1246452 - DNA, 23 bp, Homo sapiens
aatgctggactggaggcccctgg

SEQ ID NO: 1246453 - DNA, 22 bp, Homo sapiens
aatgctggctatagatgtcttt

SEQ ID NO: 1246454 - DNA, 23 bp, Homo sapiens
aatgctggctatagatgtctttt

SEQ ID NO: 1246455 - DNA, 18 bp, Homo sapiens
aatgctggctgagctgaa

SEQ ID NO: 1246456 - DNA, 12 bp, Homo sapiens
aatgctgggccc

SEQ ID NO: 1246457 - DNA, 23 bp, Homo sapiens
aatgctgggcccccagcctggcc

SEQ ID NO: 1246458 - DNA, 20 bp, Homo sapiens
aatgctgggtatgctctgtg

SEQ ID NO: 1246459 - DNA, 15 bp, Homo sapiens
aatgctggttttcct

SEQ ID NO: 1246460 - DNA, 19 bp, Homo sapiens
aatgctggttttcctaaat

SEQ ID NO: 1246461 - DNA, 18 bp, Homo sapiens
aatgctggtttttcagtt

SEQ ID NO: 1246462 - DNA, 12 bp, Homo sapiens
aatgctgtacat

SEQ ID NO: 1246463 - DNA, 12 bp, Homo sapiens
aatgctgtactt

SEQ ID NO: 1246464 - DNA, 13 bp, Homo sapiens
aatgctgtgccct

SEQ ID NO: 1246465 - DNA, 21 bp, Homo sapiens
aatgctgtgccctaaagtgta

SEQ ID NO: 1246466 - DNA, 14 bp, Homo sapiens
aatgctgtttctaa

SEQ ID NO: 1246467 - DNA, 22 bp, Homo sapiens
aatgctgtttctaagaaaatgt

SEQ ID NO: 1246468 - DNA, 14 bp, Homo sapiens
aatgcttcattatt

SEQ ID NO: 1246469 - DNA, 18 bp, Homo sapiens
aatgcttctaagtaaata

SEQ ID NO: 1246470 - DNA, 19 bp, Homo sapiens
aatgcttctaagtaaatac

SEQ ID NO: 1246471 - DNA, 11 bp, Homo sapiens
aatgctttctg

SEQ ID NO: 1246472 - DNA, 12 bp, Homo sapiens
aatgctttgata

SEQ ID NO: 1246473 - DNA, 15 bp, Homo sapiens
aatgcttttaatgaa

SEQ ID NO: 1246474 - DNA, 16 bp, Homo sapiens
aatgcttttaatgaat

SEQ ID NO: 1246475 - DNA, 19 bp, Homo sapiens
aatgcttttatattctaat

SEQ ID NO: 1246476 - DNA, 19 bp, Homo sapiens
aatgctttttagaaagcat

SEQ ID NO: 1246477 - DNA, 19 bp, Homo sapiens
aatgctttttatttctgca

SEQ ID NO: 1246478 - DNA, 20 bp, Homo sapiens
aatgctttttatttctgcat

SEQ ID NO: 1246479 - DNA, 19 bp, Homo sapiens
aatggaaaaaaacataaaa

SEQ ID NO: 1246480 - DNA, 23 bp, Homo sapiens
aatggaaaaaaagactgatgaag

SEQ ID NO: 1246481 - DNA, 18 bp, Homo sapiens
aatggaaaaatccttgaa

SEQ ID NO: 1246482 - DNA, 19 bp, Homo sapiens
aatggaaaacagactcagg

SEQ ID NO: 1246483 - DNA, 14 bp, Homo sapiens
aatggaaaatgtat

SEQ ID NO: 1246484 - DNA, 20 bp, Homo sapiens
aatggaaaatgtatattttg

SEQ ID NO: 1246485 - DNA, 17 bp, Homo sapiens
aatggaaaattttctcc

SEQ ID NO: 1246486 - DNA, 19 bp, Homo sapiens
aatggaaaattttctcctt

SEQ ID NO: 1246487 - DNA, 16 bp, Homo sapiens
aatggaaacagactca

SEQ ID NO: 1246488 - DNA, 22 bp, Homo sapiens
aatggaaagggtgttggcattg

SEQ ID NO: 1246489 - DNA, 17 bp, Homo sapiens
aatggaaattttgctat

SEQ ID NO: 1246490 - DNA, 14 bp, Homo sapiens
aatggaaccactct

SEQ ID NO: 1246491 - DNA, 22 bp, Homo sapiens
aatggaagcaaagacaaaagaa

SEQ ID NO: 1246492 - DNA, 18 bp, Homo sapiens
aatggaaggtttgtatat

SEQ ID NO: 1246493 - DNA, 16 bp, Homo sapiens
aatggaataactatct

SEQ ID NO: 1246494 - DNA, 19 bp, Homo sapiens
aatggaatcttctccagta

SEQ ID NO: 1246495 - DNA, 22 bp, Homo sapiens
aatggaatgtgcccctggccca

SEQ ID NO: 1246496 - DNA, 15 bp, Homo sapiens
aatggacacaaattt

SEQ ID NO: 1246497 - DNA, 19 bp, Homo sapiens
aatggactaagatgaaatg

SEQ ID NO: 1246498 - DNA, 17 bp, Homo sapiens
aatggactggaagggga

SEQ ID NO: 1246499 - DNA, 18 bp, Homo sapiens
aatggactgtgaatttca

SEQ ID NO: 1246500 - DNA, 12 bp, Homo sapiens
aatggagaaagt

SEQ ID NO: 1246501 - DNA, 16 bp, Homo sapiens
aatggagaatcacttt

SEQ ID NO: 1246502 - DNA, 21 bp, Homo sapiens
aatggaggaactttccaaaca

SEQ ID NO: 1246503 - DNA, 20 bp, Homo sapiens
aatggaggatctctaaagag

SEQ ID NO: 1246504 - DNA, 12 bp, Homo sapiens
aatggaggcttt

SEQ ID NO: 1246505 - DNA, 14 bp, Homo sapiens
aatggaggcttttc

SEQ ID NO: 1246506 - DNA, 21 bp, Homo sapiens
aatggaggggcagagccagga

SEQ ID NO: 1246507 - DNA, 22 bp, Homo sapiens
aatggagtcatttgagtctctt

SEQ ID NO: 1246508 - DNA, 19 bp, Homo sapiens
aatggatactacatcttta

SEQ ID NO: 1246509 - DNA, 22 bp, Homo sapiens
aatggatatagaaaatcttagt

SEQ ID NO: 1246510 - DNA, 17 bp, Homo sapiens
aatggatattattagaa

SEQ ID NO: 1246511 - DNA, 19 bp, Homo sapiens
aatggatattattagaaat

SEQ ID NO: 1246512 - DNA, 16 bp, Homo sapiens
aatggatcacaagatg

SEQ ID NO: 1246513 - DNA, 17 bp, Homo sapiens
aatgtgttggaaactgt

SEQ ID NO: 1246514 - DNA, 18 bp, Homo sapiens
aatgtgttggaaactgta

SEQ ID NO: 1246515 - DNA, 14 bp, Homo sapiens
aatgtgttttctgt

SEQ ID NO: 1246516 - DNA, 15 bp, Homo sapiens
aatgttaaactcttt

SEQ ID NO: 1246517 - DNA, 14 bp, Homo sapiens
aatgttaaagtcag

SEQ ID NO: 1246518 - DNA, 13 bp, Homo sapiens
aatgttaagaaat

SEQ ID NO: 1246519 - DNA, 12 bp, Homo sapiens
aatgttaagaat

SEQ ID NO: 1246520 - DNA, 15 bp, Homo sapiens
aatgttaagaattga

SEQ ID NO: 1246521 - DNA, 18 bp, Homo sapiens
aatgttaatttattttgc

SEQ ID NO: 1246522 - DNA, 13 bp, Homo sapiens
aatgttaattttt

SEQ ID NO: 1246523 - DNA, 20 bp, Homo sapiens
aatgttaattttttggtaca

SEQ ID NO: 1246524 - DNA, 21 bp, Homo sapiens
aatgttaattttttggtacaa

SEQ ID NO: 1246525 - DNA, 15 bp, Homo sapiens
aatgttacattgttt

SEQ ID NO: 1246526 - DNA, 18 bp, Homo sapiens
aatgttactgatcatgca

SEQ ID NO: 1246527 - DNA, 22 bp, Homo sapiens
aatgttactgatcatgcattgt

SEQ ID NO: 1246528 - DNA, 17 bp, Homo sapiens
aatgttactgccttaat

SEQ ID NO: 1246529 - DNA, 23 bp, Homo sapiens
aatgttatcttatactgtacaat

SEQ ID NO: 1246530 - DNA, 22 bp, Homo sapiens
aatgttatgttgtgttctaata

SEQ ID NO: 1246531 - DNA, 14 bp, Homo sapiens
aatgttatttaaca

SEQ ID NO: 1246532 - DNA, 22 bp, Homo sapiens
aatgttatttgttattttcagt

SEQ ID NO: 1246533 - DNA, 23 bp, Homo sapiens
aatgttatttgttattttcagta

SEQ ID NO: 1246534 - DNA, 19 bp, Homo sapiens
aatgttattttttaattat

SEQ ID NO: 1246535 - DNA, 15 bp, Homo sapiens
aatgttcacattttt

SEQ ID NO: 1246536 - DNA, 11 bp, Homo sapiens
aatgttcattg

SEQ ID NO: 1246537 - DNA, 12 bp, Homo sapiens
aatgttcattgt

SEQ ID NO: 1246538 - DNA, 15 bp, Homo sapiens
aatgttcattttctc

SEQ ID NO: 1246539 - DNA, 17 bp, Homo sapiens
aatgttccagacattct

SEQ ID NO: 1246540 - DNA, 11 bp, Homo sapiens
aatgttccatt

SEQ ID NO: 1246541 - DNA, 18 bp, Homo sapiens
aatgttccctgcaccctg

SEQ ID NO: 1246542 - DNA, 13 bp, Homo sapiens
aatgttctattta

SEQ ID NO: 1246543 - DNA, 21 bp, Homo sapiens
aatgttctgaataatttctta

SEQ ID NO: 1246544 - DNA, 20 bp, Homo sapiens
aatgttctgaatttcctttt

SEQ ID NO: 1246545 - DNA, 19 bp, Homo sapiens
aatgttctgacattaacag

SEQ ID NO: 1246546 - DNA, 12 bp, Homo sapiens
aatgttctgtga

SEQ ID NO: 1246547 - DNA, 21 bp, Homo sapiens
aatgttctgtgatacagaact

SEQ ID NO: 1246548 - DNA, 17 bp, Homo sapiens
aatgttctttggaaagt

SEQ ID NO: 1246549 - DNA, 22 bp, Homo sapiens
aatgttctttggaaagtacact

SEQ ID NO: 1246550 - DNA, 15 bp, Homo sapiens
aatgttgaaatatga

SEQ ID NO: 1246551 - DNA, 13 bp, Homo sapiens
aatgttgaccttt

SEQ ID NO: 1246552 - DNA, 12 bp, Homo sapiens
aatgttgagaag

SEQ ID NO: 1246553 - DNA, 13 bp, Homo sapiens
aatgttgagaagt

SEQ ID NO: 1246554 - DNA, 13 bp, Homo sapiens
aatgttgatcagc

SEQ ID NO: 1246555 - DNA, 17 bp, Homo sapiens
aatgttgcccacattaa

SEQ ID NO: 1246556 - DNA, 22 bp, Homo sapiens
aatgttgctagttttttgcttc

SEQ ID NO: 1246557 - DNA, 13 bp, Homo sapiens
aatgttgctggat

SEQ ID NO: 1246558 - DNA, 16 bp, Homo sapiens
aatgttggataaggaa

SEQ ID NO: 1246559 - DNA, 13 bp, Homo sapiens
aatgttggctgcg

SEQ ID NO: 1246560 - DNA, 21 bp, Homo sapiens
aatgttgggactgctaaataa

SEQ ID NO: 1246561 - DNA, 22 bp, Homo sapiens
aatgttgggtctcactctctgg

SEQ ID NO: 1246562 - DNA, 16 bp, Homo sapiens
aatgttgtacttgaaa

SEQ ID NO: 1246563 - DNA, 15 bp, Homo sapiens
aatgttgttatttaa

SEQ ID NO: 1246564 - DNA, 12 bp, Homo sapiens
aatgttgtttcc

SEQ ID NO: 1246565 - DNA, 12 bp, Homo sapiens
aatgtttaaaga

SEQ ID NO: 1246566 - DNA, 11 bp, Homo sapiens
aatgtttaaat

SEQ ID NO: 1246567 - DNA, 14 bp, Homo sapiens
aatgtttaatgctg

SEQ ID NO: 1246568 - DNA, 12 bp, Homo sapiens
aatgtttataac

SEQ ID NO: 1246569 - DNA, 13 bp, Homo sapiens
aatgtttataact

SEQ ID NO: 1246570 - DNA, 21 bp, Homo sapiens
aatgtttatgcaaggaaggaa

SEQ ID NO: 1246571 - DNA, 20 bp, Homo sapiens
aatgtttattccttctgtag

SEQ ID NO: 1246572 - DNA, 23 bp, Homo sapiens
aatgtttattccttctgtagtgt

SEQ ID NO: 1246573 - DNA, 16 bp, Homo sapiens
aatgtttattccttga

SEQ ID NO: 1246574 - DNA, 15 bp, Homo sapiens
aatgtttcatttgca

SEQ ID NO: 1246575 - DNA, 12 bp, Homo sapiens
aatgtttccttt

SEQ ID NO: 1246576 - DNA, 12 bp, Homo sapiens
aatgtttctatc

SEQ ID NO: 1246577 - DNA, 15 bp, Homo sapiens
aatgtttctgcagta

SEQ ID NO: 1246578 - DNA, 16 bp, Homo sapiens
aatgtttctggatttc

SEQ ID NO: 1246579 - DNA, 14 bp, Homo sapiens
aatgtttgatttag

SEQ ID NO: 1246580 - DNA, 16 bp, Homo sapiens
aatgtttgatttagta

SEQ ID NO: 1246581 - DNA, 13 bp, Homo sapiens
aatgtttggaaag

SEQ ID NO: 1246582 - DNA, 15 bp, Homo sapiens
aatgtttggatggtt

SEQ ID NO: 1246583 - DNA, 18 bp, Homo sapiens
aatgtttgggcagaaggg

SEQ ID NO: 1246584 - DNA, 23 bp, Homo sapiens
aatgtttgggcagaagggagaag

SEQ ID NO: 1246585 - DNA, 13 bp, Homo sapiens
aatgtttgtgaga

SEQ ID NO: 1246586 - DNA, 21 bp, Homo sapiens
aatgtttgttatttacactgg

SEQ ID NO: 1246587 - DNA, 13 bp, Homo sapiens
aatgttttaaagt

SEQ ID NO: 1246588 - DNA, 16 bp, Homo sapiens
aatgttttaaatgtac

SEQ ID NO: 1246589 - DNA, 22 bp, Homo sapiens
aatgttttactgtgaaactggc

SEQ ID NO: 1246590 - DNA, 13 bp, Homo sapiens
aatgttttcatta

SEQ ID NO: 1246591 - DNA, 17 bp, Homo sapiens
aatgttttctttgcaaa

SEQ ID NO: 1246592 - DNA, 22 bp, Homo sapiens
aatgttttctttgcaaagtatt

SEQ ID NO: 1246593 - DNA, 19 bp, Homo sapiens
aatgttttgtaaacattta

SEQ ID NO: 1246594 - DNA, 12 bp, Homo sapiens
aatgttttgtac

SEQ ID NO: 1246595 - DNA, 13 bp, Homo sapiens
aatgttttgtaca

SEQ ID NO: 1246596 - DNA, 23 bp, Homo sapiens
aatgttttttgccacagcttttg

SEQ ID NO: 1246597 - DNA, 19 bp, Homo sapiens
aatgttttttggaaattca

SEQ ID NO: 1246598 - DNA, 14 bp, Homo sapiens
aatgtttttttccc

SEQ ID NO: 1246599 - DNA, 14 bp, Homo sapiens
aattaaaaaagaaa

SEQ ID NO: 1246600 - DNA, 13 bp, Homo sapiens
aattaaaacaaaa

SEQ ID NO: 1246601 - DNA, 14 bp, Homo sapiens
aattaaaacaaaac

SEQ ID NO: 1246602 - DNA, 16 bp, Homo sapiens
aattaaaacaaatata

SEQ ID NO: 1246603 - DNA, 16 bp, Homo sapiens
aattaaaacagctgca

SEQ ID NO: 1246604 - DNA, 21 bp, Homo sapiens
aattaaaacatatttcatttt

SEQ ID NO: 1246605 - DNA, 14 bp, Homo sapiens
aattaaaacgaaaa

SEQ ID NO: 1246606 - DNA, 21 bp, Homo sapiens
aattaaaacgaaaataaagta

SEQ ID NO: 1246607 - DNA, 13 bp, Homo sapiens
aattaaaactatg

SEQ ID NO: 1246608 - DNA, 21 bp, Homo sapiens
aattaaaactgagtccatgaa

SEQ ID NO: 1246609 - DNA, 20 bp, Homo sapiens
aattaaaatattatttgata

SEQ ID NO: 1246610 - DNA, 13 bp, Homo sapiens
aattaaaatggtt

SEQ ID NO: 1246611 - DNA, 14 bp, Homo sapiens
aattaaaatgtcta

SEQ ID NO: 1246612 - DNA, 16 bp, Homo sapiens
aattaaaattacaaaa

SEQ ID NO: 1246613 - DNA, 21 bp, Homo sapiens
aattaaaattgtcccatttgc

SEQ ID NO: 1246614 - DNA, 19 bp, Homo sapiens
aattaaacaatttatttta

SEQ ID NO: 1246615 - DNA, 23 bp, Homo sapiens
aattaaacccacaagctgcctct

SEQ ID NO: 1246616 - DNA, 14 bp, Homo sapiens
aattaaacttttaa

SEQ ID NO: 1246617 - DNA, 19 bp, Homo sapiens
aattaaacttttaattcat

SEQ ID NO: 1246618 - DNA, 21 bp, Homo sapiens
aattaaagatgccatagcata

SEQ ID NO: 1246619 - DNA, 24 bp, Homo sapiens
aattaaagatgccatagcataata

SEQ ID NO: 1246620 - DNA, 19 bp, Homo sapiens
aattaaagcttaaactgaa

SEQ ID NO: 1246621 - DNA, 14 bp, Homo sapiens
aattaaataaaata

SEQ ID NO: 1246622 - DNA, 14 bp, Homo sapiens
aattaaataaactg

SEQ ID NO: 1246623 - DNA, 13 bp, Homo sapiens
aattaaataatac

SEQ ID NO: 1246624 - DNA, 11 bp, Homo sapiens
aattaaatagt

SEQ ID NO: 1246625 - DNA, 17 bp, Homo sapiens
aattaaatctagacatt

SEQ ID NO: 1246626 - DNA, 11 bp, Homo sapiens
aattaaatgtg

SEQ ID NO: 1246627 - DNA, 16 bp, Homo sapiens
aattaacacagtgttt

SEQ ID NO: 1246628 - DNA, 17 bp, Homo sapiens
aattaacacagtgtttc

SEQ ID NO: 1246629 - DNA, 19 bp, Homo sapiens
aattaacacagtgtttcaa

SEQ ID NO: 1246630 - DNA, 15 bp, Homo sapiens
aattaacatatgtca

SEQ ID NO: 1246631 - DNA, 14 bp, Homo sapiens
aattaaccatttaa

SEQ ID NO: 1246632 - DNA, 19 bp, Homo sapiens
aattaaccatttaataaag

SEQ ID NO: 1246633 - DNA, 12 bp, Homo sapiens
aattaacctggt

SEQ ID NO: 1246634 - DNA, 13 bp, Homo sapiens
aattaacctggtg

SEQ ID NO: 1246635 - DNA, 20 bp, Homo sapiens
aattaactgctccaaattta

SEQ ID NO: 1246636 - DNA, 18 bp, Homo sapiens
aattaactgggtaatgaa

SEQ ID NO: 1246637 - DNA, 14 bp, Homo sapiens
aattgtcaaaattg

SEQ ID NO: 1246638 - DNA, 19 bp, Homo sapiens
aattgtcattatttttgtt

SEQ ID NO: 1246639 - DNA, 11 bp, Homo sapiens
aattgtccctt

SEQ ID NO: 1246640 - DNA, 16 bp, Homo sapiens
aattgtcccttaaaca

SEQ ID NO: 1246641 - DNA, 15 bp, Homo sapiens
aattgtcctgtgtct

SEQ ID NO: 1246642 - DNA, 12 bp, Homo sapiens
aattgtctattt

SEQ ID NO: 1246643 - DNA, 14 bp, Homo sapiens
aattgtctatttat

SEQ ID NO: 1246644 - DNA, 18 bp, Homo sapiens
aattgtctatttatcttt

SEQ ID NO: 1246645 - DNA, 15 bp, Homo sapiens
aattgtcttaaaacc

SEQ ID NO: 1246646 - DNA, 15 bp, Homo sapiens
aattgtctttaaaaa

SEQ ID NO: 1246647 - DNA, 23 bp, Homo sapiens
aattgtcttttagacaactagat

SEQ ID NO: 1246648 - DNA, 20 bp, Homo sapiens
aattgtgattagacagaaca

SEQ ID NO: 1246649 - DNA, 14 bp, Homo sapiens
aattgtgattgttt

SEQ ID NO: 1246650 - DNA, 13 bp, Homo sapiens
aattgtgctgcca

SEQ ID NO: 1246651 - DNA, 14 bp, Homo sapiens
aattgtgctgccat

SEQ ID NO: 1246652 - DNA, 18 bp, Homo sapiens
aattgtgctttcaccaga

SEQ ID NO: 1246653 - DNA, 22 bp, Homo sapiens
aattgtgctttcaccagaattt

SEQ ID NO: 1246654 - DNA, 23 bp, Homo sapiens
aattgtggattataaaaaatgta

SEQ ID NO: 1246655 - DNA, 21 bp, Homo sapiens
aattgtgggataatctgtatt

SEQ ID NO: 1246656 - DNA, 16 bp, Homo sapiens
aattgtgtatatatct

SEQ ID NO: 1246657 - DNA, 23 bp, Homo sapiens
aattgtgtgtgatgtgaagccaa

SEQ ID NO: 1246658 - DNA, 16 bp, Homo sapiens
aattgttaatgtgatg

SEQ ID NO: 1246659 - DNA, 14 bp, Homo sapiens
aattgttatgaaaa

SEQ ID NO: 1246660 - DNA, 16 bp, Homo sapiens
aattgttatgaaaatc

SEQ ID NO: 1246661 - DNA, 13 bp, Homo sapiens
aattgttctcaga

SEQ ID NO: 1246662 - DNA, 20 bp, Homo sapiens
aattgttctcttaaatattc

SEQ ID NO: 1246663 - DNA, 21 bp, Homo sapiens
aattgttgaacaggtgttttt

SEQ ID NO: 1246664 - DNA, 15 bp, Homo sapiens
aattgttgatatttt

SEQ ID NO: 1246665 - DNA, 19 bp, Homo sapiens
aattgttgtttgtatgtat

SEQ ID NO: 1246666 - DNA, 21 bp, Homo sapiens
aattgttgtttgtatgtataa

SEQ ID NO: 1246667 - DNA, 23 bp, Homo sapiens
aattgttgtttgtatgtataatt

SEQ ID NO: 1246668 - DNA, 20 bp, Homo sapiens
aattgtttaagtgttgtaaa

SEQ ID NO: 1246669 - DNA, 16 bp, Homo sapiens
aattgtttatacacaa

SEQ ID NO: 1246670 - DNA, 15 bp, Homo sapiens
aattgtttcatatct

SEQ ID NO: 1246671 - DNA, 17 bp, Homo sapiens
aattgttttaccagctc

SEQ ID NO: 1246672 - DNA, 13 bp, Homo sapiens
aattgttttacct

SEQ ID NO: 1246673 - DNA, 22 bp, Homo sapiens
aattgttttatctgaattttta

SEQ ID NO: 1246674 - DNA, 13 bp, Homo sapiens
aattgttttcact

SEQ ID NO: 1246675 - DNA, 19 bp, Homo sapiens
aattgttttcacttgtatt

SEQ ID NO: 1246676 - DNA, 17 bp, Homo sapiens
aattgttttgcactttt

SEQ ID NO: 1246677 - DNA, 15 bp, Homo sapiens
aattgtttttgtaca

SEQ ID NO: 1246678 - DNA, 16 bp, Homo sapiens
aatttaaaaaagcaaa

SEQ ID NO: 1246679 - DNA, 15 bp, Homo sapiens
aatttaaaaatatat

SEQ ID NO: 1246680 - DNA, 15 bp, Homo sapiens
aatttaaaagtaaaa

SEQ ID NO: 1246681 - DNA, 21 bp, Homo sapiens
aatttaaaagtaaaatgtctt

SEQ ID NO: 1246682 - DNA, 16 bp, Homo sapiens
aatttaaaattaagta

SEQ ID NO: 1246683 - DNA, 19 bp, Homo sapiens
aatttaaacaggcccagca

SEQ ID NO: 1246684 - DNA, 22 bp, Homo sapiens
aatttaaacatttgttcctgga

SEQ ID NO: 1246685 - DNA, 19 bp, Homo sapiens
aatttaaagcaggttcttg

SEQ ID NO: 1246686 - DNA, 22 bp, Homo sapiens
aatttaaagcaggttcttgttg

SEQ ID NO: 1246687 - DNA, 19 bp, Homo sapiens
aatttaaagggtgtactta

SEQ ID NO: 1246688 - DNA, 21 bp, Homo sapiens
aatttaaagggtgtacttata

SEQ ID NO: 1246689 - DNA, 22 bp, Homo sapiens
aatttaaagggtgtacttatat

SEQ ID NO: 1246690 - DNA, 22 bp, Homo sapiens
aatttaaagttgtttgtgcctt

SEQ ID NO: 1246691 - DNA, 12 bp, Homo sapiens
aatttaaataaa

SEQ ID NO: 1246692 - DNA, 15 bp, Homo sapiens
aatttaaataaagtt

SEQ ID NO: 1246693 - DNA, 18 bp, Homo sapiens
aatttaaataaagttact

SEQ ID NO: 1246694 - DNA, 19 bp, Homo sapiens
aatttaaatataattctgt

SEQ ID NO: 1246695 - DNA, 20 bp, Homo sapiens
aatttaaatataattctgta

SEQ ID NO: 1246696 - DNA, 15 bp, Homo sapiens
aatttaaatgatatt

SEQ ID NO: 1246697 - DNA, 16 bp, Homo sapiens
aatttaaatgatattt

SEQ ID NO: 1246698 - DNA, 18 bp, Homo sapiens
aatttaaatgatttaaat

SEQ ID NO: 1246699 - DNA, 13 bp, Homo sapiens
aatttaaatgtta

SEQ ID NO: 1246700 - DNA, 11 bp, Homo sapiens
aatttaaattg

SEQ ID NO: 1246701 - DNA, 15 bp, Homo sapiens
aatttaagaaaacaa

SEQ ID NO: 1246702 - DNA, 11 bp, Homo sapiens
aatttaagcat

SEQ ID NO: 1246703 - DNA, 12 bp, Homo sapiens
aatttaagcatt

SEQ ID NO: 1246704 - DNA, 15 bp, Homo sapiens
aatttaagcattgtt

SEQ ID NO: 1246705 - DNA, 21 bp, Homo sapiens
aatttaagcattgtttgctta

SEQ ID NO: 1246706 - DNA, 23 bp, Homo sapiens
aatttaagcattgtttgcttatt

SEQ ID NO: 1246707 - DNA, 17 bp, Homo sapiens
aatttaaggaacacaga

SEQ ID NO: 1246708 - DNA, 14 bp, Homo sapiens
aatttaatgcatgt

SEQ ID NO: 1246709 - DNA, 10 bp, Homo sapiens
aatttaatgg

SEQ ID NO: 1246710 - DNA, 19 bp, Homo sapiens
aatttaatggactgtgaat

SEQ ID NO: 1246711 - DNA, 20 bp, Homo sapiens
aatttaatggactgtgaatt

SEQ ID NO: 1246712 - DNA, 20 bp, Homo sapiens
aatttaatgtattaatctgt

SEQ ID NO: 1246713 - DNA, 18 bp, Homo sapiens
aatttaattcatgtttct

SEQ ID NO: 1246714 - DNA, 23 bp, Homo sapiens
aatttaattcatgtttcttaaat

SEQ ID NO: 1246715 - DNA, 14 bp, Homo sapiens
aatttaattgcttt

SEQ ID NO: 1246716 - DNA, 16 bp, Homo sapiens
aatttaattgctttga

SEQ ID NO: 1246717 - DNA, 17 bp, Homo sapiens
aatttacaaagtgtgta

SEQ ID NO: 1246718 - DNA, 17 bp, Homo sapiens
aatttacctaagattac

SEQ ID NO: 1246719 - DNA, 18 bp, Homo sapiens
aatttactttgtagactg

SEQ ID NO: 1246720 - DNA, 15 bp, Homo sapiens
aatttagaaatattc

SEQ ID NO: 1246721 - DNA, 14 bp, Homo sapiens
aatttagaaatcat

SEQ ID NO: 1246722 - DNA, 21 bp, Homo sapiens
aatttagaaatcattttgcaa

SEQ ID NO: 1246723 - DNA, 19 bp, Homo sapiens
aatttagacaaagccttaa

SEQ ID NO: 1246724 - DNA, 20 bp, Homo sapiens
aatttagacaacctgaaatt

SEQ ID NO: 1246725 - DNA, 13 bp, Homo sapiens
aatttagcaaact

SEQ ID NO: 1246726 - DNA, 18 bp, Homo sapiens
aatttagccctttaaaac

SEQ ID NO: 1246727 - DNA, 21 bp, Homo sapiens
aatttagtggatggaatatca

SEQ ID NO: 1246728 - DNA, 14 bp, Homo sapiens
aatttagtttcata

SEQ ID NO: 1246729 - DNA, 22 bp, Homo sapiens
aatttataaaaaggtgttttga

SEQ ID NO: 1246730 - DNA, 14 bp, Homo sapiens
aatttataatgtat

SEQ ID NO: 1246731 - DNA, 14 bp, Homo sapiens
aatttatatgaaaa

SEQ ID NO: 1246732 - DNA, 19 bp, Homo sapiens
aatttatcttgtctctggg

SEQ ID NO: 1246733 - DNA, 14 bp, Homo sapiens
aatttatctttacc

SEQ ID NO: 1246734 - DNA, 15 bp, Homo sapiens
aatttatctttacca

SEQ ID NO: 1246735 - DNA, 15 bp, Homo sapiens
aatttatgaagcaga

SEQ ID NO: 1246736 - DNA, 12 bp, Homo sapiens
aatttattaaat

SEQ ID NO: 1246737 - DNA, 16 bp, Homo sapiens
aatttattaatctaaa

SEQ ID NO: 1246738 - DNA, 17 bp, Homo sapiens
aatttattagttaatat

SEQ ID NO: 1246739 - DNA, 19 bp, Homo sapiens
aatttattagttaatatat

SEQ ID NO: 1246740 - DNA, 14 bp, Homo sapiens
aatttattatggca

SEQ ID NO: 1246741 - DNA, 14 bp, Homo sapiens
aatttattcaagaa

SEQ ID NO: 1246742 - DNA, 19 bp, Homo sapiens
aatttattgcacattgttc

SEQ ID NO: 1246743 - DNA, 20 bp, Homo sapiens
aatttattgcacattgttca

SEQ ID NO: 1246744 - DNA, 18 bp, Homo sapiens
aatttattggggtgacct

SEQ ID NO: 1246745 - DNA, 17 bp, Homo sapiens
aatttatttatactatt

SEQ ID NO: 1246746 - DNA, 17 bp, Homo sapiens
aatttatttatattccg

SEQ ID NO: 1246747 - DNA, 16 bp, Homo sapiens
aatttatttattaaga

SEQ ID NO: 1246748 - DNA, 22 bp, Homo sapiens
aatttatttattaagatggatt

SEQ ID NO: 1246749 - DNA, 17 bp, Homo sapiens
aatttatttcatccagt

SEQ ID NO: 1246750 - DNA, 12 bp, Homo sapiens
aatttatttgtt

SEQ ID NO: 1246751 - DNA, 22 bp, Homo sapiens
aatttattttataagaaaaact

SEQ ID NO: 1246752 - DNA, 22 bp, Homo sapiens
aatttattttgctccctctgtt

SEQ ID NO: 1246753 - DNA, 15 bp, Homo sapiens
aatttcaaaaatata

SEQ ID NO: 1246754 - DNA, 19 bp, Homo sapiens
aatttcaaaaatataactt

SEQ ID NO: 1246755 - DNA, 21 bp, Homo sapiens
aatttcaaaatacatttgtaa

SEQ ID NO: 1246756 - DNA, 15 bp, Homo sapiens
aatttcaaaatttaa

SEQ ID NO: 1246757 - DNA, 14 bp, Homo sapiens
aatttcaaggaact

SEQ ID NO: 1246758 - DNA, 21 bp, Homo sapiens
aatttcaataaaagataaatt

SEQ ID NO: 1246759 - DNA, 15 bp, Homo sapiens
acaaagtaatttctt

SEQ ID NO: 1246760 - DNA, 20 bp, Homo sapiens
acaaagtaatttctttgatc

SEQ ID NO: 1246761 - DNA, 23 bp, Homo sapiens
acaaagtactctttaacatacaa

SEQ ID NO: 1246762 - DNA, 22 bp, Homo sapiens
acaaagtcatcccctctcagga

SEQ ID NO: 1246763 - DNA, 21 bp, Homo sapiens
acaaagtgactgtttggctta

SEQ ID NO: 1246764 - DNA, 23 bp, Homo sapiens
acaaagtgccgtgataatttttg

SEQ ID NO: 1246765 - DNA, 18 bp, Homo sapiens
acaaagtgctatgcggag

SEQ ID NO: 1246766 - DNA, 23 bp, Homo sapiens
acaaagtgggtgtgtggcctccc

SEQ ID NO: 1246767 - DNA, 15 bp, Homo sapiens
acaaagtgtgtatta

SEQ ID NO: 1246768 - DNA, 16 bp, Homo sapiens
acaaagtgtgtattaa

SEQ ID NO: 1246769 - DNA, 18 bp, Homo sapiens
acaaagtgtgtattaaaa

SEQ ID NO: 1246770 - DNA, 14 bp, Homo sapiens
acaaagtgttgaaa

SEQ ID NO: 1246771 - DNA, 18 bp, Homo sapiens
acaaagttaaaattgtta

SEQ ID NO: 1246772 - DNA, 15 bp, Homo sapiens
acaaagttctcagag

SEQ ID NO: 1246773 - DNA, 22 bp, Homo sapiens
acaaagtttacattgtcctgta

SEQ ID NO: 1246774 - DNA, 20 bp, Homo sapiens
acaaagtttcagagtatatt

SEQ ID NO: 1246775 - DNA, 22 bp, Homo sapiens
acaaagtttcagagtatattgt

SEQ ID NO: 1246776 - DNA, 13 bp, Homo sapiens
acaaataaacagt

SEQ ID NO: 1246777 - DNA, 14 bp, Homo sapiens
acaaataaacagtt

SEQ ID NO: 1246778 - DNA, 14 bp, Homo sapiens
acaaataaatgatt

SEQ ID NO: 1246779 - DNA, 15 bp, Homo sapiens
acaaataaatgatta

SEQ ID NO: 1246780 - DNA, 18 bp, Homo sapiens
acaaataaatgattatat

SEQ ID NO: 1246781 - DNA, 22 bp, Homo sapiens
acaaataaatgattatattcac

SEQ ID NO: 1246782 - DNA, 15 bp, Homo sapiens
acaaatagaaaatgg

SEQ ID NO: 1246783 - DNA, 16 bp, Homo sapiens
acaaatagaaaatggt

SEQ ID NO: 1246784 - DNA, 23 bp, Homo sapiens
acaaatagatttctttgcacaat

SEQ ID NO: 1246785 - DNA, 15 bp, Homo sapiens
acaaataggagtgag

SEQ ID NO: 1246786 - DNA, 22 bp, Homo sapiens
acaaataggtagagtcattcat

SEQ ID NO: 1246787 - DNA, 16 bp, Homo sapiens
acaaatataagaataa

SEQ ID NO: 1246788 - DNA, 19 bp, Homo sapiens
acaaatatgaaaaatgtaa

SEQ ID NO: 1246789 - DNA, 15 bp, Homo sapiens
acaaatattatttgt

SEQ ID NO: 1246790 - DNA, 16 bp, Homo sapiens
acaaatattgtcatct

SEQ ID NO: 1246791 - DNA, 18 bp, Homo sapiens
acaaatatttattttctt

SEQ ID NO: 1246792 - DNA, 23 bp, Homo sapiens
acaaatatttattttctttctgt

SEQ ID NO: 1246793 - DNA, 16 bp, Homo sapiens
acaaatcaacagaagc

SEQ ID NO: 1246794 - DNA, 16 bp, Homo sapiens
acaaatcagaagtcat

SEQ ID NO: 1246795 - DNA, 23 bp, Homo sapiens
acaaatcagaagtcatcttgcta

SEQ ID NO: 1246796 - DNA, 15 bp, Homo sapiens
acaaatcagtaattt

SEQ ID NO: 1246797 - DNA, 17 bp, Homo sapiens
acaaatcagttagtttt

SEQ ID NO: 1246798 - DNA, 12 bp, Homo sapiens
acaaatccacga

SEQ ID NO: 1246799 - DNA, 16 bp, Homo sapiens
acaaatctataaatat

SEQ ID NO: 1246800 - DNA, 12 bp, Homo sapiens
acaaatctcaga

SEQ ID NO: 1246801 - DNA, 21 bp, Homo sapiens
acaaatgaagaaagtcaaaaa

SEQ ID NO: 1246802 - DNA, 19 bp, Homo sapiens
acaaatgacagattctgac

SEQ ID NO: 1246803 - DNA, 23 bp, Homo sapiens
acaaatgactgtatctaggcatt

SEQ ID NO: 1246804 - DNA, 23 bp, Homo sapiens
acaaatgatcaccatgttagcct

SEQ ID NO: 1246805 - DNA, 17 bp, Homo sapiens
acaaatgcatgaacaag

SEQ ID NO: 1246806 - DNA, 21 bp, Homo sapiens
acaaatgctcaaagaaatcta

SEQ ID NO: 1246807 - DNA, 14 bp, Homo sapiens
acaaatggccttta

SEQ ID NO: 1246808 - DNA, 19 bp, Homo sapiens
acaaatgtatagaataaac

SEQ ID NO: 1246809 - DNA, 14 bp, Homo sapiens
acaaatgtcattgt

SEQ ID NO: 1246810 - DNA, 16 bp, Homo sapiens
acaaatgtcattgtct

SEQ ID NO: 1246811 - DNA, 22 bp, Homo sapiens
acaaatgtgaaacggaagctca

SEQ ID NO: 1246812 - DNA, 12 bp, Homo sapiens
acaaatgtgata

SEQ ID NO: 1246813 - DNA, 21 bp, Homo sapiens
acaaatgttcatatttattga

SEQ ID NO: 1246814 - DNA, 23 bp, Homo sapiens
acaaatgttcatatttattgatt

SEQ ID NO: 1246815 - DNA, 19 bp, Homo sapiens
acaaatgtttataactcta

SEQ ID NO: 1246816 - DNA, 22 bp, Homo sapiens
acaaatgtttataactctaggg

SEQ ID NO: 1246817 - DNA, 23 bp, Homo sapiens
acaaatgttttgctcaatagatt

SEQ ID NO: 1246818 - DNA, 22 bp, Homo sapiens
acaaattagaaaatgttattta

SEQ ID NO: 1246819 - DNA, 19 bp, Homo sapiens
acaaattagcatgcaagct

SEQ ID NO: 1246820 - DNA, 15 bp, Homo sapiens
acaaattagttatat

SEQ ID NO: 1246821 - DNA, 14 bp, Homo sapiens
acaaattatttttg

SEQ ID NO: 1246822 - DNA, 15 bp, Homo sapiens
acaaattctgtttct

SEQ ID NO: 1246823 - DNA, 16 bp, Homo sapiens
acaaattctgtttctt

SEQ ID NO: 1246824 - DNA, 18 bp, Homo sapiens
acaaattgggatctgtct

SEQ ID NO: 1246825 - DNA, 17 bp, Homo sapiens
acaaattgtcgttttta

SEQ ID NO: 1246826 - DNA, 14 bp, Homo sapiens
acaaatttataaag

SEQ ID NO: 1246827 - DNA, 21 bp, Homo sapiens
acaaatttatgcatttcattc

SEQ ID NO: 1246828 - DNA, 22 bp, Homo sapiens
acaaatttatgcatttcattca

SEQ ID NO: 1246829 - DNA, 21 bp, Homo sapiens
acaaatttggccttaagaact

SEQ ID NO: 1246830 - DNA, 17 bp, Homo sapiens
acaaattttcagaaggt

SEQ ID NO: 1246831 - DNA, 16 bp, Homo sapiens
acaaatttttatttct

SEQ ID NO: 1246832 - DNA, 18 bp, Homo sapiens
acaaatttttatttctaa

SEQ ID NO: 1246833 - DNA, 23 bp, Homo sapiens
acaacaaactgaattaaacatga

SEQ ID NO: 1246834 - DNA, 12 bp, Homo sapiens
acaacaaacttg

SEQ ID NO: 1246835 - DNA, 15 bp, Homo sapiens
acaacaataactttt

SEQ ID NO: 1246836 - DNA, 14 bp, Homo sapiens
acaacaatccttct

SEQ ID NO: 1246837 - DNA, 16 bp, Homo sapiens
acaacaatctggagat

SEQ ID NO: 1246838 - DNA, 19 bp, Homo sapiens
acaacaattggtaaaactc

SEQ ID NO: 1246839 - DNA, 21 bp, Homo sapiens
acaacagaaaaacaatcttat

SEQ ID NO: 1246840 - DNA, 13 bp, Homo sapiens
acaacagaagctt

SEQ ID NO: 1246841 - DNA, 13 bp, Homo sapiens
acaacagactgaa

SEQ ID NO: 1246842 - DNA, 17 bp, Homo sapiens
acaacagccctgcctga

SEQ ID NO: 1246843 - DNA, 15 bp, Homo sapiens
acaacagcctggggt

SEQ ID NO: 1246844 - DNA, 16 bp, Homo sapiens
acaacaggagagagat

SEQ ID NO: 1246845 - DNA, 22 bp, Homo sapiens
acaacagtagtttctcagggtc

SEQ ID NO: 1246846 - DNA, 22 bp, Homo sapiens
acaacagtgctttgtaaattgt

SEQ ID NO: 1246847 - DNA, 18 bp, Homo sapiens
acaacagttctcttctag

SEQ ID NO: 1246848 - DNA, 22 bp, Homo sapiens
acaacatagcagatctgttttg

SEQ ID NO: 1246849 - DNA, 19 bp, Homo sapiens
acaacatgtttaataaata

SEQ ID NO: 1246850 - DNA, 16 bp, Homo sapiens
acaacattaaaacaat

SEQ ID NO: 1246851 - DNA, 18 bp, Homo sapiens
acaaccaagctctctgca

SEQ ID NO: 1246852 - DNA, 18 bp, Homo sapiens
acaaccacatacaacaca

SEQ ID NO: 1246853 - DNA, 20 bp, Homo sapiens
acaaccaccgctccccagcc

SEQ ID NO: 1246854 - DNA, 21 bp, Homo sapiens
acaaccacctaatcaggctga

SEQ ID NO: 1246855 - DNA, 13 bp, Homo sapiens
acaaccattaaag

SEQ ID NO: 1246856 - DNA, 18 bp, Homo sapiens
acaaccattaaagtcaga

SEQ ID NO: 1246857 - DNA, 14 bp, Homo sapiens
acaaccccagcctc

SEQ ID NO: 1246858 - DNA, 18 bp, Homo sapiens
acaaccctgttttatact

SEQ ID NO: 1246859 - DNA, 22 bp, Homo sapiens
acaaccgtcctgctgtccctgt

SEQ ID NO: 1246860 - DNA, 15 bp, Homo sapiens
acaacctagaatgtc

SEQ ID NO: 1246861 - DNA, 14 bp, Homo sapiens
acaacctcaccaaa

SEQ ID NO: 1246862 - DNA, 22 bp, Homo sapiens
acaacctccattctattttaga

SEQ ID NO: 1246863 - DNA, 16 bp, Homo sapiens
acaacctctctgatct

SEQ ID NO: 1246864 - DNA, 14 bp, Homo sapiens
acaacctgaaccta

SEQ ID NO: 1246865 - DNA, 16 bp, Homo sapiens
acaacctgaaggaata

SEQ ID NO: 1246866 - DNA, 15 bp, Homo sapiens
acaacctgaatcttt

SEQ ID NO: 1246867 - DNA, 18 bp, Homo sapiens
acaacctgaatctttttt

SEQ ID NO: 1246868 - DNA, 23 bp, Homo sapiens
acaaccttcatttaaaaaggttt

SEQ ID NO: 1246869 - DNA, 14 bp, Homo sapiens
acaacgaatgaatg

SEQ ID NO: 1246870 - DNA, 20 bp, Homo sapiens
acaacgggcagaaatcgaga

SEQ ID NO: 1246871 - DNA, 11 bp, Homo sapiens
acaactaaaat

SEQ ID NO: 1246872 - DNA, 16 bp, Homo sapiens
acaactatcaattctt

SEQ ID NO: 1246873 - DNA, 17 bp, Homo sapiens
acaactatggatcagaa

SEQ ID NO: 1246874 - DNA, 15 bp, Homo sapiens
acaactattttttaa

SEQ ID NO: 1246875 - DNA, 16 bp, Homo sapiens
acaactcactcctttt

SEQ ID NO: 1246876 - DNA, 17 bp, Homo sapiens
acaactcactcctttta

SEQ ID NO: 1246877 - DNA, 12 bp, Homo sapiens
acaactctgcct

SEQ ID NO: 1246878 - DNA, 16 bp, Homo sapiens
acaactctgcctttat

SEQ ID NO: 1246879 - DNA, 13 bp, Homo sapiens
acaactgcctggg

SEQ ID NO: 1246880 - DNA, 19 bp, Homo sapiens
acacacggttttggcagct

SEQ ID NO: 1246881 - DNA, 21 bp, Homo sapiens
acacacgtatttatatttgga

SEQ ID NO: 1246882 - DNA, 21 bp, Homo sapiens
acacacgtgcgtgcgagcaca

SEQ ID NO: 1246883 - DNA, 17 bp, Homo sapiens
acacactaaactctggg

SEQ ID NO: 1246884 - DNA, 22 bp, Homo sapiens
acacactaaactctggggcttg

SEQ ID NO: 1246885 - DNA, 13 bp, Homo sapiens
acacactaatcga

SEQ ID NO: 1246886 - DNA, 22 bp, Homo sapiens
acacactcaccagtggcctttc

SEQ ID NO: 1246887 - DNA, 13 bp, Homo sapiens
acacactcagtgc

SEQ ID NO: 1246888 - DNA, 14 bp, Homo sapiens
acacactcagtgca

SEQ ID NO: 1246889 - DNA, 21 bp, Homo sapiens
acacactctcatgtccccttc

SEQ ID NO: 1246890 - DNA, 15 bp, Homo sapiens
acacactgcacatct

SEQ ID NO: 1246891 - DNA, 11 bp, Homo sapiens
acacactggac

SEQ ID NO: 1246892 - DNA, 13 bp, Homo sapiens
acacactggaccc

SEQ ID NO: 1246893 - DNA, 17 bp, Homo sapiens
acacactgtacacataa

SEQ ID NO: 1246894 - DNA, 19 bp, Homo sapiens
acacactgtcatgcttcat

SEQ ID NO: 1246895 - DNA, 20 bp, Homo sapiens
acacactgtctggggcccca

SEQ ID NO: 1246896 - DNA, 19 bp, Homo sapiens
acacactttttaagaaata

SEQ ID NO: 1246897 - DNA, 14 bp, Homo sapiens
acacagaaatgctg

SEQ ID NO: 1246898 - DNA, 21 bp, Homo sapiens
acacagaaatgctgctggcca

SEQ ID NO: 1246899 - DNA, 23 bp, Homo sapiens
acacagacgttaggcatttcctg

SEQ ID NO: 1246900 - DNA, 14 bp, Homo sapiens
acacagactatttt

SEQ ID NO: 1246901 - DNA, 23 bp, Homo sapiens
acacagactgcgatttgtcccag

SEQ ID NO: 1246902 - DNA, 17 bp, Homo sapiens
acacagactggcaataa

SEQ ID NO: 1246903 - DNA, 14 bp, Homo sapiens
acacagactttctg

SEQ ID NO: 1246904 - DNA, 15 bp, Homo sapiens
acacagactttctgt

SEQ ID NO: 1246905 - DNA, 12 bp, Homo sapiens
acacagagaagg

SEQ ID NO: 1246906 - DNA, 17 bp, Homo sapiens
acacagagattctggat

SEQ ID NO: 1246907 - DNA, 20 bp, Homo sapiens
acacagatcccactggaaga

SEQ ID NO: 1246908 - DNA, 18 bp, Homo sapiens
acacagatgacaaattat

SEQ ID NO: 1246909 - DNA, 11 bp, Homo sapiens
acacagcacaa

SEQ ID NO: 1246910 - DNA, 20 bp, Homo sapiens
acacagcacaccagccgctg

SEQ ID NO: 1246911 - DNA, 15 bp, Homo sapiens
acacagcagtgagta

SEQ ID NO: 1246912 - DNA, 14 bp, Homo sapiens
acacagcagtgtga

SEQ ID NO: 1246913 - DNA, 20 bp, Homo sapiens
acacagcattgtatatgtga

SEQ ID NO: 1246914 - DNA, 21 bp, Homo sapiens
acacagccaaggggatattta

SEQ ID NO: 1246915 - DNA, 13 bp, Homo sapiens
acacagcccaaga

SEQ ID NO: 1246916 - DNA, 12 bp, Homo sapiens
acacagcctcta

SEQ ID NO: 1246917 - DNA, 11 bp, Homo sapiens
acacagccttc

SEQ ID NO: 1246918 - DNA, 12 bp, Homo sapiens
acacagccttcc

SEQ ID NO: 1246919 - DNA, 15 bp, Homo sapiens
acacagccttccttc

SEQ ID NO: 1246920 - DNA, 23 bp, Homo sapiens
acacagctactctccccacgagg

SEQ ID NO: 1246921 - DNA, 22 bp, Homo sapiens
acacagctgccctagctgaccc

SEQ ID NO: 1246922 - DNA, 13 bp, Homo sapiens
acacagctgcttt

SEQ ID NO: 1246923 - DNA, 17 bp, Homo sapiens
acacagctgggcaaagc

SEQ ID NO: 1246924 - DNA, 18 bp, Homo sapiens
acacagctgggcaaagcc

SEQ ID NO: 1246925 - DNA, 16 bp, Homo sapiens
acacaggacagcggga

SEQ ID NO: 1246926 - DNA, 17 bp, Homo sapiens
acacaggacccccttcc

SEQ ID NO: 1246927 - DNA, 19 bp, Homo sapiens
acacaggactgaaaaggga

SEQ ID NO: 1246928 - DNA, 24 bp, Homo sapiens
acacaggatcctattctcaccagg

SEQ ID NO: 1246929 - DNA, 16 bp, Homo sapiens
acacaggcaactgagg

SEQ ID NO: 1246930 - DNA, 21 bp, Homo sapiens
acacaggccttctgtggggct

SEQ ID NO: 1246931 - DNA, 15 bp, Homo sapiens
acacagggacttgaa

SEQ ID NO: 1246932 - DNA, 13 bp, Homo sapiens
acacagggcactg

SEQ ID NO: 1246933 - DNA, 20 bp, Homo sapiens
acacagggcactgactgata

SEQ ID NO: 1246934 - DNA, 11 bp, Homo sapiens
acacagggcag

SEQ ID NO: 1246935 - DNA, 15 bp, Homo sapiens
acacagggctcacag

SEQ ID NO: 1246936 - DNA, 18 bp, Homo sapiens
acacagggctcacagggc

SEQ ID NO: 1246937 - DNA, 14 bp, Homo sapiens
acacagggctcttt

SEQ ID NO: 1246938 - DNA, 18 bp, Homo sapiens
acacaggtcagggctcag

SEQ ID NO: 1246939 - DNA, 15 bp, Homo sapiens
acacaggtctttcct

SEQ ID NO: 1246940 - DNA, 22 bp, Homo sapiens
acacagtaaaaacttgtactat

SEQ ID NO: 1246941 - DNA, 15 bp, Homo sapiens
acacagtaattgtga

SEQ ID NO: 1246942 - DNA, 21 bp, Homo sapiens
acacagtagctccaacacttt

SEQ ID NO: 1246943 - DNA, 21 bp, Homo sapiens
acacagtattcagagtctctg

SEQ ID NO: 1246944 - DNA, 18 bp, Homo sapiens
acacagtcaaaataattc

SEQ ID NO: 1246945 - DNA, 19 bp, Homo sapiens
acacagtcacccctccctc

SEQ ID NO: 1246946 - DNA, 16 bp, Homo sapiens
acacagtctgttttct

SEQ ID NO: 1246947 - DNA, 22 bp, Homo sapiens
acacagtgagagtactcacttt

SEQ ID NO: 1246948 - DNA, 13 bp, Homo sapiens
acacagtgtctgt

SEQ ID NO: 1246949 - DNA, 14 bp, Homo sapiens
acacagtgtctgtt

SEQ ID NO: 1246950 - DNA, 23 bp, Homo sapiens
acacagttaaataaatagaaaga

SEQ ID NO: 1246951 - DNA, 15 bp, Homo sapiens
acacagttcctggga

SEQ ID NO: 1246952 - DNA, 18 bp, Homo sapiens
acacagttctgggcaaag

SEQ ID NO: 1246953 - DNA, 19 bp, Homo sapiens
acacagttctgggcaaaga

SEQ ID NO: 1246954 - DNA, 15 bp, Homo sapiens
acacagttgctgtca

SEQ ID NO: 1246955 - DNA, 11 bp, Homo sapiens
acacatacata

SEQ ID NO: 1246956 - DNA, 17 bp, Homo sapiens
acacatacatacacata

SEQ ID NO: 1246957 - DNA, 23 bp, Homo sapiens
acacatacatacacatacataca

SEQ ID NO: 1246958 - DNA, 18 bp, Homo sapiens
acacatacgtgcacaggg

SEQ ID NO: 1246959 - DNA, 19 bp, Homo sapiens
acacatacgtgcacagggt

SEQ ID NO: 1246960 - DNA, 13 bp, Homo sapiens
acacatagattca

SEQ ID NO: 1246961 - DNA, 16 bp, Homo sapiens
acacatagcgccgtgc

SEQ ID NO: 1246962 - DNA, 12 bp, Homo sapiens
acacatatacat

SEQ ID NO: 1246963 - DNA, 13 bp, Homo sapiens
acacatatacata

SEQ ID NO: 1246964 - DNA, 12 bp, Homo sapiens
acacatatgaac

SEQ ID NO: 1246965 - DNA, 19 bp, Homo sapiens
acacatatgaacacagaca

SEQ ID NO: 1246966 - DNA, 19 bp, Homo sapiens
acacatcaagactatctac

SEQ ID NO: 1246967 - DNA, 18 bp, Homo sapiens
acacatcaagcttttctg

SEQ ID NO: 1246968 - DNA, 21 bp, Homo sapiens
acacatcaagcttttctgtag

SEQ ID NO: 1246969 - DNA, 20 bp, Homo sapiens
acacatcccggcctcttcca

SEQ ID NO: 1246970 - DNA, 17 bp, Homo sapiens
acacatccctaatgtgt

SEQ ID NO: 1246971 - DNA, 20 bp, Homo sapiens
acacatccctaatgtgtgcc

SEQ ID NO: 1246972 - DNA, 16 bp, Homo sapiens
acacatcgcactgtgg

SEQ ID NO: 1246973 - DNA, 20 bp, Homo sapiens
acacatctattgcagagact

SEQ ID NO: 1246974 - DNA, 14 bp, Homo sapiens
acacatctggctgc

SEQ ID NO: 1246975 - DNA, 23 bp, Homo sapiens
acacatctggctgcacaggctga

SEQ ID NO: 1246976 - DNA, 19 bp, Homo sapiens
acacatctgggtgccctga

SEQ ID NO: 1246977 - DNA, 15 bp, Homo sapiens
acacatcttacctct

SEQ ID NO: 1246978 - DNA, 15 bp, Homo sapiens
acacatcttcaacag

SEQ ID NO: 1246979 - DNA, 21 bp, Homo sapiens
acacatgacgccagataaaat

SEQ ID NO: 1246980 - DNA, 20 bp, Homo sapiens
acacatgcaaggtcattttt

SEQ ID NO: 1246981 - DNA, 20 bp, Homo sapiens
acacatgcccctcccccagc

SEQ ID NO: 1246982 - DNA, 18 bp, Homo sapiens
acacatgctgccttcttg

SEQ ID NO: 1246983 - DNA, 21 bp, Homo sapiens
acacatggattttggcagggc

SEQ ID NO: 1246984 - DNA, 22 bp, Homo sapiens
acacatggattttggcagggcg

SEQ ID NO: 1246985 - DNA, 17 bp, Homo sapiens
acacatggtgagcctag

SEQ ID NO: 1246986 - DNA, 23 bp, Homo sapiens
acacattaatgataaactcagat

SEQ ID NO: 1246987 - DNA, 13 bp, Homo sapiens
acacattatcttc

SEQ ID NO: 1246988 - DNA, 17 bp, Homo sapiens
acacattccagccaggc

SEQ ID NO: 1246989 - DNA, 19 bp, Homo sapiens
acacattccagccaggccc

SEQ ID NO: 1246990 - DNA, 23 bp, Homo sapiens
acacattccagccaggcccaggc

SEQ ID NO: 1246991 - DNA, 20 bp, Homo sapiens
acacattctttataaaatgt

SEQ ID NO: 1246992 - DNA, 12 bp, Homo sapiens
acacattgcctt

SEQ ID NO: 1246993 - DNA, 14 bp, Homo sapiens
acacattgccttct

SEQ ID NO: 1246994 - DNA, 13 bp, Homo sapiens
acacattttatga

SEQ ID NO: 1246995 - DNA, 14 bp, Homo sapiens
acacattttatgag

SEQ ID NO: 1246996 - DNA, 16 bp, Homo sapiens
acacattttttaaatg

SEQ ID NO: 1246997 - DNA, 22 bp, Homo sapiens
acacattttttaaatgcacctg

SEQ ID NO: 1246998 - DNA, 14 bp, Homo sapiens
acaccaagcacagc

SEQ ID NO: 1246999 - DNA, 19 bp, Homo sapiens
acaccaagcacagcagcct

SEQ ID NO: 1247000 - DNA, 22 bp, Homo sapiens
acaccaagcccgcctccagcac

SEQ ID NO: 1247001 - DNA, 17 bp, Homo sapiens
acaccaagtggctgggt

SEQ ID NO: 1247002 - DNA, 14 bp, Homo sapiens
acagaatcttgtat

SEQ ID NO: 1247003 - DNA, 16 bp, Homo sapiens
acagaatcttgtattt

SEQ ID NO: 1247004 - DNA, 20 bp, Homo sapiens
acagaatgagtatttattta

SEQ ID NO: 1247005 - DNA, 14 bp, Homo sapiens
acagaatgctcagg

SEQ ID NO: 1247006 - DNA, 17 bp, Homo sapiens
acagaatgggagaaaat

SEQ ID NO: 1247007 - DNA, 13 bp, Homo sapiens
acagaatgtatct

SEQ ID NO: 1247008 - DNA, 14 bp, Homo sapiens
acagaatgtatctg

SEQ ID NO: 1247009 - DNA, 20 bp, Homo sapiens
acagaatgtatctgtgaagt

SEQ ID NO: 1247010 - DNA, 20 bp, Homo sapiens
acagaatgttttactgtgaa

SEQ ID NO: 1247011 - DNA, 13 bp, Homo sapiens
acagaatttgaga

SEQ ID NO: 1247012 - DNA, 14 bp, Homo sapiens
acagaatttgagaa

SEQ ID NO: 1247013 - DNA, 21 bp, Homo sapiens
acagaatttgagaaccttgga

SEQ ID NO: 1247014 - DNA, 12 bp, Homo sapiens
acagacacacac

SEQ ID NO: 1247015 - DNA, 16 bp, Homo sapiens
acagacacacacacgc

SEQ ID NO: 1247016 - DNA, 16 bp, Homo sapiens
acagacacctccccct

SEQ ID NO: 1247017 - DNA, 22 bp, Homo sapiens
acagacactaacgaaatatcaa

SEQ ID NO: 1247018 - DNA, 18 bp, Homo sapiens
acagacactaagttatag

SEQ ID NO: 1247019 - DNA, 13 bp, Homo sapiens
acagacaggaatt

SEQ ID NO: 1247020 - DNA, 11 bp, Homo sapiens
acagacaggag

SEQ ID NO: 1247021 - DNA, 13 bp, Homo sapiens
acagacaggagaa

SEQ ID NO: 1247022 - DNA, 21 bp, Homo sapiens
acagacaggagaaatgcatcc

SEQ ID NO: 1247023 - DNA, 13 bp, Homo sapiens
acagacaggctct

SEQ ID NO: 1247024 - DNA, 20 bp, Homo sapiens
acagaccacatctttatctg

SEQ ID NO: 1247025 - DNA, 21 bp, Homo sapiens
acagaccacatctttatctgt

SEQ ID NO: 1247026 - DNA, 22 bp, Homo sapiens
acagaccacatctttatctgtt

SEQ ID NO: 1247027 - DNA, 22 bp, Homo sapiens
acagacccctcccctcgtgtca

SEQ ID NO: 1247028 - DNA, 18 bp, Homo sapiens
acagaccgaactgttgta

SEQ ID NO: 1247029 - DNA, 16 bp, Homo sapiens
acagacctctgcttgg

SEQ ID NO: 1247030 - DNA, 13 bp, Homo sapiens
acagacctgcagt

SEQ ID NO: 1247031 - DNA, 22 bp, Homo sapiens
acagacgaagagtttaaagaga

SEQ ID NO: 1247032 - DNA, 14 bp, Homo sapiens
acagacggcctagg

SEQ ID NO: 1247033 - DNA, 19 bp, Homo sapiens
acagacggcctaggggtgg

SEQ ID NO: 1247034 - DNA, 22 bp, Homo sapiens
acagactaagaaggaaaagaag

SEQ ID NO: 1247035 - DNA, 22 bp, Homo sapiens
acagactcacaacctgaaccta

SEQ ID NO: 1247036 - DNA, 12 bp, Homo sapiens
acagactcactg

SEQ ID NO: 1247037 - DNA, 20 bp, Homo sapiens
acagactgcagacattctca

SEQ ID NO: 1247038 - DNA, 15 bp, Homo sapiens
acagactgccccagc

SEQ ID NO: 1247039 - DNA, 16 bp, Homo sapiens
acagactgccccagcc

SEQ ID NO: 1247040 - DNA, 22 bp, Homo sapiens
acagactggagaaaacccctcc

SEQ ID NO: 1247041 - DNA, 20 bp, Homo sapiens
acagactggatgtaccacca

SEQ ID NO: 1247042 - DNA, 18 bp, Homo sapiens
acagactggcaataaact

SEQ ID NO: 1247043 - DNA, 15 bp, Homo sapiens
acagactgttaatta

SEQ ID NO: 1247044 - DNA, 17 bp, Homo sapiens
acagacttctccagacc

SEQ ID NO: 1247045 - DNA, 16 bp, Homo sapiens
acagacttctggaagg

SEQ ID NO: 1247046 - DNA, 23 bp, Homo sapiens
acagacttctggaaggctggctg

SEQ ID NO: 1247047 - DNA, 17 bp, Homo sapiens
acagacttgagaacttg

SEQ ID NO: 1247048 - DNA, 19 bp, Homo sapiens
acagactttggacagtggc

SEQ ID NO: 1247049 - DNA, 20 bp, Homo sapiens
acagactttggacagtggcc

SEQ ID NO: 1247050 - DNA, 17 bp, Homo sapiens
acagagaaaatgaattt

SEQ ID NO: 1247051 - DNA, 18 bp, Homo sapiens
acagagaaaatgaatttg

SEQ ID NO: 1247052 - DNA, 14 bp, Homo sapiens
acagagaaagaaaa

SEQ ID NO: 1247053 - DNA, 17 bp, Homo sapiens
acagagaaagaaaaggc

SEQ ID NO: 1247054 - DNA, 17 bp, Homo sapiens
acagagaaatacaaaat

SEQ ID NO: 1247055 - DNA, 19 bp, Homo sapiens
acagagaaatacaaaataa

SEQ ID NO: 1247056 - DNA, 22 bp, Homo sapiens
acagagaaatacaaaataaaga

SEQ ID NO: 1247057 - DNA, 20 bp, Homo sapiens
acagagaagcggatttccag

SEQ ID NO: 1247058 - DNA, 16 bp, Homo sapiens
acagagaaggcaggaa

SEQ ID NO: 1247059 - DNA, 13 bp, Homo sapiens
acagagaaggcta

SEQ ID NO: 1247060 - DNA, 19 bp, Homo sapiens
acagagaatttctaaagta

SEQ ID NO: 1247061 - DNA, 18 bp, Homo sapiens
acagagacaagtaatttc

SEQ ID NO: 1247062 - DNA, 14 bp, Homo sapiens
acagagacacctgc

SEQ ID NO: 1247063 - DNA, 18 bp, Homo sapiens
acagagacgcaggaatgg

SEQ ID NO: 1247064 - DNA, 16 bp, Homo sapiens
acagagacggtctgga

SEQ ID NO: 1247065 - DNA, 11 bp, Homo sapiens
acagagactca

SEQ ID NO: 1247066 - DNA, 14 bp, Homo sapiens
acagagactctatt

SEQ ID NO: 1247067 - DNA, 20 bp, Homo sapiens
acagagagacagacttgaga

SEQ ID NO: 1247068 - DNA, 16 bp, Homo sapiens
acagagaggactgtag

SEQ ID NO: 1247069 - DNA, 20 bp, Homo sapiens
acagagaggagaaacacatc

SEQ ID NO: 1247070 - DNA, 22 bp, Homo sapiens
acagagaggatacatttaataa

SEQ ID NO: 1247071 - DNA, 24 bp, Homo sapiens
acagagagggagagcagagaaaga

SEQ ID NO: 1247072 - DNA, 17 bp, Homo sapiens
acagagattgaactcca

SEQ ID NO: 1247073 - DNA, 21 bp, Homo sapiens
acagagcaagtgagaccctgt

SEQ ID NO: 1247074 - DNA, 12 bp, Homo sapiens
acagagcacgcc

SEQ ID NO: 1247075 - DNA, 16 bp, Homo sapiens
acagagcacgcctgcc

SEQ ID NO: 1247076 - DNA, 17 bp, Homo sapiens
acagagcacgcctgcca

SEQ ID NO: 1247077 - DNA, 14 bp, Homo sapiens
acagagcaggactg

SEQ ID NO: 1247078 - DNA, 20 bp, Homo sapiens
acagagcaggggctccagca

SEQ ID NO: 1247079 - DNA, 20 bp, Homo sapiens
acagagccaggagaagctca

SEQ ID NO: 1247080 - DNA, 21 bp, Homo sapiens
acagagccctgaggggctggg

SEQ ID NO: 1247081 - DNA, 12 bp, Homo sapiens
acagagcctggc

SEQ ID NO: 1247082 - DNA, 14 bp, Homo sapiens
acagagcctggccc

SEQ ID NO: 1247083 - DNA, 14 bp, Homo sapiens
acagagcctggctt

SEQ ID NO: 1247084 - DNA, 21 bp, Homo sapiens
acagagccttgagagacccag

SEQ ID NO: 1247085 - DNA, 22 bp, Homo sapiens
acagagccttgagagacccagc

SEQ ID NO: 1247086 - DNA, 22 bp, Homo sapiens
acagagctgtggaggattgcta

SEQ ID NO: 1247087 - DNA, 15 bp, Homo sapiens
acagagcttccctga

SEQ ID NO: 1247088 - DNA, 16 bp, Homo sapiens
acagagcttccctgac

SEQ ID NO: 1247089 - DNA, 18 bp, Homo sapiens
acagaggaagagcaggca

SEQ ID NO: 1247090 - DNA, 22 bp, Homo sapiens
acagaggacccttacgtgagaa

SEQ ID NO: 1247091 - DNA, 12 bp, Homo sapiens
acagaggaggcc

SEQ ID NO: 1247092 - DNA, 14 bp, Homo sapiens
acagaggaggcctc

SEQ ID NO: 1247093 - DNA, 13 bp, Homo sapiens
acagaggcagccc

SEQ ID NO: 1247094 - DNA, 11 bp, Homo sapiens
acagaggccaa

SEQ ID NO: 1247095 - DNA, 14 bp, Homo sapiens
acagaggccaagga

SEQ ID NO: 1247096 - DNA, 14 bp, Homo sapiens
acagaggccctgcc

SEQ ID NO: 1247097 - DNA, 14 bp, Homo sapiens
acagaggccggggt

SEQ ID NO: 1247098 - DNA, 20 bp, Homo sapiens
acagaggccggggtccaggc

SEQ ID NO: 1247099 - DNA, 22 bp, Homo sapiens
acagaggctgcacccctgggcc

SEQ ID NO: 1247100 - DNA, 23 bp, Homo sapiens
acagaggctggcactgagcctgc

SEQ ID NO: 1247101 - DNA, 16 bp, Homo sapiens
acagagggagacaggg

SEQ ID NO: 1247102 - DNA, 20 bp, Homo sapiens
acagagggagacagggctgc

SEQ ID NO: 1247103 - DNA, 13 bp, Homo sapiens
acagagggagttt

SEQ ID NO: 1247104 - DNA, 14 bp, Homo sapiens
acagagggccagag

SEQ ID NO: 1247105 - DNA, 15 bp, Homo sapiens
acagagtcgctggca

SEQ ID NO: 1247106 - DNA, 16 bp, Homo sapiens
acagagtgcctgcatt

SEQ ID NO: 1247107 - DNA, 22 bp, Homo sapiens
acagagtggaataagacagaga

SEQ ID NO: 1247108 - DNA, 20 bp, Homo sapiens
acagagtggcctccctgctg

SEQ ID NO: 1247109 - DNA, 13 bp, Homo sapiens
acagagttgattt

SEQ ID NO: 1247110 - DNA, 18 bp, Homo sapiens
acagagttgttacatttt

SEQ ID NO: 1247111 - DNA, 18 bp, Homo sapiens
acagataagcaagagaga

SEQ ID NO: 1247112 - DNA, 21 bp, Homo sapiens
acagataagcaagagagatgt

SEQ ID NO: 1247113 - DNA, 19 bp, Homo sapiens
acagataattcatttgtat

SEQ ID NO: 1247114 - DNA, 15 bp, Homo sapiens
acagatacacacaca

SEQ ID NO: 1247115 - DNA, 16 bp, Homo sapiens
acagatacctccaacc

SEQ ID NO: 1247116 - DNA, 21 bp, Homo sapiens
acagatattgttataaataaa

SEQ ID NO: 1247117 - DNA, 13 bp, Homo sapiens
acagatatttaaa

SEQ ID NO: 1247118 - DNA, 14 bp, Homo sapiens
acagatatttaaag

SEQ ID NO: 1247119 - DNA, 21 bp, Homo sapiens
acagatatttagctctgtgga

SEQ ID NO: 1247120 - DNA, 15 bp, Homo sapiens
acagatcaagctgtg

SEQ ID NO: 1247121 - DNA, 18 bp, Homo sapiens
acagatcactcctggagg

SEQ ID NO: 1247122 - DNA, 14 bp, Homo sapiens
acagatcagaacat

SEQ ID NO: 1247123 - DNA, 23 bp, Homo sapiens
acagatcaggaattctaaataaa

SEQ ID NO: 1247124 - DNA, 18 bp, Homo sapiens
acagggcagcagtggggt

SEQ ID NO: 1247125 - DNA, 23 bp, Homo sapiens
acagggcaggccttgctggggtc

SEQ ID NO: 1247126 - DNA, 12 bp, Homo sapiens
acagggcaggcg

SEQ ID NO: 1247127 - DNA, 23 bp, Homo sapiens
acagggcagtccttactccccca

SEQ ID NO: 1247128 - DNA, 18 bp, Homo sapiens
acagggccagtggggcct

SEQ ID NO: 1247129 - DNA, 20 bp, Homo sapiens
acagggccagtggggcctgt

SEQ ID NO: 1247130 - DNA, 21 bp, Homo sapiens
acagggccagtggggcctgtg

SEQ ID NO: 1247131 - DNA, 23 bp, Homo sapiens
acagggccagtggggcctgtgga

SEQ ID NO: 1247132 - DNA, 18 bp, Homo sapiens
acagggcccaggcctgga

SEQ ID NO: 1247133 - DNA, 18 bp, Homo sapiens
acagggcccggccacacc

SEQ ID NO: 1247134 - DNA, 23 bp, Homo sapiens
acagggcggtaccttgtgcccag

SEQ ID NO: 1247135 - DNA, 13 bp, Homo sapiens
acagggctcacag

SEQ ID NO: 1247136 - DNA, 17 bp, Homo sapiens
acagggctcacagggca

SEQ ID NO: 1247137 - DNA, 14 bp, Homo sapiens
acagggctgctccc

SEQ ID NO: 1247138 - DNA, 19 bp, Homo sapiens
acagggctgggagaagaaa

SEQ ID NO: 1247139 - DNA, 22 bp, Homo sapiens
acaggggaaggaaataacattg

SEQ ID NO: 1247140 - DNA, 14 bp, Homo sapiens
acaggggcaggcct

SEQ ID NO: 1247141 - DNA, 15 bp, Homo sapiens
acaggggcaggcctg

SEQ ID NO: 1247142 - DNA, 11 bp, Homo sapiens
acaggggccat

SEQ ID NO: 1247143 - DNA, 14 bp, Homo sapiens
acaggggccatgcc

SEQ ID NO: 1247144 - DNA, 16 bp, Homo sapiens
acaggggccatgcccc

SEQ ID NO: 1247145 - DNA, 22 bp, Homo sapiens
acaggggccccagatctgcctg

SEQ ID NO: 1247146 - DNA, 23 bp, Homo sapiens
acaggggccccagatctgcctgg

SEQ ID NO: 1247147 - DNA, 19 bp, Homo sapiens
acaggggcggggcaggaat

SEQ ID NO: 1247148 - DNA, 21 bp, Homo sapiens
acagggggaagttcagaaggt

SEQ ID NO: 1247149 - DNA, 22 bp, Homo sapiens
acaggggggtcggaagcctgtc

SEQ ID NO: 1247150 - DNA, 18 bp, Homo sapiens
acagggtccccgagtgcc

SEQ ID NO: 1247151 - DNA, 23 bp, Homo sapiens
acagggtctctagtgctgtgaaa

SEQ ID NO: 1247152 - DNA, 14 bp, Homo sapiens
acagggtctgctct

SEQ ID NO: 1247153 - DNA, 15 bp, Homo sapiens
acagggtctgctctt

SEQ ID NO: 1247154 - DNA, 22 bp, Homo sapiens
acagggtctgctctttctctgc

SEQ ID NO: 1247155 - DNA, 23 bp, Homo sapiens
acagggtttggctgtgtctaaac

SEQ ID NO: 1247156 - DNA, 16 bp, Homo sapiens
acaggtaaaacagggc

SEQ ID NO: 1247157 - DNA, 15 bp, Homo sapiens
acaggtaatataaaa

SEQ ID NO: 1247158 - DNA, 14 bp, Homo sapiens
acaggtacttggag

SEQ ID NO: 1247159 - DNA, 14 bp, Homo sapiens
acaggtagcacaga

SEQ ID NO: 1247160 - DNA, 19 bp, Homo sapiens
acaggtatatactttgaaa

SEQ ID NO: 1247161 - DNA, 20 bp, Homo sapiens
acaggtatttttttaaatca

SEQ ID NO: 1247162 - DNA, 21 bp, Homo sapiens
acaggtatttttttaaatcaa

SEQ ID NO: 1247163 - DNA, 12 bp, Homo sapiens
acaggtcaataa

SEQ ID NO: 1247164 - DNA, 13 bp, Homo sapiens
acaggtcagggct

SEQ ID NO: 1247165 - DNA, 23 bp, Homo sapiens
acaggtcagtagtcacaaactga

SEQ ID NO: 1247166 - DNA, 13 bp, Homo sapiens
acaggtcccacct

SEQ ID NO: 1247167 - DNA, 15 bp, Homo sapiens
acaggtctagacttt

SEQ ID NO: 1247168 - DNA, 14 bp, Homo sapiens
acaggtctcctctt

SEQ ID NO: 1247169 - DNA, 18 bp, Homo sapiens
acaggtctcctcttaaaa

SEQ ID NO: 1247170 - DNA, 17 bp, Homo sapiens
acaggtgatgctctggc

SEQ ID NO: 1247171 - DNA, 18 bp, Homo sapiens
acaggtgctaatttgttt

SEQ ID NO: 1247172 - DNA, 23 bp, Homo sapiens
acaggtggctgtttcttgtctgt

SEQ ID NO: 1247173 - DNA, 15 bp, Homo sapiens
acaggtgggcctggc

SEQ ID NO: 1247174 - DNA, 22 bp, Homo sapiens
acaggtgggcctggcggcctgt

SEQ ID NO: 1247175 - DNA, 16 bp, Homo sapiens
acaggtgggcctggga

SEQ ID NO: 1247176 - DNA, 15 bp, Homo sapiens
acaggtggggcctca

SEQ ID NO: 1247177 - DNA, 19 bp, Homo sapiens
acaggtggggcctcagcct

SEQ ID NO: 1247178 - DNA, 22 bp, Homo sapiens
acaggtggggcctcagcctggg

SEQ ID NO: 1247179 - DNA, 18 bp, Homo sapiens
acaggtgtctgcctagat

SEQ ID NO: 1247180 - DNA, 19 bp, Homo sapiens
acaggtgtgagccactgcg

SEQ ID NO: 1247181 - DNA, 20 bp, Homo sapiens
acaggtgtgggatggagagt

SEQ ID NO: 1247182 - DNA, 16 bp, Homo sapiens
acaggtgtgtgtgaac

SEQ ID NO: 1247183 - DNA, 23 bp, Homo sapiens
acaggtgtgtgtgaactgggcac

SEQ ID NO: 1247184 - DNA, 15 bp, Homo sapiens
acaggttataacagt

SEQ ID NO: 1247185 - DNA, 18 bp, Homo sapiens
acaggttataacagtgtt

SEQ ID NO: 1247186 - DNA, 14 bp, Homo sapiens
acaggttcctgtgg

SEQ ID NO: 1247187 - DNA, 16 bp, Homo sapiens
acaggttcctgtggag

SEQ ID NO: 1247188 - DNA, 23 bp, Homo sapiens
acaggttcctgtggagacactga

SEQ ID NO: 1247189 - DNA, 13 bp, Homo sapiens
acaggtttatctg

SEQ ID NO: 1247190 - DNA, 23 bp, Homo sapiens
acagtaaaaacttgtactatgtt

SEQ ID NO: 1247191 - DNA, 16 bp, Homo sapiens
acagtaaaaataaaat

SEQ ID NO: 1247192 - DNA, 15 bp, Homo sapiens
acagtaaaccactga

SEQ ID NO: 1247193 - DNA, 21 bp, Homo sapiens
acagtaaaccactgaaaaaat

SEQ ID NO: 1247194 - DNA, 22 bp, Homo sapiens
acagtaaaccactgaaaaaata

SEQ ID NO: 1247195 - DNA, 15 bp, Homo sapiens
acagtaactttatgt

SEQ ID NO: 1247196 - DNA, 18 bp, Homo sapiens
acagtaactttatgtgta

SEQ ID NO: 1247197 - DNA, 14 bp, Homo sapiens
acagtaagctgctc

SEQ ID NO: 1247198 - DNA, 14 bp, Homo sapiens
acagtaagttccta

SEQ ID NO: 1247199 - DNA, 16 bp, Homo sapiens
acagtaagttcctact

SEQ ID NO: 1247200 - DNA, 21 bp, Homo sapiens
acagtaatctaggtgtggctg

SEQ ID NO: 1247201 - DNA, 22 bp, Homo sapiens
acagtaatctaggtgtggctgt

SEQ ID NO: 1247202 - DNA, 19 bp, Homo sapiens
acagtaatgaaatgtttac

SEQ ID NO: 1247203 - DNA, 14 bp, Homo sapiens
acagtacactgtca

SEQ ID NO: 1247204 - DNA, 15 bp, Homo sapiens
acagtacagcatgtg

SEQ ID NO: 1247205 - DNA, 19 bp, Homo sapiens
acagtacagcatgtgcctt

SEQ ID NO: 1247206 - DNA, 21 bp, Homo sapiens
acagtacctgattgtattttt

SEQ ID NO: 1247207 - DNA, 22 bp, Homo sapiens
acagtactttattgtacagact

SEQ ID NO: 1247208 - DNA, 19 bp, Homo sapiens
acagtagaactgtctgtga

SEQ ID NO: 1247209 - DNA, 13 bp, Homo sapiens
acagtagagccag

SEQ ID NO: 1247210 - DNA, 15 bp, Homo sapiens
acagtagagccagct

SEQ ID NO: 1247211 - DNA, 22 bp, Homo sapiens
acagtaggagcccagctctgaa

SEQ ID NO: 1247212 - DNA, 15 bp, Homo sapiens
acagtaggattgctg

SEQ ID NO: 1247213 - DNA, 14 bp, Homo sapiens
acagtagtcttgat

SEQ ID NO: 1247214 - DNA, 23 bp, Homo sapiens
acagtagttgtattcttctgtat

SEQ ID NO: 1247215 - DNA, 20 bp, Homo sapiens
acagtagtttccctactgaa

SEQ ID NO: 1247216 - DNA, 21 bp, Homo sapiens
acagtatattttatttcaatg

SEQ ID NO: 1247217 - DNA, 21 bp, Homo sapiens
acagtatcccacatccaactc

SEQ ID NO: 1247218 - DNA, 15 bp, Homo sapiens
acagtatcttttctt

SEQ ID NO: 1247219 - DNA, 23 bp, Homo sapiens
acagtatgagtcaatgtgcagtg

SEQ ID NO: 1247220 - DNA, 14 bp, Homo sapiens
acagtatgatgaaa

SEQ ID NO: 1247221 - DNA, 19 bp, Homo sapiens
acagtatgggggttgtaaa

SEQ ID NO: 1247222 - DNA, 14 bp, Homo sapiens
acagtattcagagt

SEQ ID NO: 1247223 - DNA, 12 bp, Homo sapiens
acagtatttctc

SEQ ID NO: 1247224 - DNA, 23 bp, Homo sapiens
acagtatttctcttttattctgt

SEQ ID NO: 1247225 - DNA, 19 bp, Homo sapiens
acagtcaaaataattctaa

SEQ ID NO: 1247226 - DNA, 16 bp, Homo sapiens
acagtcaagatagaaa

SEQ ID NO: 1247227 - DNA, 19 bp, Homo sapiens
acagtcaatctatgagggt

SEQ ID NO: 1247228 - DNA, 18 bp, Homo sapiens
acagtcacccctccctcc

SEQ ID NO: 1247229 - DNA, 22 bp, Homo sapiens
acagtcacccctccctccctct

SEQ ID NO: 1247230 - DNA, 18 bp, Homo sapiens
acagtcactgatgtacaa

SEQ ID NO: 1247231 - DNA, 14 bp, Homo sapiens
acagtcactgctct

SEQ ID NO: 1247232 - DNA, 14 bp, Homo sapiens
acagtcaggggctg

SEQ ID NO: 1247233 - DNA, 19 bp, Homo sapiens
acagtcatcatcagggcct

SEQ ID NO: 1247234 - DNA, 15 bp, Homo sapiens
acagtcatctgtctt

SEQ ID NO: 1247235 - DNA, 14 bp, Homo sapiens
acagtcatggcctg

SEQ ID NO: 1247236 - DNA, 18 bp, Homo sapiens
acagtcattctaggatgt

SEQ ID NO: 1247237 - DNA, 19 bp, Homo sapiens
acagtcattctaggatgtg

SEQ ID NO: 1247238 - DNA, 13 bp, Homo sapiens
acagtcatttaaa

SEQ ID NO: 1247239 - DNA, 14 bp, Homo sapiens
acagtccaaccaga

SEQ ID NO: 1247240 - DNA, 19 bp, Homo sapiens
acagtccacagctgaagag

SEQ ID NO: 1247241 - DNA, 18 bp, Homo sapiens
acagtccaggaacaagct

SEQ ID NO: 1247242 - DNA, 14 bp, Homo sapiens
acagtcccccaccc

SEQ ID NO: 1247243 - DNA, 17 bp, Homo sapiens
acagtcccccacccacc

SEQ ID NO: 1247244 - DNA, 21 bp, Homo sapiens
acagtcccccacccacctcct

SEQ ID NO: 1247245 - DNA, 21 bp, Homo sapiens
acatataaagcactatacaga

SEQ ID NO: 1247246 - DNA, 14 bp, Homo sapiens
acatataacactta

SEQ ID NO: 1247247 - DNA, 23 bp, Homo sapiens
acatataatgttgttatttaaag

SEQ ID NO: 1247248 - DNA, 20 bp, Homo sapiens
acatatacacgaatagacat

SEQ ID NO: 1247249 - DNA, 22 bp, Homo sapiens
acatatacatacttacatgtgt

SEQ ID NO: 1247250 - DNA, 21 bp, Homo sapiens
acatatatatatacacataca

SEQ ID NO: 1247251 - DNA, 22 bp, Homo sapiens
acatatatatatacacatacat

SEQ ID NO: 1247252 - DNA, 16 bp, Homo sapiens
acatatatatatttgt

SEQ ID NO: 1247253 - DNA, 18 bp, Homo sapiens
acatatatatatttgtaa

SEQ ID NO: 1247254 - DNA, 21 bp, Homo sapiens
acatatatatatttgtaacat

SEQ ID NO: 1247255 - DNA, 20 bp, Homo sapiens
acatatatatattttttaat

SEQ ID NO: 1247256 - DNA, 16 bp, Homo sapiens
acatatatatctgata

SEQ ID NO: 1247257 - DNA, 14 bp, Homo sapiens
acatatatctacac

SEQ ID NO: 1247258 - DNA, 21 bp, Homo sapiens
acatatatctacacatacaga

SEQ ID NO: 1247259 - DNA, 22 bp, Homo sapiens
acatatatctacacatacagaa

SEQ ID NO: 1247260 - DNA, 23 bp, Homo sapiens
acatatatctacacatacagaaa

SEQ ID NO: 1247261 - DNA, 20 bp, Homo sapiens
acatatcatggtaatgacag

SEQ ID NO: 1247262 - DNA, 23 bp, Homo sapiens
acatatcatggtaatgacagatg

SEQ ID NO: 1247263 - DNA, 17 bp, Homo sapiens
acatatcatttgtgaag

SEQ ID NO: 1247264 - DNA, 24 bp, Homo sapiens
acatatccaaagggaatactcaca

SEQ ID NO: 1247265 - DNA, 13 bp, Homo sapiens
acatatctctgcc

SEQ ID NO: 1247266 - DNA, 15 bp, Homo sapiens
acatatctttattaa

SEQ ID NO: 1247267 - DNA, 19 bp, Homo sapiens
acatatctttattaatcac

SEQ ID NO: 1247268 - DNA, 15 bp, Homo sapiens
acatatgaacacaga

SEQ ID NO: 1247269 - DNA, 19 bp, Homo sapiens
acatatgagaatatacctt

SEQ ID NO: 1247270 - DNA, 16 bp, Homo sapiens
acatatgatctgtctg

SEQ ID NO: 1247271 - DNA, 17 bp, Homo sapiens
acatatgatctgtctgt

SEQ ID NO: 1247272 - DNA, 18 bp, Homo sapiens
acatatgatctgtctgtg

SEQ ID NO: 1247273 - DNA, 20 bp, Homo sapiens
acatatgctttaagaatcga

SEQ ID NO: 1247274 - DNA, 16 bp, Homo sapiens
acatatggatgttact

SEQ ID NO: 1247275 - DNA, 18 bp, Homo sapiens
acatatggatgttactct

SEQ ID NO: 1247276 - DNA, 23 bp, Homo sapiens
acatatggtctccattttacagt

SEQ ID NO: 1247277 - DNA, 13 bp, Homo sapiens
acatatgtatact

SEQ ID NO: 1247278 - DNA, 14 bp, Homo sapiens
acatatgtatactt

SEQ ID NO: 1247279 - DNA, 17 bp, Homo sapiens
acatatgtattaagcca

SEQ ID NO: 1247280 - DNA, 19 bp, Homo sapiens
acatattactgttgcattt

SEQ ID NO: 1247281 - DNA, 20 bp, Homo sapiens
acatattactgttgcattta

SEQ ID NO: 1247282 - DNA, 11 bp, Homo sapiens
acatattcaag

SEQ ID NO: 1247283 - DNA, 13 bp, Homo sapiens
acatattcatgaa

SEQ ID NO: 1247284 - DNA, 14 bp, Homo sapiens
acatattcatgaaa

SEQ ID NO: 1247285 - DNA, 15 bp, Homo sapiens
acatatttaatgttt

SEQ ID NO: 1247286 - DNA, 16 bp, Homo sapiens
acatatttcattttaa

SEQ ID NO: 1247287 - DNA, 16 bp, Homo sapiens
acatatttgactcttt

SEQ ID NO: 1247288 - DNA, 18 bp, Homo sapiens
acatatttgactctttca

SEQ ID NO: 1247289 - DNA, 20 bp, Homo sapiens
acatatttgactctttcaaa

SEQ ID NO: 1247290 - DNA, 21 bp, Homo sapiens
acatatttgactctttcaaag

SEQ ID NO: 1247291 - DNA, 18 bp, Homo sapiens
acatatttttatacttta

SEQ ID NO: 1247292 - DNA, 19 bp, Homo sapiens
acatatttttatactttat

SEQ ID NO: 1247293 - DNA, 16 bp, Homo sapiens
acatcaaaaccaccct

SEQ ID NO: 1247294 - DNA, 19 bp, Homo sapiens
acatcaaactcaatgcttt

SEQ ID NO: 1247295 - DNA, 16 bp, Homo sapiens
acatcaaagcttcttc

SEQ ID NO: 1247296 - DNA, 19 bp, Homo sapiens
acatcaaataaatttctgg

SEQ ID NO: 1247297 - DNA, 14 bp, Homo sapiens
acatcaaatgcccc

SEQ ID NO: 1247298 - DNA, 21 bp, Homo sapiens
acatcaagcatgcaataatgt

SEQ ID NO: 1247299 - DNA, 21 bp, Homo sapiens
acatcaagtccatctgacaaa

SEQ ID NO: 1247300 - DNA, 16 bp, Homo sapiens
acatcaatgttcattg

SEQ ID NO: 1247301 - DNA, 18 bp, Homo sapiens
acatcaatgttcattgta

SEQ ID NO: 1247302 - DNA, 16 bp, Homo sapiens
acatcaattaattgat

SEQ ID NO: 1247303 - DNA, 16 bp, Homo sapiens
acatcacagcccagcc

SEQ ID NO: 1247304 - DNA, 12 bp, Homo sapiens
acatcaccagtc

SEQ ID NO: 1247305 - DNA, 21 bp, Homo sapiens
acatcaccttcctgaattctt

SEQ ID NO: 1247306 - DNA, 20 bp, Homo sapiens
acatcacctttttgactttt

SEQ ID NO: 1247307 - DNA, 19 bp, Homo sapiens
acatcactctcaccttcca

SEQ ID NO: 1247308 - DNA, 14 bp, Homo sapiens
acatcactgcttga

SEQ ID NO: 1247309 - DNA, 21 bp, Homo sapiens
acatcactgcttgatgaagca

SEQ ID NO: 1247310 - DNA, 16 bp, Homo sapiens
acatcacttgtacaaa

SEQ ID NO: 1247311 - DNA, 16 bp, Homo sapiens
acatcagacctgtctt

SEQ ID NO: 1247312 - DNA, 21 bp, Homo sapiens
acatcagacctgtcttccaag

SEQ ID NO: 1247313 - DNA, 12 bp, Homo sapiens
acatcagcaaac

SEQ ID NO: 1247314 - DNA, 19 bp, Homo sapiens
acatcagcacgatttctgt

SEQ ID NO: 1247315 - DNA, 16 bp, Homo sapiens
acatcagcattgtctc

SEQ ID NO: 1247316 - DNA, 16 bp, Homo sapiens
acatcagccccacagg

SEQ ID NO: 1247317 - DNA, 17 bp, Homo sapiens
acatcagccccacagga

SEQ ID NO: 1247318 - DNA, 15 bp, Homo sapiens
acatcaggagactgg

SEQ ID NO: 1247319 - DNA, 21 bp, Homo sapiens
acatcaggagactgggctctg

SEQ ID NO: 1247320 - DNA, 15 bp, Homo sapiens
acatcagtaatgtat

SEQ ID NO: 1247321 - DNA, 21 bp, Homo sapiens
acatcagtagcatttttctaa

SEQ ID NO: 1247322 - DNA, 20 bp, Homo sapiens
acatcagtggcatggctcca

SEQ ID NO: 1247323 - DNA, 22 bp, Homo sapiens
acatcagtggcatggctccagt

SEQ ID NO: 1247324 - DNA, 18 bp, Homo sapiens
acatcagttactctgaag

SEQ ID NO: 1247325 - DNA, 19 bp, Homo sapiens
acatcataaggttttattc

SEQ ID NO: 1247326 - DNA, 20 bp, Homo sapiens
acatcataaggttttattca

SEQ ID NO: 1247327 - DNA, 14 bp, Homo sapiens
acatcataattaca

SEQ ID NO: 1247328 - DNA, 16 bp, Homo sapiens
acatcataattacatt

SEQ ID NO: 1247329 - DNA, 18 bp, Homo sapiens
acatcataattacattcc

SEQ ID NO: 1247330 - DNA, 12 bp, Homo sapiens
acatcatggacc

SEQ ID NO: 1247331 - DNA, 15 bp, Homo sapiens
acatcatggaccaaa

SEQ ID NO: 1247332 - DNA, 15 bp, Homo sapiens
acatcattcatgaca

SEQ ID NO: 1247333 - DNA, 15 bp, Homo sapiens
acatcattcttgaga

SEQ ID NO: 1247334 - DNA, 16 bp, Homo sapiens
acatccaaagcagaca

SEQ ID NO: 1247335 - DNA, 14 bp, Homo sapiens
acatccaaggagaa

SEQ ID NO: 1247336 - DNA, 20 bp, Homo sapiens
acatccaatattttctttaa

SEQ ID NO: 1247337 - DNA, 15 bp, Homo sapiens
acatccagaaagctg

SEQ ID NO: 1247338 - DNA, 11 bp, Homo sapiens
acatccagaag

SEQ ID NO: 1247339 - DNA, 17 bp, Homo sapiens
acatccagctcctctag

SEQ ID NO: 1247340 - DNA, 16 bp, Homo sapiens
acatccagctgcccct

SEQ ID NO: 1247341 - DNA, 19 bp, Homo sapiens
acatccagctgcccctccc

SEQ ID NO: 1247342 - DNA, 19 bp, Homo sapiens
acatccataaagaagcaat

SEQ ID NO: 1247343 - DNA, 20 bp, Homo sapiens
acatccatgtttgtaaaact

SEQ ID NO: 1247344 - DNA, 15 bp, Homo sapiens
acatcccaaacttta

SEQ ID NO: 1247345 - DNA, 21 bp, Homo sapiens
acatcccaagaaaatcacatc

SEQ ID NO: 1247346 - DNA, 16 bp, Homo sapiens
acatcccagaccagcc

SEQ ID NO: 1247347 - DNA, 13 bp, Homo sapiens
acatcccattggg

SEQ ID NO: 1247348 - DNA, 16 bp, Homo sapiens
acatccccagaatcca

SEQ ID NO: 1247349 - DNA, 21 bp, Homo sapiens
acatccccagaatccataaat

SEQ ID NO: 1247350 - DNA, 13 bp, Homo sapiens
acatccccagagc

SEQ ID NO: 1247351 - DNA, 15 bp, Homo sapiens
acatccccagagccc

SEQ ID NO: 1247352 - DNA, 22 bp, Homo sapiens
acatccccagagcccagctctt

SEQ ID NO: 1247353 - DNA, 15 bp, Homo sapiens
acatcccggcctctt

SEQ ID NO: 1247354 - DNA, 23 bp, Homo sapiens
acatccctacaaaaaattagaaa

SEQ ID NO: 1247355 - DNA, 13 bp, Homo sapiens
acatccctccccc

SEQ ID NO: 1247356 - DNA, 17 bp, Homo sapiens
acatccctgagcaggaa

SEQ ID NO: 1247357 - DNA, 20 bp, Homo sapiens
acatcccttattagttacaa

SEQ ID NO: 1247358 - DNA, 21 bp, Homo sapiens
acatcccttattagttacaaa

SEQ ID NO: 1247359 - DNA, 18 bp, Homo sapiens
acatcccttcctggaaac

SEQ ID NO: 1247360 - DNA, 15 bp, Homo sapiens
acatcctcctcccac

SEQ ID NO: 1247361 - DNA, 11 bp, Homo sapiens
acatcctcctg

SEQ ID NO: 1247362 - DNA, 19 bp, Homo sapiens
acatcctctccaggaaggg

SEQ ID NO: 1247363 - DNA, 15 bp, Homo sapiens
acatcctcttctgct

SEQ ID NO: 1247364 - DNA, 17 bp, Homo sapiens
acatcctgtataagcac

SEQ ID NO: 1247365 - DNA, 15 bp, Homo sapiens
acatccttctcactg

SEQ ID NO: 1247366 - DNA, 13 bp, Homo sapiens
acatcctttctaa

SEQ ID NO: 1247367 - DNA, 13 bp, Homo sapiens
acatttccaaatg

SEQ ID NO: 1247368 - DNA, 16 bp, Homo sapiens
acatttccaaatgaac

SEQ ID NO: 1247369 - DNA, 20 bp, Homo sapiens
acatttccagggcagcagcc

SEQ ID NO: 1247370 - DNA, 17 bp, Homo sapiens
acatttccatttattgt

SEQ ID NO: 1247371 - DNA, 13 bp, Homo sapiens
acatttcccaggg

SEQ ID NO: 1247372 - DNA, 17 bp, Homo sapiens
acatttcgttttttaca

SEQ ID NO: 1247373 - DNA, 14 bp, Homo sapiens
acatttctaacata

SEQ ID NO: 1247374 - DNA, 19 bp, Homo sapiens
acatttctaactctattaa

SEQ ID NO: 1247375 - DNA, 20 bp, Homo sapiens
acatttctatagccaaaaat

SEQ ID NO: 1247376 - DNA, 16 bp, Homo sapiens
acatttctcactgaaa

SEQ ID NO: 1247377 - DNA, 14 bp, Homo sapiens
acatttctggacag

SEQ ID NO: 1247378 - DNA, 12 bp, Homo sapiens
acatttctggat

SEQ ID NO: 1247379 - DNA, 13 bp, Homo sapiens
acatttctggatt

SEQ ID NO: 1247380 - DNA, 13 bp, Homo sapiens
acatttctgtata

SEQ ID NO: 1247381 - DNA, 23 bp, Homo sapiens
acatttcttagactacatttaga

SEQ ID NO: 1247382 - DNA, 20 bp, Homo sapiens
acatttcttatgatttttaa

SEQ ID NO: 1247383 - DNA, 22 bp, Homo sapiens
acatttctttcttgctggctct

SEQ ID NO: 1247384 - DNA, 18 bp, Homo sapiens
acatttgaaggacctaaa

SEQ ID NO: 1247385 - DNA, 14 bp, Homo sapiens
acatttgaattctt

SEQ ID NO: 1247386 - DNA, 19 bp, Homo sapiens
acatttgaattcttgatct

SEQ ID NO: 1247387 - DNA, 17 bp, Homo sapiens
acatttgatatttttcc

SEQ ID NO: 1247388 - DNA, 20 bp, Homo sapiens
acatttgatgcatgtctttt

SEQ ID NO: 1247389 - DNA, 13 bp, Homo sapiens
acatttgatgtac

SEQ ID NO: 1247390 - DNA, 13 bp, Homo sapiens
acatttgccttgc

SEQ ID NO: 1247391 - DNA, 14 bp, Homo sapiens
acatttgccttgca

SEQ ID NO: 1247392 - DNA, 17 bp, Homo sapiens
acatttgccttgcagaa

SEQ ID NO: 1247393 - DNA, 21 bp, Homo sapiens
acatttgccttgcagaactgc

SEQ ID NO: 1247394 - DNA, 23 bp, Homo sapiens
acatttgccttgcagaactgcca

SEQ ID NO: 1247395 - DNA, 14 bp, Homo sapiens
acatttgccttgct

SEQ ID NO: 1247396 - DNA, 21 bp, Homo sapiens
acatttgctgaactcagcaca

SEQ ID NO: 1247397 - DNA, 12 bp, Homo sapiens
acatttggaata

SEQ ID NO: 1247398 - DNA, 19 bp, Homo sapiens
acatttgggagacatgtga

SEQ ID NO: 1247399 - DNA, 20 bp, Homo sapiens
acatttgggagacatgtgac

SEQ ID NO: 1247400 - DNA, 21 bp, Homo sapiens
acatttgggagtttttatgag

SEQ ID NO: 1247401 - DNA, 13 bp, Homo sapiens
acatttgggctca

SEQ ID NO: 1247402 - DNA, 15 bp, Homo sapiens
acatttgggctcagg

SEQ ID NO: 1247403 - DNA, 16 bp, Homo sapiens
acatttgtaagtgtaa

SEQ ID NO: 1247404 - DNA, 21 bp, Homo sapiens
acatttgtactttatttttgt

SEQ ID NO: 1247405 - DNA, 14 bp, Homo sapiens
acatttgtagttga

SEQ ID NO: 1247406 - DNA, 12 bp, Homo sapiens
acatttgtatat

SEQ ID NO: 1247407 - DNA, 15 bp, Homo sapiens
acatttgtatattgt

SEQ ID NO: 1247408 - DNA, 16 bp, Homo sapiens
acatttgtatattgtg

SEQ ID NO: 1247409 - DNA, 18 bp, Homo sapiens
acatttgtatattgtgga

SEQ ID NO: 1247410 - DNA, 18 bp, Homo sapiens
acatttgtcacagaaatc

SEQ ID NO: 1247411 - DNA, 16 bp, Homo sapiens
acatttgtcagtattt

SEQ ID NO: 1247412 - DNA, 19 bp, Homo sapiens
acattttaaaagtgccatt

SEQ ID NO: 1247413 - DNA, 17 bp, Homo sapiens
acattttaaataaaaga

SEQ ID NO: 1247414 - DNA, 17 bp, Homo sapiens
acattttatactgtaca

SEQ ID NO: 1247415 - DNA, 19 bp, Homo sapiens
acattttatactgtacatg

SEQ ID NO: 1247416 - DNA, 15 bp, Homo sapiens
acattttatatgtga

SEQ ID NO: 1247417 - DNA, 21 bp, Homo sapiens
acattttatatttttgtacat

SEQ ID NO: 1247418 - DNA, 18 bp, Homo sapiens
acattttatcattaaaaa

SEQ ID NO: 1247419 - DNA, 16 bp, Homo sapiens
acattttatgagagtt

SEQ ID NO: 1247420 - DNA, 14 bp, Homo sapiens
acattttattttat

SEQ ID NO: 1247421 - DNA, 20 bp, Homo sapiens
acattttattttattatgca

SEQ ID NO: 1247422 - DNA, 20 bp, Homo sapiens
acattttccacggaaacaga

SEQ ID NO: 1247423 - DNA, 12 bp, Homo sapiens
acattttctaaa

SEQ ID NO: 1247424 - DNA, 14 bp, Homo sapiens
acattttctaaata

SEQ ID NO: 1247425 - DNA, 23 bp, Homo sapiens
acattttctttctttttctggaa

SEQ ID NO: 1247426 - DNA, 16 bp, Homo sapiens
acattttgtaaaatat

SEQ ID NO: 1247427 - DNA, 17 bp, Homo sapiens
acattttgtaaaatatt

SEQ ID NO: 1247428 - DNA, 21 bp, Homo sapiens
acatttttaaagtctaaactg

SEQ ID NO: 1247429 - DNA, 23 bp, Homo sapiens
acatttttaagctccatgtgcat

SEQ ID NO: 1247430 - DNA, 23 bp, Homo sapiens
acatttttaagtgctgcatttaa

SEQ ID NO: 1247431 - DNA, 22 bp, Homo sapiens
acatttttacaaataggtagag

SEQ ID NO: 1247432 - DNA, 15 bp, Homo sapiens
acatttttacaataa

SEQ ID NO: 1247433 - DNA, 21 bp, Homo sapiens
acatttttccgtttgcttttg

SEQ ID NO: 1247434 - DNA, 18 bp, Homo sapiens
acattttttaaaactgaa

SEQ ID NO: 1247435 - DNA, 14 bp, Homo sapiens
acattttttaaatg

SEQ ID NO: 1247436 - DNA, 17 bp, Homo sapiens
acattttttaactttct

SEQ ID NO: 1247437 - DNA, 19 bp, Homo sapiens
acattttttagtctgtaat

SEQ ID NO: 1247438 - DNA, 14 bp, Homo sapiens
acattttttgctat

SEQ ID NO: 1247439 - DNA, 22 bp, Homo sapiens
acatttttttatgctcttgaaa

SEQ ID NO: 1247440 - DNA, 20 bp, Homo sapiens
acatttttttctacctataa

SEQ ID NO: 1247441 - DNA, 21 bp, Homo sapiens
acatttttttctgatttgtcc

SEQ ID NO: 1247442 - DNA, 17 bp, Homo sapiens
accaaaaaaaaaaaagg

SEQ ID NO: 1247443 - DNA, 19 bp, Homo sapiens
accaaaaaaaaaaaaggaa

SEQ ID NO: 1247444 - DNA, 18 bp, Homo sapiens
accaaaaaacctcactgg

SEQ ID NO: 1247445 - DNA, 22 bp, Homo sapiens
accaaaaaccatgttgcgttca

SEQ ID NO: 1247446 - DNA, 19 bp, Homo sapiens
accaaaaactgaaagtgaa

SEQ ID NO: 1247447 - DNA, 11 bp, Homo sapiens
accaaaaagag

SEQ ID NO: 1247448 - DNA, 11 bp, Homo sapiens
accaaaacagg

SEQ ID NO: 1247449 - DNA, 14 bp, Homo sapiens
accaaaagaagtaa

SEQ ID NO: 1247450 - DNA, 17 bp, Homo sapiens
accaaaagaatttgcac

SEQ ID NO: 1247451 - DNA, 23 bp, Homo sapiens
accaaaagaatttgtgtttgtct

SEQ ID NO: 1247452 - DNA, 21 bp, Homo sapiens
accaaaagttacatgtttgca

SEQ ID NO: 1247453 - DNA, 12 bp, Homo sapiens
accaaaatgaca

SEQ ID NO: 1247454 - DNA, 18 bp, Homo sapiens
accaaaattttaaaaaag

SEQ ID NO: 1247455 - DNA, 14 bp, Homo sapiens
accaaacaaggaag

SEQ ID NO: 1247456 - DNA, 15 bp, Homo sapiens
accaaaccagccttc

SEQ ID NO: 1247457 - DNA, 17 bp, Homo sapiens
accaaactactgaatga

SEQ ID NO: 1247458 - DNA, 15 bp, Homo sapiens
accaaagaagaaagt

SEQ ID NO: 1247459 - DNA, 14 bp, Homo sapiens
accaaagaccaagt

SEQ ID NO: 1247460 - DNA, 19 bp, Homo sapiens
accaaagactatttcaaaa

SEQ ID NO: 1247461 - DNA, 17 bp, Homo sapiens
accaaagagactggagc

SEQ ID NO: 1247462 - DNA, 18 bp, Homo sapiens
accaaagagggcttcctc

SEQ ID NO: 1247463 - DNA, 19 bp, Homo sapiens
accaaagctgcccactgtt

SEQ ID NO: 1247464 - DNA, 13 bp, Homo sapiens
accaaagctgcct

SEQ ID NO: 1247465 - DNA, 15 bp, Homo sapiens
accaaaggaaggaac

SEQ ID NO: 1247466 - DNA, 20 bp, Homo sapiens
accaaagggaagtgaggccc

SEQ ID NO: 1247467 - DNA, 19 bp, Homo sapiens
accaaaggtgaaggaatat

SEQ ID NO: 1247468 - DNA, 21 bp, Homo sapiens
accaaaggtgaaggaatatat

SEQ ID NO: 1247469 - DNA, 18 bp, Homo sapiens
accaaagtatttttttat

SEQ ID NO: 1247470 - DNA, 12 bp, Homo sapiens
accaaagtcaaa

SEQ ID NO: 1247471 - DNA, 16 bp, Homo sapiens
accaaagtcccttcct

SEQ ID NO: 1247472 - DNA, 18 bp, Homo sapiens
accaaagtcccttcctgc

SEQ ID NO: 1247473 - DNA, 14 bp, Homo sapiens
accaaagtctaaac

SEQ ID NO: 1247474 - DNA, 23 bp, Homo sapiens
accaaagtgtcttttgacatttt

SEQ ID NO: 1247475 - DNA, 19 bp, Homo sapiens
accaaataatttcatattc

SEQ ID NO: 1247476 - DNA, 15 bp, Homo sapiens
accaaatattttagc

SEQ ID NO: 1247477 - DNA, 15 bp, Homo sapiens
accaaatcatcctga

SEQ ID NO: 1247478 - DNA, 13 bp, Homo sapiens
accaaatctcagt

SEQ ID NO: 1247479 - DNA, 22 bp, Homo sapiens
accaaatctcagttgtttgctt

SEQ ID NO: 1247480 - DNA, 17 bp, Homo sapiens
accaaatcttgttattg

SEQ ID NO: 1247481 - DNA, 16 bp, Homo sapiens
accaaatgcctgttgt

SEQ ID NO: 1247482 - DNA, 19 bp, Homo sapiens
accaaatggttcttacttt

SEQ ID NO: 1247483 - DNA, 17 bp, Homo sapiens
accaaatgtagttttgt

SEQ ID NO: 1247484 - DNA, 15 bp, Homo sapiens
accaaattaaaaaaa

SEQ ID NO: 1247485 - DNA, 15 bp, Homo sapiens
accaaattatcttga

SEQ ID NO: 1247486 - DNA, 21 bp, Homo sapiens
accaaattctccctggacccc

SEQ ID NO: 1247487 - DNA, 13 bp, Homo sapiens
accaaattgcttc

SEQ ID NO: 1247488 - DNA, 13 bp, Homo sapiens
accaaattttaaa

SEQ ID NO: 1247489 - DNA, 13 bp, Homo sapiens
accacttcattct

SEQ ID NO: 1247490 - DNA, 14 bp, Homo sapiens
accacttccagagc

SEQ ID NO: 1247491 - DNA, 15 bp, Homo sapiens
accacttccagagcc

SEQ ID NO: 1247492 - DNA, 18 bp, Homo sapiens
accacttccagagccaga

SEQ ID NO: 1247493 - DNA, 20 bp, Homo sapiens
accacttccaggggaacctg

SEQ ID NO: 1247494 - DNA, 13 bp, Homo sapiens
accacttcgaaac

SEQ ID NO: 1247495 - DNA, 12 bp, Homo sapiens
accacttctctg

SEQ ID NO: 1247496 - DNA, 16 bp, Homo sapiens
accacttctctgctgc

SEQ ID NO: 1247497 - DNA, 19 bp, Homo sapiens
accacttctctgctgcctc

SEQ ID NO: 1247498 - DNA, 13 bp, Homo sapiens
accacttgcctgg

SEQ ID NO: 1247499 - DNA, 14 bp, Homo sapiens
accacttgcctggg

SEQ ID NO: 1247500 - DNA, 13 bp, Homo sapiens
accacttggaaat

SEQ ID NO: 1247501 - DNA, 16 bp, Homo sapiens
accacttttctgctgt

SEQ ID NO: 1247502 - DNA, 12 bp, Homo sapiens
accacttttgtt

SEQ ID NO: 1247503 - DNA, 22 bp, Homo sapiens
accacttttgttcttggtttgt

SEQ ID NO: 1247504 - DNA, 21 bp, Homo sapiens
accagaaacacccctctgtct

SEQ ID NO: 1247505 - DNA, 16 bp, Homo sapiens
accagaaattccagta

SEQ ID NO: 1247506 - DNA, 18 bp, Homo sapiens
accagaacagtatgaatt

SEQ ID NO: 1247507 - DNA, 13 bp, Homo sapiens
accagaagggaaa

SEQ ID NO: 1247508 - DNA, 14 bp, Homo sapiens
accagaagggcttc

SEQ ID NO: 1247509 - DNA, 16 bp, Homo sapiens
accagaagtgtttcag

SEQ ID NO: 1247510 - DNA, 18 bp, Homo sapiens
accagaagtgtttcagat

SEQ ID NO: 1247511 - DNA, 16 bp, Homo sapiens
accagaattcccttga

SEQ ID NO: 1247512 - DNA, 18 bp, Homo sapiens
accagaattcccttgaat

SEQ ID NO: 1247513 - DNA, 15 bp, Homo sapiens
accagacccacctgg

SEQ ID NO: 1247514 - DNA, 16 bp, Homo sapiens
accagacggggctgga

SEQ ID NO: 1247515 - DNA, 21 bp, Homo sapiens
accagacggggctggagtgtg

SEQ ID NO: 1247516 - DNA, 17 bp, Homo sapiens
accagacgtcaggccct

SEQ ID NO: 1247517 - DNA, 21 bp, Homo sapiens
accagactacttgggagcacc

SEQ ID NO: 1247518 - DNA, 23 bp, Homo sapiens
accagactacttgggagcaccgc

SEQ ID NO: 1247519 - DNA, 13 bp, Homo sapiens
accagagaatctt

SEQ ID NO: 1247520 - DNA, 23 bp, Homo sapiens
accagagacccaacagcagtgat

SEQ ID NO: 1247521 - DNA, 20 bp, Homo sapiens
accagagcaacctctcactc

SEQ ID NO: 1247522 - DNA, 13 bp, Homo sapiens
accagagccatgg

SEQ ID NO: 1247523 - DNA, 14 bp, Homo sapiens
accagagccatgga

SEQ ID NO: 1247524 - DNA, 17 bp, Homo sapiens
accagagccatggactc

SEQ ID NO: 1247525 - DNA, 23 bp, Homo sapiens
accagagccatggactctacact

SEQ ID NO: 1247526 - DNA, 21 bp, Homo sapiens
accagagcggtatctctggca

SEQ ID NO: 1247527 - DNA, 14 bp, Homo sapiens
accagaggctgcag

SEQ ID NO: 1247528 - DNA, 22 bp, Homo sapiens
accagaggctgcagaaggccaa

SEQ ID NO: 1247529 - DNA, 22 bp, Homo sapiens
accagagggtgtggctttccag

SEQ ID NO: 1247530 - DNA, 16 bp, Homo sapiens
accagaggtgcttctg

SEQ ID NO: 1247531 - DNA, 18 bp, Homo sapiens
accagataaatagaacta

SEQ ID NO: 1247532 - DNA, 20 bp, Homo sapiens
accagataagaatgctggtt

SEQ ID NO: 1247533 - DNA, 21 bp, Homo sapiens
accagatctgtctccaagacc

SEQ ID NO: 1247534 - DNA, 15 bp, Homo sapiens
accagatctttctct

SEQ ID NO: 1247535 - DNA, 19 bp, Homo sapiens
accagatctttctcttccc

SEQ ID NO: 1247536 - DNA, 20 bp, Homo sapiens
accagatggaacactggaac

SEQ ID NO: 1247537 - DNA, 19 bp, Homo sapiens
accagattgctctgcccca

SEQ ID NO: 1247538 - DNA, 23 bp, Homo sapiens
accagcaacttgtctttttctgg

SEQ ID NO: 1247539 - DNA, 23 bp, Homo sapiens
accagcaattctctttcttttac

SEQ ID NO: 1247540 - DNA, 13 bp, Homo sapiens
accagcaccttca

SEQ ID NO: 1247541 - DNA, 14 bp, Homo sapiens
accagcagaaatgc

SEQ ID NO: 1247542 - DNA, 20 bp, Homo sapiens
accagcagaaatgcccccat

SEQ ID NO: 1247543 - DNA, 22 bp, Homo sapiens
accagcagacagagccaggaga

SEQ ID NO: 1247544 - DNA, 13 bp, Homo sapiens
accagcagcacaa

SEQ ID NO: 1247545 - DNA, 13 bp, Homo sapiens
accagcagcctgg

SEQ ID NO: 1247546 - DNA, 18 bp, Homo sapiens
accagcaggtgtggtggc

SEQ ID NO: 1247547 - DNA, 21 bp, Homo sapiens
accagcatccacactgccggc

SEQ ID NO: 1247548 - DNA, 17 bp, Homo sapiens
accagcatctcagcgcc

SEQ ID NO: 1247549 - DNA, 23 bp, Homo sapiens
accagcattccctacagcctagg

SEQ ID NO: 1247550 - DNA, 15 bp, Homo sapiens
accagcattcctttt

SEQ ID NO: 1247551 - DNA, 17 bp, Homo sapiens
accagcattccttttga

SEQ ID NO: 1247552 - DNA, 17 bp, Homo sapiens
accagcatttgtccttt

SEQ ID NO: 1247553 - DNA, 20 bp, Homo sapiens
accagccacgaacagcccgc

SEQ ID NO: 1247554 - DNA, 15 bp, Homo sapiens
accagccagccctgg

SEQ ID NO: 1247555 - DNA, 16 bp, Homo sapiens
accagccagcctcaga

SEQ ID NO: 1247556 - DNA, 13 bp, Homo sapiens
accagccaggcag

SEQ ID NO: 1247557 - DNA, 14 bp, Homo sapiens
accagccaggcaga

SEQ ID NO: 1247558 - DNA, 17 bp, Homo sapiens
accagccatcctccctc

SEQ ID NO: 1247559 - DNA, 14 bp, Homo sapiens
accagcccagcctg

SEQ ID NO: 1247560 - DNA, 15 bp, Homo sapiens
accagcccagcctgc

SEQ ID NO: 1247561 - DNA, 16 bp, Homo sapiens
accagcccagcctgcc

SEQ ID NO: 1247562 - DNA, 21 bp, Homo sapiens
accagcccatcctgaggaaag

SEQ ID NO: 1247563 - DNA, 20 bp, Homo sapiens
accagcccattggccgagct

SEQ ID NO: 1247564 - DNA, 16 bp, Homo sapiens
accagccccactgcca

SEQ ID NO: 1247565 - DNA, 17 bp, Homo sapiens
accagccccactgccag

SEQ ID NO: 1247566 - DNA, 18 bp, Homo sapiens
accagccccactgccagc

SEQ ID NO: 1247567 - DNA, 13 bp, Homo sapiens
accagccccagca

SEQ ID NO: 1247568 - DNA, 13 bp, Homo sapiens
accagcccccagg

SEQ ID NO: 1247569 - DNA, 14 bp, Homo sapiens
accagcccccagga

SEQ ID NO: 1247570 - DNA, 19 bp, Homo sapiens
accagcccccgccccagag

SEQ ID NO: 1247571 - DNA, 23 bp, Homo sapiens
accagcccccgccccagagtggc

SEQ ID NO: 1247572 - DNA, 15 bp, Homo sapiens
accagccccctggat

SEQ ID NO: 1247573 - DNA, 19 bp, Homo sapiens
accagcccgacagtgccat

SEQ ID NO: 1247574 - DNA, 14 bp, Homo sapiens
accagcccggcctg

SEQ ID NO: 1247575 - DNA, 21 bp, Homo sapiens
accagcccggcctgctcccag

SEQ ID NO: 1247576 - DNA, 13 bp, Homo sapiens
accagccctactc

SEQ ID NO: 1247577 - DNA, 14 bp, Homo sapiens
accagccctagctg

SEQ ID NO: 1247578 - DNA, 13 bp, Homo sapiens
accagccctgcag

SEQ ID NO: 1247579 - DNA, 14 bp, Homo sapiens
accagccctgcagc

SEQ ID NO: 1247580 - DNA, 16 bp, Homo sapiens
accagccgtattttac

SEQ ID NO: 1247581 - DNA, 20 bp, Homo sapiens
accagcctggccaacatggt

SEQ ID NO: 1247582 - DNA, 13 bp, Homo sapiens
accagcctgtacc

SEQ ID NO: 1247583 - DNA, 18 bp, Homo sapiens
accagcctgtaccttgct

SEQ ID NO: 1247584 - DNA, 18 bp, Homo sapiens
accagcctgtcacccagc

SEQ ID NO: 1247585 - DNA, 19 bp, Homo sapiens
accagcctttgggtcctgg

SEQ ID NO: 1247586 - DNA, 23 bp, Homo sapiens
accagcctttgggtcctgggcag

SEQ ID NO: 1247587 - DNA, 20 bp, Homo sapiens
accagcgccaaatgttcatc

SEQ ID NO: 1247588 - DNA, 14 bp, Homo sapiens
accagcgcccgctg

SEQ ID NO: 1247589 - DNA, 18 bp, Homo sapiens
accagcgcccgctgggct

SEQ ID NO: 1247590 - DNA, 19 bp, Homo sapiens
accagcgcccgctgggctg

SEQ ID NO: 1247591 - DNA, 14 bp, Homo sapiens
accagcggaaacag

SEQ ID NO: 1247592 - DNA, 17 bp, Homo sapiens
accagcggaaacaggtg

SEQ ID NO: 1247593 - DNA, 18 bp, Homo sapiens
accagcgttcccttctcc

SEQ ID NO: 1247594 - DNA, 19 bp, Homo sapiens
accagcgttcccttctccc

SEQ ID NO: 1247595 - DNA, 22 bp, Homo sapiens
accagcgttgggtttgctcatg

SEQ ID NO: 1247596 - DNA, 17 bp, Homo sapiens
accagctatctgtcatc

SEQ ID NO: 1247597 - DNA, 21 bp, Homo sapiens
accagctatctgtcatctctc

SEQ ID NO: 1247598 - DNA, 23 bp, Homo sapiens
accagctatctgtcatctctctg

SEQ ID NO: 1247599 - DNA, 22 bp, Homo sapiens
accagctcaggggacactggcc

SEQ ID NO: 1247600 - DNA, 14 bp, Homo sapiens
accagctccacaca

SEQ ID NO: 1247601 - DNA, 15 bp, Homo sapiens
accagctccacacat

SEQ ID NO: 1247602 - DNA, 21 bp, Homo sapiens
accagctccacacattccagc

SEQ ID NO: 1247603 - DNA, 15 bp, Homo sapiens
accagctcccagggt

SEQ ID NO: 1247604 - DNA, 13 bp, Homo sapiens
accagctcctcca

SEQ ID NO: 1247605 - DNA, 15 bp, Homo sapiens
accagctcctccagc

SEQ ID NO: 1247606 - DNA, 18 bp, Homo sapiens
accagctcctccagccct

SEQ ID NO: 1247607 - DNA, 19 bp, Homo sapiens
accagctcctccagccctg

SEQ ID NO: 1247608 - DNA, 13 bp, Homo sapiens
accagctcctccc

SEQ ID NO: 1247609 - DNA, 20 bp, Homo sapiens
accagctcgtgggctgggaa

SEQ ID NO: 1247610 - DNA, 22 bp, Homo sapiens
accagctctgccgtctctggag

SEQ ID NO: 1247611 - DNA, 13 bp, Homo sapiens
acccaggggtggg

SEQ ID NO: 1247612 - DNA, 22 bp, Homo sapiens
acccaggtcccccgactgcctg

SEQ ID NO: 1247613 - DNA, 16 bp, Homo sapiens
acccaggtctcttcct

SEQ ID NO: 1247614 - DNA, 21 bp, Homo sapiens
acccaggtgatttcctctaaa

SEQ ID NO: 1247615 - DNA, 20 bp, Homo sapiens
acccagtagctgcccttcct

SEQ ID NO: 1247616 - DNA, 18 bp, Homo sapiens
acccagtattactgctgc

SEQ ID NO: 1247617 - DNA, 20 bp, Homo sapiens
acccagtattactgctgctg

SEQ ID NO: 1247618 - DNA, 13 bp, Homo sapiens
acccagtccctgg

SEQ ID NO: 1247619 - DNA, 15 bp, Homo sapiens
acccagtccctgggg

SEQ ID NO: 1247620 - DNA, 15 bp, Homo sapiens
acccagtctcagaca

SEQ ID NO: 1247621 - DNA, 18 bp, Homo sapiens
acccagtctcctctccat

SEQ ID NO: 1247622 - DNA, 14 bp, Homo sapiens
acccagtgctgcca

SEQ ID NO: 1247623 - DNA, 16 bp, Homo sapiens
acccagtgctgccatg

SEQ ID NO: 1247624 - DNA, 21 bp, Homo sapiens
acccagtggaattccaacttg

SEQ ID NO: 1247625 - DNA, 15 bp, Homo sapiens
acccagtgggacaga

SEQ ID NO: 1247626 - DNA, 18 bp, Homo sapiens
acccagtgggtctgggat

SEQ ID NO: 1247627 - DNA, 13 bp, Homo sapiens
acccagttacttt

SEQ ID NO: 1247628 - DNA, 14 bp, Homo sapiens
acccatacaatgta

SEQ ID NO: 1247629 - DNA, 18 bp, Homo sapiens
acccatacaatgtatgta

SEQ ID NO: 1247630 - DNA, 21 bp, Homo sapiens
acccatacaatgtatgtacaa

SEQ ID NO: 1247631 - DNA, 17 bp, Homo sapiens
acccatacctttccagg

SEQ ID NO: 1247632 - DNA, 17 bp, Homo sapiens
acccatagatcttctga

SEQ ID NO: 1247633 - DNA, 22 bp, Homo sapiens
acccatagatcttctgaaatga

SEQ ID NO: 1247634 - DNA, 16 bp, Homo sapiens
acccatattgtaaaac

SEQ ID NO: 1247635 - DNA, 22 bp, Homo sapiens
acccatattttccccctgtttt

SEQ ID NO: 1247636 - DNA, 14 bp, Homo sapiens
acccatcagaagga

SEQ ID NO: 1247637 - DNA, 14 bp, Homo sapiens
acccatccagtgga

SEQ ID NO: 1247638 - DNA, 21 bp, Homo sapiens
acccatcccttttcctttctg

SEQ ID NO: 1247639 - DNA, 21 bp, Homo sapiens
acccatcctaccaatgcatgc

SEQ ID NO: 1247640 - DNA, 17 bp, Homo sapiens
acccatcgctgtgtgtt

SEQ ID NO: 1247641 - DNA, 18 bp, Homo sapiens
acccatcttcctgctgct

SEQ ID NO: 1247642 - DNA, 20 bp, Homo sapiens
acccatgaagacaggacagt

SEQ ID NO: 1247643 - DNA, 16 bp, Homo sapiens
acccatgagcctgccc

SEQ ID NO: 1247644 - DNA, 13 bp, Homo sapiens
acccatgaggcaa

SEQ ID NO: 1247645 - DNA, 20 bp, Homo sapiens
acccatgagttggggtctgg

SEQ ID NO: 1247646 - DNA, 17 bp, Homo sapiens
acccatgggggctgtct

SEQ ID NO: 1247647 - DNA, 18 bp, Homo sapiens
acccatgggggctgtctt

SEQ ID NO: 1247648 - DNA, 21 bp, Homo sapiens
acccatgtgctgggaaatgca

SEQ ID NO: 1247649 - DNA, 16 bp, Homo sapiens
acccatgtgttaaaat

SEQ ID NO: 1247650 - DNA, 20 bp, Homo sapiens
acccatgtgttaaaatactc

SEQ ID NO: 1247651 - DNA, 21 bp, Homo sapiens
acccattcagagactgtccct

SEQ ID NO: 1247652 - DNA, 23 bp, Homo sapiens
acccattcccccatgtggctgaa

SEQ ID NO: 1247653 - DNA, 18 bp, Homo sapiens
acccattgttgtcaagga

SEQ ID NO: 1247654 - DNA, 22 bp, Homo sapiens
acccattgttgtcaaggaagaa

SEQ ID NO: 1247655 - DNA, 23 bp, Homo sapiens
acccattgttgtcaaggaagaag

SEQ ID NO: 1247656 - DNA, 20 bp, Homo sapiens
acccattttgagtgactcga

SEQ ID NO: 1247657 - DNA, 14 bp, Homo sapiens
accccaaagagcct

SEQ ID NO: 1247658 - DNA, 15 bp, Homo sapiens
accccaaagagcctg

SEQ ID NO: 1247659 - DNA, 21 bp, Homo sapiens
accccaaagagcctggagaag

SEQ ID NO: 1247660 - DNA, 15 bp, Homo sapiens
accccaaagcccctt

SEQ ID NO: 1247661 - DNA, 17 bp, Homo sapiens
accccaaagctttcctg

SEQ ID NO: 1247662 - DNA, 17 bp, Homo sapiens
accccaactctccccag

SEQ ID NO: 1247663 - DNA, 20 bp, Homo sapiens
accccaactctccccagtgc

SEQ ID NO: 1247664 - DNA, 19 bp, Homo sapiens
accccaacttggcagcttt

SEQ ID NO: 1247665 - DNA, 18 bp, Homo sapiens
accccaagagaactcgcg

SEQ ID NO: 1247666 - DNA, 16 bp, Homo sapiens
accccaagaggaagtt

SEQ ID NO: 1247667 - DNA, 21 bp, Homo sapiens
accccaaggactgagggcagt

SEQ ID NO: 1247668 - DNA, 19 bp, Homo sapiens
accccaatccctgccactg

SEQ ID NO: 1247669 - DNA, 20 bp, Homo sapiens
accccacaccccagcccacc

SEQ ID NO: 1247670 - DNA, 17 bp, Homo sapiens
accccacatccttctca

SEQ ID NO: 1247671 - DNA, 11 bp, Homo sapiens
accccacccaa

SEQ ID NO: 1247672 - DNA, 12 bp, Homo sapiens
accccacccagc

SEQ ID NO: 1247673 - DNA, 15 bp, Homo sapiens
accccacccagctcc

SEQ ID NO: 1247674 - DNA, 14 bp, Homo sapiens
accccaccccaccc

SEQ ID NO: 1247675 - DNA, 21 bp, Homo sapiens
accccaccctagtttccctga

SEQ ID NO: 1247676 - DNA, 13 bp, Homo sapiens
accccacccttcc

SEQ ID NO: 1247677 - DNA, 16 bp, Homo sapiens
accccactcccctcac

SEQ ID NO: 1247678 - DNA, 18 bp, Homo sapiens
accccactcccctcacac

SEQ ID NO: 1247679 - DNA, 14 bp, Homo sapiens
accccactgggaga

SEQ ID NO: 1247680 - DNA, 23 bp, Homo sapiens
accccacttatgctgctgtgaat

SEQ ID NO: 1247681 - DNA, 22 bp, Homo sapiens
accccacttcccatctccaggg

SEQ ID NO: 1247682 - DNA, 19 bp, Homo sapiens
accccagaaatcactgtga

SEQ ID NO: 1247683 - DNA, 20 bp, Homo sapiens
accccagaaatcactgtgaa

SEQ ID NO: 1247684 - DNA, 21 bp, Homo sapiens
accccagaaatcactgtgaaa

SEQ ID NO: 1247685 - DNA, 18 bp, Homo sapiens
accccagaggacacaggc

SEQ ID NO: 1247686 - DNA, 19 bp, Homo sapiens
accccagagtgggagaggc

SEQ ID NO: 1247687 - DNA, 21 bp, Homo sapiens
accccagagtgggagaggctg

SEQ ID NO: 1247688 - DNA, 12 bp, Homo sapiens
accccagcacag

SEQ ID NO: 1247689 - DNA, 17 bp, Homo sapiens
accccagcacagccacc

SEQ ID NO: 1247690 - DNA, 20 bp, Homo sapiens
accccagcacagccacctcc

SEQ ID NO: 1247691 - DNA, 13 bp, Homo sapiens
accccagcatcct

SEQ ID NO: 1247692 - DNA, 17 bp, Homo sapiens
accccagcattccagct

SEQ ID NO: 1247693 - DNA, 19 bp, Homo sapiens
accccagcattccagctct

SEQ ID NO: 1247694 - DNA, 16 bp, Homo sapiens
accccagcccaccctg

SEQ ID NO: 1247695 - DNA, 12 bp, Homo sapiens
accccagcctaa

SEQ ID NO: 1247696 - DNA, 19 bp, Homo sapiens
accccagcctgacctgaga

SEQ ID NO: 1247697 - DNA, 12 bp, Homo sapiens
accccagctccg

SEQ ID NO: 1247698 - DNA, 13 bp, Homo sapiens
accccagctggga

SEQ ID NO: 1247699 - DNA, 11 bp, Homo sapiens
accccaggacg

SEQ ID NO: 1247700 - DNA, 20 bp, Homo sapiens
accccaggacgccactcatt

SEQ ID NO: 1247701 - DNA, 21 bp, Homo sapiens
accccaggacgccactcattt

SEQ ID NO: 1247702 - DNA, 20 bp, Homo sapiens
accccaggctgaagcaggtt

SEQ ID NO: 1247703 - DNA, 16 bp, Homo sapiens
accccagggcctgtct

SEQ ID NO: 1247704 - DNA, 18 bp, Homo sapiens
accccagggcctgtctcc

SEQ ID NO: 1247705 - DNA, 21 bp, Homo sapiens
accccagggcctgtctccctt

SEQ ID NO: 1247706 - DNA, 20 bp, Homo sapiens
accccagtgcggacccttcc

SEQ ID NO: 1247707 - DNA, 16 bp, Homo sapiens
accccagtgggaactg

SEQ ID NO: 1247708 - DNA, 15 bp, Homo sapiens
accccagttctaggg

SEQ ID NO: 1247709 - DNA, 15 bp, Homo sapiens
accccagttctgctc

SEQ ID NO: 1247710 - DNA, 17 bp, Homo sapiens
accccataataaccctg

SEQ ID NO: 1247711 - DNA, 17 bp, Homo sapiens
accccataccccttatt

SEQ ID NO: 1247712 - DNA, 18 bp, Homo sapiens
accccataccccttattg

SEQ ID NO: 1247713 - DNA, 23 bp, Homo sapiens
accccataccccttattgctgcc

SEQ ID NO: 1247714 - DNA, 21 bp, Homo sapiens
accccatcactcgcaggacca

SEQ ID NO: 1247715 - DNA, 18 bp, Homo sapiens
accccatccctccttaag

SEQ ID NO: 1247716 - DNA, 16 bp, Homo sapiens
accccatctgtgaata

SEQ ID NO: 1247717 - DNA, 14 bp, Homo sapiens
accccatgcacctc

SEQ ID NO: 1247718 - DNA, 18 bp, Homo sapiens
accccatgcacctcaggg

SEQ ID NO: 1247719 - DNA, 20 bp, Homo sapiens
acccccaaaatccaaaactt

SEQ ID NO: 1247720 - DNA, 18 bp, Homo sapiens
acccccaaatactctgaa

SEQ ID NO: 1247721 - DNA, 16 bp, Homo sapiens
acccccaacccccaga

SEQ ID NO: 1247722 - DNA, 21 bp, Homo sapiens
acccccaatatttttggactg

SEQ ID NO: 1247723 - DNA, 17 bp, Homo sapiens
acccccacacctcagtt

SEQ ID NO: 1247724 - DNA, 13 bp, Homo sapiens
acccccacagacc

SEQ ID NO: 1247725 - DNA, 21 bp, Homo sapiens
acccccaccatgcagcccctg

SEQ ID NO: 1247726 - DNA, 13 bp, Homo sapiens
acccccacccacc

SEQ ID NO: 1247727 - DNA, 14 bp, Homo sapiens
acccccacccacct

SEQ ID NO: 1247728 - DNA, 12 bp, Homo sapiens
acccccacccca

SEQ ID NO: 1247729 - DNA, 14 bp, Homo sapiens
acccccaccccaca

SEQ ID NO: 1247730 - DNA, 17 bp, Homo sapiens
acccccaccccacactt

SEQ ID NO: 1247731 - DNA, 19 bp, Homo sapiens
acccccacccccagctcaa

SEQ ID NO: 1247732 - DNA, 14 bp, Homo sapiens
acccccaccccttc

SEQ ID NO: 1247733 - DNA, 18 bp, Homo sapiens
acccctgcctgttggcag

SEQ ID NO: 1247734 - DNA, 23 bp, Homo sapiens
acccctgcctgttggcaggccca

SEQ ID NO: 1247735 - DNA, 12 bp, Homo sapiens
acccctgccttc

SEQ ID NO: 1247736 - DNA, 13 bp, Homo sapiens
acccctgccttcc

SEQ ID NO: 1247737 - DNA, 18 bp, Homo sapiens
acccctgccttcctctga

SEQ ID NO: 1247738 - DNA, 22 bp, Homo sapiens
acccctgctcccattcctccct

SEQ ID NO: 1247739 - DNA, 12 bp, Homo sapiens
acccctggaaga

SEQ ID NO: 1247740 - DNA, 18 bp, Homo sapiens
acccctggaagagcccag

SEQ ID NO: 1247741 - DNA, 15 bp, Homo sapiens
acccctggccagctc

SEQ ID NO: 1247742 - DNA, 17 bp, Homo sapiens
acccctggccagctctg

SEQ ID NO: 1247743 - DNA, 19 bp, Homo sapiens
acccctggccagctctgag

SEQ ID NO: 1247744 - DNA, 15 bp, Homo sapiens
acccctggctgtact

SEQ ID NO: 1247745 - DNA, 12 bp, Homo sapiens
acccctggcttt

SEQ ID NO: 1247746 - DNA, 15 bp, Homo sapiens
acccctgggggctct

SEQ ID NO: 1247747 - DNA, 17 bp, Homo sapiens
acccctgtacccagctc

SEQ ID NO: 1247748 - DNA, 15 bp, Homo sapiens
acccctgtaggcctc

SEQ ID NO: 1247749 - DNA, 22 bp, Homo sapiens
acccctgtcccatgcaggccct

SEQ ID NO: 1247750 - DNA, 17 bp, Homo sapiens
acccctgtgctcccctg

SEQ ID NO: 1247751 - DNA, 21 bp, Homo sapiens
acccctgtgctccgtgcctcc

SEQ ID NO: 1247752 - DNA, 18 bp, Homo sapiens
acccctgtggagcccgca

SEQ ID NO: 1247753 - DNA, 19 bp, Homo sapiens
acccctgtggagcccgcac

SEQ ID NO: 1247754 - DNA, 10 bp, Homo sapiens
acccctgtgt

SEQ ID NO: 1247755 - DNA, 17 bp, Homo sapiens
accccttaatcttgctt

SEQ ID NO: 1247756 - DNA, 17 bp, Homo sapiens
accccttagcctccctg

SEQ ID NO: 1247757 - DNA, 18 bp, Homo sapiens
accccttagcctccctga

SEQ ID NO: 1247758 - DNA, 15 bp, Homo sapiens
accccttatccagga

SEQ ID NO: 1247759 - DNA, 16 bp, Homo sapiens
accccttatccaggac

SEQ ID NO: 1247760 - DNA, 17 bp, Homo sapiens
accccttattgctgcca

SEQ ID NO: 1247761 - DNA, 18 bp, Homo sapiens
accccttattgctgccaa

SEQ ID NO: 1247762 - DNA, 20 bp, Homo sapiens
accccttattgctgccaaaa

SEQ ID NO: 1247763 - DNA, 22 bp, Homo sapiens
accccttcataccgcctcgtgc

SEQ ID NO: 1247764 - DNA, 13 bp, Homo sapiens
accccttccagat

SEQ ID NO: 1247765 - DNA, 16 bp, Homo sapiens
accccttccagatcac

SEQ ID NO: 1247766 - DNA, 21 bp, Homo sapiens
accccttccagatcactgcca

SEQ ID NO: 1247767 - DNA, 13 bp, Homo sapiens
accccttcccacg

SEQ ID NO: 1247768 - DNA, 13 bp, Homo sapiens
accccttccccag

SEQ ID NO: 1247769 - DNA, 15 bp, Homo sapiens
accccttccccaggc

SEQ ID NO: 1247770 - DNA, 20 bp, Homo sapiens
accccttccccaggcccacc

SEQ ID NO: 1247771 - DNA, 19 bp, Homo sapiens
accccttcctgtcctgcct

SEQ ID NO: 1247772 - DNA, 23 bp, Homo sapiens
accccttcctgtcctgcctcctc

SEQ ID NO: 1247773 - DNA, 11 bp, Homo sapiens
accccttcctt

SEQ ID NO: 1247774 - DNA, 12 bp, Homo sapiens
accccttccttt

SEQ ID NO: 1247775 - DNA, 16 bp, Homo sapiens
accccttcctttcctc

SEQ ID NO: 1247776 - DNA, 14 bp, Homo sapiens
accccttctctctc

SEQ ID NO: 1247777 - DNA, 16 bp, Homo sapiens
accccttctctctcca

SEQ ID NO: 1247778 - DNA, 16 bp, Homo sapiens
accccttgctcccttc

SEQ ID NO: 1247779 - DNA, 13 bp, Homo sapiens
accccttggcccc

SEQ ID NO: 1247780 - DNA, 19 bp, Homo sapiens
accccttggcccctcacat

SEQ ID NO: 1247781 - DNA, 16 bp, Homo sapiens
accccttgttgcactg

SEQ ID NO: 1247782 - DNA, 18 bp, Homo sapiens
accccttgttgcactgcc

SEQ ID NO: 1247783 - DNA, 12 bp, Homo sapiens
acccctttcctc

SEQ ID NO: 1247784 - DNA, 20 bp, Homo sapiens
acccctttcttctcgggcca

SEQ ID NO: 1247785 - DNA, 20 bp, Homo sapiens
accccttttccagttgctgt

SEQ ID NO: 1247786 - DNA, 16 bp, Homo sapiens
acccgaagtcctgtca

SEQ ID NO: 1247787 - DNA, 19 bp, Homo sapiens
acccgagcccagctacatt

SEQ ID NO: 1247788 - DNA, 23 bp, Homo sapiens
acccgagcccagctacattcctc

SEQ ID NO: 1247789 - DNA, 23 bp, Homo sapiens
acccgattccaccaaatgtgctt

SEQ ID NO: 1247790 - DNA, 15 bp, Homo sapiens
acccgcccctggact

SEQ ID NO: 1247791 - DNA, 22 bp, Homo sapiens
acccgccgccactaggtgtccc

SEQ ID NO: 1247792 - DNA, 13 bp, Homo sapiens
acccgcctctccc

SEQ ID NO: 1247793 - DNA, 24 bp, Homo sapiens
acccgcctctcccgtcagggccca

SEQ ID NO: 1247794 - DNA, 13 bp, Homo sapiens
acccgcctgacac

SEQ ID NO: 1247795 - DNA, 14 bp, Homo sapiens
acccgcctgctccc

SEQ ID NO: 1247796 - DNA, 15 bp, Homo sapiens
acccgctgcccctcc

SEQ ID NO: 1247797 - DNA, 19 bp, Homo sapiens
acccgctggagcccacagc

SEQ ID NO: 1247798 - DNA, 15 bp, Homo sapiens
acccggaggggcctg

SEQ ID NO: 1247799 - DNA, 20 bp, Homo sapiens
acccggcccaacccagccca

SEQ ID NO: 1247800 - DNA, 14 bp, Homo sapiens
acccggctgcagag

SEQ ID NO: 1247801 - DNA, 21 bp, Homo sapiens
acccgggaccaaactcacgga

SEQ ID NO: 1247802 - DNA, 19 bp, Homo sapiens
acccgggctgcctgcccct

SEQ ID NO: 1247803 - DNA, 18 bp, Homo sapiens
acccggggccagagacat

SEQ ID NO: 1247804 - DNA, 16 bp, Homo sapiens
acccggggtctcctgg

SEQ ID NO: 1247805 - DNA, 17 bp, Homo sapiens
acccggtgctccctctg

SEQ ID NO: 1247806 - DNA, 23 bp, Homo sapiens
acccgtaggcagcctctctgcta

SEQ ID NO: 1247807 - DNA, 22 bp, Homo sapiens
acccgtccattcttcagtgtct

SEQ ID NO: 1247808 - DNA, 15 bp, Homo sapiens
acccgtcctccctca

SEQ ID NO: 1247809 - DNA, 18 bp, Homo sapiens
acccgtcctccctcagcc

SEQ ID NO: 1247810 - DNA, 21 bp, Homo sapiens
acccgtcctccctcagcctcc

SEQ ID NO: 1247811 - DNA, 19 bp, Homo sapiens
acccgtcttcaatctctgt

SEQ ID NO: 1247812 - DNA, 15 bp, Homo sapiens
acccgtgaatgtgcc

SEQ ID NO: 1247813 - DNA, 17 bp, Homo sapiens
acccgtgacagtggctg

SEQ ID NO: 1247814 - DNA, 15 bp, Homo sapiens
acccgtgcctgggcc

SEQ ID NO: 1247815 - DNA, 17 bp, Homo sapiens
acccgtggggtgctgcc

SEQ ID NO: 1247816 - DNA, 23 bp, Homo sapiens
acccgtttcccggttcaggacca

SEQ ID NO: 1247817 - DNA, 14 bp, Homo sapiens
acccgttttatgat

SEQ ID NO: 1247818 - DNA, 21 bp, Homo sapiens
acccgttttatgatttactca

SEQ ID NO: 1247819 - DNA, 22 bp, Homo sapiens
acccgttttatgatttactcat

SEQ ID NO: 1247820 - DNA, 20 bp, Homo sapiens
accctaaagcaaatctgcca

SEQ ID NO: 1247821 - DNA, 16 bp, Homo sapiens
accctaagggcagccc

SEQ ID NO: 1247822 - DNA, 17 bp, Homo sapiens
accctaagggcagccct

SEQ ID NO: 1247823 - DNA, 21 bp, Homo sapiens
accctaagggcagccctccat

SEQ ID NO: 1247824 - DNA, 17 bp, Homo sapiens
accctaattaatagaat

SEQ ID NO: 1247825 - DNA, 16 bp, Homo sapiens
accctacataaggctg

SEQ ID NO: 1247826 - DNA, 13 bp, Homo sapiens
accctaccagctc

SEQ ID NO: 1247827 - DNA, 18 bp, Homo sapiens
accctaccagctcctcca

SEQ ID NO: 1247828 - DNA, 21 bp, Homo sapiens
accctaccagctcctccagcc

SEQ ID NO: 1247829 - DNA, 17 bp, Homo sapiens
accctacctgtgcctga

SEQ ID NO: 1247830 - DNA, 13 bp, Homo sapiens
accctacctgttc

SEQ ID NO: 1247831 - DNA, 22 bp, Homo sapiens
accctacgctcatctctggaag

SEQ ID NO: 1247832 - DNA, 19 bp, Homo sapiens
accctactttgcttccgcc

SEQ ID NO: 1247833 - DNA, 23 bp, Homo sapiens
accctagaaggtggggacctggg

SEQ ID NO: 1247834 - DNA, 13 bp, Homo sapiens
accctagcaaaag

SEQ ID NO: 1247835 - DNA, 16 bp, Homo sapiens
accctagccattcctg

SEQ ID NO: 1247836 - DNA, 17 bp, Homo sapiens
accctagccattcctgg

SEQ ID NO: 1247837 - DNA, 12 bp, Homo sapiens
accctagccttg

SEQ ID NO: 1247838 - DNA, 17 bp, Homo sapiens
accctagccttgcttgt

SEQ ID NO: 1247839 - DNA, 15 bp, Homo sapiens
accctagctgtgtca

SEQ ID NO: 1247840 - DNA, 21 bp, Homo sapiens
accctagttagtgttttgcct

SEQ ID NO: 1247841 - DNA, 21 bp, Homo sapiens
accctagttctacctcaggca

SEQ ID NO: 1247842 - DNA, 23 bp, Homo sapiens
accctatatataatttgagtgta

SEQ ID NO: 1247843 - DNA, 15 bp, Homo sapiens
accctatctcctgac

SEQ ID NO: 1247844 - DNA, 18 bp, Homo sapiens
accctatctcctgacaga

SEQ ID NO: 1247845 - DNA, 22 bp, Homo sapiens
accctatggggaggccctgcct

SEQ ID NO: 1247846 - DNA, 19 bp, Homo sapiens
accctcaaatgtcagagct

SEQ ID NO: 1247847 - DNA, 18 bp, Homo sapiens
accctcacacacacagct

SEQ ID NO: 1247848 - DNA, 21 bp, Homo sapiens
accctcacccactctggtggc

SEQ ID NO: 1247849 - DNA, 20 bp, Homo sapiens
accctcaccccctcctggca

SEQ ID NO: 1247850 - DNA, 17 bp, Homo sapiens
accctcactgctgggga

SEQ ID NO: 1247851 - DNA, 15 bp, Homo sapiens
accctcactggctct

SEQ ID NO: 1247852 - DNA, 19 bp, Homo sapiens
accctcactggctctcctg

SEQ ID NO: 1247853 - DNA, 14 bp, Homo sapiens
accctcagcacccc

SEQ ID NO: 1247854 - DNA, 16 bp, Homo sapiens
accctcagcacccctt

SEQ ID NO: 1247855 - DNA, 18 bp, Homo sapiens
acctaacattatttattc

SEQ ID NO: 1247856 - DNA, 12 bp, Homo sapiens
acctaacattcg

SEQ ID NO: 1247857 - DNA, 19 bp, Homo sapiens
acctaacgccctatttttg

SEQ ID NO: 1247858 - DNA, 16 bp, Homo sapiens
acctaagcacttctag

SEQ ID NO: 1247859 - DNA, 18 bp, Homo sapiens
acctaagcacttctagaa

SEQ ID NO: 1247860 - DNA, 18 bp, Homo sapiens
acctaagccctgccccgg

SEQ ID NO: 1247861 - DNA, 15 bp, Homo sapiens
acctaagtgttgatt

SEQ ID NO: 1247862 - DNA, 20 bp, Homo sapiens
acctaagtttcagttgattt

SEQ ID NO: 1247863 - DNA, 17 bp, Homo sapiens
acctaatctctgtaaag

SEQ ID NO: 1247864 - DNA, 17 bp, Homo sapiens
acctaatgctggcctga

SEQ ID NO: 1247865 - DNA, 21 bp, Homo sapiens
acctaatgtctcactgttctg

SEQ ID NO: 1247866 - DNA, 20 bp, Homo sapiens
acctacacacataccttcat

SEQ ID NO: 1247867 - DNA, 20 bp, Homo sapiens
acctacacacgtaccttcat

SEQ ID NO: 1247868 - DNA, 16 bp, Homo sapiens
acctacacactgtcat

SEQ ID NO: 1247869 - DNA, 22 bp, Homo sapiens
acctacaccattatcttggaaa

SEQ ID NO: 1247870 - DNA, 18 bp, Homo sapiens
acctacacccctgtgctc

SEQ ID NO: 1247871 - DNA, 16 bp, Homo sapiens
acctacagactaagaa

SEQ ID NO: 1247872 - DNA, 15 bp, Homo sapiens
acctacagtgtacag

SEQ ID NO: 1247873 - DNA, 16 bp, Homo sapiens
acctacagtgtacagt

SEQ ID NO: 1247874 - DNA, 18 bp, Homo sapiens
acctacagttttaactgt

SEQ ID NO: 1247875 - DNA, 19 bp, Homo sapiens
acctacagttttaactgtg

SEQ ID NO: 1247876 - DNA, 23 bp, Homo sapiens
acctacatatgctgatcttttaa

SEQ ID NO: 1247877 - DNA, 21 bp, Homo sapiens
acctacatgctgaaaaatata

SEQ ID NO: 1247878 - DNA, 14 bp, Homo sapiens
acctaccaaaaaat

SEQ ID NO: 1247879 - DNA, 15 bp, Homo sapiens
acctaccacagtgtc

SEQ ID NO: 1247880 - DNA, 16 bp, Homo sapiens
acctaccacagtgtct

SEQ ID NO: 1247881 - DNA, 17 bp, Homo sapiens
acctaccacagtgtctg

SEQ ID NO: 1247882 - DNA, 21 bp, Homo sapiens
acctaccaccccttcctgtcc

SEQ ID NO: 1247883 - DNA, 14 bp, Homo sapiens
acctaccatcaggg

SEQ ID NO: 1247884 - DNA, 16 bp, Homo sapiens
acctaccatgctgctt

SEQ ID NO: 1247885 - DNA, 18 bp, Homo sapiens
acctaccttcatttcagg

SEQ ID NO: 1247886 - DNA, 17 bp, Homo sapiens
acctactatgtgctggg

SEQ ID NO: 1247887 - DNA, 11 bp, Homo sapiens
acctactgagt

SEQ ID NO: 1247888 - DNA, 13 bp, Homo sapiens
acctactgcccac

SEQ ID NO: 1247889 - DNA, 22 bp, Homo sapiens
acctactgcccacatttgggct

SEQ ID NO: 1247890 - DNA, 20 bp, Homo sapiens
acctactttgactttttgca

SEQ ID NO: 1247891 - DNA, 13 bp, Homo sapiens
acctagaaatcta

SEQ ID NO: 1247892 - DNA, 20 bp, Homo sapiens
acctagaagcttaacactat

SEQ ID NO: 1247893 - DNA, 21 bp, Homo sapiens
acctagattatagtcttagta

SEQ ID NO: 1247894 - DNA, 12 bp, Homo sapiens
acctagattttt

SEQ ID NO: 1247895 - DNA, 22 bp, Homo sapiens
acctagcaacatatctctgccg

SEQ ID NO: 1247896 - DNA, 21 bp, Homo sapiens
acctagcagcaccgttctgtg

SEQ ID NO: 1247897 - DNA, 14 bp, Homo sapiens
acctagcagcctca

SEQ ID NO: 1247898 - DNA, 15 bp, Homo sapiens
acctagcagcctcaa

SEQ ID NO: 1247899 - DNA, 14 bp, Homo sapiens
acctagcaggctgt

SEQ ID NO: 1247900 - DNA, 12 bp, Homo sapiens
acctagcctgga

SEQ ID NO: 1247901 - DNA, 16 bp, Homo sapiens
acctagctaattattt

SEQ ID NO: 1247902 - DNA, 18 bp, Homo sapiens
acctagctggctctgtga

SEQ ID NO: 1247903 - DNA, 19 bp, Homo sapiens
acctagctggtagcataaa

SEQ ID NO: 1247904 - DNA, 15 bp, Homo sapiens
acctagctgttgtaa

SEQ ID NO: 1247905 - DNA, 19 bp, Homo sapiens
acctagctgttgtaaagaa

SEQ ID NO: 1247906 - DNA, 20 bp, Homo sapiens
acctagcttgaggcaatttt

SEQ ID NO: 1247907 - DNA, 17 bp, Homo sapiens
acctagcttttaaaaaa

SEQ ID NO: 1247908 - DNA, 22 bp, Homo sapiens
acctagggggacggggctgaca

SEQ ID NO: 1247909 - DNA, 20 bp, Homo sapiens
acctagtactctctgctcta

SEQ ID NO: 1247910 - DNA, 23 bp, Homo sapiens
acctagtactctctgctctagcc

SEQ ID NO: 1247911 - DNA, 17 bp, Homo sapiens
acctataagaagcctta

SEQ ID NO: 1247912 - DNA, 15 bp, Homo sapiens
acctatactgaaaga

SEQ ID NO: 1247913 - DNA, 20 bp, Homo sapiens
acctatactgaaagatctct

SEQ ID NO: 1247914 - DNA, 13 bp, Homo sapiens
acctatagaaata

SEQ ID NO: 1247915 - DNA, 14 bp, Homo sapiens
acctataggaaagt

SEQ ID NO: 1247916 - DNA, 15 bp, Homo sapiens
acctatagtcccagc

SEQ ID NO: 1247917 - DNA, 16 bp, Homo sapiens
acctatagtcccagct

SEQ ID NO: 1247918 - DNA, 13 bp, Homo sapiens
acctatatgattt

SEQ ID NO: 1247919 - DNA, 17 bp, Homo sapiens
acctatctcagccatag

SEQ ID NO: 1247920 - DNA, 13 bp, Homo sapiens
acctatctcaggg

SEQ ID NO: 1247921 - DNA, 14 bp, Homo sapiens
acctatctcaggga

SEQ ID NO: 1247922 - DNA, 16 bp, Homo sapiens
acctatctcagggagg

SEQ ID NO: 1247923 - DNA, 17 bp, Homo sapiens
acctatctcagggaggg

SEQ ID NO: 1247924 - DNA, 18 bp, Homo sapiens
acctatctcgtgggagag

SEQ ID NO: 1247925 - DNA, 17 bp, Homo sapiens
acctatctgtggaaagc

SEQ ID NO: 1247926 - DNA, 16 bp, Homo sapiens
acctatgcagggaggc

SEQ ID NO: 1247927 - DNA, 13 bp, Homo sapiens
acctatgcctgtg

SEQ ID NO: 1247928 - DNA, 21 bp, Homo sapiens
acctatgcctgtggtgaagtg

SEQ ID NO: 1247929 - DNA, 21 bp, Homo sapiens
acctatgttattttgtgtaca

SEQ ID NO: 1247930 - DNA, 17 bp, Homo sapiens
acctattcaccctccac

SEQ ID NO: 1247931 - DNA, 21 bp, Homo sapiens
acctattgggacagcatgact

SEQ ID NO: 1247932 - DNA, 19 bp, Homo sapiens
acctatttccagaaataca

SEQ ID NO: 1247933 - DNA, 11 bp, Homo sapiens
acctatttctg

SEQ ID NO: 1247934 - DNA, 13 bp, Homo sapiens
acctatttctgat

SEQ ID NO: 1247935 - DNA, 15 bp, Homo sapiens
acctatttctgatga

SEQ ID NO: 1247936 - DNA, 16 bp, Homo sapiens
acctattttcatttgt

SEQ ID NO: 1247937 - DNA, 21 bp, Homo sapiens
acctattttcatttgtacaag

SEQ ID NO: 1247938 - DNA, 20 bp, Homo sapiens
acctatttttgacatggaaa

SEQ ID NO: 1247939 - DNA, 23 bp, Homo sapiens
acctcaaacttccagtcaggtag

SEQ ID NO: 1247940 - DNA, 16 bp, Homo sapiens
acctcaacaagaagaa

SEQ ID NO: 1247941 - DNA, 21 bp, Homo sapiens
acctcaacccccatttctatt

SEQ ID NO: 1247942 - DNA, 14 bp, Homo sapiens
acctcaagccccat

SEQ ID NO: 1247943 - DNA, 19 bp, Homo sapiens
acctcaagccccatttcct

SEQ ID NO: 1247944 - DNA, 10 bp, Homo sapiens
acctcaaggg

SEQ ID NO: 1247945 - DNA, 20 bp, Homo sapiens
acctcaagggggactgtctt

SEQ ID NO: 1247946 - DNA, 20 bp, Homo sapiens
acctcaagttcttggaccag

SEQ ID NO: 1247947 - DNA, 19 bp, Homo sapiens
acctcaagtttttgttttg

SEQ ID NO: 1247948 - DNA, 18 bp, Homo sapiens
acctcaatgccctgccat

SEQ ID NO: 1247949 - DNA, 19 bp, Homo sapiens
acctcaatgccctgccatt

SEQ ID NO: 1247950 - DNA, 14 bp, Homo sapiens
acctcaatttttgt

SEQ ID NO: 1247951 - DNA, 21 bp, Homo sapiens
acctcaatttttgtttttgag

SEQ ID NO: 1247952 - DNA, 16 bp, Homo sapiens
acctcaccaaactagt

SEQ ID NO: 1247953 - DNA, 15 bp, Homo sapiens
acctcacctctttgt

SEQ ID NO: 1247954 - DNA, 14 bp, Homo sapiens
acctcaccttcctg

SEQ ID NO: 1247955 - DNA, 15 bp, Homo sapiens
acctcaccttcctgt

SEQ ID NO: 1247956 - DNA, 17 bp, Homo sapiens
acctcacgactggtcac

SEQ ID NO: 1247957 - DNA, 22 bp, Homo sapiens
acctcacgcaggctgagtccag

SEQ ID NO: 1247958 - DNA, 14 bp, Homo sapiens
acctcacgctctgg

SEQ ID NO: 1247959 - DNA, 15 bp, Homo sapiens
acctcacgctctgga

SEQ ID NO: 1247960 - DNA, 24 bp, Homo sapiens
acctcactatggtatgctggccag

SEQ ID NO: 1247961 - DNA, 15 bp, Homo sapiens
acctcactgggcctt

SEQ ID NO: 1247962 - DNA, 20 bp, Homo sapiens
acctcactgggcctttccag

SEQ ID NO: 1247963 - DNA, 23 bp, Homo sapiens
acctcactggggtcctggggcct

SEQ ID NO: 1247964 - DNA, 19 bp, Homo sapiens
acctcagaaagtcaccagg

SEQ ID NO: 1247965 - DNA, 20 bp, Homo sapiens
acctcagaaagtcaccagga

SEQ ID NO: 1247966 - DNA, 22 bp, Homo sapiens
acctcagaggctgttcttgggg

SEQ ID NO: 1247967 - DNA, 22 bp, Homo sapiens
acctcagccatgaggagttgct

SEQ ID NO: 1247968 - DNA, 10 bp, Homo sapiens
acctcagcct

SEQ ID NO: 1247969 - DNA, 15 bp, Homo sapiens
acctcagcctagacc

SEQ ID NO: 1247970 - DNA, 19 bp, Homo sapiens
acctcagcctggagaggcc

SEQ ID NO: 1247971 - DNA, 21 bp, Homo sapiens
acctcagcctggagaggcctg

SEQ ID NO: 1247972 - DNA, 22 bp, Homo sapiens
acctcagcctggagaggcctgg

SEQ ID NO: 1247973 - DNA, 16 bp, Homo sapiens
acctcagcctgtgctg

SEQ ID NO: 1247974 - DNA, 19 bp, Homo sapiens
acctcagcctgtgctgccc

SEQ ID NO: 1247975 - DNA, 14 bp, Homo sapiens
acctcagctctggg

SEQ ID NO: 1247976 - DNA, 13 bp, Homo sapiens
acctcagctgcac

SEQ ID NO: 1247977 - DNA, 19 bp, Homo sapiens
acctgggcatttggtgaga

SEQ ID NO: 1247978 - DNA, 16 bp, Homo sapiens
acctgggcccacagag

SEQ ID NO: 1247979 - DNA, 19 bp, Homo sapiens
acctgggccccactggaca

SEQ ID NO: 1247980 - DNA, 22 bp, Homo sapiens
acctgggccccactggacaaca

SEQ ID NO: 1247981 - DNA, 18 bp, Homo sapiens
acctgggcccgggcaggc

SEQ ID NO: 1247982 - DNA, 14 bp, Homo sapiens
acctgggccctgga

SEQ ID NO: 1247983 - DNA, 24 bp, Homo sapiens
acctggggagtgggacagagtctg

SEQ ID NO: 1247984 - DNA, 14 bp, Homo sapiens
acctggggcacagt

SEQ ID NO: 1247985 - DNA, 19 bp, Homo sapiens
acctggggcacagtccagg

SEQ ID NO: 1247986 - DNA, 17 bp, Homo sapiens
acctgggggagccgacc

SEQ ID NO: 1247987 - DNA, 19 bp, Homo sapiens
acctggggtctctctccct

SEQ ID NO: 1247988 - DNA, 14 bp, Homo sapiens
acctggggtgaata

SEQ ID NO: 1247989 - DNA, 17 bp, Homo sapiens
acctgggtatcccctgc

SEQ ID NO: 1247990 - DNA, 21 bp, Homo sapiens
acctgggtatcccctgcctcc

SEQ ID NO: 1247991 - DNA, 13 bp, Homo sapiens
acctgggtggaca

SEQ ID NO: 1247992 - DNA, 18 bp, Homo sapiens
acctgggttagggtgtgt

SEQ ID NO: 1247993 - DNA, 17 bp, Homo sapiens
acctgggttccctttcc

SEQ ID NO: 1247994 - DNA, 22 bp, Homo sapiens
acctgggttccctttccttcca

SEQ ID NO: 1247995 - DNA, 20 bp, Homo sapiens
acctgggtttccagggcaca

SEQ ID NO: 1247996 - DNA, 17 bp, Homo sapiens
acctggtaagcaaaact

SEQ ID NO: 1247997 - DNA, 18 bp, Homo sapiens
acctggtaccctcctggc

SEQ ID NO: 1247998 - DNA, 20 bp, Homo sapiens
acctggtccccactgctgag

SEQ ID NO: 1247999 - DNA, 22 bp, Homo sapiens
acctggtccccactgctgagct

SEQ ID NO: 1248000 - DNA, 11 bp, Homo sapiens
acctggtgctg

SEQ ID NO: 1248001 - DNA, 13 bp, Homo sapiens
acctggtgctgga

SEQ ID NO: 1248002 - DNA, 22 bp, Homo sapiens
acctggtgctggatattttcaa

SEQ ID NO: 1248003 - DNA, 20 bp, Homo sapiens
acctggtgtgcggaggcagg

SEQ ID NO: 1248004 - DNA, 16 bp, Homo sapiens
acctggtgtgtttctt

SEQ ID NO: 1248005 - DNA, 11 bp, Homo sapiens
acctgtaaaac

SEQ ID NO: 1248006 - DNA, 16 bp, Homo sapiens
acctgtaaaactttat

SEQ ID NO: 1248007 - DNA, 20 bp, Homo sapiens
acctgtaaaactttatttta

SEQ ID NO: 1248008 - DNA, 11 bp, Homo sapiens
acctgtagctg

SEQ ID NO: 1248009 - DNA, 15 bp, Homo sapiens
acctgtagtcccagc

SEQ ID NO: 1248010 - DNA, 20 bp, Homo sapiens
acctgtagtgagaaactgat

SEQ ID NO: 1248011 - DNA, 23 bp, Homo sapiens
acctgtataagtggaggcacttt

SEQ ID NO: 1248012 - DNA, 18 bp, Homo sapiens
acctgtcaccgtgagcag

SEQ ID NO: 1248013 - DNA, 18 bp, Homo sapiens
acctgtcatgcccccctc

SEQ ID NO: 1248014 - DNA, 19 bp, Homo sapiens
acctgtcatgcccccctca

SEQ ID NO: 1248015 - DNA, 20 bp, Homo sapiens
acctgtcatgcccccctcaa

SEQ ID NO: 1248016 - DNA, 14 bp, Homo sapiens
acctgtccccaccc

SEQ ID NO: 1248017 - DNA, 24 bp, Homo sapiens
acctgtcccccactctctcaccca

SEQ ID NO: 1248018 - DNA, 22 bp, Homo sapiens
acctgtcctaaggaaccttcct

SEQ ID NO: 1248019 - DNA, 16 bp, Homo sapiens
acctgtctccactgtg

SEQ ID NO: 1248020 - DNA, 19 bp, Homo sapiens
acctgtctccattgtgtga

SEQ ID NO: 1248021 - DNA, 15 bp, Homo sapiens
acctgtcttgctcct

SEQ ID NO: 1248022 - DNA, 14 bp, Homo sapiens
acctgtgaccagca

SEQ ID NO: 1248023 - DNA, 19 bp, Homo sapiens
acctgtgaccagcactgtc

SEQ ID NO: 1248024 - DNA, 19 bp, Homo sapiens
acctgtgatgaggggagga

SEQ ID NO: 1248025 - DNA, 15 bp, Homo sapiens
acctgtgccctcacc

SEQ ID NO: 1248026 - DNA, 14 bp, Homo sapiens
acctgtgctgctgc

SEQ ID NO: 1248027 - DNA, 20 bp, Homo sapiens
acctgtggaacataaaaagg

SEQ ID NO: 1248028 - DNA, 23 bp, Homo sapiens
acctgtggaacataaaaaggaca

SEQ ID NO: 1248029 - DNA, 10 bp, Homo sapiens
acctgtggat

SEQ ID NO: 1248030 - DNA, 17 bp, Homo sapiens
acctgtggccaagttct

SEQ ID NO: 1248031 - DNA, 19 bp, Homo sapiens
acctgtggccaagttctta

SEQ ID NO: 1248032 - DNA, 15 bp, Homo sapiens
acctgtggctcaggg

SEQ ID NO: 1248033 - DNA, 19 bp, Homo sapiens
acctgtggggatttctccc

SEQ ID NO: 1248034 - DNA, 20 bp, Homo sapiens
acctgtggggatttctccca

SEQ ID NO: 1248035 - DNA, 22 bp, Homo sapiens
acctgtggggatttctcccagc

SEQ ID NO: 1248036 - DNA, 23 bp, Homo sapiens
acctgtggggatttctcccagct

SEQ ID NO: 1248037 - DNA, 13 bp, Homo sapiens
acctgtgggtgta

SEQ ID NO: 1248038 - DNA, 20 bp, Homo sapiens
acctgttaaaatgtacactg

SEQ ID NO: 1248039 - DNA, 14 bp, Homo sapiens
acctgttagctccc

SEQ ID NO: 1248040 - DNA, 14 bp, Homo sapiens
acctgttatgtatg

SEQ ID NO: 1248041 - DNA, 15 bp, Homo sapiens
acctgttatgtatga

SEQ ID NO: 1248042 - DNA, 17 bp, Homo sapiens
acctgttcacagaaaaa

SEQ ID NO: 1248043 - DNA, 16 bp, Homo sapiens
acctgttctgtagctt

SEQ ID NO: 1248044 - DNA, 21 bp, Homo sapiens
acctgttctgtgttgcaagat

SEQ ID NO: 1248045 - DNA, 17 bp, Homo sapiens
acctgttcttagagtgt

SEQ ID NO: 1248046 - DNA, 18 bp, Homo sapiens
acctgttcttagagtgta

SEQ ID NO: 1248047 - DNA, 21 bp, Homo sapiens
acctgttggcctgtgggcctc

SEQ ID NO: 1248048 - DNA, 15 bp, Homo sapiens
acctgtttctctgcc

SEQ ID NO: 1248049 - DNA, 14 bp, Homo sapiens
acctgttttctgaa

SEQ ID NO: 1248050 - DNA, 21 bp, Homo sapiens
acctgttttctgactagttta

SEQ ID NO: 1248051 - DNA, 18 bp, Homo sapiens
acctgttttgttaatgct

SEQ ID NO: 1248052 - DNA, 16 bp, Homo sapiens
acctgtttttaagctg

SEQ ID NO: 1248053 - DNA, 13 bp, Homo sapiens
accttaaatacac

SEQ ID NO: 1248054 - DNA, 22 bp, Homo sapiens
accttaaatacactgaattgaa

SEQ ID NO: 1248055 - DNA, 17 bp, Homo sapiens
accttaaattaaacaat

SEQ ID NO: 1248056 - DNA, 17 bp, Homo sapiens
accttaagacactgtga

SEQ ID NO: 1248057 - DNA, 21 bp, Homo sapiens
accttaagctggcattgtgaa

SEQ ID NO: 1248058 - DNA, 14 bp, Homo sapiens
accttaatatttct

SEQ ID NO: 1248059 - DNA, 15 bp, Homo sapiens
accttaccaactttc

SEQ ID NO: 1248060 - DNA, 18 bp, Homo sapiens
accttagaaatcattgta

SEQ ID NO: 1248061 - DNA, 18 bp, Homo sapiens
accttagataatatttct

SEQ ID NO: 1248062 - DNA, 17 bp, Homo sapiens
accttagattagctctg

SEQ ID NO: 1248063 - DNA, 19 bp, Homo sapiens
accttagattagctctgga

SEQ ID NO: 1248064 - DNA, 23 bp, Homo sapiens
accttagctacatagcagacttt

SEQ ID NO: 1248065 - DNA, 16 bp, Homo sapiens
accttaggccttcctc

SEQ ID NO: 1248066 - DNA, 23 bp, Homo sapiens
accttaggctttgtatgacagtg

SEQ ID NO: 1248067 - DNA, 17 bp, Homo sapiens
accttattaacaaaata

SEQ ID NO: 1248068 - DNA, 18 bp, Homo sapiens
accttattgtacctctct

SEQ ID NO: 1248069 - DNA, 22 bp, Homo sapiens
accttatttgctaatcaaagcc

SEQ ID NO: 1248070 - DNA, 18 bp, Homo sapiens
accttattttttcccaaa

SEQ ID NO: 1248071 - DNA, 20 bp, Homo sapiens
accttcaaaatgttctattt

SEQ ID NO: 1248072 - DNA, 18 bp, Homo sapiens
accttcaattcctgggcc

SEQ ID NO: 1248073 - DNA, 17 bp, Homo sapiens
accttcagactttgctt

SEQ ID NO: 1248074 - DNA, 20 bp, Homo sapiens
accttcagccctggccaagc

SEQ ID NO: 1248075 - DNA, 23 bp, Homo sapiens
accttcatctgaaacccacagat

SEQ ID NO: 1248076 - DNA, 20 bp, Homo sapiens
accttcattctgagaccaaa

SEQ ID NO: 1248077 - DNA, 22 bp, Homo sapiens
accttcatttcatgtatagttt

SEQ ID NO: 1248078 - DNA, 19 bp, Homo sapiens
accttccaagactgaagac

SEQ ID NO: 1248079 - DNA, 19 bp, Homo sapiens
accttccatggctcttttt

SEQ ID NO: 1248080 - DNA, 16 bp, Homo sapiens
accttccattcacacc

SEQ ID NO: 1248081 - DNA, 14 bp, Homo sapiens
accttcccaaacgc

SEQ ID NO: 1248082 - DNA, 21 bp, Homo sapiens
accttcccaaacgcctcccct

SEQ ID NO: 1248083 - DNA, 14 bp, Homo sapiens
accttcccacccct

SEQ ID NO: 1248084 - DNA, 9 bp, Homo sapiens
accttcccc

SEQ ID NO: 1248085 - DNA, 16 bp, Homo sapiens
accttccccagactca

SEQ ID NO: 1248086 - DNA, 22 bp, Homo sapiens
accttcccttctacaaggactc

SEQ ID NO: 1248087 - DNA, 14 bp, Homo sapiens
accttcctcctccc

SEQ ID NO: 1248088 - DNA, 20 bp, Homo sapiens
accttcctcctccccgctcc

SEQ ID NO: 1248089 - DNA, 18 bp, Homo sapiens
accttcctcctgcagaca

SEQ ID NO: 1248090 - DNA, 15 bp, Homo sapiens
accttcctgaattct

SEQ ID NO: 1248091 - DNA, 18 bp, Homo sapiens
accttcctgccaccagtc

SEQ ID NO: 1248092 - DNA, 20 bp, Homo sapiens
accttcctgggaggacaggc

SEQ ID NO: 1248093 - DNA, 15 bp, Homo sapiens
accttcctgtccctg

SEQ ID NO: 1248094 - DNA, 18 bp, Homo sapiens
accttcctgtccctgagg

SEQ ID NO: 1248095 - DNA, 22 bp, Homo sapiens
accttcctgtgggtgttctttc

SEQ ID NO: 1248096 - DNA, 24 bp, Homo sapiens
accttccttccctgggctgtgcta

SEQ ID NO: 1248097 - DNA, 12 bp, Homo sapiens
accttccttcct

SEQ ID NO: 1248098 - DNA, 19 bp, Homo sapiens
acctttttcttgatcttaa

SEQ ID NO: 1248099 - DNA, 22 bp, Homo sapiens
acctttttgcatgatatcttca

SEQ ID NO: 1248100 - DNA, 13 bp, Homo sapiens
accttttttatac

SEQ ID NO: 1248101 - DNA, 20 bp, Homo sapiens
accttttttgttttttcaaa

SEQ ID NO: 1248102 - DNA, 17 bp, Homo sapiens
acctttttttttgaaac

SEQ ID NO: 1248103 - DNA, 18 bp, Homo sapiens
accttttttttttttcca

SEQ ID NO: 1248104 - DNA, 17 bp, Homo sapiens
acgaaaccaaaaagttg

SEQ ID NO: 1248105 - DNA, 21 bp, Homo sapiens
acgaaacttgttattgtgaat

SEQ ID NO: 1248106 - DNA, 23 bp, Homo sapiens
acgaaataattgttgttctgtta

SEQ ID NO: 1248107 - DNA, 13 bp, Homo sapiens
acgaaatgttatt

SEQ ID NO: 1248108 - DNA, 21 bp, Homo sapiens
acgaaattgttacaatagaat

SEQ ID NO: 1248109 - DNA, 13 bp, Homo sapiens
acgaacagcccgc

SEQ ID NO: 1248110 - DNA, 19 bp, Homo sapiens
acgaacctacagttttaac

SEQ ID NO: 1248111 - DNA, 17 bp, Homo sapiens
acgaacggaagggttgg

SEQ ID NO: 1248112 - DNA, 12 bp, Homo sapiens
acgaagaaaaaa

SEQ ID NO: 1248113 - DNA, 19 bp, Homo sapiens
acgaagcaatttgttgctg

SEQ ID NO: 1248114 - DNA, 12 bp, Homo sapiens
acgaagccttaa

SEQ ID NO: 1248115 - DNA, 23 bp, Homo sapiens
acgaagccttaagccataggccc

SEQ ID NO: 1248116 - DNA, 16 bp, Homo sapiens
acgaagtctttttcat

SEQ ID NO: 1248117 - DNA, 14 bp, Homo sapiens
acgaagtgttgcat

SEQ ID NO: 1248118 - DNA, 16 bp, Homo sapiens
acgaattccatcttgt

SEQ ID NO: 1248119 - DNA, 20 bp, Homo sapiens
acgacacgggtggggaaagg

SEQ ID NO: 1248120 - DNA, 13 bp, Homo sapiens
acgacgccctctc

SEQ ID NO: 1248121 - DNA, 14 bp, Homo sapiens
acgactaatcacct

SEQ ID NO: 1248122 - DNA, 13 bp, Homo sapiens
acgactcttcctg

SEQ ID NO: 1248123 - DNA, 19 bp, Homo sapiens
acgactgtatattgctaag

SEQ ID NO: 1248124 - DNA, 17 bp, Homo sapiens
acgacttttttgagaca

SEQ ID NO: 1248125 - DNA, 19 bp, Homo sapiens
acgagacacattgccttct

SEQ ID NO: 1248126 - DNA, 17 bp, Homo sapiens
acgagagcagaggtctc

SEQ ID NO: 1248127 - DNA, 19 bp, Homo sapiens
acgagcactggccagagag

SEQ ID NO: 1248128 - DNA, 12 bp, Homo sapiens
acgagccacaag

SEQ ID NO: 1248129 - DNA, 20 bp, Homo sapiens
acgaggaatctgtgggtctg

SEQ ID NO: 1248130 - DNA, 20 bp, Homo sapiens
acgaggctgcccccatccag

SEQ ID NO: 1248131 - DNA, 14 bp, Homo sapiens
acgagggctggctg

SEQ ID NO: 1248132 - DNA, 16 bp, Homo sapiens
acgagggctggctggc

SEQ ID NO: 1248133 - DNA, 10 bp, Homo sapiens
acgaggggac

SEQ ID NO: 1248134 - DNA, 17 bp, Homo sapiens
acgaggggacccatggg

SEQ ID NO: 1248135 - DNA, 21 bp, Homo sapiens
acgaggggacccatgggggct

SEQ ID NO: 1248136 - DNA, 18 bp, Homo sapiens
acgaggggtgtcttgggc

SEQ ID NO: 1248137 - DNA, 20 bp, Homo sapiens
acgaggtcaagagatcgaga

SEQ ID NO: 1248138 - DNA, 16 bp, Homo sapiens
acgagtaatttattgt

SEQ ID NO: 1248139 - DNA, 14 bp, Homo sapiens
acgagtcacctgca

SEQ ID NO: 1248140 - DNA, 21 bp, Homo sapiens
acgagtgaccgattatgcttt

SEQ ID NO: 1248141 - DNA, 23 bp, Homo sapiens
acgagttcatggggatctggggg

SEQ ID NO: 1248142 - DNA, 22 bp, Homo sapiens
acgagtttggatgttgtaaata

SEQ ID NO: 1248143 - DNA, 23 bp, Homo sapiens
acgatacgctactataaagagaa

SEQ ID NO: 1248144 - DNA, 16 bp, Homo sapiens
acgatccttcaaagtc

SEQ ID NO: 1248145 - DNA, 15 bp, Homo sapiens
acgatgaatttcttc

SEQ ID NO: 1248146 - DNA, 18 bp, Homo sapiens
acgatgatatctatatat

SEQ ID NO: 1248147 - DNA, 18 bp, Homo sapiens
acgatgggtgttgctgtt

SEQ ID NO: 1248148 - DNA, 19 bp, Homo sapiens
acgatgtggccctggcctg

SEQ ID NO: 1248149 - DNA, 22 bp, Homo sapiens
acgatttgcaggattcccttct

SEQ ID NO: 1248150 - DNA, 17 bp, Homo sapiens
acgcaaagggctgaaag

SEQ ID NO: 1248151 - DNA, 13 bp, Homo sapiens
acgcaaggaagga

SEQ ID NO: 1248152 - DNA, 21 bp, Homo sapiens
acgcaagggcatcaggcactg

SEQ ID NO: 1248153 - DNA, 13 bp, Homo sapiens
acgcaagtgccag

SEQ ID NO: 1248154 - DNA, 21 bp, Homo sapiens
acgcaattgtgggatgtcctc

SEQ ID NO: 1248155 - DNA, 19 bp, Homo sapiens
acgcaattttacctagttt

SEQ ID NO: 1248156 - DNA, 13 bp, Homo sapiens
acgcacacacaca

SEQ ID NO: 1248157 - DNA, 19 bp, Homo sapiens
acgcacacacacatacaga

SEQ ID NO: 1248158 - DNA, 20 bp, Homo sapiens
acgcacacatcttacctctc

SEQ ID NO: 1248159 - DNA, 18 bp, Homo sapiens
acgcacaccctgcccctg

SEQ ID NO: 1248160 - DNA, 19 bp, Homo sapiens
acgcacataccttcatgtg

SEQ ID NO: 1248161 - DNA, 14 bp, Homo sapiens
acgcaccactgcca

SEQ ID NO: 1248162 - DNA, 12 bp, Homo sapiens
acgcacctccac

SEQ ID NO: 1248163 - DNA, 13 bp, Homo sapiens
acgcacctccacg

SEQ ID NO: 1248164 - DNA, 16 bp, Homo sapiens
acgcacctgcctcagg

SEQ ID NO: 1248165 - DNA, 17 bp, Homo sapiens
acgcacctgcctcagga

SEQ ID NO: 1248166 - DNA, 17 bp, Homo sapiens
acgcacctgtagtccca

SEQ ID NO: 1248167 - DNA, 15 bp, Homo sapiens
acgcacgcacacaca

SEQ ID NO: 1248168 - DNA, 18 bp, Homo sapiens
acgcacgctcgctgccat

SEQ ID NO: 1248169 - DNA, 15 bp, Homo sapiens
acgcacggcagccac

SEQ ID NO: 1248170 - DNA, 17 bp, Homo sapiens
acgcacggcagccacag

SEQ ID NO: 1248171 - DNA, 14 bp, Homo sapiens
acgcacttcctctc

SEQ ID NO: 1248172 - DNA, 22 bp, Homo sapiens
acgcagatgctgtcactggcag

SEQ ID NO: 1248173 - DNA, 11 bp, Homo sapiens
acgcagcagct

SEQ ID NO: 1248174 - DNA, 12 bp, Homo sapiens
acgcagcagctg

SEQ ID NO: 1248175 - DNA, 12 bp, Homo sapiens
acgcagccctgc

SEQ ID NO: 1248176 - DNA, 23 bp, Homo sapiens
acgcagccctgctttgggctgcc

SEQ ID NO: 1248177 - DNA, 19 bp, Homo sapiens
acgcagccgccgccgccca

SEQ ID NO: 1248178 - DNA, 23 bp, Homo sapiens
acgcagccggagggaggcactag

SEQ ID NO: 1248179 - DNA, 13 bp, Homo sapiens
acgcagcctgctc

SEQ ID NO: 1248180 - DNA, 14 bp, Homo sapiens
acgcagcctgctct

SEQ ID NO: 1248181 - DNA, 12 bp, Homo sapiens
acgcaggaatgg

SEQ ID NO: 1248182 - DNA, 18 bp, Homo sapiens
acgcaggccacccgggct

SEQ ID NO: 1248183 - DNA, 22 bp, Homo sapiens
acgcaggccacccgggctgcct

SEQ ID NO: 1248184 - DNA, 12 bp, Homo sapiens
acgcaggccctg

SEQ ID NO: 1248185 - DNA, 16 bp, Homo sapiens
acgcaggcggccaggg

SEQ ID NO: 1248186 - DNA, 14 bp, Homo sapiens
acgcaggggccctg

SEQ ID NO: 1248187 - DNA, 22 bp, Homo sapiens
acgcatacacacatgccctcct

SEQ ID NO: 1248188 - DNA, 23 bp, Homo sapiens
acgcatacacacatgccctcctg

SEQ ID NO: 1248189 - DNA, 15 bp, Homo sapiens
acgcatccagcaaga

SEQ ID NO: 1248190 - DNA, 19 bp, Homo sapiens
acgcatcccatctctccca

SEQ ID NO: 1248191 - DNA, 21 bp, Homo sapiens
acgcatctcaaaacagagggc

SEQ ID NO: 1248192 - DNA, 20 bp, Homo sapiens
acgcatgggcattgcagcct

SEQ ID NO: 1248193 - DNA, 18 bp, Homo sapiens
acgccaaagtgcagccct

SEQ ID NO: 1248194 - DNA, 19 bp, Homo sapiens
acgccaaagtgcagccctt

SEQ ID NO: 1248195 - DNA, 16 bp, Homo sapiens
acgccaacttctccca

SEQ ID NO: 1248196 - DNA, 22 bp, Homo sapiens
acgccaacttctcccacccctt

SEQ ID NO: 1248197 - DNA, 21 bp, Homo sapiens
acgccacccccgcccccaccg

SEQ ID NO: 1248198 - DNA, 21 bp, Homo sapiens
acgccaccctgcccacccccg

SEQ ID NO: 1248199 - DNA, 17 bp, Homo sapiens
acgccactcatttcatc

SEQ ID NO: 1248200 - DNA, 20 bp, Homo sapiens
acgccactcatttcatctca

SEQ ID NO: 1248201 - DNA, 18 bp, Homo sapiens
acgccactccctgggaca

SEQ ID NO: 1248202 - DNA, 22 bp, Homo sapiens
acgccactgcactccagcctgg

SEQ ID NO: 1248203 - DNA, 16 bp, Homo sapiens
acgccagctcctctct

SEQ ID NO: 1248204 - DNA, 18 bp, Homo sapiens
acgccaggggaaaatcag

SEQ ID NO: 1248205 - DNA, 15 bp, Homo sapiens
acgccagtctcccag

SEQ ID NO: 1248206 - DNA, 14 bp, Homo sapiens
acgcccacccccag

SEQ ID NO: 1248207 - DNA, 17 bp, Homo sapiens
acgcccacccccagtct

SEQ ID NO: 1248208 - DNA, 17 bp, Homo sapiens
acgcccaggacagctgg

SEQ ID NO: 1248209 - DNA, 16 bp, Homo sapiens
acgcccatgtgtgagt

SEQ ID NO: 1248210 - DNA, 20 bp, Homo sapiens
acgcccctccaaacctccag

SEQ ID NO: 1248211 - DNA, 23 bp, Homo sapiens
acgcccctcccaagcgttcctgg

SEQ ID NO: 1248212 - DNA, 13 bp, Homo sapiens
acgcccctgtggc

SEQ ID NO: 1248213 - DNA, 16 bp, Homo sapiens
acgcccgtcctgcctg

SEQ ID NO: 1248214 - DNA, 20 bp, Homo sapiens
acgcccgtcctgcctgtggc

SEQ ID NO: 1248215 - DNA, 19 bp, Homo sapiens
acgccctactccactgccc

SEQ ID NO: 1248216 - DNA, 13 bp, Homo sapiens
acgccctattttt

SEQ ID NO: 1248217 - DNA, 14 bp, Homo sapiens
acgccctctcccca

SEQ ID NO: 1248218 - DNA, 15 bp, Homo sapiens
acgccctctccccac

SEQ ID NO: 1248219 - DNA, 17 bp, Homo sapiens
acgccctttcctcctca

SEQ ID NO: 1248220 - DNA, 14 bp, Homo sapiens
acgggcagccacag

SEQ ID NO: 1248221 - DNA, 16 bp, Homo sapiens
acgggcagccacagga

SEQ ID NO: 1248222 - DNA, 19 bp, Homo sapiens
acgggcagtctgctctgct

SEQ ID NO: 1248223 - DNA, 20 bp, Homo sapiens
acgggcagtctgctctgctg

SEQ ID NO: 1248224 - DNA, 14 bp, Homo sapiens
acgggcatgggcct

SEQ ID NO: 1248225 - DNA, 21 bp, Homo sapiens
acgggcccgggttgggtcacc

SEQ ID NO: 1248226 - DNA, 12 bp, Homo sapiens
acgggccctccc

SEQ ID NO: 1248227 - DNA, 22 bp, Homo sapiens
acgggccctccttccctcctgt

SEQ ID NO: 1248228 - DNA, 13 bp, Homo sapiens
acgggccgcagga

SEQ ID NO: 1248229 - DNA, 17 bp, Homo sapiens
acgggccgcaggaggga

SEQ ID NO: 1248230 - DNA, 13 bp, Homo sapiens
acgggctccttcc

SEQ ID NO: 1248231 - DNA, 18 bp, Homo sapiens
acgggctctatgcctgca

SEQ ID NO: 1248232 - DNA, 14 bp, Homo sapiens
acgggctgccctgc

SEQ ID NO: 1248233 - DNA, 18 bp, Homo sapiens
acggggagcggcggaaag

SEQ ID NO: 1248234 - DNA, 12 bp, Homo sapiens
acgggggcagtg

SEQ ID NO: 1248235 - DNA, 14 bp, Homo sapiens
acgggggcagtgtg

SEQ ID NO: 1248236 - DNA, 13 bp, Homo sapiens
acggggtggggag

SEQ ID NO: 1248237 - DNA, 16 bp, Homo sapiens
acggggtgtgtggccc

SEQ ID NO: 1248238 - DNA, 14 bp, Homo sapiens
acggtaagtgttct

SEQ ID NO: 1248239 - DNA, 15 bp, Homo sapiens
acggtaagtgttctc

SEQ ID NO: 1248240 - DNA, 22 bp, Homo sapiens
acggtatcctccctgcccatcc

SEQ ID NO: 1248241 - DNA, 17 bp, Homo sapiens
acggtcaggtttaacat

SEQ ID NO: 1248242 - DNA, 19 bp, Homo sapiens
acggtcctttaggcagcct

SEQ ID NO: 1248243 - DNA, 12 bp, Homo sapiens
acggtctgagct

SEQ ID NO: 1248244 - DNA, 19 bp, Homo sapiens
acggtctgtgtgctgtttg

SEQ ID NO: 1248245 - DNA, 18 bp, Homo sapiens
acggtctgttcttgaagc

SEQ ID NO: 1248246 - DNA, 16 bp, Homo sapiens
acggtgaaggtgacag

SEQ ID NO: 1248247 - DNA, 19 bp, Homo sapiens
acggtgaaggtgacagcag

SEQ ID NO: 1248248 - DNA, 17 bp, Homo sapiens
acggtgacacaggtcag

SEQ ID NO: 1248249 - DNA, 15 bp, Homo sapiens
acggtgcccaagcca

SEQ ID NO: 1248250 - DNA, 23 bp, Homo sapiens
acggtgctatttctattccttat

SEQ ID NO: 1248251 - DNA, 18 bp, Homo sapiens
acggtgctgtgagggagg

SEQ ID NO: 1248252 - DNA, 19 bp, Homo sapiens
acggtgctgtgagggaggg

SEQ ID NO: 1248253 - DNA, 14 bp, Homo sapiens
acggttaactgtaa

SEQ ID NO: 1248254 - DNA, 20 bp, Homo sapiens
acggttaacttgtatattcc

SEQ ID NO: 1248255 - DNA, 16 bp, Homo sapiens
acggtttcaaaccagg

SEQ ID NO: 1248256 - DNA, 18 bp, Homo sapiens
acgtaaagctagaaatga

SEQ ID NO: 1248257 - DNA, 15 bp, Homo sapiens
acgtaaatattcata

SEQ ID NO: 1248258 - DNA, 12 bp, Homo sapiens
acgtacacattt

SEQ ID NO: 1248259 - DNA, 14 bp, Homo sapiens
acgtacacatttta

SEQ ID NO: 1248260 - DNA, 20 bp, Homo sapiens
acgtactgtaactgctcaga

SEQ ID NO: 1248261 - DNA, 20 bp, Homo sapiens
acgtagggggctctgggcgg

SEQ ID NO: 1248262 - DNA, 22 bp, Homo sapiens
acgtagggggctctgggcggcc

SEQ ID NO: 1248263 - DNA, 18 bp, Homo sapiens
acgtaggttccccagaga

SEQ ID NO: 1248264 - DNA, 15 bp, Homo sapiens
acgtataaatatcag

SEQ ID NO: 1248265 - DNA, 19 bp, Homo sapiens
acgtatgaatgatatcttt

SEQ ID NO: 1248266 - DNA, 14 bp, Homo sapiens
acgtatgcatgtga

SEQ ID NO: 1248267 - DNA, 22 bp, Homo sapiens
acgtatgtaacatgatgttaac

SEQ ID NO: 1248268 - DNA, 15 bp, Homo sapiens
acgtattacaaacaa

SEQ ID NO: 1248269 - DNA, 21 bp, Homo sapiens
acgtattgctgtgtctcctct

SEQ ID NO: 1248270 - DNA, 16 bp, Homo sapiens
acgtattggtccagct

SEQ ID NO: 1248271 - DNA, 15 bp, Homo sapiens
acgtatttaatagca

SEQ ID NO: 1248272 - DNA, 17 bp, Homo sapiens
acgtatttatatttgga

SEQ ID NO: 1248273 - DNA, 21 bp, Homo sapiens
acgtatttatatttggaaaga

SEQ ID NO: 1248274 - DNA, 16 bp, Homo sapiens
acgtatttcacagagc

SEQ ID NO: 1248275 - DNA, 17 bp, Homo sapiens
acgtatttcacagagca

SEQ ID NO: 1248276 - DNA, 20 bp, Homo sapiens
acgtatttctccagacccag

SEQ ID NO: 1248277 - DNA, 20 bp, Homo sapiens
acgtcaacccaagctctggg

SEQ ID NO: 1248278 - DNA, 15 bp, Homo sapiens
acgtcacgctccctg

SEQ ID NO: 1248279 - DNA, 21 bp, Homo sapiens
acgtcactggaccactgggca

SEQ ID NO: 1248280 - DNA, 22 bp, Homo sapiens
acgtcaggccctgactcctctg

SEQ ID NO: 1248281 - DNA, 18 bp, Homo sapiens
acgtcccagcatccctgg

SEQ ID NO: 1248282 - DNA, 22 bp, Homo sapiens
acgtcccagcatccctggagca

SEQ ID NO: 1248283 - DNA, 22 bp, Homo sapiens
acgtcccctccgccgtgccggc

SEQ ID NO: 1248284 - DNA, 16 bp, Homo sapiens
acgtcccgctgcctcc

SEQ ID NO: 1248285 - DNA, 18 bp, Homo sapiens
acgtcccgctgcctcctg

SEQ ID NO: 1248286 - DNA, 22 bp, Homo sapiens
acgtcccgctgcctcctgctct

SEQ ID NO: 1248287 - DNA, 19 bp, Homo sapiens
acgtcccgctgctgtgctc

SEQ ID NO: 1248288 - DNA, 12 bp, Homo sapiens
acgtcctggtct

SEQ ID NO: 1248289 - DNA, 20 bp, Homo sapiens
acgtcctggtctttgtttga

SEQ ID NO: 1248290 - DNA, 22 bp, Homo sapiens
acgtccttccatatccctgccc

SEQ ID NO: 1248291 - DNA, 23 bp, Homo sapiens
acgtccttccatatccctgccca

SEQ ID NO: 1248292 - DNA, 16 bp, Homo sapiens
acgtccttccttgact

SEQ ID NO: 1248293 - DNA, 17 bp, Homo sapiens
acgtccttccttgactg

SEQ ID NO: 1248294 - DNA, 20 bp, Homo sapiens
acgtccttccttgactgtct

SEQ ID NO: 1248295 - DNA, 23 bp, Homo sapiens
acgtcgcccgctgagctgagtgg

SEQ ID NO: 1248296 - DNA, 14 bp, Homo sapiens
acgtctgccaggcc

SEQ ID NO: 1248297 - DNA, 16 bp, Homo sapiens
acgtctgccaggggta

SEQ ID NO: 1248298 - DNA, 22 bp, Homo sapiens
acgtctgccaggggtaacctgg

SEQ ID NO: 1248299 - DNA, 16 bp, Homo sapiens
acgtctggccaggcac

SEQ ID NO: 1248300 - DNA, 14 bp, Homo sapiens
acgtctggggtgtg

SEQ ID NO: 1248301 - DNA, 13 bp, Homo sapiens
acgtcttgctatt

SEQ ID NO: 1248302 - DNA, 23 bp, Homo sapiens
acgtcttgctatttgagcatgca

SEQ ID NO: 1248303 - DNA, 14 bp, Homo sapiens
acgtctttcctgct

SEQ ID NO: 1248304 - DNA, 16 bp, Homo sapiens
acgtgaaactgctgtt

SEQ ID NO: 1248305 - DNA, 13 bp, Homo sapiens
acgtgaaatattt

SEQ ID NO: 1248306 - DNA, 15 bp, Homo sapiens
acgtgaaatatttaa

SEQ ID NO: 1248307 - DNA, 16 bp, Homo sapiens
acgtgaaatttgcctc

SEQ ID NO: 1248308 - DNA, 20 bp, Homo sapiens
acgtgaaatttgcctctgtc

SEQ ID NO: 1248309 - DNA, 14 bp, Homo sapiens
acgtgaagaaataa

SEQ ID NO: 1248310 - DNA, 18 bp, Homo sapiens
acgtgagagaatctgcct

SEQ ID NO: 1248311 - DNA, 22 bp, Homo sapiens
acgtgagctccggaatagatgt

SEQ ID NO: 1248312 - DNA, 18 bp, Homo sapiens
acgtgcaaacaacctgaa

SEQ ID NO: 1248313 - DNA, 22 bp, Homo sapiens
acgtgcaaacaacctgaatctt

SEQ ID NO: 1248314 - DNA, 11 bp, Homo sapiens
acgtgcacagg

SEQ ID NO: 1248315 - DNA, 23 bp, Homo sapiens
acgtgcacctgtactcaggaggc

SEQ ID NO: 1248316 - DNA, 13 bp, Homo sapiens
acgtgcaggacag

SEQ ID NO: 1248317 - DNA, 18 bp, Homo sapiens
acgtgcaggacagctctt

SEQ ID NO: 1248318 - DNA, 11 bp, Homo sapiens
acgtgcattta

SEQ ID NO: 1248319 - DNA, 17 bp, Homo sapiens
acgtgccagatataact

SEQ ID NO: 1248320 - DNA, 18 bp, Homo sapiens
acgtgccagatataactg

SEQ ID NO: 1248321 - DNA, 19 bp, Homo sapiens
acgtgccagatataactgt

SEQ ID NO: 1248322 - DNA, 18 bp, Homo sapiens
acgtgccaggcccggggc

SEQ ID NO: 1248323 - DNA, 15 bp, Homo sapiens
acgtgcccccagagt

SEQ ID NO: 1248324 - DNA, 22 bp, Homo sapiens
acgtgccttttgcacccctccc

SEQ ID NO: 1248325 - DNA, 17 bp, Homo sapiens
acgtgctaggggatgag

SEQ ID NO: 1248326 - DNA, 17 bp, Homo sapiens
acgtgctgtgggcctca

SEQ ID NO: 1248327 - DNA, 14 bp, Homo sapiens
acgtggagagctgg

SEQ ID NO: 1248328 - DNA, 16 bp, Homo sapiens
acgtggagagctggtg

SEQ ID NO: 1248329 - DNA, 19 bp, Homo sapiens
acgtggagagctggtgccc

SEQ ID NO: 1248330 - DNA, 22 bp, Homo sapiens
acgtggagcggggtatgaagag

SEQ ID NO: 1248331 - DNA, 21 bp, Homo sapiens
acgtggaggaatgctccccca

SEQ ID NO: 1248332 - DNA, 14 bp, Homo sapiens
acgtggattttaaa

SEQ ID NO: 1248333 - DNA, 18 bp, Homo sapiens
acgtggattttaaaaaat

SEQ ID NO: 1248334 - DNA, 18 bp, Homo sapiens
acgtgggcatcattttaa

SEQ ID NO: 1248335 - DNA, 11 bp, Homo sapiens
acgtggggctc

SEQ ID NO: 1248336 - DNA, 18 bp, Homo sapiens
acgtggttggggccctgc

SEQ ID NO: 1248337 - DNA, 14 bp, Homo sapiens
acgtgtacagcaca

SEQ ID NO: 1248338 - DNA, 16 bp, Homo sapiens
acgtgtatagtatctg

SEQ ID NO: 1248339 - DNA, 14 bp, Homo sapiens
acgtgtatgtttct

SEQ ID NO: 1248340 - DNA, 17 bp, Homo sapiens
acgtgtatgtttcttct

SEQ ID NO: 1248341 - DNA, 18 bp, Homo sapiens
acgtgtatgtttcttctt

SEQ ID NO: 1248342 - DNA, 15 bp, Homo sapiens
actagtgacagtttc

SEQ ID NO: 1248343 - DNA, 22 bp, Homo sapiens
actagtgagtcagcaccttggc

SEQ ID NO: 1248344 - DNA, 17 bp, Homo sapiens
actagtgcaattccaag

SEQ ID NO: 1248345 - DNA, 18 bp, Homo sapiens
actagttctcttgtcctg

SEQ ID NO: 1248346 - DNA, 20 bp, Homo sapiens
actagttgtgtctggcagtt

SEQ ID NO: 1248347 - DNA, 17 bp, Homo sapiens
actagtttatgctacct

SEQ ID NO: 1248348 - DNA, 17 bp, Homo sapiens
actagttttgtgccagc

SEQ ID NO: 1248349 - DNA, 16 bp, Homo sapiens
actagtttttatagct

SEQ ID NO: 1248350 - DNA, 19 bp, Homo sapiens
actataaacttaagggcaa

SEQ ID NO: 1248351 - DNA, 13 bp, Homo sapiens
actataaagagaa

SEQ ID NO: 1248352 - DNA, 21 bp, Homo sapiens
actataaataaaaacttattt

SEQ ID NO: 1248353 - DNA, 16 bp, Homo sapiens
actataagactataaa

SEQ ID NO: 1248354 - DNA, 14 bp, Homo sapiens
actataatgtaagc

SEQ ID NO: 1248355 - DNA, 15 bp, Homo sapiens
actataattgtaaat

SEQ ID NO: 1248356 - DNA, 13 bp, Homo sapiens
actatacagccat

SEQ ID NO: 1248357 - DNA, 18 bp, Homo sapiens
actataggcttcttcctt

SEQ ID NO: 1248358 - DNA, 15 bp, Homo sapiens
actatagtggtgaga

SEQ ID NO: 1248359 - DNA, 16 bp, Homo sapiens
actatagtgtaataat

SEQ ID NO: 1248360 - DNA, 18 bp, Homo sapiens
actatagtgtaataatgt

SEQ ID NO: 1248361 - DNA, 21 bp, Homo sapiens
actatataatttatttccact

SEQ ID NO: 1248362 - DNA, 14 bp, Homo sapiens
actatatacatata

SEQ ID NO: 1248363 - DNA, 17 bp, Homo sapiens
actatatacatatatat

SEQ ID NO: 1248364 - DNA, 22 bp, Homo sapiens
actatatacatcacgttaaagt

SEQ ID NO: 1248365 - DNA, 16 bp, Homo sapiens
actatatagagatgtt

SEQ ID NO: 1248366 - DNA, 21 bp, Homo sapiens
actatatcttcccatttaaca

SEQ ID NO: 1248367 - DNA, 13 bp, Homo sapiens
actatatgtgaat

SEQ ID NO: 1248368 - DNA, 18 bp, Homo sapiens
actatattgattgtcctt

SEQ ID NO: 1248369 - DNA, 15 bp, Homo sapiens
actatcattaacatt

SEQ ID NO: 1248370 - DNA, 22 bp, Homo sapiens
actatcccaatcaaagaattac

SEQ ID NO: 1248371 - DNA, 14 bp, Homo sapiens
actatctacaaaaa

SEQ ID NO: 1248372 - DNA, 15 bp, Homo sapiens
actatctcacttcca

SEQ ID NO: 1248373 - DNA, 16 bp, Homo sapiens
actatctcacttccag

SEQ ID NO: 1248374 - DNA, 17 bp, Homo sapiens
actatctgtctggtggc

SEQ ID NO: 1248375 - DNA, 20 bp, Homo sapiens
actatctgtgcgtagaagtt

SEQ ID NO: 1248376 - DNA, 15 bp, Homo sapiens
actatctgttgaaaa

SEQ ID NO: 1248377 - DNA, 16 bp, Homo sapiens
actatctgttgaaaag

SEQ ID NO: 1248378 - DNA, 11 bp, Homo sapiens
actatcttgtg

SEQ ID NO: 1248379 - DNA, 16 bp, Homo sapiens
actatgaaaagctaga

SEQ ID NO: 1248380 - DNA, 16 bp, Homo sapiens
actatgaaaagtgggc

SEQ ID NO: 1248381 - DNA, 18 bp, Homo sapiens
actatgaaaatgctggct

SEQ ID NO: 1248382 - DNA, 15 bp, Homo sapiens
actatgactggagta

SEQ ID NO: 1248383 - DNA, 16 bp, Homo sapiens
actatgataaagttgt

SEQ ID NO: 1248384 - DNA, 14 bp, Homo sapiens
actatgatcacagt

SEQ ID NO: 1248385 - DNA, 15 bp, Homo sapiens
actatgatcacagtg

SEQ ID NO: 1248386 - DNA, 19 bp, Homo sapiens
actatgatgagaggccagc

SEQ ID NO: 1248387 - DNA, 16 bp, Homo sapiens
actatgatgggcttct

SEQ ID NO: 1248388 - DNA, 15 bp, Homo sapiens
actatgattattaac

SEQ ID NO: 1248389 - DNA, 14 bp, Homo sapiens
actatgatttattt

SEQ ID NO: 1248390 - DNA, 17 bp, Homo sapiens
actatgcagaggcctgg

SEQ ID NO: 1248391 - DNA, 22 bp, Homo sapiens
actatggaaaatcagctgctca

SEQ ID NO: 1248392 - DNA, 20 bp, Homo sapiens
actatggagtgcaccaaaga

SEQ ID NO: 1248393 - DNA, 22 bp, Homo sapiens
actatggagtgcaccaaagaga

SEQ ID NO: 1248394 - DNA, 16 bp, Homo sapiens
actatgggatgagaaa

SEQ ID NO: 1248395 - DNA, 22 bp, Homo sapiens
actatggtatgctggccagcac

SEQ ID NO: 1248396 - DNA, 16 bp, Homo sapiens
actatggtatttgagt

SEQ ID NO: 1248397 - DNA, 19 bp, Homo sapiens
actatggttcccaataaaa

SEQ ID NO: 1248398 - DNA, 23 bp, Homo sapiens
actatgtatgtatgtattattat

SEQ ID NO: 1248399 - DNA, 16 bp, Homo sapiens
actatgtctgaacata

SEQ ID NO: 1248400 - DNA, 17 bp, Homo sapiens
actatgtgccagttcct

SEQ ID NO: 1248401 - DNA, 14 bp, Homo sapiens
actattaagcagta

SEQ ID NO: 1248402 - DNA, 20 bp, Homo sapiens
actattaagcagtaaaaact

SEQ ID NO: 1248403 - DNA, 17 bp, Homo sapiens
actattagagtatttcc

SEQ ID NO: 1248404 - DNA, 17 bp, Homo sapiens
actattagcaagaatca

SEQ ID NO: 1248405 - DNA, 17 bp, Homo sapiens
actattataatttaatg

SEQ ID NO: 1248406 - DNA, 21 bp, Homo sapiens
actattataatttaatgcatg

SEQ ID NO: 1248407 - DNA, 16 bp, Homo sapiens
actattcttaagcact

SEQ ID NO: 1248408 - DNA, 21 bp, Homo sapiens
actattcttaagcactttgaa

SEQ ID NO: 1248409 - DNA, 18 bp, Homo sapiens
actattgaagttgcagat

SEQ ID NO: 1248410 - DNA, 22 bp, Homo sapiens
actattgcacatcatattctat

SEQ ID NO: 1248411 - DNA, 13 bp, Homo sapiens
actattggagggt

SEQ ID NO: 1248412 - DNA, 21 bp, Homo sapiens
actattgggctgggaggattt

SEQ ID NO: 1248413 - DNA, 15 bp, Homo sapiens
actattgggtgaata

SEQ ID NO: 1248414 - DNA, 15 bp, Homo sapiens
actattgtaatcatt

SEQ ID NO: 1248415 - DNA, 17 bp, Homo sapiens
actatttaaaataaaga

SEQ ID NO: 1248416 - DNA, 17 bp, Homo sapiens
actatttaaaattggca

SEQ ID NO: 1248417 - DNA, 11 bp, Homo sapiens
actatttaaag

SEQ ID NO: 1248418 - DNA, 21 bp, Homo sapiens
actatttacaagatggactta

SEQ ID NO: 1248419 - DNA, 17 bp, Homo sapiens
actatttactttattaa

SEQ ID NO: 1248420 - DNA, 19 bp, Homo sapiens
actatttatttacaaatgt

SEQ ID NO: 1248421 - DNA, 19 bp, Homo sapiens
actatttgcttatttaata

SEQ ID NO: 1248422 - DNA, 16 bp, Homo sapiens
actattttcatttttg

SEQ ID NO: 1248423 - DNA, 15 bp, Homo sapiens
actcaaaacttaaca

SEQ ID NO: 1248424 - DNA, 13 bp, Homo sapiens
actcaaaagctgg

SEQ ID NO: 1248425 - DNA, 20 bp, Homo sapiens
actcaaaagctgggaaccag

SEQ ID NO: 1248426 - DNA, 14 bp, Homo sapiens
actcaaaatgacag

SEQ ID NO: 1248427 - DNA, 21 bp, Homo sapiens
actcaaactgaggaatttcac

SEQ ID NO: 1248428 - DNA, 23 bp, Homo sapiens
actcaaacttttcccctgtcctg

SEQ ID NO: 1248429 - DNA, 23 bp, Homo sapiens
actcaaatgctcagaccagctct

SEQ ID NO: 1248430 - DNA, 23 bp, Homo sapiens
actcaaatggtgtcatggctgaa

SEQ ID NO: 1248431 - DNA, 19 bp, Homo sapiens
actcaacccattgttgtca

SEQ ID NO: 1248432 - DNA, 15 bp, Homo sapiens
actcaactctgagcc

SEQ ID NO: 1248433 - DNA, 17 bp, Homo sapiens
actcaagaggctgaggc

SEQ ID NO: 1248434 - DNA, 16 bp, Homo sapiens
actcaagagttcagtg

SEQ ID NO: 1248435 - DNA, 15 bp, Homo sapiens
actcaagcagatctc

SEQ ID NO: 1248436 - DNA, 17 bp, Homo sapiens
actcaaggacaggagcc

SEQ ID NO: 1248437 - DNA, 17 bp, Homo sapiens
actcaaggactttgcag

SEQ ID NO: 1248438 - DNA, 22 bp, Homo sapiens
actcaaggaggtggtgaatttt

SEQ ID NO: 1248439 - DNA, 14 bp, Homo sapiens
actcaaggagttgg

SEQ ID NO: 1248440 - DNA, 23 bp, Homo sapiens
actcaaggccaataataaagaca

SEQ ID NO: 1248441 - DNA, 12 bp, Homo sapiens
actcaataaatt

SEQ ID NO: 1248442 - DNA, 17 bp, Homo sapiens
actcaatctccagggct

SEQ ID NO: 1248443 - DNA, 16 bp, Homo sapiens
actcacaatttaaaat

SEQ ID NO: 1248444 - DNA, 17 bp, Homo sapiens
actcacaatttaaaata

SEQ ID NO: 1248445 - DNA, 21 bp, Homo sapiens
actcacacctgaactgaacac

SEQ ID NO: 1248446 - DNA, 22 bp, Homo sapiens
actcacagcttctccaagcatc

SEQ ID NO: 1248447 - DNA, 16 bp, Homo sapiens
actcacagtgctttta

SEQ ID NO: 1248448 - DNA, 12 bp, Homo sapiens
actcacattttg

SEQ ID NO: 1248449 - DNA, 22 bp, Homo sapiens
actcaccacaagctgagcagga

SEQ ID NO: 1248450 - DNA, 12 bp, Homo sapiens
actcaccagccc

SEQ ID NO: 1248451 - DNA, 20 bp, Homo sapiens
actcaccagccccactgcca

SEQ ID NO: 1248452 - DNA, 22 bp, Homo sapiens
actcaccagccccactgccagc

SEQ ID NO: 1248453 - DNA, 16 bp, Homo sapiens
actcaccagccctagc

SEQ ID NO: 1248454 - DNA, 17 bp, Homo sapiens
actcaccagccctagct

SEQ ID NO: 1248455 - DNA, 21 bp, Homo sapiens
actcaccagggtccgcaccag

SEQ ID NO: 1248456 - DNA, 19 bp, Homo sapiens
actcaccagtgtcccctcc

SEQ ID NO: 1248457 - DNA, 23 bp, Homo sapiens
actcaccagtgtcccctccactg

SEQ ID NO: 1248458 - DNA, 15 bp, Homo sapiens
actcaccatgtaaaa

SEQ ID NO: 1248459 - DNA, 12 bp, Homo sapiens
actcacccaagc

SEQ ID NO: 1248460 - DNA, 17 bp, Homo sapiens
actcacccatgtgccaa

SEQ ID NO: 1248461 - DNA, 18 bp, Homo sapiens
actcacccatgtgccaag

SEQ ID NO: 1248462 - DNA, 22 bp, Homo sapiens
actcaccctgggagccagtcct

SEQ ID NO: 1248463 - DNA, 19 bp, Homo sapiens
actcacccttcctggccca

SEQ ID NO: 1248464 - DNA, 14 bp, Homo sapiens
actccctcttccaa

SEQ ID NO: 1248465 - DNA, 16 bp, Homo sapiens
actccctgagtctgga

SEQ ID NO: 1248466 - DNA, 19 bp, Homo sapiens
actccctgccattttttaa

SEQ ID NO: 1248467 - DNA, 19 bp, Homo sapiens
actccctgcccttccccct

SEQ ID NO: 1248468 - DNA, 21 bp, Homo sapiens
actccctgggacacagaccca

SEQ ID NO: 1248469 - DNA, 16 bp, Homo sapiens
actcccttcctggcct

SEQ ID NO: 1248470 - DNA, 17 bp, Homo sapiens
actcccttcctggcctc

SEQ ID NO: 1248471 - DNA, 20 bp, Homo sapiens
actcccttctcgtgtttgct

SEQ ID NO: 1248472 - DNA, 17 bp, Homo sapiens
actcccttgctggcccc

SEQ ID NO: 1248473 - DNA, 19 bp, Homo sapiens
actcccttgctggccccag

SEQ ID NO: 1248474 - DNA, 14 bp, Homo sapiens
actcccttgggctc

SEQ ID NO: 1248475 - DNA, 14 bp, Homo sapiens
actccctttaaaga

SEQ ID NO: 1248476 - DNA, 17 bp, Homo sapiens
actccctttaaagagag

SEQ ID NO: 1248477 - DNA, 16 bp, Homo sapiens
actccgaagaaaagaa

SEQ ID NO: 1248478 - DNA, 15 bp, Homo sapiens
actccgcatcacctc

SEQ ID NO: 1248479 - DNA, 16 bp, Homo sapiens
actccgcccagcctct

SEQ ID NO: 1248480 - DNA, 22 bp, Homo sapiens
actccgcccagcctctccccgc

SEQ ID NO: 1248481 - DNA, 16 bp, Homo sapiens
actccgcccccagcct

SEQ ID NO: 1248482 - DNA, 21 bp, Homo sapiens
actccgcccccagcctatgag

SEQ ID NO: 1248483 - DNA, 22 bp, Homo sapiens
actccgcgccgatgccaccggc

SEQ ID NO: 1248484 - DNA, 14 bp, Homo sapiens
actccggagacagg

SEQ ID NO: 1248485 - DNA, 13 bp, Homo sapiens
actccggccctcc

SEQ ID NO: 1248486 - DNA, 21 bp, Homo sapiens
actccggggccccactggctg

SEQ ID NO: 1248487 - DNA, 15 bp, Homo sapiens
actccggtgtgcctg

SEQ ID NO: 1248488 - DNA, 21 bp, Homo sapiens
actccggtgtgcctgcagccc

SEQ ID NO: 1248489 - DNA, 16 bp, Homo sapiens
actccgtgtgcctggg

SEQ ID NO: 1248490 - DNA, 14 bp, Homo sapiens
actccgttcctggc

SEQ ID NO: 1248491 - DNA, 15 bp, Homo sapiens
actccgttcctggca

SEQ ID NO: 1248492 - DNA, 17 bp, Homo sapiens
actccgttggccactcc

SEQ ID NO: 1248493 - DNA, 18 bp, Homo sapiens
actccgttggccactccg

SEQ ID NO: 1248494 - DNA, 19 bp, Homo sapiens
actcctaattttaaataat

SEQ ID NO: 1248495 - DNA, 21 bp, Homo sapiens
actcctaattttaaataattt

SEQ ID NO: 1248496 - DNA, 17 bp, Homo sapiens
actcctacctcagccta

SEQ ID NO: 1248497 - DNA, 14 bp, Homo sapiens
actcctacctggta

SEQ ID NO: 1248498 - DNA, 20 bp, Homo sapiens
actcctcaaaagcaaatgag

SEQ ID NO: 1248499 - DNA, 21 bp, Homo sapiens
actcctcaaaagcaaatgaga

SEQ ID NO: 1248500 - DNA, 15 bp, Homo sapiens
actcctcaaaccact

SEQ ID NO: 1248501 - DNA, 18 bp, Homo sapiens
actcctcaaaccacttgc

SEQ ID NO: 1248502 - DNA, 19 bp, Homo sapiens
actcctcaaaccacttgcc

SEQ ID NO: 1248503 - DNA, 21 bp, Homo sapiens
actcctcaaaccacttgcctg

SEQ ID NO: 1248504 - DNA, 15 bp, Homo sapiens
actcctcaagacttt

SEQ ID NO: 1248505 - DNA, 19 bp, Homo sapiens
actcctcaagactttgatc

SEQ ID NO: 1248506 - DNA, 12 bp, Homo sapiens
actcctcccaca

SEQ ID NO: 1248507 - DNA, 13 bp, Homo sapiens
actcctcccacaa

SEQ ID NO: 1248508 - DNA, 11 bp, Homo sapiens
actcctccctc

SEQ ID NO: 1248509 - DNA, 18 bp, Homo sapiens
actcctcctcactaaaaa

SEQ ID NO: 1248510 - DNA, 11 bp, Homo sapiens
actcctcctct

SEQ ID NO: 1248511 - DNA, 12 bp, Homo sapiens
actcctcctctt

SEQ ID NO: 1248512 - DNA, 22 bp, Homo sapiens
actcctcctctttctctcccca

SEQ ID NO: 1248513 - DNA, 16 bp, Homo sapiens
actcctcctttttcca

SEQ ID NO: 1248514 - DNA, 21 bp, Homo sapiens
actcctctaagccactcttcc

SEQ ID NO: 1248515 - DNA, 22 bp, Homo sapiens
actcctctcccacagagtgctg

SEQ ID NO: 1248516 - DNA, 18 bp, Homo sapiens
actcctctctagggcaga

SEQ ID NO: 1248517 - DNA, 18 bp, Homo sapiens
actcctctgaccctcctt

SEQ ID NO: 1248518 - DNA, 20 bp, Homo sapiens
actcctctgactcagggctc

SEQ ID NO: 1248519 - DNA, 21 bp, Homo sapiens
actcctctgctgacctgctga

SEQ ID NO: 1248520 - DNA, 14 bp, Homo sapiens
actcctctggcttt

SEQ ID NO: 1248521 - DNA, 18 bp, Homo sapiens
actcctctggctttccca

SEQ ID NO: 1248522 - DNA, 21 bp, Homo sapiens
actcctctggctttcccagga

SEQ ID NO: 1248523 - DNA, 14 bp, Homo sapiens
actcctctgggcct

SEQ ID NO: 1248524 - DNA, 15 bp, Homo sapiens
actcctctgggcctg

SEQ ID NO: 1248525 - DNA, 19 bp, Homo sapiens
actcctctgggcctggggt

SEQ ID NO: 1248526 - DNA, 16 bp, Homo sapiens
actcctgaaattcaga

SEQ ID NO: 1248527 - DNA, 21 bp, Homo sapiens
actcctgacccctctcctcaa

SEQ ID NO: 1248528 - DNA, 15 bp, Homo sapiens
actcctgacctcaag

SEQ ID NO: 1248529 - DNA, 21 bp, Homo sapiens
actcctgaggacagctgtcct

SEQ ID NO: 1248530 - DNA, 17 bp, Homo sapiens
actcctgatgccctctt

SEQ ID NO: 1248531 - DNA, 21 bp, Homo sapiens
actcctgatgccctcttctcc

SEQ ID NO: 1248532 - DNA, 20 bp, Homo sapiens
actcctgattttgtagttaa

SEQ ID NO: 1248533 - DNA, 13 bp, Homo sapiens
actcctgcaaaat

SEQ ID NO: 1248534 - DNA, 15 bp, Homo sapiens
actcctgccaggcac

SEQ ID NO: 1248535 - DNA, 14 bp, Homo sapiens
actcctgccctgtt

SEQ ID NO: 1248536 - DNA, 17 bp, Homo sapiens
actcctgcggctgcctg

SEQ ID NO: 1248537 - DNA, 21 bp, Homo sapiens
actcctgcggctgcctgcccc

SEQ ID NO: 1248538 - DNA, 20 bp, Homo sapiens
actcctgcttctctcagcca

SEQ ID NO: 1248539 - DNA, 12 bp, Homo sapiens
actcctggaaat

SEQ ID NO: 1248540 - DNA, 11 bp, Homo sapiens
actcctggact

SEQ ID NO: 1248541 - DNA, 17 bp, Homo sapiens
actcctggactccggag

SEQ ID NO: 1248542 - DNA, 22 bp, Homo sapiens
actcctggactccggaggactg

SEQ ID NO: 1248543 - DNA, 16 bp, Homo sapiens
actcctggcagggcca

SEQ ID NO: 1248544 - DNA, 20 bp, Homo sapiens
actcctggcagggccacctg

SEQ ID NO: 1248545 - DNA, 23 bp, Homo sapiens
actcctggcagggccacctgcag

SEQ ID NO: 1248546 - DNA, 19 bp, Homo sapiens
actcctggctcaagccctg

SEQ ID NO: 1248547 - DNA, 18 bp, Homo sapiens
actcctgggctcaagcaa

SEQ ID NO: 1248548 - DNA, 18 bp, Homo sapiens
actcctgggctcaagtga

SEQ ID NO: 1248549 - DNA, 13 bp, Homo sapiens
actcctgggctct

SEQ ID NO: 1248550 - DNA, 16 bp, Homo sapiens
actcctgtacactgaa

SEQ ID NO: 1248551 - DNA, 12 bp, Homo sapiens
actcctgtcccg

SEQ ID NO: 1248552 - DNA, 16 bp, Homo sapiens
actcctgtccctgtag

SEQ ID NO: 1248553 - DNA, 14 bp, Homo sapiens
actcctgtgctctg

SEQ ID NO: 1248554 - DNA, 16 bp, Homo sapiens
actcctgtgctctgga

SEQ ID NO: 1248555 - DNA, 15 bp, Homo sapiens
actccttattttgta

SEQ ID NO: 1248556 - DNA, 20 bp, Homo sapiens
actccttcaacaattctaaa

SEQ ID NO: 1248557 - DNA, 22 bp, Homo sapiens
actccttcaacaattctaaaat

SEQ ID NO: 1248558 - DNA, 23 bp, Homo sapiens
actccttccagtgtccttagaac

SEQ ID NO: 1248559 - DNA, 15 bp, Homo sapiens
actccttcctggcct

SEQ ID NO: 1248560 - DNA, 16 bp, Homo sapiens
actccttcctggcctg

SEQ ID NO: 1248561 - DNA, 19 bp, Homo sapiens
actccttcctggcctgaga

SEQ ID NO: 1248562 - DNA, 20 bp, Homo sapiens
actccttcctggcctgagag

SEQ ID NO: 1248563 - DNA, 19 bp, Homo sapiens
actccttccttcaggactc

SEQ ID NO: 1248564 - DNA, 22 bp, Homo sapiens
actccttccttcaggactctgc

SEQ ID NO: 1248565 - DNA, 23 bp, Homo sapiens
actccttccttcaggactctgcg

SEQ ID NO: 1248566 - DNA, 16 bp, Homo sapiens
actccttctctcactg

SEQ ID NO: 1248567 - DNA, 21 bp, Homo sapiens
actccttgtggactggctgtg

SEQ ID NO: 1248568 - DNA, 17 bp, Homo sapiens
actcctttatctgtaat

SEQ ID NO: 1248569 - DNA, 14 bp, Homo sapiens
actcgaaactgaca

SEQ ID NO: 1248570 - DNA, 13 bp, Homo sapiens
actcgacccagaa

SEQ ID NO: 1248571 - DNA, 20 bp, Homo sapiens
actcgagaccatcctggccc

SEQ ID NO: 1248572 - DNA, 17 bp, Homo sapiens
actcgagaccttttcaa

SEQ ID NO: 1248573 - DNA, 13 bp, Homo sapiens
actcgaggcctgc

SEQ ID NO: 1248574 - DNA, 11 bp, Homo sapiens
actcgatgcac

SEQ ID NO: 1248575 - DNA, 13 bp, Homo sapiens
actcgatgcactg

SEQ ID NO: 1248576 - DNA, 13 bp, Homo sapiens
actcgcaggacca

SEQ ID NO: 1248577 - DNA, 17 bp, Homo sapiens
actcgcaggaccaaggg

SEQ ID NO: 1248578 - DNA, 16 bp, Homo sapiens
actcgcagtcgcagga

SEQ ID NO: 1248579 - DNA, 20 bp, Homo sapiens
actcgcccgcccactgtcct

SEQ ID NO: 1248580 - DNA, 16 bp, Homo sapiens
actcggctctgcagtc

SEQ ID NO: 1248581 - DNA, 15 bp, Homo sapiens
actcgggagctgcac

SEQ ID NO: 1248582 - DNA, 16 bp, Homo sapiens
actcgggagctgcaca

SEQ ID NO: 1248583 - DNA, 17 bp, Homo sapiens
actcgggagctgcacac

SEQ ID NO: 1248584 - DNA, 22 bp, Homo sapiens
actcgggaggctgagacaggag

SEQ ID NO: 1248585 - DNA, 21 bp, Homo sapiens
actcgggaggctgaggcagga

SEQ ID NO: 1248586 - DNA, 20 bp, Homo sapiens
actgaagccacttggcccag

SEQ ID NO: 1248587 - DNA, 18 bp, Homo sapiens
actgaagccagaaataaa

SEQ ID NO: 1248588 - DNA, 14 bp, Homo sapiens
actgaagcctgcag

SEQ ID NO: 1248589 - DNA, 20 bp, Homo sapiens
actgaaggaaaaacacaagc

SEQ ID NO: 1248590 - DNA, 23 bp, Homo sapiens
actgaaggaaaaacacaagcaaa

SEQ ID NO: 1248591 - DNA, 13 bp, Homo sapiens
actgaaggaaaag

SEQ ID NO: 1248592 - DNA, 19 bp, Homo sapiens
actgaaggaaaagcaagaa

SEQ ID NO: 1248593 - DNA, 21 bp, Homo sapiens
actgaaggagaaggtgcccca

SEQ ID NO: 1248594 - DNA, 19 bp, Homo sapiens
actgaaggctaaaaagcaa

SEQ ID NO: 1248595 - DNA, 16 bp, Homo sapiens
actgaaggggcacacc

SEQ ID NO: 1248596 - DNA, 23 bp, Homo sapiens
actgaaggggtgcacccacctgt

SEQ ID NO: 1248597 - DNA, 21 bp, Homo sapiens
actgaaggttttttttttaag

SEQ ID NO: 1248598 - DNA, 19 bp, Homo sapiens
actgaagtaaacagctgtg

SEQ ID NO: 1248599 - DNA, 13 bp, Homo sapiens
actgaagtgctta

SEQ ID NO: 1248600 - DNA, 17 bp, Homo sapiens
actgaagtgcttagtgt

SEQ ID NO: 1248601 - DNA, 16 bp, Homo sapiens
actgaagtgcttgcag

SEQ ID NO: 1248602 - DNA, 20 bp, Homo sapiens
actgaagtggccctccctca

SEQ ID NO: 1248603 - DNA, 13 bp, Homo sapiens
actgaagtggctg

SEQ ID NO: 1248604 - DNA, 22 bp, Homo sapiens
actgaagtggctggtagaaaaa

SEQ ID NO: 1248605 - DNA, 17 bp, Homo sapiens
actgaagttaacagaga

SEQ ID NO: 1248606 - DNA, 15 bp, Homo sapiens
actgaagtttcacat

SEQ ID NO: 1248607 - DNA, 16 bp, Homo sapiens
actgaagtttcacatg

SEQ ID NO: 1248608 - DNA, 15 bp, Homo sapiens
actgaataaattcag

SEQ ID NO: 1248609 - DNA, 13 bp, Homo sapiens
actgaataccact

SEQ ID NO: 1248610 - DNA, 17 bp, Homo sapiens
actgaataccactctgt

SEQ ID NO: 1248611 - DNA, 18 bp, Homo sapiens
actgaataccactctgta

SEQ ID NO: 1248612 - DNA, 19 bp, Homo sapiens
actgaataccactctgtaa

SEQ ID NO: 1248613 - DNA, 22 bp, Homo sapiens
actgaataccactctgtaattg

SEQ ID NO: 1248614 - DNA, 13 bp, Homo sapiens
actgaatatataa

SEQ ID NO: 1248615 - DNA, 14 bp, Homo sapiens
actgaatattttgg

SEQ ID NO: 1248616 - DNA, 15 bp, Homo sapiens
actgaatattttgga

SEQ ID NO: 1248617 - DNA, 17 bp, Homo sapiens
actgaatattttggaaa

SEQ ID NO: 1248618 - DNA, 20 bp, Homo sapiens
actgaatattttggaaactg

SEQ ID NO: 1248619 - DNA, 18 bp, Homo sapiens
actgaatcaggaaactca

SEQ ID NO: 1248620 - DNA, 15 bp, Homo sapiens
actgaatcatgttaa

SEQ ID NO: 1248621 - DNA, 23 bp, Homo sapiens
actgaatcatgttaatagacagt

SEQ ID NO: 1248622 - DNA, 19 bp, Homo sapiens
actgaatctcccctcctca

SEQ ID NO: 1248623 - DNA, 21 bp, Homo sapiens
actgaatctcccctcctcaca

SEQ ID NO: 1248624 - DNA, 14 bp, Homo sapiens
actgaatcttcacg

SEQ ID NO: 1248625 - DNA, 19 bp, Homo sapiens
actgaatgaatccattgga

SEQ ID NO: 1248626 - DNA, 12 bp, Homo sapiens
actgaatgaggt

SEQ ID NO: 1248627 - DNA, 20 bp, Homo sapiens
actgaatgaggtcagcatgt

SEQ ID NO: 1248628 - DNA, 12 bp, Homo sapiens
actgaatgtaag

SEQ ID NO: 1248629 - DNA, 15 bp, Homo sapiens
actgaattctgcctt

SEQ ID NO: 1248630 - DNA, 19 bp, Homo sapiens
actgaattttaaatgttca

SEQ ID NO: 1248631 - DNA, 21 bp, Homo sapiens
actgaattttaaatgttcaca

SEQ ID NO: 1248632 - DNA, 16 bp, Homo sapiens
actgaatttttttgta

SEQ ID NO: 1248633 - DNA, 19 bp, Homo sapiens
actgacaatgaagggaaat

SEQ ID NO: 1248634 - DNA, 20 bp, Homo sapiens
actgacagcatgtgccctcc

SEQ ID NO: 1248635 - DNA, 20 bp, Homo sapiens
actgacaggcagcctggaca

SEQ ID NO: 1248636 - DNA, 21 bp, Homo sapiens
actgacatgccctcccttctc

SEQ ID NO: 1248637 - DNA, 12 bp, Homo sapiens
actgacatgtgg

SEQ ID NO: 1248638 - DNA, 22 bp, Homo sapiens
actgacatgtggggccaggtca

SEQ ID NO: 1248639 - DNA, 20 bp, Homo sapiens
actgaccaatattgtacagt

SEQ ID NO: 1248640 - DNA, 22 bp, Homo sapiens
actgaccaatattgtacagttt

SEQ ID NO: 1248641 - DNA, 23 bp, Homo sapiens
actgaccagcctccatgctgcct

SEQ ID NO: 1248642 - DNA, 16 bp, Homo sapiens
actgaccatccactct

SEQ ID NO: 1248643 - DNA, 23 bp, Homo sapiens
actgaccatccactctaccctcc

SEQ ID NO: 1248644 - DNA, 14 bp, Homo sapiens
actgacccacctgc

SEQ ID NO: 1248645 - DNA, 19 bp, Homo sapiens
actgacccactcggatgga

SEQ ID NO: 1248646 - DNA, 21 bp, Homo sapiens
actgacccccatctgagctgg

SEQ ID NO: 1248647 - DNA, 14 bp, Homo sapiens
actgaccccctccc

SEQ ID NO: 1248648 - DNA, 16 bp, Homo sapiens
actgaccccctcccct

SEQ ID NO: 1248649 - DNA, 19 bp, Homo sapiens
actgaccctgaggaggccg

SEQ ID NO: 1248650 - DNA, 22 bp, Homo sapiens
actgaccctgcaggttgttcat

SEQ ID NO: 1248651 - DNA, 15 bp, Homo sapiens
actgacccttgaacc

SEQ ID NO: 1248652 - DNA, 21 bp, Homo sapiens
actgaccgggatccagttcca

SEQ ID NO: 1248653 - DNA, 22 bp, Homo sapiens
actgacctgtcatgcccccctc

SEQ ID NO: 1248654 - DNA, 22 bp, Homo sapiens
actgactgtcgggctttaaaaa

SEQ ID NO: 1248655 - DNA, 21 bp, Homo sapiens
actgacttcagtgggactcgg

SEQ ID NO: 1248656 - DNA, 16 bp, Homo sapiens
actgacttcatttgtg

SEQ ID NO: 1248657 - DNA, 13 bp, Homo sapiens
actgacttgagac

SEQ ID NO: 1248658 - DNA, 12 bp, Homo sapiens
actgactttctc

SEQ ID NO: 1248659 - DNA, 15 bp, Homo sapiens
actgactttgcttgc

SEQ ID NO: 1248660 - DNA, 17 bp, Homo sapiens
actgactttgcttgctt

SEQ ID NO: 1248661 - DNA, 21 bp, Homo sapiens
actgagaaggcaggcctccgt

SEQ ID NO: 1248662 - DNA, 23 bp, Homo sapiens
actgagaaggcaggcctccgtct

SEQ ID NO: 1248663 - DNA, 16 bp, Homo sapiens
actgagaccaaggctt

SEQ ID NO: 1248664 - DNA, 17 bp, Homo sapiens
actgagacttgttcttg

SEQ ID NO: 1248665 - DNA, 19 bp, Homo sapiens
actgagacttgttcttggt

SEQ ID NO: 1248666 - DNA, 20 bp, Homo sapiens
actgagagatgcagaaatat

SEQ ID NO: 1248667 - DNA, 18 bp, Homo sapiens
actgagataccagcgagg

SEQ ID NO: 1248668 - DNA, 14 bp, Homo sapiens
actgagatcactga

SEQ ID NO: 1248669 - DNA, 19 bp, Homo sapiens
actgagatcactgactctg

SEQ ID NO: 1248670 - DNA, 17 bp, Homo sapiens
actgagattttggtatt

SEQ ID NO: 1248671 - DNA, 15 bp, Homo sapiens
actgagcacagtcag

SEQ ID NO: 1248672 - DNA, 20 bp, Homo sapiens
actgagcacagtcaggggct

SEQ ID NO: 1248673 - DNA, 15 bp, Homo sapiens
actgagcagccgcca

SEQ ID NO: 1248674 - DNA, 16 bp, Homo sapiens
actgagccaaggaggc

SEQ ID NO: 1248675 - DNA, 13 bp, Homo sapiens
actgagcccccac

SEQ ID NO: 1248676 - DNA, 22 bp, Homo sapiens
actgagcccccccaacactgtg

SEQ ID NO: 1248677 - DNA, 12 bp, Homo sapiens
actgagccctct

SEQ ID NO: 1248678 - DNA, 19 bp, Homo sapiens
actgagctccccagatctc

SEQ ID NO: 1248679 - DNA, 19 bp, Homo sapiens
actgagctcctctgggcag

SEQ ID NO: 1248680 - DNA, 14 bp, Homo sapiens
actgagctctccag

SEQ ID NO: 1248681 - DNA, 23 bp, Homo sapiens
actgagctttagacagcagagca

SEQ ID NO: 1248682 - DNA, 16 bp, Homo sapiens
actgaggaattttctt

SEQ ID NO: 1248683 - DNA, 20 bp, Homo sapiens
actgaggaattttctttgtg

SEQ ID NO: 1248684 - DNA, 18 bp, Homo sapiens
actgaggagatgaccagg

SEQ ID NO: 1248685 - DNA, 20 bp, Homo sapiens
actgaggagatgaccaggga

SEQ ID NO: 1248686 - DNA, 20 bp, Homo sapiens
actgaggaggaggctgcaca

SEQ ID NO: 1248687 - DNA, 15 bp, Homo sapiens
actgaggatattcag

SEQ ID NO: 1248688 - DNA, 19 bp, Homo sapiens
actgaggcagacagcagct

SEQ ID NO: 1248689 - DNA, 23 bp, Homo sapiens
actgaggcagacagcagctcagg

SEQ ID NO: 1248690 - DNA, 21 bp, Homo sapiens
actgaggccttgtgtgtcagg

SEQ ID NO: 1248691 - DNA, 19 bp, Homo sapiens
actgaggcttagagagagg

SEQ ID NO: 1248692 - DNA, 23 bp, Homo sapiens
actgaggcttagagagaggaggc

SEQ ID NO: 1248693 - DNA, 20 bp, Homo sapiens
actgagggattttagcctct

SEQ ID NO: 1248694 - DNA, 16 bp, Homo sapiens
actgagggcagtgccc

SEQ ID NO: 1248695 - DNA, 18 bp, Homo sapiens
actgagggcagtgccctt

SEQ ID NO: 1248696 - DNA, 16 bp, Homo sapiens
actgaggggattctct

SEQ ID NO: 1248697 - DNA, 19 bp, Homo sapiens
actgaggtatggccatgcc

SEQ ID NO: 1248698 - DNA, 18 bp, Homo sapiens
actgagtaaattggaaac

SEQ ID NO: 1248699 - DNA, 20 bp, Homo sapiens
actgagtaaattggaaacat

SEQ ID NO: 1248700 - DNA, 16 bp, Homo sapiens
actgagtccatgaaaa

SEQ ID NO: 1248701 - DNA, 23 bp, Homo sapiens
actgagtgactctatatagctga

SEQ ID NO: 1248702 - DNA, 22 bp, Homo sapiens
actgagtgttcaaactactgta

SEQ ID NO: 1248703 - DNA, 15 bp, Homo sapiens
actgataaagaaaga

SEQ ID NO: 1248704 - DNA, 19 bp, Homo sapiens
actgatagcttacactgag

SEQ ID NO: 1248705 - DNA, 14 bp, Homo sapiens
actgatagtccttt

SEQ ID NO: 1248706 - DNA, 16 bp, Homo sapiens
actgatatattttaca

SEQ ID NO: 1248707 - DNA, 21 bp, Homo sapiens
actgcttacctactttcttca

SEQ ID NO: 1248708 - DNA, 17 bp, Homo sapiens
actgcttacttatgcca

SEQ ID NO: 1248709 - DNA, 17 bp, Homo sapiens
actgcttcccatcctac

SEQ ID NO: 1248710 - DNA, 22 bp, Homo sapiens
actgcttctagaaactctggct

SEQ ID NO: 1248711 - DNA, 19 bp, Homo sapiens
actgcttctcggccagccc

SEQ ID NO: 1248712 - DNA, 21 bp, Homo sapiens
actgcttgaccgtactctcac

SEQ ID NO: 1248713 - DNA, 18 bp, Homo sapiens
actgcttgaggaaaacaa

SEQ ID NO: 1248714 - DNA, 18 bp, Homo sapiens
actgcttgatgaagcaag

SEQ ID NO: 1248715 - DNA, 13 bp, Homo sapiens
actgcttgcccag

SEQ ID NO: 1248716 - DNA, 14 bp, Homo sapiens
actgcttgcccagg

SEQ ID NO: 1248717 - DNA, 17 bp, Homo sapiens
actgcttgcccagggtg

SEQ ID NO: 1248718 - DNA, 15 bp, Homo sapiens
actgctttgcaaaga

SEQ ID NO: 1248719 - DNA, 23 bp, Homo sapiens
actgctttgtttggatgcctcag

SEQ ID NO: 1248720 - DNA, 19 bp, Homo sapiens
actgcttttcattagcagt

SEQ ID NO: 1248721 - DNA, 19 bp, Homo sapiens
actgcttttcctcaagcaa

SEQ ID NO: 1248722 - DNA, 21 bp, Homo sapiens
actgcttttcctcaagcaata

SEQ ID NO: 1248723 - DNA, 18 bp, Homo sapiens
actgcttttttttttcca

SEQ ID NO: 1248724 - DNA, 21 bp, Homo sapiens
actgcttttttttttccagca

SEQ ID NO: 1248725 - DNA, 18 bp, Homo sapiens
actggaaaacagaacact

SEQ ID NO: 1248726 - DNA, 20 bp, Homo sapiens
actggaaaggggagagcctg

SEQ ID NO: 1248727 - DNA, 21 bp, Homo sapiens
actggaaaggggagagcctgc

SEQ ID NO: 1248728 - DNA, 22 bp, Homo sapiens
actggaaaggggagagcctgct

SEQ ID NO: 1248729 - DNA, 22 bp, Homo sapiens
actggaaattccaggaaccaaa

SEQ ID NO: 1248730 - DNA, 21 bp, Homo sapiens
actggaagacacttcagatct

SEQ ID NO: 1248731 - DNA, 23 bp, Homo sapiens
actggaagatcccctctcctgcc

SEQ ID NO: 1248732 - DNA, 19 bp, Homo sapiens
actggaagcacagcctcgg

SEQ ID NO: 1248733 - DNA, 21 bp, Homo sapiens
actggaagcatgtaggagaat

SEQ ID NO: 1248734 - DNA, 19 bp, Homo sapiens
actggaagctaatttgcat

SEQ ID NO: 1248735 - DNA, 21 bp, Homo sapiens
actggaagttgtggatatcag

SEQ ID NO: 1248736 - DNA, 17 bp, Homo sapiens
actggaagttttgcatt

SEQ ID NO: 1248737 - DNA, 14 bp, Homo sapiens
actggacaaagaat

SEQ ID NO: 1248738 - DNA, 15 bp, Homo sapiens
actggacaacactga

SEQ ID NO: 1248739 - DNA, 22 bp, Homo sapiens
actggacacactaaactctggg

SEQ ID NO: 1248740 - DNA, 15 bp, Homo sapiens
actggacagcttgtg

SEQ ID NO: 1248741 - DNA, 14 bp, Homo sapiens
actggacatggccc

SEQ ID NO: 1248742 - DNA, 16 bp, Homo sapiens
actggacatggcccat

SEQ ID NO: 1248743 - DNA, 13 bp, Homo sapiens
actggaccccact

SEQ ID NO: 1248744 - DNA, 14 bp, Homo sapiens
actggaccccactg

SEQ ID NO: 1248745 - DNA, 16 bp, Homo sapiens
actggaccccactggc

SEQ ID NO: 1248746 - DNA, 19 bp, Homo sapiens
actggaccccactggctga

SEQ ID NO: 1248747 - DNA, 19 bp, Homo sapiens
actggaccgctgactgcac

SEQ ID NO: 1248748 - DNA, 13 bp, Homo sapiens
actggacctgggg

SEQ ID NO: 1248749 - DNA, 22 bp, Homo sapiens
actggacctttgggttctttct

SEQ ID NO: 1248750 - DNA, 12 bp, Homo sapiens
actggactcagg

SEQ ID NO: 1248751 - DNA, 15 bp, Homo sapiens
actggacttgaatgg

SEQ ID NO: 1248752 - DNA, 19 bp, Homo sapiens
actggagaaaacccctccc

SEQ ID NO: 1248753 - DNA, 17 bp, Homo sapiens
actggagaagtcttaga

SEQ ID NO: 1248754 - DNA, 16 bp, Homo sapiens
actggagcaccaggca

SEQ ID NO: 1248755 - DNA, 14 bp, Homo sapiens
actggagcccagga

SEQ ID NO: 1248756 - DNA, 17 bp, Homo sapiens
actggaggagagaagaa

SEQ ID NO: 1248757 - DNA, 19 bp, Homo sapiens
actggaggtcacattcagg

SEQ ID NO: 1248758 - DNA, 12 bp, Homo sapiens
actggagtcccg

SEQ ID NO: 1248759 - DNA, 21 bp, Homo sapiens
actggagtgatgttagcagac

SEQ ID NO: 1248760 - DNA, 15 bp, Homo sapiens
actggagttacatta

SEQ ID NO: 1248761 - DNA, 19 bp, Homo sapiens
actggataaattgtttagt

SEQ ID NO: 1248762 - DNA, 14 bp, Homo sapiens
actggatatgttgt

SEQ ID NO: 1248763 - DNA, 10 bp, Homo sapiens
actggatctt

SEQ ID NO: 1248764 - DNA, 16 bp, Homo sapiens
actggatcttctatca

SEQ ID NO: 1248765 - DNA, 13 bp, Homo sapiens
actggatgaagat

SEQ ID NO: 1248766 - DNA, 17 bp, Homo sapiens
actggatgcagaaacag

SEQ ID NO: 1248767 - DNA, 21 bp, Homo sapiens
actggattaaaaaaatgtggt

SEQ ID NO: 1248768 - DNA, 15 bp, Homo sapiens
actggattaaactta

SEQ ID NO: 1248769 - DNA, 22 bp, Homo sapiens
actggattttgaacgcttaagt

SEQ ID NO: 1248770 - DNA, 23 bp, Homo sapiens
actggcaaaatagttctgcaggt

SEQ ID NO: 1248771 - DNA, 16 bp, Homo sapiens
actggcaaacttcaga

SEQ ID NO: 1248772 - DNA, 20 bp, Homo sapiens
actggcaaacttcagactga

SEQ ID NO: 1248773 - DNA, 15 bp, Homo sapiens
actggcaaagcagaa

SEQ ID NO: 1248774 - DNA, 14 bp, Homo sapiens
actggcaataaact

SEQ ID NO: 1248775 - DNA, 16 bp, Homo sapiens
actggcacacacccct

SEQ ID NO: 1248776 - DNA, 14 bp, Homo sapiens
actggcacagaggt

SEQ ID NO: 1248777 - DNA, 20 bp, Homo sapiens
actggcactgaattaatcat

SEQ ID NO: 1248778 - DNA, 20 bp, Homo sapiens
actggcagaaacaggaggct

SEQ ID NO: 1248779 - DNA, 23 bp, Homo sapiens
actggcagactcaaggggctgga

SEQ ID NO: 1248780 - DNA, 12 bp, Homo sapiens
actggcagagca

SEQ ID NO: 1248781 - DNA, 20 bp, Homo sapiens
actggcagagcacagcccac

SEQ ID NO: 1248782 - DNA, 14 bp, Homo sapiens
actggcagcatctt

SEQ ID NO: 1248783 - DNA, 22 bp, Homo sapiens
actggcaggagggtgaggaggt

SEQ ID NO: 1248784 - DNA, 21 bp, Homo sapiens
actggcaggtgcagatgggct

SEQ ID NO: 1248785 - DNA, 23 bp, Homo sapiens
actggcaggtgcagatgggctgt

SEQ ID NO: 1248786 - DNA, 21 bp, Homo sapiens
actggcagtaacctagtgaat

SEQ ID NO: 1248787 - DNA, 20 bp, Homo sapiens
actggcatctgacacaaaaa

SEQ ID NO: 1248788 - DNA, 21 bp, Homo sapiens
actggcatggatatagtttta

SEQ ID NO: 1248789 - DNA, 23 bp, Homo sapiens
actggcatggatatagttttact

SEQ ID NO: 1248790 - DNA, 19 bp, Homo sapiens
actggcatggattaataga

SEQ ID NO: 1248791 - DNA, 21 bp, Homo sapiens
actggcattgtccctgtgcct

SEQ ID NO: 1248792 - DNA, 14 bp, Homo sapiens
actggccaccaggc

SEQ ID NO: 1248793 - DNA, 16 bp, Homo sapiens
actggccaccaggctg

SEQ ID NO: 1248794 - DNA, 23 bp, Homo sapiens
actggccaccaggctggcgcagc

SEQ ID NO: 1248795 - DNA, 21 bp, Homo sapiens
actggccagagagggcccagc

SEQ ID NO: 1248796 - DNA, 11 bp, Homo sapiens
actggccaggg

SEQ ID NO: 1248797 - DNA, 22 bp, Homo sapiens
actggccagggccacgctccag

SEQ ID NO: 1248798 - DNA, 14 bp, Homo sapiens
actggccgctgagc

SEQ ID NO: 1248799 - DNA, 17 bp, Homo sapiens
actggcctcaaagcaag

SEQ ID NO: 1248800 - DNA, 17 bp, Homo sapiens
actggcctctgtgatta

SEQ ID NO: 1248801 - DNA, 23 bp, Homo sapiens
actggcctctgtgattacataga

SEQ ID NO: 1248802 - DNA, 21 bp, Homo sapiens
actggcgtgaacccaggaggc

SEQ ID NO: 1248803 - DNA, 18 bp, Homo sapiens
actggctagagtcctcac

SEQ ID NO: 1248804 - DNA, 21 bp, Homo sapiens
actggctagagtcctcactcc

SEQ ID NO: 1248805 - DNA, 12 bp, Homo sapiens
actggctcatgc

SEQ ID NO: 1248806 - DNA, 13 bp, Homo sapiens
actggctcatgcc

SEQ ID NO: 1248807 - DNA, 16 bp, Homo sapiens
actggctcatgcccct

SEQ ID NO: 1248808 - DNA, 21 bp, Homo sapiens
actggctcatgcctcagcccg

SEQ ID NO: 1248809 - DNA, 17 bp, Homo sapiens
actggctctcctggccc

SEQ ID NO: 1248810 - DNA, 18 bp, Homo sapiens
actggctgaacttggaga

SEQ ID NO: 1248811 - DNA, 21 bp, Homo sapiens
actggctgagaatctgggggt

SEQ ID NO: 1248812 - DNA, 23 bp, Homo sapiens
actggctgggcccctggggacag

SEQ ID NO: 1248813 - DNA, 13 bp, Homo sapiens
actggctggggca

SEQ ID NO: 1248814 - DNA, 16 bp, Homo sapiens
actggctggggcagag

SEQ ID NO: 1248815 - DNA, 17 bp, Homo sapiens
actggctggggcagagg

SEQ ID NO: 1248816 - DNA, 18 bp, Homo sapiens
actggctgtctgcctgta

SEQ ID NO: 1248817 - DNA, 22 bp, Homo sapiens
actggctgtctgcctgtatttt

SEQ ID NO: 1248818 - DNA, 19 bp, Homo sapiens
actggctgtgcccctgatg

SEQ ID NO: 1248819 - DNA, 15 bp, Homo sapiens
actggcttcagcaag

SEQ ID NO: 1248820 - DNA, 14 bp, Homo sapiens
actggcttcatttt

SEQ ID NO: 1248821 - DNA, 16 bp, Homo sapiens
actggctttggcttct

SEQ ID NO: 1248822 - DNA, 19 bp, Homo sapiens
actggcttttattaatgca

SEQ ID NO: 1248823 - DNA, 20 bp, Homo sapiens
actggcttttattaatgcac

SEQ ID NO: 1248824 - DNA, 23 bp, Homo sapiens
actggcttttattaatgcacttt

SEQ ID NO: 1248825 - DNA, 18 bp, Homo sapiens
actggcttttgcctgtaa

SEQ ID NO: 1248826 - DNA, 12 bp, Homo sapiens
actgggaagaag

SEQ ID NO: 1248827 - DNA, 16 bp, Homo sapiens
actgggaagaagcaag

SEQ ID NO: 1248828 - DNA, 12 bp, Homo sapiens
actgtgacctgt

SEQ ID NO: 1248829 - DNA, 23 bp, Homo sapiens
actgtgactctttttagggccag

SEQ ID NO: 1248830 - DNA, 16 bp, Homo sapiens
actgtgagagttgtct

SEQ ID NO: 1248831 - DNA, 18 bp, Homo sapiens
actgtgagagttgtctct

SEQ ID NO: 1248832 - DNA, 13 bp, Homo sapiens
actgtgatgccac

SEQ ID NO: 1248833 - DNA, 20 bp, Homo sapiens
actgtgatgccacacagagt

SEQ ID NO: 1248834 - DNA, 17 bp, Homo sapiens
actgtgattagatcaca

SEQ ID NO: 1248835 - DNA, 19 bp, Homo sapiens
actgtgattagatcacatc

SEQ ID NO: 1248836 - DNA, 17 bp, Homo sapiens
actgtgcaaagggctgc

SEQ ID NO: 1248837 - DNA, 17 bp, Homo sapiens
actgtgcaactttttaa

SEQ ID NO: 1248838 - DNA, 19 bp, Homo sapiens
actgtgcacatctgtgtct

SEQ ID NO: 1248839 - DNA, 20 bp, Homo sapiens
actgtgcacatctgtgtctt

SEQ ID NO: 1248840 - DNA, 15 bp, Homo sapiens
actgtgcagaataat

SEQ ID NO: 1248841 - DNA, 23 bp, Homo sapiens
actgtgccacaatgcagttctga

SEQ ID NO: 1248842 - DNA, 12 bp, Homo sapiens
actgtgccactg

SEQ ID NO: 1248843 - DNA, 20 bp, Homo sapiens
actgtgccactgacttgctg

SEQ ID NO: 1248844 - DNA, 14 bp, Homo sapiens
actgtgccctggtg

SEQ ID NO: 1248845 - DNA, 22 bp, Homo sapiens
actgtgcctcagagaccagggc

SEQ ID NO: 1248846 - DNA, 16 bp, Homo sapiens
actgtgcctcaggcca

SEQ ID NO: 1248847 - DNA, 22 bp, Homo sapiens
actgtgcctttgcaaatcagtg

SEQ ID NO: 1248848 - DNA, 11 bp, Homo sapiens
actgtgctggg

SEQ ID NO: 1248849 - DNA, 17 bp, Homo sapiens
actgtgctgttgttctc

SEQ ID NO: 1248850 - DNA, 20 bp, Homo sapiens
actgtgcttatttttttaag

SEQ ID NO: 1248851 - DNA, 14 bp, Homo sapiens
actgtgcttggcca

SEQ ID NO: 1248852 - DNA, 12 bp, Homo sapiens
actgtggaaaga

SEQ ID NO: 1248853 - DNA, 13 bp, Homo sapiens
actgtggaaagac

SEQ ID NO: 1248854 - DNA, 14 bp, Homo sapiens
actgtggaaagaca

SEQ ID NO: 1248855 - DNA, 18 bp, Homo sapiens
actgtggaaggcctccct

SEQ ID NO: 1248856 - DNA, 12 bp, Homo sapiens
actgtggaatat

SEQ ID NO: 1248857 - DNA, 14 bp, Homo sapiens
actgtggaatataa

SEQ ID NO: 1248858 - DNA, 16 bp, Homo sapiens
actgtggaatataaat

SEQ ID NO: 1248859 - DNA, 16 bp, Homo sapiens
actgtggagactttct

SEQ ID NO: 1248860 - DNA, 22 bp, Homo sapiens
actgtggagactttctgttact

SEQ ID NO: 1248861 - DNA, 20 bp, Homo sapiens
actgtggagggagtgttcaa

SEQ ID NO: 1248862 - DNA, 15 bp, Homo sapiens
actgtggatattgtt

SEQ ID NO: 1248863 - DNA, 15 bp, Homo sapiens
actgtggccacagcc

SEQ ID NO: 1248864 - DNA, 18 bp, Homo sapiens
actgtggccacagccccc

SEQ ID NO: 1248865 - DNA, 19 bp, Homo sapiens
actgtggccacagccccct

SEQ ID NO: 1248866 - DNA, 14 bp, Homo sapiens
actgtggccagagc

SEQ ID NO: 1248867 - DNA, 15 bp, Homo sapiens
actgtggccaggcct

SEQ ID NO: 1248868 - DNA, 23 bp, Homo sapiens
actgtggcccttctgtccaccag

SEQ ID NO: 1248869 - DNA, 19 bp, Homo sapiens
actgtggcgactctgcaga

SEQ ID NO: 1248870 - DNA, 19 bp, Homo sapiens
actgtggctgctagcactt

SEQ ID NO: 1248871 - DNA, 22 bp, Homo sapiens
actgtggggaaccaattgcttt

SEQ ID NO: 1248872 - DNA, 15 bp, Homo sapiens
actgtgggtggggag

SEQ ID NO: 1248873 - DNA, 17 bp, Homo sapiens
actgtgggtggggaggc

SEQ ID NO: 1248874 - DNA, 20 bp, Homo sapiens
actgtgggtggggaggccct

SEQ ID NO: 1248875 - DNA, 20 bp, Homo sapiens
actgtggtaggggcagggag

SEQ ID NO: 1248876 - DNA, 19 bp, Homo sapiens
actgtggtttcagatgtgc

SEQ ID NO: 1248877 - DNA, 22 bp, Homo sapiens
actgtggtttcagatgtgcaat

SEQ ID NO: 1248878 - DNA, 16 bp, Homo sapiens
actgtgtaaaccacat

SEQ ID NO: 1248879 - DNA, 16 bp, Homo sapiens
actgtgtacataactg

SEQ ID NO: 1248880 - DNA, 17 bp, Homo sapiens
actgtgtacataactga

SEQ ID NO: 1248881 - DNA, 14 bp, Homo sapiens
actgtgtatcatta

SEQ ID NO: 1248882 - DNA, 18 bp, Homo sapiens
actgtgtatgtacatata

SEQ ID NO: 1248883 - DNA, 20 bp, Homo sapiens
actgtgtatgtacatatata

SEQ ID NO: 1248884 - DNA, 16 bp, Homo sapiens
actgtgtattccaaga

SEQ ID NO: 1248885 - DNA, 21 bp, Homo sapiens
actgtgtattccaagacatgt

SEQ ID NO: 1248886 - DNA, 12 bp, Homo sapiens
actgtgtattta

SEQ ID NO: 1248887 - DNA, 13 bp, Homo sapiens
actgtgtctctgt

SEQ ID NO: 1248888 - DNA, 15 bp, Homo sapiens
actgtgtctctgttt

SEQ ID NO: 1248889 - DNA, 23 bp, Homo sapiens
actgtgtctggcgttctcaagaa

SEQ ID NO: 1248890 - DNA, 18 bp, Homo sapiens
actgtgtggactgtgatg

SEQ ID NO: 1248891 - DNA, 16 bp, Homo sapiens
actgtgtgtgtgaatg

SEQ ID NO: 1248892 - DNA, 22 bp, Homo sapiens
actgtgtgtgtgaatgaacact

SEQ ID NO: 1248893 - DNA, 23 bp, Homo sapiens
actgtgtgttttcccaaagcact

SEQ ID NO: 1248894 - DNA, 12 bp, Homo sapiens
actgtgttactg

SEQ ID NO: 1248895 - DNA, 14 bp, Homo sapiens
actgtgttactgct

SEQ ID NO: 1248896 - DNA, 21 bp, Homo sapiens
actgtgttactgctttgcaaa

SEQ ID NO: 1248897 - DNA, 20 bp, Homo sapiens
actgtgttgtattaacaaaa

SEQ ID NO: 1248898 - DNA, 15 bp, Homo sapiens
actgtgtttcaagtt

SEQ ID NO: 1248899 - DNA, 18 bp, Homo sapiens
actgtgtttcaagttcaa

SEQ ID NO: 1248900 - DNA, 16 bp, Homo sapiens
actgttaatacacagt

SEQ ID NO: 1248901 - DNA, 17 bp, Homo sapiens
actgttaatacacagta

SEQ ID NO: 1248902 - DNA, 12 bp, Homo sapiens
actgttacagta

SEQ ID NO: 1248903 - DNA, 13 bp, Homo sapiens
actgttactctaa

SEQ ID NO: 1248904 - DNA, 13 bp, Homo sapiens
actgttagcactg

SEQ ID NO: 1248905 - DNA, 14 bp, Homo sapiens
actgttagcactgt

SEQ ID NO: 1248906 - DNA, 23 bp, Homo sapiens
actgttatgaaataaagaaattg

SEQ ID NO: 1248907 - DNA, 14 bp, Homo sapiens
actgttcaagcaaa

SEQ ID NO: 1248908 - DNA, 15 bp, Homo sapiens
actgttcaagcaaaa

SEQ ID NO: 1248909 - DNA, 16 bp, Homo sapiens
actgttcactcactct

SEQ ID NO: 1248910 - DNA, 15 bp, Homo sapiens
actgttccctctgct

SEQ ID NO: 1248911 - DNA, 16 bp, Homo sapiens
actgttccctctgctc

SEQ ID NO: 1248912 - DNA, 20 bp, Homo sapiens
actgttccttatttctctct

SEQ ID NO: 1248913 - DNA, 23 bp, Homo sapiens
actgttccttatttctctctcct

SEQ ID NO: 1248914 - DNA, 22 bp, Homo sapiens
actgttctctttaaaatatttg

SEQ ID NO: 1248915 - DNA, 14 bp, Homo sapiens
actgttctgcaaag

SEQ ID NO: 1248916 - DNA, 15 bp, Homo sapiens
actgttctgtgtctt

SEQ ID NO: 1248917 - DNA, 13 bp, Homo sapiens
actgttgaaaatt

SEQ ID NO: 1248918 - DNA, 21 bp, Homo sapiens
actgttgaaaattattttaaa

SEQ ID NO: 1248919 - DNA, 14 bp, Homo sapiens
actgttgatacaaa

SEQ ID NO: 1248920 - DNA, 20 bp, Homo sapiens
actgttgatacaaaccactg

SEQ ID NO: 1248921 - DNA, 20 bp, Homo sapiens
actgttgatgaagtatactt

SEQ ID NO: 1248922 - DNA, 21 bp, Homo sapiens
actgttgatgaagtatacttt

SEQ ID NO: 1248923 - DNA, 22 bp, Homo sapiens
actgttgatgaagtatactttt

SEQ ID NO: 1248924 - DNA, 16 bp, Homo sapiens
actgttgatgtatctg

SEQ ID NO: 1248925 - DNA, 17 bp, Homo sapiens
actgttgatgtatctga

SEQ ID NO: 1248926 - DNA, 13 bp, Homo sapiens
actgttgcccccc

SEQ ID NO: 1248927 - DNA, 16 bp, Homo sapiens
actgttgccccccagg

SEQ ID NO: 1248928 - DNA, 16 bp, Homo sapiens
actgttgccttttaaa

SEQ ID NO: 1248929 - DNA, 12 bp, Homo sapiens
actgttgctcaa

SEQ ID NO: 1248930 - DNA, 19 bp, Homo sapiens
actgttgctttaatatgag

SEQ ID NO: 1248931 - DNA, 17 bp, Homo sapiens
actgttggattcagaaa

SEQ ID NO: 1248932 - DNA, 18 bp, Homo sapiens
actgttggattcagaaat

SEQ ID NO: 1248933 - DNA, 17 bp, Homo sapiens
actgttggcacttatag

SEQ ID NO: 1248934 - DNA, 21 bp, Homo sapiens
actgttgggtgggtgggccct

SEQ ID NO: 1248935 - DNA, 20 bp, Homo sapiens
actgttgtagcattttcctg

SEQ ID NO: 1248936 - DNA, 15 bp, Homo sapiens
actgttgtataaatt

SEQ ID NO: 1248937 - DNA, 15 bp, Homo sapiens
actgttgtgggcgct

SEQ ID NO: 1248938 - DNA, 20 bp, Homo sapiens
actgtttacaagaaaaaatg

SEQ ID NO: 1248939 - DNA, 19 bp, Homo sapiens
actgtttatacactgtgta

SEQ ID NO: 1248940 - DNA, 14 bp, Homo sapiens
actgtttcattcac

SEQ ID NO: 1248941 - DNA, 15 bp, Homo sapiens
actgtttctctgctg

SEQ ID NO: 1248942 - DNA, 23 bp, Homo sapiens
actgtttctcttgagctggcctc

SEQ ID NO: 1248943 - DNA, 17 bp, Homo sapiens
actgtttcttgcactga

SEQ ID NO: 1248944 - DNA, 21 bp, Homo sapiens
actgtttgccttctactttta

SEQ ID NO: 1248945 - DNA, 16 bp, Homo sapiens
actgtttgtttttaaa

SEQ ID NO: 1248946 - DNA, 23 bp, Homo sapiens
actgtttgtttttaaaaagcaaa

SEQ ID NO: 1248947 - DNA, 15 bp, Homo sapiens
actgttttactgttt

SEQ ID NO: 1248948 - DNA, 15 bp, Homo sapiens
actgttttagaaatt

SEQ ID NO: 1248949 - DNA, 18 bp, Homo sapiens
actgttttagaaattggt

SEQ ID NO: 1248950 - DNA, 14 bp, Homo sapiens
acttctacctgccc

SEQ ID NO: 1248951 - DNA, 17 bp, Homo sapiens
acttctacctgccctca

SEQ ID NO: 1248952 - DNA, 13 bp, Homo sapiens
acttctagctgtc

SEQ ID NO: 1248953 - DNA, 17 bp, Homo sapiens
acttctagtttcacgta

SEQ ID NO: 1248954 - DNA, 16 bp, Homo sapiens
acttctatattttaat

SEQ ID NO: 1248955 - DNA, 17 bp, Homo sapiens
acttctatattttaata

SEQ ID NO: 1248956 - DNA, 16 bp, Homo sapiens
acttctatcctttctt

SEQ ID NO: 1248957 - DNA, 20 bp, Homo sapiens
acttctattttttaaagact

SEQ ID NO: 1248958 - DNA, 22 bp, Homo sapiens
acttctccagacccaccacacc

SEQ ID NO: 1248959 - DNA, 16 bp, Homo sapiens
acttctccaggtctca

SEQ ID NO: 1248960 - DNA, 15 bp, Homo sapiens
acttctcccacccct

SEQ ID NO: 1248961 - DNA, 21 bp, Homo sapiens
acttctcccccgccctgcccc

SEQ ID NO: 1248962 - DNA, 22 bp, Homo sapiens
acttctcccccgccctgccccg

SEQ ID NO: 1248963 - DNA, 15 bp, Homo sapiens
acttctcccctgccc

SEQ ID NO: 1248964 - DNA, 20 bp, Homo sapiens
acttctcctgctgctcctgt

SEQ ID NO: 1248965 - DNA, 21 bp, Homo sapiens
acttctcctgctgctcctgtt

SEQ ID NO: 1248966 - DNA, 19 bp, Homo sapiens
acttctctataaaaaatat

SEQ ID NO: 1248967 - DNA, 23 bp, Homo sapiens
acttctctataaaaaatatgtat

SEQ ID NO: 1248968 - DNA, 18 bp, Homo sapiens
acttctctgaatcagaaa

SEQ ID NO: 1248969 - DNA, 18 bp, Homo sapiens
acttctctgctgcctctg

SEQ ID NO: 1248970 - DNA, 22 bp, Homo sapiens
acttctctgctgcctctgtgga

SEQ ID NO: 1248971 - DNA, 23 bp, Homo sapiens
acttctctgctgcctctgtggaa

SEQ ID NO: 1248972 - DNA, 10 bp, Homo sapiens
acttctctgg

SEQ ID NO: 1248973 - DNA, 18 bp, Homo sapiens
acttctctgttgtcaaac

SEQ ID NO: 1248974 - DNA, 16 bp, Homo sapiens
acttctcttacatttt

SEQ ID NO: 1248975 - DNA, 15 bp, Homo sapiens
acttctgaccacact

SEQ ID NO: 1248976 - DNA, 16 bp, Homo sapiens
acttctgaccacactt

SEQ ID NO: 1248977 - DNA, 22 bp, Homo sapiens
acttctgagtaattaataaaga

SEQ ID NO: 1248978 - DNA, 18 bp, Homo sapiens
acttctgcgggctccctc

SEQ ID NO: 1248979 - DNA, 21 bp, Homo sapiens
acttctgcgggctccctcctc

SEQ ID NO: 1248980 - DNA, 22 bp, Homo sapiens
acttctgctgaaggacagaaca

SEQ ID NO: 1248981 - DNA, 14 bp, Homo sapiens
acttctgctggcat

SEQ ID NO: 1248982 - DNA, 11 bp, Homo sapiens
acttctgcttt

SEQ ID NO: 1248983 - DNA, 13 bp, Homo sapiens
acttctgctttca

SEQ ID NO: 1248984 - DNA, 16 bp, Homo sapiens
acttctggaaggctgg

SEQ ID NO: 1248985 - DNA, 13 bp, Homo sapiens
acttctggcctcc

SEQ ID NO: 1248986 - DNA, 14 bp, Homo sapiens
acttctggcctcca

SEQ ID NO: 1248987 - DNA, 17 bp, Homo sapiens
acttctggcctccagcc

SEQ ID NO: 1248988 - DNA, 23 bp, Homo sapiens
acttctggcttcagcccccacca

SEQ ID NO: 1248989 - DNA, 17 bp, Homo sapiens
acttctgggcttcatct

SEQ ID NO: 1248990 - DNA, 19 bp, Homo sapiens
acttctgggcttcatctgg

SEQ ID NO: 1248991 - DNA, 23 bp, Homo sapiens
acttctggtcccctgtggtgatg

SEQ ID NO: 1248992 - DNA, 21 bp, Homo sapiens
acttctggttgtatttctata

SEQ ID NO: 1248993 - DNA, 15 bp, Homo sapiens
acttctgtaattgtg

SEQ ID NO: 1248994 - DNA, 19 bp, Homo sapiens
acttctgtaatttaaaagc

SEQ ID NO: 1248995 - DNA, 15 bp, Homo sapiens
acttctgtatgcatc

SEQ ID NO: 1248996 - DNA, 16 bp, Homo sapiens
acttctgtatgcatca

SEQ ID NO: 1248997 - DNA, 14 bp, Homo sapiens
acttctgtgttcat

SEQ ID NO: 1248998 - DNA, 17 bp, Homo sapiens
acttcttaaaggcctgg

SEQ ID NO: 1248999 - DNA, 18 bp, Homo sapiens
acttcttaaaggcctgga

SEQ ID NO: 1249000 - DNA, 23 bp, Homo sapiens
acttcttaaaggcctggaaccag

SEQ ID NO: 1249001 - DNA, 16 bp, Homo sapiens
acttcttacgactttt

SEQ ID NO: 1249002 - DNA, 17 bp, Homo sapiens
acttcttacgacttttt

SEQ ID NO: 1249003 - DNA, 23 bp, Homo sapiens
acttcttagaaaattaaaatagg

SEQ ID NO: 1249004 - DNA, 17 bp, Homo sapiens
acttcttatggaattga

SEQ ID NO: 1249005 - DNA, 14 bp, Homo sapiens
acttcttctccatc

SEQ ID NO: 1249006 - DNA, 13 bp, Homo sapiens
acttcttctctta

SEQ ID NO: 1249007 - DNA, 16 bp, Homo sapiens
acttcttctcttagat

SEQ ID NO: 1249008 - DNA, 12 bp, Homo sapiens
acttcttgaaaa

SEQ ID NO: 1249009 - DNA, 17 bp, Homo sapiens
acttcttgaaacagcct

SEQ ID NO: 1249010 - DNA, 23 bp, Homo sapiens
acttcttgaatataaaaaatcat

SEQ ID NO: 1249011 - DNA, 15 bp, Homo sapiens
acttcttggttcctg

SEQ ID NO: 1249012 - DNA, 19 bp, Homo sapiens
acttcttggttcctgggat

SEQ ID NO: 1249013 - DNA, 23 bp, Homo sapiens
acttcttggtttggggagaaata

SEQ ID NO: 1249014 - DNA, 17 bp, Homo sapiens
acttctttgcagagcct

SEQ ID NO: 1249015 - DNA, 20 bp, Homo sapiens
acttcttttgctcttagctg

SEQ ID NO: 1249016 - DNA, 13 bp, Homo sapiens
acttgaaagcatc

SEQ ID NO: 1249017 - DNA, 14 bp, Homo sapiens
acttgaaagcatcc

SEQ ID NO: 1249018 - DNA, 21 bp, Homo sapiens
acttgaaatctaatatttcta

SEQ ID NO: 1249019 - DNA, 18 bp, Homo sapiens
acttgaaatctaggatta

SEQ ID NO: 1249020 - DNA, 22 bp, Homo sapiens
acttgaaccacaagtgaatctt

SEQ ID NO: 1249021 - DNA, 12 bp, Homo sapiens
acttgaactcca

SEQ ID NO: 1249022 - DNA, 13 bp, Homo sapiens
acttgaactccag

SEQ ID NO: 1249023 - DNA, 20 bp, Homo sapiens
acttgaagattgtagcaata

SEQ ID NO: 1249024 - DNA, 17 bp, Homo sapiens
acttgaaggatggatga

SEQ ID NO: 1249025 - DNA, 20 bp, Homo sapiens
acttgaaggattgcatcctg

SEQ ID NO: 1249026 - DNA, 22 bp, Homo sapiens
acttgaagtctaaaagcagaaa

SEQ ID NO: 1249027 - DNA, 16 bp, Homo sapiens
acttgaagtggtttct

SEQ ID NO: 1249028 - DNA, 18 bp, Homo sapiens
acttgaagtggtttctaa

SEQ ID NO: 1249029 - DNA, 19 bp, Homo sapiens
acttgaataaaaaaaatat

SEQ ID NO: 1249030 - DNA, 15 bp, Homo sapiens
acttgaatagtattg

SEQ ID NO: 1249031 - DNA, 16 bp, Homo sapiens
acttgaatagtattgt

SEQ ID NO: 1249032 - DNA, 13 bp, Homo sapiens
acttgaatatgta

SEQ ID NO: 1249033 - DNA, 17 bp, Homo sapiens
acttgaattttttgaaa

SEQ ID NO: 1249034 - DNA, 20 bp, Homo sapiens
acttgaattttttgaaatgg

SEQ ID NO: 1249035 - DNA, 19 bp, Homo sapiens
acttgacccccttgagggt

SEQ ID NO: 1249036 - DNA, 20 bp, Homo sapiens
acttgaccctttcctccccc

SEQ ID NO: 1249037 - DNA, 22 bp, Homo sapiens
acttgaccctttcctcccccag

SEQ ID NO: 1249038 - DNA, 22 bp, Homo sapiens
acttgagaaccagtctcctcac

SEQ ID NO: 1249039 - DNA, 17 bp, Homo sapiens
acttgagacaatgtttt

SEQ ID NO: 1249040 - DNA, 15 bp, Homo sapiens
acttgagatctgtat

SEQ ID NO: 1249041 - DNA, 22 bp, Homo sapiens
acttgagatctgtataaataag

SEQ ID NO: 1249042 - DNA, 16 bp, Homo sapiens
acttgagatgatttcc

SEQ ID NO: 1249043 - DNA, 19 bp, Homo sapiens
acttgagcaagatgatgta

SEQ ID NO: 1249044 - DNA, 10 bp, Homo sapiens
acttgagcca

SEQ ID NO: 1249045 - DNA, 13 bp, Homo sapiens
acttgagcccact

SEQ ID NO: 1249046 - DNA, 21 bp, Homo sapiens
acttgagcgtgaatctgtatc

SEQ ID NO: 1249047 - DNA, 16 bp, Homo sapiens
acttgagggcccagag

SEQ ID NO: 1249048 - DNA, 18 bp, Homo sapiens
acttgagggcccagagca

SEQ ID NO: 1249049 - DNA, 16 bp, Homo sapiens
acttgagttggctgtg

SEQ ID NO: 1249050 - DNA, 15 bp, Homo sapiens
acttgataatattag

SEQ ID NO: 1249051 - DNA, 21 bp, Homo sapiens
acttgataatattagtgattc

SEQ ID NO: 1249052 - DNA, 22 bp, Homo sapiens
acttgataatattagtgattct

SEQ ID NO: 1249053 - DNA, 19 bp, Homo sapiens
acttgatatagaaagctgt

SEQ ID NO: 1249054 - DNA, 13 bp, Homo sapiens
acttgatgtgaaa

SEQ ID NO: 1249055 - DNA, 15 bp, Homo sapiens
acttgattcaggagg

SEQ ID NO: 1249056 - DNA, 18 bp, Homo sapiens
acttgattcatctctggt

SEQ ID NO: 1249057 - DNA, 13 bp, Homo sapiens
acttgattgtact

SEQ ID NO: 1249058 - DNA, 18 bp, Homo sapiens
acttgatttgatgtgact

SEQ ID NO: 1249059 - DNA, 13 bp, Homo sapiens
acttgatttgcat

SEQ ID NO: 1249060 - DNA, 14 bp, Homo sapiens
acttgatttgcatg

SEQ ID NO: 1249061 - DNA, 15 bp, Homo sapiens
acttgcaactaagga

SEQ ID NO: 1249062 - DNA, 19 bp, Homo sapiens
acttgcaactaaggacaaa

SEQ ID NO: 1249063 - DNA, 14 bp, Homo sapiens
acttgcactcttta

SEQ ID NO: 1249064 - DNA, 14 bp, Homo sapiens
acttgcactgttac

SEQ ID NO: 1249065 - DNA, 17 bp, Homo sapiens
acttgcagaggagccca

SEQ ID NO: 1249066 - DNA, 18 bp, Homo sapiens
acttgcagaggagcccag

SEQ ID NO: 1249067 - DNA, 19 bp, Homo sapiens
acttgcagaggagcccagt

SEQ ID NO: 1249068 - DNA, 21 bp, Homo sapiens
acttgcagaggagcccagtgg

SEQ ID NO: 1249069 - DNA, 19 bp, Homo sapiens
acttgcaggggtccctgct

SEQ ID NO: 1249070 - DNA, 14 bp, Homo sapiens
acttgcagtcttgt

SEQ ID NO: 1249071 - DNA, 14 bp, Homo sapiens
acttgcatcactta

SEQ ID NO: 1249072 - DNA, 17 bp, Homo sapiens
acttgtttgtcttccat

SEQ ID NO: 1249073 - DNA, 17 bp, Homo sapiens
acttgttttatgctcag

SEQ ID NO: 1249074 - DNA, 13 bp, Homo sapiens
actttaaaaagga

SEQ ID NO: 1249075 - DNA, 14 bp, Homo sapiens
actttaaaaaggaa

SEQ ID NO: 1249076 - DNA, 20 bp, Homo sapiens
actttaaaaaggaaatttgt

SEQ ID NO: 1249077 - DNA, 15 bp, Homo sapiens
actttaaaagaaaat

SEQ ID NO: 1249078 - DNA, 16 bp, Homo sapiens
actttaaaataaaaaa

SEQ ID NO: 1249079 - DNA, 15 bp, Homo sapiens
actttaaaataaaat

SEQ ID NO: 1249080 - DNA, 14 bp, Homo sapiens
actttaaacatcta

SEQ ID NO: 1249081 - DNA, 16 bp, Homo sapiens
actttaaagaggctgt

SEQ ID NO: 1249082 - DNA, 13 bp, Homo sapiens
actttaaattgtg

SEQ ID NO: 1249083 - DNA, 17 bp, Homo sapiens
actttaacttttgaaaa

SEQ ID NO: 1249084 - DNA, 17 bp, Homo sapiens
actttaagactgagcac

SEQ ID NO: 1249085 - DNA, 14 bp, Homo sapiens
actttaagctcctt

SEQ ID NO: 1249086 - DNA, 22 bp, Homo sapiens
actttaagctccttgagtaaaa

SEQ ID NO: 1249087 - DNA, 18 bp, Homo sapiens
actttaaggggaagataa

SEQ ID NO: 1249088 - DNA, 18 bp, Homo sapiens
actttaagtttcaggata

SEQ ID NO: 1249089 - DNA, 20 bp, Homo sapiens
actttaattaccaacctgtt

SEQ ID NO: 1249090 - DNA, 22 bp, Homo sapiens
actttaattaccaacctgttac

SEQ ID NO: 1249091 - DNA, 13 bp, Homo sapiens
actttaattatat

SEQ ID NO: 1249092 - DNA, 23 bp, Homo sapiens
actttaattatatattttcatcc

SEQ ID NO: 1249093 - DNA, 17 bp, Homo sapiens
actttaattgaagaact

SEQ ID NO: 1249094 - DNA, 22 bp, Homo sapiens
actttaattgaagaactgcact

SEQ ID NO: 1249095 - DNA, 10 bp, Homo sapiens
actttaattt

SEQ ID NO: 1249096 - DNA, 22 bp, Homo sapiens
actttaatttatgtaacttgaa

SEQ ID NO: 1249097 - DNA, 20 bp, Homo sapiens
actttacaatgttcatccca

SEQ ID NO: 1249098 - DNA, 18 bp, Homo sapiens
actttacagaaatggact

SEQ ID NO: 1249099 - DNA, 13 bp, Homo sapiens
actttacaggaaa

SEQ ID NO: 1249100 - DNA, 24 bp, Homo sapiens
actttacaggaaaaaaaattctgt

SEQ ID NO: 1249101 - DNA, 19 bp, Homo sapiens
actttaccataaagccttt

SEQ ID NO: 1249102 - DNA, 22 bp, Homo sapiens
actttaccataaagcctttaaa

SEQ ID NO: 1249103 - DNA, 17 bp, Homo sapiens
actttacccaaaaacta

SEQ ID NO: 1249104 - DNA, 12 bp, Homo sapiens
actttacctttt

SEQ ID NO: 1249105 - DNA, 18 bp, Homo sapiens
actttaccttttttatac

SEQ ID NO: 1249106 - DNA, 23 bp, Homo sapiens
actttaccttttttatacataaa

SEQ ID NO: 1249107 - DNA, 19 bp, Homo sapiens
actttactgcctgaataaa

SEQ ID NO: 1249108 - DNA, 11 bp, Homo sapiens
actttactgta

SEQ ID NO: 1249109 - DNA, 15 bp, Homo sapiens
actttacttgtggtg

SEQ ID NO: 1249110 - DNA, 17 bp, Homo sapiens
actttacttttgctgtt

SEQ ID NO: 1249111 - DNA, 21 bp, Homo sapiens
actttacttttgctgtttata

SEQ ID NO: 1249112 - DNA, 12 bp, Homo sapiens
actttagaaata

SEQ ID NO: 1249113 - DNA, 14 bp, Homo sapiens
actttagaaataaa

SEQ ID NO: 1249114 - DNA, 16 bp, Homo sapiens
actttagacatttttg

SEQ ID NO: 1249115 - DNA, 13 bp, Homo sapiens
actttagatgctg

SEQ ID NO: 1249116 - DNA, 14 bp, Homo sapiens
actttagatgctga

SEQ ID NO: 1249117 - DNA, 20 bp, Homo sapiens
actttagctagtatcttcaa

SEQ ID NO: 1249118 - DNA, 20 bp, Homo sapiens
actttagggggtgggagggg

SEQ ID NO: 1249119 - DNA, 20 bp, Homo sapiens
actttaggtttttttaatga

SEQ ID NO: 1249120 - DNA, 16 bp, Homo sapiens
actttagtctgcaaaa

SEQ ID NO: 1249121 - DNA, 17 bp, Homo sapiens
actttagtctgcaaaat

SEQ ID NO: 1249122 - DNA, 18 bp, Homo sapiens
actttagtctgcaaaatg

SEQ ID NO: 1249123 - DNA, 15 bp, Homo sapiens
actttagtgaaacat

SEQ ID NO: 1249124 - DNA, 22 bp, Homo sapiens
actttagttaccgagacatgaa

SEQ ID NO: 1249125 - DNA, 14 bp, Homo sapiens
actttataaacact

SEQ ID NO: 1249126 - DNA, 18 bp, Homo sapiens
actttataactaacatgt

SEQ ID NO: 1249127 - DNA, 16 bp, Homo sapiens
actttatacacttgga

SEQ ID NO: 1249128 - DNA, 15 bp, Homo sapiens
actttatagctgcaa

SEQ ID NO: 1249129 - DNA, 18 bp, Homo sapiens
actttatatcttgtttac

SEQ ID NO: 1249130 - DNA, 19 bp, Homo sapiens
actttatcaatgtgtcttt

SEQ ID NO: 1249131 - DNA, 15 bp, Homo sapiens
actttatgccggatg

SEQ ID NO: 1249132 - DNA, 20 bp, Homo sapiens
actttatgccggatgtgctt

SEQ ID NO: 1249133 - DNA, 21 bp, Homo sapiens
actttatgccggatgtgcttt

SEQ ID NO: 1249134 - DNA, 23 bp, Homo sapiens
actttatgccggatgtgcttttc

SEQ ID NO: 1249135 - DNA, 13 bp, Homo sapiens
actttatgttgta

SEQ ID NO: 1249136 - DNA, 15 bp, Homo sapiens
actttattaaataca

SEQ ID NO: 1249137 - DNA, 12 bp, Homo sapiens
actttattatcc

SEQ ID NO: 1249138 - DNA, 14 bp, Homo sapiens
actttattcttgct

SEQ ID NO: 1249139 - DNA, 19 bp, Homo sapiens
actttattgcatatagatt

SEQ ID NO: 1249140 - DNA, 21 bp, Homo sapiens
actttattgccttttaatttt

SEQ ID NO: 1249141 - DNA, 14 bp, Homo sapiens
actttattgtacag

SEQ ID NO: 1249142 - DNA, 15 bp, Homo sapiens
actttatttaaatgc

SEQ ID NO: 1249143 - DNA, 16 bp, Homo sapiens
actttatttaaatgca

SEQ ID NO: 1249144 - DNA, 17 bp, Homo sapiens
actttatttaaatgcat

SEQ ID NO: 1249145 - DNA, 20 bp, Homo sapiens
actttatttatacactgtct

SEQ ID NO: 1249146 - DNA, 18 bp, Homo sapiens
actttatttatttctagt

SEQ ID NO: 1249147 - DNA, 19 bp, Homo sapiens
actttatttgtaaaccatt

SEQ ID NO: 1249148 - DNA, 23 bp, Homo sapiens
actttattttatataataaagta

SEQ ID NO: 1249149 - DNA, 13 bp, Homo sapiens
actttattttctg

SEQ ID NO: 1249150 - DNA, 24 bp, Homo sapiens
actttattttctggtagatagaaa

SEQ ID NO: 1249151 - DNA, 14 bp, Homo sapiens
actttattttgctt

SEQ ID NO: 1249152 - DNA, 13 bp, Homo sapiens
actttatttttct

SEQ ID NO: 1249153 - DNA, 19 bp, Homo sapiens
actttatttttctgataga

SEQ ID NO: 1249154 - DNA, 16 bp, Homo sapiens
actttatttttgtata

SEQ ID NO: 1249155 - DNA, 20 bp, Homo sapiens
actttatttttgtataaaat

SEQ ID NO: 1249156 - DNA, 15 bp, Homo sapiens
actttcaaaatatat

SEQ ID NO: 1249157 - DNA, 19 bp, Homo sapiens
actttcaaaatatattttg

SEQ ID NO: 1249158 - DNA, 20 bp, Homo sapiens
actttcaattgtcacttttt

SEQ ID NO: 1249159 - DNA, 15 bp, Homo sapiens
actttcacatagatg

SEQ ID NO: 1249160 - DNA, 11 bp, Homo sapiens
actttcacttc

SEQ ID NO: 1249161 - DNA, 18 bp, Homo sapiens
actttcacttcttcctat

SEQ ID NO: 1249162 - DNA, 14 bp, Homo sapiens
actttcactttgaa

SEQ ID NO: 1249163 - DNA, 16 bp, Homo sapiens
actttcactttgaaaa

SEQ ID NO: 1249164 - DNA, 19 bp, Homo sapiens
actttcagagaattactat

SEQ ID NO: 1249165 - DNA, 20 bp, Homo sapiens
actttcagagcccccagccc

SEQ ID NO: 1249166 - DNA, 22 bp, Homo sapiens
actttcagagcccccagccctg

SEQ ID NO: 1249167 - DNA, 17 bp, Homo sapiens
actttcagtttcaggag

SEQ ID NO: 1249168 - DNA, 19 bp, Homo sapiens
actttcataccacttgaat

SEQ ID NO: 1249169 - DNA, 13 bp, Homo sapiens
actttcatcttaa

SEQ ID NO: 1249170 - DNA, 17 bp, Homo sapiens
actttcatcttaaacta

SEQ ID NO: 1249171 - DNA, 20 bp, Homo sapiens
actttcattccttcagattt

SEQ ID NO: 1249172 - DNA, 12 bp, Homo sapiens
actttccaaata

SEQ ID NO: 1249173 - DNA, 18 bp, Homo sapiens
actttccacttcttcctt

SEQ ID NO: 1249174 - DNA, 13 bp, Homo sapiens
actttccattaca

SEQ ID NO: 1249175 - DNA, 14 bp, Homo sapiens
actttccattacaa

SEQ ID NO: 1249176 - DNA, 15 bp, Homo sapiens
actttccattacaag

SEQ ID NO: 1249177 - DNA, 17 bp, Homo sapiens
actttccattacaagta

SEQ ID NO: 1249178 - DNA, 21 bp, Homo sapiens
actttccattacaagtatttt

SEQ ID NO: 1249179 - DNA, 15 bp, Homo sapiens
actttcccaaatgta

SEQ ID NO: 1249180 - DNA, 16 bp, Homo sapiens
actttcccccttcccg

SEQ ID NO: 1249181 - DNA, 14 bp, Homo sapiens
actttcccttgctt

SEQ ID NO: 1249182 - DNA, 23 bp, Homo sapiens
actttcccttgcttttccctctt

SEQ ID NO: 1249183 - DNA, 19 bp, Homo sapiens
actttcctcctgaggcttt

SEQ ID NO: 1249184 - DNA, 14 bp, Homo sapiens
actttcctgcaact

SEQ ID NO: 1249185 - DNA, 15 bp, Homo sapiens
actttcctgtggttt

SEQ ID NO: 1249186 - DNA, 20 bp, Homo sapiens
actttcgaccgactttcccc

SEQ ID NO: 1249187 - DNA, 16 bp, Homo sapiens
actttcgtacattggc

SEQ ID NO: 1249188 - DNA, 15 bp, Homo sapiens
actttctaatgtttc

SEQ ID NO: 1249189 - DNA, 19 bp, Homo sapiens
actttctacaatgtgaact

SEQ ID NO: 1249190 - DNA, 17 bp, Homo sapiens
actttctatcctctgta

SEQ ID NO: 1249191 - DNA, 22 bp, Homo sapiens
actttctccccatccccttcct

SEQ ID NO: 1249192 - DNA, 17 bp, Homo sapiens
actttctctaataataa

SEQ ID NO: 1249193 - DNA, 13 bp, Homo sapiens
actttctcttaag

SEQ ID NO: 1249194 - DNA, 16 bp, Homo sapiens
agaaacttaagcaaag

SEQ ID NO: 1249195 - DNA, 18 bp, Homo sapiens
agaaacttaagcaaaggg

SEQ ID NO: 1249196 - DNA, 19 bp, Homo sapiens
agaaacttaccaattgatg

SEQ ID NO: 1249197 - DNA, 14 bp, Homo sapiens
agaaacttccaaat

SEQ ID NO: 1249198 - DNA, 18 bp, Homo sapiens
agaaacttgaactccagg

SEQ ID NO: 1249199 - DNA, 15 bp, Homo sapiens
agaaactttctttct

SEQ ID NO: 1249200 - DNA, 19 bp, Homo sapiens
agaaactttgatctctgct

SEQ ID NO: 1249201 - DNA, 17 bp, Homo sapiens
agaaagaaaagaccctg

SEQ ID NO: 1249202 - DNA, 16 bp, Homo sapiens
agaaagaaaatgaaga

SEQ ID NO: 1249203 - DNA, 21 bp, Homo sapiens
agaaagaactttaaagctcag

SEQ ID NO: 1249204 - DNA, 24 bp, Homo sapiens
agaaagaactttaaagctcaggag

SEQ ID NO: 1249205 - DNA, 22 bp, Homo sapiens
agaaagaagacaaactttgcat

SEQ ID NO: 1249206 - DNA, 12 bp, Homo sapiens
agaaagaagccc

SEQ ID NO: 1249207 - DNA, 12 bp, Homo sapiens
agaaagaaggaa

SEQ ID NO: 1249208 - DNA, 22 bp, Homo sapiens
agaaagaatgttactgccttaa

SEQ ID NO: 1249209 - DNA, 12 bp, Homo sapiens
agaaagacttgg

SEQ ID NO: 1249210 - DNA, 22 bp, Homo sapiens
agaaagacttggttggtagggt

SEQ ID NO: 1249211 - DNA, 15 bp, Homo sapiens
agaaagagaatgaac

SEQ ID NO: 1249212 - DNA, 18 bp, Homo sapiens
agaaagagaatgaactgt

SEQ ID NO: 1249213 - DNA, 24 bp, Homo sapiens
agaaagagaatgaactgtggaatt

SEQ ID NO: 1249214 - DNA, 14 bp, Homo sapiens
agaaagaggggcct

SEQ ID NO: 1249215 - DNA, 17 bp, Homo sapiens
agaaagatcgtttaaaa

SEQ ID NO: 1249216 - DNA, 14 bp, Homo sapiens
agaaagatttgtta

SEQ ID NO: 1249217 - DNA, 20 bp, Homo sapiens
agaaagatttgttactgtat

SEQ ID NO: 1249218 - DNA, 15 bp, Homo sapiens
agaaagcaaaattat

SEQ ID NO: 1249219 - DNA, 21 bp, Homo sapiens
agaaagcaaaattatgtttgc

SEQ ID NO: 1249220 - DNA, 17 bp, Homo sapiens
agaaagcacctgttttt

SEQ ID NO: 1249221 - DNA, 20 bp, Homo sapiens
agaaagcactacaatcatgg

SEQ ID NO: 1249222 - DNA, 17 bp, Homo sapiens
agaaagcatattgactt

SEQ ID NO: 1249223 - DNA, 18 bp, Homo sapiens
agaaagccatattccagc

SEQ ID NO: 1249224 - DNA, 15 bp, Homo sapiens
agaaagcccacctgg

SEQ ID NO: 1249225 - DNA, 20 bp, Homo sapiens
agaaagcccacctgggctgg

SEQ ID NO: 1249226 - DNA, 21 bp, Homo sapiens
agaaagcccacctgggctggg

SEQ ID NO: 1249227 - DNA, 15 bp, Homo sapiens
agaaagccgggggag

SEQ ID NO: 1249228 - DNA, 16 bp, Homo sapiens
agaaagccgggggagg

SEQ ID NO: 1249229 - DNA, 18 bp, Homo sapiens
agaaagcctaaaattgag

SEQ ID NO: 1249230 - DNA, 12 bp, Homo sapiens
agaaagcctcct

SEQ ID NO: 1249231 - DNA, 21 bp, Homo sapiens
agaaagcctcctgccccctgc

SEQ ID NO: 1249232 - DNA, 23 bp, Homo sapiens
agaaagcctcctgccccctgcca

SEQ ID NO: 1249233 - DNA, 15 bp, Homo sapiens
agaaagcctctctct

SEQ ID NO: 1249234 - DNA, 18 bp, Homo sapiens
agaaagcctctctctccc

SEQ ID NO: 1249235 - DNA, 15 bp, Homo sapiens
agaaagctaaaatgg

SEQ ID NO: 1249236 - DNA, 19 bp, Homo sapiens
agaaagctagatatgcctt

SEQ ID NO: 1249237 - DNA, 11 bp, Homo sapiens
agaaagctgcc

SEQ ID NO: 1249238 - DNA, 14 bp, Homo sapiens
agaaagctgccaga

SEQ ID NO: 1249239 - DNA, 19 bp, Homo sapiens
agaaagctggcaacatgaa

SEQ ID NO: 1249240 - DNA, 17 bp, Homo sapiens
agaaagcttttattcct

SEQ ID NO: 1249241 - DNA, 14 bp, Homo sapiens
agaaaggaaacctt

SEQ ID NO: 1249242 - DNA, 21 bp, Homo sapiens
agaaaggaagcattgtaaaat

SEQ ID NO: 1249243 - DNA, 23 bp, Homo sapiens
agaaaggagagaacgggcgtcag

SEQ ID NO: 1249244 - DNA, 17 bp, Homo sapiens
agaaaggagtctgcaca

SEQ ID NO: 1249245 - DNA, 14 bp, Homo sapiens
agaaaggatataaa

SEQ ID NO: 1249246 - DNA, 16 bp, Homo sapiens
agaaaggatatttaag

SEQ ID NO: 1249247 - DNA, 14 bp, Homo sapiens
agaaaggcagccct

SEQ ID NO: 1249248 - DNA, 21 bp, Homo sapiens
agaaaggcagccctcacctct

SEQ ID NO: 1249249 - DNA, 17 bp, Homo sapiens
agaaaggcaggtttcat

SEQ ID NO: 1249250 - DNA, 19 bp, Homo sapiens
agaaagggagaggaagaga

SEQ ID NO: 1249251 - DNA, 20 bp, Homo sapiens
agaaagggagaggaagagaa

SEQ ID NO: 1249252 - DNA, 17 bp, Homo sapiens
agaaagggaggcccagc

SEQ ID NO: 1249253 - DNA, 15 bp, Homo sapiens
agaaagggattgctt

SEQ ID NO: 1249254 - DNA, 14 bp, Homo sapiens
agaaagggcaaatt

SEQ ID NO: 1249255 - DNA, 16 bp, Homo sapiens
agaaagggccaggaga

SEQ ID NO: 1249256 - DNA, 20 bp, Homo sapiens
agaaagggccaggagatgga

SEQ ID NO: 1249257 - DNA, 20 bp, Homo sapiens
agaaaggggcagtttaaagc

SEQ ID NO: 1249258 - DNA, 16 bp, Homo sapiens
agaaaggtcatccaaa

SEQ ID NO: 1249259 - DNA, 22 bp, Homo sapiens
agaaaggtgagtttgagctgcc

SEQ ID NO: 1249260 - DNA, 17 bp, Homo sapiens
agaaagtaaatctgaga

SEQ ID NO: 1249261 - DNA, 18 bp, Homo sapiens
agaaagtcaaaaaattat

SEQ ID NO: 1249262 - DNA, 19 bp, Homo sapiens
agaaagtcaaaaaattatt

SEQ ID NO: 1249263 - DNA, 14 bp, Homo sapiens
agaaagtcaccagg

SEQ ID NO: 1249264 - DNA, 17 bp, Homo sapiens
agaaagtcaccaggact

SEQ ID NO: 1249265 - DNA, 20 bp, Homo sapiens
agaaagtcgaattaatagct

SEQ ID NO: 1249266 - DNA, 13 bp, Homo sapiens
agaaagtgacatt

SEQ ID NO: 1249267 - DNA, 19 bp, Homo sapiens
agaaagtgcctgacacact

SEQ ID NO: 1249268 - DNA, 23 bp, Homo sapiens
agaaagtgcctttatctcagcca

SEQ ID NO: 1249269 - DNA, 19 bp, Homo sapiens
agaaagtggaaaacaagga

SEQ ID NO: 1249270 - DNA, 20 bp, Homo sapiens
agaaagtggaaaacaaggaa

SEQ ID NO: 1249271 - DNA, 21 bp, Homo sapiens
agaaagtggccatgccaccct

SEQ ID NO: 1249272 - DNA, 17 bp, Homo sapiens
agaaagttattcttggt

SEQ ID NO: 1249273 - DNA, 18 bp, Homo sapiens
agaaataaaaggaagcca

SEQ ID NO: 1249274 - DNA, 19 bp, Homo sapiens
agaaataaaaggaagccaa

SEQ ID NO: 1249275 - DNA, 23 bp, Homo sapiens
agaaataaaccttaatatttctt

SEQ ID NO: 1249276 - DNA, 21 bp, Homo sapiens
agaaataaagttggtgacaga

SEQ ID NO: 1249277 - DNA, 18 bp, Homo sapiens
agaaataaatagctatat

SEQ ID NO: 1249278 - DNA, 22 bp, Homo sapiens
agaaataaatagctatatccat

SEQ ID NO: 1249279 - DNA, 14 bp, Homo sapiens
agaaataaatatac

SEQ ID NO: 1249280 - DNA, 11 bp, Homo sapiens
agaaataaatt

SEQ ID NO: 1249281 - DNA, 17 bp, Homo sapiens
agaaataaattcctaaa

SEQ ID NO: 1249282 - DNA, 23 bp, Homo sapiens
agaaataaattcctaaactccct

SEQ ID NO: 1249283 - DNA, 21 bp, Homo sapiens
agaaataacagaagaaaatag

SEQ ID NO: 1249284 - DNA, 21 bp, Homo sapiens
agaaataagtggttatttctc

SEQ ID NO: 1249285 - DNA, 23 bp, Homo sapiens
agaaataagtttttgtttcacag

SEQ ID NO: 1249286 - DNA, 18 bp, Homo sapiens
agaaataatgcctccaat

SEQ ID NO: 1249287 - DNA, 13 bp, Homo sapiens
agaaataattgtt

SEQ ID NO: 1249288 - DNA, 19 bp, Homo sapiens
agaaatacagtcttccaca

SEQ ID NO: 1249289 - DNA, 14 bp, Homo sapiens
agaaatactgctct

SEQ ID NO: 1249290 - DNA, 19 bp, Homo sapiens
agaaatactgctctgaata

SEQ ID NO: 1249291 - DNA, 13 bp, Homo sapiens
agaaatagagcca

SEQ ID NO: 1249292 - DNA, 14 bp, Homo sapiens
agaaatagagccaa

SEQ ID NO: 1249293 - DNA, 19 bp, Homo sapiens
agaaatatacagtttgact

SEQ ID NO: 1249294 - DNA, 23 bp, Homo sapiens
agaaatatacagtttgacttttt

SEQ ID NO: 1249295 - DNA, 19 bp, Homo sapiens
agaaatatctgaaaatgta

SEQ ID NO: 1249296 - DNA, 14 bp, Homo sapiens
agaaatatctttct

SEQ ID NO: 1249297 - DNA, 19 bp, Homo sapiens
agaaatatctttctcttac

SEQ ID NO: 1249298 - DNA, 16 bp, Homo sapiens
agaaatatgattttat

SEQ ID NO: 1249299 - DNA, 21 bp, Homo sapiens
agaaatatgcacaatagcagt

SEQ ID NO: 1249300 - DNA, 14 bp, Homo sapiens
agaaatatgtggtt

SEQ ID NO: 1249301 - DNA, 13 bp, Homo sapiens
agaaatatttacc

SEQ ID NO: 1249302 - DNA, 21 bp, Homo sapiens
agaaatattttaaaatcagct

SEQ ID NO: 1249303 - DNA, 14 bp, Homo sapiens
agaaatcaaaagaa

SEQ ID NO: 1249304 - DNA, 15 bp, Homo sapiens
agaaatcaacttgtg

SEQ ID NO: 1249305 - DNA, 19 bp, Homo sapiens
agaaatcaagtaatgaatc

SEQ ID NO: 1249306 - DNA, 19 bp, Homo sapiens
agaaatcaatagttgaatt

SEQ ID NO: 1249307 - DNA, 22 bp, Homo sapiens
agaaatcactgtgaaatttcat

SEQ ID NO: 1249308 - DNA, 13 bp, Homo sapiens
agaaatcagaatt

SEQ ID NO: 1249309 - DNA, 14 bp, Homo sapiens
agaaatcagaggag

SEQ ID NO: 1249310 - DNA, 15 bp, Homo sapiens
agaaatcaggtgttt

SEQ ID NO: 1249311 - DNA, 16 bp, Homo sapiens
agaaatcaggtgtttt

SEQ ID NO: 1249312 - DNA, 18 bp, Homo sapiens
agaaatcaggtgttttaa

SEQ ID NO: 1249313 - DNA, 22 bp, Homo sapiens
agaaatcaggtgttttaagact

SEQ ID NO: 1249314 - DNA, 18 bp, Homo sapiens
agaaatcagtaatattta

SEQ ID NO: 1249315 - DNA, 19 bp, Homo sapiens
agaagagaggaaataacag

SEQ ID NO: 1249316 - DNA, 22 bp, Homo sapiens
agaagagatgggcttgttttct

SEQ ID NO: 1249317 - DNA, 15 bp, Homo sapiens
agaagagatgtggca

SEQ ID NO: 1249318 - DNA, 22 bp, Homo sapiens
agaagagatgtggcaaagtgct

SEQ ID NO: 1249319 - DNA, 24 bp, Homo sapiens
agaagagcgagagatcaaagatga

SEQ ID NO: 1249320 - DNA, 17 bp, Homo sapiens
agaagaggcagattcaa

SEQ ID NO: 1249321 - DNA, 17 bp, Homo sapiens
agaagaggctggtgctg

SEQ ID NO: 1249322 - DNA, 22 bp, Homo sapiens
agaagaggctggtgctgtggcc

SEQ ID NO: 1249323 - DNA, 18 bp, Homo sapiens
agaagagggcctgtggga

SEQ ID NO: 1249324 - DNA, 24 bp, Homo sapiens
agaagagggcctgtgggagcctgc

SEQ ID NO: 1249325 - DNA, 15 bp, Homo sapiens
agaagagtctattgt

SEQ ID NO: 1249326 - DNA, 16 bp, Homo sapiens
agaagagtttaaaagc

SEQ ID NO: 1249327 - DNA, 23 bp, Homo sapiens
agaagagtttaaaagcatgaaac

SEQ ID NO: 1249328 - DNA, 15 bp, Homo sapiens
agaagataatgttct

SEQ ID NO: 1249329 - DNA, 17 bp, Homo sapiens
agaagatagggaacact

SEQ ID NO: 1249330 - DNA, 18 bp, Homo sapiens
agaagatagggaacactc

SEQ ID NO: 1249331 - DNA, 17 bp, Homo sapiens
agaagatagtcttggaa

SEQ ID NO: 1249332 - DNA, 21 bp, Homo sapiens
agaagatctaccccagggaga

SEQ ID NO: 1249333 - DNA, 16 bp, Homo sapiens
agaagatgatcagacc

SEQ ID NO: 1249334 - DNA, 20 bp, Homo sapiens
agaagatgccagcttctctc

SEQ ID NO: 1249335 - DNA, 14 bp, Homo sapiens
agaagatgccctcc

SEQ ID NO: 1249336 - DNA, 17 bp, Homo sapiens
agaagatgcctgttaat

SEQ ID NO: 1249337 - DNA, 19 bp, Homo sapiens
agaagatggactctgaaaa

SEQ ID NO: 1249338 - DNA, 12 bp, Homo sapiens
agaagatgtgta

SEQ ID NO: 1249339 - DNA, 17 bp, Homo sapiens
agaagattttataagaa

SEQ ID NO: 1249340 - DNA, 23 bp, Homo sapiens
agaagattttataagaattttgc

SEQ ID NO: 1249341 - DNA, 14 bp, Homo sapiens
agaagcaagccaga

SEQ ID NO: 1249342 - DNA, 15 bp, Homo sapiens
agaagcaagccagac

SEQ ID NO: 1249343 - DNA, 16 bp, Homo sapiens
agaagcaagggcaaga

SEQ ID NO: 1249344 - DNA, 19 bp, Homo sapiens
agaagcaatctttgaaata

SEQ ID NO: 1249345 - DNA, 16 bp, Homo sapiens
agaagcacagaatatt

SEQ ID NO: 1249346 - DNA, 19 bp, Homo sapiens
agaagcacagaatattttt

SEQ ID NO: 1249347 - DNA, 15 bp, Homo sapiens
agaagcacagctcct

SEQ ID NO: 1249348 - DNA, 19 bp, Homo sapiens
agaagcacagctcctgcca

SEQ ID NO: 1249349 - DNA, 20 bp, Homo sapiens
agaagcacagctcctgccag

SEQ ID NO: 1249350 - DNA, 16 bp, Homo sapiens
agaagcagaggaagga

SEQ ID NO: 1249351 - DNA, 16 bp, Homo sapiens
agaagcagcttctttt

SEQ ID NO: 1249352 - DNA, 21 bp, Homo sapiens
agaagcagcttcttttgtctc

SEQ ID NO: 1249353 - DNA, 14 bp, Homo sapiens
agaagcaggctgga

SEQ ID NO: 1249354 - DNA, 17 bp, Homo sapiens
agaagcagtgagccgca

SEQ ID NO: 1249355 - DNA, 17 bp, Homo sapiens
agaagcatattttgctg

SEQ ID NO: 1249356 - DNA, 15 bp, Homo sapiens
agaagcatgaaaaag

SEQ ID NO: 1249357 - DNA, 23 bp, Homo sapiens
agaagcatttgtattttgtgtga

SEQ ID NO: 1249358 - DNA, 23 bp, Homo sapiens
agaagccaactatgattattaac

SEQ ID NO: 1249359 - DNA, 22 bp, Homo sapiens
agaagccaagcgctcatgttga

SEQ ID NO: 1249360 - DNA, 23 bp, Homo sapiens
agaagccaagctccctggagccc

SEQ ID NO: 1249361 - DNA, 15 bp, Homo sapiens
agaagccaagggaaa

SEQ ID NO: 1249362 - DNA, 16 bp, Homo sapiens
agaagccaagggaaag

SEQ ID NO: 1249363 - DNA, 22 bp, Homo sapiens
agaagccaagggaaaggggtgc

SEQ ID NO: 1249364 - DNA, 16 bp, Homo sapiens
agaagccaccttccca

SEQ ID NO: 1249365 - DNA, 13 bp, Homo sapiens
agaagccagaagg

SEQ ID NO: 1249366 - DNA, 12 bp, Homo sapiens
agaagccaggag

SEQ ID NO: 1249367 - DNA, 20 bp, Homo sapiens
agaagccaggagcaaatgtt

SEQ ID NO: 1249368 - DNA, 22 bp, Homo sapiens
agaagccatatatgaccagaag

SEQ ID NO: 1249369 - DNA, 22 bp, Homo sapiens
agaagcccaaattcatataaaa

SEQ ID NO: 1249370 - DNA, 18 bp, Homo sapiens
agaagcccagtggtgagg

SEQ ID NO: 1249371 - DNA, 18 bp, Homo sapiens
agaagcccatgtcttctg

SEQ ID NO: 1249372 - DNA, 18 bp, Homo sapiens
agaagccccgcacgggct

SEQ ID NO: 1249373 - DNA, 20 bp, Homo sapiens
agaagcccgtgtgagaagtg

SEQ ID NO: 1249374 - DNA, 18 bp, Homo sapiens
agaagccgggaacagaca

SEQ ID NO: 1249375 - DNA, 22 bp, Homo sapiens
agaagccgggaacagacaacag

SEQ ID NO: 1249376 - DNA, 20 bp, Homo sapiens
agaagcctcgttttgatgcc

SEQ ID NO: 1249377 - DNA, 16 bp, Homo sapiens
agaagcctctggctag

SEQ ID NO: 1249378 - DNA, 23 bp, Homo sapiens
agaagcctctggctagaggccag

SEQ ID NO: 1249379 - DNA, 20 bp, Homo sapiens
agaagcctggactctgcccc

SEQ ID NO: 1249380 - DNA, 20 bp, Homo sapiens
agaagccttaatttgcacag

SEQ ID NO: 1249381 - DNA, 13 bp, Homo sapiens
agaagccttcagc

SEQ ID NO: 1249382 - DNA, 19 bp, Homo sapiens
agaagcgatttaagttaca

SEQ ID NO: 1249383 - DNA, 18 bp, Homo sapiens
agaagcgcggctaactta

SEQ ID NO: 1249384 - DNA, 16 bp, Homo sapiens
agaagcggatttccag

SEQ ID NO: 1249385 - DNA, 23 bp, Homo sapiens
agaagcgggacgagaccctacag

SEQ ID NO: 1249386 - DNA, 15 bp, Homo sapiens
agaagcgtttttaac

SEQ ID NO: 1249387 - DNA, 14 bp, Homo sapiens
agaagctaatgtag

SEQ ID NO: 1249388 - DNA, 23 bp, Homo sapiens
agaagctaatgtaggactgtata

SEQ ID NO: 1249389 - DNA, 15 bp, Homo sapiens
agaagctagatgccc

SEQ ID NO: 1249390 - DNA, 19 bp, Homo sapiens
agaagctagatgcccctgc

SEQ ID NO: 1249391 - DNA, 21 bp, Homo sapiens
agaagctagatgcccctgcag

SEQ ID NO: 1249392 - DNA, 22 bp, Homo sapiens
agaagctatattagctgaaaca

SEQ ID NO: 1249393 - DNA, 13 bp, Homo sapiens
agaagctattttt

SEQ ID NO: 1249394 - DNA, 15 bp, Homo sapiens
agaagctcccaggaa

SEQ ID NO: 1249395 - DNA, 17 bp, Homo sapiens
agaagctctccaggccc

SEQ ID NO: 1249396 - DNA, 20 bp, Homo sapiens
agaagctcttactctttcct

SEQ ID NO: 1249397 - DNA, 14 bp, Homo sapiens
agaagctgaggcct

SEQ ID NO: 1249398 - DNA, 15 bp, Homo sapiens
agaagctgaggccta

SEQ ID NO: 1249399 - DNA, 13 bp, Homo sapiens
agaagctgcaggc

SEQ ID NO: 1249400 - DNA, 15 bp, Homo sapiens
agaagctgcaggctt

SEQ ID NO: 1249401 - DNA, 13 bp, Homo sapiens
agaagctgcatgt

SEQ ID NO: 1249402 - DNA, 18 bp, Homo sapiens
agaagctgctccaggcct

SEQ ID NO: 1249403 - DNA, 19 bp, Homo sapiens
agaagctgctccaggcctg

SEQ ID NO: 1249404 - DNA, 23 bp, Homo sapiens
agaagctgctccaggcctgcagc

SEQ ID NO: 1249405 - DNA, 16 bp, Homo sapiens
agaagcttcagaagtt

SEQ ID NO: 1249406 - DNA, 17 bp, Homo sapiens
agaagcttcagaagttt

SEQ ID NO: 1249407 - DNA, 18 bp, Homo sapiens
agaagcttccacaaaatt

SEQ ID NO: 1249408 - DNA, 18 bp, Homo sapiens
agaagcttccattccaag

SEQ ID NO: 1249409 - DNA, 19 bp, Homo sapiens
agaaggaaaacatgctgct

SEQ ID NO: 1249410 - DNA, 15 bp, Homo sapiens
agaaggaaagatggt

SEQ ID NO: 1249411 - DNA, 19 bp, Homo sapiens
agaaggaaagatggttaaa

SEQ ID NO: 1249412 - DNA, 16 bp, Homo sapiens
agaaggaaagggaaga

SEQ ID NO: 1249413 - DNA, 13 bp, Homo sapiens
agaaggaaatgat

SEQ ID NO: 1249414 - DNA, 9 bp, Homo sapiens
agaaggaag

SEQ ID NO: 1249415 - DNA, 17 bp, Homo sapiens
agaaggaatttgtactt

SEQ ID NO: 1249416 - DNA, 14 bp, Homo sapiens
agaaggagaaggaa

SEQ ID NO: 1249417 - DNA, 22 bp, Homo sapiens
agaaggaggaatgctggactgg

SEQ ID NO: 1249418 - DNA, 12 bp, Homo sapiens
agaaggagggca

SEQ ID NO: 1249419 - DNA, 16 bp, Homo sapiens
agaaggagggcagagc

SEQ ID NO: 1249420 - DNA, 21 bp, Homo sapiens
agaaggagggcagagccatgg

SEQ ID NO: 1249421 - DNA, 20 bp, Homo sapiens
agaaggagtcagaaactgtt

SEQ ID NO: 1249422 - DNA, 14 bp, Homo sapiens
agaaggatgaatga

SEQ ID NO: 1249423 - DNA, 21 bp, Homo sapiens
agaaggatgaatgaggtccca

SEQ ID NO: 1249424 - DNA, 13 bp, Homo sapiens
agaaggatgatgt

SEQ ID NO: 1249425 - DNA, 16 bp, Homo sapiens
agaaggatgtacattt

SEQ ID NO: 1249426 - DNA, 13 bp, Homo sapiens
agaaggcaatatt

SEQ ID NO: 1249427 - DNA, 15 bp, Homo sapiens
agaaggcacacagag

SEQ ID NO: 1249428 - DNA, 15 bp, Homo sapiens
agaaggcagggaaag

SEQ ID NO: 1249429 - DNA, 22 bp, Homo sapiens
agaaggccccagagagaccctg

SEQ ID NO: 1249430 - DNA, 15 bp, Homo sapiens
agaaggcgtccatgt

SEQ ID NO: 1249431 - DNA, 22 bp, Homo sapiens
agaaggctatgtaaacaaacca

SEQ ID NO: 1249432 - DNA, 18 bp, Homo sapiens
agaagggaatcctcctcc

SEQ ID NO: 1249433 - DNA, 14 bp, Homo sapiens
agaagggagaagaa

SEQ ID NO: 1249434 - DNA, 14 bp, Homo sapiens
agaagggagaagga

SEQ ID NO: 1249435 - DNA, 17 bp, Homo sapiens
agaagggctcctgcagg

SEQ ID NO: 1249436 - DNA, 18 bp, Homo sapiens
agacatttttgtgccatt

SEQ ID NO: 1249437 - DNA, 15 bp, Homo sapiens
agacattttttgcta

SEQ ID NO: 1249438 - DNA, 17 bp, Homo sapiens
agacattttttgctata

SEQ ID NO: 1249439 - DNA, 18 bp, Homo sapiens
agacattttttgctataa

SEQ ID NO: 1249440 - DNA, 22 bp, Homo sapiens
agacattttttgctataatcat

SEQ ID NO: 1249441 - DNA, 13 bp, Homo sapiens
agaccaaaataaa

SEQ ID NO: 1249442 - DNA, 22 bp, Homo sapiens
agaccaaaattactaataaatt

SEQ ID NO: 1249443 - DNA, 18 bp, Homo sapiens
agaccaaacagtgctgtt

SEQ ID NO: 1249444 - DNA, 17 bp, Homo sapiens
agaccaaaggaaggaac

SEQ ID NO: 1249445 - DNA, 20 bp, Homo sapiens
agaccaaaggaaggaacgct

SEQ ID NO: 1249446 - DNA, 22 bp, Homo sapiens
agaccaaatctcagttgtttgc

SEQ ID NO: 1249447 - DNA, 14 bp, Homo sapiens
agaccaaatgtagt

SEQ ID NO: 1249448 - DNA, 23 bp, Homo sapiens
agaccaaatgtcggggttggggt

SEQ ID NO: 1249449 - DNA, 22 bp, Homo sapiens
agaccaacgttactcagggctc

SEQ ID NO: 1249450 - DNA, 16 bp, Homo sapiens
agaccaagtcctggct

SEQ ID NO: 1249451 - DNA, 11 bp, Homo sapiens
agaccaataaa

SEQ ID NO: 1249452 - DNA, 15 bp, Homo sapiens
agaccacacatttta

SEQ ID NO: 1249453 - DNA, 13 bp, Homo sapiens
agaccacatcttt

SEQ ID NO: 1249454 - DNA, 16 bp, Homo sapiens
agaccaccacttcgaa

SEQ ID NO: 1249455 - DNA, 21 bp, Homo sapiens
agaccaccagccgccccagcc

SEQ ID NO: 1249456 - DNA, 14 bp, Homo sapiens
agaccaccagggtc

SEQ ID NO: 1249457 - DNA, 19 bp, Homo sapiens
agaccaccagggtcccagg

SEQ ID NO: 1249458 - DNA, 18 bp, Homo sapiens
agaccacccatatcatgc

SEQ ID NO: 1249459 - DNA, 23 bp, Homo sapiens
agaccacgcccgtcctgcctgtg

SEQ ID NO: 1249460 - DNA, 24 bp, Homo sapiens
agaccacgcccgtcctgcctgtgg

SEQ ID NO: 1249461 - DNA, 14 bp, Homo sapiens
agaccacgtttcta

SEQ ID NO: 1249462 - DNA, 15 bp, Homo sapiens
agaccacgtttctaa

SEQ ID NO: 1249463 - DNA, 15 bp, Homo sapiens
agaccagaaagtgtg

SEQ ID NO: 1249464 - DNA, 12 bp, Homo sapiens
agaccagaaatt

SEQ ID NO: 1249465 - DNA, 14 bp, Homo sapiens
agaccagaaattcc

SEQ ID NO: 1249466 - DNA, 18 bp, Homo sapiens
agaccagaattcccttga

SEQ ID NO: 1249467 - DNA, 19 bp, Homo sapiens
agaccagaattcccttgaa

SEQ ID NO: 1249468 - DNA, 16 bp, Homo sapiens
agaccagactgtggag

SEQ ID NO: 1249469 - DNA, 18 bp, Homo sapiens
agaccagagctgtctgaa

SEQ ID NO: 1249470 - DNA, 15 bp, Homo sapiens
agaccagcctggcca

SEQ ID NO: 1249471 - DNA, 12 bp, Homo sapiens
agaccagctctt

SEQ ID NO: 1249472 - DNA, 13 bp, Homo sapiens
agaccagctcttc

SEQ ID NO: 1249473 - DNA, 18 bp, Homo sapiens
agaccagggcttttccca

SEQ ID NO: 1249474 - DNA, 23 bp, Homo sapiens
agaccagtggtctggaaacagct

SEQ ID NO: 1249475 - DNA, 22 bp, Homo sapiens
agaccagttgaataaaagtgca

SEQ ID NO: 1249476 - DNA, 13 bp, Homo sapiens
agaccagttggga

SEQ ID NO: 1249477 - DNA, 19 bp, Homo sapiens
agaccagttgggagcactg

SEQ ID NO: 1249478 - DNA, 16 bp, Homo sapiens
agaccagtttgcatga

SEQ ID NO: 1249479 - DNA, 13 bp, Homo sapiens
agaccataatgtt

SEQ ID NO: 1249480 - DNA, 15 bp, Homo sapiens
agaccatccctgaag

SEQ ID NO: 1249481 - DNA, 16 bp, Homo sapiens
agaccatccctgaaga

SEQ ID NO: 1249482 - DNA, 15 bp, Homo sapiens
agaccatcctggcta

SEQ ID NO: 1249483 - DNA, 22 bp, Homo sapiens
agaccatgaagtaaattatgta

SEQ ID NO: 1249484 - DNA, 13 bp, Homo sapiens
agaccatgccaga

SEQ ID NO: 1249485 - DNA, 21 bp, Homo sapiens
agaccatggacactacaccca

SEQ ID NO: 1249486 - DNA, 22 bp, Homo sapiens
agaccatggacactacacccag

SEQ ID NO: 1249487 - DNA, 23 bp, Homo sapiens
agaccatggacactacacccagc

SEQ ID NO: 1249488 - DNA, 20 bp, Homo sapiens
agaccatgtggagacttcat

SEQ ID NO: 1249489 - DNA, 12 bp, Homo sapiens
agaccattctgt

SEQ ID NO: 1249490 - DNA, 14 bp, Homo sapiens
agaccattctgtga

SEQ ID NO: 1249491 - DNA, 22 bp, Homo sapiens
agacccaaattataagggccct

SEQ ID NO: 1249492 - DNA, 16 bp, Homo sapiens
agacccaaggaggaaa

SEQ ID NO: 1249493 - DNA, 16 bp, Homo sapiens
agacccaaggctcact

SEQ ID NO: 1249494 - DNA, 23 bp, Homo sapiens
agacccaagtcaaagatgcccca

SEQ ID NO: 1249495 - DNA, 15 bp, Homo sapiens
agacccacctggagc

SEQ ID NO: 1249496 - DNA, 20 bp, Homo sapiens
agacccacctggagcccgct

SEQ ID NO: 1249497 - DNA, 23 bp, Homo sapiens
agacccagagaaggacggtgcca

SEQ ID NO: 1249498 - DNA, 18 bp, Homo sapiens
agacccagaggccctgaa

SEQ ID NO: 1249499 - DNA, 20 bp, Homo sapiens
agacccagaggccctgaagc

SEQ ID NO: 1249500 - DNA, 22 bp, Homo sapiens
agacccagcccgcggcctggac

SEQ ID NO: 1249501 - DNA, 17 bp, Homo sapiens
agacccagccctcatcc

SEQ ID NO: 1249502 - DNA, 19 bp, Homo sapiens
agacccagccctcatcccg

SEQ ID NO: 1249503 - DNA, 17 bp, Homo sapiens
agacccagctgcagacc

SEQ ID NO: 1249504 - DNA, 21 bp, Homo sapiens
agacccagtgagtgaatcagg

SEQ ID NO: 1249505 - DNA, 16 bp, Homo sapiens
agacccatgtgctggg

SEQ ID NO: 1249506 - DNA, 19 bp, Homo sapiens
agacccatgtgctgggaaa

SEQ ID NO: 1249507 - DNA, 21 bp, Homo sapiens
agacccattccttagctattt

SEQ ID NO: 1249508 - DNA, 15 bp, Homo sapiens
agaccccacccaagc

SEQ ID NO: 1249509 - DNA, 14 bp, Homo sapiens
agacccccacacct

SEQ ID NO: 1249510 - DNA, 15 bp, Homo sapiens
agacccccacacctc

SEQ ID NO: 1249511 - DNA, 12 bp, Homo sapiens
agacccccaccc

SEQ ID NO: 1249512 - DNA, 13 bp, Homo sapiens
agacccccacccc

SEQ ID NO: 1249513 - DNA, 16 bp, Homo sapiens
agacccccaccccttc

SEQ ID NO: 1249514 - DNA, 20 bp, Homo sapiens
agacccccagcaaccctcct

SEQ ID NO: 1249515 - DNA, 14 bp, Homo sapiens
agacccccagcact

SEQ ID NO: 1249516 - DNA, 15 bp, Homo sapiens
agacccccaggcaga

SEQ ID NO: 1249517 - DNA, 13 bp, Homo sapiens
agacccccaggcc

SEQ ID NO: 1249518 - DNA, 14 bp, Homo sapiens
agacccccaggcct

SEQ ID NO: 1249519 - DNA, 15 bp, Homo sapiens
agacccccaggcctg

SEQ ID NO: 1249520 - DNA, 17 bp, Homo sapiens
agacccccatttgtccc

SEQ ID NO: 1249521 - DNA, 19 bp, Homo sapiens
agacccccatttgtcccag

SEQ ID NO: 1249522 - DNA, 13 bp, Homo sapiens
agacccccccatt

SEQ ID NO: 1249523 - DNA, 18 bp, Homo sapiens
agaccccgcactgcagac

SEQ ID NO: 1249524 - DNA, 18 bp, Homo sapiens
agaccccgtggctctggg

SEQ ID NO: 1249525 - DNA, 20 bp, Homo sapiens
agaccccgtggctctgggag

SEQ ID NO: 1249526 - DNA, 19 bp, Homo sapiens
agacccctctggccaggat

SEQ ID NO: 1249527 - DNA, 21 bp, Homo sapiens
agacccctctggccaggatgg

SEQ ID NO: 1249528 - DNA, 13 bp, Homo sapiens
agacccctgcctg

SEQ ID NO: 1249529 - DNA, 13 bp, Homo sapiens
agacccctgtctc

SEQ ID NO: 1249530 - DNA, 14 bp, Homo sapiens
agacccctgtctcc

SEQ ID NO: 1249531 - DNA, 23 bp, Homo sapiens
agacccctgtctttgctgagagc

SEQ ID NO: 1249532 - DNA, 19 bp, Homo sapiens
agaccccttgttgcactgc

SEQ ID NO: 1249533 - DNA, 17 bp, Homo sapiens
agacccggtcctgccct

SEQ ID NO: 1249534 - DNA, 22 bp, Homo sapiens
agacccggttattcgcccaccc

SEQ ID NO: 1249535 - DNA, 19 bp, Homo sapiens
agaccctaagcctcctttt

SEQ ID NO: 1249536 - DNA, 16 bp, Homo sapiens
agaccctcgcagacct

SEQ ID NO: 1249537 - DNA, 14 bp, Homo sapiens
agaccctcttgccc

SEQ ID NO: 1249538 - DNA, 15 bp, Homo sapiens
agaccctcttgccca

SEQ ID NO: 1249539 - DNA, 18 bp, Homo sapiens
agaccctcttgcccatcc

SEQ ID NO: 1249540 - DNA, 18 bp, Homo sapiens
agaccctgagactccaga

SEQ ID NO: 1249541 - DNA, 18 bp, Homo sapiens
agaccctgaggccctggg

SEQ ID NO: 1249542 - DNA, 20 bp, Homo sapiens
agaccctgcaaacagaacag

SEQ ID NO: 1249543 - DNA, 21 bp, Homo sapiens
agaccctgcaaacagaacagg

SEQ ID NO: 1249544 - DNA, 22 bp, Homo sapiens
agaccctgcaaacagaacaggg

SEQ ID NO: 1249545 - DNA, 19 bp, Homo sapiens
agaccctgccacagccaga

SEQ ID NO: 1249546 - DNA, 20 bp, Homo sapiens
agaccctgccacagccagag

SEQ ID NO: 1249547 - DNA, 22 bp, Homo sapiens
agaccctgccacagccagagga

SEQ ID NO: 1249548 - DNA, 13 bp, Homo sapiens
agaccctgcctga

SEQ ID NO: 1249549 - DNA, 18 bp, Homo sapiens
agaccctgcctgagccca

SEQ ID NO: 1249550 - DNA, 12 bp, Homo sapiens
agaccctggagg

SEQ ID NO: 1249551 - DNA, 15 bp, Homo sapiens
agaccctgggagaga

SEQ ID NO: 1249552 - DNA, 14 bp, Homo sapiens
agaccgagaggcca

SEQ ID NO: 1249553 - DNA, 13 bp, Homo sapiens
agaccgcagaggg

SEQ ID NO: 1249554 - DNA, 17 bp, Homo sapiens
agaccgccccagggcta

SEQ ID NO: 1249555 - DNA, 19 bp, Homo sapiens
agaccgcttcacccctgca

SEQ ID NO: 1249556 - DNA, 23 bp, Homo sapiens
agaccgtcgggggctgaggggca

SEQ ID NO: 1249557 - DNA, 19 bp, Homo sapiens
agaccgtgatttggaagag

SEQ ID NO: 1249558 - DNA, 15 bp, Homo sapiens
agagacagaagcagg

SEQ ID NO: 1249559 - DNA, 23 bp, Homo sapiens
agagacagaagcaggctggaggt

SEQ ID NO: 1249560 - DNA, 12 bp, Homo sapiens
agagacagaatg

SEQ ID NO: 1249561 - DNA, 14 bp, Homo sapiens
agagacagcccagg

SEQ ID NO: 1249562 - DNA, 18 bp, Homo sapiens
agagacagcccaggatac

SEQ ID NO: 1249563 - DNA, 21 bp, Homo sapiens
agagacaggaaaatcctctgg

SEQ ID NO: 1249564 - DNA, 15 bp, Homo sapiens
agagacaggagggca

SEQ ID NO: 1249565 - DNA, 15 bp, Homo sapiens
agagacaggcagccc

SEQ ID NO: 1249566 - DNA, 21 bp, Homo sapiens
agagacaggcagcccagcagt

SEQ ID NO: 1249567 - DNA, 23 bp, Homo sapiens
agagacatgagaaagggagagga

SEQ ID NO: 1249568 - DNA, 17 bp, Homo sapiens
agagaccacacatttta

SEQ ID NO: 1249569 - DNA, 12 bp, Homo sapiens
agagaccagcac

SEQ ID NO: 1249570 - DNA, 14 bp, Homo sapiens
agagaccagggctc

SEQ ID NO: 1249571 - DNA, 19 bp, Homo sapiens
agagaccagggctccagcc

SEQ ID NO: 1249572 - DNA, 20 bp, Homo sapiens
agagaccagggctccagccc

SEQ ID NO: 1249573 - DNA, 16 bp, Homo sapiens
agagacccaacagcag

SEQ ID NO: 1249574 - DNA, 14 bp, Homo sapiens
agagacccaaggag

SEQ ID NO: 1249575 - DNA, 13 bp, Homo sapiens
agagacccccagg

SEQ ID NO: 1249576 - DNA, 14 bp, Homo sapiens
agagaccccttcct

SEQ ID NO: 1249577 - DNA, 14 bp, Homo sapiens
agagaccctggcct

SEQ ID NO: 1249578 - DNA, 15 bp, Homo sapiens
agagaccctggcctc

SEQ ID NO: 1249579 - DNA, 19 bp, Homo sapiens
agagacctcatcaggatga

SEQ ID NO: 1249580 - DNA, 15 bp, Homo sapiens
agagacctgaagtgt

SEQ ID NO: 1249581 - DNA, 16 bp, Homo sapiens
agagacctgaagtgtg

SEQ ID NO: 1249582 - DNA, 22 bp, Homo sapiens
agagacctgacccaacaccccc

SEQ ID NO: 1249583 - DNA, 15 bp, Homo sapiens
agagacgccactccc

SEQ ID NO: 1249584 - DNA, 19 bp, Homo sapiens
agagacgccctatttctat

SEQ ID NO: 1249585 - DNA, 12 bp, Homo sapiens
agagacggtctg

SEQ ID NO: 1249586 - DNA, 19 bp, Homo sapiens
agagactcagggccccagc

SEQ ID NO: 1249587 - DNA, 19 bp, Homo sapiens
agagactctattttaatgt

SEQ ID NO: 1249588 - DNA, 20 bp, Homo sapiens
agagactctattttaatgta

SEQ ID NO: 1249589 - DNA, 13 bp, Homo sapiens
agagactctttat

SEQ ID NO: 1249590 - DNA, 13 bp, Homo sapiens
agagactgaaagc

SEQ ID NO: 1249591 - DNA, 17 bp, Homo sapiens
agagactgaaagcagca

SEQ ID NO: 1249592 - DNA, 19 bp, Homo sapiens
agagactgaaagcagcagc

SEQ ID NO: 1249593 - DNA, 20 bp, Homo sapiens
agagactgaaagcagcagct

SEQ ID NO: 1249594 - DNA, 24 bp, Homo sapiens
agagactgaaagcagcagctagga

SEQ ID NO: 1249595 - DNA, 15 bp, Homo sapiens
agagactgagcagcc

SEQ ID NO: 1249596 - DNA, 14 bp, Homo sapiens
agagactggagcat

SEQ ID NO: 1249597 - DNA, 13 bp, Homo sapiens
agagactgggaag

SEQ ID NO: 1249598 - DNA, 23 bp, Homo sapiens
agagactgggaagataggctctg

SEQ ID NO: 1249599 - DNA, 14 bp, Homo sapiens
agagactgtagatt

SEQ ID NO: 1249600 - DNA, 19 bp, Homo sapiens
agagacttaaaggacagga

SEQ ID NO: 1249601 - DNA, 18 bp, Homo sapiens
agagacttctctgtaagt

SEQ ID NO: 1249602 - DNA, 19 bp, Homo sapiens
agagacttggaagaggagg

SEQ ID NO: 1249603 - DNA, 20 bp, Homo sapiens
agagacttggaagaggagga

SEQ ID NO: 1249604 - DNA, 21 bp, Homo sapiens
agagacttggaagaggaggag

SEQ ID NO: 1249605 - DNA, 15 bp, Homo sapiens
agagagaaagcatat

SEQ ID NO: 1249606 - DNA, 17 bp, Homo sapiens
agagagaatagagctgc

SEQ ID NO: 1249607 - DNA, 21 bp, Homo sapiens
agagagaatctcaagattcta

SEQ ID NO: 1249608 - DNA, 15 bp, Homo sapiens
agagagaatgagagc

SEQ ID NO: 1249609 - DNA, 23 bp, Homo sapiens
agagagaatgagagcgacacaga

SEQ ID NO: 1249610 - DNA, 14 bp, Homo sapiens
agagagacaagaag

SEQ ID NO: 1249611 - DNA, 23 bp, Homo sapiens
agagagaccctcactgctgggga

SEQ ID NO: 1249612 - DNA, 20 bp, Homo sapiens
agagagacctcatcctgctc

SEQ ID NO: 1249613 - DNA, 22 bp, Homo sapiens
agagagacttggaagaggagga

SEQ ID NO: 1249614 - DNA, 23 bp, Homo sapiens
agagagacttggaagaggaggag

SEQ ID NO: 1249615 - DNA, 15 bp, Homo sapiens
agagagagagagagg

SEQ ID NO: 1249616 - DNA, 15 bp, Homo sapiens
agagagagaggacag

SEQ ID NO: 1249617 - DNA, 16 bp, Homo sapiens
agagagagctgtatta

SEQ ID NO: 1249618 - DNA, 13 bp, Homo sapiens
agagagaggggaa

SEQ ID NO: 1249619 - DNA, 18 bp, Homo sapiens
agagagataaaaggtgga

SEQ ID NO: 1249620 - DNA, 19 bp, Homo sapiens
agagagatgagaagccagg

SEQ ID NO: 1249621 - DNA, 17 bp, Homo sapiens
agagagcagcgcccagg

SEQ ID NO: 1249622 - DNA, 21 bp, Homo sapiens
agagagccctgggtgacttca

SEQ ID NO: 1249623 - DNA, 22 bp, Homo sapiens
agagagccctgggtgacttcag

SEQ ID NO: 1249624 - DNA, 18 bp, Homo sapiens
agagagctgccatcgctg

SEQ ID NO: 1249625 - DNA, 11 bp, Homo sapiens
agagagctggt

SEQ ID NO: 1249626 - DNA, 12 bp, Homo sapiens
agagagctggta

SEQ ID NO: 1249627 - DNA, 15 bp, Homo sapiens
agagagctgtattaa

SEQ ID NO: 1249628 - DNA, 12 bp, Homo sapiens
agagaggaagga

SEQ ID NO: 1249629 - DNA, 13 bp, Homo sapiens
agagaggacagct

SEQ ID NO: 1249630 - DNA, 13 bp, Homo sapiens
agagaggagcacc

SEQ ID NO: 1249631 - DNA, 22 bp, Homo sapiens
agagaggatacatttaataaaa

SEQ ID NO: 1249632 - DNA, 19 bp, Homo sapiens
agagaggcccgcccgccca

SEQ ID NO: 1249633 - DNA, 20 bp, Homo sapiens
agagagggcacatctccaga

SEQ ID NO: 1249634 - DNA, 18 bp, Homo sapiens
agagaggggaagaattta

SEQ ID NO: 1249635 - DNA, 22 bp, Homo sapiens
agagaggtagcgagctgctctg

SEQ ID NO: 1249636 - DNA, 17 bp, Homo sapiens
agagaggtatttaactg

SEQ ID NO: 1249637 - DNA, 23 bp, Homo sapiens
agagaggtgccggggaggggcag

SEQ ID NO: 1249638 - DNA, 20 bp, Homo sapiens
agagaggttatagagtagaa

SEQ ID NO: 1249639 - DNA, 22 bp, Homo sapiens
agagagtcctctggatggcacc

SEQ ID NO: 1249640 - DNA, 23 bp, Homo sapiens
agagagttgtctgtccaggccct

SEQ ID NO: 1249641 - DNA, 24 bp, Homo sapiens
agagagttgtctgtccaggccctt

SEQ ID NO: 1249642 - DNA, 15 bp, Homo sapiens
agagagtttcaaaag

SEQ ID NO: 1249643 - DNA, 15 bp, Homo sapiens
agagagtttgccact

SEQ ID NO: 1249644 - DNA, 14 bp, Homo sapiens
agagataataagat

SEQ ID NO: 1249645 - DNA, 15 bp, Homo sapiens
agagataataagatt

SEQ ID NO: 1249646 - DNA, 19 bp, Homo sapiens
agagatacttacatttcca

SEQ ID NO: 1249647 - DNA, 20 bp, Homo sapiens
agagatacttacatttccat

SEQ ID NO: 1249648 - DNA, 17 bp, Homo sapiens
agagatagcttctcttc

SEQ ID NO: 1249649 - DNA, 21 bp, Homo sapiens
agagatagcttctcttctttc

SEQ ID NO: 1249650 - DNA, 20 bp, Homo sapiens
agagatattttaaaatgaga

SEQ ID NO: 1249651 - DNA, 14 bp, Homo sapiens
agagatcaaagatg

SEQ ID NO: 1249652 - DNA, 22 bp, Homo sapiens
agagatcccttaagaagttaga

SEQ ID NO: 1249653 - DNA, 15 bp, Homo sapiens
agagatcgagaccat

SEQ ID NO: 1249654 - DNA, 17 bp, Homo sapiens
agagatctgcaggctgc

SEQ ID NO: 1249655 - DNA, 19 bp, Homo sapiens
agagatctttctttccaaa

SEQ ID NO: 1249656 - DNA, 16 bp, Homo sapiens
agagatgaaataattt

SEQ ID NO: 1249657 - DNA, 17 bp, Homo sapiens
agagatgagaagccagg

SEQ ID NO: 1249658 - DNA, 13 bp, Homo sapiens
agagatgcagaaa

SEQ ID NO: 1249659 - DNA, 13 bp, Homo sapiens
agagatgcattca

SEQ ID NO: 1249660 - DNA, 12 bp, Homo sapiens
agagatgcctcc

SEQ ID NO: 1249661 - DNA, 23 bp, Homo sapiens
agagatgcctccaccgctgccta

SEQ ID NO: 1249662 - DNA, 23 bp, Homo sapiens
agagatgctgtaacttaaaatag

SEQ ID NO: 1249663 - DNA, 22 bp, Homo sapiens
agagatggcacaccagatgctt

SEQ ID NO: 1249664 - DNA, 18 bp, Homo sapiens
agagatggggtttcacca

SEQ ID NO: 1249665 - DNA, 14 bp, Homo sapiens
agagatgtttacag

SEQ ID NO: 1249666 - DNA, 20 bp, Homo sapiens
agagattacctcctgagaaa

SEQ ID NO: 1249667 - DNA, 21 bp, Homo sapiens
agagattagtaaatatgtgaa

SEQ ID NO: 1249668 - DNA, 12 bp, Homo sapiens
agagattataac

SEQ ID NO: 1249669 - DNA, 15 bp, Homo sapiens
agagattcattttct

SEQ ID NO: 1249670 - DNA, 14 bp, Homo sapiens
agagattctggatc

SEQ ID NO: 1249671 - DNA, 20 bp, Homo sapiens
agagattctgtgatctttta

SEQ ID NO: 1249672 - DNA, 19 bp, Homo sapiens
agagattcttctaggggta

SEQ ID NO: 1249673 - DNA, 22 bp, Homo sapiens
agagattgcacagtcaaaacga

SEQ ID NO: 1249674 - DNA, 20 bp, Homo sapiens
agagattgggagaaatcatc

SEQ ID NO: 1249675 - DNA, 14 bp, Homo sapiens
agagatttatcttt

SEQ ID NO: 1249676 - DNA, 21 bp, Homo sapiens
agagatttcctccatggtgga

SEQ ID NO: 1249677 - DNA, 17 bp, Homo sapiens
agagatttgtctaattg

SEQ ID NO: 1249678 - DNA, 16 bp, Homo sapiens
agagatttttatgtgt

SEQ ID NO: 1249679 - DNA, 21 bp, Homo sapiens
agagcaaaagcctcagaaagg

SEQ ID NO: 1249680 - DNA, 20 bp, Homo sapiens
agagctgttcgctcctccca

SEQ ID NO: 1249681 - DNA, 19 bp, Homo sapiens
agagctgtttatggcctca

SEQ ID NO: 1249682 - DNA, 15 bp, Homo sapiens
agagcttataaaatt

SEQ ID NO: 1249683 - DNA, 16 bp, Homo sapiens
agagcttcagaggtgg

SEQ ID NO: 1249684 - DNA, 13 bp, Homo sapiens
agagcttccaaat

SEQ ID NO: 1249685 - DNA, 21 bp, Homo sapiens
agagcttccaaatgtgtcaga

SEQ ID NO: 1249686 - DNA, 13 bp, Homo sapiens
agagcttccctga

SEQ ID NO: 1249687 - DNA, 15 bp, Homo sapiens
agagcttctggcact

SEQ ID NO: 1249688 - DNA, 22 bp, Homo sapiens
agagcttgatctgtgatttctt

SEQ ID NO: 1249689 - DNA, 15 bp, Homo sapiens
agagcttgcacagcc

SEQ ID NO: 1249690 - DNA, 18 bp, Homo sapiens
agagcttgtgctcctctt

SEQ ID NO: 1249691 - DNA, 19 bp, Homo sapiens
agagctttaaaagtatctt

SEQ ID NO: 1249692 - DNA, 23 bp, Homo sapiens
agagctttctgtccttttggcac

SEQ ID NO: 1249693 - DNA, 12 bp, Homo sapiens
agagctttcttt

SEQ ID NO: 1249694 - DNA, 16 bp, Homo sapiens
agagctttctttcaca

SEQ ID NO: 1249695 - DNA, 17 bp, Homo sapiens
agagctttcttttgtat

SEQ ID NO: 1249696 - DNA, 19 bp, Homo sapiens
agagctttcttttgtatta

SEQ ID NO: 1249697 - DNA, 11 bp, Homo sapiens
agagctttgtc

SEQ ID NO: 1249698 - DNA, 13 bp, Homo sapiens
agagcttttcaga

SEQ ID NO: 1249699 - DNA, 15 bp, Homo sapiens
agaggaaaagactcc

SEQ ID NO: 1249700 - DNA, 19 bp, Homo sapiens
agaggaaaagactcctcct

SEQ ID NO: 1249701 - DNA, 21 bp, Homo sapiens
agaggaaaagtaaggtgcagt

SEQ ID NO: 1249702 - DNA, 18 bp, Homo sapiens
agaggaaagggctggctc

SEQ ID NO: 1249703 - DNA, 21 bp, Homo sapiens
agaggaacagcactggggagt

SEQ ID NO: 1249704 - DNA, 15 bp, Homo sapiens
agaggaacaggtgga

SEQ ID NO: 1249705 - DNA, 20 bp, Homo sapiens
agaggaactgtccagagagc

SEQ ID NO: 1249706 - DNA, 14 bp, Homo sapiens
agaggaagaaatgt

SEQ ID NO: 1249707 - DNA, 19 bp, Homo sapiens
agaggaagagagggaggag

SEQ ID NO: 1249708 - DNA, 13 bp, Homo sapiens
agaggaaggaccc

SEQ ID NO: 1249709 - DNA, 16 bp, Homo sapiens
agaggaaggagaggag

SEQ ID NO: 1249710 - DNA, 23 bp, Homo sapiens
agaggaaggggccagaggctcgt

SEQ ID NO: 1249711 - DNA, 15 bp, Homo sapiens
agaggaagttcagat

SEQ ID NO: 1249712 - DNA, 16 bp, Homo sapiens
agaggaagttcagatc

SEQ ID NO: 1249713 - DNA, 17 bp, Homo sapiens
agaggaatcctggcagc

SEQ ID NO: 1249714 - DNA, 16 bp, Homo sapiens
agaggacaagggaaat

SEQ ID NO: 1249715 - DNA, 13 bp, Homo sapiens
agaggaccccagg

SEQ ID NO: 1249716 - DNA, 15 bp, Homo sapiens
agaggaccccagggt

SEQ ID NO: 1249717 - DNA, 16 bp, Homo sapiens
agaggaccccagggtg

SEQ ID NO: 1249718 - DNA, 15 bp, Homo sapiens
agaggaccggcggct

SEQ ID NO: 1249719 - DNA, 21 bp, Homo sapiens
agaggactcccaaccctggct

SEQ ID NO: 1249720 - DNA, 21 bp, Homo sapiens
agaggactctgcttaaacaaa

SEQ ID NO: 1249721 - DNA, 23 bp, Homo sapiens
agaggactctgcttaaacaaagc

SEQ ID NO: 1249722 - DNA, 22 bp, Homo sapiens
agaggactgtagggagggcggc

SEQ ID NO: 1249723 - DNA, 21 bp, Homo sapiens
agaggagaaaaaaaaagtgaa

SEQ ID NO: 1249724 - DNA, 22 bp, Homo sapiens
agaggagaaatgcaataactct

SEQ ID NO: 1249725 - DNA, 11 bp, Homo sapiens
agaggagaaga

SEQ ID NO: 1249726 - DNA, 14 bp, Homo sapiens
agaggagaccctgg

SEQ ID NO: 1249727 - DNA, 14 bp, Homo sapiens
agaggagacttttt

SEQ ID NO: 1249728 - DNA, 22 bp, Homo sapiens
agaggagcccagtgggctgcac

SEQ ID NO: 1249729 - DNA, 15 bp, Homo sapiens
agaggagcttttctg

SEQ ID NO: 1249730 - DNA, 19 bp, Homo sapiens
agaggaggaggtgggggct

SEQ ID NO: 1249731 - DNA, 12 bp, Homo sapiens
agaggaggcctg

SEQ ID NO: 1249732 - DNA, 13 bp, Homo sapiens
agaggagggcaga

SEQ ID NO: 1249733 - DNA, 16 bp, Homo sapiens
agaggaggtttgcctg

SEQ ID NO: 1249734 - DNA, 19 bp, Homo sapiens
agaggaggtttgcctgtga

SEQ ID NO: 1249735 - DNA, 14 bp, Homo sapiens
agaggatacattta

SEQ ID NO: 1249736 - DNA, 20 bp, Homo sapiens
agaggatgccttttctgtga

SEQ ID NO: 1249737 - DNA, 13 bp, Homo sapiens
agaggatgtggct

SEQ ID NO: 1249738 - DNA, 18 bp, Homo sapiens
agaggatttcttcaaatc

SEQ ID NO: 1249739 - DNA, 21 bp, Homo sapiens
agaggatttttttctgagcga

SEQ ID NO: 1249740 - DNA, 18 bp, Homo sapiens
agaggcaagctgaaattt

SEQ ID NO: 1249741 - DNA, 22 bp, Homo sapiens
agaggcaagctgaaattttaga

SEQ ID NO: 1249742 - DNA, 14 bp, Homo sapiens
agaggcaaggttgc

SEQ ID NO: 1249743 - DNA, 15 bp, Homo sapiens
agaggcacctgctgg

SEQ ID NO: 1249744 - DNA, 13 bp, Homo sapiens
agaggcagaagaa

SEQ ID NO: 1249745 - DNA, 22 bp, Homo sapiens
agaggcagcatgcttgggctga

SEQ ID NO: 1249746 - DNA, 15 bp, Homo sapiens
agaggcaggaatggg

SEQ ID NO: 1249747 - DNA, 10 bp, Homo sapiens
agaggcaggc

SEQ ID NO: 1249748 - DNA, 17 bp, Homo sapiens
agaggcagtgatgactt

SEQ ID NO: 1249749 - DNA, 18 bp, Homo sapiens
agaggcagtgatgacttg

SEQ ID NO: 1249750 - DNA, 14 bp, Homo sapiens
agaggcagtggcca

SEQ ID NO: 1249751 - DNA, 15 bp, Homo sapiens
agaggcattgttagt

SEQ ID NO: 1249752 - DNA, 16 bp, Homo sapiens
agaggcatttaaaatg

SEQ ID NO: 1249753 - DNA, 19 bp, Homo sapiens
agaggcatttaaaatggaa

SEQ ID NO: 1249754 - DNA, 17 bp, Homo sapiens
agaggccagccccaccc

SEQ ID NO: 1249755 - DNA, 20 bp, Homo sapiens
agaggcccactagagggccc

SEQ ID NO: 1249756 - DNA, 13 bp, Homo sapiens
agaggcccaggca

SEQ ID NO: 1249757 - DNA, 16 bp, Homo sapiens
agaggcccccagccca

SEQ ID NO: 1249758 - DNA, 20 bp, Homo sapiens
agaggcccccagcccagggc

SEQ ID NO: 1249759 - DNA, 19 bp, Homo sapiens
agaggccctcgctgccagc

SEQ ID NO: 1249760 - DNA, 14 bp, Homo sapiens
agaggccctctgga

SEQ ID NO: 1249761 - DNA, 18 bp, Homo sapiens
agaggccctctggagtgg

SEQ ID NO: 1249762 - DNA, 22 bp, Homo sapiens
agaggccctctggagtggccac

SEQ ID NO: 1249763 - DNA, 23 bp, Homo sapiens
agaggccctctggagtggccact

SEQ ID NO: 1249764 - DNA, 24 bp, Homo sapiens
agaggccctctggagtggccacta

SEQ ID NO: 1249765 - DNA, 12 bp, Homo sapiens
agaggccctgcc

SEQ ID NO: 1249766 - DNA, 14 bp, Homo sapiens
agaggccctgccac

SEQ ID NO: 1249767 - DNA, 19 bp, Homo sapiens
agaggcctcatccagggcc

SEQ ID NO: 1249768 - DNA, 18 bp, Homo sapiens
agaggcctgaagctgagc

SEQ ID NO: 1249769 - DNA, 13 bp, Homo sapiens
agaggcctgagga

SEQ ID NO: 1249770 - DNA, 22 bp, Homo sapiens
agaggcctgaggatgagctgga

SEQ ID NO: 1249771 - DNA, 18 bp, Homo sapiens
agaggcctgggctgggaa

SEQ ID NO: 1249772 - DNA, 20 bp, Homo sapiens
agaggcctggggtgggacag

SEQ ID NO: 1249773 - DNA, 12 bp, Homo sapiens
agaggccttccc

SEQ ID NO: 1249774 - DNA, 16 bp, Homo sapiens
agaggcggcctcgtgc

SEQ ID NO: 1249775 - DNA, 13 bp, Homo sapiens
agaggcgggccag

SEQ ID NO: 1249776 - DNA, 14 bp, Homo sapiens
agaggcgggccagc

SEQ ID NO: 1249777 - DNA, 20 bp, Homo sapiens
agaggcgtctgctgtctcat

SEQ ID NO: 1249778 - DNA, 14 bp, Homo sapiens
agaggcgtgtgcag

SEQ ID NO: 1249779 - DNA, 14 bp, Homo sapiens
agaggctactcttg

SEQ ID NO: 1249780 - DNA, 16 bp, Homo sapiens
agaggctagcttctgc

SEQ ID NO: 1249781 - DNA, 17 bp, Homo sapiens
agaggctagcttctgct

SEQ ID NO: 1249782 - DNA, 16 bp, Homo sapiens
agaggctctccgtgca

SEQ ID NO: 1249783 - DNA, 15 bp, Homo sapiens
agaggctctggacag

SEQ ID NO: 1249784 - DNA, 12 bp, Homo sapiens
agaggctgagcc

SEQ ID NO: 1249785 - DNA, 13 bp, Homo sapiens
agaggctgaggac

SEQ ID NO: 1249786 - DNA, 13 bp, Homo sapiens
agaggctgaggca

SEQ ID NO: 1249787 - DNA, 14 bp, Homo sapiens
agaggctgaggcct

SEQ ID NO: 1249788 - DNA, 17 bp, Homo sapiens
agaggctgaggcctgga

SEQ ID NO: 1249789 - DNA, 18 bp, Homo sapiens
agaggctgaggcctggac

SEQ ID NO: 1249790 - DNA, 19 bp, Homo sapiens
agaggctgaggcctggact

SEQ ID NO: 1249791 - DNA, 19 bp, Homo sapiens
agaggctgaggctggcaca

SEQ ID NO: 1249792 - DNA, 16 bp, Homo sapiens
agaggctgcacccctg

SEQ ID NO: 1249793 - DNA, 22 bp, Homo sapiens
agaggctgcacccctgggccag

SEQ ID NO: 1249794 - DNA, 23 bp, Homo sapiens
agaggctgcacccctgggccagc

SEQ ID NO: 1249795 - DNA, 13 bp, Homo sapiens
agaggctgcagaa

SEQ ID NO: 1249796 - DNA, 21 bp, Homo sapiens
agaggctgcagaaggccaaga

SEQ ID NO: 1249797 - DNA, 16 bp, Homo sapiens
agaggctgcccctctc

SEQ ID NO: 1249798 - DNA, 12 bp, Homo sapiens
agaggctgcctc

SEQ ID NO: 1249799 - DNA, 19 bp, Homo sapiens
agaggctgcctcagccagt

SEQ ID NO: 1249800 - DNA, 22 bp, Homo sapiens
agaggctggaggcagggccttg

SEQ ID NO: 1249801 - DNA, 22 bp, Homo sapiens
agaggctgggaggttgggaggc

SEQ ID NO: 1249802 - DNA, 14 bp, Homo sapiens
agaggctgggttca

SEQ ID NO: 1249803 - DNA, 18 bp, Homo sapiens
agatattgtgaagtacat

SEQ ID NO: 1249804 - DNA, 21 bp, Homo sapiens
agatattgtgaagtacatatt

SEQ ID NO: 1249805 - DNA, 21 bp, Homo sapiens
agatatttaaagaatgagaaa

SEQ ID NO: 1249806 - DNA, 13 bp, Homo sapiens
agatatttatata

SEQ ID NO: 1249807 - DNA, 17 bp, Homo sapiens
agatatttatattttta

SEQ ID NO: 1249808 - DNA, 18 bp, Homo sapiens
agatatttgcagtttttc

SEQ ID NO: 1249809 - DNA, 15 bp, Homo sapiens
agatattttaaaatg

SEQ ID NO: 1249810 - DNA, 20 bp, Homo sapiens
agatattttgctttgtgatt

SEQ ID NO: 1249811 - DNA, 22 bp, Homo sapiens
agatattttgtaaaatgtatta

SEQ ID NO: 1249812 - DNA, 19 bp, Homo sapiens
agatattttttcagaaata

SEQ ID NO: 1249813 - DNA, 18 bp, Homo sapiens
agatcaaaaggttaataa

SEQ ID NO: 1249814 - DNA, 12 bp, Homo sapiens
agatcaaaataa

SEQ ID NO: 1249815 - DNA, 13 bp, Homo sapiens
agatcaaatactt

SEQ ID NO: 1249816 - DNA, 20 bp, Homo sapiens
agatcaaatactttaaagga

SEQ ID NO: 1249817 - DNA, 18 bp, Homo sapiens
agatcaacattccagggt

SEQ ID NO: 1249818 - DNA, 19 bp, Homo sapiens
agatcaagaaatgtctctg

SEQ ID NO: 1249819 - DNA, 22 bp, Homo sapiens
agatcaagaggcaggttagaag

SEQ ID NO: 1249820 - DNA, 14 bp, Homo sapiens
agatcaagctgtga

SEQ ID NO: 1249821 - DNA, 13 bp, Homo sapiens
agatcacagcctc

SEQ ID NO: 1249822 - DNA, 15 bp, Homo sapiens
agatcacagcctcca

SEQ ID NO: 1249823 - DNA, 18 bp, Homo sapiens
agatcacagcctccaggg

SEQ ID NO: 1249824 - DNA, 19 bp, Homo sapiens
agatcacatcttaaattca

SEQ ID NO: 1249825 - DNA, 14 bp, Homo sapiens
agatcacccactcc

SEQ ID NO: 1249826 - DNA, 18 bp, Homo sapiens
agatcactttctcagttt

SEQ ID NO: 1249827 - DNA, 23 bp, Homo sapiens
agatcagcagcgtgcacatctgc

SEQ ID NO: 1249828 - DNA, 19 bp, Homo sapiens
agatcagccattaaaataa

SEQ ID NO: 1249829 - DNA, 20 bp, Homo sapiens
agatcagccattaaaataaa

SEQ ID NO: 1249830 - DNA, 23 bp, Homo sapiens
agatcagccattaaaataaaaca

SEQ ID NO: 1249831 - DNA, 13 bp, Homo sapiens
agatcaggaacca

SEQ ID NO: 1249832 - DNA, 20 bp, Homo sapiens
agatcaggaaccagggcctc

SEQ ID NO: 1249833 - DNA, 14 bp, Homo sapiens
agatcataggaagt

SEQ ID NO: 1249834 - DNA, 19 bp, Homo sapiens
agatcataggaagtggctg

SEQ ID NO: 1249835 - DNA, 18 bp, Homo sapiens
agatcatatacgtgaaaa

SEQ ID NO: 1249836 - DNA, 18 bp, Homo sapiens
agatccacacacagagga

SEQ ID NO: 1249837 - DNA, 14 bp, Homo sapiens
agatccaccctcaa

SEQ ID NO: 1249838 - DNA, 21 bp, Homo sapiens
agatccaccctcaaatgtcag

SEQ ID NO: 1249839 - DNA, 15 bp, Homo sapiens
agatccattaattta

SEQ ID NO: 1249840 - DNA, 18 bp, Homo sapiens
agatccattaatttaaat

SEQ ID NO: 1249841 - DNA, 23 bp, Homo sapiens
agatcccatgggttgtgtgttta

SEQ ID NO: 1249842 - DNA, 22 bp, Homo sapiens
agatcccatgtcacctcagctg

SEQ ID NO: 1249843 - DNA, 21 bp, Homo sapiens
agatccccaagaccccctggg

SEQ ID NO: 1249844 - DNA, 18 bp, Homo sapiens
agatccccagctttctcc

SEQ ID NO: 1249845 - DNA, 16 bp, Homo sapiens
agatccccagggcagc

SEQ ID NO: 1249846 - DNA, 19 bp, Homo sapiens
agatcccccagaaaagaaa

SEQ ID NO: 1249847 - DNA, 15 bp, Homo sapiens
agatcccgcctcttc

SEQ ID NO: 1249848 - DNA, 17 bp, Homo sapiens
agatccctgcagaaccc

SEQ ID NO: 1249849 - DNA, 22 bp, Homo sapiens
agatccgagcgacggctcctcc

SEQ ID NO: 1249850 - DNA, 12 bp, Homo sapiens
agatcctaaact

SEQ ID NO: 1249851 - DNA, 13 bp, Homo sapiens
agatcctaaactc

SEQ ID NO: 1249852 - DNA, 15 bp, Homo sapiens
agatcctaaactctc

SEQ ID NO: 1249853 - DNA, 16 bp, Homo sapiens
agatcctaaactctct

SEQ ID NO: 1249854 - DNA, 17 bp, Homo sapiens
agatcctgcaccccagc

SEQ ID NO: 1249855 - DNA, 17 bp, Homo sapiens
agatcctgcgggtgggg

SEQ ID NO: 1249856 - DNA, 24 bp, Homo sapiens
agatcctggagtgatatgatccag

SEQ ID NO: 1249857 - DNA, 17 bp, Homo sapiens
agatccttcacaggcag

SEQ ID NO: 1249858 - DNA, 21 bp, Homo sapiens
agatccttcgggtgctggaag

SEQ ID NO: 1249859 - DNA, 14 bp, Homo sapiens
agatcctttcaaaa

SEQ ID NO: 1249860 - DNA, 21 bp, Homo sapiens
agatcgacaccatcctggcta

SEQ ID NO: 1249861 - DNA, 16 bp, Homo sapiens
agatcgcttgagccca

SEQ ID NO: 1249862 - DNA, 20 bp, Homo sapiens
agatcgcttgagcccaggag

SEQ ID NO: 1249863 - DNA, 22 bp, Homo sapiens
agatcgttcattgcctttccag

SEQ ID NO: 1249864 - DNA, 14 bp, Homo sapiens
agatctaatgtgaa

SEQ ID NO: 1249865 - DNA, 19 bp, Homo sapiens
agatctgaacacagtttag

SEQ ID NO: 1249866 - DNA, 12 bp, Homo sapiens
agatctgaaggg

SEQ ID NO: 1249867 - DNA, 14 bp, Homo sapiens
agatctgaataaag

SEQ ID NO: 1249868 - DNA, 12 bp, Homo sapiens
agatctgactgc

SEQ ID NO: 1249869 - DNA, 19 bp, Homo sapiens
agatctgatggtgagctgg

SEQ ID NO: 1249870 - DNA, 23 bp, Homo sapiens
agatctgatggtgagctgggaag

SEQ ID NO: 1249871 - DNA, 13 bp, Homo sapiens
agatctgcctggg

SEQ ID NO: 1249872 - DNA, 15 bp, Homo sapiens
agatctgcctgggcc

SEQ ID NO: 1249873 - DNA, 20 bp, Homo sapiens
agatctgcctgggcctgtgc

SEQ ID NO: 1249874 - DNA, 15 bp, Homo sapiens
agatctggggaggca

SEQ ID NO: 1249875 - DNA, 15 bp, Homo sapiens
agatctgtataaata

SEQ ID NO: 1249876 - DNA, 17 bp, Homo sapiens
agatctgtataaataag

SEQ ID NO: 1249877 - DNA, 22 bp, Homo sapiens
agatctgtataaataagagcat

SEQ ID NO: 1249878 - DNA, 14 bp, Homo sapiens
agatctgtgcccca

SEQ ID NO: 1249879 - DNA, 14 bp, Homo sapiens
agatctgtgcctgg

SEQ ID NO: 1249880 - DNA, 22 bp, Homo sapiens
agatctgttttgtggtttggaa

SEQ ID NO: 1249881 - DNA, 15 bp, Homo sapiens
agatcttaatataaa

SEQ ID NO: 1249882 - DNA, 18 bp, Homo sapiens
agatctttctcttccctg

SEQ ID NO: 1249883 - DNA, 20 bp, Homo sapiens
agatctttctttccaaaaca

SEQ ID NO: 1249884 - DNA, 14 bp, Homo sapiens
agatcttttcttta

SEQ ID NO: 1249885 - DNA, 17 bp, Homo sapiens
agatgaaagaggaggtt

SEQ ID NO: 1249886 - DNA, 23 bp, Homo sapiens
agatgaaagaggaggtttggggt

SEQ ID NO: 1249887 - DNA, 21 bp, Homo sapiens
agatgaaatatatattgtaaa

SEQ ID NO: 1249888 - DNA, 16 bp, Homo sapiens
agatgaaatgcactgt

SEQ ID NO: 1249889 - DNA, 14 bp, Homo sapiens
agatgaaattgcca

SEQ ID NO: 1249890 - DNA, 21 bp, Homo sapiens
agatgaactctttctggcctg

SEQ ID NO: 1249891 - DNA, 17 bp, Homo sapiens
agatgaacttgagctct

SEQ ID NO: 1249892 - DNA, 13 bp, Homo sapiens
agatgaactttgt

SEQ ID NO: 1249893 - DNA, 23 bp, Homo sapiens
agatgaactttgtcattatgatt

SEQ ID NO: 1249894 - DNA, 19 bp, Homo sapiens
agatgaagagtgagagggc

SEQ ID NO: 1249895 - DNA, 15 bp, Homo sapiens
agatgaagttttaca

SEQ ID NO: 1249896 - DNA, 16 bp, Homo sapiens
agatgaatgccgtgga

SEQ ID NO: 1249897 - DNA, 13 bp, Homo sapiens
agatgaatttgtc

SEQ ID NO: 1249898 - DNA, 14 bp, Homo sapiens
agatgaatttgtcc

SEQ ID NO: 1249899 - DNA, 20 bp, Homo sapiens
agatgacacgcgctctccac

SEQ ID NO: 1249900 - DNA, 11 bp, Homo sapiens
agatgacccct

SEQ ID NO: 1249901 - DNA, 15 bp, Homo sapiens
agatgacccctaccc

SEQ ID NO: 1249902 - DNA, 22 bp, Homo sapiens
agatgacccctaccccctcatc

SEQ ID NO: 1249903 - DNA, 15 bp, Homo sapiens
agatgaccttttgga

SEQ ID NO: 1249904 - DNA, 14 bp, Homo sapiens
agatgactctgaga

SEQ ID NO: 1249905 - DNA, 16 bp, Homo sapiens
agatgagaacaaagct

SEQ ID NO: 1249906 - DNA, 19 bp, Homo sapiens
agatgagaacaaagctgtt

SEQ ID NO: 1249907 - DNA, 15 bp, Homo sapiens
agatgaggaggggag

SEQ ID NO: 1249908 - DNA, 22 bp, Homo sapiens
agatgagggatgggcctggcat

SEQ ID NO: 1249909 - DNA, 21 bp, Homo sapiens
agatgaggtcagttgtgtttt

SEQ ID NO: 1249910 - DNA, 15 bp, Homo sapiens
agatgagttgcagtt

SEQ ID NO: 1249911 - DNA, 14 bp, Homo sapiens
agatgagtttctgg

SEQ ID NO: 1249912 - DNA, 15 bp, Homo sapiens
agatgataaaaggaa

SEQ ID NO: 1249913 - DNA, 14 bp, Homo sapiens
agatgataaagaga

SEQ ID NO: 1249914 - DNA, 16 bp, Homo sapiens
agatgatcagtccaac

SEQ ID NO: 1249915 - DNA, 18 bp, Homo sapiens
agatgatgcatgatgccc

SEQ ID NO: 1249916 - DNA, 22 bp, Homo sapiens
agatgatggaaacgcacttaca

SEQ ID NO: 1249917 - DNA, 16 bp, Homo sapiens
agatgatggatgccaa

SEQ ID NO: 1249918 - DNA, 21 bp, Homo sapiens
agatgattatatattgttgtt

SEQ ID NO: 1249919 - DNA, 13 bp, Homo sapiens
agatgattgaata

SEQ ID NO: 1249920 - DNA, 14 bp, Homo sapiens
agatgatttggtca

SEQ ID NO: 1249921 - DNA, 18 bp, Homo sapiens
agatgattttcctccctg

SEQ ID NO: 1249922 - DNA, 19 bp, Homo sapiens
agatgattttcctccctgg

SEQ ID NO: 1249923 - DNA, 15 bp, Homo sapiens
agatgattttttgaa

SEQ ID NO: 1249924 - DNA, 20 bp, Homo sapiens
agatgattttttgaaagtta

SEQ ID NO: 1249925 - DNA, 17 bp, Homo sapiens
agatgtacatttaataa

SEQ ID NO: 1249926 - DNA, 18 bp, Homo sapiens
agatgtacatttaataat

SEQ ID NO: 1249927 - DNA, 18 bp, Homo sapiens
agatgtagatttatttca

SEQ ID NO: 1249928 - DNA, 15 bp, Homo sapiens
agatgtagcattgtt

SEQ ID NO: 1249929 - DNA, 22 bp, Homo sapiens
agatgtaggggaagagatgttt

SEQ ID NO: 1249930 - DNA, 14 bp, Homo sapiens
agatgtatgcacac

SEQ ID NO: 1249931 - DNA, 17 bp, Homo sapiens
agatgtatgctttgaat

SEQ ID NO: 1249932 - DNA, 16 bp, Homo sapiens
agatgtattgactgta

SEQ ID NO: 1249933 - DNA, 23 bp, Homo sapiens
agatgtatttttgatgtatatat

SEQ ID NO: 1249934 - DNA, 15 bp, Homo sapiens
agatgtcagactggc

SEQ ID NO: 1249935 - DNA, 11 bp, Homo sapiens
agatgtcatga

SEQ ID NO: 1249936 - DNA, 23 bp, Homo sapiens
agatgtcatttagttcagcatcc

SEQ ID NO: 1249937 - DNA, 21 bp, Homo sapiens
agatgtccatttttacaagtt

SEQ ID NO: 1249938 - DNA, 21 bp, Homo sapiens
agatgtcccttgatgcacaga

SEQ ID NO: 1249939 - DNA, 22 bp, Homo sapiens
agatgtcccttgatgcacagag

SEQ ID NO: 1249940 - DNA, 23 bp, Homo sapiens
agatgtcccttgatgcacagaga

SEQ ID NO: 1249941 - DNA, 18 bp, Homo sapiens
agatgtctaatagttatt

SEQ ID NO: 1249942 - DNA, 16 bp, Homo sapiens
agatgtctcagagcct

SEQ ID NO: 1249943 - DNA, 14 bp, Homo sapiens
agatgtcttccctg

SEQ ID NO: 1249944 - DNA, 19 bp, Homo sapiens
agatgtcttccctgggctg

SEQ ID NO: 1249945 - DNA, 14 bp, Homo sapiens
agatgtcttggaac

SEQ ID NO: 1249946 - DNA, 18 bp, Homo sapiens
agatgtcttggaacattg

SEQ ID NO: 1249947 - DNA, 23 bp, Homo sapiens
agatgtctttaggcagcagcttt

SEQ ID NO: 1249948 - DNA, 11 bp, Homo sapiens
agatgtgaatt

SEQ ID NO: 1249949 - DNA, 14 bp, Homo sapiens
agatgtgaattatt

SEQ ID NO: 1249950 - DNA, 21 bp, Homo sapiens
agatgtgaattattgacactg

SEQ ID NO: 1249951 - DNA, 22 bp, Homo sapiens
agatgtgaattattgacactga

SEQ ID NO: 1249952 - DNA, 21 bp, Homo sapiens
agatgtgagccaccgtgcctg

SEQ ID NO: 1249953 - DNA, 23 bp, Homo sapiens
agatgtgagccaccgtgcctggc

SEQ ID NO: 1249954 - DNA, 18 bp, Homo sapiens
agatgtgcaaatgcaagc

SEQ ID NO: 1249955 - DNA, 19 bp, Homo sapiens
agatgtgcaacctgtggct

SEQ ID NO: 1249956 - DNA, 22 bp, Homo sapiens
agatgtgcaataatttgtacaa

SEQ ID NO: 1249957 - DNA, 19 bp, Homo sapiens
agatgtgcatttcacctgt

SEQ ID NO: 1249958 - DNA, 22 bp, Homo sapiens
agatgtgcctgtgggaggggga

SEQ ID NO: 1249959 - DNA, 21 bp, Homo sapiens
agatgtgcttctgaaccgcaa

SEQ ID NO: 1249960 - DNA, 16 bp, Homo sapiens
agatgtggctactgac

SEQ ID NO: 1249961 - DNA, 22 bp, Homo sapiens
agatgtggggctgagctgggga

SEQ ID NO: 1249962 - DNA, 20 bp, Homo sapiens
agatgtgtaaacaggtattt

SEQ ID NO: 1249963 - DNA, 22 bp, Homo sapiens
agatgtgtatcagtgtttatgt

SEQ ID NO: 1249964 - DNA, 20 bp, Homo sapiens
agatgtgtcccccccaggcc

SEQ ID NO: 1249965 - DNA, 21 bp, Homo sapiens
agatgtgtcccccccaggcct

SEQ ID NO: 1249966 - DNA, 21 bp, Homo sapiens
agatgtgtctgggagagcctg

SEQ ID NO: 1249967 - DNA, 17 bp, Homo sapiens
agatgtgtcttcaattt

SEQ ID NO: 1249968 - DNA, 23 bp, Homo sapiens
agatgtgttcctccattttctta

SEQ ID NO: 1249969 - DNA, 15 bp, Homo sapiens
agatgttaaaataaa

SEQ ID NO: 1249970 - DNA, 11 bp, Homo sapiens
agatgttaaat

SEQ ID NO: 1249971 - DNA, 14 bp, Homo sapiens
agatgttaaatgga

SEQ ID NO: 1249972 - DNA, 16 bp, Homo sapiens
agatgttactacctta

SEQ ID NO: 1249973 - DNA, 15 bp, Homo sapiens
agatgttagactcat

SEQ ID NO: 1249974 - DNA, 22 bp, Homo sapiens
agatgttagggtataagttgct

SEQ ID NO: 1249975 - DNA, 20 bp, Homo sapiens
agatgttcgctcgtgcagta

SEQ ID NO: 1249976 - DNA, 13 bp, Homo sapiens
agatgttgtcttg

SEQ ID NO: 1249977 - DNA, 13 bp, Homo sapiens
agatgtttacatt

SEQ ID NO: 1249978 - DNA, 20 bp, Homo sapiens
agatgtttattggtatattt

SEQ ID NO: 1249979 - DNA, 23 bp, Homo sapiens
agatgtttcacaccggaaggttt

SEQ ID NO: 1249980 - DNA, 22 bp, Homo sapiens
agatgtttcgagtaaacttgaa

SEQ ID NO: 1249981 - DNA, 12 bp, Homo sapiens
agatgtttctta

SEQ ID NO: 1249982 - DNA, 18 bp, Homo sapiens
agatgtttcttttgtatg

SEQ ID NO: 1249983 - DNA, 15 bp, Homo sapiens
agatgtttgtcagat

SEQ ID NO: 1249984 - DNA, 19 bp, Homo sapiens
agatgttttaccatcctta

SEQ ID NO: 1249985 - DNA, 22 bp, Homo sapiens
agatgttttaccgtaataatta

SEQ ID NO: 1249986 - DNA, 20 bp, Homo sapiens
agatgttttacgcaaggaag

SEQ ID NO: 1249987 - DNA, 22 bp, Homo sapiens
agatgttttgggatcaggagcc

SEQ ID NO: 1249988 - DNA, 13 bp, Homo sapiens
agatgtttttaaa

SEQ ID NO: 1249989 - DNA, 20 bp, Homo sapiens
agatgtttttaaaagtttca

SEQ ID NO: 1249990 - DNA, 15 bp, Homo sapiens
agattaaaaattata

SEQ ID NO: 1249991 - DNA, 16 bp, Homo sapiens
agattaaaaattatag

SEQ ID NO: 1249992 - DNA, 21 bp, Homo sapiens
agattaaaaattataggaata

SEQ ID NO: 1249993 - DNA, 15 bp, Homo sapiens
agattaaaggaagga

SEQ ID NO: 1249994 - DNA, 16 bp, Homo sapiens
agattaaaggaaggaa

SEQ ID NO: 1249995 - DNA, 18 bp, Homo sapiens
agattaaaggaaggaaaa

SEQ ID NO: 1249996 - DNA, 18 bp, Homo sapiens
agattaaatgtgtcattg

SEQ ID NO: 1249997 - DNA, 16 bp, Homo sapiens
agattaagagccatat

SEQ ID NO: 1249998 - DNA, 20 bp, Homo sapiens
agattacagagggctcattt

SEQ ID NO: 1249999 - DNA, 22 bp, Homo sapiens
agattacccaaaaactgtcttt

SEQ ID NO: 1250000 - DNA, 18 bp, Homo sapiens
agattagagggaggtgtt

SEQ ID NO: 1250001 - DNA, 15 bp, Homo sapiens
agattaggagaaaca

SEQ ID NO: 1250002 - DNA, 17 bp, Homo sapiens
agattagggaaaatgga

SEQ ID NO: 1250003 - DNA, 20 bp, Homo sapiens
agattaggtcgttttccaaa

SEQ ID NO: 1250004 - DNA, 23 bp, Homo sapiens
agattagtaaatatgtgaagaaa

SEQ ID NO: 1250005 - DNA, 15 bp, Homo sapiens
agattatcgttttct

SEQ ID NO: 1250006 - DNA, 16 bp, Homo sapiens
agattatcgttttctt

SEQ ID NO: 1250007 - DNA, 17 bp, Homo sapiens
agattatcgttttctta

SEQ ID NO: 1250008 - DNA, 17 bp, Homo sapiens
agattatgatgcataca

SEQ ID NO: 1250009 - DNA, 20 bp, Homo sapiens
agattatgatgcatacagtt

SEQ ID NO: 1250010 - DNA, 20 bp, Homo sapiens
agattatggagcttttttcc

SEQ ID NO: 1250011 - DNA, 15 bp, Homo sapiens
agattattataaact

SEQ ID NO: 1250012 - DNA, 20 bp, Homo sapiens
agattattccttcttctagt

SEQ ID NO: 1250013 - DNA, 19 bp, Homo sapiens
agattattgtgacttcact

SEQ ID NO: 1250014 - DNA, 21 bp, Homo sapiens
agattattgtgacttcactgt

SEQ ID NO: 1250015 - DNA, 13 bp, Homo sapiens
agattatttcata

SEQ ID NO: 1250016 - DNA, 15 bp, Homo sapiens
agattatttcatata

SEQ ID NO: 1250017 - DNA, 21 bp, Homo sapiens
agattatttgtgcattttatt

SEQ ID NO: 1250018 - DNA, 15 bp, Homo sapiens
agattattttttaaa

SEQ ID NO: 1250019 - DNA, 16 bp, Homo sapiens
agattcaataatgaga

SEQ ID NO: 1250020 - DNA, 17 bp, Homo sapiens
agattcaatattatgaa

SEQ ID NO: 1250021 - DNA, 11 bp, Homo sapiens
agattcaattt

SEQ ID NO: 1250022 - DNA, 22 bp, Homo sapiens
agattcacacctgactctgaaa

SEQ ID NO: 1250023 - DNA, 14 bp, Homo sapiens
agattcacctgtaa

SEQ ID NO: 1250024 - DNA, 16 bp, Homo sapiens
agattcacctgtaaaa

SEQ ID NO: 1250025 - DNA, 17 bp, Homo sapiens
agattcactttgacact

SEQ ID NO: 1250026 - DNA, 21 bp, Homo sapiens
agattcactttgtttatgcat

SEQ ID NO: 1250027 - DNA, 22 bp, Homo sapiens
agattcactttgtttatgcata

SEQ ID NO: 1250028 - DNA, 15 bp, Homo sapiens
agattcaggccagcc

SEQ ID NO: 1250029 - DNA, 17 bp, Homo sapiens
agattcaggccagccca

SEQ ID NO: 1250030 - DNA, 18 bp, Homo sapiens
agattcaggccagcccag

SEQ ID NO: 1250031 - DNA, 20 bp, Homo sapiens
agattcaggccagcccagcc

SEQ ID NO: 1250032 - DNA, 23 bp, Homo sapiens
agattcaggccagcccagccagg

SEQ ID NO: 1250033 - DNA, 14 bp, Homo sapiens
agattcaggggaag

SEQ ID NO: 1250034 - DNA, 19 bp, Homo sapiens
agattcaggtatgttgcct

SEQ ID NO: 1250035 - DNA, 20 bp, Homo sapiens
agattcaggtatgttgcctt

SEQ ID NO: 1250036 - DNA, 16 bp, Homo sapiens
agattcatatttactt

SEQ ID NO: 1250037 - DNA, 19 bp, Homo sapiens
agattcatatttacttctt

SEQ ID NO: 1250038 - DNA, 14 bp, Homo sapiens
agattccacaggac

SEQ ID NO: 1250039 - DNA, 14 bp, Homo sapiens
agattcccagagac

SEQ ID NO: 1250040 - DNA, 13 bp, Homo sapiens
agattcccagagc

SEQ ID NO: 1250041 - DNA, 16 bp, Homo sapiens
agattcccagagcaaa

SEQ ID NO: 1250042 - DNA, 23 bp, Homo sapiens
agattcctcttgcctctctcagg

SEQ ID NO: 1250043 - DNA, 19 bp, Homo sapiens
agattctactcttgtcatt

SEQ ID NO: 1250044 - DNA, 16 bp, Homo sapiens
agattctatattatta

SEQ ID NO: 1250045 - DNA, 22 bp, Homo sapiens
agattctatattattatatata

SEQ ID NO: 1250046 - DNA, 15 bp, Homo sapiens
agcaataactccaag

SEQ ID NO: 1250047 - DNA, 16 bp, Homo sapiens
agcaataactccaagc

SEQ ID NO: 1250048 - DNA, 24 bp, Homo sapiens
agcaataactccaagcagactcca

SEQ ID NO: 1250049 - DNA, 18 bp, Homo sapiens
agcaataacttctatgtt

SEQ ID NO: 1250050 - DNA, 14 bp, Homo sapiens
agcaataagaaatg

SEQ ID NO: 1250051 - DNA, 15 bp, Homo sapiens
agcaataagaaatga

SEQ ID NO: 1250052 - DNA, 20 bp, Homo sapiens
agcaataagctggactagtg

SEQ ID NO: 1250053 - DNA, 20 bp, Homo sapiens
agcaataatggtcccatcca

SEQ ID NO: 1250054 - DNA, 21 bp, Homo sapiens
agcaataatggtcccatccag

SEQ ID NO: 1250055 - DNA, 14 bp, Homo sapiens
agcaataattgttt

SEQ ID NO: 1250056 - DNA, 15 bp, Homo sapiens
agcaataattgtttc

SEQ ID NO: 1250057 - DNA, 11 bp, Homo sapiens
agcaatacaac

SEQ ID NO: 1250058 - DNA, 14 bp, Homo sapiens
agcaatacaacttt

SEQ ID NO: 1250059 - DNA, 21 bp, Homo sapiens
agcaatactcatcagagcagc

SEQ ID NO: 1250060 - DNA, 20 bp, Homo sapiens
agcaatactgtttccatttt

SEQ ID NO: 1250061 - DNA, 16 bp, Homo sapiens
agcaatatattaccag

SEQ ID NO: 1250062 - DNA, 22 bp, Homo sapiens
agcaatatattaccagcaagaa

SEQ ID NO: 1250063 - DNA, 12 bp, Homo sapiens
agcaatatgcat

SEQ ID NO: 1250064 - DNA, 14 bp, Homo sapiens
agcaatattgcctg

SEQ ID NO: 1250065 - DNA, 17 bp, Homo sapiens
agcaatccatgttagtt

SEQ ID NO: 1250066 - DNA, 21 bp, Homo sapiens
agcaatcctcctacctcagcc

SEQ ID NO: 1250067 - DNA, 13 bp, Homo sapiens
agcaatcctcctg

SEQ ID NO: 1250068 - DNA, 18 bp, Homo sapiens
agcaatcctcctgcctca

SEQ ID NO: 1250069 - DNA, 16 bp, Homo sapiens
agcaatctgcatttta

SEQ ID NO: 1250070 - DNA, 19 bp, Homo sapiens
agcaatctgcattttaaca

SEQ ID NO: 1250071 - DNA, 21 bp, Homo sapiens
agcaatctgcattttaacaag

SEQ ID NO: 1250072 - DNA, 14 bp, Homo sapiens
agcaatctttgaaa

SEQ ID NO: 1250073 - DNA, 18 bp, Homo sapiens
agcaatgacatctcaggg

SEQ ID NO: 1250074 - DNA, 20 bp, Homo sapiens
agcaatgatgtccagaagaa

SEQ ID NO: 1250075 - DNA, 23 bp, Homo sapiens
agcaatgatgtccagaagaatat

SEQ ID NO: 1250076 - DNA, 23 bp, Homo sapiens
agcaatgccatttcagtggcttc

SEQ ID NO: 1250077 - DNA, 16 bp, Homo sapiens
agcaatggatatttgt

SEQ ID NO: 1250078 - DNA, 14 bp, Homo sapiens
agcaatggccagag

SEQ ID NO: 1250079 - DNA, 17 bp, Homo sapiens
agcaatggccagagcct

SEQ ID NO: 1250080 - DNA, 19 bp, Homo sapiens
agcaatggccagagcctct

SEQ ID NO: 1250081 - DNA, 17 bp, Homo sapiens
agcaatgggggcctccg

SEQ ID NO: 1250082 - DNA, 18 bp, Homo sapiens
agcaatggtaactgcacc

SEQ ID NO: 1250083 - DNA, 23 bp, Homo sapiens
agcaatggtgtcagtatccaggc

SEQ ID NO: 1250084 - DNA, 16 bp, Homo sapiens
agcaatgtctgtgcta

SEQ ID NO: 1250085 - DNA, 15 bp, Homo sapiens
agcaattatgaaaat

SEQ ID NO: 1250086 - DNA, 18 bp, Homo sapiens
agcaattatttaaagaaa

SEQ ID NO: 1250087 - DNA, 23 bp, Homo sapiens
agcaattccatgctataaaaact

SEQ ID NO: 1250088 - DNA, 22 bp, Homo sapiens
agcaattctcctgcctcagcct

SEQ ID NO: 1250089 - DNA, 13 bp, Homo sapiens
agcaatttacctg

SEQ ID NO: 1250090 - DNA, 16 bp, Homo sapiens
agcaatttagacaaag

SEQ ID NO: 1250091 - DNA, 22 bp, Homo sapiens
agcaatttccccctaaaccaac

SEQ ID NO: 1250092 - DNA, 24 bp, Homo sapiens
agcaatttccccctaaaccaactg

SEQ ID NO: 1250093 - DNA, 14 bp, Homo sapiens
agcaattttcgaac

SEQ ID NO: 1250094 - DNA, 16 bp, Homo sapiens
agcaattttctttgtt

SEQ ID NO: 1250095 - DNA, 12 bp, Homo sapiens
agcacaaaattc

SEQ ID NO: 1250096 - DNA, 14 bp, Homo sapiens
agcacaaaattcaa

SEQ ID NO: 1250097 - DNA, 17 bp, Homo sapiens
agcacaaacattgctgc

SEQ ID NO: 1250098 - DNA, 22 bp, Homo sapiens
agcacaaacattgctgcctttg

SEQ ID NO: 1250099 - DNA, 20 bp, Homo sapiens
agcacaaagttctcagagct

SEQ ID NO: 1250100 - DNA, 14 bp, Homo sapiens
agcacaagcgtgtt

SEQ ID NO: 1250101 - DNA, 22 bp, Homo sapiens
agcacaaggccttgcctggcct

SEQ ID NO: 1250102 - DNA, 14 bp, Homo sapiens
agcacaagggcaca

SEQ ID NO: 1250103 - DNA, 21 bp, Homo sapiens
agcacaagggcacattgccca

SEQ ID NO: 1250104 - DNA, 16 bp, Homo sapiens
agcacaagtacttttg

SEQ ID NO: 1250105 - DNA, 23 bp, Homo sapiens
agcacaataactagtaataccaa

SEQ ID NO: 1250106 - DNA, 17 bp, Homo sapiens
agcacaatcactaaact

SEQ ID NO: 1250107 - DNA, 21 bp, Homo sapiens
agcacaatcctattactcttc

SEQ ID NO: 1250108 - DNA, 18 bp, Homo sapiens
agcacaattctgtccctg

SEQ ID NO: 1250109 - DNA, 22 bp, Homo sapiens
agcacaattctgtccctgtccc

SEQ ID NO: 1250110 - DNA, 19 bp, Homo sapiens
agcacaatttgcactaaat

SEQ ID NO: 1250111 - DNA, 19 bp, Homo sapiens
agcacacacaataaagaac

SEQ ID NO: 1250112 - DNA, 14 bp, Homo sapiens
agcacacagggcag

SEQ ID NO: 1250113 - DNA, 21 bp, Homo sapiens
agcacacctgaatcagctgga

SEQ ID NO: 1250114 - DNA, 18 bp, Homo sapiens
agcacacgagttccagac

SEQ ID NO: 1250115 - DNA, 19 bp, Homo sapiens
agcacactgtagcattaca

SEQ ID NO: 1250116 - DNA, 18 bp, Homo sapiens
agcacacttatttatgaa

SEQ ID NO: 1250117 - DNA, 13 bp, Homo sapiens
agcacagagaggg

SEQ ID NO: 1250118 - DNA, 14 bp, Homo sapiens
agcacagagccctg

SEQ ID NO: 1250119 - DNA, 15 bp, Homo sapiens
agcacagagccctga

SEQ ID NO: 1250120 - DNA, 12 bp, Homo sapiens
agcacagagcct

SEQ ID NO: 1250121 - DNA, 17 bp, Homo sapiens
agcacagagcctggccc

SEQ ID NO: 1250122 - DNA, 21 bp, Homo sapiens
agcacagagcctggccccagg

SEQ ID NO: 1250123 - DNA, 17 bp, Homo sapiens
agcacagagtcgctggc

SEQ ID NO: 1250124 - DNA, 15 bp, Homo sapiens
agcacagattttgaa

SEQ ID NO: 1250125 - DNA, 17 bp, Homo sapiens
agcacagattttgaatc

SEQ ID NO: 1250126 - DNA, 13 bp, Homo sapiens
agcacagccaaca

SEQ ID NO: 1250127 - DNA, 22 bp, Homo sapiens
agcacagccacctccgccagac

SEQ ID NO: 1250128 - DNA, 12 bp, Homo sapiens
agcacagccctg

SEQ ID NO: 1250129 - DNA, 15 bp, Homo sapiens
agcacagctcctgcc

SEQ ID NO: 1250130 - DNA, 19 bp, Homo sapiens
agcacagctcctgccaggg

SEQ ID NO: 1250131 - DNA, 20 bp, Homo sapiens
agcacagcttgacctgaggc

SEQ ID NO: 1250132 - DNA, 18 bp, Homo sapiens
agcacagcttgggtcagg

SEQ ID NO: 1250133 - DNA, 19 bp, Homo sapiens
agcacaggaattctcaaga

SEQ ID NO: 1250134 - DNA, 23 bp, Homo sapiens
agcacaggaattctcaagacctg

SEQ ID NO: 1250135 - DNA, 15 bp, Homo sapiens
agcacaggggcccca

SEQ ID NO: 1250136 - DNA, 20 bp, Homo sapiens
agcacaggggccccagatct

SEQ ID NO: 1250137 - DNA, 21 bp, Homo sapiens
agcacaggggccccagatctg

SEQ ID NO: 1250138 - DNA, 15 bp, Homo sapiens
agcacaggtcccacc

SEQ ID NO: 1250139 - DNA, 21 bp, Homo sapiens
agcacaggtcccacctccagc

SEQ ID NO: 1250140 - DNA, 18 bp, Homo sapiens
agcacaggtgtctgccta

SEQ ID NO: 1250141 - DNA, 17 bp, Homo sapiens
agcacagtcaggggctg

SEQ ID NO: 1250142 - DNA, 20 bp, Homo sapiens
agcacagtcaggggctgggc

SEQ ID NO: 1250143 - DNA, 19 bp, Homo sapiens
agcacagtctgatgacaca

SEQ ID NO: 1250144 - DNA, 12 bp, Homo sapiens
agcacagtgtgt

SEQ ID NO: 1250145 - DNA, 16 bp, Homo sapiens
agcacagtgttaaatg

SEQ ID NO: 1250146 - DNA, 22 bp, Homo sapiens
agcacagtgttaaatgaaattg

SEQ ID NO: 1250147 - DNA, 12 bp, Homo sapiens
agcacagtttgt

SEQ ID NO: 1250148 - DNA, 15 bp, Homo sapiens
agcacataactggat

SEQ ID NO: 1250149 - DNA, 20 bp, Homo sapiens
agcacataactggattttga

SEQ ID NO: 1250150 - DNA, 17 bp, Homo sapiens
agcacatagagcttttt

SEQ ID NO: 1250151 - DNA, 18 bp, Homo sapiens
agcacatagagcttttta

SEQ ID NO: 1250152 - DNA, 20 bp, Homo sapiens
agcacatagagctttttaat

SEQ ID NO: 1250153 - DNA, 15 bp, Homo sapiens
agcacatagcttgcc

SEQ ID NO: 1250154 - DNA, 16 bp, Homo sapiens
agcacatagtgtcctg

SEQ ID NO: 1250155 - DNA, 18 bp, Homo sapiens
agcacatattagtgcagc

SEQ ID NO: 1250156 - DNA, 23 bp, Homo sapiens
agcacatctgcattttcacccca

SEQ ID NO: 1250157 - DNA, 22 bp, Homo sapiens
agcacatgtctgtcctcagagc

SEQ ID NO: 1250158 - DNA, 16 bp, Homo sapiens
agcacatgtgctgccc

SEQ ID NO: 1250159 - DNA, 13 bp, Homo sapiens
agcacattcggga

SEQ ID NO: 1250160 - DNA, 21 bp, Homo sapiens
agcacattcgggaccaatata

SEQ ID NO: 1250161 - DNA, 17 bp, Homo sapiens
agcacatttgtcagtat

SEQ ID NO: 1250162 - DNA, 17 bp, Homo sapiens
agcaccaaaataagaaa

SEQ ID NO: 1250163 - DNA, 18 bp, Homo sapiens
agcaccaaaataagaaaa

SEQ ID NO: 1250164 - DNA, 20 bp, Homo sapiens
agcaccaaaataagaaaaga

SEQ ID NO: 1250165 - DNA, 20 bp, Homo sapiens
agcaccacagccggtcagag

SEQ ID NO: 1250166 - DNA, 18 bp, Homo sapiens
agcaccacattgcctcat

SEQ ID NO: 1250167 - DNA, 12 bp, Homo sapiens
agcagccaggac

SEQ ID NO: 1250168 - DNA, 19 bp, Homo sapiens
agcagccaggacccgcctg

SEQ ID NO: 1250169 - DNA, 14 bp, Homo sapiens
agcagccaggaggg

SEQ ID NO: 1250170 - DNA, 21 bp, Homo sapiens
agcagccagtctcagagacca

SEQ ID NO: 1250171 - DNA, 21 bp, Homo sapiens
agcagcccaagcttccctcca

SEQ ID NO: 1250172 - DNA, 11 bp, Homo sapiens
agcagcccagc

SEQ ID NO: 1250173 - DNA, 23 bp, Homo sapiens
agcagcccagcacatagcttgcc

SEQ ID NO: 1250174 - DNA, 17 bp, Homo sapiens
agcagcccagcttcctg

SEQ ID NO: 1250175 - DNA, 17 bp, Homo sapiens
agcagccccccagcact

SEQ ID NO: 1250176 - DNA, 18 bp, Homo sapiens
agcagccccccagcacta

SEQ ID NO: 1250177 - DNA, 16 bp, Homo sapiens
agcagccccctgtggc

SEQ ID NO: 1250178 - DNA, 15 bp, Homo sapiens
agcagcccctcgagg

SEQ ID NO: 1250179 - DNA, 19 bp, Homo sapiens
agcagcccctcgaggccta

SEQ ID NO: 1250180 - DNA, 20 bp, Homo sapiens
agcagcccctcgaggcctac

SEQ ID NO: 1250181 - DNA, 18 bp, Homo sapiens
agcagccctaaggatctc

SEQ ID NO: 1250182 - DNA, 16 bp, Homo sapiens
agcagccctcctcacc

SEQ ID NO: 1250183 - DNA, 12 bp, Homo sapiens
agcagccctctg

SEQ ID NO: 1250184 - DNA, 14 bp, Homo sapiens
agcagccctgcccc

SEQ ID NO: 1250185 - DNA, 23 bp, Homo sapiens
agcagcccttgtgtgtgccctgg

SEQ ID NO: 1250186 - DNA, 21 bp, Homo sapiens
agcagccggaatagagcctcg

SEQ ID NO: 1250187 - DNA, 22 bp, Homo sapiens
agcagcctcgcacaggccctag

SEQ ID NO: 1250188 - DNA, 11 bp, Homo sapiens
agcagcctcgt

SEQ ID NO: 1250189 - DNA, 13 bp, Homo sapiens
agcagcctcgtgg

SEQ ID NO: 1250190 - DNA, 23 bp, Homo sapiens
agcagcctcgtggagctcgcccc

SEQ ID NO: 1250191 - DNA, 24 bp, Homo sapiens
agcagcctcgtggagctcgcccct

SEQ ID NO: 1250192 - DNA, 18 bp, Homo sapiens
agcagcctctccccaggt

SEQ ID NO: 1250193 - DNA, 21 bp, Homo sapiens
agcagcctctccccaggtcca

SEQ ID NO: 1250194 - DNA, 12 bp, Homo sapiens
agcagcctctgg

SEQ ID NO: 1250195 - DNA, 13 bp, Homo sapiens
agcagcctctgga

SEQ ID NO: 1250196 - DNA, 16 bp, Homo sapiens
agcagcctctggacag

SEQ ID NO: 1250197 - DNA, 20 bp, Homo sapiens
agcagcctgtgagggagtgc

SEQ ID NO: 1250198 - DNA, 14 bp, Homo sapiens
agcagcctgttttc

SEQ ID NO: 1250199 - DNA, 23 bp, Homo sapiens
agcagcgcccaggcctgctggca

SEQ ID NO: 1250200 - DNA, 19 bp, Homo sapiens
agcagcgctcggcccggag

SEQ ID NO: 1250201 - DNA, 19 bp, Homo sapiens
agcagcggattgctctgga

SEQ ID NO: 1250202 - DNA, 23 bp, Homo sapiens
agcagcggctctggtcctcggag

SEQ ID NO: 1250203 - DNA, 17 bp, Homo sapiens
agcagctaaattttctg

SEQ ID NO: 1250204 - DNA, 18 bp, Homo sapiens
agcagctaaattttctga

SEQ ID NO: 1250205 - DNA, 20 bp, Homo sapiens
agcagctactgtaacttttt

SEQ ID NO: 1250206 - DNA, 18 bp, Homo sapiens
agcagctaggactgagga

SEQ ID NO: 1250207 - DNA, 12 bp, Homo sapiens
agcagctcaggc

SEQ ID NO: 1250208 - DNA, 21 bp, Homo sapiens
agcagctcatagaattttgag

SEQ ID NO: 1250209 - DNA, 18 bp, Homo sapiens
agcagctgaacagccaaa

SEQ ID NO: 1250210 - DNA, 12 bp, Homo sapiens
agcagctgaagt

SEQ ID NO: 1250211 - DNA, 19 bp, Homo sapiens
agcagctgaagtctctttt

SEQ ID NO: 1250212 - DNA, 21 bp, Homo sapiens
agcagctgcaccccagcgtca

SEQ ID NO: 1250213 - DNA, 13 bp, Homo sapiens
agcagctgcattt

SEQ ID NO: 1250214 - DNA, 17 bp, Homo sapiens
agcagctgcgggtctga

SEQ ID NO: 1250215 - DNA, 14 bp, Homo sapiens
agcagcttccagat

SEQ ID NO: 1250216 - DNA, 15 bp, Homo sapiens
agcagcttccttctg

SEQ ID NO: 1250217 - DNA, 18 bp, Homo sapiens
agcagcttccttctggga

SEQ ID NO: 1250218 - DNA, 19 bp, Homo sapiens
agcagcttccttctgggac

SEQ ID NO: 1250219 - DNA, 19 bp, Homo sapiens
agcagcttcttgggctgag

SEQ ID NO: 1250220 - DNA, 23 bp, Homo sapiens
agcagcttcttgggctgagtgca

SEQ ID NO: 1250221 - DNA, 16 bp, Homo sapiens
agcagctttaaacaaa

SEQ ID NO: 1250222 - DNA, 19 bp, Homo sapiens
agcagctttaaactcaggg

SEQ ID NO: 1250223 - DNA, 20 bp, Homo sapiens
agcagctttaaactcaggga

SEQ ID NO: 1250224 - DNA, 21 bp, Homo sapiens
agcagctttgtctctgtcaca

SEQ ID NO: 1250225 - DNA, 23 bp, Homo sapiens
agcagctttttattccctgccca

SEQ ID NO: 1250226 - DNA, 18 bp, Homo sapiens
agcaggaagggtgggaag

SEQ ID NO: 1250227 - DNA, 20 bp, Homo sapiens
agcaggaatatatgtgtgcc

SEQ ID NO: 1250228 - DNA, 21 bp, Homo sapiens
agcaggaatatatgtgtgcct

SEQ ID NO: 1250229 - DNA, 14 bp, Homo sapiens
agcaggaattatgt

SEQ ID NO: 1250230 - DNA, 16 bp, Homo sapiens
agcaggacagccagca

SEQ ID NO: 1250231 - DNA, 17 bp, Homo sapiens
agcaggacagccagcag

SEQ ID NO: 1250232 - DNA, 14 bp, Homo sapiens
agcaggacctccct

SEQ ID NO: 1250233 - DNA, 16 bp, Homo sapiens
agcaggacctgtgctt

SEQ ID NO: 1250234 - DNA, 17 bp, Homo sapiens
agcaggacctgtgcttt

SEQ ID NO: 1250235 - DNA, 18 bp, Homo sapiens
agcaggactccaggccca

SEQ ID NO: 1250236 - DNA, 22 bp, Homo sapiens
agcaggacttgctaaagcactt

SEQ ID NO: 1250237 - DNA, 18 bp, Homo sapiens
agcaggagagactgagca

SEQ ID NO: 1250238 - DNA, 19 bp, Homo sapiens
agcaggagccccgccacag

SEQ ID NO: 1250239 - DNA, 15 bp, Homo sapiens
agcaggaggccaata

SEQ ID NO: 1250240 - DNA, 21 bp, Homo sapiens
agcaggaggccaataaaaagt

SEQ ID NO: 1250241 - DNA, 22 bp, Homo sapiens
agcaggaggccaataaaaagtt

SEQ ID NO: 1250242 - DNA, 23 bp, Homo sapiens
agcaggaggccaataaaaagttc

SEQ ID NO: 1250243 - DNA, 20 bp, Homo sapiens
agcaggaggcccctggccca

SEQ ID NO: 1250244 - DNA, 22 bp, Homo sapiens
agcaggaggttctgggcctctg

SEQ ID NO: 1250245 - DNA, 21 bp, Homo sapiens
agcaggatcgaagggttttta

SEQ ID NO: 1250246 - DNA, 18 bp, Homo sapiens
agcaggatgggctgagct

SEQ ID NO: 1250247 - DNA, 20 bp, Homo sapiens
agcaggcaaaaaagggacag

SEQ ID NO: 1250248 - DNA, 15 bp, Homo sapiens
agcaggcaccgccac

SEQ ID NO: 1250249 - DNA, 19 bp, Homo sapiens
agcaggcacgggtggtccc

SEQ ID NO: 1250250 - DNA, 20 bp, Homo sapiens
agcaggcacgggtggtcccc

SEQ ID NO: 1250251 - DNA, 11 bp, Homo sapiens
agcaggcagga

SEQ ID NO: 1250252 - DNA, 14 bp, Homo sapiens
agcaggcattgctt

SEQ ID NO: 1250253 - DNA, 15 bp, Homo sapiens
agcaggcccagcatg

SEQ ID NO: 1250254 - DNA, 19 bp, Homo sapiens
agcaggcccagcatgcagg

SEQ ID NO: 1250255 - DNA, 17 bp, Homo sapiens
agcaggccccctaggat

SEQ ID NO: 1250256 - DNA, 20 bp, Homo sapiens
agcaggcctaagacatgtga

SEQ ID NO: 1250257 - DNA, 14 bp, Homo sapiens
agcaggcctccctg

SEQ ID NO: 1250258 - DNA, 19 bp, Homo sapiens
agcaggcctctggttgcct

SEQ ID NO: 1250259 - DNA, 20 bp, Homo sapiens
agcaggcctctggttgcctc

SEQ ID NO: 1250260 - DNA, 23 bp, Homo sapiens
agcaggctcctggctgtgcccag

SEQ ID NO: 1250261 - DNA, 13 bp, Homo sapiens
agcaggctggcag

SEQ ID NO: 1250262 - DNA, 20 bp, Homo sapiens
agcaggctggcagctctcca

SEQ ID NO: 1250263 - DNA, 13 bp, Homo sapiens
agcaggctgttcc

SEQ ID NO: 1250264 - DNA, 15 bp, Homo sapiens
agcagggaaggcctg

SEQ ID NO: 1250265 - DNA, 14 bp, Homo sapiens
agcagggacacccc

SEQ ID NO: 1250266 - DNA, 16 bp, Homo sapiens
agcagggactgtaaac

SEQ ID NO: 1250267 - DNA, 22 bp, Homo sapiens
agcagggatgccctggaggtgg

SEQ ID NO: 1250268 - DNA, 24 bp, Homo sapiens
agcagggatgccctggaggtggct

SEQ ID NO: 1250269 - DNA, 19 bp, Homo sapiens
agcagggattaacctctgc

SEQ ID NO: 1250270 - DNA, 14 bp, Homo sapiens
agcagggcggctgc

SEQ ID NO: 1250271 - DNA, 15 bp, Homo sapiens
agcagggcggctgcc

SEQ ID NO: 1250272 - DNA, 16 bp, Homo sapiens
agcagggcggctgccg

SEQ ID NO: 1250273 - DNA, 13 bp, Homo sapiens
agcagggctgggc

SEQ ID NO: 1250274 - DNA, 16 bp, Homo sapiens
agcagggctgggcctg

SEQ ID NO: 1250275 - DNA, 15 bp, Homo sapiens
agcaggggagccctg

SEQ ID NO: 1250276 - DNA, 16 bp, Homo sapiens
agcaggggagcttggg

SEQ ID NO: 1250277 - DNA, 18 bp, Homo sapiens
agcaggggagcttgggac

SEQ ID NO: 1250278 - DNA, 11 bp, Homo sapiens
agcaggggcag

SEQ ID NO: 1250279 - DNA, 15 bp, Homo sapiens
agcaggggctggccc

SEQ ID NO: 1250280 - DNA, 17 bp, Homo sapiens
agcagggtaccctttgg

SEQ ID NO: 1250281 - DNA, 22 bp, Homo sapiens
agcagggtaccctttggggagc

SEQ ID NO: 1250282 - DNA, 18 bp, Homo sapiens
agcagggtagtctggttt

SEQ ID NO: 1250283 - DNA, 18 bp, Homo sapiens
agcagggtcgggaaaggc

SEQ ID NO: 1250284 - DNA, 16 bp, Homo sapiens
agcagggtcttgctgt

SEQ ID NO: 1250285 - DNA, 13 bp, Homo sapiens
agcagggtggggt

SEQ ID NO: 1250286 - DNA, 17 bp, Homo sapiens
agcagggtggggtctgg

SEQ ID NO: 1250287 - DNA, 18 bp, Homo sapiens
agcagggtggggtctggg

SEQ ID NO: 1250288 - DNA, 17 bp, Homo sapiens
agcctctggacagccag

SEQ ID NO: 1250289 - DNA, 23 bp, Homo sapiens
agcctctggcattagaattattt

SEQ ID NO: 1250290 - DNA, 12 bp, Homo sapiens
agcctctggccc

SEQ ID NO: 1250291 - DNA, 18 bp, Homo sapiens
agcctctggcccctcacc

SEQ ID NO: 1250292 - DNA, 13 bp, Homo sapiens
agcctctggctag

SEQ ID NO: 1250293 - DNA, 20 bp, Homo sapiens
agcctctggctagaggccag

SEQ ID NO: 1250294 - DNA, 14 bp, Homo sapiens
agcctctggcttcc

SEQ ID NO: 1250295 - DNA, 14 bp, Homo sapiens
agcctctgttttga

SEQ ID NO: 1250296 - DNA, 19 bp, Homo sapiens
agcctcttattccaggaga

SEQ ID NO: 1250297 - DNA, 17 bp, Homo sapiens
agcctcttatttttcta

SEQ ID NO: 1250298 - DNA, 22 bp, Homo sapiens
agcctcttgcccgtcggccctg

SEQ ID NO: 1250299 - DNA, 20 bp, Homo sapiens
agcctcttggaaatcaggta

SEQ ID NO: 1250300 - DNA, 22 bp, Homo sapiens
agcctctttcctaacttccttt

SEQ ID NO: 1250301 - DNA, 15 bp, Homo sapiens
agcctctttgctgga

SEQ ID NO: 1250302 - DNA, 16 bp, Homo sapiens
agcctctttgtaataa

SEQ ID NO: 1250303 - DNA, 17 bp, Homo sapiens
agcctctttttccttct

SEQ ID NO: 1250304 - DNA, 18 bp, Homo sapiens
agcctgaactgaggcctt

SEQ ID NO: 1250305 - DNA, 20 bp, Homo sapiens
agcctgaattttgttgctgt

SEQ ID NO: 1250306 - DNA, 21 bp, Homo sapiens
agcctgaattttgttgctgtt

SEQ ID NO: 1250307 - DNA, 16 bp, Homo sapiens
agcctgaccttccttc

SEQ ID NO: 1250308 - DNA, 18 bp, Homo sapiens
agcctgactcttcccttc

SEQ ID NO: 1250309 - DNA, 13 bp, Homo sapiens
agcctgaggtccc

SEQ ID NO: 1250310 - DNA, 22 bp, Homo sapiens
agcctgagtaaagttaaaagaa

SEQ ID NO: 1250311 - DNA, 15 bp, Homo sapiens
agcctgagtctcctg

SEQ ID NO: 1250312 - DNA, 18 bp, Homo sapiens
agcctgagtctcctgtgc

SEQ ID NO: 1250313 - DNA, 22 bp, Homo sapiens
agcctgatactttagccatcat

SEQ ID NO: 1250314 - DNA, 13 bp, Homo sapiens
agcctgatctctt

SEQ ID NO: 1250315 - DNA, 15 bp, Homo sapiens
agcctgatctcttcc

SEQ ID NO: 1250316 - DNA, 16 bp, Homo sapiens
agcctgatctcttcct

SEQ ID NO: 1250317 - DNA, 20 bp, Homo sapiens
agcctgatctcttcctgttt

SEQ ID NO: 1250318 - DNA, 16 bp, Homo sapiens
agcctgatggccaagg

SEQ ID NO: 1250319 - DNA, 14 bp, Homo sapiens
agcctgcagcagga

SEQ ID NO: 1250320 - DNA, 19 bp, Homo sapiens
agcctgcagggtggtgctg

SEQ ID NO: 1250321 - DNA, 21 bp, Homo sapiens
agcctgcagggtggtgctggg

SEQ ID NO: 1250322 - DNA, 14 bp, Homo sapiens
agcctgcattctgc

SEQ ID NO: 1250323 - DNA, 14 bp, Homo sapiens
agcctgcattctta

SEQ ID NO: 1250324 - DNA, 15 bp, Homo sapiens
agcctgcattcttaa

SEQ ID NO: 1250325 - DNA, 21 bp, Homo sapiens
agcctgccaaagtgcctggga

SEQ ID NO: 1250326 - DNA, 23 bp, Homo sapiens
agcctgccaaagtgcctgggaag

SEQ ID NO: 1250327 - DNA, 10 bp, Homo sapiens
agcctgccca

SEQ ID NO: 1250328 - DNA, 20 bp, Homo sapiens
agcctgcccacctctccctg

SEQ ID NO: 1250329 - DNA, 18 bp, Homo sapiens
agcctgcccgctgcaatg

SEQ ID NO: 1250330 - DNA, 21 bp, Homo sapiens
agcctgccctcactccctctg

SEQ ID NO: 1250331 - DNA, 22 bp, Homo sapiens
agcctgccctcactccctctgc

SEQ ID NO: 1250332 - DNA, 23 bp, Homo sapiens
agcctgccctcactccctctgca

SEQ ID NO: 1250333 - DNA, 12 bp, Homo sapiens
agcctgcctcac

SEQ ID NO: 1250334 - DNA, 14 bp, Homo sapiens
agcctgcctcaccc

SEQ ID NO: 1250335 - DNA, 17 bp, Homo sapiens
agcctgcctcacccaca

SEQ ID NO: 1250336 - DNA, 19 bp, Homo sapiens
agcctgcctcttctctact

SEQ ID NO: 1250337 - DNA, 17 bp, Homo sapiens
agcctgcctgatccctg

SEQ ID NO: 1250338 - DNA, 21 bp, Homo sapiens
agcctgcgttggtccagagcg

SEQ ID NO: 1250339 - DNA, 19 bp, Homo sapiens
agcctgctccagctgttca

SEQ ID NO: 1250340 - DNA, 23 bp, Homo sapiens
agcctgctcccccaccccctccc

SEQ ID NO: 1250341 - DNA, 14 bp, Homo sapiens
agcctgctctggag

SEQ ID NO: 1250342 - DNA, 13 bp, Homo sapiens
agcctgctgacag

SEQ ID NO: 1250343 - DNA, 18 bp, Homo sapiens
agcctgctgacagacact

SEQ ID NO: 1250344 - DNA, 15 bp, Homo sapiens
agcctgctgagagcc

SEQ ID NO: 1250345 - DNA, 12 bp, Homo sapiens
agcctgctgcat

SEQ ID NO: 1250346 - DNA, 21 bp, Homo sapiens
agcctgctggcagggccaggg

SEQ ID NO: 1250347 - DNA, 23 bp, Homo sapiens
agcctgctggcagggccagggca

SEQ ID NO: 1250348 - DNA, 14 bp, Homo sapiens
agcctgctggctgc

SEQ ID NO: 1250349 - DNA, 18 bp, Homo sapiens
agcctgctttggcctttc

SEQ ID NO: 1250350 - DNA, 24 bp, Homo sapiens
agcctggaaggtggaagttgcagt

SEQ ID NO: 1250351 - DNA, 17 bp, Homo sapiens
agcctggactctgcccc

SEQ ID NO: 1250352 - DNA, 14 bp, Homo sapiens
agcctggagaggcc

SEQ ID NO: 1250353 - DNA, 15 bp, Homo sapiens
agcctggagaggcct

SEQ ID NO: 1250354 - DNA, 17 bp, Homo sapiens
agcctggagaggcctgg

SEQ ID NO: 1250355 - DNA, 12 bp, Homo sapiens
agcctggatggc

SEQ ID NO: 1250356 - DNA, 20 bp, Homo sapiens
agcctggattccagcagtga

SEQ ID NO: 1250357 - DNA, 18 bp, Homo sapiens
agcctggcaacagagcga

SEQ ID NO: 1250358 - DNA, 13 bp, Homo sapiens
agcctggcaaggc

SEQ ID NO: 1250359 - DNA, 18 bp, Homo sapiens
agcctggcacagggcagt

SEQ ID NO: 1250360 - DNA, 20 bp, Homo sapiens
agcctggcacagggcagtgg

SEQ ID NO: 1250361 - DNA, 12 bp, Homo sapiens
agcctggcaccc

SEQ ID NO: 1250362 - DNA, 16 bp, Homo sapiens
agcctggcacccaccg

SEQ ID NO: 1250363 - DNA, 17 bp, Homo sapiens
agcctggcatctgtgcg

SEQ ID NO: 1250364 - DNA, 14 bp, Homo sapiens
agcctggccaacat

SEQ ID NO: 1250365 - DNA, 23 bp, Homo sapiens
agcctggccaccagccatcctcc

SEQ ID NO: 1250366 - DNA, 14 bp, Homo sapiens
agcctggccccagg

SEQ ID NO: 1250367 - DNA, 18 bp, Homo sapiens
agcctggccccaggcccc

SEQ ID NO: 1250368 - DNA, 16 bp, Homo sapiens
agcctggccccatggt

SEQ ID NO: 1250369 - DNA, 17 bp, Homo sapiens
agcctggccccatggtc

SEQ ID NO: 1250370 - DNA, 19 bp, Homo sapiens
agcctggctatgtcctaat

SEQ ID NO: 1250371 - DNA, 14 bp, Homo sapiens
agcctggctgtcca

SEQ ID NO: 1250372 - DNA, 11 bp, Homo sapiens
agcctggcttc

SEQ ID NO: 1250373 - DNA, 18 bp, Homo sapiens
agcctggcttctggagcc

SEQ ID NO: 1250374 - DNA, 23 bp, Homo sapiens
agcctggcttctggagcccttgg

SEQ ID NO: 1250375 - DNA, 14 bp, Homo sapiens
agcctggcttctta

SEQ ID NO: 1250376 - DNA, 19 bp, Homo sapiens
agcctggcttcttatcctt

SEQ ID NO: 1250377 - DNA, 17 bp, Homo sapiens
agcctgggacacacaca

SEQ ID NO: 1250378 - DNA, 15 bp, Homo sapiens
agcctgggagcccag

SEQ ID NO: 1250379 - DNA, 18 bp, Homo sapiens
agcctgggagcccagagg

SEQ ID NO: 1250380 - DNA, 19 bp, Homo sapiens
agcctgggagcccagaggg

SEQ ID NO: 1250381 - DNA, 12 bp, Homo sapiens
agcctgggaggt

SEQ ID NO: 1250382 - DNA, 17 bp, Homo sapiens
agcctgggcaacagagc

SEQ ID NO: 1250383 - DNA, 18 bp, Homo sapiens
agcctgggcaatgtgata

SEQ ID NO: 1250384 - DNA, 17 bp, Homo sapiens
agcctgggcagcatagc

SEQ ID NO: 1250385 - DNA, 19 bp, Homo sapiens
agcctgggcagccaggctg

SEQ ID NO: 1250386 - DNA, 17 bp, Homo sapiens
agcctgggcccatctcc

SEQ ID NO: 1250387 - DNA, 22 bp, Homo sapiens
agcctgggcccatctccctgct

SEQ ID NO: 1250388 - DNA, 14 bp, Homo sapiens
agcctgggcgacag

SEQ ID NO: 1250389 - DNA, 22 bp, Homo sapiens
agcctgggcgtacagagcacat

SEQ ID NO: 1250390 - DNA, 15 bp, Homo sapiens
agcctgggcttgagc

SEQ ID NO: 1250391 - DNA, 17 bp, Homo sapiens
agcctggggcggtgtgt

SEQ ID NO: 1250392 - DNA, 19 bp, Homo sapiens
agcctggggcggtgtgtgt

SEQ ID NO: 1250393 - DNA, 12 bp, Homo sapiens
agcctggggctc

SEQ ID NO: 1250394 - DNA, 16 bp, Homo sapiens
agcctggggctccctc

SEQ ID NO: 1250395 - DNA, 18 bp, Homo sapiens
agcctggggctccctctc

SEQ ID NO: 1250396 - DNA, 14 bp, Homo sapiens
agcctggggctctc

SEQ ID NO: 1250397 - DNA, 19 bp, Homo sapiens
agcctggggtggggtcatg

SEQ ID NO: 1250398 - DNA, 16 bp, Homo sapiens
agcctggggttgtccc

SEQ ID NO: 1250399 - DNA, 22 bp, Homo sapiens
agcctggggttgtccccgctgg

SEQ ID NO: 1250400 - DNA, 23 bp, Homo sapiens
agcctggggttgtccccgctggc

SEQ ID NO: 1250401 - DNA, 14 bp, Homo sapiens
agcctgggtctgga

SEQ ID NO: 1250402 - DNA, 22 bp, Homo sapiens
agcctgggtgacagagcaagtg

SEQ ID NO: 1250403 - DNA, 21 bp, Homo sapiens
agcctgggtgagaatcctgcc

SEQ ID NO: 1250404 - DNA, 22 bp, Homo sapiens
agcctgggtgagaatcctgcct

SEQ ID NO: 1250405 - DNA, 16 bp, Homo sapiens
agcctggtgctgctgc

SEQ ID NO: 1250406 - DNA, 22 bp, Homo sapiens
agcctggtgggcctcctctgtc

SEQ ID NO: 1250407 - DNA, 17 bp, Homo sapiens
agcctggttcagaataa

SEQ ID NO: 1250408 - DNA, 18 bp, Homo sapiens
agcctggttcagaataaa

SEQ ID NO: 1250409 - DNA, 21 bp, Homo sapiens
agcctggtttagcctggatgt

SEQ ID NO: 1250410 - DNA, 20 bp, Homo sapiens
agctatttatccctttcctg

SEQ ID NO: 1250411 - DNA, 23 bp, Homo sapiens
agctatttatccctttcctggtt

SEQ ID NO: 1250412 - DNA, 22 bp, Homo sapiens
agctatttcagcctcctgtttg

SEQ ID NO: 1250413 - DNA, 14 bp, Homo sapiens
agctatttcatcta

SEQ ID NO: 1250414 - DNA, 18 bp, Homo sapiens
agctatttccattccaga

SEQ ID NO: 1250415 - DNA, 20 bp, Homo sapiens
agctatttccattccagaat

SEQ ID NO: 1250416 - DNA, 14 bp, Homo sapiens
agctattttccttg

SEQ ID NO: 1250417 - DNA, 19 bp, Homo sapiens
agctattttccttgctttt

SEQ ID NO: 1250418 - DNA, 13 bp, Homo sapiens
agctattttgtga

SEQ ID NO: 1250419 - DNA, 23 bp, Homo sapiens
agctatttttcttgttgcatctt

SEQ ID NO: 1250420 - DNA, 14 bp, Homo sapiens
agctcaaaggtttg

SEQ ID NO: 1250421 - DNA, 21 bp, Homo sapiens
agctcaaaggtttggaaggag

SEQ ID NO: 1250422 - DNA, 17 bp, Homo sapiens
agctcaaataaaaataa

SEQ ID NO: 1250423 - DNA, 22 bp, Homo sapiens
agctcaaataggtcatcatgaa

SEQ ID NO: 1250424 - DNA, 23 bp, Homo sapiens
agctcaaatgaaatgtatgcatt

SEQ ID NO: 1250425 - DNA, 23 bp, Homo sapiens
agctcaactcacagcttctccaa

SEQ ID NO: 1250426 - DNA, 13 bp, Homo sapiens
agctcaactcggg

SEQ ID NO: 1250427 - DNA, 23 bp, Homo sapiens
agctcaactcgggggcgcctgga

SEQ ID NO: 1250428 - DNA, 15 bp, Homo sapiens
agctcaaggccacct

SEQ ID NO: 1250429 - DNA, 23 bp, Homo sapiens
agctcaagggaccctgggtggga

SEQ ID NO: 1250430 - DNA, 23 bp, Homo sapiens
agctcaagtcttccctgatcaag

SEQ ID NO: 1250431 - DNA, 11 bp, Homo sapiens
agctcaagttt

SEQ ID NO: 1250432 - DNA, 18 bp, Homo sapiens
agctcaagtttaaaagcc

SEQ ID NO: 1250433 - DNA, 16 bp, Homo sapiens
agctcaattcaagtga

SEQ ID NO: 1250434 - DNA, 19 bp, Homo sapiens
agctcacactccagtggca

SEQ ID NO: 1250435 - DNA, 21 bp, Homo sapiens
agctcacactgatgggctggg

SEQ ID NO: 1250436 - DNA, 20 bp, Homo sapiens
agctcacagttcctcgccct

SEQ ID NO: 1250437 - DNA, 21 bp, Homo sapiens
agctcacagttcctcgccctg

SEQ ID NO: 1250438 - DNA, 17 bp, Homo sapiens
agctcacatgggactgg

SEQ ID NO: 1250439 - DNA, 17 bp, Homo sapiens
agctcacccctgggcag

SEQ ID NO: 1250440 - DNA, 19 bp, Homo sapiens
agctcacccctgggcaggc

SEQ ID NO: 1250441 - DNA, 18 bp, Homo sapiens
agctcaccctgcccgctc

SEQ ID NO: 1250442 - DNA, 21 bp, Homo sapiens
agctcaccctgcccgctccca

SEQ ID NO: 1250443 - DNA, 15 bp, Homo sapiens
agctcacctctgaag

SEQ ID NO: 1250444 - DNA, 15 bp, Homo sapiens
agctcagaacccagg

SEQ ID NO: 1250445 - DNA, 16 bp, Homo sapiens
agctcagaacccaggg

SEQ ID NO: 1250446 - DNA, 21 bp, Homo sapiens
agctcagaatagatctgatgg

SEQ ID NO: 1250447 - DNA, 23 bp, Homo sapiens
agctcagacttgccaggctccct

SEQ ID NO: 1250448 - DNA, 15 bp, Homo sapiens
agctcagcccacccc

SEQ ID NO: 1250449 - DNA, 19 bp, Homo sapiens
agctcagcccacccccctc

SEQ ID NO: 1250450 - DNA, 19 bp, Homo sapiens
agctcagccctggcctggc

SEQ ID NO: 1250451 - DNA, 20 bp, Homo sapiens
agctcagccctggcctggct

SEQ ID NO: 1250452 - DNA, 17 bp, Homo sapiens
agctcagcgccagcctg

SEQ ID NO: 1250453 - DNA, 17 bp, Homo sapiens
agctcaggaagaagaga

SEQ ID NO: 1250454 - DNA, 17 bp, Homo sapiens
agctcaggaggcgccct

SEQ ID NO: 1250455 - DNA, 12 bp, Homo sapiens
agctcaggaggg

SEQ ID NO: 1250456 - DNA, 22 bp, Homo sapiens
agctcaggagggtgacgcccag

SEQ ID NO: 1250457 - DNA, 23 bp, Homo sapiens
agctcaggagggtgacgcccagc

SEQ ID NO: 1250458 - DNA, 20 bp, Homo sapiens
agctcagggcagctgtgctg

SEQ ID NO: 1250459 - DNA, 20 bp, Homo sapiens
agctcaggtttgtcctggtc

SEQ ID NO: 1250460 - DNA, 19 bp, Homo sapiens
agctcagtaacataactgc

SEQ ID NO: 1250461 - DNA, 20 bp, Homo sapiens
agctcagtaacataactgct

SEQ ID NO: 1250462 - DNA, 11 bp, Homo sapiens
agctcagtcat

SEQ ID NO: 1250463 - DNA, 21 bp, Homo sapiens
agctcagtcccatcagagagc

SEQ ID NO: 1250464 - DNA, 19 bp, Homo sapiens
agctcagtgatacctcctt

SEQ ID NO: 1250465 - DNA, 20 bp, Homo sapiens
agctcatagaggtgagaaaa

SEQ ID NO: 1250466 - DNA, 18 bp, Homo sapiens
agctcatcccccctgctg

SEQ ID NO: 1250467 - DNA, 22 bp, Homo sapiens
agctcatcccccctgctgccca

SEQ ID NO: 1250468 - DNA, 23 bp, Homo sapiens
agctcatctccaaggatcctctc

SEQ ID NO: 1250469 - DNA, 18 bp, Homo sapiens
agctcattaaactttttt

SEQ ID NO: 1250470 - DNA, 21 bp, Homo sapiens
agctcattataatgtcattaa

SEQ ID NO: 1250471 - DNA, 19 bp, Homo sapiens
agctcattatgaaaaacat

SEQ ID NO: 1250472 - DNA, 18 bp, Homo sapiens
agctcatttaatcccagg

SEQ ID NO: 1250473 - DNA, 22 bp, Homo sapiens
agctcatttaatcccaggaaag

SEQ ID NO: 1250474 - DNA, 23 bp, Homo sapiens
agctcatttgagataaagtcaaa

SEQ ID NO: 1250475 - DNA, 19 bp, Homo sapiens
agctccaaatccaaggaaa

SEQ ID NO: 1250476 - DNA, 19 bp, Homo sapiens
agctccacacattccagcc

SEQ ID NO: 1250477 - DNA, 15 bp, Homo sapiens
agctccaccctggcc

SEQ ID NO: 1250478 - DNA, 13 bp, Homo sapiens
agctccacctctg

SEQ ID NO: 1250479 - DNA, 16 bp, Homo sapiens
agctccacctctggtg

SEQ ID NO: 1250480 - DNA, 22 bp, Homo sapiens
agctccacggtgcgtggctgtg

SEQ ID NO: 1250481 - DNA, 14 bp, Homo sapiens
agctccactctgct

SEQ ID NO: 1250482 - DNA, 23 bp, Homo sapiens
agctccactgtcaccctccacct

SEQ ID NO: 1250483 - DNA, 23 bp, Homo sapiens
agctccagacccccagcaaccct

SEQ ID NO: 1250484 - DNA, 16 bp, Homo sapiens
agctccaggcccaccg

SEQ ID NO: 1250485 - DNA, 13 bp, Homo sapiens
agctccaggggcc

SEQ ID NO: 1250486 - DNA, 21 bp, Homo sapiens
agctccatctccactccagat

SEQ ID NO: 1250487 - DNA, 21 bp, Homo sapiens
agctcccaacgagcctcctca

SEQ ID NO: 1250488 - DNA, 13 bp, Homo sapiens
agctcccacccca

SEQ ID NO: 1250489 - DNA, 18 bp, Homo sapiens
agctcccacctcccttcc

SEQ ID NO: 1250490 - DNA, 13 bp, Homo sapiens
agctcccaggaac

SEQ ID NO: 1250491 - DNA, 20 bp, Homo sapiens
agctccccaattctgcctgc

SEQ ID NO: 1250492 - DNA, 20 bp, Homo sapiens
agctccccatcaccatggga

SEQ ID NO: 1250493 - DNA, 23 bp, Homo sapiens
agctccccctcccccactgccat

SEQ ID NO: 1250494 - DNA, 20 bp, Homo sapiens
agctcccctgctgaggcagt

SEQ ID NO: 1250495 - DNA, 16 bp, Homo sapiens
agctccctagactgca

SEQ ID NO: 1250496 - DNA, 12 bp, Homo sapiens
agctccctggag

SEQ ID NO: 1250497 - DNA, 17 bp, Homo sapiens
agctcccttccctgcag

SEQ ID NO: 1250498 - DNA, 17 bp, Homo sapiens
agctccctttctcagga

SEQ ID NO: 1250499 - DNA, 16 bp, Homo sapiens
agctccgacctctctc

SEQ ID NO: 1250500 - DNA, 18 bp, Homo sapiens
agctccggaatagatgtc

SEQ ID NO: 1250501 - DNA, 22 bp, Homo sapiens
agctccggagggggtcctcctc

SEQ ID NO: 1250502 - DNA, 13 bp, Homo sapiens
agctcctcacata

SEQ ID NO: 1250503 - DNA, 15 bp, Homo sapiens
agctcctccagccct

SEQ ID NO: 1250504 - DNA, 15 bp, Homo sapiens
agctcctccctgtgc

SEQ ID NO: 1250505 - DNA, 23 bp, Homo sapiens
agctcctccctgtgcccccagcc

SEQ ID NO: 1250506 - DNA, 16 bp, Homo sapiens
agctcctcccttgttc

SEQ ID NO: 1250507 - DNA, 21 bp, Homo sapiens
agctcctcctccctgcatctg

SEQ ID NO: 1250508 - DNA, 20 bp, Homo sapiens
agctcctcctcggaaccgct

SEQ ID NO: 1250509 - DNA, 22 bp, Homo sapiens
agctcctctccttgggctcctg

SEQ ID NO: 1250510 - DNA, 15 bp, Homo sapiens
agctcctctctgaag

SEQ ID NO: 1250511 - DNA, 12 bp, Homo sapiens
agctcctctgag

SEQ ID NO: 1250512 - DNA, 14 bp, Homo sapiens
agctcctctgagcc

SEQ ID NO: 1250513 - DNA, 15 bp, Homo sapiens
agctcctctgagcca

SEQ ID NO: 1250514 - DNA, 14 bp, Homo sapiens
agctcctctgggca

SEQ ID NO: 1250515 - DNA, 15 bp, Homo sapiens
agctcctctgggcag

SEQ ID NO: 1250516 - DNA, 14 bp, Homo sapiens
agctcctcttccat

SEQ ID NO: 1250517 - DNA, 19 bp, Homo sapiens
agctcctgagtagctgggc

SEQ ID NO: 1250518 - DNA, 20 bp, Homo sapiens
agctcctgagtagctgggcc

SEQ ID NO: 1250519 - DNA, 22 bp, Homo sapiens
agctcctgagtagctgggcctg

SEQ ID NO: 1250520 - DNA, 14 bp, Homo sapiens
agctcctggccagg

SEQ ID NO: 1250521 - DNA, 18 bp, Homo sapiens
agctcctgggacccttgg

SEQ ID NO: 1250522 - DNA, 20 bp, Homo sapiens
agctcctgggacccttggct

SEQ ID NO: 1250523 - DNA, 17 bp, Homo sapiens
agctcctggggagctcc

SEQ ID NO: 1250524 - DNA, 13 bp, Homo sapiens
agctcctgtcctc

SEQ ID NO: 1250525 - DNA, 12 bp, Homo sapiens
agctcctgtggc

SEQ ID NO: 1250526 - DNA, 22 bp, Homo sapiens
agctcctgtggccccaccctgg

SEQ ID NO: 1250527 - DNA, 19 bp, Homo sapiens
agctccttcctggagactg

SEQ ID NO: 1250528 - DNA, 18 bp, Homo sapiens
agctccttcctgtttgtt

SEQ ID NO: 1250529 - DNA, 12 bp, Homo sapiens
agctccttggag

SEQ ID NO: 1250530 - DNA, 24 bp, Homo sapiens
agctggtgtcagcccctcttccct

SEQ ID NO: 1250531 - DNA, 18 bp, Homo sapiens
agctggtgtctgattgtt

SEQ ID NO: 1250532 - DNA, 15 bp, Homo sapiens
agctggttagaaatg

SEQ ID NO: 1250533 - DNA, 13 bp, Homo sapiens
agctggttgctcc

SEQ ID NO: 1250534 - DNA, 13 bp, Homo sapiens
agctgtaaaaatg

SEQ ID NO: 1250535 - DNA, 18 bp, Homo sapiens
agctgtaaaaatgttacg

SEQ ID NO: 1250536 - DNA, 13 bp, Homo sapiens
agctgtaagggca

SEQ ID NO: 1250537 - DNA, 19 bp, Homo sapiens
agctgtaagggcagtgccc

SEQ ID NO: 1250538 - DNA, 19 bp, Homo sapiens
agctgtaatgtttcacaga

SEQ ID NO: 1250539 - DNA, 23 bp, Homo sapiens
agctgtacaaatataagaataaa

SEQ ID NO: 1250540 - DNA, 20 bp, Homo sapiens
agctgtactataagtagttg

SEQ ID NO: 1250541 - DNA, 13 bp, Homo sapiens
agctgtactcaga

SEQ ID NO: 1250542 - DNA, 15 bp, Homo sapiens
agctgtagaaatgta

SEQ ID NO: 1250543 - DNA, 16 bp, Homo sapiens
agctgtagccatggct

SEQ ID NO: 1250544 - DNA, 22 bp, Homo sapiens
agctgtagccatggctcaggca

SEQ ID NO: 1250545 - DNA, 20 bp, Homo sapiens
agctgtaggtgtgcgggacc

SEQ ID NO: 1250546 - DNA, 20 bp, Homo sapiens
agctgtagtagccctttctg

SEQ ID NO: 1250547 - DNA, 21 bp, Homo sapiens
agctgtataattaattgtcat

SEQ ID NO: 1250548 - DNA, 11 bp, Homo sapiens
agctgtatcaa

SEQ ID NO: 1250549 - DNA, 23 bp, Homo sapiens
agctgtatcttgatgtttagaaa

SEQ ID NO: 1250550 - DNA, 13 bp, Homo sapiens
agctgtatgattt

SEQ ID NO: 1250551 - DNA, 20 bp, Homo sapiens
agctgtatgatttgttttga

SEQ ID NO: 1250552 - DNA, 17 bp, Homo sapiens
agctgtattaagtgact

SEQ ID NO: 1250553 - DNA, 21 bp, Homo sapiens
agctgtattttggctttctcc

SEQ ID NO: 1250554 - DNA, 18 bp, Homo sapiens
agctgtcacctgctcaca

SEQ ID NO: 1250555 - DNA, 19 bp, Homo sapiens
agctgtcacctgctcacag

SEQ ID NO: 1250556 - DNA, 21 bp, Homo sapiens
agctgtcacctgctcacaggg

SEQ ID NO: 1250557 - DNA, 21 bp, Homo sapiens
agctgtcacttcgcgtgccct

SEQ ID NO: 1250558 - DNA, 16 bp, Homo sapiens
agctgtcaggctggga

SEQ ID NO: 1250559 - DNA, 18 bp, Homo sapiens
agctgtccctgtcaccaa

SEQ ID NO: 1250560 - DNA, 22 bp, Homo sapiens
agctgtccctgtcaccaagctc

SEQ ID NO: 1250561 - DNA, 16 bp, Homo sapiens
agctgtcctgcagcaa

SEQ ID NO: 1250562 - DNA, 22 bp, Homo sapiens
agctgtcctgcagcaaacactc

SEQ ID NO: 1250563 - DNA, 13 bp, Homo sapiens
agctgtctactgg

SEQ ID NO: 1250564 - DNA, 14 bp, Homo sapiens
agctgtctgactgc

SEQ ID NO: 1250565 - DNA, 14 bp, Homo sapiens
agctgtctgtgaat

SEQ ID NO: 1250566 - DNA, 14 bp, Homo sapiens
agctgtgaaatcca

SEQ ID NO: 1250567 - DNA, 18 bp, Homo sapiens
agctgtgacttctccagg

SEQ ID NO: 1250568 - DNA, 17 bp, Homo sapiens
agctgtgagccatgcct

SEQ ID NO: 1250569 - DNA, 18 bp, Homo sapiens
agctgtgagccatgcctc

SEQ ID NO: 1250570 - DNA, 20 bp, Homo sapiens
agctgtgagccatgcctccc

SEQ ID NO: 1250571 - DNA, 16 bp, Homo sapiens
agctgtgcaggcatgg

SEQ ID NO: 1250572 - DNA, 18 bp, Homo sapiens
agctgtgcaggtggggag

SEQ ID NO: 1250573 - DNA, 19 bp, Homo sapiens
agctgtgcaggtggggaga

SEQ ID NO: 1250574 - DNA, 18 bp, Homo sapiens
agctgtgccccctctggt

SEQ ID NO: 1250575 - DNA, 18 bp, Homo sapiens
agctgtgcccctccccca

SEQ ID NO: 1250576 - DNA, 15 bp, Homo sapiens
agctgtgcctgctca

SEQ ID NO: 1250577 - DNA, 17 bp, Homo sapiens
agctgtgcctgctcagc

SEQ ID NO: 1250578 - DNA, 22 bp, Homo sapiens
agctgtggaggattgctatctg

SEQ ID NO: 1250579 - DNA, 21 bp, Homo sapiens
agctgtggcagagttacagtt

SEQ ID NO: 1250580 - DNA, 18 bp, Homo sapiens
agctgtgtccttgcacct

SEQ ID NO: 1250581 - DNA, 20 bp, Homo sapiens
agctgtgtccttgcacctgc

SEQ ID NO: 1250582 - DNA, 21 bp, Homo sapiens
agctgtgtccttgcacctgca

SEQ ID NO: 1250583 - DNA, 21 bp, Homo sapiens
agctgtgtctgacatgtttgt

SEQ ID NO: 1250584 - DNA, 14 bp, Homo sapiens
agctgtgtctgcca

SEQ ID NO: 1250585 - DNA, 23 bp, Homo sapiens
agctgtgtgacatttggagaggg

SEQ ID NO: 1250586 - DNA, 15 bp, Homo sapiens
agctgttaaactgtt

SEQ ID NO: 1250587 - DNA, 22 bp, Homo sapiens
agctgttaaactgttagcactg

SEQ ID NO: 1250588 - DNA, 16 bp, Homo sapiens
agctgttactttcttt

SEQ ID NO: 1250589 - DNA, 23 bp, Homo sapiens
agctgttactttctttcagatgt

SEQ ID NO: 1250590 - DNA, 15 bp, Homo sapiens
agctgttagggctga

SEQ ID NO: 1250591 - DNA, 16 bp, Homo sapiens
agctgttagggctgaa

SEQ ID NO: 1250592 - DNA, 16 bp, Homo sapiens
agctgttcctgtgttc

SEQ ID NO: 1250593 - DNA, 17 bp, Homo sapiens
agctgttctaatggatt

SEQ ID NO: 1250594 - DNA, 14 bp, Homo sapiens
agctgttctggact

SEQ ID NO: 1250595 - DNA, 21 bp, Homo sapiens
agctgttcttttttgtacttt

SEQ ID NO: 1250596 - DNA, 12 bp, Homo sapiens
agctgttgagaa

SEQ ID NO: 1250597 - DNA, 13 bp, Homo sapiens
agctgttgagaaa

SEQ ID NO: 1250598 - DNA, 13 bp, Homo sapiens
agctgttgagctg

SEQ ID NO: 1250599 - DNA, 22 bp, Homo sapiens
agctgttggcctctgcaaagga

SEQ ID NO: 1250600 - DNA, 17 bp, Homo sapiens
agctgttgtgagctttg

SEQ ID NO: 1250601 - DNA, 16 bp, Homo sapiens
agctgtttaagatggg

SEQ ID NO: 1250602 - DNA, 17 bp, Homo sapiens
agctgtttatggcctca

SEQ ID NO: 1250603 - DNA, 21 bp, Homo sapiens
agctgtttatggcctcagctg

SEQ ID NO: 1250604 - DNA, 12 bp, Homo sapiens
agctgtttctca

SEQ ID NO: 1250605 - DNA, 17 bp, Homo sapiens
agctgtttctcatgaag

SEQ ID NO: 1250606 - DNA, 16 bp, Homo sapiens
agctgtttggaaaaga

SEQ ID NO: 1250607 - DNA, 20 bp, Homo sapiens
agctgtttggatacagctgc

SEQ ID NO: 1250608 - DNA, 18 bp, Homo sapiens
agctgttttccctgacct

SEQ ID NO: 1250609 - DNA, 16 bp, Homo sapiens
agctgttttgtgtata

SEQ ID NO: 1250610 - DNA, 17 bp, Homo sapiens
agctgttttgtgtatat

SEQ ID NO: 1250611 - DNA, 13 bp, Homo sapiens
agcttaaaaagag

SEQ ID NO: 1250612 - DNA, 12 bp, Homo sapiens
agcttaaaactt

SEQ ID NO: 1250613 - DNA, 16 bp, Homo sapiens
agcttaaaactttgaa

SEQ ID NO: 1250614 - DNA, 19 bp, Homo sapiens
agcttaaacccatacaatg

SEQ ID NO: 1250615 - DNA, 15 bp, Homo sapiens
agcttaaagcttgat

SEQ ID NO: 1250616 - DNA, 20 bp, Homo sapiens
agcttaaaggggctagagtg

SEQ ID NO: 1250617 - DNA, 24 bp, Homo sapiens
agcttaaattgcttttgttgtgac

SEQ ID NO: 1250618 - DNA, 19 bp, Homo sapiens
agcttaagtgtaaatgaag

SEQ ID NO: 1250619 - DNA, 20 bp, Homo sapiens
agcttaagtgtaaatgaagt

SEQ ID NO: 1250620 - DNA, 16 bp, Homo sapiens
agcttaatagccctcc

SEQ ID NO: 1250621 - DNA, 15 bp, Homo sapiens
agcttacaagccagc

SEQ ID NO: 1250622 - DNA, 19 bp, Homo sapiens
agcttacaagccagctgga

SEQ ID NO: 1250623 - DNA, 15 bp, Homo sapiens
agcttacactgagga

SEQ ID NO: 1250624 - DNA, 16 bp, Homo sapiens
agcttacactgaggac

SEQ ID NO: 1250625 - DNA, 18 bp, Homo sapiens
agcttacactgaggactg

SEQ ID NO: 1250626 - DNA, 22 bp, Homo sapiens
agcttacagaatgggagaaaat

SEQ ID NO: 1250627 - DNA, 18 bp, Homo sapiens
agcttacaggaagctttt

SEQ ID NO: 1250628 - DNA, 22 bp, Homo sapiens
agcttaccagaagcttccatag

SEQ ID NO: 1250629 - DNA, 16 bp, Homo sapiens
agcttagacctcagcc

SEQ ID NO: 1250630 - DNA, 20 bp, Homo sapiens
agcttagagttcttctttct

SEQ ID NO: 1250631 - DNA, 13 bp, Homo sapiens
agcttagatttca

SEQ ID NO: 1250632 - DNA, 16 bp, Homo sapiens
agcttagatttcatag

SEQ ID NO: 1250633 - DNA, 16 bp, Homo sapiens
agcttagccttgtgcc

SEQ ID NO: 1250634 - DNA, 15 bp, Homo sapiens
agcttagggccctgg

SEQ ID NO: 1250635 - DNA, 21 bp, Homo sapiens
agcttataatgaaatctgttt

SEQ ID NO: 1250636 - DNA, 23 bp, Homo sapiens
agcttataatgaaatctgtttgt

SEQ ID NO: 1250637 - DNA, 12 bp, Homo sapiens
agcttatctcag

SEQ ID NO: 1250638 - DNA, 22 bp, Homo sapiens
agcttatctcttttatatttgt

SEQ ID NO: 1250639 - DNA, 18 bp, Homo sapiens
agcttatctttctttcca

SEQ ID NO: 1250640 - DNA, 22 bp, Homo sapiens
agcttattatccaattcaaaaa

SEQ ID NO: 1250641 - DNA, 18 bp, Homo sapiens
agcttattgatcccacat

SEQ ID NO: 1250642 - DNA, 17 bp, Homo sapiens
agcttattggccactgg

SEQ ID NO: 1250643 - DNA, 12 bp, Homo sapiens
agcttcaaagct

SEQ ID NO: 1250644 - DNA, 23 bp, Homo sapiens
agcttcaaattatagaaacaata

SEQ ID NO: 1250645 - DNA, 14 bp, Homo sapiens
agcttcaatataag

SEQ ID NO: 1250646 - DNA, 15 bp, Homo sapiens
agcttcaatataaga

SEQ ID NO: 1250647 - DNA, 16 bp, Homo sapiens
agcttcaccctgtcaa

SEQ ID NO: 1250648 - DNA, 16 bp, Homo sapiens
agcttcagaagtttgg

SEQ ID NO: 1250649 - DNA, 21 bp, Homo sapiens
agcttcagaagtttggcaata

SEQ ID NO: 1250650 - DNA, 15 bp, Homo sapiens
agcttcagactcaag

SEQ ID NO: 1250651 - DNA, 20 bp, Homo sapiens
aggaaataacagagagaatg

SEQ ID NO: 1250652 - DNA, 15 bp, Homo sapiens
aggaaataacattgc

SEQ ID NO: 1250653 - DNA, 17 bp, Homo sapiens
aggaaataactaagaga

SEQ ID NO: 1250654 - DNA, 18 bp, Homo sapiens
aggaaataagaaaaatca

SEQ ID NO: 1250655 - DNA, 15 bp, Homo sapiens
aggaaatacacttct

SEQ ID NO: 1250656 - DNA, 21 bp, Homo sapiens
aggaaatagtaccttcaatac

SEQ ID NO: 1250657 - DNA, 15 bp, Homo sapiens
aggaaatatactttt

SEQ ID NO: 1250658 - DNA, 20 bp, Homo sapiens
aggaaatatatatgtgtgtg

SEQ ID NO: 1250659 - DNA, 19 bp, Homo sapiens
aggaaatatatttgtaaaa

SEQ ID NO: 1250660 - DNA, 13 bp, Homo sapiens
aggaaatcaaatg

SEQ ID NO: 1250661 - DNA, 19 bp, Homo sapiens
aggaaatccattgtttaaa

SEQ ID NO: 1250662 - DNA, 16 bp, Homo sapiens
aggaaattagtctttt

SEQ ID NO: 1250663 - DNA, 22 bp, Homo sapiens
aggaaatttgtttgtatttttt

SEQ ID NO: 1250664 - DNA, 20 bp, Homo sapiens
aggaacaagcatgtctctct

SEQ ID NO: 1250665 - DNA, 22 bp, Homo sapiens
aggaacaagctggcttctgtga

SEQ ID NO: 1250666 - DNA, 12 bp, Homo sapiens
aggaacactggc

SEQ ID NO: 1250667 - DNA, 19 bp, Homo sapiens
aggaacactggcttgaagg

SEQ ID NO: 1250668 - DNA, 21 bp, Homo sapiens
aggaacagctatgggagcccc

SEQ ID NO: 1250669 - DNA, 23 bp, Homo sapiens
aggaacaggttcctgtggagaca

SEQ ID NO: 1250670 - DNA, 18 bp, Homo sapiens
aggaacagtggctgggtg

SEQ ID NO: 1250671 - DNA, 16 bp, Homo sapiens
aggaacatatgaaaat

SEQ ID NO: 1250672 - DNA, 19 bp, Homo sapiens
aggaacatatgaaaataca

SEQ ID NO: 1250673 - DNA, 20 bp, Homo sapiens
aggaaccacaatgtttcttc

SEQ ID NO: 1250674 - DNA, 17 bp, Homo sapiens
aggaaccacaccacatc

SEQ ID NO: 1250675 - DNA, 13 bp, Homo sapiens
aggaaccagggcc

SEQ ID NO: 1250676 - DNA, 15 bp, Homo sapiens
aggaaccagggcctc

SEQ ID NO: 1250677 - DNA, 21 bp, Homo sapiens
aggaacccttgcatccattgt

SEQ ID NO: 1250678 - DNA, 23 bp, Homo sapiens
aggaacccttgcatccattgttg

SEQ ID NO: 1250679 - DNA, 18 bp, Homo sapiens
aggaacctctgatttatt

SEQ ID NO: 1250680 - DNA, 21 bp, Homo sapiens
aggaacctctgatttattttg

SEQ ID NO: 1250681 - DNA, 14 bp, Homo sapiens
aggaaccttccttc

SEQ ID NO: 1250682 - DNA, 20 bp, Homo sapiens
aggaaccttccttcctgctt

SEQ ID NO: 1250683 - DNA, 16 bp, Homo sapiens
aggaacgagcactggc

SEQ ID NO: 1250684 - DNA, 13 bp, Homo sapiens
aggaacggccctg

SEQ ID NO: 1250685 - DNA, 20 bp, Homo sapiens
aggaacgggcagccacagga

SEQ ID NO: 1250686 - DNA, 22 bp, Homo sapiens
aggaacgtaatcgtgtccccta

SEQ ID NO: 1250687 - DNA, 20 bp, Homo sapiens
aggaactagtaaacatatgt

SEQ ID NO: 1250688 - DNA, 12 bp, Homo sapiens
aggaactcacat

SEQ ID NO: 1250689 - DNA, 14 bp, Homo sapiens
aggaactccaggac

SEQ ID NO: 1250690 - DNA, 13 bp, Homo sapiens
aggaactctggct

SEQ ID NO: 1250691 - DNA, 16 bp, Homo sapiens
aggaactctggcttcc

SEQ ID NO: 1250692 - DNA, 18 bp, Homo sapiens
aggaactctggcttccag

SEQ ID NO: 1250693 - DNA, 20 bp, Homo sapiens
aggaactgcctgggccatgc

SEQ ID NO: 1250694 - DNA, 13 bp, Homo sapiens
aggaactgggctg

SEQ ID NO: 1250695 - DNA, 16 bp, Homo sapiens
aggaactgggctgggc

SEQ ID NO: 1250696 - DNA, 16 bp, Homo sapiens
aggaactgtccagaga

SEQ ID NO: 1250697 - DNA, 17 bp, Homo sapiens
aggaactgtccagagag

SEQ ID NO: 1250698 - DNA, 14 bp, Homo sapiens
aggaactgttataa

SEQ ID NO: 1250699 - DNA, 18 bp, Homo sapiens
aggaacttgctgctgtgc

SEQ ID NO: 1250700 - DNA, 13 bp, Homo sapiens
aggaactttcccc

SEQ ID NO: 1250701 - DNA, 20 bp, Homo sapiens
aggaagaagacaaatgacag

SEQ ID NO: 1250702 - DNA, 17 bp, Homo sapiens
aggaagaagagatgcac

SEQ ID NO: 1250703 - DNA, 18 bp, Homo sapiens
aggaagaagggataatag

SEQ ID NO: 1250704 - DNA, 17 bp, Homo sapiens
aggaagacagttctaca

SEQ ID NO: 1250705 - DNA, 14 bp, Homo sapiens
aggaagacataaaa

SEQ ID NO: 1250706 - DNA, 17 bp, Homo sapiens
aggaagaccaaggcctc

SEQ ID NO: 1250707 - DNA, 19 bp, Homo sapiens
aggaagaccaaggcctcgg

SEQ ID NO: 1250708 - DNA, 17 bp, Homo sapiens
aggaagaccattctgtg

SEQ ID NO: 1250709 - DNA, 14 bp, Homo sapiens
aggaagagaaaaaa

SEQ ID NO: 1250710 - DNA, 13 bp, Homo sapiens
aggaagagagaga

SEQ ID NO: 1250711 - DNA, 12 bp, Homo sapiens
aggaagagccac

SEQ ID NO: 1250712 - DNA, 16 bp, Homo sapiens
aggaagagccacctgc

SEQ ID NO: 1250713 - DNA, 17 bp, Homo sapiens
aggaagagccacctgca

SEQ ID NO: 1250714 - DNA, 16 bp, Homo sapiens
aggaagagctaataaa

SEQ ID NO: 1250715 - DNA, 13 bp, Homo sapiens
aggaagaggccca

SEQ ID NO: 1250716 - DNA, 17 bp, Homo sapiens
aggaagagggctgagct

SEQ ID NO: 1250717 - DNA, 18 bp, Homo sapiens
aggaagagggctgagctg

SEQ ID NO: 1250718 - DNA, 12 bp, Homo sapiens
aggaagagttta

SEQ ID NO: 1250719 - DNA, 16 bp, Homo sapiens
aggaagatcccccaga

SEQ ID NO: 1250720 - DNA, 17 bp, Homo sapiens
aggaagatgaaagagga

SEQ ID NO: 1250721 - DNA, 23 bp, Homo sapiens
aggaagatttgacgttgttgtca

SEQ ID NO: 1250722 - DNA, 13 bp, Homo sapiens
aggaagatttgga

SEQ ID NO: 1250723 - DNA, 19 bp, Homo sapiens
aggaagcaaatagaagaga

SEQ ID NO: 1250724 - DNA, 18 bp, Homo sapiens
aggaagcaccccatgcca

SEQ ID NO: 1250725 - DNA, 12 bp, Homo sapiens
aggaagcaggga

SEQ ID NO: 1250726 - DNA, 14 bp, Homo sapiens
aggaagcagggaga

SEQ ID NO: 1250727 - DNA, 15 bp, Homo sapiens
aggaagcagggagag

SEQ ID NO: 1250728 - DNA, 14 bp, Homo sapiens
aggaagcagttggg

SEQ ID NO: 1250729 - DNA, 18 bp, Homo sapiens
aggaagcagttggggccc

SEQ ID NO: 1250730 - DNA, 18 bp, Homo sapiens
aggaagcattcagagagc

SEQ ID NO: 1250731 - DNA, 21 bp, Homo sapiens
aggaagcattgtaaaataatt

SEQ ID NO: 1250732 - DNA, 11 bp, Homo sapiens
aggaagccaga

SEQ ID NO: 1250733 - DNA, 21 bp, Homo sapiens
aggaagccagtcaccttctgg

SEQ ID NO: 1250734 - DNA, 19 bp, Homo sapiens
aggaagcccaattgctgga

SEQ ID NO: 1250735 - DNA, 22 bp, Homo sapiens
aggaagcccaccaatctgccct

SEQ ID NO: 1250736 - DNA, 23 bp, Homo sapiens
aggaagcccaccaatctgccctt

SEQ ID NO: 1250737 - DNA, 21 bp, Homo sapiens
aggaagcccaggctcggagga

SEQ ID NO: 1250738 - DNA, 22 bp, Homo sapiens
aggaagcccaggctcggaggac

SEQ ID NO: 1250739 - DNA, 22 bp, Homo sapiens
aggaagcccccaccgtgggcag

SEQ ID NO: 1250740 - DNA, 9 bp, Homo sapiens
aggaagccg

SEQ ID NO: 1250741 - DNA, 14 bp, Homo sapiens
aggaagccggtgtc

SEQ ID NO: 1250742 - DNA, 21 bp, Homo sapiens
aggaagccgttgaatctggga

SEQ ID NO: 1250743 - DNA, 23 bp, Homo sapiens
aggaagccgttgaatctgggagg

SEQ ID NO: 1250744 - DNA, 19 bp, Homo sapiens
aggaagcctgcagtcctgg

SEQ ID NO: 1250745 - DNA, 18 bp, Homo sapiens
aggaagctccttcctgtt

SEQ ID NO: 1250746 - DNA, 18 bp, Homo sapiens
aggaagctggcagaacgg

SEQ ID NO: 1250747 - DNA, 15 bp, Homo sapiens
aggaaggaacaaaga

SEQ ID NO: 1250748 - DNA, 15 bp, Homo sapiens
aggaaggacaggaag

SEQ ID NO: 1250749 - DNA, 19 bp, Homo sapiens
aggaaggagactcacctct

SEQ ID NO: 1250750 - DNA, 23 bp, Homo sapiens
aggaaggagactcacctctgcct

SEQ ID NO: 1250751 - DNA, 21 bp, Homo sapiens
aggaaggagagatgaccccta

SEQ ID NO: 1250752 - DNA, 18 bp, Homo sapiens
aggaaggaggacccagga

SEQ ID NO: 1250753 - DNA, 21 bp, Homo sapiens
aggaaggaggacccaggacag

SEQ ID NO: 1250754 - DNA, 14 bp, Homo sapiens
aggaaggcaagagg

SEQ ID NO: 1250755 - DNA, 16 bp, Homo sapiens
aggaaggcagcattcc

SEQ ID NO: 1250756 - DNA, 19 bp, Homo sapiens
aggaaggcagcattccatg

SEQ ID NO: 1250757 - DNA, 12 bp, Homo sapiens
aggaaggcagct

SEQ ID NO: 1250758 - DNA, 16 bp, Homo sapiens
aggaaggcagctgctc

SEQ ID NO: 1250759 - DNA, 19 bp, Homo sapiens
aggaaggcagctgctctta

SEQ ID NO: 1250760 - DNA, 19 bp, Homo sapiens
aggaaggccaaaatcaaga

SEQ ID NO: 1250761 - DNA, 16 bp, Homo sapiens
aggaaggcctttcttc

SEQ ID NO: 1250762 - DNA, 19 bp, Homo sapiens
aggaaggcctttcttctgt

SEQ ID NO: 1250763 - DNA, 19 bp, Homo sapiens
aggaagggagtgaggggct

SEQ ID NO: 1250764 - DNA, 22 bp, Homo sapiens
aggaagggagtgaggggctgtg

SEQ ID NO: 1250765 - DNA, 19 bp, Homo sapiens
aggaaggggggttgcagtg

SEQ ID NO: 1250766 - DNA, 16 bp, Homo sapiens
aggaagggggttgtgg

SEQ ID NO: 1250767 - DNA, 14 bp, Homo sapiens
aggaaggtgctgag

SEQ ID NO: 1250768 - DNA, 17 bp, Homo sapiens
aggaagtaaaataaata

SEQ ID NO: 1250769 - DNA, 18 bp, Homo sapiens
aggaagtatgagtgctga

SEQ ID NO: 1250770 - DNA, 15 bp, Homo sapiens
aggaagtccagccac

SEQ ID NO: 1250771 - DNA, 19 bp, Homo sapiens
aggaagtggctggtctgga

SEQ ID NO: 1250772 - DNA, 12 bp, Homo sapiens
aggaagtggggt

SEQ ID NO: 1250773 - DNA, 16 bp, Homo sapiens
aggacttggggtcagg

SEQ ID NO: 1250774 - DNA, 15 bp, Homo sapiens
aggactttgtacatt

SEQ ID NO: 1250775 - DNA, 12 bp, Homo sapiens
aggagaaaaaaa

SEQ ID NO: 1250776 - DNA, 16 bp, Homo sapiens
aggagaaaagtgggct

SEQ ID NO: 1250777 - DNA, 17 bp, Homo sapiens
aggagaaaagtgggctg

SEQ ID NO: 1250778 - DNA, 19 bp, Homo sapiens
aggagaaacacattcttat

SEQ ID NO: 1250779 - DNA, 18 bp, Homo sapiens
aggagaaagccgggggag

SEQ ID NO: 1250780 - DNA, 14 bp, Homo sapiens
aggagaaatctcag

SEQ ID NO: 1250781 - DNA, 20 bp, Homo sapiens
aggagaaatgcaataactct

SEQ ID NO: 1250782 - DNA, 15 bp, Homo sapiens
aggagaaccactaca

SEQ ID NO: 1250783 - DNA, 15 bp, Homo sapiens
aggagaagagaggaa

SEQ ID NO: 1250784 - DNA, 18 bp, Homo sapiens
aggagaagcacagctcct

SEQ ID NO: 1250785 - DNA, 14 bp, Homo sapiens
aggagaaggaaaac

SEQ ID NO: 1250786 - DNA, 21 bp, Homo sapiens
aggagaagggggctctgcccc

SEQ ID NO: 1250787 - DNA, 14 bp, Homo sapiens
aggagaaggtcagc

SEQ ID NO: 1250788 - DNA, 21 bp, Homo sapiens
aggagaaggtcagcgagaagg

SEQ ID NO: 1250789 - DNA, 22 bp, Homo sapiens
aggagaatcgcttgaacctggg

SEQ ID NO: 1250790 - DNA, 16 bp, Homo sapiens
aggagaatgaaatgta

SEQ ID NO: 1250791 - DNA, 15 bp, Homo sapiens
aggagaattgaattc

SEQ ID NO: 1250792 - DNA, 14 bp, Homo sapiens
aggagacaaagcag

SEQ ID NO: 1250793 - DNA, 16 bp, Homo sapiens
aggagacaaagcagga

SEQ ID NO: 1250794 - DNA, 17 bp, Homo sapiens
aggagacaaagcaggag

SEQ ID NO: 1250795 - DNA, 21 bp, Homo sapiens
aggagacaaagcaggagtgga

SEQ ID NO: 1250796 - DNA, 18 bp, Homo sapiens
aggagacacacctgaggc

SEQ ID NO: 1250797 - DNA, 18 bp, Homo sapiens
aggagacagttcaagaaa

SEQ ID NO: 1250798 - DNA, 14 bp, Homo sapiens
aggagacatatata

SEQ ID NO: 1250799 - DNA, 13 bp, Homo sapiens
aggagactgaggc

SEQ ID NO: 1250800 - DNA, 19 bp, Homo sapiens
aggagactgaggcttagag

SEQ ID NO: 1250801 - DNA, 12 bp, Homo sapiens
aggagactgcgt

SEQ ID NO: 1250802 - DNA, 14 bp, Homo sapiens
aggagagaaaatat

SEQ ID NO: 1250803 - DNA, 16 bp, Homo sapiens
aggagagaaaatatat

SEQ ID NO: 1250804 - DNA, 16 bp, Homo sapiens
aggagagaagaaagtg

SEQ ID NO: 1250805 - DNA, 11 bp, Homo sapiens
aggagagaccg

SEQ ID NO: 1250806 - DNA, 23 bp, Homo sapiens
aggagagactgaaagcagcagct

SEQ ID NO: 1250807 - DNA, 15 bp, Homo sapiens
aggagagagccagga

SEQ ID NO: 1250808 - DNA, 15 bp, Homo sapiens
aggagagagtcccag

SEQ ID NO: 1250809 - DNA, 16 bp, Homo sapiens
aggagagagtcccaga

SEQ ID NO: 1250810 - DNA, 11 bp, Homo sapiens
aggagagatga

SEQ ID NO: 1250811 - DNA, 16 bp, Homo sapiens
aggagagatgacccct

SEQ ID NO: 1250812 - DNA, 11 bp, Homo sapiens
aggagagcact

SEQ ID NO: 1250813 - DNA, 14 bp, Homo sapiens
aggagagccactgg

SEQ ID NO: 1250814 - DNA, 16 bp, Homo sapiens
aggagagccactgggc

SEQ ID NO: 1250815 - DNA, 15 bp, Homo sapiens
aggagagccagccct

SEQ ID NO: 1250816 - DNA, 16 bp, Homo sapiens
aggagagccagccctc

SEQ ID NO: 1250817 - DNA, 14 bp, Homo sapiens
aggagagcctgctg

SEQ ID NO: 1250818 - DNA, 16 bp, Homo sapiens
aggagagcctgctgca

SEQ ID NO: 1250819 - DNA, 11 bp, Homo sapiens
aggagaggaaa

SEQ ID NO: 1250820 - DNA, 11 bp, Homo sapiens
aggagaggaga

SEQ ID NO: 1250821 - DNA, 15 bp, Homo sapiens
aggagaggagaaaaa

SEQ ID NO: 1250822 - DNA, 15 bp, Homo sapiens
aggagaggagagggg

SEQ ID NO: 1250823 - DNA, 13 bp, Homo sapiens
aggagaggagggt

SEQ ID NO: 1250824 - DNA, 23 bp, Homo sapiens
aggagagggcctcgtagtggcac

SEQ ID NO: 1250825 - DNA, 13 bp, Homo sapiens
aggagaggggcag

SEQ ID NO: 1250826 - DNA, 17 bp, Homo sapiens
aggagagtcccagagca

SEQ ID NO: 1250827 - DNA, 24 bp, Homo sapiens
aggagagtcccagagcaggaggcc

SEQ ID NO: 1250828 - DNA, 13 bp, Homo sapiens
aggagagtggcag

SEQ ID NO: 1250829 - DNA, 20 bp, Homo sapiens
aggagagtggttgttgccaa

SEQ ID NO: 1250830 - DNA, 22 bp, Homo sapiens
aggagagtgtgcaactggccag

SEQ ID NO: 1250831 - DNA, 19 bp, Homo sapiens
aggagagtgtgtgggcagg

SEQ ID NO: 1250832 - DNA, 19 bp, Homo sapiens
aggagatatctgagggagg

SEQ ID NO: 1250833 - DNA, 23 bp, Homo sapiens
aggagatcgacaccatcctggct

SEQ ID NO: 1250834 - DNA, 14 bp, Homo sapiens
aggagatgaccagg

SEQ ID NO: 1250835 - DNA, 17 bp, Homo sapiens
aggagatgctccttggg

SEQ ID NO: 1250836 - DNA, 20 bp, Homo sapiens
aggagatggaagttgcagtg

SEQ ID NO: 1250837 - DNA, 14 bp, Homo sapiens
aggagatggccata

SEQ ID NO: 1250838 - DNA, 13 bp, Homo sapiens
aggagatggcccc

SEQ ID NO: 1250839 - DNA, 20 bp, Homo sapiens
aggagattggatttgctgtg

SEQ ID NO: 1250840 - DNA, 17 bp, Homo sapiens
aggagattggccagtga

SEQ ID NO: 1250841 - DNA, 15 bp, Homo sapiens
aggagatttcttagt

SEQ ID NO: 1250842 - DNA, 16 bp, Homo sapiens
aggagcaaacactgaa

SEQ ID NO: 1250843 - DNA, 19 bp, Homo sapiens
aggagcaaatgtttctgca

SEQ ID NO: 1250844 - DNA, 22 bp, Homo sapiens
aggagcaaatgtttctgcagta

SEQ ID NO: 1250845 - DNA, 15 bp, Homo sapiens
aggagcaagaagaaa

SEQ ID NO: 1250846 - DNA, 15 bp, Homo sapiens
aggagcaatcacagg

SEQ ID NO: 1250847 - DNA, 15 bp, Homo sapiens
aggagcacaggcagc

SEQ ID NO: 1250848 - DNA, 16 bp, Homo sapiens
aggagcacaggtccca

SEQ ID NO: 1250849 - DNA, 13 bp, Homo sapiens
aggagcacctgga

SEQ ID NO: 1250850 - DNA, 14 bp, Homo sapiens
aggagcagaaatgc

SEQ ID NO: 1250851 - DNA, 13 bp, Homo sapiens
aggagcagccagg

SEQ ID NO: 1250852 - DNA, 14 bp, Homo sapiens
aggagcagccagga

SEQ ID NO: 1250853 - DNA, 13 bp, Homo sapiens
aggagcagcctcg

SEQ ID NO: 1250854 - DNA, 15 bp, Homo sapiens
aggagcagcctcgag

SEQ ID NO: 1250855 - DNA, 18 bp, Homo sapiens
aggagcagcttccttctg

SEQ ID NO: 1250856 - DNA, 16 bp, Homo sapiens
aggagcaggcacgggt

SEQ ID NO: 1250857 - DNA, 19 bp, Homo sapiens
aggagcagggcggctgccg

SEQ ID NO: 1250858 - DNA, 20 bp, Homo sapiens
aggagcattaagcccaatct

SEQ ID NO: 1250859 - DNA, 15 bp, Homo sapiens
aggagccaccagttc

SEQ ID NO: 1250860 - DNA, 13 bp, Homo sapiens
aggagcccagtgg

SEQ ID NO: 1250861 - DNA, 15 bp, Homo sapiens
aggagcccttctctt

SEQ ID NO: 1250862 - DNA, 18 bp, Homo sapiens
aggagcccttctctttga

SEQ ID NO: 1250863 - DNA, 19 bp, Homo sapiens
aggagcctagcggagccca

SEQ ID NO: 1250864 - DNA, 15 bp, Homo sapiens
aggagcctccctgca

SEQ ID NO: 1250865 - DNA, 22 bp, Homo sapiens
aggagcctccctgcacggccca

SEQ ID NO: 1250866 - DNA, 11 bp, Homo sapiens
aggagcctctg

SEQ ID NO: 1250867 - DNA, 14 bp, Homo sapiens
aggagcctctggct

SEQ ID NO: 1250868 - DNA, 11 bp, Homo sapiens
aggagcctggc

SEQ ID NO: 1250869 - DNA, 11 bp, Homo sapiens
aggagccttga

SEQ ID NO: 1250870 - DNA, 14 bp, Homo sapiens
aggagccttgctgg

SEQ ID NO: 1250871 - DNA, 18 bp, Homo sapiens
aggagccttgctgggcca

SEQ ID NO: 1250872 - DNA, 20 bp, Homo sapiens
aggagccttgctgggccagg

SEQ ID NO: 1250873 - DNA, 14 bp, Homo sapiens
aggagctcaccctg

SEQ ID NO: 1250874 - DNA, 20 bp, Homo sapiens
aggagctcaccctgcccgct

SEQ ID NO: 1250875 - DNA, 23 bp, Homo sapiens
aggagctcactgtggtgtctgtg

SEQ ID NO: 1250876 - DNA, 22 bp, Homo sapiens
aggagctcaggaagaagagatg

SEQ ID NO: 1250877 - DNA, 17 bp, Homo sapiens
aggagctcccctgtttg

SEQ ID NO: 1250878 - DNA, 17 bp, Homo sapiens
aggagctctgcgccagg

SEQ ID NO: 1250879 - DNA, 19 bp, Homo sapiens
aggagctctgcgccaggca

SEQ ID NO: 1250880 - DNA, 22 bp, Homo sapiens
aggagctgactcacacctgaac

SEQ ID NO: 1250881 - DNA, 11 bp, Homo sapiens
aggagctgaga

SEQ ID NO: 1250882 - DNA, 18 bp, Homo sapiens
aggagctgagggagggag

SEQ ID NO: 1250883 - DNA, 21 bp, Homo sapiens
aggagctgagggagggagcca

SEQ ID NO: 1250884 - DNA, 19 bp, Homo sapiens
aggagctgatttccaggcc

SEQ ID NO: 1250885 - DNA, 22 bp, Homo sapiens
aggagctgatttccaggcccct

SEQ ID NO: 1250886 - DNA, 14 bp, Homo sapiens
aggagctgcctctt

SEQ ID NO: 1250887 - DNA, 18 bp, Homo sapiens
aggagctgccttggctca

SEQ ID NO: 1250888 - DNA, 19 bp, Homo sapiens
aggagctgccttggctcag

SEQ ID NO: 1250889 - DNA, 13 bp, Homo sapiens
aggagctgctata

SEQ ID NO: 1250890 - DNA, 14 bp, Homo sapiens
aggagctgctggct

SEQ ID NO: 1250891 - DNA, 16 bp, Homo sapiens
aggagctgctggcttg

SEQ ID NO: 1250892 - DNA, 17 bp, Homo sapiens
aggagctgggaggaaaa

SEQ ID NO: 1250893 - DNA, 12 bp, Homo sapiens
aggagctgggcc

SEQ ID NO: 1250894 - DNA, 20 bp, Homo sapiens
aggagctgtcaccaaggaaa

SEQ ID NO: 1250895 - DNA, 17 bp, Homo sapiens
aggagcttacccaagct

SEQ ID NO: 1250896 - DNA, 23 bp, Homo sapiens
aggagcttacccaagctgtggca

SEQ ID NO: 1250897 - DNA, 21 bp, Homo sapiens
aggcagagaaagaagagacag

SEQ ID NO: 1250898 - DNA, 13 bp, Homo sapiens
aggcagagaaatc

SEQ ID NO: 1250899 - DNA, 14 bp, Homo sapiens
aggcagagaaatct

SEQ ID NO: 1250900 - DNA, 18 bp, Homo sapiens
aggcagagaatctcttgg

SEQ ID NO: 1250901 - DNA, 19 bp, Homo sapiens
aggcagagaatctcttggg

SEQ ID NO: 1250902 - DNA, 16 bp, Homo sapiens
aggcagagacctccaa

SEQ ID NO: 1250903 - DNA, 20 bp, Homo sapiens
aggcagagagtacagactgc

SEQ ID NO: 1250904 - DNA, 13 bp, Homo sapiens
aggcagagctgag

SEQ ID NO: 1250905 - DNA, 21 bp, Homo sapiens
aggcagagctgagggccctgt

SEQ ID NO: 1250906 - DNA, 20 bp, Homo sapiens
aggcagagctggagccccca

SEQ ID NO: 1250907 - DNA, 23 bp, Homo sapiens
aggcagagctggagcccccagca

SEQ ID NO: 1250908 - DNA, 12 bp, Homo sapiens
aggcagaggaat

SEQ ID NO: 1250909 - DNA, 21 bp, Homo sapiens
aggcagaggaatttggctgct

SEQ ID NO: 1250910 - DNA, 18 bp, Homo sapiens
aggcagaggcctgggctg

SEQ ID NO: 1250911 - DNA, 15 bp, Homo sapiens
aggcagaggttttaa

SEQ ID NO: 1250912 - DNA, 18 bp, Homo sapiens
aggcagatggagatcaga

SEQ ID NO: 1250913 - DNA, 16 bp, Homo sapiens
aggcagattcaatttt

SEQ ID NO: 1250914 - DNA, 16 bp, Homo sapiens
aggcagatttgaggtt

SEQ ID NO: 1250915 - DNA, 20 bp, Homo sapiens
aggcagcaaggtggccacag

SEQ ID NO: 1250916 - DNA, 16 bp, Homo sapiens
aggcagcaccacactg

SEQ ID NO: 1250917 - DNA, 19 bp, Homo sapiens
aggcagcaccacactgggt

SEQ ID NO: 1250918 - DNA, 13 bp, Homo sapiens
aggcagcagagag

SEQ ID NO: 1250919 - DNA, 14 bp, Homo sapiens
aggcagcaggggct

SEQ ID NO: 1250920 - DNA, 19 bp, Homo sapiens
aggcagcatgcttgggctg

SEQ ID NO: 1250921 - DNA, 16 bp, Homo sapiens
aggcagccagacccag

SEQ ID NO: 1250922 - DNA, 17 bp, Homo sapiens
aggcagccagacccaga

SEQ ID NO: 1250923 - DNA, 15 bp, Homo sapiens
aggcagccagtgaga

SEQ ID NO: 1250924 - DNA, 15 bp, Homo sapiens
aggcagccccctcca

SEQ ID NO: 1250925 - DNA, 16 bp, Homo sapiens
aggcagccccctccac

SEQ ID NO: 1250926 - DNA, 18 bp, Homo sapiens
aggcagccctcacctctg

SEQ ID NO: 1250927 - DNA, 20 bp, Homo sapiens
aggcagccctgtctgaagga

SEQ ID NO: 1250928 - DNA, 20 bp, Homo sapiens
aggcagcctcaaggccctcg

SEQ ID NO: 1250929 - DNA, 21 bp, Homo sapiens
aggcagcctccagagccagcc

SEQ ID NO: 1250930 - DNA, 23 bp, Homo sapiens
aggcagcctccagagccagcctg

SEQ ID NO: 1250931 - DNA, 19 bp, Homo sapiens
aggcagcctcctttgtgtg

SEQ ID NO: 1250932 - DNA, 16 bp, Homo sapiens
aggcagcctgaacact

SEQ ID NO: 1250933 - DNA, 12 bp, Homo sapiens
aggcagcctgcc

SEQ ID NO: 1250934 - DNA, 14 bp, Homo sapiens
aggcagcctgccgc

SEQ ID NO: 1250935 - DNA, 12 bp, Homo sapiens
aggcagccttga

SEQ ID NO: 1250936 - DNA, 15 bp, Homo sapiens
aggcagctcacccct

SEQ ID NO: 1250937 - DNA, 20 bp, Homo sapiens
aggcagctcacccctgggca

SEQ ID NO: 1250938 - DNA, 21 bp, Homo sapiens
aggcagctcacccctgggcag

SEQ ID NO: 1250939 - DNA, 22 bp, Homo sapiens
aggcagctcacccctgggcagg

SEQ ID NO: 1250940 - DNA, 13 bp, Homo sapiens
aggcagctccctc

SEQ ID NO: 1250941 - DNA, 17 bp, Homo sapiens
aggcagctcttctggag

SEQ ID NO: 1250942 - DNA, 15 bp, Homo sapiens
aggcagctgagacca

SEQ ID NO: 1250943 - DNA, 17 bp, Homo sapiens
aggcagctgagaccagg

SEQ ID NO: 1250944 - DNA, 19 bp, Homo sapiens
aggcagctgagaccagggt

SEQ ID NO: 1250945 - DNA, 15 bp, Homo sapiens
aggcagctgcctctg

SEQ ID NO: 1250946 - DNA, 16 bp, Homo sapiens
aggcagctgcctctgc

SEQ ID NO: 1250947 - DNA, 20 bp, Homo sapiens
aggcagctgcctctgctccc

SEQ ID NO: 1250948 - DNA, 13 bp, Homo sapiens
aggcagctgctct

SEQ ID NO: 1250949 - DNA, 23 bp, Homo sapiens
aggcagctgctcttagtgcccgc

SEQ ID NO: 1250950 - DNA, 15 bp, Homo sapiens
aggcaggaacataca

SEQ ID NO: 1250951 - DNA, 12 bp, Homo sapiens
aggcaggaaggg

SEQ ID NO: 1250952 - DNA, 17 bp, Homo sapiens
aggcaggaagggaagcg

SEQ ID NO: 1250953 - DNA, 17 bp, Homo sapiens
aggcaggaagggcagga

SEQ ID NO: 1250954 - DNA, 21 bp, Homo sapiens
aggcaggaccttcgggctgtg

SEQ ID NO: 1250955 - DNA, 22 bp, Homo sapiens
aggcaggaccttcgggctgtgc

SEQ ID NO: 1250956 - DNA, 18 bp, Homo sapiens
aggcaggagaatggtgtg

SEQ ID NO: 1250957 - DNA, 15 bp, Homo sapiens
aggcaggagactggc

SEQ ID NO: 1250958 - DNA, 11 bp, Homo sapiens
aggcaggagca

SEQ ID NO: 1250959 - DNA, 13 bp, Homo sapiens
aggcaggagtggc

SEQ ID NO: 1250960 - DNA, 15 bp, Homo sapiens
aggcaggagtggcag

SEQ ID NO: 1250961 - DNA, 12 bp, Homo sapiens
aggcaggatggc

SEQ ID NO: 1250962 - DNA, 16 bp, Homo sapiens
aggcaggattgaaaat

SEQ ID NO: 1250963 - DNA, 21 bp, Homo sapiens
aggcaggccaaggccttctcc

SEQ ID NO: 1250964 - DNA, 22 bp, Homo sapiens
aggcaggccaaggccttctcct

SEQ ID NO: 1250965 - DNA, 17 bp, Homo sapiens
aggcaggccaggctgcc

SEQ ID NO: 1250966 - DNA, 20 bp, Homo sapiens
aggcaggccaggctgcctcg

SEQ ID NO: 1250967 - DNA, 19 bp, Homo sapiens
aggcaggcctatttcatca

SEQ ID NO: 1250968 - DNA, 17 bp, Homo sapiens
aggcaggcggctcctcc

SEQ ID NO: 1250969 - DNA, 20 bp, Homo sapiens
aggcaggcggctcctcctca

SEQ ID NO: 1250970 - DNA, 13 bp, Homo sapiens
aggcaggcgggcc

SEQ ID NO: 1250971 - DNA, 12 bp, Homo sapiens
aggcaggctggg

SEQ ID NO: 1250972 - DNA, 13 bp, Homo sapiens
aggcaggctggga

SEQ ID NO: 1250973 - DNA, 13 bp, Homo sapiens
aggcagggagaag

SEQ ID NO: 1250974 - DNA, 13 bp, Homo sapiens
aggcagggagggg

SEQ ID NO: 1250975 - DNA, 13 bp, Homo sapiens
aggcagggcagag

SEQ ID NO: 1250976 - DNA, 11 bp, Homo sapiens
aggcagggcca

SEQ ID NO: 1250977 - DNA, 14 bp, Homo sapiens
aggcagggccactt

SEQ ID NO: 1250978 - DNA, 13 bp, Homo sapiens
aggcaggggccca

SEQ ID NO: 1250979 - DNA, 22 bp, Homo sapiens
aggcaggggcccacttggggcc

SEQ ID NO: 1250980 - DNA, 13 bp, Homo sapiens
aggcaggggcgga

SEQ ID NO: 1250981 - DNA, 16 bp, Homo sapiens
aggcaggggtgggaga

SEQ ID NO: 1250982 - DNA, 23 bp, Homo sapiens
aggcaggggtgggggtggaggct

SEQ ID NO: 1250983 - DNA, 14 bp, Homo sapiens
aggcagggtcagga

SEQ ID NO: 1250984 - DNA, 21 bp, Homo sapiens
aggcagggtcccatttctcac

SEQ ID NO: 1250985 - DNA, 22 bp, Homo sapiens
aggcaggtctgcaagggcccag

SEQ ID NO: 1250986 - DNA, 18 bp, Homo sapiens
aggcaggtgcctccaggt

SEQ ID NO: 1250987 - DNA, 20 bp, Homo sapiens
aggcaggtgcctccaggtgt

SEQ ID NO: 1250988 - DNA, 21 bp, Homo sapiens
aggcaggtgcctccaggtgtg

SEQ ID NO: 1250989 - DNA, 15 bp, Homo sapiens
aggcaggtgcctgga

SEQ ID NO: 1250990 - DNA, 17 bp, Homo sapiens
aggcaggttagaagaac

SEQ ID NO: 1250991 - DNA, 22 bp, Homo sapiens
aggcaggtttgccagtgaagac

SEQ ID NO: 1250992 - DNA, 21 bp, Homo sapiens
aggcagtattttgtgtcctcc

SEQ ID NO: 1250993 - DNA, 14 bp, Homo sapiens
aggcagtccagagc

SEQ ID NO: 1250994 - DNA, 22 bp, Homo sapiens
aggcagtccaggcctctctctg

SEQ ID NO: 1250995 - DNA, 20 bp, Homo sapiens
aggcagtcccgggagaaaag

SEQ ID NO: 1250996 - DNA, 21 bp, Homo sapiens
aggcagtcgggggctggccta

SEQ ID NO: 1250997 - DNA, 22 bp, Homo sapiens
aggcagtcgggggctggcctag

SEQ ID NO: 1250998 - DNA, 11 bp, Homo sapiens
aggcagtctga

SEQ ID NO: 1250999 - DNA, 15 bp, Homo sapiens
aggcagtctgaaccc

SEQ ID NO: 1251000 - DNA, 18 bp, Homo sapiens
aggcagtgatgacttgct

SEQ ID NO: 1251001 - DNA, 20 bp, Homo sapiens
aggcagtgatgacttgctgt

SEQ ID NO: 1251002 - DNA, 12 bp, Homo sapiens
aggcagtgcatg

SEQ ID NO: 1251003 - DNA, 14 bp, Homo sapiens
aggcagtgcatgtg

SEQ ID NO: 1251004 - DNA, 15 bp, Homo sapiens
aggcagtgcatgtga

SEQ ID NO: 1251005 - DNA, 12 bp, Homo sapiens
aggcagtggcta

SEQ ID NO: 1251006 - DNA, 12 bp, Homo sapiens
aggcagttttct

SEQ ID NO: 1251007 - DNA, 14 bp, Homo sapiens
aggcagttttctaa

SEQ ID NO: 1251008 - DNA, 20 bp, Homo sapiens
aggcatacactgtagttttt

SEQ ID NO: 1251009 - DNA, 21 bp, Homo sapiens
aggcatacgagagcagaggtc

SEQ ID NO: 1251010 - DNA, 15 bp, Homo sapiens
aggcatagaggcttc

SEQ ID NO: 1251011 - DNA, 22 bp, Homo sapiens
aggcatagaggcttctccgcca

SEQ ID NO: 1251012 - DNA, 13 bp, Homo sapiens
aggcataggcctg

SEQ ID NO: 1251013 - DNA, 14 bp, Homo sapiens
aggcataggcctgg

SEQ ID NO: 1251014 - DNA, 19 bp, Homo sapiens
aggcataggcctgggtgct

SEQ ID NO: 1251015 - DNA, 20 bp, Homo sapiens
aggcataggcctgggtgctg

SEQ ID NO: 1251016 - DNA, 18 bp, Homo sapiens
aggcataggtctctttgc

SEQ ID NO: 1251017 - DNA, 20 bp, Homo sapiens
aggcatatcttctatatctg

SEQ ID NO: 1251018 - DNA, 23 bp, Homo sapiens
aggcatatgtttccccatctctg

SEQ ID NO: 1251019 - DNA, 16 bp, Homo sapiens
aggccttctgtggggc

SEQ ID NO: 1251020 - DNA, 18 bp, Homo sapiens
aggccttctgtggggctg

SEQ ID NO: 1251021 - DNA, 19 bp, Homo sapiens
aggccttctgtggggctgg

SEQ ID NO: 1251022 - DNA, 24 bp, Homo sapiens
aggccttgctcactcactcactcc

SEQ ID NO: 1251023 - DNA, 19 bp, Homo sapiens
aggccttgctgactctctg

SEQ ID NO: 1251024 - DNA, 23 bp, Homo sapiens
aggccttgctgactctctgagct

SEQ ID NO: 1251025 - DNA, 15 bp, Homo sapiens
aggccttgctggggt

SEQ ID NO: 1251026 - DNA, 22 bp, Homo sapiens
aggccttgctggggtccagggc

SEQ ID NO: 1251027 - DNA, 23 bp, Homo sapiens
aggccttgctggggtccagggct

SEQ ID NO: 1251028 - DNA, 20 bp, Homo sapiens
aggccttggggtgggggcca

SEQ ID NO: 1251029 - DNA, 21 bp, Homo sapiens
aggccttggggtgggggccag

SEQ ID NO: 1251030 - DNA, 18 bp, Homo sapiens
aggccttggtggagcagc

SEQ ID NO: 1251031 - DNA, 19 bp, Homo sapiens
aggccttggtggagcagcc

SEQ ID NO: 1251032 - DNA, 11 bp, Homo sapiens
aggcctttctt

SEQ ID NO: 1251033 - DNA, 20 bp, Homo sapiens
aggcctttcttctgtgttaa

SEQ ID NO: 1251034 - DNA, 16 bp, Homo sapiens
aggcctttggagggga

SEQ ID NO: 1251035 - DNA, 15 bp, Homo sapiens
aggcgaggagagtgg

SEQ ID NO: 1251036 - DNA, 15 bp, Homo sapiens
aggcgagtcaccctc

SEQ ID NO: 1251037 - DNA, 18 bp, Homo sapiens
aggcgagtcaccctcctc

SEQ ID NO: 1251038 - DNA, 22 bp, Homo sapiens
aggcgagtcaccctcctcacag

SEQ ID NO: 1251039 - DNA, 23 bp, Homo sapiens
aggcgagtctggggacctggcac

SEQ ID NO: 1251040 - DNA, 15 bp, Homo sapiens
aggcgagtgccagga

SEQ ID NO: 1251041 - DNA, 24 bp, Homo sapiens
aggcgagtgccaggactccccagg

SEQ ID NO: 1251042 - DNA, 23 bp, Homo sapiens
aggcgatccacctgtctcagcct

SEQ ID NO: 1251043 - DNA, 21 bp, Homo sapiens
aggcgcactgtgacccccagc

SEQ ID NO: 1251044 - DNA, 21 bp, Homo sapiens
aggcgcagaggtcccagcccc

SEQ ID NO: 1251045 - DNA, 22 bp, Homo sapiens
aggcgcagaggtcccagcccca

SEQ ID NO: 1251046 - DNA, 14 bp, Homo sapiens
aggcgcagggacat

SEQ ID NO: 1251047 - DNA, 20 bp, Homo sapiens
aggcgcagggacatggggca

SEQ ID NO: 1251048 - DNA, 21 bp, Homo sapiens
aggcgcagggacatggggcaa

SEQ ID NO: 1251049 - DNA, 22 bp, Homo sapiens
aggcgcatgagtatctgtggga

SEQ ID NO: 1251050 - DNA, 14 bp, Homo sapiens
aggcgcatgtctgc

SEQ ID NO: 1251051 - DNA, 12 bp, Homo sapiens
aggcgcccccgc

SEQ ID NO: 1251052 - DNA, 13 bp, Homo sapiens
aggcgcccccgcc

SEQ ID NO: 1251053 - DNA, 16 bp, Homo sapiens
aggcgcccccgcccca

SEQ ID NO: 1251054 - DNA, 14 bp, Homo sapiens
aggcgccggcgggc

SEQ ID NO: 1251055 - DNA, 23 bp, Homo sapiens
aggcgcttctccaatgctctgga

SEQ ID NO: 1251056 - DNA, 15 bp, Homo sapiens
aggcggagagtacag

SEQ ID NO: 1251057 - DNA, 17 bp, Homo sapiens
aggcggaggctgtgctc

SEQ ID NO: 1251058 - DNA, 13 bp, Homo sapiens
aggcggccctcag

SEQ ID NO: 1251059 - DNA, 16 bp, Homo sapiens
aggcggccctggggag

SEQ ID NO: 1251060 - DNA, 17 bp, Homo sapiens
aggcggccctggggagg

SEQ ID NO: 1251061 - DNA, 15 bp, Homo sapiens
aggcgggaaggaggg

SEQ ID NO: 1251062 - DNA, 14 bp, Homo sapiens
aggcgggcccatga

SEQ ID NO: 1251063 - DNA, 15 bp, Homo sapiens
aggcgggccccagac

SEQ ID NO: 1251064 - DNA, 14 bp, Homo sapiens
aggcgggctcaagg

SEQ ID NO: 1251065 - DNA, 22 bp, Homo sapiens
aggcggggcagtatgtgatgga

SEQ ID NO: 1251066 - DNA, 16 bp, Homo sapiens
aggcggtcatgtgtgc

SEQ ID NO: 1251067 - DNA, 21 bp, Homo sapiens
aggcgtcttcatctccctgcc

SEQ ID NO: 1251068 - DNA, 13 bp, Homo sapiens
aggcgtgcccccc

SEQ ID NO: 1251069 - DNA, 22 bp, Homo sapiens
aggcgtgcccccctcctccagt

SEQ ID NO: 1251070 - DNA, 17 bp, Homo sapiens
aggcgtggaggagagga

SEQ ID NO: 1251071 - DNA, 13 bp, Homo sapiens
aggcgtgtggcag

SEQ ID NO: 1251072 - DNA, 16 bp, Homo sapiens
aggcgttctcctgctt

SEQ ID NO: 1251073 - DNA, 21 bp, Homo sapiens
aggctaaacatccaatatttt

SEQ ID NO: 1251074 - DNA, 12 bp, Homo sapiens
aggctaaatgtt

SEQ ID NO: 1251075 - DNA, 17 bp, Homo sapiens
aggctaacatcccactt

SEQ ID NO: 1251076 - DNA, 17 bp, Homo sapiens
aggctaagttgggatct

SEQ ID NO: 1251077 - DNA, 12 bp, Homo sapiens
aggctaattttt

SEQ ID NO: 1251078 - DNA, 23 bp, Homo sapiens
aggctaatttttttgtattttag

SEQ ID NO: 1251079 - DNA, 19 bp, Homo sapiens
aggctacaattttctccca

SEQ ID NO: 1251080 - DNA, 23 bp, Homo sapiens
aggctagaagtgtgaagtgcaga

SEQ ID NO: 1251081 - DNA, 21 bp, Homo sapiens
aggctagagtgcaatggtgca

SEQ ID NO: 1251082 - DNA, 21 bp, Homo sapiens
aggctaggtgggttgaaagcc

SEQ ID NO: 1251083 - DNA, 22 bp, Homo sapiens
aggctatggacagggcatgcca

SEQ ID NO: 1251084 - DNA, 18 bp, Homo sapiens
aggctatggttgccaccc

SEQ ID NO: 1251085 - DNA, 19 bp, Homo sapiens
aggctatggttgccacccc

SEQ ID NO: 1251086 - DNA, 17 bp, Homo sapiens
aggctattaaaagaatc

SEQ ID NO: 1251087 - DNA, 18 bp, Homo sapiens
aggctattatttattgta

SEQ ID NO: 1251088 - DNA, 16 bp, Homo sapiens
aggctattattttcac

SEQ ID NO: 1251089 - DNA, 18 bp, Homo sapiens
aggctattattttcactg

SEQ ID NO: 1251090 - DNA, 11 bp, Homo sapiens
aggctatttgt

SEQ ID NO: 1251091 - DNA, 14 bp, Homo sapiens
aggctatttgttca

SEQ ID NO: 1251092 - DNA, 18 bp, Homo sapiens
aggctatttgttcagaga

SEQ ID NO: 1251093 - DNA, 19 bp, Homo sapiens
aggctcacccccttctcca

SEQ ID NO: 1251094 - DNA, 21 bp, Homo sapiens
aggctcacctttagaacagga

SEQ ID NO: 1251095 - DNA, 15 bp, Homo sapiens
aggctcactgcagcg

SEQ ID NO: 1251096 - DNA, 16 bp, Homo sapiens
aggctcactgccaggc

SEQ ID NO: 1251097 - DNA, 19 bp, Homo sapiens
aggctcactgccaggccag

SEQ ID NO: 1251098 - DNA, 20 bp, Homo sapiens
aggctcactgccaggccagc

SEQ ID NO: 1251099 - DNA, 13 bp, Homo sapiens
aggctcagcccac

SEQ ID NO: 1251100 - DNA, 18 bp, Homo sapiens
aggctcagcccaccctcc

SEQ ID NO: 1251101 - DNA, 10 bp, Homo sapiens
aggctcaggt

SEQ ID NO: 1251102 - DNA, 16 bp, Homo sapiens
aggctcagtctcagga

SEQ ID NO: 1251103 - DNA, 19 bp, Homo sapiens
aggctcagtctcaggagca

SEQ ID NO: 1251104 - DNA, 19 bp, Homo sapiens
aggctcagtggtagctctg

SEQ ID NO: 1251105 - DNA, 22 bp, Homo sapiens
aggctcagtggtagctctggct

SEQ ID NO: 1251106 - DNA, 13 bp, Homo sapiens
aggctccccaccc

SEQ ID NO: 1251107 - DNA, 13 bp, Homo sapiens
aggctccccgcct

SEQ ID NO: 1251108 - DNA, 19 bp, Homo sapiens
aggctccccgcctccactc

SEQ ID NO: 1251109 - DNA, 20 bp, Homo sapiens
aggctcctggctgtgcccag

SEQ ID NO: 1251110 - DNA, 21 bp, Homo sapiens
aggctcctggctgtgcccagc

SEQ ID NO: 1251111 - DNA, 23 bp, Homo sapiens
aggctcctggctgtgcccagcag

SEQ ID NO: 1251112 - DNA, 16 bp, Homo sapiens
aggctcctgttttgca

SEQ ID NO: 1251113 - DNA, 23 bp, Homo sapiens
aggctcgattttgtatctgcagg

SEQ ID NO: 1251114 - DNA, 20 bp, Homo sapiens
aggctctcaacaggggagag

SEQ ID NO: 1251115 - DNA, 16 bp, Homo sapiens
aggctctcccctctcg

SEQ ID NO: 1251116 - DNA, 13 bp, Homo sapiens
aggctctccgggc

SEQ ID NO: 1251117 - DNA, 12 bp, Homo sapiens
aggctctctcct

SEQ ID NO: 1251118 - DNA, 13 bp, Homo sapiens
aggctctgaaata

SEQ ID NO: 1251119 - DNA, 14 bp, Homo sapiens
aggctctgagacac

SEQ ID NO: 1251120 - DNA, 13 bp, Homo sapiens
aggctctgcacag

SEQ ID NO: 1251121 - DNA, 12 bp, Homo sapiens
aggctctggaca

SEQ ID NO: 1251122 - DNA, 22 bp, Homo sapiens
aggctctggacagcagaagcct

SEQ ID NO: 1251123 - DNA, 23 bp, Homo sapiens
aggctctggacagcagaagcctc

SEQ ID NO: 1251124 - DNA, 17 bp, Homo sapiens
aggctctggagccagag

SEQ ID NO: 1251125 - DNA, 12 bp, Homo sapiens
aggctctgggca

SEQ ID NO: 1251126 - DNA, 14 bp, Homo sapiens
aggctctgggcaca

SEQ ID NO: 1251127 - DNA, 17 bp, Homo sapiens
aggctctgggcacagtg

SEQ ID NO: 1251128 - DNA, 18 bp, Homo sapiens
aggctctgggcacagtgc

SEQ ID NO: 1251129 - DNA, 14 bp, Homo sapiens
aggctctgggctca

SEQ ID NO: 1251130 - DNA, 16 bp, Homo sapiens
aggctctgggctcagg

SEQ ID NO: 1251131 - DNA, 19 bp, Homo sapiens
aggctctgggctcagggct

SEQ ID NO: 1251132 - DNA, 20 bp, Homo sapiens
aggctctgggctcagggctg

SEQ ID NO: 1251133 - DNA, 23 bp, Homo sapiens
aggctctgggctcagggctggag

SEQ ID NO: 1251134 - DNA, 13 bp, Homo sapiens
aggctctgtcact

SEQ ID NO: 1251135 - DNA, 14 bp, Homo sapiens
aggctctgtcactg

SEQ ID NO: 1251136 - DNA, 18 bp, Homo sapiens
aggctctgtcactgagca

SEQ ID NO: 1251137 - DNA, 21 bp, Homo sapiens
aggctctgttatcagctgggc

SEQ ID NO: 1251138 - DNA, 18 bp, Homo sapiens
aggctcttaagcagcatg

SEQ ID NO: 1251139 - DNA, 22 bp, Homo sapiens
aggctcttaagcagcatggaaa

SEQ ID NO: 1251140 - DNA, 23 bp, Homo sapiens
agggaccagtgggatgggctcta

SEQ ID NO: 1251141 - DNA, 14 bp, Homo sapiens
agggaccatctgct

SEQ ID NO: 1251142 - DNA, 17 bp, Homo sapiens
agggaccatctgctgca

SEQ ID NO: 1251143 - DNA, 21 bp, Homo sapiens
agggaccatctgctgcagtta

SEQ ID NO: 1251144 - DNA, 23 bp, Homo sapiens
agggaccatctgctgcagttacc

SEQ ID NO: 1251145 - DNA, 19 bp, Homo sapiens
agggacccaaagcaggatg

SEQ ID NO: 1251146 - DNA, 20 bp, Homo sapiens
agggacccggggtctcctgg

SEQ ID NO: 1251147 - DNA, 21 bp, Homo sapiens
agggacccggggtctcctgga

SEQ ID NO: 1251148 - DNA, 18 bp, Homo sapiens
agggacccttgcctgcct

SEQ ID NO: 1251149 - DNA, 19 bp, Homo sapiens
agggacccttgcctgcctc

SEQ ID NO: 1251150 - DNA, 22 bp, Homo sapiens
agggacccttgcctgcctccta

SEQ ID NO: 1251151 - DNA, 17 bp, Homo sapiens
agggaccctttgggggt

SEQ ID NO: 1251152 - DNA, 20 bp, Homo sapiens
agggaccggtgctgcaggag

SEQ ID NO: 1251153 - DNA, 16 bp, Homo sapiens
agggacctcaggggca

SEQ ID NO: 1251154 - DNA, 19 bp, Homo sapiens
agggacctcaggggcacct

SEQ ID NO: 1251155 - DNA, 20 bp, Homo sapiens
agggacctcaggggcacctc

SEQ ID NO: 1251156 - DNA, 13 bp, Homo sapiens
agggacctgctca

SEQ ID NO: 1251157 - DNA, 15 bp, Homo sapiens
agggaccttgaaggg

SEQ ID NO: 1251158 - DNA, 13 bp, Homo sapiens
agggacgcctggg

SEQ ID NO: 1251159 - DNA, 15 bp, Homo sapiens
agggacgcggaggag

SEQ ID NO: 1251160 - DNA, 21 bp, Homo sapiens
agggacgctttgggagaatgt

SEQ ID NO: 1251161 - DNA, 17 bp, Homo sapiens
agggactaggagcactg

SEQ ID NO: 1251162 - DNA, 22 bp, Homo sapiens
agggactcgggtggcctgcgct

SEQ ID NO: 1251163 - DNA, 20 bp, Homo sapiens
agggactgagagatgcagaa

SEQ ID NO: 1251164 - DNA, 20 bp, Homo sapiens
agggactgtaaacacagaca

SEQ ID NO: 1251165 - DNA, 14 bp, Homo sapiens
agggacttgaagtt

SEQ ID NO: 1251166 - DNA, 17 bp, Homo sapiens
agggacttggctgtcct

SEQ ID NO: 1251167 - DNA, 18 bp, Homo sapiens
agggacttggctgtcctt

SEQ ID NO: 1251168 - DNA, 17 bp, Homo sapiens
agggagaaaatccaggt

SEQ ID NO: 1251169 - DNA, 13 bp, Homo sapiens
agggagaaatgtt

SEQ ID NO: 1251170 - DNA, 16 bp, Homo sapiens
agggagaagaaaggtg

SEQ ID NO: 1251171 - DNA, 16 bp, Homo sapiens
agggagaaggatctag

SEQ ID NO: 1251172 - DNA, 21 bp, Homo sapiens
agggagaagtagctagtagca

SEQ ID NO: 1251173 - DNA, 19 bp, Homo sapiens
agggagaataaaattccta

SEQ ID NO: 1251174 - DNA, 21 bp, Homo sapiens
agggagacggccctgctgggg

SEQ ID NO: 1251175 - DNA, 21 bp, Homo sapiens
agggagactgggtaggaaaga

SEQ ID NO: 1251176 - DNA, 23 bp, Homo sapiens
agggagagacctcatcaggatga

SEQ ID NO: 1251177 - DNA, 22 bp, Homo sapiens
agggagagagagagagagagga

SEQ ID NO: 1251178 - DNA, 17 bp, Homo sapiens
agggagagcgcctcttc

SEQ ID NO: 1251179 - DNA, 15 bp, Homo sapiens
agggagagctgagcc

SEQ ID NO: 1251180 - DNA, 16 bp, Homo sapiens
agggagagctgagcca

SEQ ID NO: 1251181 - DNA, 20 bp, Homo sapiens
agggagaggtggcaggaata

SEQ ID NO: 1251182 - DNA, 21 bp, Homo sapiens
agggagagttggggaaggcaa

SEQ ID NO: 1251183 - DNA, 14 bp, Homo sapiens
agggagatgtgtga

SEQ ID NO: 1251184 - DNA, 17 bp, Homo sapiens
agggagcaccctgccca

SEQ ID NO: 1251185 - DNA, 17 bp, Homo sapiens
agggagcacctgtctgg

SEQ ID NO: 1251186 - DNA, 15 bp, Homo sapiens
agggagcactgttca

SEQ ID NO: 1251187 - DNA, 14 bp, Homo sapiens
agggagcagacagg

SEQ ID NO: 1251188 - DNA, 19 bp, Homo sapiens
agggagcaggcggtgggca

SEQ ID NO: 1251189 - DNA, 16 bp, Homo sapiens
agggagcagggaaggc

SEQ ID NO: 1251190 - DNA, 18 bp, Homo sapiens
agggagccatggaaggtg

SEQ ID NO: 1251191 - DNA, 15 bp, Homo sapiens
agggagccatttgag

SEQ ID NO: 1251192 - DNA, 18 bp, Homo sapiens
agggagcctttggttctg

SEQ ID NO: 1251193 - DNA, 23 bp, Homo sapiens
agggagctctggggacagcttcc

SEQ ID NO: 1251194 - DNA, 21 bp, Homo sapiens
agggagctgatgccccttctc

SEQ ID NO: 1251195 - DNA, 15 bp, Homo sapiens
agggagctgctggct

SEQ ID NO: 1251196 - DNA, 16 bp, Homo sapiens
agggagctgctggctg

SEQ ID NO: 1251197 - DNA, 21 bp, Homo sapiens
agggagcttcctggctctggg

SEQ ID NO: 1251198 - DNA, 17 bp, Homo sapiens
agggagcttgccacact

SEQ ID NO: 1251199 - DNA, 14 bp, Homo sapiens
agggaggaagatat

SEQ ID NO: 1251200 - DNA, 14 bp, Homo sapiens
agggaggaaggcct

SEQ ID NO: 1251201 - DNA, 23 bp, Homo sapiens
agggaggaatcgaggaaccagag

SEQ ID NO: 1251202 - DNA, 13 bp, Homo sapiens
agggaggacctgg

SEQ ID NO: 1251203 - DNA, 17 bp, Homo sapiens
agggaggacctggggca

SEQ ID NO: 1251204 - DNA, 20 bp, Homo sapiens
agggaggacctggggcacag

SEQ ID NO: 1251205 - DNA, 16 bp, Homo sapiens
agggaggaggccacct

SEQ ID NO: 1251206 - DNA, 15 bp, Homo sapiens
agggaggagtggagg

SEQ ID NO: 1251207 - DNA, 15 bp, Homo sapiens
agggaggcaagccct

SEQ ID NO: 1251208 - DNA, 12 bp, Homo sapiens
agggaggcagcg

SEQ ID NO: 1251209 - DNA, 17 bp, Homo sapiens
agggaggccaggcgggc

SEQ ID NO: 1251210 - DNA, 17 bp, Homo sapiens
agggaggcgcagggaca

SEQ ID NO: 1251211 - DNA, 16 bp, Homo sapiens
agggaggcggggagga

SEQ ID NO: 1251212 - DNA, 18 bp, Homo sapiens
agggaggcggggaggagg

SEQ ID NO: 1251213 - DNA, 20 bp, Homo sapiens
agggaggcgtcttcatctcc

SEQ ID NO: 1251214 - DNA, 15 bp, Homo sapiens
agggaggctgggcgg

SEQ ID NO: 1251215 - DNA, 14 bp, Homo sapiens
agggagggaagggc

SEQ ID NO: 1251216 - DNA, 17 bp, Homo sapiens
agggagggaaggggatg

SEQ ID NO: 1251217 - DNA, 12 bp, Homo sapiens
agggagggagtt

SEQ ID NO: 1251218 - DNA, 14 bp, Homo sapiens
agggagggccaggg

SEQ ID NO: 1251219 - DNA, 22 bp, Homo sapiens
agggagggccggcggctctgag

SEQ ID NO: 1251220 - DNA, 23 bp, Homo sapiens
agggaggggaaatgtaatactgg

SEQ ID NO: 1251221 - DNA, 17 bp, Homo sapiens
agggaggggaaggggcc

SEQ ID NO: 1251222 - DNA, 16 bp, Homo sapiens
agggaggggacagagg

SEQ ID NO: 1251223 - DNA, 19 bp, Homo sapiens
agggaggggacagaggccc

SEQ ID NO: 1251224 - DNA, 20 bp, Homo sapiens
agggaggggacagaggccct

SEQ ID NO: 1251225 - DNA, 13 bp, Homo sapiens
agggaggggaggc

SEQ ID NO: 1251226 - DNA, 15 bp, Homo sapiens
agggaggggcctagg

SEQ ID NO: 1251227 - DNA, 19 bp, Homo sapiens
agggaggggcctaggcctc

SEQ ID NO: 1251228 - DNA, 14 bp, Homo sapiens
agggaggggctggg

SEQ ID NO: 1251229 - DNA, 22 bp, Homo sapiens
agggaggggctggggcaggctc

SEQ ID NO: 1251230 - DNA, 13 bp, Homo sapiens
agggaggggctgt

SEQ ID NO: 1251231 - DNA, 23 bp, Homo sapiens
agggagggggcgctcaggaccca

SEQ ID NO: 1251232 - DNA, 19 bp, Homo sapiens
agggagggttagcctgcac

SEQ ID NO: 1251233 - DNA, 23 bp, Homo sapiens
agggaggtgggggcctcctcagc

SEQ ID NO: 1251234 - DNA, 13 bp, Homo sapiens
agggaggtttgtg

SEQ ID NO: 1251235 - DNA, 17 bp, Homo sapiens
agggaggtttgtgagag

SEQ ID NO: 1251236 - DNA, 17 bp, Homo sapiens
agggagtacctgctgcc

SEQ ID NO: 1251237 - DNA, 18 bp, Homo sapiens
agggagtcccagagccct

SEQ ID NO: 1251238 - DNA, 14 bp, Homo sapiens
agggagtcccctcc

SEQ ID NO: 1251239 - DNA, 15 bp, Homo sapiens
agggagtcccctccc

SEQ ID NO: 1251240 - DNA, 15 bp, Homo sapiens
agggagtgaagccac

SEQ ID NO: 1251241 - DNA, 17 bp, Homo sapiens
agggagtgaagccacag

SEQ ID NO: 1251242 - DNA, 14 bp, Homo sapiens
agggagtgagcagc

SEQ ID NO: 1251243 - DNA, 16 bp, Homo sapiens
agggagtgaggggctg

SEQ ID NO: 1251244 - DNA, 14 bp, Homo sapiens
agggagtgcagaac

SEQ ID NO: 1251245 - DNA, 18 bp, Homo sapiens
agggagtgttcaaaatac

SEQ ID NO: 1251246 - DNA, 21 bp, Homo sapiens
agggagttatctaaaagaaat

SEQ ID NO: 1251247 - DNA, 20 bp, Homo sapiens
agggagttcatctggagggt

SEQ ID NO: 1251248 - DNA, 13 bp, Homo sapiens
agggagtttttga

SEQ ID NO: 1251249 - DNA, 20 bp, Homo sapiens
agggataaccccaggcactg

SEQ ID NO: 1251250 - DNA, 21 bp, Homo sapiens
agggataaccccaggcactgt

SEQ ID NO: 1251251 - DNA, 20 bp, Homo sapiens
agggataatagacacatcaa

SEQ ID NO: 1251252 - DNA, 16 bp, Homo sapiens
agggatataaaaacag

SEQ ID NO: 1251253 - DNA, 22 bp, Homo sapiens
agggatataaaaacagattctg

SEQ ID NO: 1251254 - DNA, 21 bp, Homo sapiens
agggatcaaccagctaagaaa

SEQ ID NO: 1251255 - DNA, 22 bp, Homo sapiens
agggatcacagggccccagaag

SEQ ID NO: 1251256 - DNA, 22 bp, Homo sapiens
agggatcagccccgcctgtcac

SEQ ID NO: 1251257 - DNA, 23 bp, Homo sapiens
agggatcagccccgcctgtcaca

SEQ ID NO: 1251258 - DNA, 15 bp, Homo sapiens
agggatccctcatct

SEQ ID NO: 1251259 - DNA, 22 bp, Homo sapiens
agggatccctcatctgtccctc

SEQ ID NO: 1251260 - DNA, 20 bp, Homo sapiens
agggatctgagtaggtctgg

SEQ ID NO: 1251261 - DNA, 15 bp, Homo sapiens
agggcggccagggac

SEQ ID NO: 1251262 - DNA, 20 bp, Homo sapiens
agggcgggcagagggctgga

SEQ ID NO: 1251263 - DNA, 12 bp, Homo sapiens
agggcgtcaggc

SEQ ID NO: 1251264 - DNA, 19 bp, Homo sapiens
agggcgtcaggcagaggca

SEQ ID NO: 1251265 - DNA, 22 bp, Homo sapiens
agggcgttctaggtaggaagag

SEQ ID NO: 1251266 - DNA, 20 bp, Homo sapiens
agggctaattctgggaaggg

SEQ ID NO: 1251267 - DNA, 19 bp, Homo sapiens
agggctaccctcccccagg

SEQ ID NO: 1251268 - DNA, 22 bp, Homo sapiens
agggctaccctgagctgaggca

SEQ ID NO: 1251269 - DNA, 23 bp, Homo sapiens
agggctaccctgagctgaggcag

SEQ ID NO: 1251270 - DNA, 14 bp, Homo sapiens
agggctagccctga

SEQ ID NO: 1251271 - DNA, 20 bp, Homo sapiens
agggctagggaggtggggta

SEQ ID NO: 1251272 - DNA, 23 bp, Homo sapiens
agggctagtcttcccttacctca

SEQ ID NO: 1251273 - DNA, 24 bp, Homo sapiens
agggctagtgacttgtgtcccatg

SEQ ID NO: 1251274 - DNA, 17 bp, Homo sapiens
agggctcacactcctgg

SEQ ID NO: 1251275 - DNA, 18 bp, Homo sapiens
agggctcacactcctggg

SEQ ID NO: 1251276 - DNA, 20 bp, Homo sapiens
agggctcacactcctgggct

SEQ ID NO: 1251277 - DNA, 17 bp, Homo sapiens
agggctcacagggcagg

SEQ ID NO: 1251278 - DNA, 18 bp, Homo sapiens
agggctcacagggcaggc

SEQ ID NO: 1251279 - DNA, 20 bp, Homo sapiens
agggctcacagggcaggcct

SEQ ID NO: 1251280 - DNA, 21 bp, Homo sapiens
agggctcacagggcaggcctt

SEQ ID NO: 1251281 - DNA, 15 bp, Homo sapiens
agggctcagaagagc

SEQ ID NO: 1251282 - DNA, 16 bp, Homo sapiens
agggctcagaagagca

SEQ ID NO: 1251283 - DNA, 17 bp, Homo sapiens
agggctcagagtgaccc

SEQ ID NO: 1251284 - DNA, 14 bp, Homo sapiens
agggctcagggcag

SEQ ID NO: 1251285 - DNA, 15 bp, Homo sapiens
agggctcagggcagt

SEQ ID NO: 1251286 - DNA, 21 bp, Homo sapiens
agggctccagcatccagcctg

SEQ ID NO: 1251287 - DNA, 15 bp, Homo sapiens
agggctccagcccct

SEQ ID NO: 1251288 - DNA, 22 bp, Homo sapiens
agggctccatgctgaaggctcc

SEQ ID NO: 1251289 - DNA, 14 bp, Homo sapiens
agggctcccagggg

SEQ ID NO: 1251290 - DNA, 14 bp, Homo sapiens
agggctccctcctg

SEQ ID NO: 1251291 - DNA, 18 bp, Homo sapiens
agggctccctcctggagc

SEQ ID NO: 1251292 - DNA, 20 bp, Homo sapiens
agggctccctcctggagcat

SEQ ID NO: 1251293 - DNA, 11 bp, Homo sapiens
agggctcctcc

SEQ ID NO: 1251294 - DNA, 19 bp, Homo sapiens
agggctcctctccagtctg

SEQ ID NO: 1251295 - DNA, 15 bp, Homo sapiens
agggctctgatattc

SEQ ID NO: 1251296 - DNA, 12 bp, Homo sapiens
agggctctgccc

SEQ ID NO: 1251297 - DNA, 14 bp, Homo sapiens
agggctctgcccca

SEQ ID NO: 1251298 - DNA, 16 bp, Homo sapiens
agggctctgccccagt

SEQ ID NO: 1251299 - DNA, 16 bp, Homo sapiens
agggctgagcctggtc

SEQ ID NO: 1251300 - DNA, 15 bp, Homo sapiens
agggctgagcgtgga

SEQ ID NO: 1251301 - DNA, 20 bp, Homo sapiens
agggctgagcgtggaagggg

SEQ ID NO: 1251302 - DNA, 16 bp, Homo sapiens
agggctgagctgagct

SEQ ID NO: 1251303 - DNA, 17 bp, Homo sapiens
agggctgagctgagctt

SEQ ID NO: 1251304 - DNA, 13 bp, Homo sapiens
agggctgaggagc

SEQ ID NO: 1251305 - DNA, 16 bp, Homo sapiens
agggctgaggagcagc

SEQ ID NO: 1251306 - DNA, 18 bp, Homo sapiens
agggctgaggagcagcca

SEQ ID NO: 1251307 - DNA, 16 bp, Homo sapiens
agggctgaggggcctg

SEQ ID NO: 1251308 - DNA, 16 bp, Homo sapiens
agggctgcacattgcc

SEQ ID NO: 1251309 - DNA, 19 bp, Homo sapiens
agggctgcacattgcctgt

SEQ ID NO: 1251310 - DNA, 11 bp, Homo sapiens
agggctgcagt

SEQ ID NO: 1251311 - DNA, 12 bp, Homo sapiens
agggctgcagtt

SEQ ID NO: 1251312 - DNA, 22 bp, Homo sapiens
agggctgcatgatgtttgccca

SEQ ID NO: 1251313 - DNA, 16 bp, Homo sapiens
agggctgccctgagaa

SEQ ID NO: 1251314 - DNA, 12 bp, Homo sapiens
agggctgctccc

SEQ ID NO: 1251315 - DNA, 22 bp, Homo sapiens
agggctgctccccaacacctgc

SEQ ID NO: 1251316 - DNA, 17 bp, Homo sapiens
agggctgctgcttctgc

SEQ ID NO: 1251317 - DNA, 20 bp, Homo sapiens
agggctgctgggggcaactg

SEQ ID NO: 1251318 - DNA, 21 bp, Homo sapiens
agggctggaatgggagacctg

SEQ ID NO: 1251319 - DNA, 12 bp, Homo sapiens
agggctggacct

SEQ ID NO: 1251320 - DNA, 16 bp, Homo sapiens
agggctggagcctggg

SEQ ID NO: 1251321 - DNA, 17 bp, Homo sapiens
agggctggatggacaga

SEQ ID NO: 1251322 - DNA, 21 bp, Homo sapiens
agggctggatggacagacacc

SEQ ID NO: 1251323 - DNA, 12 bp, Homo sapiens
agggctggctcc

SEQ ID NO: 1251324 - DNA, 13 bp, Homo sapiens
agggctggctccc

SEQ ID NO: 1251325 - DNA, 16 bp, Homo sapiens
agggctggctccccct

SEQ ID NO: 1251326 - DNA, 16 bp, Homo sapiens
agggctggctcctgat

SEQ ID NO: 1251327 - DNA, 12 bp, Homo sapiens
agggctggctgg

SEQ ID NO: 1251328 - DNA, 18 bp, Homo sapiens
agggctgggaggaaggac

SEQ ID NO: 1251329 - DNA, 11 bp, Homo sapiens
agggctgggga

SEQ ID NO: 1251330 - DNA, 18 bp, Homo sapiens
agggctggggcggagctg

SEQ ID NO: 1251331 - DNA, 15 bp, Homo sapiens
agggctggggtgagc

SEQ ID NO: 1251332 - DNA, 19 bp, Homo sapiens
agggctggggtgagcctga

SEQ ID NO: 1251333 - DNA, 17 bp, Homo sapiens
agggctggttaatgtag

SEQ ID NO: 1251334 - DNA, 15 bp, Homo sapiens
agggctgtcccagcc

SEQ ID NO: 1251335 - DNA, 18 bp, Homo sapiens
agggctgtcccagccccg

SEQ ID NO: 1251336 - DNA, 12 bp, Homo sapiens
agggctgtcctt

SEQ ID NO: 1251337 - DNA, 20 bp, Homo sapiens
agggctgttgctagggagag

SEQ ID NO: 1251338 - DNA, 23 bp, Homo sapiens
agggcttacctgtacactgactt

SEQ ID NO: 1251339 - DNA, 23 bp, Homo sapiens
agggcttcaaggccctcagagat

SEQ ID NO: 1251340 - DNA, 22 bp, Homo sapiens
agggcttccccatcagctccca

SEQ ID NO: 1251341 - DNA, 23 bp, Homo sapiens
agggcttccccatcagctcccaa

SEQ ID NO: 1251342 - DNA, 20 bp, Homo sapiens
agggcttcctctagaagcca

SEQ ID NO: 1251343 - DNA, 16 bp, Homo sapiens
agggcttctcctcctc

SEQ ID NO: 1251344 - DNA, 23 bp, Homo sapiens
agggcttctgccatttctgagat

SEQ ID NO: 1251345 - DNA, 16 bp, Homo sapiens
agggcttgaggtgaat

SEQ ID NO: 1251346 - DNA, 15 bp, Homo sapiens
agggcttggcccagc

SEQ ID NO: 1251347 - DNA, 17 bp, Homo sapiens
agggcttggcccagcgc

SEQ ID NO: 1251348 - DNA, 18 bp, Homo sapiens
agggcttggcccagcgcc

SEQ ID NO: 1251349 - DNA, 20 bp, Homo sapiens
agggcttggggctgcacctc

SEQ ID NO: 1251350 - DNA, 12 bp, Homo sapiens
agggcttgtttt

SEQ ID NO: 1251351 - DNA, 23 bp, Homo sapiens
agggctttttaaatttggtgccg

SEQ ID NO: 1251352 - DNA, 22 bp, Homo sapiens
aggggaaaatcagcctgctcca

SEQ ID NO: 1251353 - DNA, 13 bp, Homo sapiens
aggggaaaatgaa

SEQ ID NO: 1251354 - DNA, 18 bp, Homo sapiens
aggggaaatggggaaagc

SEQ ID NO: 1251355 - DNA, 23 bp, Homo sapiens
aggggaacaaggagttctcttcc

SEQ ID NO: 1251356 - DNA, 17 bp, Homo sapiens
aggggaaccctgtccct

SEQ ID NO: 1251357 - DNA, 13 bp, Homo sapiens
aggggaacctgcc

SEQ ID NO: 1251358 - DNA, 15 bp, Homo sapiens
aggggaagaggcctg

SEQ ID NO: 1251359 - DNA, 14 bp, Homo sapiens
aggggaagctgggc

SEQ ID NO: 1251360 - DNA, 11 bp, Homo sapiens
aggggaaggaa

SEQ ID NO: 1251361 - DNA, 20 bp, Homo sapiens
aggggaaggaaggagggcac

SEQ ID NO: 1251362 - DNA, 21 bp, Homo sapiens
aggggaaggccctgaggcgga

SEQ ID NO: 1251363 - DNA, 11 bp, Homo sapiens
aggggaagggc

SEQ ID NO: 1251364 - DNA, 23 bp, Homo sapiens
aggggaagggccagtctgggctg

SEQ ID NO: 1251365 - DNA, 20 bp, Homo sapiens
aggggaagggctttgagggt

SEQ ID NO: 1251366 - DNA, 17 bp, Homo sapiens
aggggaataatagaaga

SEQ ID NO: 1251367 - DNA, 18 bp, Homo sapiens
aggggaataatagaagaa

SEQ ID NO: 1251368 - DNA, 22 bp, Homo sapiens
aggggaattccctccccctcct

SEQ ID NO: 1251369 - DNA, 23 bp, Homo sapiens
aggggacacttccctctgtttct

SEQ ID NO: 1251370 - DNA, 12 bp, Homo sapiens
aggggacagagc

SEQ ID NO: 1251371 - DNA, 13 bp, Homo sapiens
aggggacaggcct

SEQ ID NO: 1251372 - DNA, 15 bp, Homo sapiens
aggggacaggcctca

SEQ ID NO: 1251373 - DNA, 21 bp, Homo sapiens
aggggacattttctggattct

SEQ ID NO: 1251374 - DNA, 14 bp, Homo sapiens
aggggacccaagaa

SEQ ID NO: 1251375 - DNA, 17 bp, Homo sapiens
aggggacccaagaaacc

SEQ ID NO: 1251376 - DNA, 21 bp, Homo sapiens
aggggacccagctcctctgag

SEQ ID NO: 1251377 - DNA, 22 bp, Homo sapiens
aggggacccccgccccctgccc

SEQ ID NO: 1251378 - DNA, 16 bp, Homo sapiens
aggggacgggcaagtg

SEQ ID NO: 1251379 - DNA, 18 bp, Homo sapiens
aggggacgtgggccctgc

SEQ ID NO: 1251380 - DNA, 14 bp, Homo sapiens
aggggactcagccc

SEQ ID NO: 1251381 - DNA, 18 bp, Homo sapiens
aggggactgggggactgg

SEQ ID NO: 1251382 - DNA, 16 bp, Homo sapiens
aggggagaaactgaaa

SEQ ID NO: 1251383 - DNA, 19 bp, Homo sapiens
agggtcctgcagcctgcag

SEQ ID NO: 1251384 - DNA, 21 bp, Homo sapiens
agggtcctgcagcctgcagga

SEQ ID NO: 1251385 - DNA, 13 bp, Homo sapiens
agggtcctgccct

SEQ ID NO: 1251386 - DNA, 14 bp, Homo sapiens
agggtcctgccctc

SEQ ID NO: 1251387 - DNA, 21 bp, Homo sapiens
agggtcctgccctccggagga

SEQ ID NO: 1251388 - DNA, 22 bp, Homo sapiens
agggtcctgccctccggaggag

SEQ ID NO: 1251389 - DNA, 14 bp, Homo sapiens
agggtcctggctcc

SEQ ID NO: 1251390 - DNA, 20 bp, Homo sapiens
agggtcctttagtacctgaa

SEQ ID NO: 1251391 - DNA, 24 bp, Homo sapiens
agggtcgctgcataaactgttgta

SEQ ID NO: 1251392 - DNA, 22 bp, Homo sapiens
agggtcggaacccaagcttaga

SEQ ID NO: 1251393 - DNA, 14 bp, Homo sapiens
agggtctcccctcc

SEQ ID NO: 1251394 - DNA, 16 bp, Homo sapiens
agggtctcccctcctg

SEQ ID NO: 1251395 - DNA, 19 bp, Homo sapiens
agggtctcccctcctgcac

SEQ ID NO: 1251396 - DNA, 20 bp, Homo sapiens
agggtctcccctcctgcaca

SEQ ID NO: 1251397 - DNA, 17 bp, Homo sapiens
agggtctctccctcagg

SEQ ID NO: 1251398 - DNA, 17 bp, Homo sapiens
agggtctgcagcctgct

SEQ ID NO: 1251399 - DNA, 18 bp, Homo sapiens
agggtctgcagcctgctg

SEQ ID NO: 1251400 - DNA, 23 bp, Homo sapiens
agggtctgcagcctgctggggct

SEQ ID NO: 1251401 - DNA, 17 bp, Homo sapiens
agggtctgctctttctc

SEQ ID NO: 1251402 - DNA, 20 bp, Homo sapiens
agggtctgctctttctctgc

SEQ ID NO: 1251403 - DNA, 15 bp, Homo sapiens
agggtctggagaagc

SEQ ID NO: 1251404 - DNA, 12 bp, Homo sapiens
agggtctggcag

SEQ ID NO: 1251405 - DNA, 18 bp, Homo sapiens
agggtctggcagagcctc

SEQ ID NO: 1251406 - DNA, 20 bp, Homo sapiens
agggtctggcagagcctctg

SEQ ID NO: 1251407 - DNA, 13 bp, Homo sapiens
agggtctgggctg

SEQ ID NO: 1251408 - DNA, 17 bp, Homo sapiens
agggtctgggctgggca

SEQ ID NO: 1251409 - DNA, 23 bp, Homo sapiens
agggtctgggctgggcacctgac

SEQ ID NO: 1251410 - DNA, 18 bp, Homo sapiens
agggtcttcttggcagct

SEQ ID NO: 1251411 - DNA, 14 bp, Homo sapiens
agggtcttgctctg

SEQ ID NO: 1251412 - DNA, 22 bp, Homo sapiens
agggtctttctgatgacgcctg

SEQ ID NO: 1251413 - DNA, 23 bp, Homo sapiens
agggtcttttaccctgtgtcaga

SEQ ID NO: 1251414 - DNA, 13 bp, Homo sapiens
agggtcttttcat

SEQ ID NO: 1251415 - DNA, 21 bp, Homo sapiens
agggtcttttcatctgggaaa

SEQ ID NO: 1251416 - DNA, 17 bp, Homo sapiens
agggtgaaggaggtcag

SEQ ID NO: 1251417 - DNA, 16 bp, Homo sapiens
agggtgacgcccagct

SEQ ID NO: 1251418 - DNA, 17 bp, Homo sapiens
agggtgacgcccagctc

SEQ ID NO: 1251419 - DNA, 16 bp, Homo sapiens
agggtgacgcctgaga

SEQ ID NO: 1251420 - DNA, 22 bp, Homo sapiens
agggtgacgcctgagacagcac

SEQ ID NO: 1251421 - DNA, 18 bp, Homo sapiens
agggtgactcacagccgc

SEQ ID NO: 1251422 - DNA, 15 bp, Homo sapiens
agggtgagacactgc

SEQ ID NO: 1251423 - DNA, 19 bp, Homo sapiens
agggtgagacactgcacag

SEQ ID NO: 1251424 - DNA, 21 bp, Homo sapiens
agggtgagcagggtcaagcct

SEQ ID NO: 1251425 - DNA, 17 bp, Homo sapiens
agggtgcagccctcttg

SEQ ID NO: 1251426 - DNA, 20 bp, Homo sapiens
agggtgcagccctcttgccc

SEQ ID NO: 1251427 - DNA, 18 bp, Homo sapiens
agggtgccagttgggctc

SEQ ID NO: 1251428 - DNA, 18 bp, Homo sapiens
agggtgcccttttccagc

SEQ ID NO: 1251429 - DNA, 16 bp, Homo sapiens
agggtgcctcaggacc

SEQ ID NO: 1251430 - DNA, 22 bp, Homo sapiens
agggtgctctgaatctgtacat

SEQ ID NO: 1251431 - DNA, 17 bp, Homo sapiens
agggtgctgcttccctc

SEQ ID NO: 1251432 - DNA, 21 bp, Homo sapiens
agggtgctgcttccctctgcc

SEQ ID NO: 1251433 - DNA, 15 bp, Homo sapiens
agggtggaccaggcc

SEQ ID NO: 1251434 - DNA, 20 bp, Homo sapiens
agggtggaccaggcctggag

SEQ ID NO: 1251435 - DNA, 20 bp, Homo sapiens
agggtggaccccctgagtca

SEQ ID NO: 1251436 - DNA, 14 bp, Homo sapiens
agggtggacttcag

SEQ ID NO: 1251437 - DNA, 16 bp, Homo sapiens
agggtggagagggaga

SEQ ID NO: 1251438 - DNA, 23 bp, Homo sapiens
agggtggagagggagactcctgg

SEQ ID NO: 1251439 - DNA, 14 bp, Homo sapiens
agggtggagctgag

SEQ ID NO: 1251440 - DNA, 22 bp, Homo sapiens
agggtggagctgagaagaggag

SEQ ID NO: 1251441 - DNA, 19 bp, Homo sapiens
agggtggaggaaggtgctg

SEQ ID NO: 1251442 - DNA, 11 bp, Homo sapiens
agggtggcagg

SEQ ID NO: 1251443 - DNA, 22 bp, Homo sapiens
agggtggcaggtcactgtcact

SEQ ID NO: 1251444 - DNA, 15 bp, Homo sapiens
agggtggcatcccag

SEQ ID NO: 1251445 - DNA, 21 bp, Homo sapiens
agggtggcatcccagtggcct

SEQ ID NO: 1251446 - DNA, 14 bp, Homo sapiens
agggtggcccttgc

SEQ ID NO: 1251447 - DNA, 17 bp, Homo sapiens
agggtggctgccagccc

SEQ ID NO: 1251448 - DNA, 19 bp, Homo sapiens
agggtggctttaattgtat

SEQ ID NO: 1251449 - DNA, 16 bp, Homo sapiens
agggtgggagagccca

SEQ ID NO: 1251450 - DNA, 19 bp, Homo sapiens
agggtgggagagcccagcc

SEQ ID NO: 1251451 - DNA, 14 bp, Homo sapiens
agggtgggaggcaa

SEQ ID NO: 1251452 - DNA, 17 bp, Homo sapiens
agggtgggatggaggag

SEQ ID NO: 1251453 - DNA, 13 bp, Homo sapiens
agggtgggccagc

SEQ ID NO: 1251454 - DNA, 22 bp, Homo sapiens
agggtgggcgtttggggccctc

SEQ ID NO: 1251455 - DNA, 12 bp, Homo sapiens
agggtggggaga

SEQ ID NO: 1251456 - DNA, 15 bp, Homo sapiens
agggtggggagggag

SEQ ID NO: 1251457 - DNA, 17 bp, Homo sapiens
agggtgggggagggagg

SEQ ID NO: 1251458 - DNA, 20 bp, Homo sapiens
agggtgggggccacctgcct

SEQ ID NO: 1251459 - DNA, 12 bp, Homo sapiens
agggtggggggt

SEQ ID NO: 1251460 - DNA, 15 bp, Homo sapiens
agggtgggtgctcag

SEQ ID NO: 1251461 - DNA, 23 bp, Homo sapiens
agggtggtgctgggactgagcca

SEQ ID NO: 1251462 - DNA, 20 bp, Homo sapiens
agggtggttcaacaaagaaa

SEQ ID NO: 1251463 - DNA, 19 bp, Homo sapiens
agggtgtaggggccacctc

SEQ ID NO: 1251464 - DNA, 20 bp, Homo sapiens
agggtgtaggggccacctcc

SEQ ID NO: 1251465 - DNA, 22 bp, Homo sapiens
agggtgtccggtccctgtccca

SEQ ID NO: 1251466 - DNA, 15 bp, Homo sapiens
agggtgtcctgaggt

SEQ ID NO: 1251467 - DNA, 20 bp, Homo sapiens
agggtgtgactcgggagctg

SEQ ID NO: 1251468 - DNA, 22 bp, Homo sapiens
agggtgtggccctgccatcttc

SEQ ID NO: 1251469 - DNA, 14 bp, Homo sapiens
agggtgtggctcct

SEQ ID NO: 1251470 - DNA, 16 bp, Homo sapiens
agggtgtggctttcca

SEQ ID NO: 1251471 - DNA, 23 bp, Homo sapiens
agggtgtggctttccaggcaccc

SEQ ID NO: 1251472 - DNA, 23 bp, Homo sapiens
agggtgtggggccatgcctcctc

SEQ ID NO: 1251473 - DNA, 17 bp, Homo sapiens
agggtgtgtgttcacct

SEQ ID NO: 1251474 - DNA, 17 bp, Homo sapiens
agggtgttcagaggcag

SEQ ID NO: 1251475 - DNA, 22 bp, Homo sapiens
agggtgttggcattggtgtctg

SEQ ID NO: 1251476 - DNA, 14 bp, Homo sapiens
agggtgtttatgta

SEQ ID NO: 1251477 - DNA, 20 bp, Homo sapiens
agggttacagagacctatgt

SEQ ID NO: 1251478 - DNA, 16 bp, Homo sapiens
agggttagcctgcacc

SEQ ID NO: 1251479 - DNA, 19 bp, Homo sapiens
agggttaggaatctcttca

SEQ ID NO: 1251480 - DNA, 18 bp, Homo sapiens
agggttcagagactcagg

SEQ ID NO: 1251481 - DNA, 15 bp, Homo sapiens
agggttcccccagcc

SEQ ID NO: 1251482 - DNA, 15 bp, Homo sapiens
agggttcccctggcc

SEQ ID NO: 1251483 - DNA, 17 bp, Homo sapiens
agggttcccctggcctt

SEQ ID NO: 1251484 - DNA, 23 bp, Homo sapiens
agggttcctgtagacctagggag

SEQ ID NO: 1251485 - DNA, 20 bp, Homo sapiens
agggttctgccctgcctgag

SEQ ID NO: 1251486 - DNA, 19 bp, Homo sapiens
agggttctgcctctccagg

SEQ ID NO: 1251487 - DNA, 20 bp, Homo sapiens
agggttctgcctctccaggc

SEQ ID NO: 1251488 - DNA, 22 bp, Homo sapiens
agggttgaagacggaaaacaat

SEQ ID NO: 1251489 - DNA, 21 bp, Homo sapiens
agggttgaaggcagtctgaac

SEQ ID NO: 1251490 - DNA, 17 bp, Homo sapiens
agggttgaccccagagg

SEQ ID NO: 1251491 - DNA, 15 bp, Homo sapiens
agggttggggagggg

SEQ ID NO: 1251492 - DNA, 17 bp, Homo sapiens
agggttggggaggggcg

SEQ ID NO: 1251493 - DNA, 16 bp, Homo sapiens
agggttggtgggctgg

SEQ ID NO: 1251494 - DNA, 20 bp, Homo sapiens
agggttggtgggctggccca

SEQ ID NO: 1251495 - DNA, 21 bp, Homo sapiens
agggttggtgggctggcccag

SEQ ID NO: 1251496 - DNA, 16 bp, Homo sapiens
agggtttaatagactg

SEQ ID NO: 1251497 - DNA, 17 bp, Homo sapiens
agggtttcagagagcct

SEQ ID NO: 1251498 - DNA, 20 bp, Homo sapiens
agggtttcgactggtccagc

SEQ ID NO: 1251499 - DNA, 18 bp, Homo sapiens
agggtttgtaatacttta

SEQ ID NO: 1251500 - DNA, 14 bp, Homo sapiens
agggtttgtgccca

SEQ ID NO: 1251501 - DNA, 19 bp, Homo sapiens
agggttttccaccctggaa

SEQ ID NO: 1251502 - DNA, 18 bp, Homo sapiens
agggttttgcaataactt

SEQ ID NO: 1251503 - DNA, 21 bp, Homo sapiens
agggttttttttttttccttt

SEQ ID NO: 1251504 - DNA, 17 bp, Homo sapiens
aggtgtgggagggaaga

SEQ ID NO: 1251505 - DNA, 18 bp, Homo sapiens
aggtgtgggggctgcagc

SEQ ID NO: 1251506 - DNA, 19 bp, Homo sapiens
aggtgtgggtgtctgtttg

SEQ ID NO: 1251507 - DNA, 14 bp, Homo sapiens
aggtgtggtggcgt

SEQ ID NO: 1251508 - DNA, 17 bp, Homo sapiens
aggtgtggtggctcatg

SEQ ID NO: 1251509 - DNA, 22 bp, Homo sapiens
aggtgtgtccttgaactgaggc

SEQ ID NO: 1251510 - DNA, 18 bp, Homo sapiens
aggtgtgtgtgaactggg

SEQ ID NO: 1251511 - DNA, 23 bp, Homo sapiens
aggtgtgtgtgaactgggcacag

SEQ ID NO: 1251512 - DNA, 23 bp, Homo sapiens
aggtgttatttggaaccttgttt

SEQ ID NO: 1251513 - DNA, 17 bp, Homo sapiens
aggtgttctacactcat

SEQ ID NO: 1251514 - DNA, 18 bp, Homo sapiens
aggtgttgattttctgtt

SEQ ID NO: 1251515 - DNA, 21 bp, Homo sapiens
aggtgttgattttctgttgta

SEQ ID NO: 1251516 - DNA, 22 bp, Homo sapiens
aggtgttgccaaatatgtcctg

SEQ ID NO: 1251517 - DNA, 18 bp, Homo sapiens
aggtgttgtcagcaggca

SEQ ID NO: 1251518 - DNA, 20 bp, Homo sapiens
aggtgtttaaagagaggtta

SEQ ID NO: 1251519 - DNA, 19 bp, Homo sapiens
aggtgttttttatgaagtg

SEQ ID NO: 1251520 - DNA, 22 bp, Homo sapiens
aggtgttttttatgaagtgcgt

SEQ ID NO: 1251521 - DNA, 18 bp, Homo sapiens
aggttaaacggtgcccat

SEQ ID NO: 1251522 - DNA, 18 bp, Homo sapiens
aggttaaagaagctgcat

SEQ ID NO: 1251523 - DNA, 14 bp, Homo sapiens
aggttaaagctaaa

SEQ ID NO: 1251524 - DNA, 16 bp, Homo sapiens
aggttaaagctaaact

SEQ ID NO: 1251525 - DNA, 17 bp, Homo sapiens
aggttaaagctaaactg

SEQ ID NO: 1251526 - DNA, 20 bp, Homo sapiens
aggttaaggtgggtccagga

SEQ ID NO: 1251527 - DNA, 17 bp, Homo sapiens
aggttactgagtgagtt

SEQ ID NO: 1251528 - DNA, 16 bp, Homo sapiens
aggttagaaaggcagc

SEQ ID NO: 1251529 - DNA, 13 bp, Homo sapiens
aggttagaagaac

SEQ ID NO: 1251530 - DNA, 18 bp, Homo sapiens
aggttaggatttaacagt

SEQ ID NO: 1251531 - DNA, 14 bp, Homo sapiens
aggttataattttt

SEQ ID NO: 1251532 - DNA, 21 bp, Homo sapiens
aggttatacaataacccagtt

SEQ ID NO: 1251533 - DNA, 14 bp, Homo sapiens
aggttataggtcac

SEQ ID NO: 1251534 - DNA, 17 bp, Homo sapiens
aggttatatgaatatat

SEQ ID NO: 1251535 - DNA, 14 bp, Homo sapiens
aggttatctgcctg

SEQ ID NO: 1251536 - DNA, 22 bp, Homo sapiens
aggttatctgcctggcctggct

SEQ ID NO: 1251537 - DNA, 18 bp, Homo sapiens
aggttatgaaacatatca

SEQ ID NO: 1251538 - DNA, 14 bp, Homo sapiens
aggttatttaaaat

SEQ ID NO: 1251539 - DNA, 17 bp, Homo sapiens
aggttcaaagatatttt

SEQ ID NO: 1251540 - DNA, 20 bp, Homo sapiens
aggttcactgagctccccag

SEQ ID NO: 1251541 - DNA, 19 bp, Homo sapiens
aggttcagccaaggtttta

SEQ ID NO: 1251542 - DNA, 21 bp, Homo sapiens
aggttcatgccaccatggcca

SEQ ID NO: 1251543 - DNA, 15 bp, Homo sapiens
aggttcatgcccaag

SEQ ID NO: 1251544 - DNA, 11 bp, Homo sapiens
aggttccagaa

SEQ ID NO: 1251545 - DNA, 13 bp, Homo sapiens
aggttcccaagga

SEQ ID NO: 1251546 - DNA, 14 bp, Homo sapiens
aggttcccaaggac

SEQ ID NO: 1251547 - DNA, 19 bp, Homo sapiens
aggttcccagggctggaga

SEQ ID NO: 1251548 - DNA, 14 bp, Homo sapiens
aggttccccagaga

SEQ ID NO: 1251549 - DNA, 19 bp, Homo sapiens
aggttccccagagagcagg

SEQ ID NO: 1251550 - DNA, 20 bp, Homo sapiens
aggttccccagagagcaggc

SEQ ID NO: 1251551 - DNA, 14 bp, Homo sapiens
aggttcccctgtca

SEQ ID NO: 1251552 - DNA, 18 bp, Homo sapiens
aggttccctgttcttcct

SEQ ID NO: 1251553 - DNA, 19 bp, Homo sapiens
aggttccctgttcttcctc

SEQ ID NO: 1251554 - DNA, 22 bp, Homo sapiens
aggttccgtatctccctggaga

SEQ ID NO: 1251555 - DNA, 12 bp, Homo sapiens
aggttcctctgc

SEQ ID NO: 1251556 - DNA, 18 bp, Homo sapiens
aggttcctctgcctgccc

SEQ ID NO: 1251557 - DNA, 20 bp, Homo sapiens
aggttcctctgcctgccccg

SEQ ID NO: 1251558 - DNA, 18 bp, Homo sapiens
aggttctcagagccaagt

SEQ ID NO: 1251559 - DNA, 13 bp, Homo sapiens
aggttctccaaca

SEQ ID NO: 1251560 - DNA, 21 bp, Homo sapiens
aggttctccgttagctcctgt

SEQ ID NO: 1251561 - DNA, 14 bp, Homo sapiens
aggttctgcctgct

SEQ ID NO: 1251562 - DNA, 17 bp, Homo sapiens
aggttctgggcctctga

SEQ ID NO: 1251563 - DNA, 18 bp, Homo sapiens
aggttctgggcctctgaa

SEQ ID NO: 1251564 - DNA, 21 bp, Homo sapiens
aggttctgttaccccatcctc

SEQ ID NO: 1251565 - DNA, 21 bp, Homo sapiens
aggttcttcttcctgaagctg

SEQ ID NO: 1251566 - DNA, 23 bp, Homo sapiens
aggttcttcttcctgaagctgag

SEQ ID NO: 1251567 - DNA, 23 bp, Homo sapiens
aggttcttcttgggagtatgttg

SEQ ID NO: 1251568 - DNA, 14 bp, Homo sapiens
aggttcttgatgtc

SEQ ID NO: 1251569 - DNA, 16 bp, Homo sapiens
aggttcttgatgtcat

SEQ ID NO: 1251570 - DNA, 14 bp, Homo sapiens
aggttcttttccat

SEQ ID NO: 1251571 - DNA, 12 bp, Homo sapiens
aggttgaagcca

SEQ ID NO: 1251572 - DNA, 17 bp, Homo sapiens
aggttgaagccatgtct

SEQ ID NO: 1251573 - DNA, 22 bp, Homo sapiens
aggttgaagctaaaaggaaaag

SEQ ID NO: 1251574 - DNA, 23 bp, Homo sapiens
aggttgaggaaaagactgtgggt

SEQ ID NO: 1251575 - DNA, 17 bp, Homo sapiens
aggttgaggggctcctg

SEQ ID NO: 1251576 - DNA, 20 bp, Homo sapiens
aggttgaggggctcctggaa

SEQ ID NO: 1251577 - DNA, 14 bp, Homo sapiens
aggttgcagtgagc

SEQ ID NO: 1251578 - DNA, 18 bp, Homo sapiens
aggttgcagtgagccgag

SEQ ID NO: 1251579 - DNA, 12 bp, Homo sapiens
aggttgcctgaa

SEQ ID NO: 1251580 - DNA, 18 bp, Homo sapiens
aggttggacagccccctt

SEQ ID NO: 1251581 - DNA, 20 bp, Homo sapiens
aggttggacagcccccttcg

SEQ ID NO: 1251582 - DNA, 12 bp, Homo sapiens
aggttggatggg

SEQ ID NO: 1251583 - DNA, 20 bp, Homo sapiens
aggttggatgggagtgggca

SEQ ID NO: 1251584 - DNA, 18 bp, Homo sapiens
aggttggcggcagacaca

SEQ ID NO: 1251585 - DNA, 20 bp, Homo sapiens
aggttggcgtgccctggagg

SEQ ID NO: 1251586 - DNA, 17 bp, Homo sapiens
aggttgggaggctgtgg

SEQ ID NO: 1251587 - DNA, 20 bp, Homo sapiens
aggttgggaggctgtggaga

SEQ ID NO: 1251588 - DNA, 21 bp, Homo sapiens
aggttggggataggttttctg

SEQ ID NO: 1251589 - DNA, 18 bp, Homo sapiens
aggttgggggaaccagca

SEQ ID NO: 1251590 - DNA, 19 bp, Homo sapiens
aggttggggtgtactagtt

SEQ ID NO: 1251591 - DNA, 22 bp, Homo sapiens
aggttggttccttggggggcca

SEQ ID NO: 1251592 - DNA, 23 bp, Homo sapiens
aggttggttccttggggggccaa

SEQ ID NO: 1251593 - DNA, 17 bp, Homo sapiens
aggttgtctccaggcca

SEQ ID NO: 1251594 - DNA, 23 bp, Homo sapiens
aggttgtggatgctccagggcag

SEQ ID NO: 1251595 - DNA, 21 bp, Homo sapiens
aggttgtggggaggctgcact

SEQ ID NO: 1251596 - DNA, 15 bp, Homo sapiens
aggtttaacatttgc

SEQ ID NO: 1251597 - DNA, 16 bp, Homo sapiens
aggtttacaatttaca

SEQ ID NO: 1251598 - DNA, 17 bp, Homo sapiens
aggtttacaatttacaa

SEQ ID NO: 1251599 - DNA, 18 bp, Homo sapiens
aggtttaggctggtggcc

SEQ ID NO: 1251600 - DNA, 15 bp, Homo sapiens
aggtttataaagcag

SEQ ID NO: 1251601 - DNA, 16 bp, Homo sapiens
aggtttatgaaaaaga

SEQ ID NO: 1251602 - DNA, 21 bp, Homo sapiens
aggtttatgaaaaagaagaat

SEQ ID NO: 1251603 - DNA, 20 bp, Homo sapiens
aggtttcagatgaggtcaac

SEQ ID NO: 1251604 - DNA, 22 bp, Homo sapiens
aggtttcagcaacaagactgcc

SEQ ID NO: 1251605 - DNA, 12 bp, Homo sapiens
aggtttctattg

SEQ ID NO: 1251606 - DNA, 15 bp, Homo sapiens
aggtttctctccctc

SEQ ID NO: 1251607 - DNA, 16 bp, Homo sapiens
aggtttctctccctcc

SEQ ID NO: 1251608 - DNA, 23 bp, Homo sapiens
aggtttcttggggtcccagggaa

SEQ ID NO: 1251609 - DNA, 17 bp, Homo sapiens
aggtttgcacccctcct

SEQ ID NO: 1251610 - DNA, 21 bp, Homo sapiens
aggtttggatgggagtgagac

SEQ ID NO: 1251611 - DNA, 19 bp, Homo sapiens
aggtttggtgcaaagtatt

SEQ ID NO: 1251612 - DNA, 12 bp, Homo sapiens
aggtttgtatat

SEQ ID NO: 1251613 - DNA, 23 bp, Homo sapiens
aggtttgtcgggcaccagccagc

SEQ ID NO: 1251614 - DNA, 17 bp, Homo sapiens
aggtttgttttgtgaat

SEQ ID NO: 1251615 - DNA, 20 bp, Homo sapiens
aggtttgttttgtgaatttt

SEQ ID NO: 1251616 - DNA, 15 bp, Homo sapiens
aggttttaaagtgat

SEQ ID NO: 1251617 - DNA, 20 bp, Homo sapiens
aggttttatttcatttttca

SEQ ID NO: 1251618 - DNA, 22 bp, Homo sapiens
aggttttcccctcttttgttaa

SEQ ID NO: 1251619 - DNA, 13 bp, Homo sapiens
aggttttctccac

SEQ ID NO: 1251620 - DNA, 14 bp, Homo sapiens
aggttttgaataaa

SEQ ID NO: 1251621 - DNA, 17 bp, Homo sapiens
aggttttggagagtttg

SEQ ID NO: 1251622 - DNA, 13 bp, Homo sapiens
aggttttgtaaag

SEQ ID NO: 1251623 - DNA, 15 bp, Homo sapiens
aggtttttcttggga

SEQ ID NO: 1251624 - DNA, 16 bp, Homo sapiens
aggtttttcttgggaa

SEQ ID NO: 1251625 - DNA, 17 bp, Homo sapiens
agtagctgcccttcctg

SEQ ID NO: 1251626 - DNA, 22 bp, Homo sapiens
agtagctgggaccacaggcatg

SEQ ID NO: 1251627 - DNA, 18 bp, Homo sapiens
agtagctgggactacagg

SEQ ID NO: 1251628 - DNA, 14 bp, Homo sapiens
agtagctgggatta

SEQ ID NO: 1251629 - DNA, 21 bp, Homo sapiens
agtagctgggattacaggcgc

SEQ ID NO: 1251630 - DNA, 20 bp, Homo sapiens
agtagctgggcctgtgcact

SEQ ID NO: 1251631 - DNA, 18 bp, Homo sapiens
agtagcttgctccctgtg

SEQ ID NO: 1251632 - DNA, 13 bp, Homo sapiens
agtaggagcccag

SEQ ID NO: 1251633 - DNA, 23 bp, Homo sapiens
agtaggatatagcgaaaggcgag

SEQ ID NO: 1251634 - DNA, 21 bp, Homo sapiens
agtaggggttgaagaaaacaa

SEQ ID NO: 1251635 - DNA, 18 bp, Homo sapiens
agtagtaaatcagaaagt

SEQ ID NO: 1251636 - DNA, 18 bp, Homo sapiens
agtagtacttcttctgta

SEQ ID NO: 1251637 - DNA, 21 bp, Homo sapiens
agtagtacttcttctgtaata

SEQ ID NO: 1251638 - DNA, 22 bp, Homo sapiens
agtagtacttcttctgtaatat

SEQ ID NO: 1251639 - DNA, 21 bp, Homo sapiens
agtagtcaaaaacaaagctga

SEQ ID NO: 1251640 - DNA, 17 bp, Homo sapiens
agtagtcagaagcaggt

SEQ ID NO: 1251641 - DNA, 16 bp, Homo sapiens
agtagtccttggcata

SEQ ID NO: 1251642 - DNA, 17 bp, Homo sapiens
agtagtcttatgtaaag

SEQ ID NO: 1251643 - DNA, 22 bp, Homo sapiens
agtagtgaggattttgttgata

SEQ ID NO: 1251644 - DNA, 14 bp, Homo sapiens
agtagtgtctggat

SEQ ID NO: 1251645 - DNA, 12 bp, Homo sapiens
agtagtgtggcc

SEQ ID NO: 1251646 - DNA, 14 bp, Homo sapiens
agtagtgtggcctg

SEQ ID NO: 1251647 - DNA, 18 bp, Homo sapiens
agtagttctgtttggtgt

SEQ ID NO: 1251648 - DNA, 15 bp, Homo sapiens
agtagttggtttgta

SEQ ID NO: 1251649 - DNA, 14 bp, Homo sapiens
agtagttttcaaaa

SEQ ID NO: 1251650 - DNA, 15 bp, Homo sapiens
agtagttttcaaaac

SEQ ID NO: 1251651 - DNA, 13 bp, Homo sapiens
agtataaaatagt

SEQ ID NO: 1251652 - DNA, 16 bp, Homo sapiens
agtataaacaaagtta

SEQ ID NO: 1251653 - DNA, 13 bp, Homo sapiens
agtataacagttt

SEQ ID NO: 1251654 - DNA, 22 bp, Homo sapiens
agtataacagttttgagtaatt

SEQ ID NO: 1251655 - DNA, 21 bp, Homo sapiens
agtataaccatatgatactat

SEQ ID NO: 1251656 - DNA, 18 bp, Homo sapiens
agtataagatttttgaaa

SEQ ID NO: 1251657 - DNA, 12 bp, Homo sapiens
agtataatcttt

SEQ ID NO: 1251658 - DNA, 18 bp, Homo sapiens
agtataatgtttattaaa

SEQ ID NO: 1251659 - DNA, 23 bp, Homo sapiens
agtatacaacaggagagagatgg

SEQ ID NO: 1251660 - DNA, 12 bp, Homo sapiens
agtatacctggc

SEQ ID NO: 1251661 - DNA, 20 bp, Homo sapiens
agtatacgtataaatatcag

SEQ ID NO: 1251662 - DNA, 23 bp, Homo sapiens
agtatacttttcccctgttaaac

SEQ ID NO: 1251663 - DNA, 15 bp, Homo sapiens
agtatagaaaatctt

SEQ ID NO: 1251664 - DNA, 18 bp, Homo sapiens
agtatagaagtctggaaa

SEQ ID NO: 1251665 - DNA, 13 bp, Homo sapiens
agtatataataac

SEQ ID NO: 1251666 - DNA, 15 bp, Homo sapiens
agtatataataactt

SEQ ID NO: 1251667 - DNA, 17 bp, Homo sapiens
agtatataataacttta

SEQ ID NO: 1251668 - DNA, 11 bp, Homo sapiens
agtatatactg

SEQ ID NO: 1251669 - DNA, 15 bp, Homo sapiens
agtatatagtatatt

SEQ ID NO: 1251670 - DNA, 12 bp, Homo sapiens
agtatatgtgag

SEQ ID NO: 1251671 - DNA, 15 bp, Homo sapiens
agtatatgttccctc

SEQ ID NO: 1251672 - DNA, 14 bp, Homo sapiens
agtatattatgtat

SEQ ID NO: 1251673 - DNA, 17 bp, Homo sapiens
agtatattatgtattta

SEQ ID NO: 1251674 - DNA, 11 bp, Homo sapiens
agtatattctt

SEQ ID NO: 1251675 - DNA, 20 bp, Homo sapiens
agtatattgttgaagagaca

SEQ ID NO: 1251676 - DNA, 13 bp, Homo sapiens
agtatatttatac

SEQ ID NO: 1251677 - DNA, 16 bp, Homo sapiens
agtatatttatactct

SEQ ID NO: 1251678 - DNA, 14 bp, Homo sapiens
agtatatttatagt

SEQ ID NO: 1251679 - DNA, 13 bp, Homo sapiens
agtatattttatt

SEQ ID NO: 1251680 - DNA, 19 bp, Homo sapiens
agtatattttatttcaatg

SEQ ID NO: 1251681 - DNA, 18 bp, Homo sapiens
agtatattttcttttcct

SEQ ID NO: 1251682 - DNA, 21 bp, Homo sapiens
agtatatttttgtctgcagct

SEQ ID NO: 1251683 - DNA, 13 bp, Homo sapiens
agtatcatgaagc

SEQ ID NO: 1251684 - DNA, 12 bp, Homo sapiens
agtatcatgcat

SEQ ID NO: 1251685 - DNA, 14 bp, Homo sapiens
agtatcatgcattc

SEQ ID NO: 1251686 - DNA, 19 bp, Homo sapiens
agtatcatgccctgtgcaa

SEQ ID NO: 1251687 - DNA, 15 bp, Homo sapiens
agtatccaatgtctt

SEQ ID NO: 1251688 - DNA, 14 bp, Homo sapiens
agtatccactttgc

SEQ ID NO: 1251689 - DNA, 11 bp, Homo sapiens
agtatccaggc

SEQ ID NO: 1251690 - DNA, 23 bp, Homo sapiens
agtatccaggctttgtacagagt

SEQ ID NO: 1251691 - DNA, 13 bp, Homo sapiens
agtatccttcctt

SEQ ID NO: 1251692 - DNA, 18 bp, Homo sapiens
agtatctacctggaaaca

SEQ ID NO: 1251693 - DNA, 19 bp, Homo sapiens
agtatctatatatgtgtat

SEQ ID NO: 1251694 - DNA, 18 bp, Homo sapiens
agtatctgggattattct

SEQ ID NO: 1251695 - DNA, 19 bp, Homo sapiens
agtatcttacctgtaaagt

SEQ ID NO: 1251696 - DNA, 18 bp, Homo sapiens
agtatcttagagtttaca

SEQ ID NO: 1251697 - DNA, 20 bp, Homo sapiens
agtatcttagagtttacagt

SEQ ID NO: 1251698 - DNA, 23 bp, Homo sapiens
agtatcttgggtgtattctctgt

SEQ ID NO: 1251699 - DNA, 14 bp, Homo sapiens
agtatcttgtgctt

SEQ ID NO: 1251700 - DNA, 13 bp, Homo sapiens
agtatgaatctat

SEQ ID NO: 1251701 - DNA, 17 bp, Homo sapiens
agtatgaatctatgcca

SEQ ID NO: 1251702 - DNA, 18 bp, Homo sapiens
agtatgagtcttctgtaa

SEQ ID NO: 1251703 - DNA, 21 bp, Homo sapiens
agtatgatgaaaataattttc

SEQ ID NO: 1251704 - DNA, 23 bp, Homo sapiens
agtatgatgaaaataattttcca

SEQ ID NO: 1251705 - DNA, 12 bp, Homo sapiens
agtatgcaaaat

SEQ ID NO: 1251706 - DNA, 13 bp, Homo sapiens
agtatgcaaaata

SEQ ID NO: 1251707 - DNA, 14 bp, Homo sapiens
agtatgcaatgctt

SEQ ID NO: 1251708 - DNA, 18 bp, Homo sapiens
agtatgcactatatacat

SEQ ID NO: 1251709 - DNA, 14 bp, Homo sapiens
agtatgctggcttg

SEQ ID NO: 1251710 - DNA, 18 bp, Homo sapiens
agtatgggggttgtaaat

SEQ ID NO: 1251711 - DNA, 23 bp, Homo sapiens
agtatggtaatctttacctgtat

SEQ ID NO: 1251712 - DNA, 21 bp, Homo sapiens
agtatggttcaagattgttga

SEQ ID NO: 1251713 - DNA, 16 bp, Homo sapiens
agtatgtaaagtatgt

SEQ ID NO: 1251714 - DNA, 18 bp, Homo sapiens
agtatgtatattaaaaaa

SEQ ID NO: 1251715 - DNA, 13 bp, Homo sapiens
agtatgtattatt

SEQ ID NO: 1251716 - DNA, 13 bp, Homo sapiens
agtatgtctgttt

SEQ ID NO: 1251717 - DNA, 21 bp, Homo sapiens
agtatgtgacttttctgatta

SEQ ID NO: 1251718 - DNA, 22 bp, Homo sapiens
agtatgtgagtagtcttatgta

SEQ ID NO: 1251719 - DNA, 23 bp, Homo sapiens
agtatgtgagtagtcttatgtaa

SEQ ID NO: 1251720 - DNA, 23 bp, Homo sapiens
agtatgtgggcagattttcagca

SEQ ID NO: 1251721 - DNA, 16 bp, Homo sapiens
agtatgttaagctctt

SEQ ID NO: 1251722 - DNA, 19 bp, Homo sapiens
agtatgttaagctctttat

SEQ ID NO: 1251723 - DNA, 14 bp, Homo sapiens
agtatgttattcct

SEQ ID NO: 1251724 - DNA, 15 bp, Homo sapiens
agtatgttattcctg

SEQ ID NO: 1251725 - DNA, 23 bp, Homo sapiens
agtatgttgtacatactgccgaa

SEQ ID NO: 1251726 - DNA, 14 bp, Homo sapiens
agtatgttgtcaaa

SEQ ID NO: 1251727 - DNA, 14 bp, Homo sapiens
agtatgttgtcata

SEQ ID NO: 1251728 - DNA, 18 bp, Homo sapiens
agtatgttttagcatgtg

SEQ ID NO: 1251729 - DNA, 20 bp, Homo sapiens
agtattaaaagttgcatttg

SEQ ID NO: 1251730 - DNA, 15 bp, Homo sapiens
agtattaaagggggg

SEQ ID NO: 1251731 - DNA, 20 bp, Homo sapiens
agtattaaaggggggagggg

SEQ ID NO: 1251732 - DNA, 15 bp, Homo sapiens
agtattaacttacaa

SEQ ID NO: 1251733 - DNA, 13 bp, Homo sapiens
agtattaagggta

SEQ ID NO: 1251734 - DNA, 19 bp, Homo sapiens
agtattaagggtaggatgt

SEQ ID NO: 1251735 - DNA, 21 bp, Homo sapiens
agtattaccaccctttcacaa

SEQ ID NO: 1251736 - DNA, 17 bp, Homo sapiens
agtattactaaattgac

SEQ ID NO: 1251737 - DNA, 19 bp, Homo sapiens
agtattactgctgctgtgc

SEQ ID NO: 1251738 - DNA, 15 bp, Homo sapiens
agtattatcattgct

SEQ ID NO: 1251739 - DNA, 23 bp, Homo sapiens
agtattatcttgttcaggaaaag

SEQ ID NO: 1251740 - DNA, 18 bp, Homo sapiens
agtattatgcatatataa

SEQ ID NO: 1251741 - DNA, 13 bp, Homo sapiens
agtattcagaaat

SEQ ID NO: 1251742 - DNA, 14 bp, Homo sapiens
agtattcagaaatt

SEQ ID NO: 1251743 - DNA, 19 bp, Homo sapiens
agtattcagaaattaaaat

SEQ ID NO: 1251744 - DNA, 21 bp, Homo sapiens
agtattcagaaattaaaatat

SEQ ID NO: 1251745 - DNA, 23 bp, Homo sapiens
agtattcagaaattaaaatatta

SEQ ID NO: 1251746 - DNA, 18 bp, Homo sapiens
agtattcaggcactgaga

SEQ ID NO: 1251747 - DNA, 17 bp, Homo sapiens
agtcggagtggacaccg

SEQ ID NO: 1251748 - DNA, 15 bp, Homo sapiens
agtcggccccatctc

SEQ ID NO: 1251749 - DNA, 15 bp, Homo sapiens
agtcggggcctggga

SEQ ID NO: 1251750 - DNA, 15 bp, Homo sapiens
agtcgggggctggcc

SEQ ID NO: 1251751 - DNA, 20 bp, Homo sapiens
agtcgggggctggcctagga

SEQ ID NO: 1251752 - DNA, 15 bp, Homo sapiens
agtcgggtgccagga

SEQ ID NO: 1251753 - DNA, 16 bp, Homo sapiens
agtcgggtgccaggac

SEQ ID NO: 1251754 - DNA, 16 bp, Homo sapiens
agtcgtaaaagagata

SEQ ID NO: 1251755 - DNA, 13 bp, Homo sapiens
agtcgtgatgtgg

SEQ ID NO: 1251756 - DNA, 14 bp, Homo sapiens
agtcgtgatgtgga

SEQ ID NO: 1251757 - DNA, 15 bp, Homo sapiens
agtcgtgcctgtgtc

SEQ ID NO: 1251758 - DNA, 15 bp, Homo sapiens
agtcgttatttctgt

SEQ ID NO: 1251759 - DNA, 20 bp, Homo sapiens
agtctaaagctggtttaatg

SEQ ID NO: 1251760 - DNA, 13 bp, Homo sapiens
agtctaacagttt

SEQ ID NO: 1251761 - DNA, 23 bp, Homo sapiens
agtctaacatattcaatgcaagt

SEQ ID NO: 1251762 - DNA, 19 bp, Homo sapiens
agtctaatctagtgacacc

SEQ ID NO: 1251763 - DNA, 16 bp, Homo sapiens
agtctacagttgtcct

SEQ ID NO: 1251764 - DNA, 18 bp, Homo sapiens
agtctacccgacataagt

SEQ ID NO: 1251765 - DNA, 16 bp, Homo sapiens
agtctaccctgtcctt

SEQ ID NO: 1251766 - DNA, 18 bp, Homo sapiens
agtctacctgagcattca

SEQ ID NO: 1251767 - DNA, 13 bp, Homo sapiens
agtctagatacag

SEQ ID NO: 1251768 - DNA, 20 bp, Homo sapiens
agtctaggagctgggaggaa

SEQ ID NO: 1251769 - DNA, 14 bp, Homo sapiens
agtctagtcttctg

SEQ ID NO: 1251770 - DNA, 20 bp, Homo sapiens
agtctatcaaatgaaactct

SEQ ID NO: 1251771 - DNA, 23 bp, Homo sapiens
agtctatctggtattaaatgcca

SEQ ID NO: 1251772 - DNA, 19 bp, Homo sapiens
agtctatgttcaaagactg

SEQ ID NO: 1251773 - DNA, 22 bp, Homo sapiens
agtctatttccactgaacaaaa

SEQ ID NO: 1251774 - DNA, 23 bp, Homo sapiens
agtctatttttttaactgaaaat

SEQ ID NO: 1251775 - DNA, 18 bp, Homo sapiens
agtctcaagggtggcagg

SEQ ID NO: 1251776 - DNA, 19 bp, Homo sapiens
agtctcactctgttgccca

SEQ ID NO: 1251777 - DNA, 19 bp, Homo sapiens
agtctcagaaactcccctg

SEQ ID NO: 1251778 - DNA, 20 bp, Homo sapiens
agtctcagaaactcccctgg

SEQ ID NO: 1251779 - DNA, 13 bp, Homo sapiens
agtctcagctaag

SEQ ID NO: 1251780 - DNA, 18 bp, Homo sapiens
agtctcagctaagctcac

SEQ ID NO: 1251781 - DNA, 13 bp, Homo sapiens
agtctcaggagca

SEQ ID NO: 1251782 - DNA, 10 bp, Homo sapiens
agtctcagtt

SEQ ID NO: 1251783 - DNA, 19 bp, Homo sapiens
agtctcagttcgtgtttga

SEQ ID NO: 1251784 - DNA, 18 bp, Homo sapiens
agtctcatctatgtcata

SEQ ID NO: 1251785 - DNA, 15 bp, Homo sapiens
agtctcatctcctga

SEQ ID NO: 1251786 - DNA, 18 bp, Homo sapiens
agtctcattacttttgaa

SEQ ID NO: 1251787 - DNA, 22 bp, Homo sapiens
agtctccaacatgtttctgttt

SEQ ID NO: 1251788 - DNA, 21 bp, Homo sapiens
agtctccactttctcaatgct

SEQ ID NO: 1251789 - DNA, 11 bp, Homo sapiens
agtctccaggg

SEQ ID NO: 1251790 - DNA, 18 bp, Homo sapiens
agtctcccactgcaactt

SEQ ID NO: 1251791 - DNA, 23 bp, Homo sapiens
agtctcccactgcaacttgtgaa

SEQ ID NO: 1251792 - DNA, 13 bp, Homo sapiens
agtctcccaggcc

SEQ ID NO: 1251793 - DNA, 23 bp, Homo sapiens
agtctcccaggccccctgcatct

SEQ ID NO: 1251794 - DNA, 21 bp, Homo sapiens
agtctccccactccaccctgt

SEQ ID NO: 1251795 - DNA, 15 bp, Homo sapiens
agtctccccttgcag

SEQ ID NO: 1251796 - DNA, 20 bp, Homo sapiens
agtctccccttgcagcctgg

SEQ ID NO: 1251797 - DNA, 21 bp, Homo sapiens
agtctccctccgactccagat

SEQ ID NO: 1251798 - DNA, 17 bp, Homo sapiens
agtctccctttcccttc

SEQ ID NO: 1251799 - DNA, 11 bp, Homo sapiens
agtctcctcaa

SEQ ID NO: 1251800 - DNA, 14 bp, Homo sapiens
agtctcctcactct

SEQ ID NO: 1251801 - DNA, 21 bp, Homo sapiens
agtctcctcactctgtccctg

SEQ ID NO: 1251802 - DNA, 20 bp, Homo sapiens
agtctcctcccctactctgc

SEQ ID NO: 1251803 - DNA, 11 bp, Homo sapiens
agtctcctctc

SEQ ID NO: 1251804 - DNA, 11 bp, Homo sapiens
agtctcctggg

SEQ ID NO: 1251805 - DNA, 19 bp, Homo sapiens
agtctcctttgcactgagg

SEQ ID NO: 1251806 - DNA, 21 bp, Homo sapiens
agtctcctttgcactgagggc

SEQ ID NO: 1251807 - DNA, 23 bp, Homo sapiens
agtctcctttgcactgagggcca

SEQ ID NO: 1251808 - DNA, 16 bp, Homo sapiens
agtctctatattatgt

SEQ ID NO: 1251809 - DNA, 18 bp, Homo sapiens
agtctctatattatgtct

SEQ ID NO: 1251810 - DNA, 19 bp, Homo sapiens
agtctctatattatgtctt

SEQ ID NO: 1251811 - DNA, 13 bp, Homo sapiens
agtctctctgtga

SEQ ID NO: 1251812 - DNA, 20 bp, Homo sapiens
agtctctctgtgaatacaat

SEQ ID NO: 1251813 - DNA, 21 bp, Homo sapiens
agtctctctgtgaatacaatt

SEQ ID NO: 1251814 - DNA, 14 bp, Homo sapiens
agtctctcttctct

SEQ ID NO: 1251815 - DNA, 18 bp, Homo sapiens
agtctctcttctctccag

SEQ ID NO: 1251816 - DNA, 21 bp, Homo sapiens
agtctctcttctctccagctg

SEQ ID NO: 1251817 - DNA, 19 bp, Homo sapiens
agtctctgaatacacagta

SEQ ID NO: 1251818 - DNA, 16 bp, Homo sapiens
agtctctgccacccac

SEQ ID NO: 1251819 - DNA, 16 bp, Homo sapiens
agtctctgtgctttga

SEQ ID NO: 1251820 - DNA, 11 bp, Homo sapiens
agtctcttcca

SEQ ID NO: 1251821 - DNA, 15 bp, Homo sapiens
agtctcttctccact

SEQ ID NO: 1251822 - DNA, 22 bp, Homo sapiens
agtctctttaatcttcagtttt

SEQ ID NO: 1251823 - DNA, 16 bp, Homo sapiens
agtctctttcttcctt

SEQ ID NO: 1251824 - DNA, 19 bp, Homo sapiens
agtctcttttttattctgt

SEQ ID NO: 1251825 - DNA, 15 bp, Homo sapiens
agtctgaaagacaga

SEQ ID NO: 1251826 - DNA, 16 bp, Homo sapiens
agtctgaacagctgta

SEQ ID NO: 1251827 - DNA, 18 bp, Homo sapiens
agtctgaacccttgtgct

SEQ ID NO: 1251828 - DNA, 22 bp, Homo sapiens
agtctgaagtgcctactggggg

SEQ ID NO: 1251829 - DNA, 17 bp, Homo sapiens
agtctgaagtttcattt

SEQ ID NO: 1251830 - DNA, 16 bp, Homo sapiens
agtctgaatttttaaa

SEQ ID NO: 1251831 - DNA, 13 bp, Homo sapiens
agtctgagaaata

SEQ ID NO: 1251832 - DNA, 14 bp, Homo sapiens
agtctgagaaatag

SEQ ID NO: 1251833 - DNA, 12 bp, Homo sapiens
agtctgagcccc

SEQ ID NO: 1251834 - DNA, 15 bp, Homo sapiens
agtctgaggactgtc

SEQ ID NO: 1251835 - DNA, 16 bp, Homo sapiens
agtctgagtaaaatct

SEQ ID NO: 1251836 - DNA, 16 bp, Homo sapiens
agtctgagtcctgtct

SEQ ID NO: 1251837 - DNA, 20 bp, Homo sapiens
agtctgccttcccccaaccc

SEQ ID NO: 1251838 - DNA, 13 bp, Homo sapiens
agtctgctccacc

SEQ ID NO: 1251839 - DNA, 14 bp, Homo sapiens
agtctgctctgctg

SEQ ID NO: 1251840 - DNA, 16 bp, Homo sapiens
agtctgctctgctgct

SEQ ID NO: 1251841 - DNA, 15 bp, Homo sapiens
agtctgctgccctcc

SEQ ID NO: 1251842 - DNA, 17 bp, Homo sapiens
agtctgctgccctccat

SEQ ID NO: 1251843 - DNA, 18 bp, Homo sapiens
agtctgctgccctccatc

SEQ ID NO: 1251844 - DNA, 20 bp, Homo sapiens
agtctgctgccctccatccc

SEQ ID NO: 1251845 - DNA, 18 bp, Homo sapiens
agtctggaaaacagaaac

SEQ ID NO: 1251846 - DNA, 11 bp, Homo sapiens
agtctggacct

SEQ ID NO: 1251847 - DNA, 14 bp, Homo sapiens
agtctggacctcca

SEQ ID NO: 1251848 - DNA, 16 bp, Homo sapiens
agtctggacctccatc

SEQ ID NO: 1251849 - DNA, 19 bp, Homo sapiens
agtctggccactgtcaagg

SEQ ID NO: 1251850 - DNA, 22 bp, Homo sapiens
agtctgggacacaaaactccgc

SEQ ID NO: 1251851 - DNA, 17 bp, Homo sapiens
agtctgggcctctgact

SEQ ID NO: 1251852 - DNA, 14 bp, Homo sapiens
agtctgggctgccg

SEQ ID NO: 1251853 - DNA, 16 bp, Homo sapiens
agtctggggacctggc

SEQ ID NO: 1251854 - DNA, 21 bp, Homo sapiens
agtctgggtctgggtttggat

SEQ ID NO: 1251855 - DNA, 20 bp, Homo sapiens
agtctggtttctagacttgt

SEQ ID NO: 1251856 - DNA, 23 bp, Homo sapiens
agtctgtcagggccttggcccag

SEQ ID NO: 1251857 - DNA, 13 bp, Homo sapiens
agtctgtcctgtg

SEQ ID NO: 1251858 - DNA, 13 bp, Homo sapiens
agtctgtccttga

SEQ ID NO: 1251859 - DNA, 13 bp, Homo sapiens
agtctgtctactg

SEQ ID NO: 1251860 - DNA, 18 bp, Homo sapiens
agtctgtctactgtggtg

SEQ ID NO: 1251861 - DNA, 19 bp, Homo sapiens
agtctgtctactgtggtga

SEQ ID NO: 1251862 - DNA, 17 bp, Homo sapiens
agtctgtctcaaaagaa

SEQ ID NO: 1251863 - DNA, 21 bp, Homo sapiens
agtctgtctttcctgaaccat

SEQ ID NO: 1251864 - DNA, 20 bp, Homo sapiens
agtctgtgccacgtgtttgt

SEQ ID NO: 1251865 - DNA, 17 bp, Homo sapiens
agtctgtggatcagaga

SEQ ID NO: 1251866 - DNA, 15 bp, Homo sapiens
agtctgtgtgaaggt

SEQ ID NO: 1251867 - DNA, 21 bp, Homo sapiens
agtctgtgttcaaaaatatat

SEQ ID NO: 1251868 - DNA, 15 bp, Homo sapiens
agtctgttcactgca

SEQ ID NO: 1251869 - DNA, 21 bp, Homo sapiens
agtgattctgtttgccttttg

SEQ ID NO: 1251870 - DNA, 14 bp, Homo sapiens
agtgattgcagctt

SEQ ID NO: 1251871 - DNA, 17 bp, Homo sapiens
agtgattgtcttaatat

SEQ ID NO: 1251872 - DNA, 18 bp, Homo sapiens
agtgatttagttgtggaa

SEQ ID NO: 1251873 - DNA, 15 bp, Homo sapiens
agtgatttctagaaa

SEQ ID NO: 1251874 - DNA, 20 bp, Homo sapiens
agtgattttatttttgcaaa

SEQ ID NO: 1251875 - DNA, 13 bp, Homo sapiens
agtgcaaaaaaca

SEQ ID NO: 1251876 - DNA, 14 bp, Homo sapiens
agtgcaaaactgtg

SEQ ID NO: 1251877 - DNA, 17 bp, Homo sapiens
agtgcaacatctctgaa

SEQ ID NO: 1251878 - DNA, 24 bp, Homo sapiens
agtgcaacttagatctctcctgca

SEQ ID NO: 1251879 - DNA, 18 bp, Homo sapiens
agtgcaagcccctgctcc

SEQ ID NO: 1251880 - DNA, 16 bp, Homo sapiens
agtgcaatgacacagt

SEQ ID NO: 1251881 - DNA, 18 bp, Homo sapiens
agtgcaatgacacagtct

SEQ ID NO: 1251882 - DNA, 15 bp, Homo sapiens
agtgcaatggtgcaa

SEQ ID NO: 1251883 - DNA, 16 bp, Homo sapiens
agtgcaccaaagagaa

SEQ ID NO: 1251884 - DNA, 21 bp, Homo sapiens
agtgcactgaaagtcacggct

SEQ ID NO: 1251885 - DNA, 13 bp, Homo sapiens
agtgcactgcatt

SEQ ID NO: 1251886 - DNA, 23 bp, Homo sapiens
agtgcactgcattcctgtgccct

SEQ ID NO: 1251887 - DNA, 21 bp, Homo sapiens
agtgcactttctaatgtttct

SEQ ID NO: 1251888 - DNA, 19 bp, Homo sapiens
agtgcagaacacctggccg

SEQ ID NO: 1251889 - DNA, 19 bp, Homo sapiens
agtgcagatgagtgtgtgt

SEQ ID NO: 1251890 - DNA, 12 bp, Homo sapiens
agtgcagccaaa

SEQ ID NO: 1251891 - DNA, 14 bp, Homo sapiens
agtgcagcccttcc

SEQ ID NO: 1251892 - DNA, 15 bp, Homo sapiens
agtgcagcccttcct

SEQ ID NO: 1251893 - DNA, 20 bp, Homo sapiens
agtgcagcccttcctcctga

SEQ ID NO: 1251894 - DNA, 16 bp, Homo sapiens
agtgcagccttctcca

SEQ ID NO: 1251895 - DNA, 17 bp, Homo sapiens
agtgcagctgattttaa

SEQ ID NO: 1251896 - DNA, 18 bp, Homo sapiens
agtgcagctgattttaac

SEQ ID NO: 1251897 - DNA, 15 bp, Homo sapiens
agtgcaggctggcac

SEQ ID NO: 1251898 - DNA, 15 bp, Homo sapiens
agtgcagggaggaaa

SEQ ID NO: 1251899 - DNA, 15 bp, Homo sapiens
agtgcagtatagaat

SEQ ID NO: 1251900 - DNA, 17 bp, Homo sapiens
agtgcagtccatttcct

SEQ ID NO: 1251901 - DNA, 16 bp, Homo sapiens
agtgcagtcctgatca

SEQ ID NO: 1251902 - DNA, 23 bp, Homo sapiens
agtgcatagctactaaaatcagt

SEQ ID NO: 1251903 - DNA, 13 bp, Homo sapiens
agtgcatctactt

SEQ ID NO: 1251904 - DNA, 17 bp, Homo sapiens
agtgcatctcagcccac

SEQ ID NO: 1251905 - DNA, 16 bp, Homo sapiens
agtgcatgacgtttaa

SEQ ID NO: 1251906 - DNA, 14 bp, Homo sapiens
agtgcatgcatgtt

SEQ ID NO: 1251907 - DNA, 22 bp, Homo sapiens
agtgcatgtgaagcatgctttg

SEQ ID NO: 1251908 - DNA, 17 bp, Homo sapiens
agtgcatttaaggagat

SEQ ID NO: 1251909 - DNA, 17 bp, Homo sapiens
agtgcattttgtttctg

SEQ ID NO: 1251910 - DNA, 19 bp, Homo sapiens
agtgcattttgtttctgta

SEQ ID NO: 1251911 - DNA, 18 bp, Homo sapiens
agtgcatttttaaacttg

SEQ ID NO: 1251912 - DNA, 19 bp, Homo sapiens
agtgcatttttaaacttga

SEQ ID NO: 1251913 - DNA, 21 bp, Homo sapiens
agtgcatttttaaacttgaaa

SEQ ID NO: 1251914 - DNA, 13 bp, Homo sapiens
agtgccacagcct

SEQ ID NO: 1251915 - DNA, 19 bp, Homo sapiens
agtgccacagcctgctggc

SEQ ID NO: 1251916 - DNA, 23 bp, Homo sapiens
agtgccacagcctgctggcaggg

SEQ ID NO: 1251917 - DNA, 13 bp, Homo sapiens
agtgccacccgca

SEQ ID NO: 1251918 - DNA, 15 bp, Homo sapiens
agtgccacccgcaga

SEQ ID NO: 1251919 - DNA, 15 bp, Homo sapiens
agtgccacctatgcc

SEQ ID NO: 1251920 - DNA, 17 bp, Homo sapiens
agtgccacctatgcctg

SEQ ID NO: 1251921 - DNA, 17 bp, Homo sapiens
agtgccactgttgtttt

SEQ ID NO: 1251922 - DNA, 18 bp, Homo sapiens
agtgccacttaatgtatg

SEQ ID NO: 1251923 - DNA, 17 bp, Homo sapiens
agtgccacttgacattc

SEQ ID NO: 1251924 - DNA, 20 bp, Homo sapiens
agtgccacttgacattcctt

SEQ ID NO: 1251925 - DNA, 15 bp, Homo sapiens
agtgccagaggtggg

SEQ ID NO: 1251926 - DNA, 18 bp, Homo sapiens
agtgccagctccagtgcc

SEQ ID NO: 1251927 - DNA, 22 bp, Homo sapiens
agtgccagctccagtgccgctc

SEQ ID NO: 1251928 - DNA, 15 bp, Homo sapiens
agtgccaggaccagc

SEQ ID NO: 1251929 - DNA, 12 bp, Homo sapiens
agtgccaggagg

SEQ ID NO: 1251930 - DNA, 18 bp, Homo sapiens
agtgccaggagggcacag

SEQ ID NO: 1251931 - DNA, 21 bp, Homo sapiens
agtgccagggtgggctgggga

SEQ ID NO: 1251932 - DNA, 16 bp, Homo sapiens
agtgccattaacaaat

SEQ ID NO: 1251933 - DNA, 16 bp, Homo sapiens
agtgccattactactg

SEQ ID NO: 1251934 - DNA, 20 bp, Homo sapiens
agtgccattactactgtaca

SEQ ID NO: 1251935 - DNA, 16 bp, Homo sapiens
agtgcccaccgccctc

SEQ ID NO: 1251936 - DNA, 18 bp, Homo sapiens
agtgcccaccgccctcct

SEQ ID NO: 1251937 - DNA, 19 bp, Homo sapiens
agtgccccacctcccgccc

SEQ ID NO: 1251938 - DNA, 16 bp, Homo sapiens
agtgccccacttctgg

SEQ ID NO: 1251939 - DNA, 13 bp, Homo sapiens
agtgccccagact

SEQ ID NO: 1251940 - DNA, 20 bp, Homo sapiens
agtgccccagggagtccagg

SEQ ID NO: 1251941 - DNA, 22 bp, Homo sapiens
agtgccccagggagtccagggt

SEQ ID NO: 1251942 - DNA, 20 bp, Homo sapiens
agtgccccattcttttgtaa

SEQ ID NO: 1251943 - DNA, 11 bp, Homo sapiens
agtgcccctgc

SEQ ID NO: 1251944 - DNA, 13 bp, Homo sapiens
agtgcccctgctg

SEQ ID NO: 1251945 - DNA, 21 bp, Homo sapiens
agtgcccctgctgcctcccca

SEQ ID NO: 1251946 - DNA, 19 bp, Homo sapiens
agtgcccctgtcccacctg

SEQ ID NO: 1251947 - DNA, 22 bp, Homo sapiens
agtgcccctgtcccacctggct

SEQ ID NO: 1251948 - DNA, 23 bp, Homo sapiens
agtgcccctgtcccacctggctc

SEQ ID NO: 1251949 - DNA, 19 bp, Homo sapiens
agtgcccgcctaggagttg

SEQ ID NO: 1251950 - DNA, 13 bp, Homo sapiens
agtgccctccagc

SEQ ID NO: 1251951 - DNA, 14 bp, Homo sapiens
agtgccctccagcc

SEQ ID NO: 1251952 - DNA, 17 bp, Homo sapiens
agtgccctccagccccg

SEQ ID NO: 1251953 - DNA, 18 bp, Homo sapiens
agtgccctccagccccgc

SEQ ID NO: 1251954 - DNA, 17 bp, Homo sapiens
agtgccgcaaattgtac

SEQ ID NO: 1251955 - DNA, 14 bp, Homo sapiens
agtgccgctcctgc

SEQ ID NO: 1251956 - DNA, 15 bp, Homo sapiens
agtgccgctcctgct

SEQ ID NO: 1251957 - DNA, 17 bp, Homo sapiens
agtgccgctcctgcttc

SEQ ID NO: 1251958 - DNA, 18 bp, Homo sapiens
agtgccgctcctgcttcc

SEQ ID NO: 1251959 - DNA, 23 bp, Homo sapiens
agtgccgctcctgcttcccctcc

SEQ ID NO: 1251960 - DNA, 18 bp, Homo sapiens
agtgcctaaaattgtatg

SEQ ID NO: 1251961 - DNA, 16 bp, Homo sapiens
agtgcctaaagtgctg

SEQ ID NO: 1251962 - DNA, 13 bp, Homo sapiens
agtgcctcacctc

SEQ ID NO: 1251963 - DNA, 17 bp, Homo sapiens
agtgcctcacctcgaaa

SEQ ID NO: 1251964 - DNA, 21 bp, Homo sapiens
agtgcctcacctcgaaaggag

SEQ ID NO: 1251965 - DNA, 16 bp, Homo sapiens
agtgcctccacatgct

SEQ ID NO: 1251966 - DNA, 22 bp, Homo sapiens
agtgcctccacatgctgcctgg

SEQ ID NO: 1251967 - DNA, 12 bp, Homo sapiens
agtgcctcctgg

SEQ ID NO: 1251968 - DNA, 14 bp, Homo sapiens
agtgcctcctggcc

SEQ ID NO: 1251969 - DNA, 13 bp, Homo sapiens
agtgcctcgaggc

SEQ ID NO: 1251970 - DNA, 17 bp, Homo sapiens
agtgcctcttccagtga

SEQ ID NO: 1251971 - DNA, 15 bp, Homo sapiens
agtgcctctttgaag

SEQ ID NO: 1251972 - DNA, 18 bp, Homo sapiens
agtgcctgacacactaac

SEQ ID NO: 1251973 - DNA, 23 bp, Homo sapiens
agtgcctgcattcccaggaaaat

SEQ ID NO: 1251974 - DNA, 11 bp, Homo sapiens
agtgcctgcca

SEQ ID NO: 1251975 - DNA, 17 bp, Homo sapiens
agtgcctgccactctct

SEQ ID NO: 1251976 - DNA, 23 bp, Homo sapiens
agtgcctgccactctctgggact

SEQ ID NO: 1251977 - DNA, 12 bp, Homo sapiens
agtgcctggagt

SEQ ID NO: 1251978 - DNA, 17 bp, Homo sapiens
agtgccttacctcctgc

SEQ ID NO: 1251979 - DNA, 22 bp, Homo sapiens
agtgccttacctcctgcccagg

SEQ ID NO: 1251980 - DNA, 23 bp, Homo sapiens
agtgccttacctcctgcccagga

SEQ ID NO: 1251981 - DNA, 14 bp, Homo sapiens
agtgccttagggga

SEQ ID NO: 1251982 - DNA, 15 bp, Homo sapiens
agtgccttccataat

SEQ ID NO: 1251983 - DNA, 19 bp, Homo sapiens
agtgccttcctgtttttca

SEQ ID NO: 1251984 - DNA, 12 bp, Homo sapiens
agtgccttctct

SEQ ID NO: 1251985 - DNA, 14 bp, Homo sapiens
agtgccttctgggc

SEQ ID NO: 1251986 - DNA, 14 bp, Homo sapiens
agtgccttgcccac

SEQ ID NO: 1251987 - DNA, 19 bp, Homo sapiens
agtgcctttatctcagcca

SEQ ID NO: 1251988 - DNA, 20 bp, Homo sapiens
agtgccttttgcagaagagg

SEQ ID NO: 1251989 - DNA, 14 bp, Homo sapiens
agtgcctttttcct

SEQ ID NO: 1251990 - DNA, 17 bp, Homo sapiens
agtgcctttttccttat

SEQ ID NO: 1251991 - DNA, 23 bp, Homo sapiens
agtggatgatatacacagtggca

SEQ ID NO: 1251992 - DNA, 15 bp, Homo sapiens
agtggatgatgtttc

SEQ ID NO: 1251993 - DNA, 16 bp, Homo sapiens
agtggatggcccagca

SEQ ID NO: 1251994 - DNA, 17 bp, Homo sapiens
agtggatgtttttaatg

SEQ ID NO: 1251995 - DNA, 12 bp, Homo sapiens
agtggattccca

SEQ ID NO: 1251996 - DNA, 15 bp, Homo sapiens
agtggcacggagaga

SEQ ID NO: 1251997 - DNA, 14 bp, Homo sapiens
agtggcactgaagt

SEQ ID NO: 1251998 - DNA, 20 bp, Homo sapiens
agtggcactgaagtggccct

SEQ ID NO: 1251999 - DNA, 22 bp, Homo sapiens
agtggcacttctgccttgagtc

SEQ ID NO: 1252000 - DNA, 13 bp, Homo sapiens
agtggcagccatg

SEQ ID NO: 1252001 - DNA, 14 bp, Homo sapiens
agtggcagccatgc

SEQ ID NO: 1252002 - DNA, 16 bp, Homo sapiens
agtggcagccatgcct

SEQ ID NO: 1252003 - DNA, 17 bp, Homo sapiens
agtggcagccatgcctc

SEQ ID NO: 1252004 - DNA, 21 bp, Homo sapiens
agtggcagctgtcccctctcc

SEQ ID NO: 1252005 - DNA, 22 bp, Homo sapiens
agtggcagctgtcccctctccc

SEQ ID NO: 1252006 - DNA, 16 bp, Homo sapiens
agtggcatgtgctgtg

SEQ ID NO: 1252007 - DNA, 22 bp, Homo sapiens
agtggcatgttttgtgcatttg

SEQ ID NO: 1252008 - DNA, 18 bp, Homo sapiens
agtggcatttgtcaggga

SEQ ID NO: 1252009 - DNA, 19 bp, Homo sapiens
agtggccaaataggaggga

SEQ ID NO: 1252010 - DNA, 21 bp, Homo sapiens
agtggccaaataggagggaga

SEQ ID NO: 1252011 - DNA, 18 bp, Homo sapiens
agtggccaagaagcagtg

SEQ ID NO: 1252012 - DNA, 20 bp, Homo sapiens
agtggccaagcctgctgtgt

SEQ ID NO: 1252013 - DNA, 20 bp, Homo sapiens
agtggccacgttcagggagg

SEQ ID NO: 1252014 - DNA, 21 bp, Homo sapiens
agtggccacgttcagggaggg

SEQ ID NO: 1252015 - DNA, 14 bp, Homo sapiens
agtggccactaagc

SEQ ID NO: 1252016 - DNA, 10 bp, Homo sapiens
agtggccagc

SEQ ID NO: 1252017 - DNA, 18 bp, Homo sapiens
agtggccagccagtgcca

SEQ ID NO: 1252018 - DNA, 16 bp, Homo sapiens
agtggccagcgccagg

SEQ ID NO: 1252019 - DNA, 23 bp, Homo sapiens
agtggccagcgccagggcccagg

SEQ ID NO: 1252020 - DNA, 19 bp, Homo sapiens
agtggcccatggcatttta

SEQ ID NO: 1252021 - DNA, 15 bp, Homo sapiens
agtggcccccgggcc

SEQ ID NO: 1252022 - DNA, 17 bp, Homo sapiens
agtggcccccgggcctg

SEQ ID NO: 1252023 - DNA, 21 bp, Homo sapiens
agtggcccccgggcctgcaca

SEQ ID NO: 1252024 - DNA, 14 bp, Homo sapiens
agtggccctccctc

SEQ ID NO: 1252025 - DNA, 16 bp, Homo sapiens
agtggccctccctcag

SEQ ID NO: 1252026 - DNA, 20 bp, Homo sapiens
agtggcctcaaccctccctc

SEQ ID NO: 1252027 - DNA, 12 bp, Homo sapiens
agtggcctccct

SEQ ID NO: 1252028 - DNA, 14 bp, Homo sapiens
agtggcctccctgc

SEQ ID NO: 1252029 - DNA, 14 bp, Homo sapiens
agtggcctggccag

SEQ ID NO: 1252030 - DNA, 22 bp, Homo sapiens
agtggcctggccaggagctctt

SEQ ID NO: 1252031 - DNA, 15 bp, Homo sapiens
agtggcctttcagtg

SEQ ID NO: 1252032 - DNA, 14 bp, Homo sapiens
agtggctcaacatt

SEQ ID NO: 1252033 - DNA, 14 bp, Homo sapiens
agtggctcacgcct

SEQ ID NO: 1252034 - DNA, 14 bp, Homo sapiens
agtggctccccacc

SEQ ID NO: 1252035 - DNA, 15 bp, Homo sapiens
agtggctccccacct

SEQ ID NO: 1252036 - DNA, 18 bp, Homo sapiens
agtggctccccacctgga

SEQ ID NO: 1252037 - DNA, 23 bp, Homo sapiens
agtggctccccacctggacacac

SEQ ID NO: 1252038 - DNA, 18 bp, Homo sapiens
agtggctgcggtgtttgg

SEQ ID NO: 1252039 - DNA, 16 bp, Homo sapiens
agtggctggaattaaa

SEQ ID NO: 1252040 - DNA, 20 bp, Homo sapiens
agtggctgggtgggcccaga

SEQ ID NO: 1252041 - DNA, 15 bp, Homo sapiens
agtggctggtagaaa

SEQ ID NO: 1252042 - DNA, 18 bp, Homo sapiens
agtggctggtagaaaaag

SEQ ID NO: 1252043 - DNA, 14 bp, Homo sapiens
agtggctggtgccc

SEQ ID NO: 1252044 - DNA, 19 bp, Homo sapiens
agtggctggtgcccatgaa

SEQ ID NO: 1252045 - DNA, 19 bp, Homo sapiens
agtggctgttcatgctcca

SEQ ID NO: 1252046 - DNA, 17 bp, Homo sapiens
agtgggaactgtgcaaa

SEQ ID NO: 1252047 - DNA, 17 bp, Homo sapiens
agtgggaagcccatcct

SEQ ID NO: 1252048 - DNA, 21 bp, Homo sapiens
agtgggaagcccatcctgacc

SEQ ID NO: 1252049 - DNA, 15 bp, Homo sapiens
agtgggacagagtct

SEQ ID NO: 1252050 - DNA, 15 bp, Homo sapiens
agtgggacagcccag

SEQ ID NO: 1252051 - DNA, 19 bp, Homo sapiens
agtgggacagggcatggcc

SEQ ID NO: 1252052 - DNA, 21 bp, Homo sapiens
agtgggacagggcatggccag

SEQ ID NO: 1252053 - DNA, 15 bp, Homo sapiens
agtgggacattagta

SEQ ID NO: 1252054 - DNA, 14 bp, Homo sapiens
agtgggacttggag

SEQ ID NO: 1252055 - DNA, 22 bp, Homo sapiens
agtgggacttggagagcaaagg

SEQ ID NO: 1252056 - DNA, 16 bp, Homo sapiens
agtgggagaggctggg

SEQ ID NO: 1252057 - DNA, 16 bp, Homo sapiens
agtgggagctgagctg

SEQ ID NO: 1252058 - DNA, 13 bp, Homo sapiens
agtgggaggggca

SEQ ID NO: 1252059 - DNA, 17 bp, Homo sapiens
agtgggaggggcaggct

SEQ ID NO: 1252060 - DNA, 22 bp, Homo sapiens
agtgggagggtaccagcagaaa

SEQ ID NO: 1252061 - DNA, 12 bp, Homo sapiens
agtgggaggtca

SEQ ID NO: 1252062 - DNA, 22 bp, Homo sapiens
agtgggataaaggcccagactc

SEQ ID NO: 1252063 - DNA, 15 bp, Homo sapiens
agtgggcacctcaga

SEQ ID NO: 1252064 - DNA, 17 bp, Homo sapiens
agtgggccagccacaga

SEQ ID NO: 1252065 - DNA, 13 bp, Homo sapiens
agtgggccaggac

SEQ ID NO: 1252066 - DNA, 21 bp, Homo sapiens
agtgggccaggacaggcccgg

SEQ ID NO: 1252067 - DNA, 12 bp, Homo sapiens
agtgggccaggg

SEQ ID NO: 1252068 - DNA, 15 bp, Homo sapiens
agtgggccagggctg

SEQ ID NO: 1252069 - DNA, 14 bp, Homo sapiens
agtgggccagtgtg

SEQ ID NO: 1252070 - DNA, 18 bp, Homo sapiens
agtgggcctgctgaggcc

SEQ ID NO: 1252071 - DNA, 20 bp, Homo sapiens
agtgggctgatgctgggacc

SEQ ID NO: 1252072 - DNA, 23 bp, Homo sapiens
agtgggctgcacgctcccctcca

SEQ ID NO: 1252073 - DNA, 15 bp, Homo sapiens
agtgggctgcagcag

SEQ ID NO: 1252074 - DNA, 16 bp, Homo sapiens
agtgggctgcagcagc

SEQ ID NO: 1252075 - DNA, 17 bp, Homo sapiens
agtgggcttggagatgg

SEQ ID NO: 1252076 - DNA, 17 bp, Homo sapiens
agtggggacagggaggg

SEQ ID NO: 1252077 - DNA, 18 bp, Homo sapiens
agtggggacagggagggg

SEQ ID NO: 1252078 - DNA, 15 bp, Homo sapiens
agtggggcctgggag

SEQ ID NO: 1252079 - DNA, 17 bp, Homo sapiens
agtggggctaaatgaag

SEQ ID NO: 1252080 - DNA, 16 bp, Homo sapiens
agtggggctgcaggca

SEQ ID NO: 1252081 - DNA, 19 bp, Homo sapiens
agtggggctgcaggcaggc

SEQ ID NO: 1252082 - DNA, 17 bp, Homo sapiens
agtgggggcagcccagg

SEQ ID NO: 1252083 - DNA, 13 bp, Homo sapiens
agtggggggagga

SEQ ID NO: 1252084 - DNA, 18 bp, Homo sapiens
agtggggggtcgtgggcc

SEQ ID NO: 1252085 - DNA, 18 bp, Homo sapiens
agtggggtctccctctcc

SEQ ID NO: 1252086 - DNA, 22 bp, Homo sapiens
agtggggtctccctctcctgcc

SEQ ID NO: 1252087 - DNA, 23 bp, Homo sapiens
agtggggtctccctctcctgcct

SEQ ID NO: 1252088 - DNA, 16 bp, Homo sapiens
agtggggtgctgggag

SEQ ID NO: 1252089 - DNA, 18 bp, Homo sapiens
agtggggtgctgggagga

SEQ ID NO: 1252090 - DNA, 21 bp, Homo sapiens
agtggggtgctgggaggaggg

SEQ ID NO: 1252091 - DNA, 20 bp, Homo sapiens
agtggggtggtgtcagaccc

SEQ ID NO: 1252092 - DNA, 19 bp, Homo sapiens
agtggggttatctctgtgt

SEQ ID NO: 1252093 - DNA, 21 bp, Homo sapiens
agtggggttatctctgtgtta

SEQ ID NO: 1252094 - DNA, 21 bp, Homo sapiens
agtgggtgacaagagcctgat

SEQ ID NO: 1252095 - DNA, 22 bp, Homo sapiens
agtgggtgatgcttttgctgct

SEQ ID NO: 1252096 - DNA, 19 bp, Homo sapiens
agtggtaaaaaggcctcct

SEQ ID NO: 1252097 - DNA, 19 bp, Homo sapiens
agtggtaaatactgtgaaa

SEQ ID NO: 1252098 - DNA, 16 bp, Homo sapiens
agtggtaatcatatgt

SEQ ID NO: 1252099 - DNA, 22 bp, Homo sapiens
agtggtagagaggtttttcttg

SEQ ID NO: 1252100 - DNA, 14 bp, Homo sapiens
agtggtatagaaat

SEQ ID NO: 1252101 - DNA, 15 bp, Homo sapiens
agtggtatagaaatg

SEQ ID NO: 1252102 - DNA, 18 bp, Homo sapiens
agtggtcactggtcaggg

SEQ ID NO: 1252103 - DNA, 22 bp, Homo sapiens
agtggtcactggtcagggcagt

SEQ ID NO: 1252104 - DNA, 22 bp, Homo sapiens
agtggtcgcttactttgagtga

SEQ ID NO: 1252105 - DNA, 13 bp, Homo sapiens
agtggtctctgct

SEQ ID NO: 1252106 - DNA, 15 bp, Homo sapiens
agtggtctctgctgg

SEQ ID NO: 1252107 - DNA, 13 bp, Homo sapiens
agtggtctttctg

SEQ ID NO: 1252108 - DNA, 15 bp, Homo sapiens
agtggtctttctgga

SEQ ID NO: 1252109 - DNA, 13 bp, Homo sapiens
agtggtgcaatca

SEQ ID NO: 1252110 - DNA, 14 bp, Homo sapiens
agtggtgcagacag

SEQ ID NO: 1252111 - DNA, 13 bp, Homo sapiens
agtggtgccctgg

SEQ ID NO: 1252112 - DNA, 20 bp, Homo sapiens
agtggtggtaaccctggtgg

SEQ ID NO: 1252113 - DNA, 13 bp, Homo sapiens
agttacggaggga

SEQ ID NO: 1252114 - DNA, 17 bp, Homo sapiens
agttacgtataatgctt

SEQ ID NO: 1252115 - DNA, 14 bp, Homo sapiens
agttactactgatt

SEQ ID NO: 1252116 - DNA, 21 bp, Homo sapiens
agttactcccttctcgtgttt

SEQ ID NO: 1252117 - DNA, 23 bp, Homo sapiens
agttactcccttctcgtgtttgc

SEQ ID NO: 1252118 - DNA, 21 bp, Homo sapiens
agttactgtcctgttgattaa

SEQ ID NO: 1252119 - DNA, 18 bp, Homo sapiens
agttactgtgtaattagt

SEQ ID NO: 1252120 - DNA, 22 bp, Homo sapiens
agttacttaattgccagcaaat

SEQ ID NO: 1252121 - DNA, 16 bp, Homo sapiens
agttacttgaatttca

SEQ ID NO: 1252122 - DNA, 15 bp, Homo sapiens
agttacttgtctgag

SEQ ID NO: 1252123 - DNA, 12 bp, Homo sapiens
agttacttgtga

SEQ ID NO: 1252124 - DNA, 15 bp, Homo sapiens
agttactttagatgg

SEQ ID NO: 1252125 - DNA, 19 bp, Homo sapiens
agttactttgtcagaggca

SEQ ID NO: 1252126 - DNA, 16 bp, Homo sapiens
agttactttttgtaga

SEQ ID NO: 1252127 - DNA, 18 bp, Homo sapiens
agttactttttgtagaga

SEQ ID NO: 1252128 - DNA, 21 bp, Homo sapiens
agttagactcttcccctccct

SEQ ID NO: 1252129 - DNA, 21 bp, Homo sapiens
agttagagaactaaactagtt

SEQ ID NO: 1252130 - DNA, 12 bp, Homo sapiens
agttagccctca

SEQ ID NO: 1252131 - DNA, 16 bp, Homo sapiens
agttagctcaggaggc

SEQ ID NO: 1252132 - DNA, 19 bp, Homo sapiens
agttagctcaggaggcttg

SEQ ID NO: 1252133 - DNA, 22 bp, Homo sapiens
agttagctttaacttaaatagt

SEQ ID NO: 1252134 - DNA, 12 bp, Homo sapiens
agttaggaaata

SEQ ID NO: 1252135 - DNA, 14 bp, Homo sapiens
agttaggaaataaa

SEQ ID NO: 1252136 - DNA, 15 bp, Homo sapiens
agttaggaaataaaa

SEQ ID NO: 1252137 - DNA, 16 bp, Homo sapiens
agttaggatagcattt

SEQ ID NO: 1252138 - DNA, 16 bp, Homo sapiens
agttaggattcagatc

SEQ ID NO: 1252139 - DNA, 18 bp, Homo sapiens
agttaggctattcacaac

SEQ ID NO: 1252140 - DNA, 14 bp, Homo sapiens
agttaggggcctta

SEQ ID NO: 1252141 - DNA, 18 bp, Homo sapiens
agttagggggttcttatt

SEQ ID NO: 1252142 - DNA, 21 bp, Homo sapiens
agttaggttgtctccaggcca

SEQ ID NO: 1252143 - DNA, 17 bp, Homo sapiens
agttagtggattactgc

SEQ ID NO: 1252144 - DNA, 23 bp, Homo sapiens
agttagttctctcgtaactggtt

SEQ ID NO: 1252145 - DNA, 14 bp, Homo sapiens
agttagtttgtata

SEQ ID NO: 1252146 - DNA, 22 bp, Homo sapiens
agttagtttgtatatattatta

SEQ ID NO: 1252147 - DNA, 15 bp, Homo sapiens
agttataaaattaaa

SEQ ID NO: 1252148 - DNA, 17 bp, Homo sapiens
agttataataactgaac

SEQ ID NO: 1252149 - DNA, 20 bp, Homo sapiens
agttataataactgaactgt

SEQ ID NO: 1252150 - DNA, 19 bp, Homo sapiens
agttatacagttataaaat

SEQ ID NO: 1252151 - DNA, 15 bp, Homo sapiens
agttatagatgtcta

SEQ ID NO: 1252152 - DNA, 17 bp, Homo sapiens
agttatagatgtctagg

SEQ ID NO: 1252153 - DNA, 15 bp, Homo sapiens
agttatagtttcaga

SEQ ID NO: 1252154 - DNA, 22 bp, Homo sapiens
agttatatgactaatataactt

SEQ ID NO: 1252155 - DNA, 17 bp, Homo sapiens
agttatatgatattctt

SEQ ID NO: 1252156 - DNA, 22 bp, Homo sapiens
agttatattagtgaagatggtt

SEQ ID NO: 1252157 - DNA, 16 bp, Homo sapiens
agttatattcacagtt

SEQ ID NO: 1252158 - DNA, 17 bp, Homo sapiens
agttatattgaatatat

SEQ ID NO: 1252159 - DNA, 19 bp, Homo sapiens
agttatattgaatatatca

SEQ ID NO: 1252160 - DNA, 14 bp, Homo sapiens
agttatattttgca

SEQ ID NO: 1252161 - DNA, 19 bp, Homo sapiens
agttatcatctcaccacac

SEQ ID NO: 1252162 - DNA, 18 bp, Homo sapiens
agttatcatgaattttaa

SEQ ID NO: 1252163 - DNA, 17 bp, Homo sapiens
agttatcttctttatta

SEQ ID NO: 1252164 - DNA, 22 bp, Homo sapiens
agttattaacgggcatgtatta

SEQ ID NO: 1252165 - DNA, 14 bp, Homo sapiens
agttattaacttta

SEQ ID NO: 1252166 - DNA, 11 bp, Homo sapiens
agttattcaaa

SEQ ID NO: 1252167 - DNA, 17 bp, Homo sapiens
agttattcaaatgaagg

SEQ ID NO: 1252168 - DNA, 23 bp, Homo sapiens
agttattcttggtactgttgctt

SEQ ID NO: 1252169 - DNA, 20 bp, Homo sapiens
agttattgctggtgcaaaga

SEQ ID NO: 1252170 - DNA, 12 bp, Homo sapiens
agttattgtaca

SEQ ID NO: 1252171 - DNA, 21 bp, Homo sapiens
agttatttatttattggagat

SEQ ID NO: 1252172 - DNA, 15 bp, Homo sapiens
agttatttcatacca

SEQ ID NO: 1252173 - DNA, 18 bp, Homo sapiens
agttatttcttgtttgtt

SEQ ID NO: 1252174 - DNA, 18 bp, Homo sapiens
agttatttgtataaatta

SEQ ID NO: 1252175 - DNA, 19 bp, Homo sapiens
agttattttaattatcttt

SEQ ID NO: 1252176 - DNA, 20 bp, Homo sapiens
agttattttatttgcttatt

SEQ ID NO: 1252177 - DNA, 19 bp, Homo sapiens
agttattttcttgtttaac

SEQ ID NO: 1252178 - DNA, 15 bp, Homo sapiens
agttatttttctctt

SEQ ID NO: 1252179 - DNA, 16 bp, Homo sapiens
agttatttttctcttt

SEQ ID NO: 1252180 - DNA, 17 bp, Homo sapiens
agttatttttctctttg

SEQ ID NO: 1252181 - DNA, 23 bp, Homo sapiens
agttatttttctttttaagagat

SEQ ID NO: 1252182 - DNA, 13 bp, Homo sapiens
agttcaaaattct

SEQ ID NO: 1252183 - DNA, 18 bp, Homo sapiens
agttcaaagagtctgtct

SEQ ID NO: 1252184 - DNA, 18 bp, Homo sapiens
agttcaaagtgtatattt

SEQ ID NO: 1252185 - DNA, 13 bp, Homo sapiens
agttcaagaaata

SEQ ID NO: 1252186 - DNA, 15 bp, Homo sapiens
agttcaagcctgtgg

SEQ ID NO: 1252187 - DNA, 13 bp, Homo sapiens
agttcaatacagt

SEQ ID NO: 1252188 - DNA, 13 bp, Homo sapiens
agttcacagaggt

SEQ ID NO: 1252189 - DNA, 22 bp, Homo sapiens
agttcacgtaagatacaagttt

SEQ ID NO: 1252190 - DNA, 21 bp, Homo sapiens
agttcactataaatggtgttt

SEQ ID NO: 1252191 - DNA, 20 bp, Homo sapiens
agttcactgttgtacacagt

SEQ ID NO: 1252192 - DNA, 22 bp, Homo sapiens
agttcagatcttaatataaatt

SEQ ID NO: 1252193 - DNA, 15 bp, Homo sapiens
agttcagcaaaactg

SEQ ID NO: 1252194 - DNA, 12 bp, Homo sapiens
agttcagccatt

SEQ ID NO: 1252195 - DNA, 15 bp, Homo sapiens
agttcagctgcttct

SEQ ID NO: 1252196 - DNA, 12 bp, Homo sapiens
agttcagggacc

SEQ ID NO: 1252197 - DNA, 20 bp, Homo sapiens
agttcagtagaattaccatt

SEQ ID NO: 1252198 - DNA, 17 bp, Homo sapiens
agttcagtctgtaggga

SEQ ID NO: 1252199 - DNA, 20 bp, Homo sapiens
agttcatagggtctcttcag

SEQ ID NO: 1252200 - DNA, 16 bp, Homo sapiens
agttcatatatacata

SEQ ID NO: 1252201 - DNA, 16 bp, Homo sapiens
agttcatatgcagaac

SEQ ID NO: 1252202 - DNA, 22 bp, Homo sapiens
agttcatatgtaccatgtacat

SEQ ID NO: 1252203 - DNA, 16 bp, Homo sapiens
agttcatccaatcctc

SEQ ID NO: 1252204 - DNA, 18 bp, Homo sapiens
agttcatccaatcctcac

SEQ ID NO: 1252205 - DNA, 22 bp, Homo sapiens
agttcatccaatcctcactggg

SEQ ID NO: 1252206 - DNA, 18 bp, Homo sapiens
agttcatcgattttctat

SEQ ID NO: 1252207 - DNA, 15 bp, Homo sapiens
agttcattagaaata

SEQ ID NO: 1252208 - DNA, 18 bp, Homo sapiens
agttcattagaaatattt

SEQ ID NO: 1252209 - DNA, 20 bp, Homo sapiens
agttcattattttgtggttc

SEQ ID NO: 1252210 - DNA, 13 bp, Homo sapiens
agttccactgaga

SEQ ID NO: 1252211 - DNA, 15 bp, Homo sapiens
agttccactgagacc

SEQ ID NO: 1252212 - DNA, 14 bp, Homo sapiens
agttccactgagct

SEQ ID NO: 1252213 - DNA, 16 bp, Homo sapiens
agttccagaaagtaaa

SEQ ID NO: 1252214 - DNA, 13 bp, Homo sapiens
agttccagtttct

SEQ ID NO: 1252215 - DNA, 15 bp, Homo sapiens
agttccagtttctcc

SEQ ID NO: 1252216 - DNA, 15 bp, Homo sapiens
agttccatagaaaag

SEQ ID NO: 1252217 - DNA, 17 bp, Homo sapiens
agttcccaaaagattgc

SEQ ID NO: 1252218 - DNA, 18 bp, Homo sapiens
agttcccacattaaagaa

SEQ ID NO: 1252219 - DNA, 18 bp, Homo sapiens
agttcccagacagctttt

SEQ ID NO: 1252220 - DNA, 19 bp, Homo sapiens
agttcccagctccccccgc

SEQ ID NO: 1252221 - DNA, 16 bp, Homo sapiens
agttccccaaatacaa

SEQ ID NO: 1252222 - DNA, 11 bp, Homo sapiens
agttccctcct

SEQ ID NO: 1252223 - DNA, 15 bp, Homo sapiens
agttccctcctgccc

SEQ ID NO: 1252224 - DNA, 21 bp, Homo sapiens
agttccctgaaaacccagaga

SEQ ID NO: 1252225 - DNA, 24 bp, Homo sapiens
agttccctgaaaacccagagagga

SEQ ID NO: 1252226 - DNA, 15 bp, Homo sapiens
agttccctgaaacac

SEQ ID NO: 1252227 - DNA, 16 bp, Homo sapiens
agttcccttggcctca

SEQ ID NO: 1252228 - DNA, 17 bp, Homo sapiens
agttcccttggcctcag

SEQ ID NO: 1252229 - DNA, 18 bp, Homo sapiens
agttcccttggcctcaga

SEQ ID NO: 1252230 - DNA, 17 bp, Homo sapiens
agttccggcctgggcac

SEQ ID NO: 1252231 - DNA, 18 bp, Homo sapiens
agttcctaacaggatgaa

SEQ ID NO: 1252232 - DNA, 15 bp, Homo sapiens
agttcctcgccctgg

SEQ ID NO: 1252233 - DNA, 20 bp, Homo sapiens
agttcctctcccttcccttc

SEQ ID NO: 1252234 - DNA, 22 bp, Homo sapiens
agttcctgagtgcgtggatctg

SEQ ID NO: 1252235 - DNA, 21 bp, Homo sapiens
agttttacagattgcctcctt

SEQ ID NO: 1252236 - DNA, 14 bp, Homo sapiens
agttttacatttta

SEQ ID NO: 1252237 - DNA, 15 bp, Homo sapiens
agttttactgtgatt

SEQ ID NO: 1252238 - DNA, 15 bp, Homo sapiens
agttttagttgcaga

SEQ ID NO: 1252239 - DNA, 24 bp, Homo sapiens
agttttataatccttaaatcttaa

SEQ ID NO: 1252240 - DNA, 14 bp, Homo sapiens
agttttatcatttt

SEQ ID NO: 1252241 - DNA, 20 bp, Homo sapiens
agttttatggcatgatttat

SEQ ID NO: 1252242 - DNA, 22 bp, Homo sapiens
agttttatttttaagaaaaatt

SEQ ID NO: 1252243 - DNA, 15 bp, Homo sapiens
agttttatttttgcc

SEQ ID NO: 1252244 - DNA, 16 bp, Homo sapiens
agttttcagaacctct

SEQ ID NO: 1252245 - DNA, 22 bp, Homo sapiens
agttttcagaacctcttcccca

SEQ ID NO: 1252246 - DNA, 11 bp, Homo sapiens
agttttcagtt

SEQ ID NO: 1252247 - DNA, 13 bp, Homo sapiens
agttttcattgat

SEQ ID NO: 1252248 - DNA, 21 bp, Homo sapiens
agttttccatgaaaacgtttt

SEQ ID NO: 1252249 - DNA, 20 bp, Homo sapiens
agttttccctgcactgtgtc

SEQ ID NO: 1252250 - DNA, 20 bp, Homo sapiens
agttttcccttgaggaaaca

SEQ ID NO: 1252251 - DNA, 23 bp, Homo sapiens
agttttccttctcatctgtgatt

SEQ ID NO: 1252252 - DNA, 13 bp, Homo sapiens
agttttccttgct

SEQ ID NO: 1252253 - DNA, 20 bp, Homo sapiens
agttttccttgctatttcaa

SEQ ID NO: 1252254 - DNA, 12 bp, Homo sapiens
agttttctctta

SEQ ID NO: 1252255 - DNA, 15 bp, Homo sapiens
agttttcttccatga

SEQ ID NO: 1252256 - DNA, 14 bp, Homo sapiens
agttttgaaagaaa

SEQ ID NO: 1252257 - DNA, 14 bp, Homo sapiens
agttttgacattta

SEQ ID NO: 1252258 - DNA, 22 bp, Homo sapiens
agttttgataaagtaattcata

SEQ ID NO: 1252259 - DNA, 14 bp, Homo sapiens
agttttgatgaaat

SEQ ID NO: 1252260 - DNA, 21 bp, Homo sapiens
agttttgatgaaattcttgaa

SEQ ID NO: 1252261 - DNA, 19 bp, Homo sapiens
agttttgatgctgtatttg

SEQ ID NO: 1252262 - DNA, 24 bp, Homo sapiens
agttttgattaatgtttcttaaat

SEQ ID NO: 1252263 - DNA, 14 bp, Homo sapiens
agttttgattttgg

SEQ ID NO: 1252264 - DNA, 16 bp, Homo sapiens
agttttgcatttatgg

SEQ ID NO: 1252265 - DNA, 13 bp, Homo sapiens
agttttggaatct

SEQ ID NO: 1252266 - DNA, 20 bp, Homo sapiens
agttttggaatctaagctgt

SEQ ID NO: 1252267 - DNA, 21 bp, Homo sapiens
agttttggaatctaagctgtt

SEQ ID NO: 1252268 - DNA, 22 bp, Homo sapiens
agttttgtaaaaactgaagaat

SEQ ID NO: 1252269 - DNA, 22 bp, Homo sapiens
agttttgtaaaagaaatcatgt

SEQ ID NO: 1252270 - DNA, 13 bp, Homo sapiens
agttttgtaactt

SEQ ID NO: 1252271 - DNA, 17 bp, Homo sapiens
agttttgtaagccctct

SEQ ID NO: 1252272 - DNA, 20 bp, Homo sapiens
agttttgtataaataataaa

SEQ ID NO: 1252273 - DNA, 15 bp, Homo sapiens
agttttgtctgtctc

SEQ ID NO: 1252274 - DNA, 16 bp, Homo sapiens
agttttgtgtttgttg

SEQ ID NO: 1252275 - DNA, 19 bp, Homo sapiens
agttttgtgtttgttgtag

SEQ ID NO: 1252276 - DNA, 19 bp, Homo sapiens
agttttgttccagaggagc

SEQ ID NO: 1252277 - DNA, 18 bp, Homo sapiens
agttttgttttaaaatta

SEQ ID NO: 1252278 - DNA, 23 bp, Homo sapiens
agtttttaaaatatattgctgca

SEQ ID NO: 1252279 - DNA, 22 bp, Homo sapiens
agtttttacctaccacagtgtc

SEQ ID NO: 1252280 - DNA, 23 bp, Homo sapiens
agtttttacctaccacagtgtct

SEQ ID NO: 1252281 - DNA, 17 bp, Homo sapiens
agtttttatatgttgta

SEQ ID NO: 1252282 - DNA, 17 bp, Homo sapiens
agtttttatggggctga

SEQ ID NO: 1252283 - DNA, 20 bp, Homo sapiens
agtttttattgcttgttgga

SEQ ID NO: 1252284 - DNA, 20 bp, Homo sapiens
agtttttcaggagcgcaaga

SEQ ID NO: 1252285 - DNA, 21 bp, Homo sapiens
agtttttcaggagcgcaagat

SEQ ID NO: 1252286 - DNA, 18 bp, Homo sapiens
agtttttcattaaataaa

SEQ ID NO: 1252287 - DNA, 13 bp, Homo sapiens
agtttttcatttg

SEQ ID NO: 1252288 - DNA, 14 bp, Homo sapiens
agtttttcatttgt

SEQ ID NO: 1252289 - DNA, 22 bp, Homo sapiens
agtttttcatttgttttgcttt

SEQ ID NO: 1252290 - DNA, 15 bp, Homo sapiens
agtttttcattttaa

SEQ ID NO: 1252291 - DNA, 12 bp, Homo sapiens
agtttttctgtc

SEQ ID NO: 1252292 - DNA, 14 bp, Homo sapiens
agtttttctttaat

SEQ ID NO: 1252293 - DNA, 14 bp, Homo sapiens
agtttttgaaaatt

SEQ ID NO: 1252294 - DNA, 17 bp, Homo sapiens
agtttttgaaaattatg

SEQ ID NO: 1252295 - DNA, 19 bp, Homo sapiens
agtttttgaaaattatgca

SEQ ID NO: 1252296 - DNA, 22 bp, Homo sapiens
agtttttgaaaattatgcaaaa

SEQ ID NO: 1252297 - DNA, 21 bp, Homo sapiens
agtttttgatcaagaatgcaa

SEQ ID NO: 1252298 - DNA, 22 bp, Homo sapiens
agtttttgatcaagaatgcaat

SEQ ID NO: 1252299 - DNA, 23 bp, Homo sapiens
agtttttggagtgttatgtattt

SEQ ID NO: 1252300 - DNA, 23 bp, Homo sapiens
agtttttgtatcttggggcaaga

SEQ ID NO: 1252301 - DNA, 17 bp, Homo sapiens
agtttttgtttgtttct

SEQ ID NO: 1252302 - DNA, 23 bp, Homo sapiens
agttttttaattaagcagaaaca

SEQ ID NO: 1252303 - DNA, 18 bp, Homo sapiens
agttttttacttctctta

SEQ ID NO: 1252304 - DNA, 19 bp, Homo sapiens
agttttttactttggttta

SEQ ID NO: 1252305 - DNA, 17 bp, Homo sapiens
agttttttattatgcat

SEQ ID NO: 1252306 - DNA, 23 bp, Homo sapiens
agttttttcatcttcagttgtct

SEQ ID NO: 1252307 - DNA, 23 bp, Homo sapiens
agttttttgaaattatgtgacat

SEQ ID NO: 1252308 - DNA, 14 bp, Homo sapiens
agttttttgcttct

SEQ ID NO: 1252309 - DNA, 18 bp, Homo sapiens
agttttttgcttctcttt

SEQ ID NO: 1252310 - DNA, 14 bp, Homo sapiens
agtttttttaaatg

SEQ ID NO: 1252311 - DNA, 14 bp, Homo sapiens
agtttttttctgtt

SEQ ID NO: 1252312 - DNA, 16 bp, Homo sapiens
agtttttttctgttta

SEQ ID NO: 1252313 - DNA, 18 bp, Homo sapiens
agttttttttttcttgtc

SEQ ID NO: 1252314 - DNA, 17 bp, Homo sapiens
agtttttttttttccag

SEQ ID NO: 1252315 - DNA, 20 bp, Homo sapiens
ataaaaaaaaaaggatgaaa

SEQ ID NO: 1252316 - DNA, 17 bp, Homo sapiens
ataaaaaaaagaaaaaa

SEQ ID NO: 1252317 - DNA, 16 bp, Homo sapiens
ataaaaaaagaaagca

SEQ ID NO: 1252318 - DNA, 13 bp, Homo sapiens
ataaaaaaatgat

SEQ ID NO: 1252319 - DNA, 15 bp, Homo sapiens
ataaaaaaatgatgc

SEQ ID NO: 1252320 - DNA, 14 bp, Homo sapiens
ataaaaaagaaatc

SEQ ID NO: 1252321 - DNA, 11 bp, Homo sapiens
ataaaaaagat

SEQ ID NO: 1252322 - DNA, 13 bp, Homo sapiens
ataaaaaatagac

SEQ ID NO: 1252323 - DNA, 15 bp, Homo sapiens
ataaaaaatagacat

SEQ ID NO: 1252324 - DNA, 13 bp, Homo sapiens
ataaaaaatatgt

SEQ ID NO: 1252325 - DNA, 14 bp, Homo sapiens
ataaaaaatatgta

SEQ ID NO: 1252326 - DNA, 20 bp, Homo sapiens
ataaaaaatctttagggaat

SEQ ID NO: 1252327 - DNA, 13 bp, Homo sapiens
ataaaaaatggtt

SEQ ID NO: 1252328 - DNA, 17 bp, Homo sapiens
ataaaaaatgtaacatc

SEQ ID NO: 1252329 - DNA, 15 bp, Homo sapiens
ataaaaaattatgac

SEQ ID NO: 1252330 - DNA, 12 bp, Homo sapiens
ataaaaacactt

SEQ ID NO: 1252331 - DNA, 15 bp, Homo sapiens
ataaaaacagattct

SEQ ID NO: 1252332 - DNA, 17 bp, Homo sapiens
ataaaaacagattctga

SEQ ID NO: 1252333 - DNA, 19 bp, Homo sapiens
ataaaaacattttgaagtg

SEQ ID NO: 1252334 - DNA, 17 bp, Homo sapiens
ataaaaactaatttcat

SEQ ID NO: 1252335 - DNA, 19 bp, Homo sapiens
ataaaaactcctgggctta

SEQ ID NO: 1252336 - DNA, 21 bp, Homo sapiens
ataaaaacttattttatcctt

SEQ ID NO: 1252337 - DNA, 16 bp, Homo sapiens
ataaaaagagatgaaa

SEQ ID NO: 1252338 - DNA, 14 bp, Homo sapiens
ataaaaagatcact

SEQ ID NO: 1252339 - DNA, 17 bp, Homo sapiens
ataaaaagcttccatga

SEQ ID NO: 1252340 - DNA, 11 bp, Homo sapiens
ataaaaaggaa

SEQ ID NO: 1252341 - DNA, 12 bp, Homo sapiens
ataaaaaggaaa

SEQ ID NO: 1252342 - DNA, 13 bp, Homo sapiens
ataaaaaggaagg

SEQ ID NO: 1252343 - DNA, 14 bp, Homo sapiens
ataaaaaggacatc

SEQ ID NO: 1252344 - DNA, 12 bp, Homo sapiens
ataaaaaggtgt

SEQ ID NO: 1252345 - DNA, 16 bp, Homo sapiens
ataaaaagtgaacttt

SEQ ID NO: 1252346 - DNA, 17 bp, Homo sapiens
ataaaaagtgaactttt

SEQ ID NO: 1252347 - DNA, 11 bp, Homo sapiens
ataaaaagttc

SEQ ID NO: 1252348 - DNA, 21 bp, Homo sapiens
ataaaaagtttcacaggtcaa

SEQ ID NO: 1252349 - DNA, 23 bp, Homo sapiens
ataaaaagtttcacaggtcaata

SEQ ID NO: 1252350 - DNA, 15 bp, Homo sapiens
ataaaaatatatatt

SEQ ID NO: 1252351 - DNA, 13 bp, Homo sapiens
ataaaaatatgta

SEQ ID NO: 1252352 - DNA, 14 bp, Homo sapiens
ataaaaatgtcttg

SEQ ID NO: 1252353 - DNA, 16 bp, Homo sapiens
ataaaaattctagatt

SEQ ID NO: 1252354 - DNA, 18 bp, Homo sapiens
ataaaaattctagattac

SEQ ID NO: 1252355 - DNA, 14 bp, Homo sapiens
ataaaaattgatga

SEQ ID NO: 1252356 - DNA, 22 bp, Homo sapiens
ataaaacaaaaccaagccttgg

SEQ ID NO: 1252357 - DNA, 19 bp, Homo sapiens
ataaatcattcttactaaa

SEQ ID NO: 1252358 - DNA, 18 bp, Homo sapiens
ataaatgaagcagcttta

SEQ ID NO: 1252359 - DNA, 20 bp, Homo sapiens
ataaatgaagcagctttaaa

SEQ ID NO: 1252360 - DNA, 17 bp, Homo sapiens
ataaatgaattttagtt

SEQ ID NO: 1252361 - DNA, 16 bp, Homo sapiens
ataaatgacacccaga

SEQ ID NO: 1252362 - DNA, 13 bp, Homo sapiens
ataaatgagaaaa

SEQ ID NO: 1252363 - DNA, 23 bp, Homo sapiens
ataaatgcaatattaatgccttt

SEQ ID NO: 1252364 - DNA, 21 bp, Homo sapiens
ataaatgctattttttatttt

SEQ ID NO: 1252365 - DNA, 19 bp, Homo sapiens
ataaatggccagtgctgct

SEQ ID NO: 1252366 - DNA, 22 bp, Homo sapiens
ataaatggccagtgctgcttct

SEQ ID NO: 1252367 - DNA, 13 bp, Homo sapiens
ataaatggtttct

SEQ ID NO: 1252368 - DNA, 12 bp, Homo sapiens
ataaatgtacat

SEQ ID NO: 1252369 - DNA, 18 bp, Homo sapiens
ataaatgtaccagagaga

SEQ ID NO: 1252370 - DNA, 17 bp, Homo sapiens
ataaatgtatcatagaa

SEQ ID NO: 1252371 - DNA, 18 bp, Homo sapiens
ataaatgtatcttattca

SEQ ID NO: 1252372 - DNA, 17 bp, Homo sapiens
ataaatgtgtgtatgtg

SEQ ID NO: 1252373 - DNA, 13 bp, Homo sapiens
ataaattaaaatg

SEQ ID NO: 1252374 - DNA, 14 bp, Homo sapiens
ataaattaaaatgt

SEQ ID NO: 1252375 - DNA, 18 bp, Homo sapiens
ataaattaaaatgtaaaa

SEQ ID NO: 1252376 - DNA, 18 bp, Homo sapiens
ataaattaaataaactgt

SEQ ID NO: 1252377 - DNA, 16 bp, Homo sapiens
ataaattaagaagagt

SEQ ID NO: 1252378 - DNA, 20 bp, Homo sapiens
ataaattaagatcctaaact

SEQ ID NO: 1252379 - DNA, 22 bp, Homo sapiens
ataaattaagatcctaaactct

SEQ ID NO: 1252380 - DNA, 20 bp, Homo sapiens
ataaattactatctgttgaa

SEQ ID NO: 1252381 - DNA, 22 bp, Homo sapiens
ataaattactatctgttgaaaa

SEQ ID NO: 1252382 - DNA, 14 bp, Homo sapiens
ataaattaggacca

SEQ ID NO: 1252383 - DNA, 19 bp, Homo sapiens
ataaattatggcatttcta

SEQ ID NO: 1252384 - DNA, 15 bp, Homo sapiens
ataaattattcagaa

SEQ ID NO: 1252385 - DNA, 11 bp, Homo sapiens
ataaattattt

SEQ ID NO: 1252386 - DNA, 13 bp, Homo sapiens
ataaattcaaaac

SEQ ID NO: 1252387 - DNA, 14 bp, Homo sapiens
ataaattcactttc

SEQ ID NO: 1252388 - DNA, 23 bp, Homo sapiens
ataaattcactttcatttttgat

SEQ ID NO: 1252389 - DNA, 22 bp, Homo sapiens
ataaattcagatatatttttca

SEQ ID NO: 1252390 - DNA, 14 bp, Homo sapiens
ataaattcatcaga

SEQ ID NO: 1252391 - DNA, 15 bp, Homo sapiens
ataaattcatcagaa

SEQ ID NO: 1252392 - DNA, 23 bp, Homo sapiens
ataaattcccaacttctcttgct

SEQ ID NO: 1252393 - DNA, 13 bp, Homo sapiens
ataaattcctctt

SEQ ID NO: 1252394 - DNA, 19 bp, Homo sapiens
ataaattgctaatgttgct

SEQ ID NO: 1252395 - DNA, 18 bp, Homo sapiens
ataaattgctccttgaca

SEQ ID NO: 1252396 - DNA, 13 bp, Homo sapiens
ataaattgtacat

SEQ ID NO: 1252397 - DNA, 18 bp, Homo sapiens
ataaattgtagggcttta

SEQ ID NO: 1252398 - DNA, 15 bp, Homo sapiens
ataaatttaagaaaa

SEQ ID NO: 1252399 - DNA, 17 bp, Homo sapiens
ataaatttaagaaaaca

SEQ ID NO: 1252400 - DNA, 20 bp, Homo sapiens
ataaatttaagaaaacaagt

SEQ ID NO: 1252401 - DNA, 15 bp, Homo sapiens
ataaatttatatgaa

SEQ ID NO: 1252402 - DNA, 21 bp, Homo sapiens
ataaatttatcctataagatg

SEQ ID NO: 1252403 - DNA, 21 bp, Homo sapiens
ataaatttgacttttctgtaa

SEQ ID NO: 1252404 - DNA, 19 bp, Homo sapiens
ataaatttgttgaatattg

SEQ ID NO: 1252405 - DNA, 13 bp, Homo sapiens
ataaattttcaaa

SEQ ID NO: 1252406 - DNA, 22 bp, Homo sapiens
ataaattttttttgtttcatat

SEQ ID NO: 1252407 - DNA, 22 bp, Homo sapiens
ataacaaagcacataactggat

SEQ ID NO: 1252408 - DNA, 16 bp, Homo sapiens
ataacaagatctttca

SEQ ID NO: 1252409 - DNA, 16 bp, Homo sapiens
ataacaatgtgctctc

SEQ ID NO: 1252410 - DNA, 11 bp, Homo sapiens
ataacacacat

SEQ ID NO: 1252411 - DNA, 22 bp, Homo sapiens
ataacacagagagacagacttg

SEQ ID NO: 1252412 - DNA, 22 bp, Homo sapiens
ataacaccgtcccagggctctg

SEQ ID NO: 1252413 - DNA, 15 bp, Homo sapiens
ataacactaaaattt

SEQ ID NO: 1252414 - DNA, 21 bp, Homo sapiens
ataacactgttggcacttata

SEQ ID NO: 1252415 - DNA, 14 bp, Homo sapiens
ataacagaagaaaa

SEQ ID NO: 1252416 - DNA, 19 bp, Homo sapiens
ataacagattttttttgga

SEQ ID NO: 1252417 - DNA, 14 bp, Homo sapiens
ataacagcctcttg

SEQ ID NO: 1252418 - DNA, 17 bp, Homo sapiens
ataacagctcctttatt

SEQ ID NO: 1252419 - DNA, 19 bp, Homo sapiens
ataacagtcttactgcagg

SEQ ID NO: 1252420 - DNA, 15 bp, Homo sapiens
ataacagttatattt

SEQ ID NO: 1252421 - DNA, 14 bp, Homo sapiens
ataacatatgcagt

SEQ ID NO: 1252422 - DNA, 13 bp, Homo sapiens
ataacatgctgcc

SEQ ID NO: 1252423 - DNA, 22 bp, Homo sapiens
ataacatggagctcttgttgca

SEQ ID NO: 1252424 - DNA, 12 bp, Homo sapiens
ataacatttaaa

SEQ ID NO: 1252425 - DNA, 13 bp, Homo sapiens
ataacatttaaag

SEQ ID NO: 1252426 - DNA, 17 bp, Homo sapiens
ataacatttaaattcca

SEQ ID NO: 1252427 - DNA, 20 bp, Homo sapiens
ataacattttatacaatttc

SEQ ID NO: 1252428 - DNA, 20 bp, Homo sapiens
ataaccaacattaaaactca

SEQ ID NO: 1252429 - DNA, 19 bp, Homo sapiens
ataaccaagtgtgctcttt

SEQ ID NO: 1252430 - DNA, 14 bp, Homo sapiens
ataaccagctgtaa

SEQ ID NO: 1252431 - DNA, 20 bp, Homo sapiens
ataaccatgtgaaaaggcaa

SEQ ID NO: 1252432 - DNA, 15 bp, Homo sapiens
ataacccagttactt

SEQ ID NO: 1252433 - DNA, 15 bp, Homo sapiens
ataaccccaggcact

SEQ ID NO: 1252434 - DNA, 16 bp, Homo sapiens
ataaccccaggcactg

SEQ ID NO: 1252435 - DNA, 21 bp, Homo sapiens
ataaccccaggcactgtttgg

SEQ ID NO: 1252436 - DNA, 14 bp, Homo sapiens
ataacctaattaat

SEQ ID NO: 1252437 - DNA, 20 bp, Homo sapiens
ataacctagttaaagaaagg

SEQ ID NO: 1252438 - DNA, 18 bp, Homo sapiens
ataacctatttttttctc

SEQ ID NO: 1252439 - DNA, 15 bp, Homo sapiens
ataacctctggccct

SEQ ID NO: 1252440 - DNA, 18 bp, Homo sapiens
ataacctctggcccttgg

SEQ ID NO: 1252441 - DNA, 22 bp, Homo sapiens
ataacctgatgccataaataca

SEQ ID NO: 1252442 - DNA, 17 bp, Homo sapiens
ataaccttcatttttaa

SEQ ID NO: 1252443 - DNA, 18 bp, Homo sapiens
ataaccttcatttttaag

SEQ ID NO: 1252444 - DNA, 16 bp, Homo sapiens
ataactaagcatcctt

SEQ ID NO: 1252445 - DNA, 19 bp, Homo sapiens
ataactactgtgttcctgg

SEQ ID NO: 1252446 - DNA, 13 bp, Homo sapiens
ataactagacatc

SEQ ID NO: 1252447 - DNA, 16 bp, Homo sapiens
ataactagtgttgctt

SEQ ID NO: 1252448 - DNA, 15 bp, Homo sapiens
ataactcaatggaaa

SEQ ID NO: 1252449 - DNA, 15 bp, Homo sapiens
ataactccaagcaga

SEQ ID NO: 1252450 - DNA, 20 bp, Homo sapiens
ataactccaagcagactcca

SEQ ID NO: 1252451 - DNA, 13 bp, Homo sapiens
ataactctaggga

SEQ ID NO: 1252452 - DNA, 20 bp, Homo sapiens
ataactctagggatataaaa

SEQ ID NO: 1252453 - DNA, 15 bp, Homo sapiens
ataactctctttcct

SEQ ID NO: 1252454 - DNA, 11 bp, Homo sapiens
ataactctgca

SEQ ID NO: 1252455 - DNA, 12 bp, Homo sapiens
ataactctgtaa

SEQ ID NO: 1252456 - DNA, 14 bp, Homo sapiens
ataactgaacatcc

SEQ ID NO: 1252457 - DNA, 18 bp, Homo sapiens
ataactgaaggagaaggt

SEQ ID NO: 1252458 - DNA, 15 bp, Homo sapiens
ataactgaatttgga

SEQ ID NO: 1252459 - DNA, 12 bp, Homo sapiens
ataactgagaat

SEQ ID NO: 1252460 - DNA, 20 bp, Homo sapiens
ataactgcaaagtgaagttg

SEQ ID NO: 1252461 - DNA, 13 bp, Homo sapiens
ataactgcttctt

SEQ ID NO: 1252462 - DNA, 16 bp, Homo sapiens
ataactggattttgaa

SEQ ID NO: 1252463 - DNA, 17 bp, Homo sapiens
ataactggattttgaac

SEQ ID NO: 1252464 - DNA, 18 bp, Homo sapiens
ataactggattttgaacg

SEQ ID NO: 1252465 - DNA, 14 bp, Homo sapiens
ataactgtagctca

SEQ ID NO: 1252466 - DNA, 16 bp, Homo sapiens
ataactgtcttgtttc

SEQ ID NO: 1252467 - DNA, 15 bp, Homo sapiens
ataactgtgtactgt

SEQ ID NO: 1252468 - DNA, 16 bp, Homo sapiens
ataactgtgtactgtt

SEQ ID NO: 1252469 - DNA, 19 bp, Homo sapiens
ataacttaaaaatgtaaat

SEQ ID NO: 1252470 - DNA, 20 bp, Homo sapiens
ataacttaaaaatgtaaata

SEQ ID NO: 1252471 - DNA, 16 bp, Homo sapiens
ataacttaaaatattt

SEQ ID NO: 1252472 - DNA, 15 bp, Homo sapiens
ataacttaatgaaaa

SEQ ID NO: 1252473 - DNA, 18 bp, Homo sapiens
ataacttaatgaaaacaa

SEQ ID NO: 1252474 - DNA, 17 bp, Homo sapiens
ataacttactgtatatg

SEQ ID NO: 1252475 - DNA, 22 bp, Homo sapiens
ataacttcagtcctgctccaga

SEQ ID NO: 1252476 - DNA, 22 bp, Homo sapiens
ataacttctatattttaataga

SEQ ID NO: 1252477 - DNA, 23 bp, Homo sapiens
ataacttctatattttaatagaa

SEQ ID NO: 1252478 - DNA, 13 bp, Homo sapiens
ataacttcttaaa

SEQ ID NO: 1252479 - DNA, 22 bp, Homo sapiens
ataatgtgtctgtgttgcttca

SEQ ID NO: 1252480 - DNA, 23 bp, Homo sapiens
ataatgtgtctgtgttgcttcaa

SEQ ID NO: 1252481 - DNA, 19 bp, Homo sapiens
ataatgttctttaatgttg

SEQ ID NO: 1252482 - DNA, 21 bp, Homo sapiens
ataatgttctttaatgttgtc

SEQ ID NO: 1252483 - DNA, 17 bp, Homo sapiens
ataatgttgtatttaat

SEQ ID NO: 1252484 - DNA, 14 bp, Homo sapiens
ataatgttgttatt

SEQ ID NO: 1252485 - DNA, 19 bp, Homo sapiens
ataatgttgttatttaaag

SEQ ID NO: 1252486 - DNA, 12 bp, Homo sapiens
ataatgtttaaa

SEQ ID NO: 1252487 - DNA, 15 bp, Homo sapiens
ataatgtttaaatca

SEQ ID NO: 1252488 - DNA, 22 bp, Homo sapiens
ataatgtttaatattgagaaag

SEQ ID NO: 1252489 - DNA, 19 bp, Homo sapiens
ataatgtttattaaatgct

SEQ ID NO: 1252490 - DNA, 13 bp, Homo sapiens
ataatgtttgcta

SEQ ID NO: 1252491 - DNA, 14 bp, Homo sapiens
ataatgtttgctat

SEQ ID NO: 1252492 - DNA, 20 bp, Homo sapiens
ataatgtttttcctttctta

SEQ ID NO: 1252493 - DNA, 17 bp, Homo sapiens
ataattaaaaaaaaaac

SEQ ID NO: 1252494 - DNA, 22 bp, Homo sapiens
ataattaaagatgccatagcat

SEQ ID NO: 1252495 - DNA, 17 bp, Homo sapiens
ataattaaatctcttta

SEQ ID NO: 1252496 - DNA, 21 bp, Homo sapiens
ataattaacttaactgaagaa

SEQ ID NO: 1252497 - DNA, 16 bp, Homo sapiens
ataattaattgtcatt

SEQ ID NO: 1252498 - DNA, 15 bp, Homo sapiens
ataattacattccta

SEQ ID NO: 1252499 - DNA, 17 bp, Homo sapiens
ataattatataactgta

SEQ ID NO: 1252500 - DNA, 16 bp, Homo sapiens
ataattatcggaagca

SEQ ID NO: 1252501 - DNA, 21 bp, Homo sapiens
ataattatcggaagcagtgcc

SEQ ID NO: 1252502 - DNA, 13 bp, Homo sapiens
ataattatgaaaa

SEQ ID NO: 1252503 - DNA, 17 bp, Homo sapiens
ataattatttatttaat

SEQ ID NO: 1252504 - DNA, 18 bp, Homo sapiens
ataattatttatttaata

SEQ ID NO: 1252505 - DNA, 17 bp, Homo sapiens
ataattcagaactaaat

SEQ ID NO: 1252506 - DNA, 23 bp, Homo sapiens
ataattcagaactaaatttttca

SEQ ID NO: 1252507 - DNA, 17 bp, Homo sapiens
ataattcatttgtattg

SEQ ID NO: 1252508 - DNA, 17 bp, Homo sapiens
ataattccctatctttt

SEQ ID NO: 1252509 - DNA, 13 bp, Homo sapiens
ataattcctacag

SEQ ID NO: 1252510 - DNA, 22 bp, Homo sapiens
ataattctcattaaaagaatat

SEQ ID NO: 1252511 - DNA, 23 bp, Homo sapiens
ataattctgagttttgtgtttgt

SEQ ID NO: 1252512 - DNA, 13 bp, Homo sapiens
ataattctgtaaa

SEQ ID NO: 1252513 - DNA, 12 bp, Homo sapiens
ataattgaaact

SEQ ID NO: 1252514 - DNA, 22 bp, Homo sapiens
ataattgacaggattattggaa

SEQ ID NO: 1252515 - DNA, 14 bp, Homo sapiens
ataattgatcaaat

SEQ ID NO: 1252516 - DNA, 16 bp, Homo sapiens
ataattgattaaaatc

SEQ ID NO: 1252517 - DNA, 18 bp, Homo sapiens
ataattgattaaaatctc

SEQ ID NO: 1252518 - DNA, 23 bp, Homo sapiens
ataattggtgctatttgaagaaa

SEQ ID NO: 1252519 - DNA, 13 bp, Homo sapiens
ataattgtggatt

SEQ ID NO: 1252520 - DNA, 12 bp, Homo sapiens
ataattgttgat

SEQ ID NO: 1252521 - DNA, 13 bp, Homo sapiens
ataattgttgata

SEQ ID NO: 1252522 - DNA, 19 bp, Homo sapiens
ataattgttggagtattta

SEQ ID NO: 1252523 - DNA, 15 bp, Homo sapiens
ataattgttgtgtgt

SEQ ID NO: 1252524 - DNA, 17 bp, Homo sapiens
ataattgttgttctgtt

SEQ ID NO: 1252525 - DNA, 22 bp, Homo sapiens
ataattgttgttctgttaactg

SEQ ID NO: 1252526 - DNA, 12 bp, Homo sapiens
ataattgtttcc

SEQ ID NO: 1252527 - DNA, 21 bp, Homo sapiens
ataattgttttatctgaattt

SEQ ID NO: 1252528 - DNA, 14 bp, Homo sapiens
ataatttaaatgat

SEQ ID NO: 1252529 - DNA, 15 bp, Homo sapiens
ataatttaaatgata

SEQ ID NO: 1252530 - DNA, 15 bp, Homo sapiens
ataatttaatgcatg

SEQ ID NO: 1252531 - DNA, 23 bp, Homo sapiens
ataatttacctaagattacaaat

SEQ ID NO: 1252532 - DNA, 14 bp, Homo sapiens
ataatttagatggt

SEQ ID NO: 1252533 - DNA, 18 bp, Homo sapiens
ataatttagttgtttcta

SEQ ID NO: 1252534 - DNA, 18 bp, Homo sapiens
ataatttcagggaaatta

SEQ ID NO: 1252535 - DNA, 21 bp, Homo sapiens
ataatttcagggaaattaatc

SEQ ID NO: 1252536 - DNA, 14 bp, Homo sapiens
ataatttcatattc

SEQ ID NO: 1252537 - DNA, 20 bp, Homo sapiens
ataatttcctcactgcctgg

SEQ ID NO: 1252538 - DNA, 19 bp, Homo sapiens
ataatttctattaatatca

SEQ ID NO: 1252539 - DNA, 21 bp, Homo sapiens
ataatttgaaaaagttccata

SEQ ID NO: 1252540 - DNA, 11 bp, Homo sapiens
ataatttgaat

SEQ ID NO: 1252541 - DNA, 14 bp, Homo sapiens
ataatttgaatgta

SEQ ID NO: 1252542 - DNA, 14 bp, Homo sapiens
ataatttgaattaa

SEQ ID NO: 1252543 - DNA, 15 bp, Homo sapiens
ataatttgagtgtat

SEQ ID NO: 1252544 - DNA, 17 bp, Homo sapiens
ataatttgagtgtatat

SEQ ID NO: 1252545 - DNA, 21 bp, Homo sapiens
ataatttgtaaatgattttaa

SEQ ID NO: 1252546 - DNA, 20 bp, Homo sapiens
ataatttgtacaatggttta

SEQ ID NO: 1252547 - DNA, 21 bp, Homo sapiens
ataatttgtacaatggtttat

SEQ ID NO: 1252548 - DNA, 22 bp, Homo sapiens
ataatttgtgtctgtgtttaat

SEQ ID NO: 1252549 - DNA, 13 bp, Homo sapiens
ataatttgtttaa

SEQ ID NO: 1252550 - DNA, 16 bp, Homo sapiens
ataattttaaataacc

SEQ ID NO: 1252551 - DNA, 17 bp, Homo sapiens
ataattttaaataacct

SEQ ID NO: 1252552 - DNA, 20 bp, Homo sapiens
ataattttagtaatttccta

SEQ ID NO: 1252553 - DNA, 16 bp, Homo sapiens
ataattttctaagaca

SEQ ID NO: 1252554 - DNA, 17 bp, Homo sapiens
ataattttcttcatgca

SEQ ID NO: 1252555 - DNA, 23 bp, Homo sapiens
ataattttcttcatgcaatgaca

SEQ ID NO: 1252556 - DNA, 13 bp, Homo sapiens
ataattttgcata

SEQ ID NO: 1252557 - DNA, 15 bp, Homo sapiens
ataatttttaaagta

SEQ ID NO: 1252558 - DNA, 19 bp, Homo sapiens
ataatttttgctgaattcc

SEQ ID NO: 1252559 - DNA, 20 bp, Homo sapiens
ataatttttgtacatcccaa

SEQ ID NO: 1252560 - DNA, 13 bp, Homo sapiens
ataattttttgta

SEQ ID NO: 1252561 - DNA, 22 bp, Homo sapiens
ataattttttgtaatgtgtgaa

SEQ ID NO: 1252562 - DNA, 18 bp, Homo sapiens
ataattttttttaaaata

SEQ ID NO: 1252563 - DNA, 16 bp, Homo sapiens
ataattttttttaaag

SEQ ID NO: 1252564 - DNA, 19 bp, Homo sapiens
ataattttttttaaagaag

SEQ ID NO: 1252565 - DNA, 13 bp, Homo sapiens
atacaaaagaatt

SEQ ID NO: 1252566 - DNA, 12 bp, Homo sapiens
atacaaaagcat

SEQ ID NO: 1252567 - DNA, 23 bp, Homo sapiens
atacaaaagttcaacctcttaca

SEQ ID NO: 1252568 - DNA, 18 bp, Homo sapiens
atacaaaatatttaagtg

SEQ ID NO: 1252569 - DNA, 21 bp, Homo sapiens
atacaaaccactgtgaacatt

SEQ ID NO: 1252570 - DNA, 13 bp, Homo sapiens
atacaaactctca

SEQ ID NO: 1252571 - DNA, 17 bp, Homo sapiens
atacaaactggtattct

SEQ ID NO: 1252572 - DNA, 19 bp, Homo sapiens
atacaaagttagagaacta

SEQ ID NO: 1252573 - DNA, 13 bp, Homo sapiens
atacaaatggatt

SEQ ID NO: 1252574 - DNA, 14 bp, Homo sapiens
atacaaatggattt

SEQ ID NO: 1252575 - DNA, 20 bp, Homo sapiens
atacaaatggattttgggag

SEQ ID NO: 1252576 - DNA, 15 bp, Homo sapiens
atacaaattagaaaa

SEQ ID NO: 1252577 - DNA, 13 bp, Homo sapiens
atacaaatttata

SEQ ID NO: 1252578 - DNA, 16 bp, Homo sapiens
atacaaatttataaag

SEQ ID NO: 1252579 - DNA, 14 bp, Homo sapiens
atacaaatttggcc

SEQ ID NO: 1252580 - DNA, 23 bp, Homo sapiens
atacaaatttggccttaagaact

SEQ ID NO: 1252581 - DNA, 19 bp, Homo sapiens
atacaaattttcagaaggt

SEQ ID NO: 1252582 - DNA, 21 bp, Homo sapiens
atacaaattttgtataacttt

SEQ ID NO: 1252583 - DNA, 19 bp, Homo sapiens
atacaactgtaaagcaaat

SEQ ID NO: 1252584 - DNA, 16 bp, Homo sapiens
atacaacttaaataat

SEQ ID NO: 1252585 - DNA, 14 bp, Homo sapiens
atacaagaaaatgt

SEQ ID NO: 1252586 - DNA, 17 bp, Homo sapiens
atacaagattgaaaatc

SEQ ID NO: 1252587 - DNA, 12 bp, Homo sapiens
atacaagccaaa

SEQ ID NO: 1252588 - DNA, 14 bp, Homo sapiens
atacaataaaagag

SEQ ID NO: 1252589 - DNA, 15 bp, Homo sapiens
atacaatatcatcca

SEQ ID NO: 1252590 - DNA, 16 bp, Homo sapiens
atacaatcctgtttat

SEQ ID NO: 1252591 - DNA, 17 bp, Homo sapiens
atacaatgaacacttat

SEQ ID NO: 1252592 - DNA, 21 bp, Homo sapiens
atacaatggtcatttccagac

SEQ ID NO: 1252593 - DNA, 13 bp, Homo sapiens
atacaatgtatgt

SEQ ID NO: 1252594 - DNA, 14 bp, Homo sapiens
atacaatgtatgta

SEQ ID NO: 1252595 - DNA, 15 bp, Homo sapiens
atacaattaaaggtc

SEQ ID NO: 1252596 - DNA, 16 bp, Homo sapiens
atacaattaaaggtcc

SEQ ID NO: 1252597 - DNA, 16 bp, Homo sapiens
atacaatttccatata

SEQ ID NO: 1252598 - DNA, 19 bp, Homo sapiens
atacaatttccatatagtc

SEQ ID NO: 1252599 - DNA, 24 bp, Homo sapiens
atacaatttccatatagtctattc

SEQ ID NO: 1252600 - DNA, 9 bp, Homo sapiens
atacacaca

SEQ ID NO: 1252601 - DNA, 23 bp, Homo sapiens
atagaagagtttaaaagcatgaa

SEQ ID NO: 1252602 - DNA, 16 bp, Homo sapiens
atagaagataatgact

SEQ ID NO: 1252603 - DNA, 16 bp, Homo sapiens
atagaagctgtagtag

SEQ ID NO: 1252604 - DNA, 21 bp, Homo sapiens
atagaaggaatttgtacttct

SEQ ID NO: 1252605 - DNA, 13 bp, Homo sapiens
atagaagttttat

SEQ ID NO: 1252606 - DNA, 18 bp, Homo sapiens
atagaagttttcctgata

SEQ ID NO: 1252607 - DNA, 12 bp, Homo sapiens
atagaataaagg

SEQ ID NO: 1252608 - DNA, 20 bp, Homo sapiens
atagaataaaggcagttttc

SEQ ID NO: 1252609 - DNA, 16 bp, Homo sapiens
atagaataatctatta

SEQ ID NO: 1252610 - DNA, 14 bp, Homo sapiens
atagaataattctt

SEQ ID NO: 1252611 - DNA, 13 bp, Homo sapiens
atagaatactttt

SEQ ID NO: 1252612 - DNA, 20 bp, Homo sapiens
atagaataggcactttaaaa

SEQ ID NO: 1252613 - DNA, 19 bp, Homo sapiens
atagaatatttattacctc

SEQ ID NO: 1252614 - DNA, 22 bp, Homo sapiens
atagaatatttattacctctga

SEQ ID NO: 1252615 - DNA, 14 bp, Homo sapiens
atagaatttccaat

SEQ ID NO: 1252616 - DNA, 16 bp, Homo sapiens
atagacaatttattat

SEQ ID NO: 1252617 - DNA, 12 bp, Homo sapiens
atagacacgcac

SEQ ID NO: 1252618 - DNA, 22 bp, Homo sapiens
atagacactccccgaagtcttt

SEQ ID NO: 1252619 - DNA, 13 bp, Homo sapiens
atagacactggac

SEQ ID NO: 1252620 - DNA, 14 bp, Homo sapiens
atagacactggaca

SEQ ID NO: 1252621 - DNA, 13 bp, Homo sapiens
atagacagaagaa

SEQ ID NO: 1252622 - DNA, 17 bp, Homo sapiens
atagacagaagaaacaa

SEQ ID NO: 1252623 - DNA, 19 bp, Homo sapiens
atagacagaagaaacaagg

SEQ ID NO: 1252624 - DNA, 16 bp, Homo sapiens
atagacagtaaaatac

SEQ ID NO: 1252625 - DNA, 24 bp, Homo sapiens
atagacagtaaaatactattctca

SEQ ID NO: 1252626 - DNA, 16 bp, Homo sapiens
atagacattctcacat

SEQ ID NO: 1252627 - DNA, 15 bp, Homo sapiens
atagacatttcaaaa

SEQ ID NO: 1252628 - DNA, 16 bp, Homo sapiens
atagacatttgtaaat

SEQ ID NO: 1252629 - DNA, 18 bp, Homo sapiens
atagacattttggggttt

SEQ ID NO: 1252630 - DNA, 22 bp, Homo sapiens
atagactagtcctatggaaaaa

SEQ ID NO: 1252631 - DNA, 19 bp, Homo sapiens
atagactgaggtataaaga

SEQ ID NO: 1252632 - DNA, 20 bp, Homo sapiens
atagactgaggtataaagac

SEQ ID NO: 1252633 - DNA, 15 bp, Homo sapiens
atagacttaaatctc

SEQ ID NO: 1252634 - DNA, 14 bp, Homo sapiens
atagacttctctta

SEQ ID NO: 1252635 - DNA, 14 bp, Homo sapiens
atagagaataaggc

SEQ ID NO: 1252636 - DNA, 14 bp, Homo sapiens
atagagactgtaga

SEQ ID NO: 1252637 - DNA, 15 bp, Homo sapiens
atagagaggcctgct

SEQ ID NO: 1252638 - DNA, 18 bp, Homo sapiens
atagagagggagaagaag

SEQ ID NO: 1252639 - DNA, 16 bp, Homo sapiens
atagagatgtttttaa

SEQ ID NO: 1252640 - DNA, 22 bp, Homo sapiens
atagagatttgtctaattgcat

SEQ ID NO: 1252641 - DNA, 21 bp, Homo sapiens
atagagcacctagtccagtga

SEQ ID NO: 1252642 - DNA, 17 bp, Homo sapiens
atagagccaactgattt

SEQ ID NO: 1252643 - DNA, 16 bp, Homo sapiens
atagagctgccactgg

SEQ ID NO: 1252644 - DNA, 12 bp, Homo sapiens
atagagctttta

SEQ ID NO: 1252645 - DNA, 18 bp, Homo sapiens
atagagcttttaaaaatg

SEQ ID NO: 1252646 - DNA, 17 bp, Homo sapiens
atagagctttttaatag

SEQ ID NO: 1252647 - DNA, 12 bp, Homo sapiens
atagaggaagaa

SEQ ID NO: 1252648 - DNA, 13 bp, Homo sapiens
atagaggaagaaa

SEQ ID NO: 1252649 - DNA, 23 bp, Homo sapiens
atagaggatagggagaatattta

SEQ ID NO: 1252650 - DNA, 14 bp, Homo sapiens
atagaggcccaggc

SEQ ID NO: 1252651 - DNA, 15 bp, Homo sapiens
atagaggcccaggca

SEQ ID NO: 1252652 - DNA, 16 bp, Homo sapiens
atagaggcccaggcac

SEQ ID NO: 1252653 - DNA, 18 bp, Homo sapiens
atagaggcccaggcacca

SEQ ID NO: 1252654 - DNA, 18 bp, Homo sapiens
atagaggtgatgctgcta

SEQ ID NO: 1252655 - DNA, 17 bp, Homo sapiens
atagagttggagtttta

SEQ ID NO: 1252656 - DNA, 22 bp, Homo sapiens
atagagttggagttttattttt

SEQ ID NO: 1252657 - DNA, 15 bp, Homo sapiens
atagagtttgctatt

SEQ ID NO: 1252658 - DNA, 13 bp, Homo sapiens
atagatacaaatg

SEQ ID NO: 1252659 - DNA, 13 bp, Homo sapiens
atagatataatga

SEQ ID NO: 1252660 - DNA, 20 bp, Homo sapiens
atagatataatgaacaaaat

SEQ ID NO: 1252661 - DNA, 23 bp, Homo sapiens
atagatataatgaacaaaattat

SEQ ID NO: 1252662 - DNA, 20 bp, Homo sapiens
atagatatgtatatatacat

SEQ ID NO: 1252663 - DNA, 20 bp, Homo sapiens
atagatcagccattaaaata

SEQ ID NO: 1252664 - DNA, 23 bp, Homo sapiens
atagatcagccattaaaataaaa

SEQ ID NO: 1252665 - DNA, 13 bp, Homo sapiens
atagatctccagc

SEQ ID NO: 1252666 - DNA, 14 bp, Homo sapiens
atagatcttctgaa

SEQ ID NO: 1252667 - DNA, 19 bp, Homo sapiens
atagatgtccctttcttgg

SEQ ID NO: 1252668 - DNA, 13 bp, Homo sapiens
atagatgtctttt

SEQ ID NO: 1252669 - DNA, 16 bp, Homo sapiens
atagattaggtttgcg

SEQ ID NO: 1252670 - DNA, 20 bp, Homo sapiens
atagattattataaactata

SEQ ID NO: 1252671 - DNA, 14 bp, Homo sapiens
atagattatttcat

SEQ ID NO: 1252672 - DNA, 13 bp, Homo sapiens
atagattcacctg

SEQ ID NO: 1252673 - DNA, 19 bp, Homo sapiens
atagattcacctgtaaaac

SEQ ID NO: 1252674 - DNA, 21 bp, Homo sapiens
atagattcacctgtaaaactt

SEQ ID NO: 1252675 - DNA, 22 bp, Homo sapiens
atagattcacctgtaaaacttt

SEQ ID NO: 1252676 - DNA, 17 bp, Homo sapiens
atagattgctcaaatca

SEQ ID NO: 1252677 - DNA, 21 bp, Homo sapiens
atagattgtccttttgcaaag

SEQ ID NO: 1252678 - DNA, 19 bp, Homo sapiens
atagatttattttacattt

SEQ ID NO: 1252679 - DNA, 21 bp, Homo sapiens
atagatttatttttcagttcc

SEQ ID NO: 1252680 - DNA, 17 bp, Homo sapiens
atagattttctctggaa

SEQ ID NO: 1252681 - DNA, 22 bp, Homo sapiens
atagattttctctggaaataaa

SEQ ID NO: 1252682 - DNA, 16 bp, Homo sapiens
atagattttttttaaa

SEQ ID NO: 1252683 - DNA, 16 bp, Homo sapiens
atagcaaaagaagaag

SEQ ID NO: 1252684 - DNA, 19 bp, Homo sapiens
atagcaaaagaagaagttt

SEQ ID NO: 1252685 - DNA, 14 bp, Homo sapiens
atagcaaagtagta

SEQ ID NO: 1252686 - DNA, 16 bp, Homo sapiens
atagcaacaacaattg

SEQ ID NO: 1252687 - DNA, 19 bp, Homo sapiens
atagcaacaacaattggta

SEQ ID NO: 1252688 - DNA, 17 bp, Homo sapiens
atagcaagagtgtgaaa

SEQ ID NO: 1252689 - DNA, 19 bp, Homo sapiens
atagcaagtgaatttttct

SEQ ID NO: 1252690 - DNA, 17 bp, Homo sapiens
atagcacaggctaattt

SEQ ID NO: 1252691 - DNA, 11 bp, Homo sapiens
atagcactttc

SEQ ID NO: 1252692 - DNA, 16 bp, Homo sapiens
atagcagacagtgttt

SEQ ID NO: 1252693 - DNA, 22 bp, Homo sapiens
atagcagattttaattttgaat

SEQ ID NO: 1252694 - DNA, 22 bp, Homo sapiens
atagcataatatgaagcctttg

SEQ ID NO: 1252695 - DNA, 15 bp, Homo sapiens
atagcatactgtgta

SEQ ID NO: 1252696 - DNA, 20 bp, Homo sapiens
atagcatactgtgtatgttt

SEQ ID NO: 1252697 - DNA, 22 bp, Homo sapiens
atagcatactgtgtatgtttta

SEQ ID NO: 1252698 - DNA, 23 bp, Homo sapiens
atagcatctcaggagatttcatg

SEQ ID NO: 1252699 - DNA, 15 bp, Homo sapiens
atagcatgcttcctt

SEQ ID NO: 1252700 - DNA, 17 bp, Homo sapiens
atagcatggggcccctg

SEQ ID NO: 1252701 - DNA, 12 bp, Homo sapiens
atagcatgtcaa

SEQ ID NO: 1252702 - DNA, 18 bp, Homo sapiens
atagcatgtcaacttttg

SEQ ID NO: 1252703 - DNA, 22 bp, Homo sapiens
atagcatgtcaacttttgacta

SEQ ID NO: 1252704 - DNA, 19 bp, Homo sapiens
atagcatgtgtattaatgt

SEQ ID NO: 1252705 - DNA, 22 bp, Homo sapiens
atagcatgtgtattaatgtcta

SEQ ID NO: 1252706 - DNA, 17 bp, Homo sapiens
atagcattgataatctt

SEQ ID NO: 1252707 - DNA, 24 bp, Homo sapiens
atagcattgataatcttcaggtga

SEQ ID NO: 1252708 - DNA, 12 bp, Homo sapiens
atagcattgctt

SEQ ID NO: 1252709 - DNA, 15 bp, Homo sapiens
atagcattgtgaact

SEQ ID NO: 1252710 - DNA, 20 bp, Homo sapiens
atagcatttgccacttagta

SEQ ID NO: 1252711 - DNA, 21 bp, Homo sapiens
atagcatttttgatttatgca

SEQ ID NO: 1252712 - DNA, 14 bp, Homo sapiens
atagccaaaaatag

SEQ ID NO: 1252713 - DNA, 22 bp, Homo sapiens
atagccacatccctttgaaaca

SEQ ID NO: 1252714 - DNA, 13 bp, Homo sapiens
atagccacatttg

SEQ ID NO: 1252715 - DNA, 16 bp, Homo sapiens
atagccacatttggaa

SEQ ID NO: 1252716 - DNA, 22 bp, Homo sapiens
atagccacatttggaatacttt

SEQ ID NO: 1252717 - DNA, 15 bp, Homo sapiens
atagccactaacctt

SEQ ID NO: 1252718 - DNA, 22 bp, Homo sapiens
atagccactaaccttgcctggt

SEQ ID NO: 1252719 - DNA, 20 bp, Homo sapiens
atagccactgatggtgacag

SEQ ID NO: 1252720 - DNA, 14 bp, Homo sapiens
atagccagagagga

SEQ ID NO: 1252721 - DNA, 14 bp, Homo sapiens
atagcccagatcag

SEQ ID NO: 1252722 - DNA, 13 bp, Homo sapiens
atagcccaggagc

SEQ ID NO: 1252723 - DNA, 15 bp, Homo sapiens
atagtatagaagtct

SEQ ID NO: 1252724 - DNA, 17 bp, Homo sapiens
atagtatatctggacaa

SEQ ID NO: 1252725 - DNA, 13 bp, Homo sapiens
atagtatgtgact

SEQ ID NO: 1252726 - DNA, 14 bp, Homo sapiens
atagtatgtgactt

SEQ ID NO: 1252727 - DNA, 15 bp, Homo sapiens
atagtatgtgacttt

SEQ ID NO: 1252728 - DNA, 21 bp, Homo sapiens
atagtatgtgacttttctgat

SEQ ID NO: 1252729 - DNA, 20 bp, Homo sapiens
atagtattggaaaataaaaa

SEQ ID NO: 1252730 - DNA, 12 bp, Homo sapiens
atagtattggag

SEQ ID NO: 1252731 - DNA, 21 bp, Homo sapiens
atagtatttgattcaaaatat

SEQ ID NO: 1252732 - DNA, 17 bp, Homo sapiens
atagtcaatttctactt

SEQ ID NO: 1252733 - DNA, 14 bp, Homo sapiens
atagtccaatattt

SEQ ID NO: 1252734 - DNA, 17 bp, Homo sapiens
atagtccaatatttggc

SEQ ID NO: 1252735 - DNA, 17 bp, Homo sapiens
atagtccaatttttact

SEQ ID NO: 1252736 - DNA, 20 bp, Homo sapiens
atagtccaatttttactcag

SEQ ID NO: 1252737 - DNA, 21 bp, Homo sapiens
atagtccatggacaatataaa

SEQ ID NO: 1252738 - DNA, 22 bp, Homo sapiens
atagtcctcagggctcagtctt

SEQ ID NO: 1252739 - DNA, 13 bp, Homo sapiens
atagtccttcctg

SEQ ID NO: 1252740 - DNA, 17 bp, Homo sapiens
atagtctcttgtttgtc

SEQ ID NO: 1252741 - DNA, 21 bp, Homo sapiens
atagtctctttaaaaggaaag

SEQ ID NO: 1252742 - DNA, 13 bp, Homo sapiens
atagtctgtgtga

SEQ ID NO: 1252743 - DNA, 22 bp, Homo sapiens
atagtctgttccttttctctcc

SEQ ID NO: 1252744 - DNA, 16 bp, Homo sapiens
atagtctttggagaaa

SEQ ID NO: 1252745 - DNA, 19 bp, Homo sapiens
atagtgacctgtgtttcac

SEQ ID NO: 1252746 - DNA, 18 bp, Homo sapiens
atagtgactatgaacttc

SEQ ID NO: 1252747 - DNA, 15 bp, Homo sapiens
atagtgagagaggag

SEQ ID NO: 1252748 - DNA, 21 bp, Homo sapiens
atagtgagccatgattttcta

SEQ ID NO: 1252749 - DNA, 21 bp, Homo sapiens
atagtgaggcatcgcaatgta

SEQ ID NO: 1252750 - DNA, 20 bp, Homo sapiens
atagtgatgtaatcttgaat

SEQ ID NO: 1252751 - DNA, 18 bp, Homo sapiens
atagtgcaaaactgtgtc

SEQ ID NO: 1252752 - DNA, 16 bp, Homo sapiens
atagtgccaggtggct

SEQ ID NO: 1252753 - DNA, 16 bp, Homo sapiens
atagtgcctaaagtgc

SEQ ID NO: 1252754 - DNA, 19 bp, Homo sapiens
atagtgcctaaagtgctgc

SEQ ID NO: 1252755 - DNA, 23 bp, Homo sapiens
atagtgcctaaagtgctgcagcc

SEQ ID NO: 1252756 - DNA, 16 bp, Homo sapiens
atagtgctgtttaagc

SEQ ID NO: 1252757 - DNA, 17 bp, Homo sapiens
atagtgcttaaaaatca

SEQ ID NO: 1252758 - DNA, 21 bp, Homo sapiens
atagtggggttccatgagtta

SEQ ID NO: 1252759 - DNA, 17 bp, Homo sapiens
atagtgggtacatcaag

SEQ ID NO: 1252760 - DNA, 16 bp, Homo sapiens
atagtggtgagatgga

SEQ ID NO: 1252761 - DNA, 15 bp, Homo sapiens
atagtggtgtgattt

SEQ ID NO: 1252762 - DNA, 23 bp, Homo sapiens
atagtgtaacttgcttaaatttc

SEQ ID NO: 1252763 - DNA, 12 bp, Homo sapiens
atagtgtaagaa

SEQ ID NO: 1252764 - DNA, 14 bp, Homo sapiens
atagtgtaagaact

SEQ ID NO: 1252765 - DNA, 15 bp, Homo sapiens
atagtgtaagaactg

SEQ ID NO: 1252766 - DNA, 18 bp, Homo sapiens
atagtgtaagaactgtac

SEQ ID NO: 1252767 - DNA, 19 bp, Homo sapiens
atagtgtcatataaactca

SEQ ID NO: 1252768 - DNA, 20 bp, Homo sapiens
atagtgtctattatcacatt

SEQ ID NO: 1252769 - DNA, 14 bp, Homo sapiens
atagtgtgaaatat

SEQ ID NO: 1252770 - DNA, 17 bp, Homo sapiens
atagtgttaactgtcag

SEQ ID NO: 1252771 - DNA, 21 bp, Homo sapiens
atagtgttcacaaactgtgaa

SEQ ID NO: 1252772 - DNA, 20 bp, Homo sapiens
atagtgttctgctcctgctt

SEQ ID NO: 1252773 - DNA, 18 bp, Homo sapiens
atagtgtttaactggcat

SEQ ID NO: 1252774 - DNA, 15 bp, Homo sapiens
atagttagaacctgg

SEQ ID NO: 1252775 - DNA, 23 bp, Homo sapiens
atagttaggatagcatttttgat

SEQ ID NO: 1252776 - DNA, 22 bp, Homo sapiens
atagttcactgacacagtaaaa

SEQ ID NO: 1252777 - DNA, 21 bp, Homo sapiens
atagttcagtagaattaccat

SEQ ID NO: 1252778 - DNA, 16 bp, Homo sapiens
atagttccttgcctta

SEQ ID NO: 1252779 - DNA, 23 bp, Homo sapiens
atagttccttgccttaataaata

SEQ ID NO: 1252780 - DNA, 22 bp, Homo sapiens
atagttctgtgtagagaatgtc

SEQ ID NO: 1252781 - DNA, 19 bp, Homo sapiens
atagttcttagctttgaaa

SEQ ID NO: 1252782 - DNA, 12 bp, Homo sapiens
atagttgaatta

SEQ ID NO: 1252783 - DNA, 18 bp, Homo sapiens
atagttgtgggtgggaga

SEQ ID NO: 1252784 - DNA, 17 bp, Homo sapiens
atagtttacctgaataa

SEQ ID NO: 1252785 - DNA, 16 bp, Homo sapiens
atagtttaggagaaac

SEQ ID NO: 1252786 - DNA, 20 bp, Homo sapiens
atagtttatcttatactcct

SEQ ID NO: 1252787 - DNA, 14 bp, Homo sapiens
atagtttattgaca

SEQ ID NO: 1252788 - DNA, 19 bp, Homo sapiens
atagtttcaaatctgtaat

SEQ ID NO: 1252789 - DNA, 14 bp, Homo sapiens
atagtttcagatat

SEQ ID NO: 1252790 - DNA, 15 bp, Homo sapiens
atagtttgtacatgc

SEQ ID NO: 1252791 - DNA, 15 bp, Homo sapiens
atagttttactttta

SEQ ID NO: 1252792 - DNA, 23 bp, Homo sapiens
atagttttcatccataactgaac

SEQ ID NO: 1252793 - DNA, 17 bp, Homo sapiens
atagttttgtaagtaac

SEQ ID NO: 1252794 - DNA, 14 bp, Homo sapiens
atagttttgtttaa

SEQ ID NO: 1252795 - DNA, 13 bp, Homo sapiens
atataaaaacaga

SEQ ID NO: 1252796 - DNA, 19 bp, Homo sapiens
atataaaaacagattctga

SEQ ID NO: 1252797 - DNA, 17 bp, Homo sapiens
atataaaaagaaaagat

SEQ ID NO: 1252798 - DNA, 23 bp, Homo sapiens
atataaaaagaaaagataaagat

SEQ ID NO: 1252799 - DNA, 13 bp, Homo sapiens
atataaaactgaa

SEQ ID NO: 1252800 - DNA, 15 bp, Homo sapiens
atataaaactgaaat

SEQ ID NO: 1252801 - DNA, 21 bp, Homo sapiens
atataaaaggcaaatgtgtac

SEQ ID NO: 1252802 - DNA, 23 bp, Homo sapiens
atataaaaggcaaatgtgtacat

SEQ ID NO: 1252803 - DNA, 18 bp, Homo sapiens
atataaaataaaaagtca

SEQ ID NO: 1252804 - DNA, 15 bp, Homo sapiens
atataaaataaatat

SEQ ID NO: 1252805 - DNA, 18 bp, Homo sapiens
atataaaataaatatata

SEQ ID NO: 1252806 - DNA, 21 bp, Homo sapiens
atataaaataaatatatataa

SEQ ID NO: 1252807 - DNA, 24 bp, Homo sapiens
atataaaataaatatatataaacc

SEQ ID NO: 1252808 - DNA, 12 bp, Homo sapiens
atataaaataat

SEQ ID NO: 1252809 - DNA, 17 bp, Homo sapiens
atataaaatgtattcaa

SEQ ID NO: 1252810 - DNA, 20 bp, Homo sapiens
atataaaatgtattcaagca

SEQ ID NO: 1252811 - DNA, 19 bp, Homo sapiens
atataaacctaaaaaagat

SEQ ID NO: 1252812 - DNA, 20 bp, Homo sapiens
atataaacctaaaaaagata

SEQ ID NO: 1252813 - DNA, 12 bp, Homo sapiens
atataaactgta

SEQ ID NO: 1252814 - DNA, 21 bp, Homo sapiens
atataaaggaccctgtttctg

SEQ ID NO: 1252815 - DNA, 20 bp, Homo sapiens
atataaaggttatgaaacat

SEQ ID NO: 1252816 - DNA, 22 bp, Homo sapiens
atataaaggttatgaaacatat

SEQ ID NO: 1252817 - DNA, 17 bp, Homo sapiens
atataaagtattctttt

SEQ ID NO: 1252818 - DNA, 18 bp, Homo sapiens
atataaataaatgtttct

SEQ ID NO: 1252819 - DNA, 19 bp, Homo sapiens
atataaatagctgaaaact

SEQ ID NO: 1252820 - DNA, 16 bp, Homo sapiens
atataaatatatattc

SEQ ID NO: 1252821 - DNA, 18 bp, Homo sapiens
atataaatggctggtttt

SEQ ID NO: 1252822 - DNA, 11 bp, Homo sapiens
atataaatgtg

SEQ ID NO: 1252823 - DNA, 13 bp, Homo sapiens
atataaattgtac

SEQ ID NO: 1252824 - DNA, 15 bp, Homo sapiens
atataaattgtacat

SEQ ID NO: 1252825 - DNA, 15 bp, Homo sapiens
atataaatttaagca

SEQ ID NO: 1252826 - DNA, 22 bp, Homo sapiens
atataaattttttttgtttcat

SEQ ID NO: 1252827 - DNA, 15 bp, Homo sapiens
atataacagatacat

SEQ ID NO: 1252828 - DNA, 15 bp, Homo sapiens
atataaccattacat

SEQ ID NO: 1252829 - DNA, 19 bp, Homo sapiens
atataaccctaggaattta

SEQ ID NO: 1252830 - DNA, 17 bp, Homo sapiens
atataactgtatttgaa

SEQ ID NO: 1252831 - DNA, 22 bp, Homo sapiens
atataactgtcttgtttcagtg

SEQ ID NO: 1252832 - DNA, 21 bp, Homo sapiens
atataacttaaaaatgtaaat

SEQ ID NO: 1252833 - DNA, 20 bp, Homo sapiens
atataacttatattgtaaga

SEQ ID NO: 1252834 - DNA, 15 bp, Homo sapiens
atataactttagaaa

SEQ ID NO: 1252835 - DNA, 14 bp, Homo sapiens
atataagcataaaa

SEQ ID NO: 1252836 - DNA, 16 bp, Homo sapiens
atataagcataaaaga

SEQ ID NO: 1252837 - DNA, 14 bp, Homo sapiens
atataagtaaagtg

SEQ ID NO: 1252838 - DNA, 22 bp, Homo sapiens
atataagtaaagtgattaaagt

SEQ ID NO: 1252839 - DNA, 20 bp, Homo sapiens
atataagtggtgcttagaaa

SEQ ID NO: 1252840 - DNA, 15 bp, Homo sapiens
atataagtgtacata

SEQ ID NO: 1252841 - DNA, 19 bp, Homo sapiens
atataagtttgaaggaaac

SEQ ID NO: 1252842 - DNA, 13 bp, Homo sapiens
atataataaaaga

SEQ ID NO: 1252843 - DNA, 12 bp, Homo sapiens
atataataaagt

SEQ ID NO: 1252844 - DNA, 17 bp, Homo sapiens
atatctatctatttgag

SEQ ID NO: 1252845 - DNA, 18 bp, Homo sapiens
atatctattaatatatgt

SEQ ID NO: 1252846 - DNA, 15 bp, Homo sapiens
atatctcaatctgca

SEQ ID NO: 1252847 - DNA, 12 bp, Homo sapiens
atatctgcagcg

SEQ ID NO: 1252848 - DNA, 14 bp, Homo sapiens
atatctgcctcccc

SEQ ID NO: 1252849 - DNA, 19 bp, Homo sapiens
atatctgggttaagtgttt

SEQ ID NO: 1252850 - DNA, 18 bp, Homo sapiens
atatctggtatatgtcat

SEQ ID NO: 1252851 - DNA, 20 bp, Homo sapiens
atatctgtacagatcaagaa

SEQ ID NO: 1252852 - DNA, 15 bp, Homo sapiens
atatctgttcacttt

SEQ ID NO: 1252853 - DNA, 18 bp, Homo sapiens
atatctgtttgtatattt

SEQ ID NO: 1252854 - DNA, 20 bp, Homo sapiens
atatctgtttgtatatttgc

SEQ ID NO: 1252855 - DNA, 21 bp, Homo sapiens
atatctgtttgtatatttgca

SEQ ID NO: 1252856 - DNA, 23 bp, Homo sapiens
atatcttcccatttaacattgtt

SEQ ID NO: 1252857 - DNA, 15 bp, Homo sapiens
atatcttcctttggg

SEQ ID NO: 1252858 - DNA, 19 bp, Homo sapiens
atatcttggacaaatcaca

SEQ ID NO: 1252859 - DNA, 13 bp, Homo sapiens
atatcttgttatt

SEQ ID NO: 1252860 - DNA, 14 bp, Homo sapiens
atatcttgttatta

SEQ ID NO: 1252861 - DNA, 21 bp, Homo sapiens
atatcttgttattaatgtttc

SEQ ID NO: 1252862 - DNA, 14 bp, Homo sapiens
atatcttgtttaca

SEQ ID NO: 1252863 - DNA, 13 bp, Homo sapiens
atatctttctctt

SEQ ID NO: 1252864 - DNA, 13 bp, Homo sapiens
atatcttttggtt

SEQ ID NO: 1252865 - DNA, 14 bp, Homo sapiens
atatcttttggtta

SEQ ID NO: 1252866 - DNA, 19 bp, Homo sapiens
atatgaaaaatgtaaatac

SEQ ID NO: 1252867 - DNA, 13 bp, Homo sapiens
atatgaaagctga

SEQ ID NO: 1252868 - DNA, 17 bp, Homo sapiens
atatgaaagctgatttt

SEQ ID NO: 1252869 - DNA, 21 bp, Homo sapiens
atatgaaattccagcaataag

SEQ ID NO: 1252870 - DNA, 15 bp, Homo sapiens
atatgaacatattgt

SEQ ID NO: 1252871 - DNA, 19 bp, Homo sapiens
atatgaacatattgttgaa

SEQ ID NO: 1252872 - DNA, 21 bp, Homo sapiens
atatgaacctattttcatttg

SEQ ID NO: 1252873 - DNA, 23 bp, Homo sapiens
atatgaacctattttcatttgta

SEQ ID NO: 1252874 - DNA, 14 bp, Homo sapiens
atatgaagacataa

SEQ ID NO: 1252875 - DNA, 14 bp, Homo sapiens
atatgaagagtttt

SEQ ID NO: 1252876 - DNA, 14 bp, Homo sapiens
atatgaatctataa

SEQ ID NO: 1252877 - DNA, 14 bp, Homo sapiens
atatgacagctgtc

SEQ ID NO: 1252878 - DNA, 15 bp, Homo sapiens
atatgacagctgtcc

SEQ ID NO: 1252879 - DNA, 15 bp, Homo sapiens
atatgaccagaagcc

SEQ ID NO: 1252880 - DNA, 16 bp, Homo sapiens
atatgaccagaagcct

SEQ ID NO: 1252881 - DNA, 17 bp, Homo sapiens
atatgacccacactgcc

SEQ ID NO: 1252882 - DNA, 23 bp, Homo sapiens
atatgagccggttattacttctg

SEQ ID NO: 1252883 - DNA, 17 bp, Homo sapiens
atatgagcttcaatata

SEQ ID NO: 1252884 - DNA, 23 bp, Homo sapiens
atatgagcttcaatataagaagc

SEQ ID NO: 1252885 - DNA, 20 bp, Homo sapiens
atatgagtgtggaagccgga

SEQ ID NO: 1252886 - DNA, 13 bp, Homo sapiens
atatgagttcttc

SEQ ID NO: 1252887 - DNA, 15 bp, Homo sapiens
atatgatactgatgc

SEQ ID NO: 1252888 - DNA, 20 bp, Homo sapiens
atatgatagcgggaaaagga

SEQ ID NO: 1252889 - DNA, 14 bp, Homo sapiens
atatgatatgtaaa

SEQ ID NO: 1252890 - DNA, 19 bp, Homo sapiens
atatgatattctttaaaca

SEQ ID NO: 1252891 - DNA, 15 bp, Homo sapiens
atatgatccagagca

SEQ ID NO: 1252892 - DNA, 20 bp, Homo sapiens
atatgatccctaatgtgttt

SEQ ID NO: 1252893 - DNA, 15 bp, Homo sapiens
atatgatctgtctgt

SEQ ID NO: 1252894 - DNA, 11 bp, Homo sapiens
atatgatgcca

SEQ ID NO: 1252895 - DNA, 13 bp, Homo sapiens
atatgatgccact

SEQ ID NO: 1252896 - DNA, 17 bp, Homo sapiens
atatgatgggggaaaaa

SEQ ID NO: 1252897 - DNA, 21 bp, Homo sapiens
atatgatgtggacatatgtat

SEQ ID NO: 1252898 - DNA, 22 bp, Homo sapiens
atatgatgtggacatatgtata

SEQ ID NO: 1252899 - DNA, 15 bp, Homo sapiens
atatgattctctgtg

SEQ ID NO: 1252900 - DNA, 16 bp, Homo sapiens
atatgattctctgtgg

SEQ ID NO: 1252901 - DNA, 14 bp, Homo sapiens
atatgattggttca

SEQ ID NO: 1252902 - DNA, 20 bp, Homo sapiens
atatgatttaaatcagccgt

SEQ ID NO: 1252903 - DNA, 13 bp, Homo sapiens
atatgatttatag

SEQ ID NO: 1252904 - DNA, 18 bp, Homo sapiens
atatgatttcttgctttg

SEQ ID NO: 1252905 - DNA, 21 bp, Homo sapiens
atatgcaacttattgtatctg

SEQ ID NO: 1252906 - DNA, 16 bp, Homo sapiens
atatgcaagcagcttt

SEQ ID NO: 1252907 - DNA, 22 bp, Homo sapiens
atatgcaagtaagaaataatgc

SEQ ID NO: 1252908 - DNA, 19 bp, Homo sapiens
atatgcacaaaactacttt

SEQ ID NO: 1252909 - DNA, 13 bp, Homo sapiens
atatgcacacatt

SEQ ID NO: 1252910 - DNA, 17 bp, Homo sapiens
atatgcacccctggaac

SEQ ID NO: 1252911 - DNA, 16 bp, Homo sapiens
atatgcactatgtata

SEQ ID NO: 1252912 - DNA, 13 bp, Homo sapiens
atatgcacttata

SEQ ID NO: 1252913 - DNA, 14 bp, Homo sapiens
atatgcacttataa

SEQ ID NO: 1252914 - DNA, 20 bp, Homo sapiens
atatgcactttccctagaaa

SEQ ID NO: 1252915 - DNA, 13 bp, Homo sapiens
atatgcagccaac

SEQ ID NO: 1252916 - DNA, 16 bp, Homo sapiens
atatgcagttttcctt

SEQ ID NO: 1252917 - DNA, 21 bp, Homo sapiens
atatgccccttcttgggcccc

SEQ ID NO: 1252918 - DNA, 22 bp, Homo sapiens
atatgctaattaaataatacaa

SEQ ID NO: 1252919 - DNA, 16 bp, Homo sapiens
atatgctctgcatgtt

SEQ ID NO: 1252920 - DNA, 17 bp, Homo sapiens
atatgctctgcttttag

SEQ ID NO: 1252921 - DNA, 15 bp, Homo sapiens
atatgctgcaacaaa

SEQ ID NO: 1252922 - DNA, 18 bp, Homo sapiens
atatgctgccaaattttg

SEQ ID NO: 1252923 - DNA, 14 bp, Homo sapiens
atatgctgtatttc

SEQ ID NO: 1252924 - DNA, 19 bp, Homo sapiens
atatgctgtatttctttgt

SEQ ID NO: 1252925 - DNA, 20 bp, Homo sapiens
atatgctgtatttctttgta

SEQ ID NO: 1252926 - DNA, 16 bp, Homo sapiens
atatgcttaaaataag

SEQ ID NO: 1252927 - DNA, 19 bp, Homo sapiens
atatgcttaaaataagcag

SEQ ID NO: 1252928 - DNA, 19 bp, Homo sapiens
atatgcttgtaactaaaat

SEQ ID NO: 1252929 - DNA, 19 bp, Homo sapiens
atatggaaatcttttacat

SEQ ID NO: 1252930 - DNA, 16 bp, Homo sapiens
atatggaaccttccct

SEQ ID NO: 1252931 - DNA, 19 bp, Homo sapiens
atatggaaccttccctcca

SEQ ID NO: 1252932 - DNA, 20 bp, Homo sapiens
atatggaaccttccctccaa

SEQ ID NO: 1252933 - DNA, 14 bp, Homo sapiens
atatggaagaaagt

SEQ ID NO: 1252934 - DNA, 15 bp, Homo sapiens
atatggaattttgca

SEQ ID NO: 1252935 - DNA, 15 bp, Homo sapiens
atatggacacttaat

SEQ ID NO: 1252936 - DNA, 15 bp, Homo sapiens
atatggagctcatgt

SEQ ID NO: 1252937 - DNA, 21 bp, Homo sapiens
atatggaggattctttcccca

SEQ ID NO: 1252938 - DNA, 22 bp, Homo sapiens
atatggaggattctttccccag

SEQ ID NO: 1252939 - DNA, 23 bp, Homo sapiens
atatggaggattctttccccaga

SEQ ID NO: 1252940 - DNA, 23 bp, Homo sapiens
atatggagtgagtcacctgctcc

SEQ ID NO: 1252941 - DNA, 12 bp, Homo sapiens
atatggatgtta

SEQ ID NO: 1252942 - DNA, 14 bp, Homo sapiens
atatggatgttact

SEQ ID NO: 1252943 - DNA, 22 bp, Homo sapiens
atatggatgttactctcttgca

SEQ ID NO: 1252944 - DNA, 16 bp, Homo sapiens
atatggcaaaaatggc

SEQ ID NO: 1252945 - DNA, 15 bp, Homo sapiens
atatggcaagaaagc

SEQ ID NO: 1252946 - DNA, 17 bp, Homo sapiens
atatggcaagaaagctg

SEQ ID NO: 1252947 - DNA, 20 bp, Homo sapiens
atatggcagagttgtaaata

SEQ ID NO: 1252948 - DNA, 19 bp, Homo sapiens
atatggcaggactcctggc

SEQ ID NO: 1252949 - DNA, 20 bp, Homo sapiens
atatggcaggactcctggca

SEQ ID NO: 1252950 - DNA, 22 bp, Homo sapiens
atatggcaggactcctggcagg

SEQ ID NO: 1252951 - DNA, 16 bp, Homo sapiens
atatggcccagccttg

SEQ ID NO: 1252952 - DNA, 15 bp, Homo sapiens
atatggcggcctgca

SEQ ID NO: 1252953 - DNA, 16 bp, Homo sapiens
atatggcggcctgcag

SEQ ID NO: 1252954 - DNA, 15 bp, Homo sapiens
atatggctataaata

SEQ ID NO: 1252955 - DNA, 11 bp, Homo sapiens
atatggctgcc

SEQ ID NO: 1252956 - DNA, 15 bp, Homo sapiens
atatggctgcccagg

SEQ ID NO: 1252957 - DNA, 16 bp, Homo sapiens
atatggggaatatatt

SEQ ID NO: 1252958 - DNA, 19 bp, Homo sapiens
atatggggatggtagtttt

SEQ ID NO: 1252959 - DNA, 22 bp, Homo sapiens
atatgggttgcatttggtcaag

SEQ ID NO: 1252960 - DNA, 20 bp, Homo sapiens
atatggttctccaagaaact

SEQ ID NO: 1252961 - DNA, 21 bp, Homo sapiens
atatggttggagagccctgga

SEQ ID NO: 1252962 - DNA, 13 bp, Homo sapiens
atatgtaaaacat

SEQ ID NO: 1252963 - DNA, 24 bp, Homo sapiens
atatgtaaaacatttattttgaca

SEQ ID NO: 1252964 - DNA, 12 bp, Homo sapiens
atatgtaaaata

SEQ ID NO: 1252965 - DNA, 13 bp, Homo sapiens
atatgtaaaataa

SEQ ID NO: 1252966 - DNA, 17 bp, Homo sapiens
atatttttttaacttta

SEQ ID NO: 1252967 - DNA, 17 bp, Homo sapiens
atatttttttaatttaa

SEQ ID NO: 1252968 - DNA, 18 bp, Homo sapiens
atatttttttcttttctt

SEQ ID NO: 1252969 - DNA, 14 bp, Homo sapiens
atcaaaacaagtac

SEQ ID NO: 1252970 - DNA, 17 bp, Homo sapiens
atcaaaacctgtgccag

SEQ ID NO: 1252971 - DNA, 20 bp, Homo sapiens
atcaaaaggttaataaagta

SEQ ID NO: 1252972 - DNA, 18 bp, Homo sapiens
atcaaaataaaaagtgac

SEQ ID NO: 1252973 - DNA, 23 bp, Homo sapiens
atcaaaatagtttaggaaaatga

SEQ ID NO: 1252974 - DNA, 18 bp, Homo sapiens
atcaaaatcttaatcatt

SEQ ID NO: 1252975 - DNA, 13 bp, Homo sapiens
atcaaaatgcttt

SEQ ID NO: 1252976 - DNA, 22 bp, Homo sapiens
atcaaacaccaacataaaaatg

SEQ ID NO: 1252977 - DNA, 19 bp, Homo sapiens
atcaaacagtaatctaggt

SEQ ID NO: 1252978 - DNA, 15 bp, Homo sapiens
atcaaacattttctg

SEQ ID NO: 1252979 - DNA, 17 bp, Homo sapiens
atcaaaccctagccttg

SEQ ID NO: 1252980 - DNA, 22 bp, Homo sapiens
atcaaaccctagccttgcttgt

SEQ ID NO: 1252981 - DNA, 16 bp, Homo sapiens
atcaaagaaaaacaat

SEQ ID NO: 1252982 - DNA, 13 bp, Homo sapiens
atcaaagaaaaga

SEQ ID NO: 1252983 - DNA, 17 bp, Homo sapiens
atcaaagaaaagacttt

SEQ ID NO: 1252984 - DNA, 13 bp, Homo sapiens
atcaaagaacaga

SEQ ID NO: 1252985 - DNA, 15 bp, Homo sapiens
atcaaagaacagatg

SEQ ID NO: 1252986 - DNA, 14 bp, Homo sapiens
atcaaagaattaca

SEQ ID NO: 1252987 - DNA, 15 bp, Homo sapiens
atcaaagaattacag

SEQ ID NO: 1252988 - DNA, 20 bp, Homo sapiens
atcaaagaggttttaaaaaa

SEQ ID NO: 1252989 - DNA, 20 bp, Homo sapiens
atcaaagcaagggctccagc

SEQ ID NO: 1252990 - DNA, 16 bp, Homo sapiens
atcaaagcagaagtct

SEQ ID NO: 1252991 - DNA, 16 bp, Homo sapiens
atcaaagccacactct

SEQ ID NO: 1252992 - DNA, 16 bp, Homo sapiens
atcaaagccagggtct

SEQ ID NO: 1252993 - DNA, 14 bp, Homo sapiens
atcaaagtaaaaaa

SEQ ID NO: 1252994 - DNA, 23 bp, Homo sapiens
atcaaagtaaaaaattaaagccc

SEQ ID NO: 1252995 - DNA, 19 bp, Homo sapiens
atcaaagtcattaaagaca

SEQ ID NO: 1252996 - DNA, 23 bp, Homo sapiens
atcaaagtggtaaatactgtgaa

SEQ ID NO: 1252997 - DNA, 17 bp, Homo sapiens
atcaaataaaaattcta

SEQ ID NO: 1252998 - DNA, 21 bp, Homo sapiens
atcaaataaaaattctagatt

SEQ ID NO: 1252999 - DNA, 19 bp, Homo sapiens
atcaaataagtatttataa

SEQ ID NO: 1253000 - DNA, 14 bp, Homo sapiens
atcaaatactttaa

SEQ ID NO: 1253001 - DNA, 21 bp, Homo sapiens
atcaaatagaaccactatgaa

SEQ ID NO: 1253002 - DNA, 17 bp, Homo sapiens
atcaaatctgtatatgt

SEQ ID NO: 1253003 - DNA, 17 bp, Homo sapiens
atcaaatttgccaccac

SEQ ID NO: 1253004 - DNA, 22 bp, Homo sapiens
atcaaatttgccatgacatttc

SEQ ID NO: 1253005 - DNA, 17 bp, Homo sapiens
atcaacagtgagagact

SEQ ID NO: 1253006 - DNA, 14 bp, Homo sapiens
atcaactaaaacat

SEQ ID NO: 1253007 - DNA, 13 bp, Homo sapiens
atcaactctaata

SEQ ID NO: 1253008 - DNA, 12 bp, Homo sapiens
atcaactctgaa

SEQ ID NO: 1253009 - DNA, 13 bp, Homo sapiens
atcaactctgaag

SEQ ID NO: 1253010 - DNA, 14 bp, Homo sapiens
atcaactgaatgag

SEQ ID NO: 1253011 - DNA, 15 bp, Homo sapiens
atcaacttaaaagtc

SEQ ID NO: 1253012 - DNA, 12 bp, Homo sapiens
atcaacttaaca

SEQ ID NO: 1253013 - DNA, 16 bp, Homo sapiens
atcaagaaaaaaaggg

SEQ ID NO: 1253014 - DNA, 12 bp, Homo sapiens
atcaagaaagtc

SEQ ID NO: 1253015 - DNA, 19 bp, Homo sapiens
atcaagaaatgtctctgct

SEQ ID NO: 1253016 - DNA, 14 bp, Homo sapiens
atcaagaagggctg

SEQ ID NO: 1253017 - DNA, 22 bp, Homo sapiens
atcaagaattagaagtctttca

SEQ ID NO: 1253018 - DNA, 20 bp, Homo sapiens
atcaagactatctacaaaaa

SEQ ID NO: 1253019 - DNA, 19 bp, Homo sapiens
atcaagagtccggatttct

SEQ ID NO: 1253020 - DNA, 14 bp, Homo sapiens
atcaagattttagg

SEQ ID NO: 1253021 - DNA, 15 bp, Homo sapiens
atcaagcacactgta

SEQ ID NO: 1253022 - DNA, 14 bp, Homo sapiens
atcaagcctttatg

SEQ ID NO: 1253023 - DNA, 17 bp, Homo sapiens
atcaagctagaaggcca

SEQ ID NO: 1253024 - DNA, 20 bp, Homo sapiens
atcaagctagaaggccacat

SEQ ID NO: 1253025 - DNA, 22 bp, Homo sapiens
atcaaggaaaggctcatttaaa

SEQ ID NO: 1253026 - DNA, 22 bp, Homo sapiens
atcaaggaagaaatggttcaga

SEQ ID NO: 1253027 - DNA, 20 bp, Homo sapiens
atcaaggattttcatgttga

SEQ ID NO: 1253028 - DNA, 17 bp, Homo sapiens
atcaaggcaaaaggaat

SEQ ID NO: 1253029 - DNA, 15 bp, Homo sapiens
atcaaggtccagtgg

SEQ ID NO: 1253030 - DNA, 16 bp, Homo sapiens
atcaagtaatacaaac

SEQ ID NO: 1253031 - DNA, 21 bp, Homo sapiens
atcaagtattactaaattgac

SEQ ID NO: 1253032 - DNA, 14 bp, Homo sapiens
atcaagtattatac

SEQ ID NO: 1253033 - DNA, 21 bp, Homo sapiens
atcaagtatttgggaagtgaa

SEQ ID NO: 1253034 - DNA, 17 bp, Homo sapiens
atcaagtccatctgaca

SEQ ID NO: 1253035 - DNA, 20 bp, Homo sapiens
atcaagtccatctgacaaaa

SEQ ID NO: 1253036 - DNA, 22 bp, Homo sapiens
atcaagttctccccagggtaga

SEQ ID NO: 1253037 - DNA, 15 bp, Homo sapiens
atcaagttgaattga

SEQ ID NO: 1253038 - DNA, 18 bp, Homo sapiens
atcaagttgttgactgtg

SEQ ID NO: 1253039 - DNA, 21 bp, Homo sapiens
atcaagttgttgactgtgatt

SEQ ID NO: 1253040 - DNA, 22 bp, Homo sapiens
atcaagttgttgactgtgatta

SEQ ID NO: 1253041 - DNA, 11 bp, Homo sapiens
atcaagtttta

SEQ ID NO: 1253042 - DNA, 20 bp, Homo sapiens
atcaataaaggacaggctgg

SEQ ID NO: 1253043 - DNA, 16 bp, Homo sapiens
atcaataatatatttt

SEQ ID NO: 1253044 - DNA, 21 bp, Homo sapiens
atcaataatatattttctgtt

SEQ ID NO: 1253045 - DNA, 12 bp, Homo sapiens
atcaatacacta

SEQ ID NO: 1253046 - DNA, 13 bp, Homo sapiens
atcaatagttgaa

SEQ ID NO: 1253047 - DNA, 17 bp, Homo sapiens
atcaatagttgaattag

SEQ ID NO: 1253048 - DNA, 23 bp, Homo sapiens
atcaatatgcagaatggcatttg

SEQ ID NO: 1253049 - DNA, 12 bp, Homo sapiens
atcaatcaatgg

SEQ ID NO: 1253050 - DNA, 20 bp, Homo sapiens
atcaatcatctgtgtgaaaa

SEQ ID NO: 1253051 - DNA, 13 bp, Homo sapiens
atcaatcttgtta

SEQ ID NO: 1253052 - DNA, 16 bp, Homo sapiens
atcaatcttgttactg

SEQ ID NO: 1253053 - DNA, 19 bp, Homo sapiens
atcaatcttgttactgctg

SEQ ID NO: 1253054 - DNA, 15 bp, Homo sapiens
atcaatggtgcaaaa

SEQ ID NO: 1253055 - DNA, 16 bp, Homo sapiens
atcaatggtgcaaaaa

SEQ ID NO: 1253056 - DNA, 14 bp, Homo sapiens
atcaatgtgtcttt

SEQ ID NO: 1253057 - DNA, 14 bp, Homo sapiens
atcaatgttcattg

SEQ ID NO: 1253058 - DNA, 17 bp, Homo sapiens
atcaatgttcattgtaa

SEQ ID NO: 1253059 - DNA, 18 bp, Homo sapiens
atcaatgttcattgtaat

SEQ ID NO: 1253060 - DNA, 15 bp, Homo sapiens
atcaattaaatgtag

SEQ ID NO: 1253061 - DNA, 16 bp, Homo sapiens
atcaattcatatctat

SEQ ID NO: 1253062 - DNA, 14 bp, Homo sapiens
atcaatttctccca

SEQ ID NO: 1253063 - DNA, 19 bp, Homo sapiens
atcaattttcattaaactt

SEQ ID NO: 1253064 - DNA, 22 bp, Homo sapiens
atcaattttcattaaacttgaa

SEQ ID NO: 1253065 - DNA, 22 bp, Homo sapiens
atcaattttgacttaatgtgat

SEQ ID NO: 1253066 - DNA, 16 bp, Homo sapiens
atcaatttttcccagt

SEQ ID NO: 1253067 - DNA, 17 bp, Homo sapiens
atcaatttttcccagta

SEQ ID NO: 1253068 - DNA, 19 bp, Homo sapiens
atcaatttttcccagtatt

SEQ ID NO: 1253069 - DNA, 13 bp, Homo sapiens
atcacaaaaacaa

SEQ ID NO: 1253070 - DNA, 16 bp, Homo sapiens
atcacaaaaacaaaaa

SEQ ID NO: 1253071 - DNA, 20 bp, Homo sapiens
atcacaaaaacaaaaaaact

SEQ ID NO: 1253072 - DNA, 21 bp, Homo sapiens
atcacaaaaacaaaaaaacta

SEQ ID NO: 1253073 - DNA, 15 bp, Homo sapiens
atcacaaagtggaac

SEQ ID NO: 1253074 - DNA, 16 bp, Homo sapiens
atcacaagatggaatt

SEQ ID NO: 1253075 - DNA, 21 bp, Homo sapiens
atcacacccagcccatgtggc

SEQ ID NO: 1253076 - DNA, 15 bp, Homo sapiens
atcacacctctgggc

SEQ ID NO: 1253077 - DNA, 18 bp, Homo sapiens
atcacacttatattttat

SEQ ID NO: 1253078 - DNA, 19 bp, Homo sapiens
atcacacttatattttatg

SEQ ID NO: 1253079 - DNA, 18 bp, Homo sapiens
atcacacttctgtgagac

SEQ ID NO: 1253080 - DNA, 20 bp, Homo sapiens
atcacagatgggtattaaac

SEQ ID NO: 1253081 - DNA, 10 bp, Homo sapiens
atcacagcct

SEQ ID NO: 1253082 - DNA, 14 bp, Homo sapiens
atcacagcctccag

SEQ ID NO: 1253083 - DNA, 17 bp, Homo sapiens
atcacagcctccagggc

SEQ ID NO: 1253084 - DNA, 20 bp, Homo sapiens
atcacagctccctaggtagg

SEQ ID NO: 1253085 - DNA, 12 bp, Homo sapiens
atcacagctgct

SEQ ID NO: 1253086 - DNA, 15 bp, Homo sapiens
atcacagggcagagc

SEQ ID NO: 1253087 - DNA, 12 bp, Homo sapiens
atcacagggccc

SEQ ID NO: 1253088 - DNA, 21 bp, Homo sapiens
atcataaggagttggtgtaat

SEQ ID NO: 1253089 - DNA, 14 bp, Homo sapiens
atcataattacatt

SEQ ID NO: 1253090 - DNA, 19 bp, Homo sapiens
atcataattacattcctaa

SEQ ID NO: 1253091 - DNA, 18 bp, Homo sapiens
atcataattaccaagtga

SEQ ID NO: 1253092 - DNA, 14 bp, Homo sapiens
atcatacagttttc

SEQ ID NO: 1253093 - DNA, 18 bp, Homo sapiens
atcatactgcctactgtt

SEQ ID NO: 1253094 - DNA, 21 bp, Homo sapiens
atcatagattattataaacta

SEQ ID NO: 1253095 - DNA, 23 bp, Homo sapiens
atcatagattattataaactata

SEQ ID NO: 1253096 - DNA, 20 bp, Homo sapiens
atcatagctcactgcagcct

SEQ ID NO: 1253097 - DNA, 17 bp, Homo sapiens
atcataggaagtggctg

SEQ ID NO: 1253098 - DNA, 19 bp, Homo sapiens
atcataggaagtggctggt

SEQ ID NO: 1253099 - DNA, 20 bp, Homo sapiens
atcatataataaatgtacat

SEQ ID NO: 1253100 - DNA, 21 bp, Homo sapiens
atcatatgaggacctttatat

SEQ ID NO: 1253101 - DNA, 13 bp, Homo sapiens
atcatatgattct

SEQ ID NO: 1253102 - DNA, 19 bp, Homo sapiens
atcatatgattctgctttt

SEQ ID NO: 1253103 - DNA, 14 bp, Homo sapiens
atcatatgcctgac

SEQ ID NO: 1253104 - DNA, 13 bp, Homo sapiens
atcatcaaaaagt

SEQ ID NO: 1253105 - DNA, 17 bp, Homo sapiens
atcatcaagaagggctg

SEQ ID NO: 1253106 - DNA, 18 bp, Homo sapiens
atcatcaagaagggctgc

SEQ ID NO: 1253107 - DNA, 23 bp, Homo sapiens
atcatcaagcaggaattatgtcg

SEQ ID NO: 1253108 - DNA, 21 bp, Homo sapiens
atcatcaagtaatacaaacta

SEQ ID NO: 1253109 - DNA, 17 bp, Homo sapiens
atcatcacgtatgttat

SEQ ID NO: 1253110 - DNA, 22 bp, Homo sapiens
atcatcacgtatgttatacaac

SEQ ID NO: 1253111 - DNA, 17 bp, Homo sapiens
atcatcactgtaaagac

SEQ ID NO: 1253112 - DNA, 21 bp, Homo sapiens
atcatcactgtaaagacaaat

SEQ ID NO: 1253113 - DNA, 14 bp, Homo sapiens
atcatcagggcctg

SEQ ID NO: 1253114 - DNA, 16 bp, Homo sapiens
atcatcagtgtagaac

SEQ ID NO: 1253115 - DNA, 18 bp, Homo sapiens
atcatcatgtgtgtccac

SEQ ID NO: 1253116 - DNA, 23 bp, Homo sapiens
atcatcattcttgtgggagacag

SEQ ID NO: 1253117 - DNA, 17 bp, Homo sapiens
atcatccagatgtggct

SEQ ID NO: 1253118 - DNA, 16 bp, Homo sapiens
atcatcccttaataaa

SEQ ID NO: 1253119 - DNA, 14 bp, Homo sapiens
atcatccctttctc

SEQ ID NO: 1253120 - DNA, 17 bp, Homo sapiens
atcatcctccattgctc

SEQ ID NO: 1253121 - DNA, 20 bp, Homo sapiens
atcatcctgaatctgatctt

SEQ ID NO: 1253122 - DNA, 15 bp, Homo sapiens
atcatcctgttttct

SEQ ID NO: 1253123 - DNA, 18 bp, Homo sapiens
atcatcctgttttctctg

SEQ ID NO: 1253124 - DNA, 17 bp, Homo sapiens
atcatcctttgttctga

SEQ ID NO: 1253125 - DNA, 20 bp, Homo sapiens
atcatcctttgttctgagca

SEQ ID NO: 1253126 - DNA, 22 bp, Homo sapiens
atcatcctttgttctgagcatt

SEQ ID NO: 1253127 - DNA, 24 bp, Homo sapiens
atcatcggagtcagccaggagctg

SEQ ID NO: 1253128 - DNA, 14 bp, Homo sapiens
atcatctccatcat

SEQ ID NO: 1253129 - DNA, 17 bp, Homo sapiens
atcatctgcattcctga

SEQ ID NO: 1253130 - DNA, 18 bp, Homo sapiens
atcatctgcattcctgat

SEQ ID NO: 1253131 - DNA, 18 bp, Homo sapiens
atcatcttagactttgca

SEQ ID NO: 1253132 - DNA, 15 bp, Homo sapiens
atcatgaaatatgca

SEQ ID NO: 1253133 - DNA, 18 bp, Homo sapiens
atcatgaagccttgctga

SEQ ID NO: 1253134 - DNA, 22 bp, Homo sapiens
atcatgaagccttgctgaacta

SEQ ID NO: 1253135 - DNA, 20 bp, Homo sapiens
atcatgaattcccttttaat

SEQ ID NO: 1253136 - DNA, 21 bp, Homo sapiens
atcatgaattcccttttaatc

SEQ ID NO: 1253137 - DNA, 19 bp, Homo sapiens
atcatgaatttattgcaca

SEQ ID NO: 1253138 - DNA, 20 bp, Homo sapiens
atcatgacaaagactgagta

SEQ ID NO: 1253139 - DNA, 21 bp, Homo sapiens
atcatgagaaaaactgttctt

SEQ ID NO: 1253140 - DNA, 18 bp, Homo sapiens
atcatgcacacaattaga

SEQ ID NO: 1253141 - DNA, 19 bp, Homo sapiens
atcatgcactttttctcct

SEQ ID NO: 1253142 - DNA, 12 bp, Homo sapiens
atcatgcattgt

SEQ ID NO: 1253143 - DNA, 19 bp, Homo sapiens
atcatgccagtatttttaa

SEQ ID NO: 1253144 - DNA, 12 bp, Homo sapiens
atcatgccctgt

SEQ ID NO: 1253145 - DNA, 20 bp, Homo sapiens
atcatgccttgataaatata

SEQ ID NO: 1253146 - DNA, 21 bp, Homo sapiens
atcatgccttgataaatatat

SEQ ID NO: 1253147 - DNA, 22 bp, Homo sapiens
atcatgccttgataaatatata

SEQ ID NO: 1253148 - DNA, 16 bp, Homo sapiens
atcatgcgttttatat

SEQ ID NO: 1253149 - DNA, 22 bp, Homo sapiens
atcatgctggaacctgcaaaaa

SEQ ID NO: 1253150 - DNA, 15 bp, Homo sapiens
atcatggaccaaatg

SEQ ID NO: 1253151 - DNA, 12 bp, Homo sapiens
atcatggagaaa

SEQ ID NO: 1253152 - DNA, 21 bp, Homo sapiens
atcatggattcattacagctt

SEQ ID NO: 1253153 - DNA, 19 bp, Homo sapiens
atcatgggaaaagaccagg

SEQ ID NO: 1253154 - DNA, 18 bp, Homo sapiens
atcatgggccagagcctc

SEQ ID NO: 1253155 - DNA, 14 bp, Homo sapiens
atcatgggtcaaga

SEQ ID NO: 1253156 - DNA, 17 bp, Homo sapiens
atcatggtcaagttccc

SEQ ID NO: 1253157 - DNA, 15 bp, Homo sapiens
atcatgtaaatgctc

SEQ ID NO: 1253158 - DNA, 16 bp, Homo sapiens
atcatgtaaatgctca

SEQ ID NO: 1253159 - DNA, 21 bp, Homo sapiens
atcatgtactttggcatcttt

SEQ ID NO: 1253160 - DNA, 19 bp, Homo sapiens
atcatgtcaggcctgtgtg

SEQ ID NO: 1253161 - DNA, 14 bp, Homo sapiens
atcatgtctattgt

SEQ ID NO: 1253162 - DNA, 21 bp, Homo sapiens
atcatgtctattgtccaaagt

SEQ ID NO: 1253163 - DNA, 20 bp, Homo sapiens
atcatgtcttgtgcataatt

SEQ ID NO: 1253164 - DNA, 17 bp, Homo sapiens
atcatgtggccccaccc

SEQ ID NO: 1253165 - DNA, 15 bp, Homo sapiens
atcatgttgaaacaa

SEQ ID NO: 1253166 - DNA, 16 bp, Homo sapiens
atcatgttgaaacaaa

SEQ ID NO: 1253167 - DNA, 19 bp, Homo sapiens
atcatgttgatcatgtact

SEQ ID NO: 1253168 - DNA, 23 bp, Homo sapiens
atcatgttgttgtgtgtatatgt

SEQ ID NO: 1253169 - DNA, 16 bp, Homo sapiens
atcatgtttgctctcc

SEQ ID NO: 1253170 - DNA, 17 bp, Homo sapiens
atcatgttttataattt

SEQ ID NO: 1253171 - DNA, 20 bp, Homo sapiens
atcatgttttataatttgaa

SEQ ID NO: 1253172 - DNA, 12 bp, Homo sapiens
atcattaaaaat

SEQ ID NO: 1253173 - DNA, 13 bp, Homo sapiens
atcattaaaatat

SEQ ID NO: 1253174 - DNA, 19 bp, Homo sapiens
atcattaaaatatatgttc

SEQ ID NO: 1253175 - DNA, 22 bp, Homo sapiens
atcattaaaatatatgttctgc

SEQ ID NO: 1253176 - DNA, 11 bp, Homo sapiens
atcattaatac

SEQ ID NO: 1253177 - DNA, 15 bp, Homo sapiens
atcattactggtaaa

SEQ ID NO: 1253178 - DNA, 16 bp, Homo sapiens
atcattactggtaaag

SEQ ID NO: 1253179 - DNA, 20 bp, Homo sapiens
atcattagagcttaaattgt

SEQ ID NO: 1253180 - DNA, 16 bp, Homo sapiens
atcattaggtgtgact

SEQ ID NO: 1253181 - DNA, 16 bp, Homo sapiens
atcattataaacgtga

SEQ ID NO: 1253182 - DNA, 20 bp, Homo sapiens
atcattataactgaaggaga

SEQ ID NO: 1253183 - DNA, 15 bp, Homo sapiens
atcattccctctcat

SEQ ID NO: 1253184 - DNA, 22 bp, Homo sapiens
atcattccctctcatctcaggt

SEQ ID NO: 1253185 - DNA, 11 bp, Homo sapiens
atcattctcag

SEQ ID NO: 1253186 - DNA, 12 bp, Homo sapiens
atcattctcagt

SEQ ID NO: 1253187 - DNA, 21 bp, Homo sapiens
atcattctctgtctcatccat

SEQ ID NO: 1253188 - DNA, 24 bp, Homo sapiens
atcattctctgtctcatccatcat

SEQ ID NO: 1253189 - DNA, 13 bp, Homo sapiens
atcattctgtgtc

SEQ ID NO: 1253190 - DNA, 23 bp, Homo sapiens
atcattcttactaaaaagtataa

SEQ ID NO: 1253191 - DNA, 20 bp, Homo sapiens
atcattcttgtgggagacag

SEQ ID NO: 1253192 - DNA, 16 bp, Homo sapiens
atcattctttcccctc

SEQ ID NO: 1253193 - DNA, 17 bp, Homo sapiens
atcattctttcccctca

SEQ ID NO: 1253194 - DNA, 22 bp, Homo sapiens
atcattctttcccctcagagct

SEQ ID NO: 1253195 - DNA, 23 bp, Homo sapiens
atcattctttcccctcagagctc

SEQ ID NO: 1253196 - DNA, 15 bp, Homo sapiens
atcattgaaatactt

SEQ ID NO: 1253197 - DNA, 13 bp, Homo sapiens
atcattgcatttc

SEQ ID NO: 1253198 - DNA, 23 bp, Homo sapiens
atcattgctttgaagcagttgtg

SEQ ID NO: 1253199 - DNA, 19 bp, Homo sapiens
atcattggaacaactgata

SEQ ID NO: 1253200 - DNA, 14 bp, Homo sapiens
atcatttcagccaa

SEQ ID NO: 1253201 - DNA, 16 bp, Homo sapiens
atcatttcagccaaag

SEQ ID NO: 1253202 - DNA, 15 bp, Homo sapiens
atcatttctatttct

SEQ ID NO: 1253203 - DNA, 23 bp, Homo sapiens
atcatttctgtctttaagaacta

SEQ ID NO: 1253204 - DNA, 15 bp, Homo sapiens
atcatttcttgggcc

SEQ ID NO: 1253205 - DNA, 17 bp, Homo sapiens
atcatttggttaaatca

SEQ ID NO: 1253206 - DNA, 13 bp, Homo sapiens
atcatttgtgaag

SEQ ID NO: 1253207 - DNA, 13 bp, Homo sapiens
atcatttgtttaa

SEQ ID NO: 1253208 - DNA, 13 bp, Homo sapiens
atcattttaaaaa

SEQ ID NO: 1253209 - DNA, 14 bp, Homo sapiens
atccctcttgtaag

SEQ ID NO: 1253210 - DNA, 15 bp, Homo sapiens
atccctcttgtaagt

SEQ ID NO: 1253211 - DNA, 20 bp, Homo sapiens
atccctgaacccctggccag

SEQ ID NO: 1253212 - DNA, 21 bp, Homo sapiens
atccctgaacccctggccagc

SEQ ID NO: 1253213 - DNA, 22 bp, Homo sapiens
atccctgaggactgatttcaga

SEQ ID NO: 1253214 - DNA, 11 bp, Homo sapiens
atccctgcaga

SEQ ID NO: 1253215 - DNA, 12 bp, Homo sapiens
atccctgccact

SEQ ID NO: 1253216 - DNA, 14 bp, Homo sapiens
atccctgccactgg

SEQ ID NO: 1253217 - DNA, 14 bp, Homo sapiens
atccctgcccagcc

SEQ ID NO: 1253218 - DNA, 16 bp, Homo sapiens
atccctgcggcctcca

SEQ ID NO: 1253219 - DNA, 15 bp, Homo sapiens
atccctgctctggtc

SEQ ID NO: 1253220 - DNA, 17 bp, Homo sapiens
atccctgggcattgctt

SEQ ID NO: 1253221 - DNA, 16 bp, Homo sapiens
atccctgggcccctcc

SEQ ID NO: 1253222 - DNA, 19 bp, Homo sapiens
atccctgttacccagagaa

SEQ ID NO: 1253223 - DNA, 13 bp, Homo sapiens
atccctgtttaat

SEQ ID NO: 1253224 - DNA, 15 bp, Homo sapiens
atccctgtttaatat

SEQ ID NO: 1253225 - DNA, 16 bp, Homo sapiens
atccctgtttaatatt

SEQ ID NO: 1253226 - DNA, 21 bp, Homo sapiens
atcccttaatatcctaaacat

SEQ ID NO: 1253227 - DNA, 12 bp, Homo sapiens
atcccttcctgg

SEQ ID NO: 1253228 - DNA, 16 bp, Homo sapiens
atcccttcctggaaac

SEQ ID NO: 1253229 - DNA, 21 bp, Homo sapiens
atcccttcctggaaacagcat

SEQ ID NO: 1253230 - DNA, 21 bp, Homo sapiens
atcccttccttttagcctagt

SEQ ID NO: 1253231 - DNA, 18 bp, Homo sapiens
atcccttcggagccaaca

SEQ ID NO: 1253232 - DNA, 22 bp, Homo sapiens
atccctttcatgtctttccact

SEQ ID NO: 1253233 - DNA, 12 bp, Homo sapiens
atccctttctcc

SEQ ID NO: 1253234 - DNA, 23 bp, Homo sapiens
atccctttgtctgtcaatcacag

SEQ ID NO: 1253235 - DNA, 18 bp, Homo sapiens
atcccttttcctttctgg

SEQ ID NO: 1253236 - DNA, 21 bp, Homo sapiens
atcccttttcctttctggccc

SEQ ID NO: 1253237 - DNA, 15 bp, Homo sapiens
atccgaagggaatta

SEQ ID NO: 1253238 - DNA, 13 bp, Homo sapiens
atccgagcgacgg

SEQ ID NO: 1253239 - DNA, 21 bp, Homo sapiens
atccgagcgacggctcctccc

SEQ ID NO: 1253240 - DNA, 16 bp, Homo sapiens
atccgcaatgtggagc

SEQ ID NO: 1253241 - DNA, 23 bp, Homo sapiens
atccgcaatgtggagcagcagcc

SEQ ID NO: 1253242 - DNA, 16 bp, Homo sapiens
atccgctctcttcctg

SEQ ID NO: 1253243 - DNA, 14 bp, Homo sapiens
atccgctgccacca

SEQ ID NO: 1253244 - DNA, 13 bp, Homo sapiens
atccggaaagaag

SEQ ID NO: 1253245 - DNA, 14 bp, Homo sapiens
atccggagaagctg

SEQ ID NO: 1253246 - DNA, 22 bp, Homo sapiens
atccggcaacatcaacccgagt

SEQ ID NO: 1253247 - DNA, 21 bp, Homo sapiens
atccggtggcctattccagga

SEQ ID NO: 1253248 - DNA, 23 bp, Homo sapiens
atccggtttagtcatccaacaag

SEQ ID NO: 1253249 - DNA, 17 bp, Homo sapiens
atccgtagttccctgaa

SEQ ID NO: 1253250 - DNA, 16 bp, Homo sapiens
atccgtcattgctgct

SEQ ID NO: 1253251 - DNA, 14 bp, Homo sapiens
atcctaaaacaaat

SEQ ID NO: 1253252 - DNA, 22 bp, Homo sapiens
atcctaaaagagatctgggcat

SEQ ID NO: 1253253 - DNA, 14 bp, Homo sapiens
atcctaaactctct

SEQ ID NO: 1253254 - DNA, 18 bp, Homo sapiens
atcctaaactctctagct

SEQ ID NO: 1253255 - DNA, 13 bp, Homo sapiens
atcctaagaattt

SEQ ID NO: 1253256 - DNA, 15 bp, Homo sapiens
atcctaagacacaaa

SEQ ID NO: 1253257 - DNA, 21 bp, Homo sapiens
atcctaagctattcagtaata

SEQ ID NO: 1253258 - DNA, 19 bp, Homo sapiens
atcctaatttctcctccct

SEQ ID NO: 1253259 - DNA, 18 bp, Homo sapiens
atcctacaagacacagtg

SEQ ID NO: 1253260 - DNA, 13 bp, Homo sapiens
atcctagacttga

SEQ ID NO: 1253261 - DNA, 23 bp, Homo sapiens
atcctagcactttgggaggctga

SEQ ID NO: 1253262 - DNA, 21 bp, Homo sapiens
atcctaggcatttgctgaata

SEQ ID NO: 1253263 - DNA, 19 bp, Homo sapiens
atcctagggcacttctagt

SEQ ID NO: 1253264 - DNA, 15 bp, Homo sapiens
atcctagtttcctct

SEQ ID NO: 1253265 - DNA, 18 bp, Homo sapiens
atcctagtttcctctcct

SEQ ID NO: 1253266 - DNA, 19 bp, Homo sapiens
atcctataagcttaaatag

SEQ ID NO: 1253267 - DNA, 12 bp, Homo sapiens
atcctatatctg

SEQ ID NO: 1253268 - DNA, 18 bp, Homo sapiens
atcctatatctgtttgta

SEQ ID NO: 1253269 - DNA, 23 bp, Homo sapiens
atcctatatctgtttgtatattt

SEQ ID NO: 1253270 - DNA, 21 bp, Homo sapiens
atcctatctggggagctcctg

SEQ ID NO: 1253271 - DNA, 23 bp, Homo sapiens
atcctatctggggagctcctggc

SEQ ID NO: 1253272 - DNA, 18 bp, Homo sapiens
atcctattctcaccagga

SEQ ID NO: 1253273 - DNA, 20 bp, Homo sapiens
atcctattctcaccaggaag

SEQ ID NO: 1253274 - DNA, 15 bp, Homo sapiens
atcctcaaagaaagt

SEQ ID NO: 1253275 - DNA, 20 bp, Homo sapiens
atcctcaaagaaagtgtatt

SEQ ID NO: 1253276 - DNA, 17 bp, Homo sapiens
atcctcaacactattgt

SEQ ID NO: 1253277 - DNA, 22 bp, Homo sapiens
atcctcaccatccacagcaaga

SEQ ID NO: 1253278 - DNA, 19 bp, Homo sapiens
atcctcacccagatcagga

SEQ ID NO: 1253279 - DNA, 16 bp, Homo sapiens
atcctcactgccctcc

SEQ ID NO: 1253280 - DNA, 20 bp, Homo sapiens
atcctcagaggctgagccct

SEQ ID NO: 1253281 - DNA, 23 bp, Homo sapiens
atcctcagaggctgagccctgta

SEQ ID NO: 1253282 - DNA, 18 bp, Homo sapiens
atcctcagcccctccagt

SEQ ID NO: 1253283 - DNA, 19 bp, Homo sapiens
atcctcagcccctccagtc

SEQ ID NO: 1253284 - DNA, 20 bp, Homo sapiens
atcctcagccgagaaattgg

SEQ ID NO: 1253285 - DNA, 18 bp, Homo sapiens
atcctcaggtagtactgg

SEQ ID NO: 1253286 - DNA, 20 bp, Homo sapiens
atcctcaggtagtactggga

SEQ ID NO: 1253287 - DNA, 16 bp, Homo sapiens
atcctcatatggccca

SEQ ID NO: 1253288 - DNA, 17 bp, Homo sapiens
atcctcattgcctcctg

SEQ ID NO: 1253289 - DNA, 18 bp, Homo sapiens
atcctcattgcctcctgt

SEQ ID NO: 1253290 - DNA, 22 bp, Homo sapiens
atcctcatttgaggaagctctc

SEQ ID NO: 1253291 - DNA, 14 bp, Homo sapiens
atcctccaatgtct

SEQ ID NO: 1253292 - DNA, 17 bp, Homo sapiens
atcctccaatgtctaat

SEQ ID NO: 1253293 - DNA, 16 bp, Homo sapiens
atcctccacagagagg

SEQ ID NO: 1253294 - DNA, 13 bp, Homo sapiens
atcctccagcagg

SEQ ID NO: 1253295 - DNA, 15 bp, Homo sapiens
atcctccagcaggga

SEQ ID NO: 1253296 - DNA, 14 bp, Homo sapiens
atcctccagcttct

SEQ ID NO: 1253297 - DNA, 23 bp, Homo sapiens
atcctccctacttccaagaaaaa

SEQ ID NO: 1253298 - DNA, 12 bp, Homo sapiens
atcctccctcca

SEQ ID NO: 1253299 - DNA, 19 bp, Homo sapiens
atcctccctccacctcaag

SEQ ID NO: 1253300 - DNA, 12 bp, Homo sapiens
atcctccctgcc

SEQ ID NO: 1253301 - DNA, 17 bp, Homo sapiens
atcctccctgcccatcc

SEQ ID NO: 1253302 - DNA, 20 bp, Homo sapiens
atcctccctggcagacacaa

SEQ ID NO: 1253303 - DNA, 22 bp, Homo sapiens
atcctcccttgccccaggccag

SEQ ID NO: 1253304 - DNA, 22 bp, Homo sapiens
atcctcctacctcagcctcctg

SEQ ID NO: 1253305 - DNA, 13 bp, Homo sapiens
atcctcctccagg

SEQ ID NO: 1253306 - DNA, 14 bp, Homo sapiens
atcctcctcccacc

SEQ ID NO: 1253307 - DNA, 11 bp, Homo sapiens
atcctcctgcc

SEQ ID NO: 1253308 - DNA, 19 bp, Homo sapiens
atcctcctgcccagctcct

SEQ ID NO: 1253309 - DNA, 21 bp, Homo sapiens
atcctcctgcccagctcctca

SEQ ID NO: 1253310 - DNA, 22 bp, Homo sapiens
atcctcctgcccagctcctcac

SEQ ID NO: 1253311 - DNA, 12 bp, Homo sapiens
atcctcctgcct

SEQ ID NO: 1253312 - DNA, 14 bp, Homo sapiens
atcctcctgcctca

SEQ ID NO: 1253313 - DNA, 19 bp, Homo sapiens
atcctcctgcctcagcctt

SEQ ID NO: 1253314 - DNA, 14 bp, Homo sapiens
atcctcctggaacc

SEQ ID NO: 1253315 - DNA, 16 bp, Homo sapiens
atcctcctggaacctt

SEQ ID NO: 1253316 - DNA, 22 bp, Homo sapiens
atcctcctggaaccttgctgtc

SEQ ID NO: 1253317 - DNA, 19 bp, Homo sapiens
atcctctaaagcagaggca

SEQ ID NO: 1253318 - DNA, 14 bp, Homo sapiens
atcctctattttgt

SEQ ID NO: 1253319 - DNA, 10 bp, Homo sapiens
atcctctctc

SEQ ID NO: 1253320 - DNA, 14 bp, Homo sapiens
atcctctctctctt

SEQ ID NO: 1253321 - DNA, 15 bp, Homo sapiens
atcctctctctcttc

SEQ ID NO: 1253322 - DNA, 16 bp, Homo sapiens
atcctctctctcttct

SEQ ID NO: 1253323 - DNA, 17 bp, Homo sapiens
atcctctctctcttcta

SEQ ID NO: 1253324 - DNA, 13 bp, Homo sapiens
atcctctcttcct

SEQ ID NO: 1253325 - DNA, 20 bp, Homo sapiens
atcctctcttcctcttcccc

SEQ ID NO: 1253326 - DNA, 18 bp, Homo sapiens
atcctctgagtgtgacca

SEQ ID NO: 1253327 - DNA, 13 bp, Homo sapiens
atcctcttcctct

SEQ ID NO: 1253328 - DNA, 22 bp, Homo sapiens
atcctcttctgcttaggagaga

SEQ ID NO: 1253329 - DNA, 16 bp, Homo sapiens
atcctcttgtatactt

SEQ ID NO: 1253330 - DNA, 15 bp, Homo sapiens
atcctgacacattct

SEQ ID NO: 1253331 - DNA, 18 bp, Homo sapiens
atctagtttacagaaaaa

SEQ ID NO: 1253332 - DNA, 22 bp, Homo sapiens
atctagtttacagaaaaatctt

SEQ ID NO: 1253333 - DNA, 11 bp, Homo sapiens
atctataattt

SEQ ID NO: 1253334 - DNA, 13 bp, Homo sapiens
atctataatttac

SEQ ID NO: 1253335 - DNA, 17 bp, Homo sapiens
atctataggcagcttct

SEQ ID NO: 1253336 - DNA, 18 bp, Homo sapiens
atctataggcagcttcta

SEQ ID NO: 1253337 - DNA, 21 bp, Homo sapiens
atctataggcagcttctaaga

SEQ ID NO: 1253338 - DNA, 21 bp, Homo sapiens
atctatagttgatatgtttta

SEQ ID NO: 1253339 - DNA, 13 bp, Homo sapiens
atctatataaaat

SEQ ID NO: 1253340 - DNA, 16 bp, Homo sapiens
atctatataaaataac

SEQ ID NO: 1253341 - DNA, 18 bp, Homo sapiens
atctatatatgtgtatgt

SEQ ID NO: 1253342 - DNA, 22 bp, Homo sapiens
atctatatgtacttgtcaaaga

SEQ ID NO: 1253343 - DNA, 14 bp, Homo sapiens
atctatattaaatg

SEQ ID NO: 1253344 - DNA, 15 bp, Homo sapiens
atctatattaaatga

SEQ ID NO: 1253345 - DNA, 20 bp, Homo sapiens
atctatatttgtcttccgat

SEQ ID NO: 1253346 - DNA, 17 bp, Homo sapiens
atctatcagtagtatag

SEQ ID NO: 1253347 - DNA, 21 bp, Homo sapiens
atctatctggtgatttctagc

SEQ ID NO: 1253348 - DNA, 13 bp, Homo sapiens
atctatgaggaaa

SEQ ID NO: 1253349 - DNA, 14 bp, Homo sapiens
atctatgcagcatg

SEQ ID NO: 1253350 - DNA, 17 bp, Homo sapiens
atctatgccaaagatca

SEQ ID NO: 1253351 - DNA, 19 bp, Homo sapiens
atctatgccaaagatcact

SEQ ID NO: 1253352 - DNA, 21 bp, Homo sapiens
atctatgccaaagatcacttg

SEQ ID NO: 1253353 - DNA, 19 bp, Homo sapiens
atctatggcttatttctat

SEQ ID NO: 1253354 - DNA, 21 bp, Homo sapiens
atctatggcttatttctatga

SEQ ID NO: 1253355 - DNA, 20 bp, Homo sapiens
atctatgtcgtgttttcaag

SEQ ID NO: 1253356 - DNA, 23 bp, Homo sapiens
atctatgtcgtgttttcaaggaa

SEQ ID NO: 1253357 - DNA, 16 bp, Homo sapiens
atctatgtgtttctgt

SEQ ID NO: 1253358 - DNA, 19 bp, Homo sapiens
atctatgtgtttctgtaac

SEQ ID NO: 1253359 - DNA, 17 bp, Homo sapiens
atctattaaagtgactt

SEQ ID NO: 1253360 - DNA, 18 bp, Homo sapiens
atctattaaagtgacttt

SEQ ID NO: 1253361 - DNA, 14 bp, Homo sapiens
atctattaatatat

SEQ ID NO: 1253362 - DNA, 18 bp, Homo sapiens
atctattaatatatgtat

SEQ ID NO: 1253363 - DNA, 21 bp, Homo sapiens
atctattacttttgcaaactg

SEQ ID NO: 1253364 - DNA, 22 bp, Homo sapiens
atctattcagacaagcaacagg

SEQ ID NO: 1253365 - DNA, 23 bp, Homo sapiens
atctattcctgtaaataagagtt

SEQ ID NO: 1253366 - DNA, 13 bp, Homo sapiens
atctatttattaa

SEQ ID NO: 1253367 - DNA, 12 bp, Homo sapiens
atctatttgtac

SEQ ID NO: 1253368 - DNA, 17 bp, Homo sapiens
atctatttgtacaattt

SEQ ID NO: 1253369 - DNA, 23 bp, Homo sapiens
atctatttgtacaattttaaagt

SEQ ID NO: 1253370 - DNA, 14 bp, Homo sapiens
atctattttggatt

SEQ ID NO: 1253371 - DNA, 22 bp, Homo sapiens
atctattttggattgtatattg

SEQ ID NO: 1253372 - DNA, 19 bp, Homo sapiens
atctatttttggcagtctg

SEQ ID NO: 1253373 - DNA, 23 bp, Homo sapiens
atctatttttttttctttttaaa

SEQ ID NO: 1253374 - DNA, 17 bp, Homo sapiens
atctcaaagcacaatgt

SEQ ID NO: 1253375 - DNA, 15 bp, Homo sapiens
atctcaaaggagaaa

SEQ ID NO: 1253376 - DNA, 23 bp, Homo sapiens
atctcaaataactaaaaggtatg

SEQ ID NO: 1253377 - DNA, 20 bp, Homo sapiens
atctcaaataggctattaaa

SEQ ID NO: 1253378 - DNA, 16 bp, Homo sapiens
atctcaaatttctaaa

SEQ ID NO: 1253379 - DNA, 17 bp, Homo sapiens
atctcaaatttctaaat

SEQ ID NO: 1253380 - DNA, 23 bp, Homo sapiens
atctcaagatgggggcagggctg

SEQ ID NO: 1253381 - DNA, 16 bp, Homo sapiens
atctcaatctgcagcc

SEQ ID NO: 1253382 - DNA, 16 bp, Homo sapiens
atctcacaggctgaga

SEQ ID NO: 1253383 - DNA, 17 bp, Homo sapiens
atctcagaaagtgcctg

SEQ ID NO: 1253384 - DNA, 18 bp, Homo sapiens
atctcagaaagtgcctga

SEQ ID NO: 1253385 - DNA, 23 bp, Homo sapiens
atctcagaaccttgtcccagcca

SEQ ID NO: 1253386 - DNA, 19 bp, Homo sapiens
atctcagatacttatgaaa

SEQ ID NO: 1253387 - DNA, 18 bp, Homo sapiens
atctcagatgttaaaata

SEQ ID NO: 1253388 - DNA, 16 bp, Homo sapiens
atctcagattctgtct

SEQ ID NO: 1253389 - DNA, 23 bp, Homo sapiens
atctcagcaaagctacaggactg

SEQ ID NO: 1253390 - DNA, 14 bp, Homo sapiens
atctcagccatagg

SEQ ID NO: 1253391 - DNA, 22 bp, Homo sapiens
atctcagccatccgcagactgc

SEQ ID NO: 1253392 - DNA, 14 bp, Homo sapiens
atctcagcctcctg

SEQ ID NO: 1253393 - DNA, 18 bp, Homo sapiens
atctcagcctcctgagcc

SEQ ID NO: 1253394 - DNA, 23 bp, Homo sapiens
atctcagctttgagaagccttca

SEQ ID NO: 1253395 - DNA, 14 bp, Homo sapiens
atctcaggccacct

SEQ ID NO: 1253396 - DNA, 19 bp, Homo sapiens
atctcaggccacctgcccc

SEQ ID NO: 1253397 - DNA, 20 bp, Homo sapiens
atctcaggccacctgccccc

SEQ ID NO: 1253398 - DNA, 16 bp, Homo sapiens
atctcagggcctggtc

SEQ ID NO: 1253399 - DNA, 15 bp, Homo sapiens
atctcaggggccaga

SEQ ID NO: 1253400 - DNA, 23 bp, Homo sapiens
atctcaggggccagaggaactgt

SEQ ID NO: 1253401 - DNA, 14 bp, Homo sapiens
atctcaggtgccac

SEQ ID NO: 1253402 - DNA, 23 bp, Homo sapiens
atctcaggttggcggcagacaca

SEQ ID NO: 1253403 - DNA, 14 bp, Homo sapiens
atctcagtgaagaa

SEQ ID NO: 1253404 - DNA, 15 bp, Homo sapiens
atctcagtgaagaat

SEQ ID NO: 1253405 - DNA, 17 bp, Homo sapiens
atctcagtgaagaatac

SEQ ID NO: 1253406 - DNA, 15 bp, Homo sapiens
atctcatactgtctg

SEQ ID NO: 1253407 - DNA, 16 bp, Homo sapiens
atctcatactgtctgg

SEQ ID NO: 1253408 - DNA, 14 bp, Homo sapiens
atctcatagggatg

SEQ ID NO: 1253409 - DNA, 20 bp, Homo sapiens
atctcatagggatgctgtga

SEQ ID NO: 1253410 - DNA, 17 bp, Homo sapiens
atctcatccccccaccc

SEQ ID NO: 1253411 - DNA, 18 bp, Homo sapiens
atctcatccccccacccg

SEQ ID NO: 1253412 - DNA, 19 bp, Homo sapiens
atctcatctcagtgaagaa

SEQ ID NO: 1253413 - DNA, 17 bp, Homo sapiens
atctcatgattccatgc

SEQ ID NO: 1253414 - DNA, 14 bp, Homo sapiens
atctcattggaccc

SEQ ID NO: 1253415 - DNA, 19 bp, Homo sapiens
atctcattggacccttcca

SEQ ID NO: 1253416 - DNA, 16 bp, Homo sapiens
atctcatttaagggaa

SEQ ID NO: 1253417 - DNA, 20 bp, Homo sapiens
atctcatttaagggaaaaat

SEQ ID NO: 1253418 - DNA, 23 bp, Homo sapiens
atctcatttaagggaaaaatata

SEQ ID NO: 1253419 - DNA, 17 bp, Homo sapiens
atctccaaaataaaact

SEQ ID NO: 1253420 - DNA, 13 bp, Homo sapiens
atctccaagacct

SEQ ID NO: 1253421 - DNA, 16 bp, Homo sapiens
atctccaaggaccagg

SEQ ID NO: 1253422 - DNA, 15 bp, Homo sapiens
atctccaattgcctc

SEQ ID NO: 1253423 - DNA, 16 bp, Homo sapiens
atctccagcggccctg

SEQ ID NO: 1253424 - DNA, 12 bp, Homo sapiens
atctccaggatt

SEQ ID NO: 1253425 - DNA, 11 bp, Homo sapiens
atctccaggga

SEQ ID NO: 1253426 - DNA, 12 bp, Homo sapiens
atctccagggaa

SEQ ID NO: 1253427 - DNA, 20 bp, Homo sapiens
atctccagggagtcccctcc

SEQ ID NO: 1253428 - DNA, 18 bp, Homo sapiens
atctccagtattcttgtc

SEQ ID NO: 1253429 - DNA, 13 bp, Homo sapiens
atctccagtgtgc

SEQ ID NO: 1253430 - DNA, 15 bp, Homo sapiens
atctccagtgtgcca

SEQ ID NO: 1253431 - DNA, 19 bp, Homo sapiens
atctccagtgtgccagaca

SEQ ID NO: 1253432 - DNA, 14 bp, Homo sapiens
atctccatggccct

SEQ ID NO: 1253433 - DNA, 15 bp, Homo sapiens
atctccatggcttcc

SEQ ID NO: 1253434 - DNA, 19 bp, Homo sapiens
atctccatggcttcctcct

SEQ ID NO: 1253435 - DNA, 23 bp, Homo sapiens
atctccatgtagaataaatgaag

SEQ ID NO: 1253436 - DNA, 22 bp, Homo sapiens
atctccattgtgcctaagtcca

SEQ ID NO: 1253437 - DNA, 20 bp, Homo sapiens
atctcccacctagcagcacc

SEQ ID NO: 1253438 - DNA, 19 bp, Homo sapiens
atctcccattttggaattt

SEQ ID NO: 1253439 - DNA, 14 bp, Homo sapiens
atctccccactcta

SEQ ID NO: 1253440 - DNA, 18 bp, Homo sapiens
atctccccaggcctccag

SEQ ID NO: 1253441 - DNA, 13 bp, Homo sapiens
atctcccctcctc

SEQ ID NO: 1253442 - DNA, 16 bp, Homo sapiens
atctcccctcctcaca

SEQ ID NO: 1253443 - DNA, 15 bp, Homo sapiens
atctcccgctgctgc

SEQ ID NO: 1253444 - DNA, 14 bp, Homo sapiens
atctccctcccaca

SEQ ID NO: 1253445 - DNA, 14 bp, Homo sapiens
atctccctccccag

SEQ ID NO: 1253446 - DNA, 21 bp, Homo sapiens
atctccctgccatccccctct

SEQ ID NO: 1253447 - DNA, 15 bp, Homo sapiens
atctccctgccgcct

SEQ ID NO: 1253448 - DNA, 17 bp, Homo sapiens
atctccctgcctggccc

SEQ ID NO: 1253449 - DNA, 20 bp, Homo sapiens
atctccctgcctggccccca

SEQ ID NO: 1253450 - DNA, 14 bp, Homo sapiens
atctccctgctttg

SEQ ID NO: 1253451 - DNA, 19 bp, Homo sapiens
atctcccttagaagagagc

SEQ ID NO: 1253452 - DNA, 14 bp, Homo sapiens
atctcctaactttg

SEQ ID NO: 1253453 - DNA, 23 bp, Homo sapiens
atctgagtgaattgtacctattt

SEQ ID NO: 1253454 - DNA, 12 bp, Homo sapiens
atctgagttgca

SEQ ID NO: 1253455 - DNA, 14 bp, Homo sapiens
atctgagttgccaa

SEQ ID NO: 1253456 - DNA, 18 bp, Homo sapiens
atctgagttgccaagaca

SEQ ID NO: 1253457 - DNA, 23 bp, Homo sapiens
atctgagttgccaagacaaatca

SEQ ID NO: 1253458 - DNA, 20 bp, Homo sapiens
atctgatagaatgatgtttt

SEQ ID NO: 1253459 - DNA, 15 bp, Homo sapiens
atctgatctgtgatt

SEQ ID NO: 1253460 - DNA, 23 bp, Homo sapiens
atctgatctttttatacacaata

SEQ ID NO: 1253461 - DNA, 19 bp, Homo sapiens
atctgatggccttaatttc

SEQ ID NO: 1253462 - DNA, 23 bp, Homo sapiens
atctgatggccttaatttccttt

SEQ ID NO: 1253463 - DNA, 17 bp, Homo sapiens
atctgatggtgagctgg

SEQ ID NO: 1253464 - DNA, 22 bp, Homo sapiens
atctgattgttgtcaggccata

SEQ ID NO: 1253465 - DNA, 14 bp, Homo sapiens
atctgcaacaaaaa

SEQ ID NO: 1253466 - DNA, 14 bp, Homo sapiens
atctgcaatatgaa

SEQ ID NO: 1253467 - DNA, 15 bp, Homo sapiens
atctgcaatatgaat

SEQ ID NO: 1253468 - DNA, 18 bp, Homo sapiens
atctgcaatttctactac

SEQ ID NO: 1253469 - DNA, 18 bp, Homo sapiens
atctgcaccccttctctc

SEQ ID NO: 1253470 - DNA, 12 bp, Homo sapiens
atctgcaccctt

SEQ ID NO: 1253471 - DNA, 17 bp, Homo sapiens
atctgcacccttctttt

SEQ ID NO: 1253472 - DNA, 19 bp, Homo sapiens
atctgcacccttcttttct

SEQ ID NO: 1253473 - DNA, 14 bp, Homo sapiens
atctgcagaaggaa

SEQ ID NO: 1253474 - DNA, 19 bp, Homo sapiens
atctgcagaatgggccact

SEQ ID NO: 1253475 - DNA, 20 bp, Homo sapiens
atctgcaggcaccgggctgg

SEQ ID NO: 1253476 - DNA, 14 bp, Homo sapiens
atctgcaggcagac

SEQ ID NO: 1253477 - DNA, 14 bp, Homo sapiens
atctgcatatttct

SEQ ID NO: 1253478 - DNA, 15 bp, Homo sapiens
atctgcatatttctg

SEQ ID NO: 1253479 - DNA, 16 bp, Homo sapiens
atctgcatatttctgt

SEQ ID NO: 1253480 - DNA, 15 bp, Homo sapiens
atctgcattatctat

SEQ ID NO: 1253481 - DNA, 14 bp, Homo sapiens
atctgcattcctga

SEQ ID NO: 1253482 - DNA, 22 bp, Homo sapiens
atctgcattttcaccccaccct

SEQ ID NO: 1253483 - DNA, 23 bp, Homo sapiens
atctgcattttcaccccaccctt

SEQ ID NO: 1253484 - DNA, 16 bp, Homo sapiens
atctgccaaattgaga

SEQ ID NO: 1253485 - DNA, 15 bp, Homo sapiens
atctgccacaaaaac

SEQ ID NO: 1253486 - DNA, 17 bp, Homo sapiens
atctgccagaccttaat

SEQ ID NO: 1253487 - DNA, 16 bp, Homo sapiens
atctgcccaggggtgc

SEQ ID NO: 1253488 - DNA, 11 bp, Homo sapiens
atctgcccctc

SEQ ID NO: 1253489 - DNA, 22 bp, Homo sapiens
atctgccctccctgtttctcca

SEQ ID NO: 1253490 - DNA, 14 bp, Homo sapiens
atctgcctcccctg

SEQ ID NO: 1253491 - DNA, 22 bp, Homo sapiens
atctgcctctggaaaactattg

SEQ ID NO: 1253492 - DNA, 15 bp, Homo sapiens
atctgcctgcgctct

SEQ ID NO: 1253493 - DNA, 13 bp, Homo sapiens
atctgcctggcct

SEQ ID NO: 1253494 - DNA, 14 bp, Homo sapiens
atctgcctggcctg

SEQ ID NO: 1253495 - DNA, 11 bp, Homo sapiens
atctgcctggg

SEQ ID NO: 1253496 - DNA, 14 bp, Homo sapiens
atctgcctgggcct

SEQ ID NO: 1253497 - DNA, 15 bp, Homo sapiens
atctgcctgggcctg

SEQ ID NO: 1253498 - DNA, 18 bp, Homo sapiens
atctgcctgggcctgtgc

SEQ ID NO: 1253499 - DNA, 14 bp, Homo sapiens
atctgcctgtaatt

SEQ ID NO: 1253500 - DNA, 18 bp, Homo sapiens
atctgcctgtggccttgc

SEQ ID NO: 1253501 - DNA, 20 bp, Homo sapiens
atctgcctgtggccttgccc

SEQ ID NO: 1253502 - DNA, 17 bp, Homo sapiens
atctgccttaaaaccaa

SEQ ID NO: 1253503 - DNA, 15 bp, Homo sapiens
atctgcgcagggtgg

SEQ ID NO: 1253504 - DNA, 22 bp, Homo sapiens
atctgcggatctcagctttgag

SEQ ID NO: 1253505 - DNA, 23 bp, Homo sapiens
atctgcggatctcagctttgaga

SEQ ID NO: 1253506 - DNA, 16 bp, Homo sapiens
atctgcgtgacaataa

SEQ ID NO: 1253507 - DNA, 15 bp, Homo sapiens
atctgcgtgtgtgca

SEQ ID NO: 1253508 - DNA, 14 bp, Homo sapiens
atctgctagaaagt

SEQ ID NO: 1253509 - DNA, 20 bp, Homo sapiens
atctgctagggaatatcaat

SEQ ID NO: 1253510 - DNA, 17 bp, Homo sapiens
atctgctagtgctgtaa

SEQ ID NO: 1253511 - DNA, 20 bp, Homo sapiens
atctgctagtgctgtaatat

SEQ ID NO: 1253512 - DNA, 23 bp, Homo sapiens
atctgctagtgctgtaatattgt

SEQ ID NO: 1253513 - DNA, 18 bp, Homo sapiens
atctgctcattttgacaa

SEQ ID NO: 1253514 - DNA, 13 bp, Homo sapiens
atctgctcctccc

SEQ ID NO: 1253515 - DNA, 15 bp, Homo sapiens
atctgctctgtttta

SEQ ID NO: 1253516 - DNA, 20 bp, Homo sapiens
atctgctgcagttaccacag

SEQ ID NO: 1253517 - DNA, 13 bp, Homo sapiens
atctgctgcatag

SEQ ID NO: 1253518 - DNA, 13 bp, Homo sapiens
atctgctgggaac

SEQ ID NO: 1253519 - DNA, 12 bp, Homo sapiens
atctgctgtgtg

SEQ ID NO: 1253520 - DNA, 21 bp, Homo sapiens
atctgcttacaattccctgct

SEQ ID NO: 1253521 - DNA, 14 bp, Homo sapiens
atctgcttcagtgg

SEQ ID NO: 1253522 - DNA, 13 bp, Homo sapiens
atctgcttctcca

SEQ ID NO: 1253523 - DNA, 17 bp, Homo sapiens
atctggaatattgtgat

SEQ ID NO: 1253524 - DNA, 19 bp, Homo sapiens
atctggaccccatctgtga

SEQ ID NO: 1253525 - DNA, 21 bp, Homo sapiens
atctggaccccatctgtgaat

SEQ ID NO: 1253526 - DNA, 17 bp, Homo sapiens
atctggactcctctgtc

SEQ ID NO: 1253527 - DNA, 22 bp, Homo sapiens
atctggactcctctgtccaggc

SEQ ID NO: 1253528 - DNA, 21 bp, Homo sapiens
atctggagaccagggagcctt

SEQ ID NO: 1253529 - DNA, 22 bp, Homo sapiens
atctggagaccagggagccttt

SEQ ID NO: 1253530 - DNA, 20 bp, Homo sapiens
atctggagcacttgttttaa

SEQ ID NO: 1253531 - DNA, 19 bp, Homo sapiens
atctggaggccttccagct

SEQ ID NO: 1253532 - DNA, 21 bp, Homo sapiens
atctggaggccttccagctgc

SEQ ID NO: 1253533 - DNA, 22 bp, Homo sapiens
atctggcagagcctcagctgta

SEQ ID NO: 1253534 - DNA, 21 bp, Homo sapiens
atctggccctcgacactcacc

SEQ ID NO: 1253535 - DNA, 15 bp, Homo sapiens
atctggctgcacagg

SEQ ID NO: 1253536 - DNA, 16 bp, Homo sapiens
atctggctgcacaggc

SEQ ID NO: 1253537 - DNA, 22 bp, Homo sapiens
atctggctgcagttttgctatc

SEQ ID NO: 1253538 - DNA, 21 bp, Homo sapiens
atctggctggaaagcagagcc

SEQ ID NO: 1253539 - DNA, 20 bp, Homo sapiens
atctggctgtctagaatgtg

SEQ ID NO: 1253540 - DNA, 16 bp, Homo sapiens
atctggcttacagggg

SEQ ID NO: 1253541 - DNA, 14 bp, Homo sapiens
atctgggaaagaca

SEQ ID NO: 1253542 - DNA, 16 bp, Homo sapiens
atctgggaccctttcc

SEQ ID NO: 1253543 - DNA, 15 bp, Homo sapiens
atctgggagggaagt

SEQ ID NO: 1253544 - DNA, 20 bp, Homo sapiens
atctgggcattttcctcctc

SEQ ID NO: 1253545 - DNA, 21 bp, Homo sapiens
atctgggcattttcctcctct

SEQ ID NO: 1253546 - DNA, 23 bp, Homo sapiens
atctgggcattttcctcctctgc

SEQ ID NO: 1253547 - DNA, 24 bp, Homo sapiens
atctgggcattttcctcctctgcc

SEQ ID NO: 1253548 - DNA, 16 bp, Homo sapiens
atctggggagctcctg

SEQ ID NO: 1253549 - DNA, 12 bp, Homo sapiens
atctggggaggc

SEQ ID NO: 1253550 - DNA, 22 bp, Homo sapiens
atctggggcagcaccctataaa

SEQ ID NO: 1253551 - DNA, 23 bp, Homo sapiens
atctggggggtggggaggaggaa

SEQ ID NO: 1253552 - DNA, 14 bp, Homo sapiens
atctgggtagctgt

SEQ ID NO: 1253553 - DNA, 15 bp, Homo sapiens
atctgggtatctttc

SEQ ID NO: 1253554 - DNA, 18 bp, Homo sapiens
atctgggtccttgcaccc

SEQ ID NO: 1253555 - DNA, 22 bp, Homo sapiens
atctgggtctcccaggacacat

SEQ ID NO: 1253556 - DNA, 14 bp, Homo sapiens
atctgggtgccctg

SEQ ID NO: 1253557 - DNA, 20 bp, Homo sapiens
atctggtagggggaaaatgt

SEQ ID NO: 1253558 - DNA, 16 bp, Homo sapiens
atctggtatatgtcat

SEQ ID NO: 1253559 - DNA, 16 bp, Homo sapiens
atctggtattaaatgc

SEQ ID NO: 1253560 - DNA, 22 bp, Homo sapiens
atctggtcaagttgagattttt

SEQ ID NO: 1253561 - DNA, 17 bp, Homo sapiens
atctggtcctacccatc

SEQ ID NO: 1253562 - DNA, 18 bp, Homo sapiens
atctggtcctacccatcc

SEQ ID NO: 1253563 - DNA, 16 bp, Homo sapiens
atctggtctaatttat

SEQ ID NO: 1253564 - DNA, 20 bp, Homo sapiens
atctggtcttgtttccagga

SEQ ID NO: 1253565 - DNA, 14 bp, Homo sapiens
atctggtgacaaat

SEQ ID NO: 1253566 - DNA, 15 bp, Homo sapiens
atctggtgatttcta

SEQ ID NO: 1253567 - DNA, 13 bp, Homo sapiens
atctggtgcctcc

SEQ ID NO: 1253568 - DNA, 17 bp, Homo sapiens
atctggtgcctcctcaa

SEQ ID NO: 1253569 - DNA, 15 bp, Homo sapiens
atctggtggtcagcc

SEQ ID NO: 1253570 - DNA, 16 bp, Homo sapiens
atctgtaaagaaaacc

SEQ ID NO: 1253571 - DNA, 22 bp, Homo sapiens
atctgtaacccccaaggaggaa

SEQ ID NO: 1253572 - DNA, 19 bp, Homo sapiens
atctgtaacccttgaattt

SEQ ID NO: 1253573 - DNA, 23 bp, Homo sapiens
atctgtaacccttgaatttctag

SEQ ID NO: 1253574 - DNA, 18 bp, Homo sapiens
atctgtaatggtactgac

SEQ ID NO: 1253575 - DNA, 14 bp, Homo sapiens
atcttttacttttt

SEQ ID NO: 1253576 - DNA, 17 bp, Homo sapiens
atcttttagtgtttact

SEQ ID NO: 1253577 - DNA, 13 bp, Homo sapiens
atcttttattctt

SEQ ID NO: 1253578 - DNA, 20 bp, Homo sapiens
atcttttcaaggcatttgtc

SEQ ID NO: 1253579 - DNA, 20 bp, Homo sapiens
atcttttctaatcacagtgt

SEQ ID NO: 1253580 - DNA, 22 bp, Homo sapiens
atcttttctagagacacattgg

SEQ ID NO: 1253581 - DNA, 13 bp, Homo sapiens
atcttttcttatt

SEQ ID NO: 1253582 - DNA, 14 bp, Homo sapiens
atcttttgaagagc

SEQ ID NO: 1253583 - DNA, 14 bp, Homo sapiens
atcttttggttatt

SEQ ID NO: 1253584 - DNA, 23 bp, Homo sapiens
atcttttgtgagatgtaattgtt

SEQ ID NO: 1253585 - DNA, 11 bp, Homo sapiens
atctttttaaa

SEQ ID NO: 1253586 - DNA, 19 bp, Homo sapiens
atctttttaaaaactcttc

SEQ ID NO: 1253587 - DNA, 21 bp, Homo sapiens
atctttttaaaaactcttcag

SEQ ID NO: 1253588 - DNA, 22 bp, Homo sapiens
atctttttaaaaactcttcagt

SEQ ID NO: 1253589 - DNA, 23 bp, Homo sapiens
atctttttaaaaactcttcagtg

SEQ ID NO: 1253590 - DNA, 15 bp, Homo sapiens
atctttttaaaacta

SEQ ID NO: 1253591 - DNA, 12 bp, Homo sapiens
atctttttacag

SEQ ID NO: 1253592 - DNA, 19 bp, Homo sapiens
atctttttacctttcatac

SEQ ID NO: 1253593 - DNA, 16 bp, Homo sapiens
atctttttatacacaa

SEQ ID NO: 1253594 - DNA, 18 bp, Homo sapiens
atctttttatacacaata

SEQ ID NO: 1253595 - DNA, 16 bp, Homo sapiens
atctttttatattctt

SEQ ID NO: 1253596 - DNA, 22 bp, Homo sapiens
atctttttatcccatttagtgt

SEQ ID NO: 1253597 - DNA, 23 bp, Homo sapiens
atctttttatcccatttagtgtg

SEQ ID NO: 1253598 - DNA, 15 bp, Homo sapiens
atctttttatgcaaa

SEQ ID NO: 1253599 - DNA, 16 bp, Homo sapiens
atctttttatgcaaaa

SEQ ID NO: 1253600 - DNA, 23 bp, Homo sapiens
atctttttctagagttatcttct

SEQ ID NO: 1253601 - DNA, 16 bp, Homo sapiens
atctttttctccaccc

SEQ ID NO: 1253602 - DNA, 16 bp, Homo sapiens
atctttttctttttaa

SEQ ID NO: 1253603 - DNA, 13 bp, Homo sapiens
atctttttgcttc

SEQ ID NO: 1253604 - DNA, 14 bp, Homo sapiens
atcttttttcaaaa

SEQ ID NO: 1253605 - DNA, 15 bp, Homo sapiens
atgaaaaacaaacaa

SEQ ID NO: 1253606 - DNA, 17 bp, Homo sapiens
atgaaaaagaagaatct

SEQ ID NO: 1253607 - DNA, 13 bp, Homo sapiens
atgaaaaatacat

SEQ ID NO: 1253608 - DNA, 15 bp, Homo sapiens
atgaaaaatgtaaat

SEQ ID NO: 1253609 - DNA, 18 bp, Homo sapiens
atgaaaaattggggagga

SEQ ID NO: 1253610 - DNA, 16 bp, Homo sapiens
atgaaaaatttaagca

SEQ ID NO: 1253611 - DNA, 15 bp, Homo sapiens
atgaaaacacatttt

SEQ ID NO: 1253612 - DNA, 13 bp, Homo sapiens
atgaaaacatgta

SEQ ID NO: 1253613 - DNA, 20 bp, Homo sapiens
atgaaaactcatgatcaaga

SEQ ID NO: 1253614 - DNA, 16 bp, Homo sapiens
atgaaaactctttgct

SEQ ID NO: 1253615 - DNA, 16 bp, Homo sapiens
atgaaaacttttgtaa

SEQ ID NO: 1253616 - DNA, 19 bp, Homo sapiens
atgaaaacttttgtaaatt

SEQ ID NO: 1253617 - DNA, 13 bp, Homo sapiens
atgaaaagctaga

SEQ ID NO: 1253618 - DNA, 18 bp, Homo sapiens
atgaaaagctagaattga

SEQ ID NO: 1253619 - DNA, 11 bp, Homo sapiens
atgaaaaggat

SEQ ID NO: 1253620 - DNA, 21 bp, Homo sapiens
atgaaaaggttgcctgaaaaa

SEQ ID NO: 1253621 - DNA, 16 bp, Homo sapiens
atgaaaagtatattga

SEQ ID NO: 1253622 - DNA, 19 bp, Homo sapiens
atgaaaataactgaatttg

SEQ ID NO: 1253623 - DNA, 17 bp, Homo sapiens
atgaaaataatctctga

SEQ ID NO: 1253624 - DNA, 15 bp, Homo sapiens
atgaaaataattttc

SEQ ID NO: 1253625 - DNA, 22 bp, Homo sapiens
atgaaaatacaacttaaataat

SEQ ID NO: 1253626 - DNA, 15 bp, Homo sapiens
atgaaaatacatctt

SEQ ID NO: 1253627 - DNA, 13 bp, Homo sapiens
atgaaaatgagcc

SEQ ID NO: 1253628 - DNA, 14 bp, Homo sapiens
atgaaaatgagccc

SEQ ID NO: 1253629 - DNA, 20 bp, Homo sapiens
atgaaaatgagccctggctc

SEQ ID NO: 1253630 - DNA, 14 bp, Homo sapiens
atgaaaatgtcttg

SEQ ID NO: 1253631 - DNA, 15 bp, Homo sapiens
atgaaaatgtcttgt

SEQ ID NO: 1253632 - DNA, 11 bp, Homo sapiens
atgaaaattgt

SEQ ID NO: 1253633 - DNA, 12 bp, Homo sapiens
atgaaacacctt

SEQ ID NO: 1253634 - DNA, 17 bp, Homo sapiens
atgaaacaccttctctg

SEQ ID NO: 1253635 - DNA, 15 bp, Homo sapiens
atgaaacacttctca

SEQ ID NO: 1253636 - DNA, 16 bp, Homo sapiens
atgaaacacttctcat

SEQ ID NO: 1253637 - DNA, 15 bp, Homo sapiens
atgaaacagatgata

SEQ ID NO: 1253638 - DNA, 21 bp, Homo sapiens
atgaaacagatgataaatatt

SEQ ID NO: 1253639 - DNA, 23 bp, Homo sapiens
atgaaacagatgataaatattta

SEQ ID NO: 1253640 - DNA, 20 bp, Homo sapiens
atgaaactcctgattttgta

SEQ ID NO: 1253641 - DNA, 15 bp, Homo sapiens
atgaaactctttcat

SEQ ID NO: 1253642 - DNA, 20 bp, Homo sapiens
atgaaactctttcattcttc

SEQ ID NO: 1253643 - DNA, 12 bp, Homo sapiens
atgaaagactgt

SEQ ID NO: 1253644 - DNA, 13 bp, Homo sapiens
atgaaagactgta

SEQ ID NO: 1253645 - DNA, 20 bp, Homo sapiens
atgaaagatggctgtgcctc

SEQ ID NO: 1253646 - DNA, 21 bp, Homo sapiens
atgaaagggtttgtaatactt

SEQ ID NO: 1253647 - DNA, 23 bp, Homo sapiens
atgaaagggtttgtaatacttta

SEQ ID NO: 1253648 - DNA, 15 bp, Homo sapiens
atgaaaggtactata

SEQ ID NO: 1253649 - DNA, 20 bp, Homo sapiens
atgaaaggtactatatttgc

SEQ ID NO: 1253650 - DNA, 21 bp, Homo sapiens
atgaaaggtactatatttgct

SEQ ID NO: 1253651 - DNA, 21 bp, Homo sapiens
atgaaaggtttacattgtcaa

SEQ ID NO: 1253652 - DNA, 19 bp, Homo sapiens
atgaaagtcttactgggcc

SEQ ID NO: 1253653 - DNA, 15 bp, Homo sapiens
atgaaagtgacttta

SEQ ID NO: 1253654 - DNA, 15 bp, Homo sapiens
atgaaagtgcctgcc

SEQ ID NO: 1253655 - DNA, 20 bp, Homo sapiens
atgaaataactccttcttgt

SEQ ID NO: 1253656 - DNA, 15 bp, Homo sapiens
atgaaataatgtgaa

SEQ ID NO: 1253657 - DNA, 17 bp, Homo sapiens
atgaaatactatttaaa

SEQ ID NO: 1253658 - DNA, 22 bp, Homo sapiens
atgaaataggagggaaaccttt

SEQ ID NO: 1253659 - DNA, 23 bp, Homo sapiens
atgaaatatatattgtaaagaag

SEQ ID NO: 1253660 - DNA, 13 bp, Homo sapiens
atgaaatattgct

SEQ ID NO: 1253661 - DNA, 20 bp, Homo sapiens
atgaaatctgctagaaagtt

SEQ ID NO: 1253662 - DNA, 13 bp, Homo sapiens
atgaaatctgttt

SEQ ID NO: 1253663 - DNA, 16 bp, Homo sapiens
atgaaatctgtttgtt

SEQ ID NO: 1253664 - DNA, 14 bp, Homo sapiens
atgaaatctttctt

SEQ ID NO: 1253665 - DNA, 17 bp, Homo sapiens
atgaaatgataaagact

SEQ ID NO: 1253666 - DNA, 20 bp, Homo sapiens
atgaaatgataaagactttt

SEQ ID NO: 1253667 - DNA, 23 bp, Homo sapiens
atgaaatgataaagacttttatg

SEQ ID NO: 1253668 - DNA, 18 bp, Homo sapiens
atgaaatgcatatttgca

SEQ ID NO: 1253669 - DNA, 13 bp, Homo sapiens
atgaaatgtttac

SEQ ID NO: 1253670 - DNA, 18 bp, Homo sapiens
atgaaattaccagatata

SEQ ID NO: 1253671 - DNA, 23 bp, Homo sapiens
atgaaattttctagactttctgt

SEQ ID NO: 1253672 - DNA, 14 bp, Homo sapiens
atgaacaaaattat

SEQ ID NO: 1253673 - DNA, 13 bp, Homo sapiens
atgaacaaactat

SEQ ID NO: 1253674 - DNA, 16 bp, Homo sapiens
atgaacaaatatgctt

SEQ ID NO: 1253675 - DNA, 12 bp, Homo sapiens
atgaacaaatgg

SEQ ID NO: 1253676 - DNA, 15 bp, Homo sapiens
atgaacacactgtgt

SEQ ID NO: 1253677 - DNA, 14 bp, Homo sapiens
atgaacacagacaa

SEQ ID NO: 1253678 - DNA, 16 bp, Homo sapiens
atgaacagaaactaca

SEQ ID NO: 1253679 - DNA, 21 bp, Homo sapiens
atgaacagaacatagacagaa

SEQ ID NO: 1253680 - DNA, 13 bp, Homo sapiens
atgaacagctctg

SEQ ID NO: 1253681 - DNA, 20 bp, Homo sapiens
atgaacagctctgagatcct

SEQ ID NO: 1253682 - DNA, 23 bp, Homo sapiens
atgaacagctctgagatcctgga

SEQ ID NO: 1253683 - DNA, 15 bp, Homo sapiens
atgaacagctgtgtc

SEQ ID NO: 1253684 - DNA, 21 bp, Homo sapiens
atgaacagggcccaggcctgg

SEQ ID NO: 1253685 - DNA, 22 bp, Homo sapiens
atgaacagggcccaggcctgga

SEQ ID NO: 1253686 - DNA, 23 bp, Homo sapiens
atgaacagggcccaggcctggag

SEQ ID NO: 1253687 - DNA, 15 bp, Homo sapiens
atgaacatattcatg

SEQ ID NO: 1253688 - DNA, 21 bp, Homo sapiens
atgaacatattgttgaaaggt

SEQ ID NO: 1253689 - DNA, 13 bp, Homo sapiens
atgaacattgtac

SEQ ID NO: 1253690 - DNA, 17 bp, Homo sapiens
atgaacattgtactgtt

SEQ ID NO: 1253691 - DNA, 18 bp, Homo sapiens
atgaacattgtactgttg

SEQ ID NO: 1253692 - DNA, 22 bp, Homo sapiens
atgaacattgtactgttgcttt

SEQ ID NO: 1253693 - DNA, 23 bp, Homo sapiens
atgaacattgtactgttgcttta

SEQ ID NO: 1253694 - DNA, 18 bp, Homo sapiens
atgaacccgaggctgaga

SEQ ID NO: 1253695 - DNA, 16 bp, Homo sapiens
atgaaccctcctcctt

SEQ ID NO: 1253696 - DNA, 15 bp, Homo sapiens
atgaaccctcttgcc

SEQ ID NO: 1253697 - DNA, 16 bp, Homo sapiens
atgacagatattttat

SEQ ID NO: 1253698 - DNA, 15 bp, Homo sapiens
atgacagatgcaagt

SEQ ID NO: 1253699 - DNA, 18 bp, Homo sapiens
atgacagatgcaagttat

SEQ ID NO: 1253700 - DNA, 16 bp, Homo sapiens
atgacagatgttgaat

SEQ ID NO: 1253701 - DNA, 15 bp, Homo sapiens
atgacagcctgcagc

SEQ ID NO: 1253702 - DNA, 16 bp, Homo sapiens
atgacagcctgcagca

SEQ ID NO: 1253703 - DNA, 14 bp, Homo sapiens
atgacagctggcta

SEQ ID NO: 1253704 - DNA, 15 bp, Homo sapiens
atgacagctgtccct

SEQ ID NO: 1253705 - DNA, 15 bp, Homo sapiens
atgacaggcctgtcc

SEQ ID NO: 1253706 - DNA, 12 bp, Homo sapiens
atgacagggcag

SEQ ID NO: 1253707 - DNA, 13 bp, Homo sapiens
atgacagggcaga

SEQ ID NO: 1253708 - DNA, 15 bp, Homo sapiens
atgacaggtgtgagc

SEQ ID NO: 1253709 - DNA, 19 bp, Homo sapiens
atgacagtccgtcaaaaca

SEQ ID NO: 1253710 - DNA, 21 bp, Homo sapiens
atgacagtccgtcaaaacaga

SEQ ID NO: 1253711 - DNA, 15 bp, Homo sapiens
atgacagtgcttgca

SEQ ID NO: 1253712 - DNA, 16 bp, Homo sapiens
atgacatcaaaatgag

SEQ ID NO: 1253713 - DNA, 14 bp, Homo sapiens
atgacatcacttgt

SEQ ID NO: 1253714 - DNA, 18 bp, Homo sapiens
atgacatcacttgtacaa

SEQ ID NO: 1253715 - DNA, 20 bp, Homo sapiens
atgacatcacttgtacaaaa

SEQ ID NO: 1253716 - DNA, 20 bp, Homo sapiens
atgacatccagaaagctgag

SEQ ID NO: 1253717 - DNA, 22 bp, Homo sapiens
atgacatccagaaagctgagga

SEQ ID NO: 1253718 - DNA, 15 bp, Homo sapiens
atgacatgttatata

SEQ ID NO: 1253719 - DNA, 17 bp, Homo sapiens
atgacatgttatatatt

SEQ ID NO: 1253720 - DNA, 23 bp, Homo sapiens
atgacatgttatatattttttgt

SEQ ID NO: 1253721 - DNA, 20 bp, Homo sapiens
atgacatgttcctttaaggt

SEQ ID NO: 1253722 - DNA, 19 bp, Homo sapiens
atgacattaaatgcaataa

SEQ ID NO: 1253723 - DNA, 21 bp, Homo sapiens
atgacattaaatgcaataatt

SEQ ID NO: 1253724 - DNA, 21 bp, Homo sapiens
atgacattacaatcctgcatt

SEQ ID NO: 1253725 - DNA, 19 bp, Homo sapiens
atgacattgttaaaataaa

SEQ ID NO: 1253726 - DNA, 15 bp, Homo sapiens
atgacatttcatctg

SEQ ID NO: 1253727 - DNA, 20 bp, Homo sapiens
atgacatttcgttttttaca

SEQ ID NO: 1253728 - DNA, 18 bp, Homo sapiens
atgaccaaaccagccttc

SEQ ID NO: 1253729 - DNA, 19 bp, Homo sapiens
atgaccaaaccagccttcg

SEQ ID NO: 1253730 - DNA, 18 bp, Homo sapiens
atgaccaaagtcccttcc

SEQ ID NO: 1253731 - DNA, 15 bp, Homo sapiens
atgaccaaagtcctt

SEQ ID NO: 1253732 - DNA, 23 bp, Homo sapiens
atgaccacacccgaagtcctgtc

SEQ ID NO: 1253733 - DNA, 23 bp, Homo sapiens
atgaccacataagaaggcaattt

SEQ ID NO: 1253734 - DNA, 23 bp, Homo sapiens
atgaccacgcacctccacgccac

SEQ ID NO: 1253735 - DNA, 18 bp, Homo sapiens
atgaccactgggcctgct

SEQ ID NO: 1253736 - DNA, 14 bp, Homo sapiens
atgaccagaagcct

SEQ ID NO: 1253737 - DNA, 14 bp, Homo sapiens
atgaccagcaaata

SEQ ID NO: 1253738 - DNA, 23 bp, Homo sapiens
atgaccagcagcagctttcagct

SEQ ID NO: 1253739 - DNA, 14 bp, Homo sapiens
atgaccagggatgc

SEQ ID NO: 1253740 - DNA, 21 bp, Homo sapiens
atgaccagggatgctgggctg

SEQ ID NO: 1253741 - DNA, 22 bp, Homo sapiens
atgaccagggatgctgggctgg

SEQ ID NO: 1253742 - DNA, 17 bp, Homo sapiens
atgaccatactgaggga

SEQ ID NO: 1253743 - DNA, 15 bp, Homo sapiens
atgacccaaagacca

SEQ ID NO: 1253744 - DNA, 16 bp, Homo sapiens
atgacccaaagaccaa

SEQ ID NO: 1253745 - DNA, 15 bp, Homo sapiens
atgacccacactgcc

SEQ ID NO: 1253746 - DNA, 16 bp, Homo sapiens
atgacccacactgcca

SEQ ID NO: 1253747 - DNA, 12 bp, Homo sapiens
atgacccacccc

SEQ ID NO: 1253748 - DNA, 13 bp, Homo sapiens
atgacccacccct

SEQ ID NO: 1253749 - DNA, 14 bp, Homo sapiens
atgacccagcctga

SEQ ID NO: 1253750 - DNA, 18 bp, Homo sapiens
atgacccctaccccctca

SEQ ID NO: 1253751 - DNA, 17 bp, Homo sapiens
atgaccccttctctctc

SEQ ID NO: 1253752 - DNA, 14 bp, Homo sapiens
atgaccgtgtacaa

SEQ ID NO: 1253753 - DNA, 15 bp, Homo sapiens
atgaccgtgtacaat

SEQ ID NO: 1253754 - DNA, 16 bp, Homo sapiens
atgacctacagtgctg

SEQ ID NO: 1253755 - DNA, 13 bp, Homo sapiens
atgacctccattt

SEQ ID NO: 1253756 - DNA, 18 bp, Homo sapiens
atgacctcttcctttagg

SEQ ID NO: 1253757 - DNA, 21 bp, Homo sapiens
atgacctgaaataatatattt

SEQ ID NO: 1253758 - DNA, 14 bp, Homo sapiens
atgacctggataac

SEQ ID NO: 1253759 - DNA, 21 bp, Homo sapiens
atgacctgtgaccagcactgt

SEQ ID NO: 1253760 - DNA, 13 bp, Homo sapiens
atgaccttttgga

SEQ ID NO: 1253761 - DNA, 23 bp, Homo sapiens
atgacgccagataaaatgttcag

SEQ ID NO: 1253762 - DNA, 16 bp, Homo sapiens
atgacggaagaacata

SEQ ID NO: 1253763 - DNA, 19 bp, Homo sapiens
atgacggaagaacatagaa

SEQ ID NO: 1253764 - DNA, 20 bp, Homo sapiens
atgacggtaagtgttctcat

SEQ ID NO: 1253765 - DNA, 17 bp, Homo sapiens
atgacgtttaaggccac

SEQ ID NO: 1253766 - DNA, 14 bp, Homo sapiens
atgactaaaaatat

SEQ ID NO: 1253767 - DNA, 14 bp, Homo sapiens
atgactaaagagag

SEQ ID NO: 1253768 - DNA, 19 bp, Homo sapiens
atgactaaagagagaatgt

SEQ ID NO: 1253769 - DNA, 20 bp, Homo sapiens
atgactaaagagagaatgta

SEQ ID NO: 1253770 - DNA, 20 bp, Homo sapiens
atgactaaattttcttttaa

SEQ ID NO: 1253771 - DNA, 13 bp, Homo sapiens
atgactaatgctt

SEQ ID NO: 1253772 - DNA, 19 bp, Homo sapiens
atgactacctcagaacata

SEQ ID NO: 1253773 - DNA, 15 bp, Homo sapiens
atgactagaggcagg

SEQ ID NO: 1253774 - DNA, 19 bp, Homo sapiens
atgactagaggcagggagg

SEQ ID NO: 1253775 - DNA, 17 bp, Homo sapiens
atgactatataatttat

SEQ ID NO: 1253776 - DNA, 22 bp, Homo sapiens
atgactatataatttatttcca

SEQ ID NO: 1253777 - DNA, 19 bp, Homo sapiens
atgactcaggacatccccc

SEQ ID NO: 1253778 - DNA, 20 bp, Homo sapiens
atgactccaccttctcacct

SEQ ID NO: 1253779 - DNA, 23 bp, Homo sapiens
atgactctctccaagagggcagg

SEQ ID NO: 1253780 - DNA, 14 bp, Homo sapiens
atgactctttattg

SEQ ID NO: 1253781 - DNA, 18 bp, Homo sapiens
atgactctttattgtctg

SEQ ID NO: 1253782 - DNA, 14 bp, Homo sapiens
atgactgaaagaag

SEQ ID NO: 1253783 - DNA, 13 bp, Homo sapiens
atgactgaatggg

SEQ ID NO: 1253784 - DNA, 13 bp, Homo sapiens
atgactgcacatg

SEQ ID NO: 1253785 - DNA, 23 bp, Homo sapiens
atgactgcacccagctccagggg

SEQ ID NO: 1253786 - DNA, 20 bp, Homo sapiens
atgactggctgtctgcctgt

SEQ ID NO: 1253787 - DNA, 18 bp, Homo sapiens
atgactggggagggctgc

SEQ ID NO: 1253788 - DNA, 23 bp, Homo sapiens
atgactgtgtctgcctgtcccca

SEQ ID NO: 1253789 - DNA, 19 bp, Homo sapiens
atgactgtttcttttgtaa

SEQ ID NO: 1253790 - DNA, 19 bp, Homo sapiens
atgactgtttttcggacag

SEQ ID NO: 1253791 - DNA, 21 bp, Homo sapiens
atgactgtttttcggacagtt

SEQ ID NO: 1253792 - DNA, 14 bp, Homo sapiens
atgacttactgtac

SEQ ID NO: 1253793 - DNA, 20 bp, Homo sapiens
atgacttagcgtcaagacat

SEQ ID NO: 1253794 - DNA, 22 bp, Homo sapiens
atgacttagcgtcaagacattt

SEQ ID NO: 1253795 - DNA, 19 bp, Homo sapiens
atgacttatttctgctctg

SEQ ID NO: 1253796 - DNA, 20 bp, Homo sapiens
atgacttatttctgctctgg

SEQ ID NO: 1253797 - DNA, 22 bp, Homo sapiens
atgacttcagtgaaattttcag

SEQ ID NO: 1253798 - DNA, 23 bp, Homo sapiens
atgacttctttactaacactggc

SEQ ID NO: 1253799 - DNA, 15 bp, Homo sapiens
atgacttgccattaa

SEQ ID NO: 1253800 - DNA, 22 bp, Homo sapiens
atgacttggtggcttttccttg

SEQ ID NO: 1253801 - DNA, 12 bp, Homo sapiens
atgactttagaa

SEQ ID NO: 1253802 - DNA, 13 bp, Homo sapiens
atgactttattgc

SEQ ID NO: 1253803 - DNA, 21 bp, Homo sapiens
atgactttattgcatctgggt

SEQ ID NO: 1253804 - DNA, 13 bp, Homo sapiens
atgactttgaact

SEQ ID NO: 1253805 - DNA, 21 bp, Homo sapiens
atgactttgaactgaaacttt

SEQ ID NO: 1253806 - DNA, 14 bp, Homo sapiens
atgacttttcttaa

SEQ ID NO: 1253807 - DNA, 14 bp, Homo sapiens
atgagaaaaaacta

SEQ ID NO: 1253808 - DNA, 18 bp, Homo sapiens
atgagaaaaactgttctt

SEQ ID NO: 1253809 - DNA, 21 bp, Homo sapiens
atgagaaaaatattcaagtaa

SEQ ID NO: 1253810 - DNA, 14 bp, Homo sapiens
atgagaaaagaggc

SEQ ID NO: 1253811 - DNA, 20 bp, Homo sapiens
atgagaaactggcaaagcag

SEQ ID NO: 1253812 - DNA, 20 bp, Homo sapiens
atgagaaacttaaatgttat

SEQ ID NO: 1253813 - DNA, 23 bp, Homo sapiens
atgagaaactttgatctctgctt

SEQ ID NO: 1253814 - DNA, 21 bp, Homo sapiens
atgagaaagcttttattcctt

SEQ ID NO: 1253815 - DNA, 13 bp, Homo sapiens
atgagaacaaaca

SEQ ID NO: 1253816 - DNA, 13 bp, Homo sapiens
atgagaacaaagc

SEQ ID NO: 1253817 - DNA, 15 bp, Homo sapiens
atgagaacaaagctg

SEQ ID NO: 1253818 - DNA, 17 bp, Homo sapiens
atgagaacaagtcacag

SEQ ID NO: 1253819 - DNA, 21 bp, Homo sapiens
atgatttccttgaatgtggct

SEQ ID NO: 1253820 - DNA, 16 bp, Homo sapiens
atgatttcttgctttg

SEQ ID NO: 1253821 - DNA, 21 bp, Homo sapiens
atgatttgccgacatgtttga

SEQ ID NO: 1253822 - DNA, 19 bp, Homo sapiens
atgatttgggggaggcttt

SEQ ID NO: 1253823 - DNA, 16 bp, Homo sapiens
atgattttatttgaca

SEQ ID NO: 1253824 - DNA, 18 bp, Homo sapiens
atgattttatttgacaaa

SEQ ID NO: 1253825 - DNA, 18 bp, Homo sapiens
atgattttgcaaaatgag

SEQ ID NO: 1253826 - DNA, 13 bp, Homo sapiens
atgatttttagat

SEQ ID NO: 1253827 - DNA, 22 bp, Homo sapiens
atgatttttagatgagattgtt

SEQ ID NO: 1253828 - DNA, 19 bp, Homo sapiens
atgatttttctttacaaaa

SEQ ID NO: 1253829 - DNA, 16 bp, Homo sapiens
atgatttttggtattt

SEQ ID NO: 1253830 - DNA, 15 bp, Homo sapiens
atgattttttgaaag

SEQ ID NO: 1253831 - DNA, 17 bp, Homo sapiens
atgatttttttttcata

SEQ ID NO: 1253832 - DNA, 23 bp, Homo sapiens
atgcaaaaccttgtgaactgact

SEQ ID NO: 1253833 - DNA, 23 bp, Homo sapiens
atgcaaaagtacaagggctgaga

SEQ ID NO: 1253834 - DNA, 14 bp, Homo sapiens
atgcaaaagtgggg

SEQ ID NO: 1253835 - DNA, 12 bp, Homo sapiens
atgcaaaattag

SEQ ID NO: 1253836 - DNA, 22 bp, Homo sapiens
atgcaaaattgttttcacttgt

SEQ ID NO: 1253837 - DNA, 16 bp, Homo sapiens
atgcaaaccagcttta

SEQ ID NO: 1253838 - DNA, 14 bp, Homo sapiens
atgcaaaccatagc

SEQ ID NO: 1253839 - DNA, 22 bp, Homo sapiens
atgcaaactgctttattttccc

SEQ ID NO: 1253840 - DNA, 22 bp, Homo sapiens
atgcaaactgtggcaactgaga

SEQ ID NO: 1253841 - DNA, 16 bp, Homo sapiens
atgcaaataacacaaa

SEQ ID NO: 1253842 - DNA, 15 bp, Homo sapiens
atgcaaatgaatcat

SEQ ID NO: 1253843 - DNA, 19 bp, Homo sapiens
atgcaaatgaatcattgtt

SEQ ID NO: 1253844 - DNA, 18 bp, Homo sapiens
atgcaaatgagttcagga

SEQ ID NO: 1253845 - DNA, 20 bp, Homo sapiens
atgcaaatgagttcaggact

SEQ ID NO: 1253846 - DNA, 14 bp, Homo sapiens
atgcaacagaagtg

SEQ ID NO: 1253847 - DNA, 20 bp, Homo sapiens
atgcaactaattcaataaaa

SEQ ID NO: 1253848 - DNA, 18 bp, Homo sapiens
atgcaagagtgattgcag

SEQ ID NO: 1253849 - DNA, 21 bp, Homo sapiens
atgcaagagtgattgcagctt

SEQ ID NO: 1253850 - DNA, 19 bp, Homo sapiens
atgcaagcttggtcaaact

SEQ ID NO: 1253851 - DNA, 20 bp, Homo sapiens
atgcaagcttggtcaaactt

SEQ ID NO: 1253852 - DNA, 14 bp, Homo sapiens
atgcaaggaccagg

SEQ ID NO: 1253853 - DNA, 24 bp, Homo sapiens
atgcaagtacaagtatataatatg

SEQ ID NO: 1253854 - DNA, 18 bp, Homo sapiens
atgcaagtcaggaatcat

SEQ ID NO: 1253855 - DNA, 20 bp, Homo sapiens
atgcaagttattttatttgc

SEQ ID NO: 1253856 - DNA, 17 bp, Homo sapiens
atgcaataactctggga

SEQ ID NO: 1253857 - DNA, 18 bp, Homo sapiens
atgcaataactctgggag

SEQ ID NO: 1253858 - DNA, 19 bp, Homo sapiens
atgcaataatccaccccca

SEQ ID NO: 1253859 - DNA, 15 bp, Homo sapiens
atgcaataatgtgca

SEQ ID NO: 1253860 - DNA, 12 bp, Homo sapiens
atgcaataattt

SEQ ID NO: 1253861 - DNA, 15 bp, Homo sapiens
atgcaatccttccct

SEQ ID NO: 1253862 - DNA, 18 bp, Homo sapiens
atgcaatgaaacagatga

SEQ ID NO: 1253863 - DNA, 18 bp, Homo sapiens
atgcaatgcttcattatt

SEQ ID NO: 1253864 - DNA, 23 bp, Homo sapiens
atgcaatgcttcattattcaaga

SEQ ID NO: 1253865 - DNA, 17 bp, Homo sapiens
atgcaatgtgctactga

SEQ ID NO: 1253866 - DNA, 13 bp, Homo sapiens
atgcaattaaaac

SEQ ID NO: 1253867 - DNA, 23 bp, Homo sapiens
atgcaatttaatggatatttctc

SEQ ID NO: 1253868 - DNA, 12 bp, Homo sapiens
atgcaatttgat

SEQ ID NO: 1253869 - DNA, 16 bp, Homo sapiens
atgcacaagaatggat

SEQ ID NO: 1253870 - DNA, 15 bp, Homo sapiens
atgcacacagataca

SEQ ID NO: 1253871 - DNA, 13 bp, Homo sapiens
atgcacacatttt

SEQ ID NO: 1253872 - DNA, 15 bp, Homo sapiens
atgcacacatttttt

SEQ ID NO: 1253873 - DNA, 22 bp, Homo sapiens
atgcacactagcctctccagga

SEQ ID NO: 1253874 - DNA, 14 bp, Homo sapiens
atgcacacttctga

SEQ ID NO: 1253875 - DNA, 18 bp, Homo sapiens
atgcacagagaagctggg

SEQ ID NO: 1253876 - DNA, 18 bp, Homo sapiens
atgcacagagttgttaca

SEQ ID NO: 1253877 - DNA, 20 bp, Homo sapiens
atgcacagcctagttatcaa

SEQ ID NO: 1253878 - DNA, 14 bp, Homo sapiens
atgcacatttatat

SEQ ID NO: 1253879 - DNA, 17 bp, Homo sapiens
atgcacatttctggatt

SEQ ID NO: 1253880 - DNA, 12 bp, Homo sapiens
atgcacccctgg

SEQ ID NO: 1253881 - DNA, 20 bp, Homo sapiens
atgcaccctcatacacagaa

SEQ ID NO: 1253882 - DNA, 14 bp, Homo sapiens
atgcacctaaagaa

SEQ ID NO: 1253883 - DNA, 13 bp, Homo sapiens
atgcactatgagg

SEQ ID NO: 1253884 - DNA, 23 bp, Homo sapiens
atgcactgacctgctccgccagg

SEQ ID NO: 1253885 - DNA, 16 bp, Homo sapiens
atgcactgatgttgtg

SEQ ID NO: 1253886 - DNA, 19 bp, Homo sapiens
atgcactgtaaatatccct

SEQ ID NO: 1253887 - DNA, 21 bp, Homo sapiens
atgcactgtattgctcctccc

SEQ ID NO: 1253888 - DNA, 13 bp, Homo sapiens
atgcactgtggtt

SEQ ID NO: 1253889 - DNA, 22 bp, Homo sapiens
atgcactgtggtttcagatgtg

SEQ ID NO: 1253890 - DNA, 22 bp, Homo sapiens
atgcactgttccccctgtgcag

SEQ ID NO: 1253891 - DNA, 17 bp, Homo sapiens
atgcactgtttttaatc

SEQ ID NO: 1253892 - DNA, 19 bp, Homo sapiens
atgcacttataattttcct

SEQ ID NO: 1253893 - DNA, 21 bp, Homo sapiens
atgcacttcaaataattaaat

SEQ ID NO: 1253894 - DNA, 18 bp, Homo sapiens
atgcacttgattcaggag

SEQ ID NO: 1253895 - DNA, 19 bp, Homo sapiens
atgcactttaattgaagaa

SEQ ID NO: 1253896 - DNA, 16 bp, Homo sapiens
atgcactttccctaga

SEQ ID NO: 1253897 - DNA, 22 bp, Homo sapiens
atgcactttccctagaaagcca

SEQ ID NO: 1253898 - DNA, 22 bp, Homo sapiens
atgcactttctatcctctgtaa

SEQ ID NO: 1253899 - DNA, 15 bp, Homo sapiens
atgcacttttagaaa

SEQ ID NO: 1253900 - DNA, 20 bp, Homo sapiens
atgcacttttagaaatgcat

SEQ ID NO: 1253901 - DNA, 22 bp, Homo sapiens
atgcagaaatagacaaaaagta

SEQ ID NO: 1253902 - DNA, 19 bp, Homo sapiens
atgcagaaatcacgttgct

SEQ ID NO: 1253903 - DNA, 18 bp, Homo sapiens
atgcagaacgtatttagc

SEQ ID NO: 1253904 - DNA, 21 bp, Homo sapiens
atgcagaagcatattttgctg

SEQ ID NO: 1253905 - DNA, 23 bp, Homo sapiens
atgcagaagcatattttgctggt

SEQ ID NO: 1253906 - DNA, 16 bp, Homo sapiens
atgcagacagtctgtt

SEQ ID NO: 1253907 - DNA, 23 bp, Homo sapiens
atgcagacagtctgttatgcact

SEQ ID NO: 1253908 - DNA, 20 bp, Homo sapiens
atgcagacctcatgcccagc

SEQ ID NO: 1253909 - DNA, 23 bp, Homo sapiens
atgcagacctcatgcccagctct

SEQ ID NO: 1253910 - DNA, 18 bp, Homo sapiens
atgcagactcctcagatc

SEQ ID NO: 1253911 - DNA, 18 bp, Homo sapiens
atgcagaggtccacaaca

SEQ ID NO: 1253912 - DNA, 15 bp, Homo sapiens
atgcagaggtctcca

SEQ ID NO: 1253913 - DNA, 21 bp, Homo sapiens
atgcagaggtctccaaactga

SEQ ID NO: 1253914 - DNA, 16 bp, Homo sapiens
atgcagataaaatatt

SEQ ID NO: 1253915 - DNA, 23 bp, Homo sapiens
atgcagatggggctcccgcccgt

SEQ ID NO: 1253916 - DNA, 16 bp, Homo sapiens
atgcagattcctgggc

SEQ ID NO: 1253917 - DNA, 18 bp, Homo sapiens
atgcagattcctgggcct

SEQ ID NO: 1253918 - DNA, 17 bp, Homo sapiens
atgcagcatggggtttt

SEQ ID NO: 1253919 - DNA, 19 bp, Homo sapiens
atgcagccacgattggaga

SEQ ID NO: 1253920 - DNA, 21 bp, Homo sapiens
atgcagccacgattggagaat

SEQ ID NO: 1253921 - DNA, 11 bp, Homo sapiens
atgcagcccac

SEQ ID NO: 1253922 - DNA, 23 bp, Homo sapiens
atgcagcccatgcccacctgccc

SEQ ID NO: 1253923 - DNA, 15 bp, Homo sapiens
atgcagcccctgggc

SEQ ID NO: 1253924 - DNA, 18 bp, Homo sapiens
atgcagccttggggcatt

SEQ ID NO: 1253925 - DNA, 14 bp, Homo sapiens
atgcagctatctgg

SEQ ID NO: 1253926 - DNA, 15 bp, Homo sapiens
atgcagctgcaccct

SEQ ID NO: 1253927 - DNA, 21 bp, Homo sapiens
atgcagctgcaccctccctcc

SEQ ID NO: 1253928 - DNA, 13 bp, Homo sapiens
atgcagctgcctg

SEQ ID NO: 1253929 - DNA, 15 bp, Homo sapiens
atgcagctgcctggg

SEQ ID NO: 1253930 - DNA, 15 bp, Homo sapiens
atgcagctgtggcag

SEQ ID NO: 1253931 - DNA, 21 bp, Homo sapiens
atgcagctgttgagaaaacga

SEQ ID NO: 1253932 - DNA, 21 bp, Homo sapiens
atgcagcttatacgaaataat

SEQ ID NO: 1253933 - DNA, 15 bp, Homo sapiens
atgcaggaagaggcc

SEQ ID NO: 1253934 - DNA, 12 bp, Homo sapiens
atgcaggccctt

SEQ ID NO: 1253935 - DNA, 17 bp, Homo sapiens
atgcagggaagagggca

SEQ ID NO: 1253936 - DNA, 18 bp, Homo sapiens
atgcagggaagagggcag

SEQ ID NO: 1253937 - DNA, 16 bp, Homo sapiens
atgcagggaggccacg

SEQ ID NO: 1253938 - DNA, 16 bp, Homo sapiens
atgcaggtgaactttt

SEQ ID NO: 1253939 - DNA, 19 bp, Homo sapiens
atgcaggtgatgccattac

SEQ ID NO: 1253940 - DNA, 21 bp, Homo sapiens
atgccccttctccccttcctg

SEQ ID NO: 1253941 - DNA, 17 bp, Homo sapiens
atgcccgagtccgccca

SEQ ID NO: 1253942 - DNA, 21 bp, Homo sapiens
atgcccgagtccgcccatccc

SEQ ID NO: 1253943 - DNA, 20 bp, Homo sapiens
atgcccggctaatttttgta

SEQ ID NO: 1253944 - DNA, 17 bp, Homo sapiens
atgccctcccttctccc

SEQ ID NO: 1253945 - DNA, 19 bp, Homo sapiens
atgccctcctaaatgtcag

SEQ ID NO: 1253946 - DNA, 12 bp, Homo sapiens
atgccctcctgg

SEQ ID NO: 1253947 - DNA, 15 bp, Homo sapiens
atgccctgcagagca

SEQ ID NO: 1253948 - DNA, 20 bp, Homo sapiens
atgccctgcccttcctcagg

SEQ ID NO: 1253949 - DNA, 14 bp, Homo sapiens
atgccctggatcca

SEQ ID NO: 1253950 - DNA, 20 bp, Homo sapiens
atgccctgggatgcctcacc

SEQ ID NO: 1253951 - DNA, 23 bp, Homo sapiens
atgccctgtgcaacctcttggcc

SEQ ID NO: 1253952 - DNA, 19 bp, Homo sapiens
atgccctttggaaagccat

SEQ ID NO: 1253953 - DNA, 19 bp, Homo sapiens
atgccgatttctgtaaact

SEQ ID NO: 1253954 - DNA, 20 bp, Homo sapiens
atgccgcagggagggctgtg

SEQ ID NO: 1253955 - DNA, 14 bp, Homo sapiens
atgccggatgtgct

SEQ ID NO: 1253956 - DNA, 17 bp, Homo sapiens
atgccggatgtgctttt

SEQ ID NO: 1253957 - DNA, 18 bp, Homo sapiens
atgccgggcgccaggaca

SEQ ID NO: 1253958 - DNA, 20 bp, Homo sapiens
atgccgggcgccaggacagc

SEQ ID NO: 1253959 - DNA, 13 bp, Homo sapiens
atgccgtcctgct

SEQ ID NO: 1253960 - DNA, 14 bp, Homo sapiens
atgccgtcctgctg

SEQ ID NO: 1253961 - DNA, 22 bp, Homo sapiens
atgccgtggattgcacgtggcc

SEQ ID NO: 1253962 - DNA, 20 bp, Homo sapiens
atgcctaaaaattcccttcc

SEQ ID NO: 1253963 - DNA, 22 bp, Homo sapiens
atgcctaaaaattcccttcctg

SEQ ID NO: 1253964 - DNA, 23 bp, Homo sapiens
atgcctagacttcccaacagcct

SEQ ID NO: 1253965 - DNA, 22 bp, Homo sapiens
atgcctcaattcacatagattt

SEQ ID NO: 1253966 - DNA, 16 bp, Homo sapiens
atgcctcacgagattt

SEQ ID NO: 1253967 - DNA, 20 bp, Homo sapiens
atgcctcactaatttttgta

SEQ ID NO: 1253968 - DNA, 23 bp, Homo sapiens
atgcctcactaatttttgtatta

SEQ ID NO: 1253969 - DNA, 18 bp, Homo sapiens
atgcctcactttcttcta

SEQ ID NO: 1253970 - DNA, 21 bp, Homo sapiens
atgcctcagcccaggtcagct

SEQ ID NO: 1253971 - DNA, 14 bp, Homo sapiens
atgcctcagtgtat

SEQ ID NO: 1253972 - DNA, 11 bp, Homo sapiens
atgcctccctg

SEQ ID NO: 1253973 - DNA, 22 bp, Homo sapiens
atgcctccctgggccacctcct

SEQ ID NO: 1253974 - DNA, 15 bp, Homo sapiens
atgcctcctcaggag

SEQ ID NO: 1253975 - DNA, 14 bp, Homo sapiens
atgcctcctgtggg

SEQ ID NO: 1253976 - DNA, 11 bp, Homo sapiens
atgcctctgga

SEQ ID NO: 1253977 - DNA, 19 bp, Homo sapiens
atgcctgaccccttgctcc

SEQ ID NO: 1253978 - DNA, 14 bp, Homo sapiens
atgcctgagggtgg

SEQ ID NO: 1253979 - DNA, 17 bp, Homo sapiens
atgcctgcactgggaag

SEQ ID NO: 1253980 - DNA, 19 bp, Homo sapiens
atgcctgccccaaacaaat

SEQ ID NO: 1253981 - DNA, 16 bp, Homo sapiens
atgcctgcgcctgctg

SEQ ID NO: 1253982 - DNA, 10 bp, Homo sapiens
atgcctggag

SEQ ID NO: 1253983 - DNA, 15 bp, Homo sapiens
atgcctggcctgcca

SEQ ID NO: 1253984 - DNA, 16 bp, Homo sapiens
atgcctggcctgccag

SEQ ID NO: 1253985 - DNA, 18 bp, Homo sapiens
atgcctggtattttcaac

SEQ ID NO: 1253986 - DNA, 14 bp, Homo sapiens
atgcctgtggtgaa

SEQ ID NO: 1253987 - DNA, 15 bp, Homo sapiens
atgcctgttaattta

SEQ ID NO: 1253988 - DNA, 17 bp, Homo sapiens
atgcctgttgaaggtac

SEQ ID NO: 1253989 - DNA, 18 bp, Homo sapiens
atgcctgttgtatttatg

SEQ ID NO: 1253990 - DNA, 23 bp, Homo sapiens
atgccttaagcagaacaaatgtg

SEQ ID NO: 1253991 - DNA, 22 bp, Homo sapiens
atgccttcatgggggtgacccc

SEQ ID NO: 1253992 - DNA, 15 bp, Homo sapiens
atgccttctgtattt

SEQ ID NO: 1253993 - DNA, 15 bp, Homo sapiens
atgccttctgtggcc

SEQ ID NO: 1253994 - DNA, 14 bp, Homo sapiens
atgccttcttattg

SEQ ID NO: 1253995 - DNA, 15 bp, Homo sapiens
atgccttgaataata

SEQ ID NO: 1253996 - DNA, 16 bp, Homo sapiens
atgccttggtgccggt

SEQ ID NO: 1253997 - DNA, 24 bp, Homo sapiens
atgccttggtttttactgctctga

SEQ ID NO: 1253998 - DNA, 13 bp, Homo sapiens
atgccttgtataa

SEQ ID NO: 1253999 - DNA, 21 bp, Homo sapiens
atgcctttaaagtatgaatct

SEQ ID NO: 1254000 - DNA, 21 bp, Homo sapiens
atgcctttaaatctgtgatga

SEQ ID NO: 1254001 - DNA, 13 bp, Homo sapiens
atgcctttctagt

SEQ ID NO: 1254002 - DNA, 21 bp, Homo sapiens
atgcctttctagtcctattct

SEQ ID NO: 1254003 - DNA, 14 bp, Homo sapiens
atgcctttgctgtt

SEQ ID NO: 1254004 - DNA, 12 bp, Homo sapiens
atgcctttgtaa

SEQ ID NO: 1254005 - DNA, 13 bp, Homo sapiens
atgcctttgtaac

SEQ ID NO: 1254006 - DNA, 15 bp, Homo sapiens
atgccttttctgtga

SEQ ID NO: 1254007 - DNA, 22 bp, Homo sapiens
atgcctttttagatgtattttt

SEQ ID NO: 1254008 - DNA, 18 bp, Homo sapiens
atgcgagcttggccttgg

SEQ ID NO: 1254009 - DNA, 22 bp, Homo sapiens
atgcgagcttggccttgggccg

SEQ ID NO: 1254010 - DNA, 15 bp, Homo sapiens
atgcgaggggccagc

SEQ ID NO: 1254011 - DNA, 18 bp, Homo sapiens
atgcgaggggccagcaga

SEQ ID NO: 1254012 - DNA, 17 bp, Homo sapiens
atgcgcagatgaggggc

SEQ ID NO: 1254013 - DNA, 12 bp, Homo sapiens
atgcgcaggctc

SEQ ID NO: 1254014 - DNA, 13 bp, Homo sapiens
atgcggagccagc

SEQ ID NO: 1254015 - DNA, 21 bp, Homo sapiens
atgcggctttctctgcctctg

SEQ ID NO: 1254016 - DNA, 23 bp, Homo sapiens
atgcggctttctctgcctctggg

SEQ ID NO: 1254017 - DNA, 21 bp, Homo sapiens
atgcggttataaaaaatggtt

SEQ ID NO: 1254018 - DNA, 13 bp, Homo sapiens
atgcgtatatgtg

SEQ ID NO: 1254019 - DNA, 18 bp, Homo sapiens
atgcgtatatgtgcgtct

SEQ ID NO: 1254020 - DNA, 15 bp, Homo sapiens
atgcgtattctgtgg

SEQ ID NO: 1254021 - DNA, 16 bp, Homo sapiens
atgcgtgcccagctct

SEQ ID NO: 1254022 - DNA, 16 bp, Homo sapiens
atgcgtgccgcctgct

SEQ ID NO: 1254023 - DNA, 24 bp, Homo sapiens
atgcgtgccgcctgctcctcactg

SEQ ID NO: 1254024 - DNA, 16 bp, Homo sapiens
atgcgtgggaggcaga

SEQ ID NO: 1254025 - DNA, 14 bp, Homo sapiens
atgcgttcactcca

SEQ ID NO: 1254026 - DNA, 15 bp, Homo sapiens
atgcgttcactccaa

SEQ ID NO: 1254027 - DNA, 19 bp, Homo sapiens
atgctaacatctaaaaata

SEQ ID NO: 1254028 - DNA, 19 bp, Homo sapiens
atgctaacctctctgaact

SEQ ID NO: 1254029 - DNA, 22 bp, Homo sapiens
atgctaagagaagtagaaatca

SEQ ID NO: 1254030 - DNA, 15 bp, Homo sapiens
atgctaattaaataa

SEQ ID NO: 1254031 - DNA, 17 bp, Homo sapiens
atgctacacactgcatg

SEQ ID NO: 1254032 - DNA, 16 bp, Homo sapiens
atgctaccaggatgct

SEQ ID NO: 1254033 - DNA, 23 bp, Homo sapiens
atgctaccaggatgctaaagatg

SEQ ID NO: 1254034 - DNA, 22 bp, Homo sapiens
atgctagaaaatcgagttggca

SEQ ID NO: 1254035 - DNA, 21 bp, Homo sapiens
atgctaggatgcggaaatccc

SEQ ID NO: 1254036 - DNA, 14 bp, Homo sapiens
atgctatgaaattg

SEQ ID NO: 1254037 - DNA, 16 bp, Homo sapiens
atgctcaaagaaatct

SEQ ID NO: 1254038 - DNA, 17 bp, Homo sapiens
atgctcaacccccctcc

SEQ ID NO: 1254039 - DNA, 17 bp, Homo sapiens
atgctcaagaatgtagt

SEQ ID NO: 1254040 - DNA, 18 bp, Homo sapiens
atgctcaagaatgtagtc

SEQ ID NO: 1254041 - DNA, 13 bp, Homo sapiens
atgctcacctcta

SEQ ID NO: 1254042 - DNA, 14 bp, Homo sapiens
atgctcactttatt

SEQ ID NO: 1254043 - DNA, 13 bp, Homo sapiens
atgctcaggctac

SEQ ID NO: 1254044 - DNA, 19 bp, Homo sapiens
atgctcagggtcactgaac

SEQ ID NO: 1254045 - DNA, 19 bp, Homo sapiens
atgctcataaagatgttaa

SEQ ID NO: 1254046 - DNA, 16 bp, Homo sapiens
atgctcatctgctggt

SEQ ID NO: 1254047 - DNA, 13 bp, Homo sapiens
atgctcatgtata

SEQ ID NO: 1254048 - DNA, 16 bp, Homo sapiens
atgctcattttctggt

SEQ ID NO: 1254049 - DNA, 16 bp, Homo sapiens
atgctcattttcttta

SEQ ID NO: 1254050 - DNA, 17 bp, Homo sapiens
atgctccagccaacccc

SEQ ID NO: 1254051 - DNA, 11 bp, Homo sapiens
atgctccaggg

SEQ ID NO: 1254052 - DNA, 13 bp, Homo sapiens
atgctccagggca

SEQ ID NO: 1254053 - DNA, 18 bp, Homo sapiens
atgctccagggcagcctc

SEQ ID NO: 1254054 - DNA, 19 bp, Homo sapiens
atgctcccagctgtgctgt

SEQ ID NO: 1254055 - DNA, 20 bp, Homo sapiens
atgctcccagctgtgctgtg

SEQ ID NO: 1254056 - DNA, 12 bp, Homo sapiens
atgctccccaca

SEQ ID NO: 1254057 - DNA, 22 bp, Homo sapiens
atgctccccacagcgtccctgg

SEQ ID NO: 1254058 - DNA, 14 bp, Homo sapiens
atgctccctcccct

SEQ ID NO: 1254059 - DNA, 20 bp, Homo sapiens
atgctccgaggactggactg

SEQ ID NO: 1254060 - DNA, 19 bp, Homo sapiens
atgctcctggcccactgca

SEQ ID NO: 1254061 - DNA, 16 bp, Homo sapiens
atgctccttgggccct

SEQ ID NO: 1254062 - DNA, 21 bp, Homo sapiens
atggagcccataggccacccc

SEQ ID NO: 1254063 - DNA, 23 bp, Homo sapiens
atggagcgcacctgccccctggt

SEQ ID NO: 1254064 - DNA, 24 bp, Homo sapiens
atggagctcacactccagtggcag

SEQ ID NO: 1254065 - DNA, 15 bp, Homo sapiens
atggagctcatgtca

SEQ ID NO: 1254066 - DNA, 17 bp, Homo sapiens
atggagctcatgtcagc

SEQ ID NO: 1254067 - DNA, 21 bp, Homo sapiens
atggagctcatgtcagccgtg

SEQ ID NO: 1254068 - DNA, 16 bp, Homo sapiens
atggaggaaaaccaag

SEQ ID NO: 1254069 - DNA, 13 bp, Homo sapiens
atggaggaatatg

SEQ ID NO: 1254070 - DNA, 17 bp, Homo sapiens
atggaggactccaggca

SEQ ID NO: 1254071 - DNA, 21 bp, Homo sapiens
atggaggatctctaaagagca

SEQ ID NO: 1254072 - DNA, 18 bp, Homo sapiens
atggaggatggagagagg

SEQ ID NO: 1254073 - DNA, 21 bp, Homo sapiens
atggaggattctttccccaga

SEQ ID NO: 1254074 - DNA, 22 bp, Homo sapiens
atggaggattctttccccagag

SEQ ID NO: 1254075 - DNA, 23 bp, Homo sapiens
atggaggattctttccccagagg

SEQ ID NO: 1254076 - DNA, 11 bp, Homo sapiens
atggaggccag

SEQ ID NO: 1254077 - DNA, 22 bp, Homo sapiens
atggaggccagagtctcccagt

SEQ ID NO: 1254078 - DNA, 16 bp, Homo sapiens
atggaggccctcctgt

SEQ ID NO: 1254079 - DNA, 14 bp, Homo sapiens
atggagggcttggc

SEQ ID NO: 1254080 - DNA, 14 bp, Homo sapiens
atggaggggaattc

SEQ ID NO: 1254081 - DNA, 14 bp, Homo sapiens
atggaggggcagag

SEQ ID NO: 1254082 - DNA, 20 bp, Homo sapiens
atggaggggtggtcctgact

SEQ ID NO: 1254083 - DNA, 22 bp, Homo sapiens
atggaggggtggtcctgactca

SEQ ID NO: 1254084 - DNA, 22 bp, Homo sapiens
atggagggtggaaataatttga

SEQ ID NO: 1254085 - DNA, 19 bp, Homo sapiens
atggagtcttgctctgtca

SEQ ID NO: 1254086 - DNA, 11 bp, Homo sapiens
atggagtgacg

SEQ ID NO: 1254087 - DNA, 22 bp, Homo sapiens
atggagtgacggtcccacactg

SEQ ID NO: 1254088 - DNA, 19 bp, Homo sapiens
atggagtgagtcacctgct

SEQ ID NO: 1254089 - DNA, 17 bp, Homo sapiens
atggagtgcaccaaaga

SEQ ID NO: 1254090 - DNA, 17 bp, Homo sapiens
atggagtgtgcagacag

SEQ ID NO: 1254091 - DNA, 19 bp, Homo sapiens
atggagtgtgcagacagcc

SEQ ID NO: 1254092 - DNA, 19 bp, Homo sapiens
atggagttaacatcatgaa

SEQ ID NO: 1254093 - DNA, 13 bp, Homo sapiens
atggatacataaa

SEQ ID NO: 1254094 - DNA, 13 bp, Homo sapiens
atggatactacat

SEQ ID NO: 1254095 - DNA, 19 bp, Homo sapiens
atggatactacatctttaa

SEQ ID NO: 1254096 - DNA, 20 bp, Homo sapiens
atggatcaaagaaattcaga

SEQ ID NO: 1254097 - DNA, 16 bp, Homo sapiens
atggatcacaagatgg

SEQ ID NO: 1254098 - DNA, 19 bp, Homo sapiens
atggatcagaggagtaaat

SEQ ID NO: 1254099 - DNA, 14 bp, Homo sapiens
atggatctgatctg

SEQ ID NO: 1254100 - DNA, 22 bp, Homo sapiens
atggatgccaatattaaatctg

SEQ ID NO: 1254101 - DNA, 19 bp, Homo sapiens
atggatgcccagaggactc

SEQ ID NO: 1254102 - DNA, 12 bp, Homo sapiens
atggattaaaaa

SEQ ID NO: 1254103 - DNA, 19 bp, Homo sapiens
atggattaaaaactgctta

SEQ ID NO: 1254104 - DNA, 16 bp, Homo sapiens
atggattaaagactta

SEQ ID NO: 1254105 - DNA, 21 bp, Homo sapiens
atggattaatagagttggagt

SEQ ID NO: 1254106 - DNA, 16 bp, Homo sapiens
atggattcagtttcta

SEQ ID NO: 1254107 - DNA, 19 bp, Homo sapiens
atggattcagtttctaaaa

SEQ ID NO: 1254108 - DNA, 18 bp, Homo sapiens
atggattcattacagctt

SEQ ID NO: 1254109 - DNA, 14 bp, Homo sapiens
atggattctaaaat

SEQ ID NO: 1254110 - DNA, 15 bp, Homo sapiens
atggattctaaaatg

SEQ ID NO: 1254111 - DNA, 14 bp, Homo sapiens
atggatttagaaaa

SEQ ID NO: 1254112 - DNA, 14 bp, Homo sapiens
atggatttcagaag

SEQ ID NO: 1254113 - DNA, 14 bp, Homo sapiens
atggatttgaagca

SEQ ID NO: 1254114 - DNA, 17 bp, Homo sapiens
atggatttgatgctgtt

SEQ ID NO: 1254115 - DNA, 19 bp, Homo sapiens
atggatttgatgctgtttg

SEQ ID NO: 1254116 - DNA, 18 bp, Homo sapiens
atggattttggcagggcg

SEQ ID NO: 1254117 - DNA, 15 bp, Homo sapiens
atggatttttcttta

SEQ ID NO: 1254118 - DNA, 14 bp, Homo sapiens
atggcaaaaatggc

SEQ ID NO: 1254119 - DNA, 18 bp, Homo sapiens
atggcaaaggaaggtgga

SEQ ID NO: 1254120 - DNA, 19 bp, Homo sapiens
atggcaaatcaggggccag

SEQ ID NO: 1254121 - DNA, 20 bp, Homo sapiens
atggcaaatcaggggccaga

SEQ ID NO: 1254122 - DNA, 14 bp, Homo sapiens
atggcaaatgggca

SEQ ID NO: 1254123 - DNA, 16 bp, Homo sapiens
atggcaaccattataa

SEQ ID NO: 1254124 - DNA, 18 bp, Homo sapiens
atggcaaccattataacc

SEQ ID NO: 1254125 - DNA, 18 bp, Homo sapiens
atggcaaggcagccctgt

SEQ ID NO: 1254126 - DNA, 21 bp, Homo sapiens
atggcaaggcagccctgtctg

SEQ ID NO: 1254127 - DNA, 22 bp, Homo sapiens
atggcaagtctagagtctcaga

SEQ ID NO: 1254128 - DNA, 14 bp, Homo sapiens
atggcaagtgatat

SEQ ID NO: 1254129 - DNA, 15 bp, Homo sapiens
atggcaattctggaa

SEQ ID NO: 1254130 - DNA, 21 bp, Homo sapiens
atggcacaaaaaatgaggaat

SEQ ID NO: 1254131 - DNA, 17 bp, Homo sapiens
atggcacaatgaatgta

SEQ ID NO: 1254132 - DNA, 18 bp, Homo sapiens
atggcacaatgaatgtat

SEQ ID NO: 1254133 - DNA, 19 bp, Homo sapiens
atggcaccaaagccaccag

SEQ ID NO: 1254134 - DNA, 18 bp, Homo sapiens
atggcaccagccccctgg

SEQ ID NO: 1254135 - DNA, 17 bp, Homo sapiens
atggcaccttcagactt

SEQ ID NO: 1254136 - DNA, 22 bp, Homo sapiens
atggcactaaaccacttctctg

SEQ ID NO: 1254137 - DNA, 21 bp, Homo sapiens
atggcagaaggcaaacccatc

SEQ ID NO: 1254138 - DNA, 13 bp, Homo sapiens
atggcagaaggga

SEQ ID NO: 1254139 - DNA, 14 bp, Homo sapiens
atggcagaagggaa

SEQ ID NO: 1254140 - DNA, 16 bp, Homo sapiens
atggcagaagggaatt

SEQ ID NO: 1254141 - DNA, 13 bp, Homo sapiens
atggcagactctt

SEQ ID NO: 1254142 - DNA, 19 bp, Homo sapiens
atggcagaggaatatcaat

SEQ ID NO: 1254143 - DNA, 18 bp, Homo sapiens
atggcagagttgtaaata

SEQ ID NO: 1254144 - DNA, 14 bp, Homo sapiens
atggcagctgccac

SEQ ID NO: 1254145 - DNA, 12 bp, Homo sapiens
atggcaggactc

SEQ ID NO: 1254146 - DNA, 18 bp, Homo sapiens
atggcaggactcctggca

SEQ ID NO: 1254147 - DNA, 13 bp, Homo sapiens
atggcaggctggg

SEQ ID NO: 1254148 - DNA, 17 bp, Homo sapiens
atggcagggcctcatct

SEQ ID NO: 1254149 - DNA, 21 bp, Homo sapiens
atggcagggcctcatctcacc

SEQ ID NO: 1254150 - DNA, 17 bp, Homo sapiens
atggcagggggtggaat

SEQ ID NO: 1254151 - DNA, 24 bp, Homo sapiens
atggcagggggtggaattattact

SEQ ID NO: 1254152 - DNA, 13 bp, Homo sapiens
atggcatcagcac

SEQ ID NO: 1254153 - DNA, 21 bp, Homo sapiens
atggcatccctttttcataaa

SEQ ID NO: 1254154 - DNA, 22 bp, Homo sapiens
atggcatccctttttcataaat

SEQ ID NO: 1254155 - DNA, 17 bp, Homo sapiens
atggcatcttcaatatg

SEQ ID NO: 1254156 - DNA, 22 bp, Homo sapiens
atggcatgattagattgcaaag

SEQ ID NO: 1254157 - DNA, 19 bp, Homo sapiens
atggcatgatttatatatg

SEQ ID NO: 1254158 - DNA, 20 bp, Homo sapiens
atggcatgatttatatatgg

SEQ ID NO: 1254159 - DNA, 16 bp, Homo sapiens
atggcatttctcttta

SEQ ID NO: 1254160 - DNA, 15 bp, Homo sapiens
atggcatttgctggt

SEQ ID NO: 1254161 - DNA, 21 bp, Homo sapiens
atggccaagggggtggacgca

SEQ ID NO: 1254162 - DNA, 14 bp, Homo sapiens
atggccacatttaa

SEQ ID NO: 1254163 - DNA, 15 bp, Homo sapiens
atggccacatttaat

SEQ ID NO: 1254164 - DNA, 21 bp, Homo sapiens
atggccaccccgtgccacccg

SEQ ID NO: 1254165 - DNA, 16 bp, Homo sapiens
atggccaccttttcag

SEQ ID NO: 1254166 - DNA, 17 bp, Homo sapiens
atggccaccttttcagc

SEQ ID NO: 1254167 - DNA, 12 bp, Homo sapiens
atggccagagcc

SEQ ID NO: 1254168 - DNA, 13 bp, Homo sapiens
atggccagagcct

SEQ ID NO: 1254169 - DNA, 18 bp, Homo sapiens
atggccagtgctgcttct

SEQ ID NO: 1254170 - DNA, 16 bp, Homo sapiens
atggccatagaggccc

SEQ ID NO: 1254171 - DNA, 17 bp, Homo sapiens
atggccatagaggccca

SEQ ID NO: 1254172 - DNA, 18 bp, Homo sapiens
atggccatagaggcccag

SEQ ID NO: 1254173 - DNA, 20 bp, Homo sapiens
atggccatagaggcccaggc

SEQ ID NO: 1254174 - DNA, 21 bp, Homo sapiens
atggccatagaggcccaggca

SEQ ID NO: 1254175 - DNA, 16 bp, Homo sapiens
atggccataggagagg

SEQ ID NO: 1254176 - DNA, 15 bp, Homo sapiens
atggccatgcaggag

SEQ ID NO: 1254177 - DNA, 16 bp, Homo sapiens
atggccatgcaggagg

SEQ ID NO: 1254178 - DNA, 14 bp, Homo sapiens
atggccattttaaa

SEQ ID NO: 1254179 - DNA, 14 bp, Homo sapiens
atggcccaggcagc

SEQ ID NO: 1254180 - DNA, 18 bp, Homo sapiens
atggcccaggcagcctca

SEQ ID NO: 1254181 - DNA, 17 bp, Homo sapiens
atggccccagcacagct

SEQ ID NO: 1254182 - DNA, 18 bp, Homo sapiens
atggccccagcacagctt

SEQ ID NO: 1254183 - DNA, 18 bp, Homo sapiens
atggcccccaataaaggc

SEQ ID NO: 1254184 - DNA, 18 bp, Homo sapiens
atggtccaggagaaggcc

SEQ ID NO: 1254185 - DNA, 18 bp, Homo sapiens
atggtccatttgttcctg

SEQ ID NO: 1254186 - DNA, 11 bp, Homo sapiens
atggtcccagg

SEQ ID NO: 1254187 - DNA, 22 bp, Homo sapiens
atggtcccaggaagcagggaga

SEQ ID NO: 1254188 - DNA, 17 bp, Homo sapiens
atggtcccatccaggca

SEQ ID NO: 1254189 - DNA, 19 bp, Homo sapiens
atggtcccatccaggcagt

SEQ ID NO: 1254190 - DNA, 17 bp, Homo sapiens
atggtcctggggctctg

SEQ ID NO: 1254191 - DNA, 19 bp, Homo sapiens
atggtcctggggctctgtg

SEQ ID NO: 1254192 - DNA, 20 bp, Homo sapiens
atggtcctggggctctgtgc

SEQ ID NO: 1254193 - DNA, 14 bp, Homo sapiens
atggtcgcccagga

SEQ ID NO: 1254194 - DNA, 15 bp, Homo sapiens
atggtcgcccaggag

SEQ ID NO: 1254195 - DNA, 17 bp, Homo sapiens
atggtcggatctcacag

SEQ ID NO: 1254196 - DNA, 18 bp, Homo sapiens
atggtctcagaaaccaaa

SEQ ID NO: 1254197 - DNA, 18 bp, Homo sapiens
atggtctcgatctcctga

SEQ ID NO: 1254198 - DNA, 22 bp, Homo sapiens
atggtctctctccctctgtctt

SEQ ID NO: 1254199 - DNA, 23 bp, Homo sapiens
atggtcttgagccagtaatcttt

SEQ ID NO: 1254200 - DNA, 14 bp, Homo sapiens
atggtgaaaatgta

SEQ ID NO: 1254201 - DNA, 21 bp, Homo sapiens
atggtgaaaccccgtctctac

SEQ ID NO: 1254202 - DNA, 12 bp, Homo sapiens
atggtgaagaca

SEQ ID NO: 1254203 - DNA, 19 bp, Homo sapiens
atggtgagatgcagctgga

SEQ ID NO: 1254204 - DNA, 18 bp, Homo sapiens
atggtgagtgatttttat

SEQ ID NO: 1254205 - DNA, 17 bp, Homo sapiens
atggtgatcctctattt

SEQ ID NO: 1254206 - DNA, 20 bp, Homo sapiens
atggtgcagttgacagcagg

SEQ ID NO: 1254207 - DNA, 20 bp, Homo sapiens
atggtgccttaggaatgact

SEQ ID NO: 1254208 - DNA, 20 bp, Homo sapiens
atggtgctcacgactcttcc

SEQ ID NO: 1254209 - DNA, 23 bp, Homo sapiens
atggtgcttgttaatgctttctg

SEQ ID NO: 1254210 - DNA, 18 bp, Homo sapiens
atggtggactacaaaata

SEQ ID NO: 1254211 - DNA, 20 bp, Homo sapiens
atggtggagggcacttcagg

SEQ ID NO: 1254212 - DNA, 19 bp, Homo sapiens
atggtggcacaggcactga

SEQ ID NO: 1254213 - DNA, 16 bp, Homo sapiens
atggtggcgcgcacct

SEQ ID NO: 1254214 - DNA, 16 bp, Homo sapiens
atggtggtgatgtcca

SEQ ID NO: 1254215 - DNA, 18 bp, Homo sapiens
atggtgtagaacactaat

SEQ ID NO: 1254216 - DNA, 18 bp, Homo sapiens
atggtgtcattctgcctg

SEQ ID NO: 1254217 - DNA, 17 bp, Homo sapiens
atggtgtccttccctgc

SEQ ID NO: 1254218 - DNA, 18 bp, Homo sapiens
atggtgtgaacccgggag

SEQ ID NO: 1254219 - DNA, 20 bp, Homo sapiens
atggtgtggggggctggggg

SEQ ID NO: 1254220 - DNA, 20 bp, Homo sapiens
atggtgtgggtgtcctgcct

SEQ ID NO: 1254221 - DNA, 16 bp, Homo sapiens
atggtgtgtggtgcta

SEQ ID NO: 1254222 - DNA, 21 bp, Homo sapiens
atggtgttaaagctgtacacc

SEQ ID NO: 1254223 - DNA, 16 bp, Homo sapiens
atggtgttgagaagaa

SEQ ID NO: 1254224 - DNA, 14 bp, Homo sapiens
atggttaaaaaggc

SEQ ID NO: 1254225 - DNA, 13 bp, Homo sapiens
atggttaaacatt

SEQ ID NO: 1254226 - DNA, 16 bp, Homo sapiens
atggttatgtttttct

SEQ ID NO: 1254227 - DNA, 16 bp, Homo sapiens
atggttccatgcctga

SEQ ID NO: 1254228 - DNA, 17 bp, Homo sapiens
atggttccatgcctgag

SEQ ID NO: 1254229 - DNA, 22 bp, Homo sapiens
atggttccatgcctgagggtgg

SEQ ID NO: 1254230 - DNA, 18 bp, Homo sapiens
atggttctggctgtttga

SEQ ID NO: 1254231 - DNA, 16 bp, Homo sapiens
atggttgagaaatgaa

SEQ ID NO: 1254232 - DNA, 19 bp, Homo sapiens
atggttgagaaatgaataa

SEQ ID NO: 1254233 - DNA, 15 bp, Homo sapiens
atggttgatggaaaa

SEQ ID NO: 1254234 - DNA, 14 bp, Homo sapiens
atggttgccacccc

SEQ ID NO: 1254235 - DNA, 17 bp, Homo sapiens
atggttgccttaaagaa

SEQ ID NO: 1254236 - DNA, 15 bp, Homo sapiens
atggttgggacaatg

SEQ ID NO: 1254237 - DNA, 12 bp, Homo sapiens
atggttgtagca

SEQ ID NO: 1254238 - DNA, 18 bp, Homo sapiens
atggttgtctgtttttgt

SEQ ID NO: 1254239 - DNA, 16 bp, Homo sapiens
atggttgtgaaatgta

SEQ ID NO: 1254240 - DNA, 20 bp, Homo sapiens
atggttgtgaaatgtaacat

SEQ ID NO: 1254241 - DNA, 14 bp, Homo sapiens
atggtttaaaagaa

SEQ ID NO: 1254242 - DNA, 14 bp, Homo sapiens
atggtttcctctgg

SEQ ID NO: 1254243 - DNA, 18 bp, Homo sapiens
atggtttctgtctgaatt

SEQ ID NO: 1254244 - DNA, 14 bp, Homo sapiens
atggtttgaaattt

SEQ ID NO: 1254245 - DNA, 22 bp, Homo sapiens
atggtttgactcccgaacatca

SEQ ID NO: 1254246 - DNA, 22 bp, Homo sapiens
atggtttggtgctttttataaa

SEQ ID NO: 1254247 - DNA, 14 bp, Homo sapiens
atggttttcaaaat

SEQ ID NO: 1254248 - DNA, 20 bp, Homo sapiens
atggttttctccaagagcta

SEQ ID NO: 1254249 - DNA, 21 bp, Homo sapiens
atggttttgaatagatcttta

SEQ ID NO: 1254250 - DNA, 18 bp, Homo sapiens
atggttttggctctccca

SEQ ID NO: 1254251 - DNA, 16 bp, Homo sapiens
atggtttttaaatttt

SEQ ID NO: 1254252 - DNA, 18 bp, Homo sapiens
atggtttttaaattttgt

SEQ ID NO: 1254253 - DNA, 11 bp, Homo sapiens
atgtaaaaaag

SEQ ID NO: 1254254 - DNA, 20 bp, Homo sapiens
atgtaaaaatgaaggaatta

SEQ ID NO: 1254255 - DNA, 15 bp, Homo sapiens
atgtaaaacaggaaa

SEQ ID NO: 1254256 - DNA, 22 bp, Homo sapiens
atgtaaaagacttttttcccaa

SEQ ID NO: 1254257 - DNA, 19 bp, Homo sapiens
atgtaaaaggattattact

SEQ ID NO: 1254258 - DNA, 21 bp, Homo sapiens
atgtaaaaggtattaaattga

SEQ ID NO: 1254259 - DNA, 20 bp, Homo sapiens
atgtaaaattgaaaatatgt

SEQ ID NO: 1254260 - DNA, 14 bp, Homo sapiens
atgtaaacaggaga

SEQ ID NO: 1254261 - DNA, 16 bp, Homo sapiens
atgtaaacagtgcctg

SEQ ID NO: 1254262 - DNA, 22 bp, Homo sapiens
atgtaaacagtgcctgctgaat

SEQ ID NO: 1254263 - DNA, 11 bp, Homo sapiens
atgtaaactgc

SEQ ID NO: 1254264 - DNA, 13 bp, Homo sapiens
atgtaaactgcca

SEQ ID NO: 1254265 - DNA, 14 bp, Homo sapiens
atgtaaactgtgca

SEQ ID NO: 1254266 - DNA, 21 bp, Homo sapiens
atgtaaactttgtcatggttt

SEQ ID NO: 1254267 - DNA, 14 bp, Homo sapiens
atgtaaagatattt

SEQ ID NO: 1254268 - DNA, 14 bp, Homo sapiens
atgtaaagcttgtc

SEQ ID NO: 1254269 - DNA, 13 bp, Homo sapiens
atgtaaagtatgt

SEQ ID NO: 1254270 - DNA, 17 bp, Homo sapiens
atgtaaagtatgtaaac

SEQ ID NO: 1254271 - DNA, 19 bp, Homo sapiens
atgtaaatactcatgaatg

SEQ ID NO: 1254272 - DNA, 12 bp, Homo sapiens
atgtaaatattc

SEQ ID NO: 1254273 - DNA, 20 bp, Homo sapiens
atgtaaatattttaaagaat

SEQ ID NO: 1254274 - DNA, 21 bp, Homo sapiens
atgtaaattaaattagttcag

SEQ ID NO: 1254275 - DNA, 21 bp, Homo sapiens
atgtaaattattgtaaacttt

SEQ ID NO: 1254276 - DNA, 21 bp, Homo sapiens
atgtaaatttataaatatatt

SEQ ID NO: 1254277 - DNA, 14 bp, Homo sapiens
atgtaacagttgtg

SEQ ID NO: 1254278 - DNA, 11 bp, Homo sapiens
atgtaacatca

SEQ ID NO: 1254279 - DNA, 14 bp, Homo sapiens
atgtaacatcataa

SEQ ID NO: 1254280 - DNA, 15 bp, Homo sapiens
atgtaacatgaagca

SEQ ID NO: 1254281 - DNA, 16 bp, Homo sapiens
atgtaacatgaagcaa

SEQ ID NO: 1254282 - DNA, 12 bp, Homo sapiens
atgtaactatgt

SEQ ID NO: 1254283 - DNA, 20 bp, Homo sapiens
atgtaactccagatagagaa

SEQ ID NO: 1254284 - DNA, 21 bp, Homo sapiens
atgtaactccagatagagaaa

SEQ ID NO: 1254285 - DNA, 19 bp, Homo sapiens
atgtaactctccagccatt

SEQ ID NO: 1254286 - DNA, 12 bp, Homo sapiens
atgtaacttgca

SEQ ID NO: 1254287 - DNA, 16 bp, Homo sapiens
atgtaagaaaatgtta

SEQ ID NO: 1254288 - DNA, 22 bp, Homo sapiens
atgtaagcaaaggctctgaaat

SEQ ID NO: 1254289 - DNA, 16 bp, Homo sapiens
atgtaagcatactttg

SEQ ID NO: 1254290 - DNA, 23 bp, Homo sapiens
atgtaaggcactgtcaggaatgg

SEQ ID NO: 1254291 - DNA, 11 bp, Homo sapiens
atgtaagggtc

SEQ ID NO: 1254292 - DNA, 22 bp, Homo sapiens
atgtaagtaattgcatttctgc

SEQ ID NO: 1254293 - DNA, 19 bp, Homo sapiens
atgtaataaaaagtatatg

SEQ ID NO: 1254294 - DNA, 15 bp, Homo sapiens
atgtaataaacttta

SEQ ID NO: 1254295 - DNA, 17 bp, Homo sapiens
atgtaataaattcaaaa

SEQ ID NO: 1254296 - DNA, 14 bp, Homo sapiens
atgtaataactttc

SEQ ID NO: 1254297 - DNA, 12 bp, Homo sapiens
atgtaatatatt

SEQ ID NO: 1254298 - DNA, 23 bp, Homo sapiens
atgtaatatattgtacaaatgta

SEQ ID NO: 1254299 - DNA, 20 bp, Homo sapiens
atgtaatcaaacttctaggt

SEQ ID NO: 1254300 - DNA, 15 bp, Homo sapiens
atgtaatcaatgttt

SEQ ID NO: 1254301 - DNA, 16 bp, Homo sapiens
atgtaatcagatgcca

SEQ ID NO: 1254302 - DNA, 21 bp, Homo sapiens
atgtaatctctctgcagctgc

SEQ ID NO: 1254303 - DNA, 23 bp, Homo sapiens
atgtaatggaaagggtgttggca

SEQ ID NO: 1254304 - DNA, 17 bp, Homo sapiens
atgtaatggcagttata

SEQ ID NO: 1254305 - DNA, 12 bp, Homo sapiens
atgtaatgtttt

SEQ ID NO: 1254306 - DNA, 12 bp, Homo sapiens
atgtccagaaga

SEQ ID NO: 1254307 - DNA, 22 bp, Homo sapiens
atgtccagaagaatattcagga

SEQ ID NO: 1254308 - DNA, 20 bp, Homo sapiens
atgtccagtcatcctgccct

SEQ ID NO: 1254309 - DNA, 16 bp, Homo sapiens
atgtccataaaagaga

SEQ ID NO: 1254310 - DNA, 13 bp, Homo sapiens
atgtcccaagagc

SEQ ID NO: 1254311 - DNA, 12 bp, Homo sapiens
atgtcccagtgt

SEQ ID NO: 1254312 - DNA, 13 bp, Homo sapiens
atgtcccctgcgg

SEQ ID NO: 1254313 - DNA, 14 bp, Homo sapiens
atgtcccctgtccc

SEQ ID NO: 1254314 - DNA, 16 bp, Homo sapiens
atgtccctccaacaca

SEQ ID NO: 1254315 - DNA, 20 bp, Homo sapiens
atgtccctgggccagggtct

SEQ ID NO: 1254316 - DNA, 20 bp, Homo sapiens
atgtcctaaggacacactaa

SEQ ID NO: 1254317 - DNA, 16 bp, Homo sapiens
atgtcctccagaagcc

SEQ ID NO: 1254318 - DNA, 20 bp, Homo sapiens
atgtcctccagaagcctctg

SEQ ID NO: 1254319 - DNA, 23 bp, Homo sapiens
atgtcctccagaagcctctggct

SEQ ID NO: 1254320 - DNA, 21 bp, Homo sapiens
atgtcctgcctattatctgtc

SEQ ID NO: 1254321 - DNA, 17 bp, Homo sapiens
atgtcctttccatctgt

SEQ ID NO: 1254322 - DNA, 18 bp, Homo sapiens
atgtcgatcaagagaatc

SEQ ID NO: 1254323 - DNA, 17 bp, Homo sapiens
atgtcggggttggggtg

SEQ ID NO: 1254324 - DNA, 21 bp, Homo sapiens
atgtcggggttggggtgggag

SEQ ID NO: 1254325 - DNA, 19 bp, Homo sapiens
atgtcgtggacacacacag

SEQ ID NO: 1254326 - DNA, 20 bp, Homo sapiens
atgtcgtggacacacacaga

SEQ ID NO: 1254327 - DNA, 16 bp, Homo sapiens
atgtcgtgttttcaag

SEQ ID NO: 1254328 - DNA, 18 bp, Homo sapiens
atgtcgtgttttcaagga

SEQ ID NO: 1254329 - DNA, 17 bp, Homo sapiens
atgtctaaatgctgaaa

SEQ ID NO: 1254330 - DNA, 15 bp, Homo sapiens
atgtctacagaaaat

SEQ ID NO: 1254331 - DNA, 16 bp, Homo sapiens
atgtctacagaaaatg

SEQ ID NO: 1254332 - DNA, 22 bp, Homo sapiens
atgtctactttttaatttttaa

SEQ ID NO: 1254333 - DNA, 20 bp, Homo sapiens
atgtctatcaactttaatca

SEQ ID NO: 1254334 - DNA, 17 bp, Homo sapiens
atgtctatgatagataa

SEQ ID NO: 1254335 - DNA, 17 bp, Homo sapiens
atgtctattaaggtgat

SEQ ID NO: 1254336 - DNA, 15 bp, Homo sapiens
atgtctatttaagcc

SEQ ID NO: 1254337 - DNA, 13 bp, Homo sapiens
atgtctcactgtt

SEQ ID NO: 1254338 - DNA, 17 bp, Homo sapiens
atgtctcactgttctgc

SEQ ID NO: 1254339 - DNA, 18 bp, Homo sapiens
atgtctcagagccttcca

SEQ ID NO: 1254340 - DNA, 13 bp, Homo sapiens
atgtctcatgtaa

SEQ ID NO: 1254341 - DNA, 14 bp, Homo sapiens
atgtctcatgtaat

SEQ ID NO: 1254342 - DNA, 13 bp, Homo sapiens
atgtctccagatt

SEQ ID NO: 1254343 - DNA, 20 bp, Homo sapiens
atgtctccattttcttctct

SEQ ID NO: 1254344 - DNA, 12 bp, Homo sapiens
atgtctcccaca

SEQ ID NO: 1254345 - DNA, 18 bp, Homo sapiens
atgtctcctcaagcctgt

SEQ ID NO: 1254346 - DNA, 20 bp, Homo sapiens
atgtctcctcaagcctgtgg

SEQ ID NO: 1254347 - DNA, 13 bp, Homo sapiens
atgtctcctcccc

SEQ ID NO: 1254348 - DNA, 15 bp, Homo sapiens
atgtctcgtggtagg

SEQ ID NO: 1254349 - DNA, 19 bp, Homo sapiens
atgtctcgtggtaggactg

SEQ ID NO: 1254350 - DNA, 15 bp, Homo sapiens
atgtctctctgccaa

SEQ ID NO: 1254351 - DNA, 16 bp, Homo sapiens
atgtctctctgccaag

SEQ ID NO: 1254352 - DNA, 13 bp, Homo sapiens
atgtctctgctcc

SEQ ID NO: 1254353 - DNA, 11 bp, Homo sapiens
atgtctctggg

SEQ ID NO: 1254354 - DNA, 20 bp, Homo sapiens
atgtctcttcctctgttcta

SEQ ID NO: 1254355 - DNA, 23 bp, Homo sapiens
atgtctcttgagcatcaatcttg

SEQ ID NO: 1254356 - DNA, 13 bp, Homo sapiens
atgtctcttgtag

SEQ ID NO: 1254357 - DNA, 15 bp, Homo sapiens
atgtctcttgtagaa

SEQ ID NO: 1254358 - DNA, 18 bp, Homo sapiens
atgtctgaagtacaaaca

SEQ ID NO: 1254359 - DNA, 16 bp, Homo sapiens
atgtctgacacattaa

SEQ ID NO: 1254360 - DNA, 22 bp, Homo sapiens
atgtctgagtgaacctgtataa

SEQ ID NO: 1254361 - DNA, 12 bp, Homo sapiens
atgtctgataat

SEQ ID NO: 1254362 - DNA, 14 bp, Homo sapiens
atgtctgataatga

SEQ ID NO: 1254363 - DNA, 15 bp, Homo sapiens
atgtctgataatgat

SEQ ID NO: 1254364 - DNA, 18 bp, Homo sapiens
atgtctgcaggtgtctga

SEQ ID NO: 1254365 - DNA, 13 bp, Homo sapiens
atgtctgccttcg

SEQ ID NO: 1254366 - DNA, 11 bp, Homo sapiens
atgtctgctgg

SEQ ID NO: 1254367 - DNA, 19 bp, Homo sapiens
atgtctgctggtatttcta

SEQ ID NO: 1254368 - DNA, 20 bp, Homo sapiens
atgtctgctggtatttctaa

SEQ ID NO: 1254369 - DNA, 12 bp, Homo sapiens
atgtctgcttct

SEQ ID NO: 1254370 - DNA, 13 bp, Homo sapiens
atgtctgcttctg

SEQ ID NO: 1254371 - DNA, 19 bp, Homo sapiens
atgtctgcttctgtccagg

SEQ ID NO: 1254372 - DNA, 21 bp, Homo sapiens
atgtctgcttctgtccaggac

SEQ ID NO: 1254373 - DNA, 22 bp, Homo sapiens
atgtctgtaataaataaatata

SEQ ID NO: 1254374 - DNA, 18 bp, Homo sapiens
atgtctgtagctcctcaa

SEQ ID NO: 1254375 - DNA, 18 bp, Homo sapiens
atgtctgtcctcagagca

SEQ ID NO: 1254376 - DNA, 12 bp, Homo sapiens
atgtctgtgcta

SEQ ID NO: 1254377 - DNA, 20 bp, Homo sapiens
atgtctgtgctagggaaact

SEQ ID NO: 1254378 - DNA, 14 bp, Homo sapiens
atgtctgtggattt

SEQ ID NO: 1254379 - DNA, 20 bp, Homo sapiens
atgtctgttaccatgtcact

SEQ ID NO: 1254380 - DNA, 15 bp, Homo sapiens
atgtctgtttattaa

SEQ ID NO: 1254381 - DNA, 23 bp, Homo sapiens
atgtctgtttattaactactgaa

SEQ ID NO: 1254382 - DNA, 21 bp, Homo sapiens
atgtcttaaataaaactattt

SEQ ID NO: 1254383 - DNA, 17 bp, Homo sapiens
atgtcttaacaaatcag

SEQ ID NO: 1254384 - DNA, 20 bp, Homo sapiens
atgtcttcatcacttcttcc

SEQ ID NO: 1254385 - DNA, 11 bp, Homo sapiens
atgtcttccct

SEQ ID NO: 1254386 - DNA, 12 bp, Homo sapiens
atgtcttccctg

SEQ ID NO: 1254387 - DNA, 14 bp, Homo sapiens
atgtcttccctggg

SEQ ID NO: 1254388 - DNA, 15 bp, Homo sapiens
atgtcttctagctgc

SEQ ID NO: 1254389 - DNA, 12 bp, Homo sapiens
atgtcttctgcc

SEQ ID NO: 1254390 - DNA, 15 bp, Homo sapiens
atgtcttcttttgtg

SEQ ID NO: 1254391 - DNA, 20 bp, Homo sapiens
atgtcttgctgttgacatat

SEQ ID NO: 1254392 - DNA, 13 bp, Homo sapiens
atgtcttgtcata

SEQ ID NO: 1254393 - DNA, 22 bp, Homo sapiens
atgtcttgtcatacaaatttat

SEQ ID NO: 1254394 - DNA, 12 bp, Homo sapiens
atgtcttgtgca

SEQ ID NO: 1254395 - DNA, 19 bp, Homo sapiens
atgtctttccaaattattt

SEQ ID NO: 1254396 - DNA, 20 bp, Homo sapiens
atgtctttgttggaaaagaa

SEQ ID NO: 1254397 - DNA, 14 bp, Homo sapiens
atgtcttttaaaat

SEQ ID NO: 1254398 - DNA, 18 bp, Homo sapiens
atgtcttttagaagatag

SEQ ID NO: 1254399 - DNA, 17 bp, Homo sapiens
atgtcttttcccattta

SEQ ID NO: 1254400 - DNA, 15 bp, Homo sapiens
atgtcttttgaatat

SEQ ID NO: 1254401 - DNA, 16 bp, Homo sapiens
atgtcttttgaatatt

SEQ ID NO: 1254402 - DNA, 15 bp, Homo sapiens
atgtctttttattaa

SEQ ID NO: 1254403 - DNA, 21 bp, Homo sapiens
atgtcttttttcaaactttat

SEQ ID NO: 1254404 - DNA, 14 bp, Homo sapiens
atgtgaaaaaggaa

SEQ ID NO: 1254405 - DNA, 13 bp, Homo sapiens
atgtgaaaaatta

SEQ ID NO: 1254406 - DNA, 21 bp, Homo sapiens
atgtgaaaagcacagctgtat

SEQ ID NO: 1254407 - DNA, 22 bp, Homo sapiens
atgtgaaaagcacagctgtata

SEQ ID NO: 1254408 - DNA, 21 bp, Homo sapiens
atgtgaaaatggtccaggaga

SEQ ID NO: 1254409 - DNA, 22 bp, Homo sapiens
atgtgaaactggattaaactta

SEQ ID NO: 1254410 - DNA, 18 bp, Homo sapiens
atgtgaaaggaacatttt

SEQ ID NO: 1254411 - DNA, 14 bp, Homo sapiens
atgtgaaaggatat

SEQ ID NO: 1254412 - DNA, 13 bp, Homo sapiens
atgtgaaatctca

SEQ ID NO: 1254413 - DNA, 19 bp, Homo sapiens
atgtgaaatgcttatgctt

SEQ ID NO: 1254414 - DNA, 14 bp, Homo sapiens
atgtgaaatgcttt

SEQ ID NO: 1254415 - DNA, 14 bp, Homo sapiens
atgtgaacagcata

SEQ ID NO: 1254416 - DNA, 17 bp, Homo sapiens
atgtgaactttattaaa

SEQ ID NO: 1254417 - DNA, 11 bp, Homo sapiens
atgtgaagaaa

SEQ ID NO: 1254418 - DNA, 17 bp, Homo sapiens
atgtgaagaaaaagacc

SEQ ID NO: 1254419 - DNA, 20 bp, Homo sapiens
atgtgaagacattttttgct

SEQ ID NO: 1254420 - DNA, 17 bp, Homo sapiens
atgtgaagcatgctttg

SEQ ID NO: 1254421 - DNA, 20 bp, Homo sapiens
atgtgaagcatgctttgctg

SEQ ID NO: 1254422 - DNA, 21 bp, Homo sapiens
atgtgaagttttccttgctat

SEQ ID NO: 1254423 - DNA, 15 bp, Homo sapiens
atgtgaatcagaccc

SEQ ID NO: 1254424 - DNA, 16 bp, Homo sapiens
atgtgaatcagaccct

SEQ ID NO: 1254425 - DNA, 20 bp, Homo sapiens
atgtgaatgatctctctgaa

SEQ ID NO: 1254426 - DNA, 18 bp, Homo sapiens
atgtgaattattgacact

SEQ ID NO: 1254427 - DNA, 11 bp, Homo sapiens
atgtgaatttt

SEQ ID NO: 1254428 - DNA, 13 bp, Homo sapiens
atgtgaattttta

SEQ ID NO: 1254429 - DNA, 17 bp, Homo sapiens
atgttactctcttgcac

SEQ ID NO: 1254430 - DNA, 22 bp, Homo sapiens
atgttactgatcatgcattgtt

SEQ ID NO: 1254431 - DNA, 14 bp, Homo sapiens
atgttactgcttca

SEQ ID NO: 1254432 - DNA, 19 bp, Homo sapiens
atgttacttccccacccct

SEQ ID NO: 1254433 - DNA, 15 bp, Homo sapiens
atgttagaagaagag

SEQ ID NO: 1254434 - DNA, 21 bp, Homo sapiens
atgttagaggttttaaagtga

SEQ ID NO: 1254435 - DNA, 16 bp, Homo sapiens
atgttagtaaaggaac

SEQ ID NO: 1254436 - DNA, 23 bp, Homo sapiens
atgttagttaccttatagttact

SEQ ID NO: 1254437 - DNA, 15 bp, Homo sapiens
atgttatacaaggca

SEQ ID NO: 1254438 - DNA, 17 bp, Homo sapiens
atgttatacaaggcaag

SEQ ID NO: 1254439 - DNA, 20 bp, Homo sapiens
atgttatacaaggcaagcat

SEQ ID NO: 1254440 - DNA, 13 bp, Homo sapiens
atgttatatttaa

SEQ ID NO: 1254441 - DNA, 22 bp, Homo sapiens
atgttatatttaatgcattaaa

SEQ ID NO: 1254442 - DNA, 18 bp, Homo sapiens
atgttatcaaccaactgc

SEQ ID NO: 1254443 - DNA, 17 bp, Homo sapiens
atgttatgaacagctgt

SEQ ID NO: 1254444 - DNA, 20 bp, Homo sapiens
atgttatgaacagctgtgtc

SEQ ID NO: 1254445 - DNA, 14 bp, Homo sapiens
atgttatgaacatg

SEQ ID NO: 1254446 - DNA, 18 bp, Homo sapiens
atgttatgactatgtaaa

SEQ ID NO: 1254447 - DNA, 20 bp, Homo sapiens
atgttatgatattgtttaaa

SEQ ID NO: 1254448 - DNA, 17 bp, Homo sapiens
atgttatgcataaagtc

SEQ ID NO: 1254449 - DNA, 13 bp, Homo sapiens
atgttatgctggt

SEQ ID NO: 1254450 - DNA, 17 bp, Homo sapiens
atgttatgggatgtaaa

SEQ ID NO: 1254451 - DNA, 16 bp, Homo sapiens
atgttatgtttaataa

SEQ ID NO: 1254452 - DNA, 21 bp, Homo sapiens
atgttattactgttttgggcc

SEQ ID NO: 1254453 - DNA, 22 bp, Homo sapiens
atgttattactgttttgggcct

SEQ ID NO: 1254454 - DNA, 13 bp, Homo sapiens
atgttattatgct

SEQ ID NO: 1254455 - DNA, 21 bp, Homo sapiens
atgttattattaccagcattt

SEQ ID NO: 1254456 - DNA, 23 bp, Homo sapiens
atgttattattactctacactga

SEQ ID NO: 1254457 - DNA, 15 bp, Homo sapiens
atgttattgcataat

SEQ ID NO: 1254458 - DNA, 23 bp, Homo sapiens
atgttatttaacagctgaattat

SEQ ID NO: 1254459 - DNA, 20 bp, Homo sapiens
atgttatttgttattttcag

SEQ ID NO: 1254460 - DNA, 17 bp, Homo sapiens
atgttattttttaatta

SEQ ID NO: 1254461 - DNA, 14 bp, Homo sapiens
atgttcacttttga

SEQ ID NO: 1254462 - DNA, 20 bp, Homo sapiens
atgttcacttttgacaaagg

SEQ ID NO: 1254463 - DNA, 22 bp, Homo sapiens
atgttcagaaatgtaaatgtta

SEQ ID NO: 1254464 - DNA, 17 bp, Homo sapiens
atgttcagaagaaattc

SEQ ID NO: 1254465 - DNA, 22 bp, Homo sapiens
atgttcagagtggctcactggc

SEQ ID NO: 1254466 - DNA, 15 bp, Homo sapiens
atgttcatattggat

SEQ ID NO: 1254467 - DNA, 20 bp, Homo sapiens
atgttcatatttattgatta

SEQ ID NO: 1254468 - DNA, 12 bp, Homo sapiens
atgttcattata

SEQ ID NO: 1254469 - DNA, 15 bp, Homo sapiens
atgttcattataatc

SEQ ID NO: 1254470 - DNA, 21 bp, Homo sapiens
atgttcattataatctcaaag

SEQ ID NO: 1254471 - DNA, 21 bp, Homo sapiens
atgttcattgtaatgttactg

SEQ ID NO: 1254472 - DNA, 23 bp, Homo sapiens
atgttcattgtaatgttactgat

SEQ ID NO: 1254473 - DNA, 16 bp, Homo sapiens
atgttccacctgccac

SEQ ID NO: 1254474 - DNA, 17 bp, Homo sapiens
atgttccagacattctc

SEQ ID NO: 1254475 - DNA, 12 bp, Homo sapiens
atgttccccagg

SEQ ID NO: 1254476 - DNA, 14 bp, Homo sapiens
atgttccctgcacc

SEQ ID NO: 1254477 - DNA, 15 bp, Homo sapiens
atgttcccttgacca

SEQ ID NO: 1254478 - DNA, 16 bp, Homo sapiens
atgttcctaacaaaat

SEQ ID NO: 1254479 - DNA, 20 bp, Homo sapiens
atgttcctaaggtcatttct

SEQ ID NO: 1254480 - DNA, 12 bp, Homo sapiens
atgttcctcctt

SEQ ID NO: 1254481 - DNA, 23 bp, Homo sapiens
atgttcctccttttcttcaccct

SEQ ID NO: 1254482 - DNA, 19 bp, Homo sapiens
atgttcctgaattctattt

SEQ ID NO: 1254483 - DNA, 22 bp, Homo sapiens
atgttcctttggaagaaaaaat

SEQ ID NO: 1254484 - DNA, 14 bp, Homo sapiens
atgttccttttgaa

SEQ ID NO: 1254485 - DNA, 18 bp, Homo sapiens
atgttctaagtctttcca

SEQ ID NO: 1254486 - DNA, 14 bp, Homo sapiens
atgttctaggtttc

SEQ ID NO: 1254487 - DNA, 20 bp, Homo sapiens
atgttctattttttgttttg

SEQ ID NO: 1254488 - DNA, 16 bp, Homo sapiens
atgttctgaataattt

SEQ ID NO: 1254489 - DNA, 18 bp, Homo sapiens
atgttctgaataatttct

SEQ ID NO: 1254490 - DNA, 14 bp, Homo sapiens
atgttctgacatta

SEQ ID NO: 1254491 - DNA, 19 bp, Homo sapiens
atgttctgacattaacagt

SEQ ID NO: 1254492 - DNA, 16 bp, Homo sapiens
atgttctgcaagaatt

SEQ ID NO: 1254493 - DNA, 21 bp, Homo sapiens
atgttctgcaagaattaaaac

SEQ ID NO: 1254494 - DNA, 23 bp, Homo sapiens
atgttctgcaagaattaaaactg

SEQ ID NO: 1254495 - DNA, 14 bp, Homo sapiens
atgttctgccccca

SEQ ID NO: 1254496 - DNA, 18 bp, Homo sapiens
atgttctgcccccagccc

SEQ ID NO: 1254497 - DNA, 21 bp, Homo sapiens
atgttctgtcacgtgaaatat

SEQ ID NO: 1254498 - DNA, 16 bp, Homo sapiens
atgttctgtttgctgt

SEQ ID NO: 1254499 - DNA, 20 bp, Homo sapiens
atgttcttagtggatgttct

SEQ ID NO: 1254500 - DNA, 21 bp, Homo sapiens
atgttcttgtcataaaatgca

SEQ ID NO: 1254501 - DNA, 22 bp, Homo sapiens
atgttcttgtcataaaatgcat

SEQ ID NO: 1254502 - DNA, 20 bp, Homo sapiens
atgttcttttaaatgattga

SEQ ID NO: 1254503 - DNA, 16 bp, Homo sapiens
atgttgaaaagtcaaa

SEQ ID NO: 1254504 - DNA, 18 bp, Homo sapiens
atgttgaaagatcaaaag

SEQ ID NO: 1254505 - DNA, 15 bp, Homo sapiens
atgttgaaatatgca

SEQ ID NO: 1254506 - DNA, 17 bp, Homo sapiens
atgttgaaatatgcata

SEQ ID NO: 1254507 - DNA, 19 bp, Homo sapiens
atgttgaaatatgcatact

SEQ ID NO: 1254508 - DNA, 14 bp, Homo sapiens
atgttgaacttttt

SEQ ID NO: 1254509 - DNA, 16 bp, Homo sapiens
atgttgaagaaaaaag

SEQ ID NO: 1254510 - DNA, 14 bp, Homo sapiens
atgttgaatacttt

SEQ ID NO: 1254511 - DNA, 15 bp, Homo sapiens
atgttgacattttct

SEQ ID NO: 1254512 - DNA, 14 bp, Homo sapiens
atgttgataatttc

SEQ ID NO: 1254513 - DNA, 15 bp, Homo sapiens
atgttgatcagcaaa

SEQ ID NO: 1254514 - DNA, 19 bp, Homo sapiens
atgttgatcagcaaattta

SEQ ID NO: 1254515 - DNA, 14 bp, Homo sapiens
atgttgatctgcat

SEQ ID NO: 1254516 - DNA, 20 bp, Homo sapiens
atgttgatctgcatatttct

SEQ ID NO: 1254517 - DNA, 19 bp, Homo sapiens
atgttgcaatgtgaaaaat

SEQ ID NO: 1254518 - DNA, 13 bp, Homo sapiens
atgttgcatgcct

SEQ ID NO: 1254519 - DNA, 22 bp, Homo sapiens
atgttgccacctgttaaaatgt

SEQ ID NO: 1254520 - DNA, 20 bp, Homo sapiens
atgttgctagttttttgctt

SEQ ID NO: 1254521 - DNA, 19 bp, Homo sapiens
atgttgctatgtgccttat

SEQ ID NO: 1254522 - DNA, 15 bp, Homo sapiens
atgttgctattgtaa

SEQ ID NO: 1254523 - DNA, 13 bp, Homo sapiens
atgttgctgccaa

SEQ ID NO: 1254524 - DNA, 15 bp, Homo sapiens
atgttgctggactgt

SEQ ID NO: 1254525 - DNA, 15 bp, Homo sapiens
atgttgctggatcag

SEQ ID NO: 1254526 - DNA, 20 bp, Homo sapiens
atgttgctgtgcacggtgga

SEQ ID NO: 1254527 - DNA, 17 bp, Homo sapiens
atgttgctgttattata

SEQ ID NO: 1254528 - DNA, 19 bp, Homo sapiens
atgttgctgttattatatt

SEQ ID NO: 1254529 - DNA, 20 bp, Homo sapiens
atgttgcttctgaatcactg

SEQ ID NO: 1254530 - DNA, 17 bp, Homo sapiens
atgttggacagacactg

SEQ ID NO: 1254531 - DNA, 18 bp, Homo sapiens
atgttggacagacactgt

SEQ ID NO: 1254532 - DNA, 17 bp, Homo sapiens
atgttggataaggaatt

SEQ ID NO: 1254533 - DNA, 22 bp, Homo sapiens
atgttggatgatgaaacattca

SEQ ID NO: 1254534 - DNA, 16 bp, Homo sapiens
atgttggatttataaa

SEQ ID NO: 1254535 - DNA, 20 bp, Homo sapiens
atgttggatttataaatgct

SEQ ID NO: 1254536 - DNA, 16 bp, Homo sapiens
atgttggccaggctgg

SEQ ID NO: 1254537 - DNA, 20 bp, Homo sapiens
atgttggctgcgtactccac

SEQ ID NO: 1254538 - DNA, 19 bp, Homo sapiens
atgttgggaaacttggctc

SEQ ID NO: 1254539 - DNA, 20 bp, Homo sapiens
atgttgggaaacttggctcg

SEQ ID NO: 1254540 - DNA, 17 bp, Homo sapiens
atgttgggtctcactct

SEQ ID NO: 1254541 - DNA, 12 bp, Homo sapiens
atgttggtttat

SEQ ID NO: 1254542 - DNA, 15 bp, Homo sapiens
atgttggtttcagtg

SEQ ID NO: 1254543 - DNA, 15 bp, Homo sapiens
atgttgtatttgtta

SEQ ID NO: 1254544 - DNA, 11 bp, Homo sapiens
atgttgtcata

SEQ ID NO: 1254545 - DNA, 21 bp, Homo sapiens
atgttgtcataacatttaaag

SEQ ID NO: 1254546 - DNA, 22 bp, Homo sapiens
atgttgtccaacaataaacagg

SEQ ID NO: 1254547 - DNA, 23 bp, Homo sapiens
atgttgtccaacaataaacagga

SEQ ID NO: 1254548 - DNA, 19 bp, Homo sapiens
atgttgtgtattgtggttt

SEQ ID NO: 1254549 - DNA, 15 bp, Homo sapiens
atgttgttaaacacg

SEQ ID NO: 1254550 - DNA, 21 bp, Homo sapiens
attacatatttgactctttca

SEQ ID NO: 1254551 - DNA, 23 bp, Homo sapiens
attacatatttgactctttcaaa

SEQ ID NO: 1254552 - DNA, 16 bp, Homo sapiens
attacatctttcacat

SEQ ID NO: 1254553 - DNA, 18 bp, Homo sapiens
attacatctttcacattg

SEQ ID NO: 1254554 - DNA, 22 bp, Homo sapiens
attacatctttcacattggcta

SEQ ID NO: 1254555 - DNA, 18 bp, Homo sapiens
attacatgtttaaattgt

SEQ ID NO: 1254556 - DNA, 15 bp, Homo sapiens
attacattattaaac

SEQ ID NO: 1254557 - DNA, 22 bp, Homo sapiens
attacattcctaactagaatta

SEQ ID NO: 1254558 - DNA, 23 bp, Homo sapiens
attacattcctaactagaattag

SEQ ID NO: 1254559 - DNA, 14 bp, Homo sapiens
attacatttataca

SEQ ID NO: 1254560 - DNA, 15 bp, Homo sapiens
attacattttcagtg

SEQ ID NO: 1254561 - DNA, 18 bp, Homo sapiens
attaccaaaaatcttggg

SEQ ID NO: 1254562 - DNA, 13 bp, Homo sapiens
attaccaaaacag

SEQ ID NO: 1254563 - DNA, 19 bp, Homo sapiens
attaccaataggcaaatta

SEQ ID NO: 1254564 - DNA, 22 bp, Homo sapiens
attaccaataggcaaattaatc

SEQ ID NO: 1254565 - DNA, 19 bp, Homo sapiens
attaccacagacatactaa

SEQ ID NO: 1254566 - DNA, 21 bp, Homo sapiens
attaccagtggcgttgttgca

SEQ ID NO: 1254567 - DNA, 15 bp, Homo sapiens
attaccatgtaatgg

SEQ ID NO: 1254568 - DNA, 22 bp, Homo sapiens
attaccattaattacatacaga

SEQ ID NO: 1254569 - DNA, 14 bp, Homo sapiens
attaccatttgtta

SEQ ID NO: 1254570 - DNA, 17 bp, Homo sapiens
attaccccatacccctt

SEQ ID NO: 1254571 - DNA, 13 bp, Homo sapiens
attaccccctcct

SEQ ID NO: 1254572 - DNA, 16 bp, Homo sapiens
attaccgcgttgtaaa

SEQ ID NO: 1254573 - DNA, 18 bp, Homo sapiens
attaccgcgttgtaaaat

SEQ ID NO: 1254574 - DNA, 13 bp, Homo sapiens
attacctcctgag

SEQ ID NO: 1254575 - DNA, 13 bp, Homo sapiens
attacctctgata

SEQ ID NO: 1254576 - DNA, 19 bp, Homo sapiens
attacctgtggagttgcat

SEQ ID NO: 1254577 - DNA, 14 bp, Homo sapiens
attacctgtggata

SEQ ID NO: 1254578 - DNA, 19 bp, Homo sapiens
attacctgtggatatttgt

SEQ ID NO: 1254579 - DNA, 21 bp, Homo sapiens
attaccttagattagctctgg

SEQ ID NO: 1254580 - DNA, 15 bp, Homo sapiens
attacgtgcatttaa

SEQ ID NO: 1254581 - DNA, 18 bp, Homo sapiens
attacgtgcatttaaact

SEQ ID NO: 1254582 - DNA, 19 bp, Homo sapiens
attacgtgtatgtttcttc

SEQ ID NO: 1254583 - DNA, 22 bp, Homo sapiens
attacgttcttacaagcttaaa

SEQ ID NO: 1254584 - DNA, 15 bp, Homo sapiens
attacgtttgttatt

SEQ ID NO: 1254585 - DNA, 21 bp, Homo sapiens
attactacaaaatttgaaatt

SEQ ID NO: 1254586 - DNA, 14 bp, Homo sapiens
attactactgtaca

SEQ ID NO: 1254587 - DNA, 21 bp, Homo sapiens
attactattccctttgacttc

SEQ ID NO: 1254588 - DNA, 14 bp, Homo sapiens
attactctacactg

SEQ ID NO: 1254589 - DNA, 18 bp, Homo sapiens
attactctacactgaaac

SEQ ID NO: 1254590 - DNA, 18 bp, Homo sapiens
attactctagtttattct

SEQ ID NO: 1254591 - DNA, 17 bp, Homo sapiens
attactctcattctttg

SEQ ID NO: 1254592 - DNA, 19 bp, Homo sapiens
attactctttttcaataaa

SEQ ID NO: 1254593 - DNA, 21 bp, Homo sapiens
attactctttttcaataaatt

SEQ ID NO: 1254594 - DNA, 16 bp, Homo sapiens
attactgaataatatc

SEQ ID NO: 1254595 - DNA, 17 bp, Homo sapiens
attactgatgtgatatt

SEQ ID NO: 1254596 - DNA, 13 bp, Homo sapiens
attactgctgctg

SEQ ID NO: 1254597 - DNA, 17 bp, Homo sapiens
attactgctgctgtgct

SEQ ID NO: 1254598 - DNA, 20 bp, Homo sapiens
attactgctttaatcagaaa

SEQ ID NO: 1254599 - DNA, 14 bp, Homo sapiens
attactgggcctta

SEQ ID NO: 1254600 - DNA, 13 bp, Homo sapiens
attactgtcaata

SEQ ID NO: 1254601 - DNA, 15 bp, Homo sapiens
attactgtctttatt

SEQ ID NO: 1254602 - DNA, 15 bp, Homo sapiens
attactgtgtaaata

SEQ ID NO: 1254603 - DNA, 21 bp, Homo sapiens
attactgttgcatttactttt

SEQ ID NO: 1254604 - DNA, 17 bp, Homo sapiens
attactgtttattactt

SEQ ID NO: 1254605 - DNA, 18 bp, Homo sapiens
attactgtttattacttc

SEQ ID NO: 1254606 - DNA, 18 bp, Homo sapiens
attactgttttatgttga

SEQ ID NO: 1254607 - DNA, 22 bp, Homo sapiens
attactgttttatgttgatctg

SEQ ID NO: 1254608 - DNA, 13 bp, Homo sapiens
attacttatttaa

SEQ ID NO: 1254609 - DNA, 14 bp, Homo sapiens
attacttatttaac

SEQ ID NO: 1254610 - DNA, 15 bp, Homo sapiens
attacttatttttga

SEQ ID NO: 1254611 - DNA, 17 bp, Homo sapiens
attacttatttttgaca

SEQ ID NO: 1254612 - DNA, 22 bp, Homo sapiens
attacttcactatacaaacaaa

SEQ ID NO: 1254613 - DNA, 16 bp, Homo sapiens
attacttccatgaatt

SEQ ID NO: 1254614 - DNA, 22 bp, Homo sapiens
attacttctctataaaaaatat

SEQ ID NO: 1254615 - DNA, 15 bp, Homo sapiens
attacttgtgcactt

SEQ ID NO: 1254616 - DNA, 16 bp, Homo sapiens
attacttgtgttactt

SEQ ID NO: 1254617 - DNA, 12 bp, Homo sapiens
attactttcctc

SEQ ID NO: 1254618 - DNA, 19 bp, Homo sapiens
attacttttgtaaatattc

SEQ ID NO: 1254619 - DNA, 20 bp, Homo sapiens
attacttttgtaaatattct

SEQ ID NO: 1254620 - DNA, 23 bp, Homo sapiens
attacttttgtaaatattcttgt

SEQ ID NO: 1254621 - DNA, 11 bp, Homo sapiens
attactttttt

SEQ ID NO: 1254622 - DNA, 21 bp, Homo sapiens
attactttttttgtagatgaa

SEQ ID NO: 1254623 - DNA, 16 bp, Homo sapiens
attagaaaaaaattac

SEQ ID NO: 1254624 - DNA, 22 bp, Homo sapiens
attagaaaaaaattactaattt

SEQ ID NO: 1254625 - DNA, 11 bp, Homo sapiens
attagaaaaca

SEQ ID NO: 1254626 - DNA, 16 bp, Homo sapiens
attagaaatagacagt

SEQ ID NO: 1254627 - DNA, 15 bp, Homo sapiens
attagaaatatttta

SEQ ID NO: 1254628 - DNA, 24 bp, Homo sapiens
attagaaatattttaaaatcagct

SEQ ID NO: 1254629 - DNA, 15 bp, Homo sapiens
attagaaattagaaa

SEQ ID NO: 1254630 - DNA, 23 bp, Homo sapiens
attagaaattagctgtgtgaaat

SEQ ID NO: 1254631 - DNA, 15 bp, Homo sapiens
attagaagacaacag

SEQ ID NO: 1254632 - DNA, 17 bp, Homo sapiens
attagaagtctttcagt

SEQ ID NO: 1254633 - DNA, 13 bp, Homo sapiens
attagaatagtgt

SEQ ID NO: 1254634 - DNA, 20 bp, Homo sapiens
attagaatcaaacattttga

SEQ ID NO: 1254635 - DNA, 21 bp, Homo sapiens
attagaatcaaacattttgaa

SEQ ID NO: 1254636 - DNA, 20 bp, Homo sapiens
attagaatgaatttatcttt

SEQ ID NO: 1254637 - DNA, 13 bp, Homo sapiens
attagaatgtgat

SEQ ID NO: 1254638 - DNA, 15 bp, Homo sapiens
attagaattaccatt

SEQ ID NO: 1254639 - DNA, 13 bp, Homo sapiens
attagaattattt

SEQ ID NO: 1254640 - DNA, 18 bp, Homo sapiens
attagacactttggaaga

SEQ ID NO: 1254641 - DNA, 17 bp, Homo sapiens
attagacagaacaccta

SEQ ID NO: 1254642 - DNA, 18 bp, Homo sapiens
attagacctttatttttc

SEQ ID NO: 1254643 - DNA, 14 bp, Homo sapiens
attagactgtgatt

SEQ ID NO: 1254644 - DNA, 13 bp, Homo sapiens
attagagaagaga

SEQ ID NO: 1254645 - DNA, 20 bp, Homo sapiens
attagagattacctcctgag

SEQ ID NO: 1254646 - DNA, 16 bp, Homo sapiens
attagagcacagcttc

SEQ ID NO: 1254647 - DNA, 18 bp, Homo sapiens
attagagcacagcttctt

SEQ ID NO: 1254648 - DNA, 23 bp, Homo sapiens
attagagcacagcttcttctgcc

SEQ ID NO: 1254649 - DNA, 14 bp, Homo sapiens
attagagcattgaa

SEQ ID NO: 1254650 - DNA, 14 bp, Homo sapiens
attagagcttaaat

SEQ ID NO: 1254651 - DNA, 19 bp, Homo sapiens
attagagggaggagaatga

SEQ ID NO: 1254652 - DNA, 13 bp, Homo sapiens
attagagggaggt

SEQ ID NO: 1254653 - DNA, 11 bp, Homo sapiens
attagagggcc

SEQ ID NO: 1254654 - DNA, 19 bp, Homo sapiens
attagagggccttgcttct

SEQ ID NO: 1254655 - DNA, 21 bp, Homo sapiens
attagagggccttgcttctct

SEQ ID NO: 1254656 - DNA, 22 bp, Homo sapiens
attagagggccttgcttctctt

SEQ ID NO: 1254657 - DNA, 12 bp, Homo sapiens
attagagtattt

SEQ ID NO: 1254658 - DNA, 23 bp, Homo sapiens
attagagtatttcccttccaaag

SEQ ID NO: 1254659 - DNA, 17 bp, Homo sapiens
attagagtgcaaaagtg

SEQ ID NO: 1254660 - DNA, 17 bp, Homo sapiens
attagagtgtctttcca

SEQ ID NO: 1254661 - DNA, 16 bp, Homo sapiens
attagatcaaatagtt

SEQ ID NO: 1254662 - DNA, 21 bp, Homo sapiens
attagatcaaatagttgcata

SEQ ID NO: 1254663 - DNA, 19 bp, Homo sapiens
attagatcttcaaacagaa

SEQ ID NO: 1254664 - DNA, 20 bp, Homo sapiens
attagatcttcaaacagaat

SEQ ID NO: 1254665 - DNA, 19 bp, Homo sapiens
attagatgattatatattg

SEQ ID NO: 1254666 - DNA, 22 bp, Homo sapiens
attagatggcttattttttaaa

SEQ ID NO: 1254667 - DNA, 16 bp, Homo sapiens
attagattttatttta

SEQ ID NO: 1254668 - DNA, 18 bp, Homo sapiens
attagattttattttact

SEQ ID NO: 1254669 - DNA, 14 bp, Homo sapiens
attagcaaggctgg

SEQ ID NO: 1254670 - DNA, 22 bp, Homo sapiens
attagcagaatggagaaagtaa

SEQ ID NO: 1254671 - DNA, 17 bp, Homo sapiens
attagcagtttgctttg

SEQ ID NO: 1254672 - DNA, 14 bp, Homo sapiens
attattttgtattc

SEQ ID NO: 1254673 - DNA, 18 bp, Homo sapiens
attatttttacctaaaga

SEQ ID NO: 1254674 - DNA, 22 bp, Homo sapiens
attatttttccactttgttctt

SEQ ID NO: 1254675 - DNA, 14 bp, Homo sapiens
attatttttgtaga

SEQ ID NO: 1254676 - DNA, 14 bp, Homo sapiens
attatttttgtgtt

SEQ ID NO: 1254677 - DNA, 17 bp, Homo sapiens
attatttttgtgtttct

SEQ ID NO: 1254678 - DNA, 22 bp, Homo sapiens
attattttttttatatttattg

SEQ ID NO: 1254679 - DNA, 16 bp, Homo sapiens
attcaaaaacaggttt

SEQ ID NO: 1254680 - DNA, 20 bp, Homo sapiens
attcaaaaataaattagaaa

SEQ ID NO: 1254681 - DNA, 16 bp, Homo sapiens
attcaaaaattatcta

SEQ ID NO: 1254682 - DNA, 23 bp, Homo sapiens
attcaaaaattatctatagctaa

SEQ ID NO: 1254683 - DNA, 22 bp, Homo sapiens
attcaaaagtgattatctcttt

SEQ ID NO: 1254684 - DNA, 16 bp, Homo sapiens
attcaaaagttgaaat

SEQ ID NO: 1254685 - DNA, 18 bp, Homo sapiens
attcaaaatagggtatat

SEQ ID NO: 1254686 - DNA, 14 bp, Homo sapiens
attcaaaatattta

SEQ ID NO: 1254687 - DNA, 13 bp, Homo sapiens
attcaaaatgctc

SEQ ID NO: 1254688 - DNA, 15 bp, Homo sapiens
attcaaacatattct

SEQ ID NO: 1254689 - DNA, 17 bp, Homo sapiens
attcaaaccaaagctgc

SEQ ID NO: 1254690 - DNA, 18 bp, Homo sapiens
attcaaaccaaagctgcc

SEQ ID NO: 1254691 - DNA, 21 bp, Homo sapiens
attcaaaccaaagctgcctgt

SEQ ID NO: 1254692 - DNA, 24 bp, Homo sapiens
attcaaaccaaagctgcctgtgcc

SEQ ID NO: 1254693 - DNA, 14 bp, Homo sapiens
attcaaataccaat

SEQ ID NO: 1254694 - DNA, 19 bp, Homo sapiens
attcaaatcagtgatctat

SEQ ID NO: 1254695 - DNA, 12 bp, Homo sapiens
attcaaatttat

SEQ ID NO: 1254696 - DNA, 13 bp, Homo sapiens
attcaaatttatt

SEQ ID NO: 1254697 - DNA, 21 bp, Homo sapiens
attcaaatttatttccaatgt

SEQ ID NO: 1254698 - DNA, 18 bp, Homo sapiens
attcaacatcaaaactta

SEQ ID NO: 1254699 - DNA, 19 bp, Homo sapiens
attcaacatcaaaacttaa

SEQ ID NO: 1254700 - DNA, 21 bp, Homo sapiens
attcaagaatgaaaaatataa

SEQ ID NO: 1254701 - DNA, 20 bp, Homo sapiens
attcaagagtggggggagga

SEQ ID NO: 1254702 - DNA, 17 bp, Homo sapiens
attcaagcaaacatcaa

SEQ ID NO: 1254703 - DNA, 16 bp, Homo sapiens
attcaagcctctaaac

SEQ ID NO: 1254704 - DNA, 18 bp, Homo sapiens
attcaagctatttaatat

SEQ ID NO: 1254705 - DNA, 11 bp, Homo sapiens
attcaagctga

SEQ ID NO: 1254706 - DNA, 14 bp, Homo sapiens
attcaagctgagaa

SEQ ID NO: 1254707 - DNA, 16 bp, Homo sapiens
attcaaggaatttctt

SEQ ID NO: 1254708 - DNA, 19 bp, Homo sapiens
attcaaggaatttcttaac

SEQ ID NO: 1254709 - DNA, 18 bp, Homo sapiens
attcaaggagaatatgat

SEQ ID NO: 1254710 - DNA, 20 bp, Homo sapiens
attcaaggagaatatgataa

SEQ ID NO: 1254711 - DNA, 18 bp, Homo sapiens
attcaaggccacaaaaac

SEQ ID NO: 1254712 - DNA, 14 bp, Homo sapiens
attcaagtaacact

SEQ ID NO: 1254713 - DNA, 16 bp, Homo sapiens
attcaagtaacacttt

SEQ ID NO: 1254714 - DNA, 14 bp, Homo sapiens
attcaagtgcctct

SEQ ID NO: 1254715 - DNA, 14 bp, Homo sapiens
attcaagttattgt

SEQ ID NO: 1254716 - DNA, 15 bp, Homo sapiens
attcaagttattgta

SEQ ID NO: 1254717 - DNA, 12 bp, Homo sapiens
attcaataaaaa

SEQ ID NO: 1254718 - DNA, 18 bp, Homo sapiens
attcaataaaaaaaagaa

SEQ ID NO: 1254719 - DNA, 22 bp, Homo sapiens
attcaataaagcagttaattta

SEQ ID NO: 1254720 - DNA, 19 bp, Homo sapiens
attcaataatgagagctca

SEQ ID NO: 1254721 - DNA, 17 bp, Homo sapiens
attcaataccgctcagt

SEQ ID NO: 1254722 - DNA, 13 bp, Homo sapiens
attcaatattgaa

SEQ ID NO: 1254723 - DNA, 20 bp, Homo sapiens
attcaatattgacatttgta

SEQ ID NO: 1254724 - DNA, 18 bp, Homo sapiens
attcaatcatttattcat

SEQ ID NO: 1254725 - DNA, 14 bp, Homo sapiens
attcaatctgtaaa

SEQ ID NO: 1254726 - DNA, 15 bp, Homo sapiens
attcaatctgtaaac

SEQ ID NO: 1254727 - DNA, 16 bp, Homo sapiens
attcaatctgtaaact

SEQ ID NO: 1254728 - DNA, 17 bp, Homo sapiens
attcaatctgtaaactg

SEQ ID NO: 1254729 - DNA, 20 bp, Homo sapiens
attcaatgtgaacactggca

SEQ ID NO: 1254730 - DNA, 22 bp, Homo sapiens
attcaatgtttatgcaaggaag

SEQ ID NO: 1254731 - DNA, 23 bp, Homo sapiens
attcaatgtttatgcaaggaagg

SEQ ID NO: 1254732 - DNA, 21 bp, Homo sapiens
attcaattgtaaattgaatca

SEQ ID NO: 1254733 - DNA, 14 bp, Homo sapiens
attcaatttggcaa

SEQ ID NO: 1254734 - DNA, 15 bp, Homo sapiens
attcaatttggcaaa

SEQ ID NO: 1254735 - DNA, 13 bp, Homo sapiens
attcacaaacttt

SEQ ID NO: 1254736 - DNA, 14 bp, Homo sapiens
attcacaaactttt

SEQ ID NO: 1254737 - DNA, 16 bp, Homo sapiens
attcacaaagtaattt

SEQ ID NO: 1254738 - DNA, 22 bp, Homo sapiens
attcacaacctcaccaaactag

SEQ ID NO: 1254739 - DNA, 18 bp, Homo sapiens
attcacaagcctcctgta

SEQ ID NO: 1254740 - DNA, 14 bp, Homo sapiens
attcacaatagaaa

SEQ ID NO: 1254741 - DNA, 19 bp, Homo sapiens
attcacacctcacgctctg

SEQ ID NO: 1254742 - DNA, 19 bp, Homo sapiens
attcacactttttatttaa

SEQ ID NO: 1254743 - DNA, 11 bp, Homo sapiens
attcacagccc

SEQ ID NO: 1254744 - DNA, 17 bp, Homo sapiens
attcacatctaacctca

SEQ ID NO: 1254745 - DNA, 20 bp, Homo sapiens
attcacatctaacctcatct

SEQ ID NO: 1254746 - DNA, 20 bp, Homo sapiens
attcacatttgatgtacatg

SEQ ID NO: 1254747 - DNA, 21 bp, Homo sapiens
attcacatttgatgtacatgt

SEQ ID NO: 1254748 - DNA, 15 bp, Homo sapiens
attcaccagtgttcc

SEQ ID NO: 1254749 - DNA, 22 bp, Homo sapiens
attcaccccctttcctggacac

SEQ ID NO: 1254750 - DNA, 19 bp, Homo sapiens
attcaccctccacttcccg

SEQ ID NO: 1254751 - DNA, 15 bp, Homo sapiens
attcacctcagcctg

SEQ ID NO: 1254752 - DNA, 22 bp, Homo sapiens
attcacctcagcctggagaggc

SEQ ID NO: 1254753 - DNA, 15 bp, Homo sapiens
attcacctcttcctc

SEQ ID NO: 1254754 - DNA, 18 bp, Homo sapiens
attcacctcttcctctgg

SEQ ID NO: 1254755 - DNA, 19 bp, Homo sapiens
attcacctgccccaactct

SEQ ID NO: 1254756 - DNA, 19 bp, Homo sapiens
attcacctgtaaaacttta

SEQ ID NO: 1254757 - DNA, 14 bp, Homo sapiens
attcacgcttttgt

SEQ ID NO: 1254758 - DNA, 13 bp, Homo sapiens
attcactcccaca

SEQ ID NO: 1254759 - DNA, 15 bp, Homo sapiens
attcactcttccaga

SEQ ID NO: 1254760 - DNA, 11 bp, Homo sapiens
attcactgctg

SEQ ID NO: 1254761 - DNA, 16 bp, Homo sapiens
attcactggttttaca

SEQ ID NO: 1254762 - DNA, 13 bp, Homo sapiens
attcactgtgcac

SEQ ID NO: 1254763 - DNA, 14 bp, Homo sapiens
attcacttgcattt

SEQ ID NO: 1254764 - DNA, 20 bp, Homo sapiens
attcactttgtttatgcata

SEQ ID NO: 1254765 - DNA, 19 bp, Homo sapiens
attcacttttgttaacagt

SEQ ID NO: 1254766 - DNA, 13 bp, Homo sapiens
attcagaaattaa

SEQ ID NO: 1254767 - DNA, 15 bp, Homo sapiens
attcagaaattaaaa

SEQ ID NO: 1254768 - DNA, 17 bp, Homo sapiens
attcagaactaaatttt

SEQ ID NO: 1254769 - DNA, 22 bp, Homo sapiens
attcagaactaaatttttcata

SEQ ID NO: 1254770 - DNA, 16 bp, Homo sapiens
attcagaagaaaaaga

SEQ ID NO: 1254771 - DNA, 18 bp, Homo sapiens
attcagaagaaaaagaag

SEQ ID NO: 1254772 - DNA, 14 bp, Homo sapiens
attcagacaaaatg

SEQ ID NO: 1254773 - DNA, 15 bp, Homo sapiens
attcagacaaaatgg

SEQ ID NO: 1254774 - DNA, 23 bp, Homo sapiens
attcagacaaaatggatacataa

SEQ ID NO: 1254775 - DNA, 17 bp, Homo sapiens
attcagacagagacttt

SEQ ID NO: 1254776 - DNA, 15 bp, Homo sapiens
attcagacatctgag

SEQ ID NO: 1254777 - DNA, 16 bp, Homo sapiens
attcagagactgccct

SEQ ID NO: 1254778 - DNA, 20 bp, Homo sapiens
attcagagactgcccttctc

SEQ ID NO: 1254779 - DNA, 13 bp, Homo sapiens
attcagaggcagt

SEQ ID NO: 1254780 - DNA, 15 bp, Homo sapiens
attcagaggcagtga

SEQ ID NO: 1254781 - DNA, 23 bp, Homo sapiens
attcagatcaaaatgcctttcag

SEQ ID NO: 1254782 - DNA, 23 bp, Homo sapiens
attcagatcactgaatttataaa

SEQ ID NO: 1254783 - DNA, 13 bp, Homo sapiens
attcagatcgaaa

SEQ ID NO: 1254784 - DNA, 20 bp, Homo sapiens
attcagatgaatagatggaa

SEQ ID NO: 1254785 - DNA, 14 bp, Homo sapiens
attcagatgtatgt

SEQ ID NO: 1254786 - DNA, 18 bp, Homo sapiens
attcagattgtcttgcaa

SEQ ID NO: 1254787 - DNA, 22 bp, Homo sapiens
attcagattgtcttgcaacttc

SEQ ID NO: 1254788 - DNA, 17 bp, Homo sapiens
attcagattgttatcta

SEQ ID NO: 1254789 - DNA, 17 bp, Homo sapiens
attcagcaccctgggtg

SEQ ID NO: 1254790 - DNA, 17 bp, Homo sapiens
attcagcagttttatcc

SEQ ID NO: 1254791 - DNA, 14 bp, Homo sapiens
attcagccagctta

SEQ ID NO: 1254792 - DNA, 17 bp, Homo sapiens
attcagccagcttaaac

SEQ ID NO: 1254793 - DNA, 14 bp, Homo sapiens
attcagccttcttt

SEQ ID NO: 1254794 - DNA, 16 bp, Homo sapiens
attcgcctttgtcttg

SEQ ID NO: 1254795 - DNA, 21 bp, Homo sapiens
attcgctactatgatttaatt

SEQ ID NO: 1254796 - DNA, 16 bp, Homo sapiens
attcgctgtacccttt

SEQ ID NO: 1254797 - DNA, 21 bp, Homo sapiens
attcgctgtaccctttaagat

SEQ ID NO: 1254798 - DNA, 13 bp, Homo sapiens
attcgctttctaa

SEQ ID NO: 1254799 - DNA, 21 bp, Homo sapiens
attcggcatttaacttacatt

SEQ ID NO: 1254800 - DNA, 16 bp, Homo sapiens
attcgggggctgacct

SEQ ID NO: 1254801 - DNA, 19 bp, Homo sapiens
attcggtgtgaacttttct

SEQ ID NO: 1254802 - DNA, 22 bp, Homo sapiens
attcggtgtgctgccaacttga

SEQ ID NO: 1254803 - DNA, 23 bp, Homo sapiens
attcggtgtggtgcagtgtgaaa

SEQ ID NO: 1254804 - DNA, 23 bp, Homo sapiens
attcgtatgatcagtactgactt

SEQ ID NO: 1254805 - DNA, 19 bp, Homo sapiens
attcgttgtgttttttaag

SEQ ID NO: 1254806 - DNA, 14 bp, Homo sapiens
attctaaaaccatt

SEQ ID NO: 1254807 - DNA, 14 bp, Homo sapiens
attctaaaatgatt

SEQ ID NO: 1254808 - DNA, 16 bp, Homo sapiens
attctaaaatgattgt

SEQ ID NO: 1254809 - DNA, 14 bp, Homo sapiens
attctaaaatgcct

SEQ ID NO: 1254810 - DNA, 15 bp, Homo sapiens
attctaaaatgcctt

SEQ ID NO: 1254811 - DNA, 15 bp, Homo sapiens
attctaaatgaatgt

SEQ ID NO: 1254812 - DNA, 24 bp, Homo sapiens
attctaagaaatatctgtgaaata

SEQ ID NO: 1254813 - DNA, 18 bp, Homo sapiens
attctaagccagttttca

SEQ ID NO: 1254814 - DNA, 23 bp, Homo sapiens
attctaagccagttttcattttg

SEQ ID NO: 1254815 - DNA, 19 bp, Homo sapiens
attctaagccctttgccat

SEQ ID NO: 1254816 - DNA, 18 bp, Homo sapiens
attctaagttagactctt

SEQ ID NO: 1254817 - DNA, 17 bp, Homo sapiens
attctaagttatttact

SEQ ID NO: 1254818 - DNA, 19 bp, Homo sapiens
attctaagttatttacttt

SEQ ID NO: 1254819 - DNA, 18 bp, Homo sapiens
attctaataaatatacta

SEQ ID NO: 1254820 - DNA, 19 bp, Homo sapiens
attctaataactgcttact

SEQ ID NO: 1254821 - DNA, 13 bp, Homo sapiens
attctaatgtctt

SEQ ID NO: 1254822 - DNA, 14 bp, Homo sapiens
attctaatgtcttc

SEQ ID NO: 1254823 - DNA, 16 bp, Homo sapiens
attctaatgtcttcat

SEQ ID NO: 1254824 - DNA, 19 bp, Homo sapiens
attctacacatgtaaaata

SEQ ID NO: 1254825 - DNA, 14 bp, Homo sapiens
attctacagaataa

SEQ ID NO: 1254826 - DNA, 16 bp, Homo sapiens
attctaccaaattttt

SEQ ID NO: 1254827 - DNA, 18 bp, Homo sapiens
attctacctccttgtgtt

SEQ ID NO: 1254828 - DNA, 17 bp, Homo sapiens
attctactaatgtgatg

SEQ ID NO: 1254829 - DNA, 13 bp, Homo sapiens
attctactggaaa

SEQ ID NO: 1254830 - DNA, 20 bp, Homo sapiens
attctagatgcaagtctctt

SEQ ID NO: 1254831 - DNA, 19 bp, Homo sapiens
attctagctgtatgatttg

SEQ ID NO: 1254832 - DNA, 22 bp, Homo sapiens
attctagctgtatgatttgttt

SEQ ID NO: 1254833 - DNA, 16 bp, Homo sapiens
attctaggatgtggag

SEQ ID NO: 1254834 - DNA, 16 bp, Homo sapiens
attctaggcatcccag

SEQ ID NO: 1254835 - DNA, 21 bp, Homo sapiens
attctaggtggaggttgtgca

SEQ ID NO: 1254836 - DNA, 15 bp, Homo sapiens
attctagtacataat

SEQ ID NO: 1254837 - DNA, 22 bp, Homo sapiens
attctagtacataattgattaa

SEQ ID NO: 1254838 - DNA, 15 bp, Homo sapiens
attctagtgctgctg

SEQ ID NO: 1254839 - DNA, 19 bp, Homo sapiens
attctagtggctgttcatg

SEQ ID NO: 1254840 - DNA, 21 bp, Homo sapiens
attctagttaaggaaatgttg

SEQ ID NO: 1254841 - DNA, 16 bp, Homo sapiens
attctagttttgtcaa

SEQ ID NO: 1254842 - DNA, 15 bp, Homo sapiens
attctataaggccat

SEQ ID NO: 1254843 - DNA, 12 bp, Homo sapiens
attctataattt

SEQ ID NO: 1254844 - DNA, 15 bp, Homo sapiens
attctatatgaattt

SEQ ID NO: 1254845 - DNA, 16 bp, Homo sapiens
attctatatgaattta

SEQ ID NO: 1254846 - DNA, 16 bp, Homo sapiens
attctatctctcttta

SEQ ID NO: 1254847 - DNA, 20 bp, Homo sapiens
attctatcttttgtttcctt

SEQ ID NO: 1254848 - DNA, 14 bp, Homo sapiens
attctattaacttt

SEQ ID NO: 1254849 - DNA, 13 bp, Homo sapiens
attctattatata

SEQ ID NO: 1254850 - DNA, 23 bp, Homo sapiens
attctattgtattatttggagtt

SEQ ID NO: 1254851 - DNA, 13 bp, Homo sapiens
attctatttctct

SEQ ID NO: 1254852 - DNA, 16 bp, Homo sapiens
attctatttctctatg

SEQ ID NO: 1254853 - DNA, 15 bp, Homo sapiens
attctatttgctggg

SEQ ID NO: 1254854 - DNA, 16 bp, Homo sapiens
attctattttagaata

SEQ ID NO: 1254855 - DNA, 14 bp, Homo sapiens
attctcaaagcagg

SEQ ID NO: 1254856 - DNA, 21 bp, Homo sapiens
attctcaacctaccacccctt

SEQ ID NO: 1254857 - DNA, 15 bp, Homo sapiens
attctcaagacctga

SEQ ID NO: 1254858 - DNA, 18 bp, Homo sapiens
attctcaagacctgagta

SEQ ID NO: 1254859 - DNA, 13 bp, Homo sapiens
attctcacaatag

SEQ ID NO: 1254860 - DNA, 14 bp, Homo sapiens
attctcaccaggaa

SEQ ID NO: 1254861 - DNA, 17 bp, Homo sapiens
attctcaccattcctgt

SEQ ID NO: 1254862 - DNA, 16 bp, Homo sapiens
attctcactccaccac

SEQ ID NO: 1254863 - DNA, 17 bp, Homo sapiens
attctcactccaccacc

SEQ ID NO: 1254864 - DNA, 14 bp, Homo sapiens
attctcagaatctc

SEQ ID NO: 1254865 - DNA, 23 bp, Homo sapiens
attctcagatatttatattttta

SEQ ID NO: 1254866 - DNA, 12 bp, Homo sapiens
attctcagggct

SEQ ID NO: 1254867 - DNA, 13 bp, Homo sapiens
attctcagggctg

SEQ ID NO: 1254868 - DNA, 18 bp, Homo sapiens
attctcagggctggagcc

SEQ ID NO: 1254869 - DNA, 21 bp, Homo sapiens
attctcaggtaatcattttaa

SEQ ID NO: 1254870 - DNA, 22 bp, Homo sapiens
attctcaggtaggaagcaacag

SEQ ID NO: 1254871 - DNA, 18 bp, Homo sapiens
attctcattaaaagaata

SEQ ID NO: 1254872 - DNA, 22 bp, Homo sapiens
attctccctaaggaatctgaaa

SEQ ID NO: 1254873 - DNA, 13 bp, Homo sapiens
attctcctgcctc

SEQ ID NO: 1254874 - DNA, 22 bp, Homo sapiens
attctcctgcctgtagcagtga

SEQ ID NO: 1254875 - DNA, 13 bp, Homo sapiens
attctcctgtgct

SEQ ID NO: 1254876 - DNA, 14 bp, Homo sapiens
attctcctgtgcta

SEQ ID NO: 1254877 - DNA, 22 bp, Homo sapiens
attctccttgtgttactaagtt

SEQ ID NO: 1254878 - DNA, 14 bp, Homo sapiens
attctctactgcca

SEQ ID NO: 1254879 - DNA, 12 bp, Homo sapiens
attctctattgg

SEQ ID NO: 1254880 - DNA, 17 bp, Homo sapiens
attctctatttgaatta

SEQ ID NO: 1254881 - DNA, 17 bp, Homo sapiens
attctctcccatcctgg

SEQ ID NO: 1254882 - DNA, 19 bp, Homo sapiens
attctctcctgtacctctt

SEQ ID NO: 1254883 - DNA, 15 bp, Homo sapiens
attctctctcctgtc

SEQ ID NO: 1254884 - DNA, 16 bp, Homo sapiens
attctctctcctgtcc

SEQ ID NO: 1254885 - DNA, 11 bp, Homo sapiens
attctctgccc

SEQ ID NO: 1254886 - DNA, 16 bp, Homo sapiens
attctctgcccgggcc

SEQ ID NO: 1254887 - DNA, 12 bp, Homo sapiens
attctctgtctc

SEQ ID NO: 1254888 - DNA, 16 bp, Homo sapiens
attctctgtctcatcc

SEQ ID NO: 1254889 - DNA, 17 bp, Homo sapiens
attctctgtctcatcca

SEQ ID NO: 1254890 - DNA, 18 bp, Homo sapiens
attctctgtctcatccat

SEQ ID NO: 1254891 - DNA, 17 bp, Homo sapiens
attctctttaaaaaaga

SEQ ID NO: 1254892 - DNA, 15 bp, Homo sapiens
attctctttaactgt

SEQ ID NO: 1254893 - DNA, 20 bp, Homo sapiens
attctctttaccttctaaaa

SEQ ID NO: 1254894 - DNA, 14 bp, Homo sapiens
attctctttcaaag

SEQ ID NO: 1254895 - DNA, 18 bp, Homo sapiens
attctctttggtcattga

SEQ ID NO: 1254896 - DNA, 17 bp, Homo sapiens
attctgaaacaggccct

SEQ ID NO: 1254897 - DNA, 16 bp, Homo sapiens
attctgaaatactttt

SEQ ID NO: 1254898 - DNA, 22 bp, Homo sapiens
attctgaaatttttttcctaag

SEQ ID NO: 1254899 - DNA, 16 bp, Homo sapiens
attctgaaggagcccc

SEQ ID NO: 1254900 - DNA, 22 bp, Homo sapiens
attctgaatcaagcacactgta

SEQ ID NO: 1254901 - DNA, 14 bp, Homo sapiens
attctgaatctcaa

SEQ ID NO: 1254902 - DNA, 15 bp, Homo sapiens
attctgaatgcttct

SEQ ID NO: 1254903 - DNA, 16 bp, Homo sapiens
attctgaatgcttcta

SEQ ID NO: 1254904 - DNA, 17 bp, Homo sapiens
attctgaatgcttctaa

SEQ ID NO: 1254905 - DNA, 17 bp, Homo sapiens
attctgacataaaattc

SEQ ID NO: 1254906 - DNA, 14 bp, Homo sapiens
attctgacatgtaa

SEQ ID NO: 1254907 - DNA, 15 bp, Homo sapiens
attctgacatttata

SEQ ID NO: 1254908 - DNA, 16 bp, Homo sapiens
attctgacatttatat

SEQ ID NO: 1254909 - DNA, 20 bp, Homo sapiens
attctgaccacccttctcat

SEQ ID NO: 1254910 - DNA, 16 bp, Homo sapiens
attctgacccagggcc

SEQ ID NO: 1254911 - DNA, 20 bp, Homo sapiens
attctgactcggtttctcca

SEQ ID NO: 1254912 - DNA, 20 bp, Homo sapiens
attctgactgtccaggagct

SEQ ID NO: 1254913 - DNA, 14 bp, Homo sapiens
attctgagaccaaa

SEQ ID NO: 1254914 - DNA, 17 bp, Homo sapiens
attctgaggccctgccc

SEQ ID NO: 1254915 - DNA, 17 bp, Homo sapiens
attctgagttttgtgtt

SEQ ID NO: 1254916 - DNA, 13 bp, Homo sapiens
attctgattccct

SEQ ID NO: 1254917 - DNA, 15 bp, Homo sapiens
attgcttctgtagta

SEQ ID NO: 1254918 - DNA, 17 bp, Homo sapiens
attgcttcttctcctat

SEQ ID NO: 1254919 - DNA, 23 bp, Homo sapiens
attgcttcttctcctatgtgtaa

SEQ ID NO: 1254920 - DNA, 14 bp, Homo sapiens
attgcttgagctca

SEQ ID NO: 1254921 - DNA, 18 bp, Homo sapiens
attgcttgagctcaggag

SEQ ID NO: 1254922 - DNA, 16 bp, Homo sapiens
attgcttgttggattt

SEQ ID NO: 1254923 - DNA, 18 bp, Homo sapiens
attgctttcgtgtaaatt

SEQ ID NO: 1254924 - DNA, 21 bp, Homo sapiens
attgctttgaagcagttgtgt

SEQ ID NO: 1254925 - DNA, 12 bp, Homo sapiens
attgctttgagc

SEQ ID NO: 1254926 - DNA, 22 bp, Homo sapiens
attgctttgtggttatcacttt

SEQ ID NO: 1254927 - DNA, 15 bp, Homo sapiens
attgctttttctaat

SEQ ID NO: 1254928 - DNA, 21 bp, Homo sapiens
attgcttttttccaaaacaaa

SEQ ID NO: 1254929 - DNA, 12 bp, Homo sapiens
attggaaatgta

SEQ ID NO: 1254930 - DNA, 19 bp, Homo sapiens
attggaagaaattcctgta

SEQ ID NO: 1254931 - DNA, 16 bp, Homo sapiens
attggaagaccccacc

SEQ ID NO: 1254932 - DNA, 19 bp, Homo sapiens
attggaagctgctgaggcc

SEQ ID NO: 1254933 - DNA, 17 bp, Homo sapiens
attggaatcttcacctc

SEQ ID NO: 1254934 - DNA, 22 bp, Homo sapiens
attggaatcttcacctcagagt

SEQ ID NO: 1254935 - DNA, 12 bp, Homo sapiens
attggaattaac

SEQ ID NO: 1254936 - DNA, 16 bp, Homo sapiens
attggaattaacctgg

SEQ ID NO: 1254937 - DNA, 20 bp, Homo sapiens
attggaattaacctggtgct

SEQ ID NO: 1254938 - DNA, 14 bp, Homo sapiens
attggaattctttc

SEQ ID NO: 1254939 - DNA, 19 bp, Homo sapiens
attggacagatttcagtaa

SEQ ID NO: 1254940 - DNA, 13 bp, Homo sapiens
attggaccaggcc

SEQ ID NO: 1254941 - DNA, 14 bp, Homo sapiens
attggacccttcca

SEQ ID NO: 1254942 - DNA, 15 bp, Homo sapiens
attggagaatacttt

SEQ ID NO: 1254943 - DNA, 21 bp, Homo sapiens
attggagaatactttgcttca

SEQ ID NO: 1254944 - DNA, 18 bp, Homo sapiens
attggagagtaaaaactg

SEQ ID NO: 1254945 - DNA, 22 bp, Homo sapiens
attggagggtgggagagcccag

SEQ ID NO: 1254946 - DNA, 23 bp, Homo sapiens
attggaggtgagatcacagcctc

SEQ ID NO: 1254947 - DNA, 20 bp, Homo sapiens
attggatcttttactttaaa

SEQ ID NO: 1254948 - DNA, 16 bp, Homo sapiens
attggatgaaaagaga

SEQ ID NO: 1254949 - DNA, 15 bp, Homo sapiens
attggatttcctaat

SEQ ID NO: 1254950 - DNA, 19 bp, Homo sapiens
attggatttgctgtgacta

SEQ ID NO: 1254951 - DNA, 19 bp, Homo sapiens
attggcaagtaacttctga

SEQ ID NO: 1254952 - DNA, 20 bp, Homo sapiens
attggcaatgggccgtcccc

SEQ ID NO: 1254953 - DNA, 20 bp, Homo sapiens
attggcagccaaggaatgtg

SEQ ID NO: 1254954 - DNA, 17 bp, Homo sapiens
attggcaggataagaaa

SEQ ID NO: 1254955 - DNA, 14 bp, Homo sapiens
attggcatggcttt

SEQ ID NO: 1254956 - DNA, 20 bp, Homo sapiens
attggccactgggtctcact

SEQ ID NO: 1254957 - DNA, 15 bp, Homo sapiens
attggccgagctcct

SEQ ID NO: 1254958 - DNA, 15 bp, Homo sapiens
attggcctctgtgta

SEQ ID NO: 1254959 - DNA, 11 bp, Homo sapiens
attggcctgga

SEQ ID NO: 1254960 - DNA, 15 bp, Homo sapiens
attggctataacatg

SEQ ID NO: 1254961 - DNA, 19 bp, Homo sapiens
attggcttaaagtgaagga

SEQ ID NO: 1254962 - DNA, 20 bp, Homo sapiens
attggcttaaagtgaaggaa

SEQ ID NO: 1254963 - DNA, 20 bp, Homo sapiens
attgggaaggggacccccgc

SEQ ID NO: 1254964 - DNA, 20 bp, Homo sapiens
attgggacagcatgactgtg

SEQ ID NO: 1254965 - DNA, 18 bp, Homo sapiens
attgggagacaattagca

SEQ ID NO: 1254966 - DNA, 18 bp, Homo sapiens
attgggagcttgggaatg

SEQ ID NO: 1254967 - DNA, 15 bp, Homo sapiens
attgggatctgtctt

SEQ ID NO: 1254968 - DNA, 17 bp, Homo sapiens
attgggcaagtgattga

SEQ ID NO: 1254969 - DNA, 22 bp, Homo sapiens
attgggcattagtgtcccccct

SEQ ID NO: 1254970 - DNA, 23 bp, Homo sapiens
attgggcattagtgtcccccctt

SEQ ID NO: 1254971 - DNA, 12 bp, Homo sapiens
attggggaggag

SEQ ID NO: 1254972 - DNA, 20 bp, Homo sapiens
attggggggaaagagggagc

SEQ ID NO: 1254973 - DNA, 22 bp, Homo sapiens
attggggggaaagagggagcaa

SEQ ID NO: 1254974 - DNA, 13 bp, Homo sapiens
attggggtagttg

SEQ ID NO: 1254975 - DNA, 15 bp, Homo sapiens
attggggtccctcta

SEQ ID NO: 1254976 - DNA, 13 bp, Homo sapiens
attggggtgacct

SEQ ID NO: 1254977 - DNA, 14 bp, Homo sapiens
attggggtgacctt

SEQ ID NO: 1254978 - DNA, 19 bp, Homo sapiens
attggggtgataaggggcc

SEQ ID NO: 1254979 - DNA, 22 bp, Homo sapiens
attgggtggaggaccgttctct

SEQ ID NO: 1254980 - DNA, 20 bp, Homo sapiens
attgggtgggattttttccc

SEQ ID NO: 1254981 - DNA, 22 bp, Homo sapiens
attgggtttggggccatggtgg

SEQ ID NO: 1254982 - DNA, 13 bp, Homo sapiens
attgggtttttat

SEQ ID NO: 1254983 - DNA, 23 bp, Homo sapiens
attggtaaattctggtatacatt

SEQ ID NO: 1254984 - DNA, 16 bp, Homo sapiens
attggtaattaaaaga

SEQ ID NO: 1254985 - DNA, 18 bp, Homo sapiens
attggtaattaaaagact

SEQ ID NO: 1254986 - DNA, 18 bp, Homo sapiens
attggtattcactaatct

SEQ ID NO: 1254987 - DNA, 14 bp, Homo sapiens
attggtccagcttg

SEQ ID NO: 1254988 - DNA, 21 bp, Homo sapiens
attggtcttaatgttgaatgt

SEQ ID NO: 1254989 - DNA, 21 bp, Homo sapiens
attggtgctatttgaagaaaa

SEQ ID NO: 1254990 - DNA, 18 bp, Homo sapiens
attggtgcttgactctca

SEQ ID NO: 1254991 - DNA, 23 bp, Homo sapiens
attggtgggtggtgtatttgaga

SEQ ID NO: 1254992 - DNA, 18 bp, Homo sapiens
attggtgtatatcatgaa

SEQ ID NO: 1254993 - DNA, 14 bp, Homo sapiens
attggtgtatatta

SEQ ID NO: 1254994 - DNA, 15 bp, Homo sapiens
attggttaaaatgtg

SEQ ID NO: 1254995 - DNA, 15 bp, Homo sapiens
attggttactggtga

SEQ ID NO: 1254996 - DNA, 14 bp, Homo sapiens
attggttagtattt

SEQ ID NO: 1254997 - DNA, 18 bp, Homo sapiens
attggtttaaagaaagtg

SEQ ID NO: 1254998 - DNA, 15 bp, Homo sapiens
attgtaaaacattca

SEQ ID NO: 1254999 - DNA, 19 bp, Homo sapiens
attgtaaaagcattttgta

SEQ ID NO: 1255000 - DNA, 21 bp, Homo sapiens
attgtaaaagcattttgtaat

SEQ ID NO: 1255001 - DNA, 23 bp, Homo sapiens
attgtaaaagcattttgtaataa

SEQ ID NO: 1255002 - DNA, 13 bp, Homo sapiens
attgtaaaataat

SEQ ID NO: 1255003 - DNA, 21 bp, Homo sapiens
attgtaaaatagcttgtatag

SEQ ID NO: 1255004 - DNA, 20 bp, Homo sapiens
attgtaaaattatttcatga

SEQ ID NO: 1255005 - DNA, 19 bp, Homo sapiens
attgtaaactttttcaatg

SEQ ID NO: 1255006 - DNA, 13 bp, Homo sapiens
attgtaaagaagg

SEQ ID NO: 1255007 - DNA, 10 bp, Homo sapiens
attgtaaata

SEQ ID NO: 1255008 - DNA, 18 bp, Homo sapiens
attgtaaatactggactc

SEQ ID NO: 1255009 - DNA, 21 bp, Homo sapiens
attgtaaatactggactcagg

SEQ ID NO: 1255010 - DNA, 22 bp, Homo sapiens
attgtaaatactggactcagga

SEQ ID NO: 1255011 - DNA, 16 bp, Homo sapiens
attgtaaatatgtttt

SEQ ID NO: 1255012 - DNA, 14 bp, Homo sapiens
attgtaaatattgt

SEQ ID NO: 1255013 - DNA, 15 bp, Homo sapiens
attgtaaatctgaag

SEQ ID NO: 1255014 - DNA, 20 bp, Homo sapiens
attgtaaatctgaagaaagt

SEQ ID NO: 1255015 - DNA, 15 bp, Homo sapiens
attgtaaatgtggat

SEQ ID NO: 1255016 - DNA, 21 bp, Homo sapiens
attgtaaattatatttgtgct

SEQ ID NO: 1255017 - DNA, 15 bp, Homo sapiens
attgtaactattaac

SEQ ID NO: 1255018 - DNA, 15 bp, Homo sapiens
attgtaactgttctt

SEQ ID NO: 1255019 - DNA, 14 bp, Homo sapiens
attgtaagaaatac

SEQ ID NO: 1255020 - DNA, 20 bp, Homo sapiens
attgtaagaaatactgtaca

SEQ ID NO: 1255021 - DNA, 21 bp, Homo sapiens
attgtaagaaatactgtacaa

SEQ ID NO: 1255022 - DNA, 17 bp, Homo sapiens
attgtaaggtctttgta

SEQ ID NO: 1255023 - DNA, 18 bp, Homo sapiens
attgtaaggtctttgtaa

SEQ ID NO: 1255024 - DNA, 23 bp, Homo sapiens
attgtaagtgaaattaagcattt

SEQ ID NO: 1255025 - DNA, 22 bp, Homo sapiens
attgtaatatagaaaaaaacat

SEQ ID NO: 1255026 - DNA, 18 bp, Homo sapiens
attgtaatcgtgtgccat

SEQ ID NO: 1255027 - DNA, 19 bp, Homo sapiens
attgtaatcgtgtgccatg

SEQ ID NO: 1255028 - DNA, 16 bp, Homo sapiens
attgtaatctgaataa

SEQ ID NO: 1255029 - DNA, 15 bp, Homo sapiens
attgtaatctttcat

SEQ ID NO: 1255030 - DNA, 13 bp, Homo sapiens
attgtaatgttac

SEQ ID NO: 1255031 - DNA, 17 bp, Homo sapiens
attgtaatgttactgat

SEQ ID NO: 1255032 - DNA, 13 bp, Homo sapiens
attgtaattccaa

SEQ ID NO: 1255033 - DNA, 21 bp, Homo sapiens
attgtacagaatcattgctta

SEQ ID NO: 1255034 - DNA, 16 bp, Homo sapiens
attgtacagctgttta

SEQ ID NO: 1255035 - DNA, 17 bp, Homo sapiens
attgtacagctgtttaa

SEQ ID NO: 1255036 - DNA, 20 bp, Homo sapiens
attgtacagctgtttaagat

SEQ ID NO: 1255037 - DNA, 14 bp, Homo sapiens
attgtacctatttc

SEQ ID NO: 1255038 - DNA, 17 bp, Homo sapiens
attgtactaatctgaga

SEQ ID NO: 1255039 - DNA, 13 bp, Homo sapiens
atttaagacacat

SEQ ID NO: 1255040 - DNA, 13 bp, Homo sapiens
atttaagactgat

SEQ ID NO: 1255041 - DNA, 23 bp, Homo sapiens
atttaagagaagacctagctatg

SEQ ID NO: 1255042 - DNA, 16 bp, Homo sapiens
atttaagagactcttt

SEQ ID NO: 1255043 - DNA, 15 bp, Homo sapiens
atttaagataattat

SEQ ID NO: 1255044 - DNA, 16 bp, Homo sapiens
atttaagatgtacatt

SEQ ID NO: 1255045 - DNA, 18 bp, Homo sapiens
atttaagatgtacattta

SEQ ID NO: 1255046 - DNA, 16 bp, Homo sapiens
atttaagcaacatctt

SEQ ID NO: 1255047 - DNA, 12 bp, Homo sapiens
atttaagcattg

SEQ ID NO: 1255048 - DNA, 14 bp, Homo sapiens
atttaagcattgtt

SEQ ID NO: 1255049 - DNA, 19 bp, Homo sapiens
atttaagcctcatatttaa

SEQ ID NO: 1255050 - DNA, 20 bp, Homo sapiens
atttaaggaatcaaatctta

SEQ ID NO: 1255051 - DNA, 22 bp, Homo sapiens
atttaaggaatcaaatcttaca

SEQ ID NO: 1255052 - DNA, 17 bp, Homo sapiens
atttaagggaaagaaaa

SEQ ID NO: 1255053 - DNA, 18 bp, Homo sapiens
atttaagtagaaaagttg

SEQ ID NO: 1255054 - DNA, 22 bp, Homo sapiens
atttaagtagaaaagttgcaga

SEQ ID NO: 1255055 - DNA, 14 bp, Homo sapiens
atttaagtatatag

SEQ ID NO: 1255056 - DNA, 13 bp, Homo sapiens
atttaagtatctt

SEQ ID NO: 1255057 - DNA, 15 bp, Homo sapiens
atttaagtatcttgt

SEQ ID NO: 1255058 - DNA, 12 bp, Homo sapiens
atttaagtatgg

SEQ ID NO: 1255059 - DNA, 14 bp, Homo sapiens
atttaagtatggaa

SEQ ID NO: 1255060 - DNA, 16 bp, Homo sapiens
atttaagtgtatttaa

SEQ ID NO: 1255061 - DNA, 15 bp, Homo sapiens
atttaataaaactgc

SEQ ID NO: 1255062 - DNA, 13 bp, Homo sapiens
atttaataaagat

SEQ ID NO: 1255063 - DNA, 16 bp, Homo sapiens
atttaataaagatgag

SEQ ID NO: 1255064 - DNA, 17 bp, Homo sapiens
atttaataaagatgagt

SEQ ID NO: 1255065 - DNA, 13 bp, Homo sapiens
atttaatacagca

SEQ ID NO: 1255066 - DNA, 15 bp, Homo sapiens
atttaatacagcagt

SEQ ID NO: 1255067 - DNA, 20 bp, Homo sapiens
atttaatagcaaagaattga

SEQ ID NO: 1255068 - DNA, 15 bp, Homo sapiens
atttaatatcttcag

SEQ ID NO: 1255069 - DNA, 16 bp, Homo sapiens
atttaatatgcaaagt

SEQ ID NO: 1255070 - DNA, 19 bp, Homo sapiens
atttaatcttttcttattt

SEQ ID NO: 1255071 - DNA, 18 bp, Homo sapiens
atttaatgcattaaacct

SEQ ID NO: 1255072 - DNA, 13 bp, Homo sapiens
atttaatgctgcc

SEQ ID NO: 1255073 - DNA, 22 bp, Homo sapiens
atttaatggaagtgtatttatt

SEQ ID NO: 1255074 - DNA, 23 bp, Homo sapiens
atttaatggaagtgtatttattt

SEQ ID NO: 1255075 - DNA, 15 bp, Homo sapiens
atttaatggactgtg

SEQ ID NO: 1255076 - DNA, 16 bp, Homo sapiens
atttaatggactgtga

SEQ ID NO: 1255077 - DNA, 15 bp, Homo sapiens
atttaatggcagcta

SEQ ID NO: 1255078 - DNA, 21 bp, Homo sapiens
atttaatggcagctagtgcct

SEQ ID NO: 1255079 - DNA, 21 bp, Homo sapiens
atttaatggccggctggaaat

SEQ ID NO: 1255080 - DNA, 19 bp, Homo sapiens
atttaatgtattaatctgt

SEQ ID NO: 1255081 - DNA, 12 bp, Homo sapiens
atttaatgtttg

SEQ ID NO: 1255082 - DNA, 15 bp, Homo sapiens
atttaatgtttgatt

SEQ ID NO: 1255083 - DNA, 17 bp, Homo sapiens
atttaatgttttaaatg

SEQ ID NO: 1255084 - DNA, 18 bp, Homo sapiens
atttaatgttttaaatgt

SEQ ID NO: 1255085 - DNA, 21 bp, Homo sapiens
atttaatgttttaaatgtaca

SEQ ID NO: 1255086 - DNA, 23 bp, Homo sapiens
atttaatgttttaaatgtacaga

SEQ ID NO: 1255087 - DNA, 18 bp, Homo sapiens
atttaattaaagcacact

SEQ ID NO: 1255088 - DNA, 16 bp, Homo sapiens
atttaattatgaaaac

SEQ ID NO: 1255089 - DNA, 16 bp, Homo sapiens
atttaattcacctcag

SEQ ID NO: 1255090 - DNA, 23 bp, Homo sapiens
atttaattcctctttttagggct

SEQ ID NO: 1255091 - DNA, 22 bp, Homo sapiens
atttaattcttcacctttgtaa

SEQ ID NO: 1255092 - DNA, 19 bp, Homo sapiens
atttaattgggcactattt

SEQ ID NO: 1255093 - DNA, 19 bp, Homo sapiens
atttaatttcttcatgtga

SEQ ID NO: 1255094 - DNA, 22 bp, Homo sapiens
atttaattttgacactgaaata

SEQ ID NO: 1255095 - DNA, 15 bp, Homo sapiens
atttacaaagtgtgt

SEQ ID NO: 1255096 - DNA, 16 bp, Homo sapiens
atttacaaagtgtgta

SEQ ID NO: 1255097 - DNA, 20 bp, Homo sapiens
atttacaaagtgtgtattaa

SEQ ID NO: 1255098 - DNA, 15 bp, Homo sapiens
atttacaatgtatta

SEQ ID NO: 1255099 - DNA, 15 bp, Homo sapiens
atttacactggtcta

SEQ ID NO: 1255100 - DNA, 19 bp, Homo sapiens
atttacactggtctaatgt

SEQ ID NO: 1255101 - DNA, 22 bp, Homo sapiens
atttacagacacacccagtgcg

SEQ ID NO: 1255102 - DNA, 18 bp, Homo sapiens
atttacagtctctttctt

SEQ ID NO: 1255103 - DNA, 20 bp, Homo sapiens
atttacagtctctttcttcc

SEQ ID NO: 1255104 - DNA, 20 bp, Homo sapiens
atttacatagtgcaaaactg

SEQ ID NO: 1255105 - DNA, 19 bp, Homo sapiens
atttacatgttttaaagaa

SEQ ID NO: 1255106 - DNA, 13 bp, Homo sapiens
atttacattttat

SEQ ID NO: 1255107 - DNA, 14 bp, Homo sapiens
atttacattttata

SEQ ID NO: 1255108 - DNA, 15 bp, Homo sapiens
atttaccaaattgct

SEQ ID NO: 1255109 - DNA, 18 bp, Homo sapiens
atttaccaaggatgaatt

SEQ ID NO: 1255110 - DNA, 22 bp, Homo sapiens
atttaccaaggatgaattcttt

SEQ ID NO: 1255111 - DNA, 15 bp, Homo sapiens
atttaccacagcagc

SEQ ID NO: 1255112 - DNA, 21 bp, Homo sapiens
atttaccgttgcttgaaatta

SEQ ID NO: 1255113 - DNA, 14 bp, Homo sapiens
atttacctaagatt

SEQ ID NO: 1255114 - DNA, 17 bp, Homo sapiens
atttacctaagattaca

SEQ ID NO: 1255115 - DNA, 21 bp, Homo sapiens
atttacgaaaccaaaaagttg

SEQ ID NO: 1255116 - DNA, 19 bp, Homo sapiens
atttacgctttgattcata

SEQ ID NO: 1255117 - DNA, 21 bp, Homo sapiens
atttactaagccacaagaaat

SEQ ID NO: 1255118 - DNA, 15 bp, Homo sapiens
atttactcctcctgc

SEQ ID NO: 1255119 - DNA, 13 bp, Homo sapiens
atttactcttctt

SEQ ID NO: 1255120 - DNA, 15 bp, Homo sapiens
atttactctttgcaa

SEQ ID NO: 1255121 - DNA, 13 bp, Homo sapiens
atttactgagctt

SEQ ID NO: 1255122 - DNA, 17 bp, Homo sapiens
atttactgctctttatt

SEQ ID NO: 1255123 - DNA, 22 bp, Homo sapiens
atttactgctctttattgcaga

SEQ ID NO: 1255124 - DNA, 19 bp, Homo sapiens
atttacttaagacttaatg

SEQ ID NO: 1255125 - DNA, 23 bp, Homo sapiens
atttactttattaacttacggat

SEQ ID NO: 1255126 - DNA, 14 bp, Homo sapiens
atttactttcttca

SEQ ID NO: 1255127 - DNA, 16 bp, Homo sapiens
atttactttgtagact

SEQ ID NO: 1255128 - DNA, 12 bp, Homo sapiens
atttacttttaa

SEQ ID NO: 1255129 - DNA, 17 bp, Homo sapiens
atttagaaaaaaacatg

SEQ ID NO: 1255130 - DNA, 15 bp, Homo sapiens
atttagaaatataat

SEQ ID NO: 1255131 - DNA, 14 bp, Homo sapiens
atttagaactgtat

SEQ ID NO: 1255132 - DNA, 15 bp, Homo sapiens
atttagaagaaagat

SEQ ID NO: 1255133 - DNA, 22 bp, Homo sapiens
atttagaagcaaagatttcagt

SEQ ID NO: 1255134 - DNA, 22 bp, Homo sapiens
atttagaagccaactatgatta

SEQ ID NO: 1255135 - DNA, 20 bp, Homo sapiens
atttagacaagagatgggaa

SEQ ID NO: 1255136 - DNA, 16 bp, Homo sapiens
atttagagatgctgta

SEQ ID NO: 1255137 - DNA, 19 bp, Homo sapiens
atttagagcgtttggttaa

SEQ ID NO: 1255138 - DNA, 20 bp, Homo sapiens
atttagagcgtttggttaaa

SEQ ID NO: 1255139 - DNA, 22 bp, Homo sapiens
atttagagcgtttggttaaagt

SEQ ID NO: 1255140 - DNA, 18 bp, Homo sapiens
atttagaggatgtggctg

SEQ ID NO: 1255141 - DNA, 20 bp, Homo sapiens
atttagagtcaatttgctga

SEQ ID NO: 1255142 - DNA, 14 bp, Homo sapiens
atttagagttctag

SEQ ID NO: 1255143 - DNA, 13 bp, Homo sapiens
atttagatatgca

SEQ ID NO: 1255144 - DNA, 17 bp, Homo sapiens
atttagatgataaagag

SEQ ID NO: 1255145 - DNA, 18 bp, Homo sapiens
atttagattgttaaaata

SEQ ID NO: 1255146 - DNA, 13 bp, Homo sapiens
atttagcaaataa

SEQ ID NO: 1255147 - DNA, 15 bp, Homo sapiens
atttagcatgttgtt

SEQ ID NO: 1255148 - DNA, 13 bp, Homo sapiens
atttagccctcac

SEQ ID NO: 1255149 - DNA, 16 bp, Homo sapiens
atttagccgggcgcgg

SEQ ID NO: 1255150 - DNA, 21 bp, Homo sapiens
atttagcgcacccagagaaaa

SEQ ID NO: 1255151 - DNA, 22 bp, Homo sapiens
atttagcgcacccagagaaaat

SEQ ID NO: 1255152 - DNA, 22 bp, Homo sapiens
atttagctaaacggattccaaa

SEQ ID NO: 1255153 - DNA, 23 bp, Homo sapiens
atttagctaaacggattccaaag

SEQ ID NO: 1255154 - DNA, 15 bp, Homo sapiens
atttagctgtatcaa

SEQ ID NO: 1255155 - DNA, 13 bp, Homo sapiens
atttaggaaacac

SEQ ID NO: 1255156 - DNA, 14 bp, Homo sapiens
atttaggaaacacc

SEQ ID NO: 1255157 - DNA, 23 bp, Homo sapiens
atttaggaagttgacttatagta

SEQ ID NO: 1255158 - DNA, 21 bp, Homo sapiens
atttaggagtgtgtgacattc

SEQ ID NO: 1255159 - DNA, 22 bp, Homo sapiens
atttaggcagattgaaaaggac

SEQ ID NO: 1255160 - DNA, 16 bp, Homo sapiens
atttagggaactgctt

SEQ ID NO: 1255161 - DNA, 19 bp, Homo sapiens
atttctaggtaggaaatgt

SEQ ID NO: 1255162 - DNA, 16 bp, Homo sapiens
atttctagtgtatact

SEQ ID NO: 1255163 - DNA, 18 bp, Homo sapiens
atttctagtgtatactct

SEQ ID NO: 1255164 - DNA, 20 bp, Homo sapiens
atttctagtgtatactctgt

SEQ ID NO: 1255165 - DNA, 14 bp, Homo sapiens
atttctataaattt

SEQ ID NO: 1255166 - DNA, 17 bp, Homo sapiens
atttctatagccaaaaa

SEQ ID NO: 1255167 - DNA, 14 bp, Homo sapiens
atttctatatttat

SEQ ID NO: 1255168 - DNA, 15 bp, Homo sapiens
atttctatatttatt

SEQ ID NO: 1255169 - DNA, 13 bp, Homo sapiens
atttctatgacaa

SEQ ID NO: 1255170 - DNA, 15 bp, Homo sapiens
atttctatgacaaat

SEQ ID NO: 1255171 - DNA, 17 bp, Homo sapiens
atttctatgacaaattc

SEQ ID NO: 1255172 - DNA, 17 bp, Homo sapiens
atttctatgagaaaaga

SEQ ID NO: 1255173 - DNA, 15 bp, Homo sapiens
atttctatgtaaatt

SEQ ID NO: 1255174 - DNA, 12 bp, Homo sapiens
atttctatgtca

SEQ ID NO: 1255175 - DNA, 12 bp, Homo sapiens
atttctatttat

SEQ ID NO: 1255176 - DNA, 19 bp, Homo sapiens
atttctcaacaaagcacag

SEQ ID NO: 1255177 - DNA, 14 bp, Homo sapiens
atttctcactgaga

SEQ ID NO: 1255178 - DNA, 20 bp, Homo sapiens
atttctcatacttagaaaca

SEQ ID NO: 1255179 - DNA, 22 bp, Homo sapiens
atttctcatgttccttttgaaa

SEQ ID NO: 1255180 - DNA, 17 bp, Homo sapiens
atttctcattgcctctt

SEQ ID NO: 1255181 - DNA, 22 bp, Homo sapiens
atttctcattgcctcttctact

SEQ ID NO: 1255182 - DNA, 18 bp, Homo sapiens
atttctccagacccagag

SEQ ID NO: 1255183 - DNA, 15 bp, Homo sapiens
atttctccatacgca

SEQ ID NO: 1255184 - DNA, 20 bp, Homo sapiens
atttctccatcccctccctg

SEQ ID NO: 1255185 - DNA, 23 bp, Homo sapiens
atttctccatcccctccctgcct

SEQ ID NO: 1255186 - DNA, 16 bp, Homo sapiens
atttctccatctttat

SEQ ID NO: 1255187 - DNA, 11 bp, Homo sapiens
atttctcccag

SEQ ID NO: 1255188 - DNA, 20 bp, Homo sapiens
atttctcctccatgggagaa

SEQ ID NO: 1255189 - DNA, 12 bp, Homo sapiens
atttctcctccc

SEQ ID NO: 1255190 - DNA, 14 bp, Homo sapiens
atttctctccccac

SEQ ID NO: 1255191 - DNA, 15 bp, Homo sapiens
atttctctctcctgg

SEQ ID NO: 1255192 - DNA, 18 bp, Homo sapiens
atttctctgagcagtcag

SEQ ID NO: 1255193 - DNA, 20 bp, Homo sapiens
atttctctgtgtatttatat

SEQ ID NO: 1255194 - DNA, 15 bp, Homo sapiens
atttctcttgggcag

SEQ ID NO: 1255195 - DNA, 17 bp, Homo sapiens
atttctcttgggcaggc

SEQ ID NO: 1255196 - DNA, 20 bp, Homo sapiens
atttctcttgggcaggcaga

SEQ ID NO: 1255197 - DNA, 15 bp, Homo sapiens
atttctcttgtcctt

SEQ ID NO: 1255198 - DNA, 20 bp, Homo sapiens
atttctgaaggtagcattct

SEQ ID NO: 1255199 - DNA, 23 bp, Homo sapiens
atttctgagtttcattctcctgc

SEQ ID NO: 1255200 - DNA, 13 bp, Homo sapiens
atttctgatgatg

SEQ ID NO: 1255201 - DNA, 14 bp, Homo sapiens
atttctgatgatgt

SEQ ID NO: 1255202 - DNA, 19 bp, Homo sapiens
atttctgatgtctccagat

SEQ ID NO: 1255203 - DNA, 16 bp, Homo sapiens
atttctgcaggttctt

SEQ ID NO: 1255204 - DNA, 23 bp, Homo sapiens
atttctgcatatgttgaatactt

SEQ ID NO: 1255205 - DNA, 16 bp, Homo sapiens
atttctgccatttcat

SEQ ID NO: 1255206 - DNA, 21 bp, Homo sapiens
atttctgcccttgttccagct

SEQ ID NO: 1255207 - DNA, 21 bp, Homo sapiens
atttctgctaaatatcaccta

SEQ ID NO: 1255208 - DNA, 21 bp, Homo sapiens
atttctgctctggaataaagt

SEQ ID NO: 1255209 - DNA, 13 bp, Homo sapiens
atttctggcctcc

SEQ ID NO: 1255210 - DNA, 15 bp, Homo sapiens
atttctgtatactgt

SEQ ID NO: 1255211 - DNA, 21 bp, Homo sapiens
atttctgtatactgtaaaagt

SEQ ID NO: 1255212 - DNA, 23 bp, Homo sapiens
atttctgtatactgtaaaagtta

SEQ ID NO: 1255213 - DNA, 13 bp, Homo sapiens
atttctgtatata

SEQ ID NO: 1255214 - DNA, 22 bp, Homo sapiens
atttctgtatatttgtcatgac

SEQ ID NO: 1255215 - DNA, 17 bp, Homo sapiens
atttctgtatttggcta

SEQ ID NO: 1255216 - DNA, 20 bp, Homo sapiens
atttctgtcacagtaaaaat

SEQ ID NO: 1255217 - DNA, 13 bp, Homo sapiens
atttctgtgggag

SEQ ID NO: 1255218 - DNA, 19 bp, Homo sapiens
atttctgtgtacacatcta

SEQ ID NO: 1255219 - DNA, 11 bp, Homo sapiens
atttctgtgtt

SEQ ID NO: 1255220 - DNA, 19 bp, Homo sapiens
atttctgtttagataatac

SEQ ID NO: 1255221 - DNA, 21 bp, Homo sapiens
atttctgtttagataatacac

SEQ ID NO: 1255222 - DNA, 16 bp, Homo sapiens
atttcttaaagctttt

SEQ ID NO: 1255223 - DNA, 19 bp, Homo sapiens
atttcttaaattattttat

SEQ ID NO: 1255224 - DNA, 14 bp, Homo sapiens
atttcttaacttct

SEQ ID NO: 1255225 - DNA, 17 bp, Homo sapiens
atttcttaacttcttgc

SEQ ID NO: 1255226 - DNA, 22 bp, Homo sapiens
atttcttaattattataaaaat

SEQ ID NO: 1255227 - DNA, 22 bp, Homo sapiens
atttcttagtgcttcagagttt

SEQ ID NO: 1255228 - DNA, 15 bp, Homo sapiens
atttcttatgatttt

SEQ ID NO: 1255229 - DNA, 19 bp, Homo sapiens
atttcttattgaatttgtt

SEQ ID NO: 1255230 - DNA, 14 bp, Homo sapiens
atttcttcagaatt

SEQ ID NO: 1255231 - DNA, 15 bp, Homo sapiens
atttcttcagggctg

SEQ ID NO: 1255232 - DNA, 23 bp, Homo sapiens
atttcttcctaccaagtcaaact

SEQ ID NO: 1255233 - DNA, 12 bp, Homo sapiens
atttcttccttc

SEQ ID NO: 1255234 - DNA, 21 bp, Homo sapiens
atttcttcgctgctctagctg

SEQ ID NO: 1255235 - DNA, 22 bp, Homo sapiens
atttcttcgctgctctagctgg

SEQ ID NO: 1255236 - DNA, 17 bp, Homo sapiens
atttcttcgttcttttt

SEQ ID NO: 1255237 - DNA, 13 bp, Homo sapiens
atttcttctctct

SEQ ID NO: 1255238 - DNA, 20 bp, Homo sapiens
atttcttctctctgttccct

SEQ ID NO: 1255239 - DNA, 21 bp, Homo sapiens
atttcttctcttatcctctct

SEQ ID NO: 1255240 - DNA, 13 bp, Homo sapiens
atttcttcttaga

SEQ ID NO: 1255241 - DNA, 17 bp, Homo sapiens
atttcttcttagaaaaa

SEQ ID NO: 1255242 - DNA, 16 bp, Homo sapiens
atttcttcttctaaga

SEQ ID NO: 1255243 - DNA, 22 bp, Homo sapiens
atttcttcttctaagaagacat

SEQ ID NO: 1255244 - DNA, 14 bp, Homo sapiens
atttcttgaagaat

SEQ ID NO: 1255245 - DNA, 11 bp, Homo sapiens
atttcttgctt

SEQ ID NO: 1255246 - DNA, 14 bp, Homo sapiens
atttcttggcaaat

SEQ ID NO: 1255247 - DNA, 16 bp, Homo sapiens
atttcttgggccctcc

SEQ ID NO: 1255248 - DNA, 18 bp, Homo sapiens
atttcttgggccctcctg

SEQ ID NO: 1255249 - DNA, 13 bp, Homo sapiens
atttcttgtttgt

SEQ ID NO: 1255250 - DNA, 16 bp, Homo sapiens
atttctttacagaatg

SEQ ID NO: 1255251 - DNA, 16 bp, Homo sapiens
atttctttatgtggaa

SEQ ID NO: 1255252 - DNA, 14 bp, Homo sapiens
atttctttctaact

SEQ ID NO: 1255253 - DNA, 15 bp, Homo sapiens
atttctttgaaaaaa

SEQ ID NO: 1255254 - DNA, 15 bp, Homo sapiens
atttctttgtagaat

SEQ ID NO: 1255255 - DNA, 15 bp, Homo sapiens
atttctttgtctttt

SEQ ID NO: 1255256 - DNA, 20 bp, Homo sapiens
atttctttgtctttttccta

SEQ ID NO: 1255257 - DNA, 22 bp, Homo sapiens
atttctttgtctttttcctact

SEQ ID NO: 1255258 - DNA, 21 bp, Homo sapiens
atttctttgttatcaaacttc

SEQ ID NO: 1255259 - DNA, 18 bp, Homo sapiens
atttcttttactctgtgt

SEQ ID NO: 1255260 - DNA, 23 bp, Homo sapiens
atttcttttgccgttattaaaaa

SEQ ID NO: 1255261 - DNA, 18 bp, Homo sapiens
atttcttttttatgtgat

SEQ ID NO: 1255262 - DNA, 14 bp, Homo sapiens
atttgaaaattgta

SEQ ID NO: 1255263 - DNA, 16 bp, Homo sapiens
atttgaacctggatcc

SEQ ID NO: 1255264 - DNA, 16 bp, Homo sapiens
atttgaagacttcaaa

SEQ ID NO: 1255265 - DNA, 12 bp, Homo sapiens
atttgaatgaga

SEQ ID NO: 1255266 - DNA, 11 bp, Homo sapiens
atttgaatgta

SEQ ID NO: 1255267 - DNA, 11 bp, Homo sapiens
atttgaattgg

SEQ ID NO: 1255268 - DNA, 14 bp, Homo sapiens
atttgaatttttac

SEQ ID NO: 1255269 - DNA, 23 bp, Homo sapiens
atttgacaaaatttgttgaaatt

SEQ ID NO: 1255270 - DNA, 12 bp, Homo sapiens
atttgaccaaat

SEQ ID NO: 1255271 - DNA, 22 bp, Homo sapiens
atttgacgttgttgtcattgtc

SEQ ID NO: 1255272 - DNA, 22 bp, Homo sapiens
atttgactctttcaaagaaatc

SEQ ID NO: 1255273 - DNA, 13 bp, Homo sapiens
atttgacttgaat

SEQ ID NO: 1255274 - DNA, 16 bp, Homo sapiens
atttgacttgaatatg

SEQ ID NO: 1255275 - DNA, 15 bp, Homo sapiens
atttgagaaaatata

SEQ ID NO: 1255276 - DNA, 20 bp, Homo sapiens
atttgagaaaatataataaa

SEQ ID NO: 1255277 - DNA, 23 bp, Homo sapiens
atttgagaaaatataataaaaga

SEQ ID NO: 1255278 - DNA, 23 bp, Homo sapiens
atttgagaagataatcattgctt

SEQ ID NO: 1255279 - DNA, 16 bp, Homo sapiens
atttgagaatacataa

SEQ ID NO: 1255280 - DNA, 17 bp, Homo sapiens
atttgagagaaatatga

SEQ ID NO: 1255281 - DNA, 15 bp, Homo sapiens
atttgagagaagcca

SEQ ID NO: 1255282 - DNA, 13 bp, Homo sapiens
atttgagataaag

SEQ ID NO: 1255283 - DNA, 18 bp, Homo sapiens
atttgtttgctgtacaga

SEQ ID NO: 1255284 - DNA, 13 bp, Homo sapiens
atttgtttgtatt

SEQ ID NO: 1255285 - DNA, 14 bp, Homo sapiens
atttgtttgtattt

SEQ ID NO: 1255286 - DNA, 15 bp, Homo sapiens
atttgttttcatggt

SEQ ID NO: 1255287 - DNA, 18 bp, Homo sapiens
atttgttttgacggatga

SEQ ID NO: 1255288 - DNA, 21 bp, Homo sapiens
atttgttttgacggatgattg

SEQ ID NO: 1255289 - DNA, 12 bp, Homo sapiens
atttgttttgct

SEQ ID NO: 1255290 - DNA, 15 bp, Homo sapiens
atttgttttgctttt

SEQ ID NO: 1255291 - DNA, 18 bp, Homo sapiens
atttgttttgcttttgtt

SEQ ID NO: 1255292 - DNA, 20 bp, Homo sapiens
atttgttttgttttaaaata

SEQ ID NO: 1255293 - DNA, 17 bp, Homo sapiens
atttgtttttaaactgt

SEQ ID NO: 1255294 - DNA, 14 bp, Homo sapiens
atttgtttttgcat

SEQ ID NO: 1255295 - DNA, 12 bp, Homo sapiens
attttaaaaaag

SEQ ID NO: 1255296 - DNA, 14 bp, Homo sapiens
attttaaaaaaggg

SEQ ID NO: 1255297 - DNA, 14 bp, Homo sapiens
attttaaaaaatca

SEQ ID NO: 1255298 - DNA, 17 bp, Homo sapiens
attttaaaaaatcaatc

SEQ ID NO: 1255299 - DNA, 19 bp, Homo sapiens
attttaaaaaatcaatcaa

SEQ ID NO: 1255300 - DNA, 16 bp, Homo sapiens
attttaaaaaatggtc

SEQ ID NO: 1255301 - DNA, 16 bp, Homo sapiens
attttaaaaacataga

SEQ ID NO: 1255302 - DNA, 17 bp, Homo sapiens
attttaaaaactttatt

SEQ ID NO: 1255303 - DNA, 14 bp, Homo sapiens
attttaaaaataca

SEQ ID NO: 1255304 - DNA, 22 bp, Homo sapiens
attttaaaaatacatatcgctg

SEQ ID NO: 1255305 - DNA, 19 bp, Homo sapiens
attttaaaataaattagtt

SEQ ID NO: 1255306 - DNA, 23 bp, Homo sapiens
attttaaaatagcgttcttgtaa

SEQ ID NO: 1255307 - DNA, 14 bp, Homo sapiens
attttaaaatattt

SEQ ID NO: 1255308 - DNA, 15 bp, Homo sapiens
attttaaaatattta

SEQ ID NO: 1255309 - DNA, 23 bp, Homo sapiens
attttaaaatctgagggaaatgt

SEQ ID NO: 1255310 - DNA, 23 bp, Homo sapiens
attttaaaatctgatttaatgtt

SEQ ID NO: 1255311 - DNA, 14 bp, Homo sapiens
attttaaaatgaat

SEQ ID NO: 1255312 - DNA, 18 bp, Homo sapiens
attttaaaatgaataatt

SEQ ID NO: 1255313 - DNA, 14 bp, Homo sapiens
attttaaaatgaga

SEQ ID NO: 1255314 - DNA, 14 bp, Homo sapiens
attttaaaatttgt

SEQ ID NO: 1255315 - DNA, 17 bp, Homo sapiens
attttaaaatttgttct

SEQ ID NO: 1255316 - DNA, 21 bp, Homo sapiens
attttaaacatatccaagttt

SEQ ID NO: 1255317 - DNA, 12 bp, Homo sapiens
attttaaagaat

SEQ ID NO: 1255318 - DNA, 14 bp, Homo sapiens
attttaaagacatg

SEQ ID NO: 1255319 - DNA, 15 bp, Homo sapiens
attttaaagacccaa

SEQ ID NO: 1255320 - DNA, 14 bp, Homo sapiens
attttaaagttagt

SEQ ID NO: 1255321 - DNA, 15 bp, Homo sapiens
attttaaataaaaga

SEQ ID NO: 1255322 - DNA, 21 bp, Homo sapiens
attttaaataaaagtgatcaa

SEQ ID NO: 1255323 - DNA, 14 bp, Homo sapiens
attttaaataacct

SEQ ID NO: 1255324 - DNA, 17 bp, Homo sapiens
attttaaataatttcta

SEQ ID NO: 1255325 - DNA, 22 bp, Homo sapiens
attttaaatatccacagtactc

SEQ ID NO: 1255326 - DNA, 14 bp, Homo sapiens
attttaaatgaaag

SEQ ID NO: 1255327 - DNA, 14 bp, Homo sapiens
attttaaattccac

SEQ ID NO: 1255328 - DNA, 19 bp, Homo sapiens
attttaaattccactgaaa

SEQ ID NO: 1255329 - DNA, 21 bp, Homo sapiens
attttaaattccactgaaaat

SEQ ID NO: 1255330 - DNA, 14 bp, Homo sapiens
attttaaattttat

SEQ ID NO: 1255331 - DNA, 16 bp, Homo sapiens
attttaacaaaagcaa

SEQ ID NO: 1255332 - DNA, 11 bp, Homo sapiens
attttaacaag

SEQ ID NO: 1255333 - DNA, 11 bp, Homo sapiens
attttaacact

SEQ ID NO: 1255334 - DNA, 13 bp, Homo sapiens
attttaacatgat

SEQ ID NO: 1255335 - DNA, 16 bp, Homo sapiens
attttaacatgatttc

SEQ ID NO: 1255336 - DNA, 22 bp, Homo sapiens
attttaacctatgatattttct

SEQ ID NO: 1255337 - DNA, 21 bp, Homo sapiens
attttaactaaattttaaagc

SEQ ID NO: 1255338 - DNA, 22 bp, Homo sapiens
attttaactgatttaacacttt

SEQ ID NO: 1255339 - DNA, 19 bp, Homo sapiens
attttaacttaactgaaat

SEQ ID NO: 1255340 - DNA, 17 bp, Homo sapiens
attttaactttatcaca

SEQ ID NO: 1255341 - DNA, 14 bp, Homo sapiens
attttaagaaacag

SEQ ID NO: 1255342 - DNA, 21 bp, Homo sapiens
attttaagaaagagaatgaac

SEQ ID NO: 1255343 - DNA, 16 bp, Homo sapiens
attttaaggatatgat

SEQ ID NO: 1255344 - DNA, 15 bp, Homo sapiens
attttaagtaggaaa

SEQ ID NO: 1255345 - DNA, 23 bp, Homo sapiens
attttaagtattgcatctgtata

SEQ ID NO: 1255346 - DNA, 20 bp, Homo sapiens
attttaagtttgtagtaaaa

SEQ ID NO: 1255347 - DNA, 13 bp, Homo sapiens
attttaatagaaa

SEQ ID NO: 1255348 - DNA, 20 bp, Homo sapiens
attttaatagaatttttaac

SEQ ID NO: 1255349 - DNA, 20 bp, Homo sapiens
attttaatattaacttttaa

SEQ ID NO: 1255350 - DNA, 22 bp, Homo sapiens
attttaatcccctgcactaggc

SEQ ID NO: 1255351 - DNA, 19 bp, Homo sapiens
attttaatgaatattgatg

SEQ ID NO: 1255352 - DNA, 21 bp, Homo sapiens
attttaatgatggtgttaaag

SEQ ID NO: 1255353 - DNA, 21 bp, Homo sapiens
attttaatgctgtttctaaga

SEQ ID NO: 1255354 - DNA, 18 bp, Homo sapiens
attttaattatcttttct

SEQ ID NO: 1255355 - DNA, 14 bp, Homo sapiens
attttaattctctc

SEQ ID NO: 1255356 - DNA, 19 bp, Homo sapiens
attttaatttagtaaatgt

SEQ ID NO: 1255357 - DNA, 17 bp, Homo sapiens
attttacaaaagatgta

SEQ ID NO: 1255358 - DNA, 22 bp, Homo sapiens
attttacaagggcataaagtaa

SEQ ID NO: 1255359 - DNA, 21 bp, Homo sapiens
attttacaattgaaatgacta

SEQ ID NO: 1255360 - DNA, 19 bp, Homo sapiens
attttacacattagatttt

SEQ ID NO: 1255361 - DNA, 14 bp, Homo sapiens
attttacagttaag

SEQ ID NO: 1255362 - DNA, 18 bp, Homo sapiens
attttacatttagagtat

SEQ ID NO: 1255363 - DNA, 21 bp, Homo sapiens
attttaccagatgttttgatg

SEQ ID NO: 1255364 - DNA, 22 bp, Homo sapiens
attttaccctgggtcacttgct

SEQ ID NO: 1255365 - DNA, 17 bp, Homo sapiens
attttacctagctaatt

SEQ ID NO: 1255366 - DNA, 16 bp, Homo sapiens
attttacctctctctg

SEQ ID NO: 1255367 - DNA, 15 bp, Homo sapiens
attttactttaacag

SEQ ID NO: 1255368 - DNA, 16 bp, Homo sapiens
attttactttaacagt

SEQ ID NO: 1255369 - DNA, 14 bp, Homo sapiens
attttactttgtac

SEQ ID NO: 1255370 - DNA, 20 bp, Homo sapiens
attttagacttaccttgaac

SEQ ID NO: 1255371 - DNA, 21 bp, Homo sapiens
attttagatgttattatgcta

SEQ ID NO: 1255372 - DNA, 16 bp, Homo sapiens
attttagctggtgtca

SEQ ID NO: 1255373 - DNA, 15 bp, Homo sapiens
attttagcttcagtt

SEQ ID NO: 1255374 - DNA, 15 bp, Homo sapiens
attttaggaataata

SEQ ID NO: 1255375 - DNA, 16 bp, Homo sapiens
attttaggaataataa

SEQ ID NO: 1255376 - DNA, 22 bp, Homo sapiens
attttaggcactcttaaatgat

SEQ ID NO: 1255377 - DNA, 22 bp, Homo sapiens
attttaggcactgttcaatact

SEQ ID NO: 1255378 - DNA, 15 bp, Homo sapiens
attttaggtgttgat

SEQ ID NO: 1255379 - DNA, 12 bp, Homo sapiens
attttagtatac

SEQ ID NO: 1255380 - DNA, 16 bp, Homo sapiens
attttagtattcattc

SEQ ID NO: 1255381 - DNA, 19 bp, Homo sapiens
attttagtattcattctgc

SEQ ID NO: 1255382 - DNA, 18 bp, Homo sapiens
attttagtgactgtaatt

SEQ ID NO: 1255383 - DNA, 20 bp, Homo sapiens
attttagtgtattaatcata

SEQ ID NO: 1255384 - DNA, 12 bp, Homo sapiens
attttagtttct

SEQ ID NO: 1255385 - DNA, 19 bp, Homo sapiens
attttagtttttcattaaa

SEQ ID NO: 1255386 - DNA, 20 bp, Homo sapiens
attttagtttttcattaaat

SEQ ID NO: 1255387 - DNA, 22 bp, Homo sapiens
attttataacatgttaaaatgt

SEQ ID NO: 1255388 - DNA, 17 bp, Homo sapiens
attttataagaaaaact

SEQ ID NO: 1255389 - DNA, 20 bp, Homo sapiens
attttataagaattttgctt

SEQ ID NO: 1255390 - DNA, 15 bp, Homo sapiens
attttataattggtg

SEQ ID NO: 1255391 - DNA, 21 bp, Homo sapiens
attttataattggtgctattt

SEQ ID NO: 1255392 - DNA, 22 bp, Homo sapiens
attttatagctcagtttatcca

SEQ ID NO: 1255393 - DNA, 22 bp, Homo sapiens
attttataggcatacctcctat

SEQ ID NO: 1255394 - DNA, 18 bp, Homo sapiens
attttatataaaatccat

SEQ ID NO: 1255395 - DNA, 15 bp, Homo sapiens
attttatataaagta

SEQ ID NO: 1255396 - DNA, 14 bp, Homo sapiens
attttatataataa

SEQ ID NO: 1255397 - DNA, 22 bp, Homo sapiens
attttatataataaagtattcc

SEQ ID NO: 1255398 - DNA, 17 bp, Homo sapiens
attttatatcatacagt

SEQ ID NO: 1255399 - DNA, 18 bp, Homo sapiens
attttatatcatacagtt

SEQ ID NO: 1255400 - DNA, 18 bp, Homo sapiens
attttatatgcttactga

SEQ ID NO: 1255401 - DNA, 15 bp, Homo sapiens
attttatatgtaaat

SEQ ID NO: 1255402 - DNA, 19 bp, Homo sapiens
attttatatgttcatattg

SEQ ID NO: 1255403 - DNA, 17 bp, Homo sapiens
attttatattcagtgaa

SEQ ID NO: 1255404 - DNA, 20 bp, Homo sapiens
attttatatttttgtacata

SEQ ID NO: 1255405 - DNA, 14 bp, Homo sapiens
atttttaaacaagt

SEQ ID NO: 1255406 - DNA, 15 bp, Homo sapiens
atttttaaacaagta

SEQ ID NO: 1255407 - DNA, 13 bp, Homo sapiens
atttttaaacttg

SEQ ID NO: 1255408 - DNA, 21 bp, Homo sapiens
atttttaaacttgaaatatat

SEQ ID NO: 1255409 - DNA, 18 bp, Homo sapiens
atttttaaagaatgttag

SEQ ID NO: 1255410 - DNA, 13 bp, Homo sapiens
atttttaaagatc

SEQ ID NO: 1255411 - DNA, 13 bp, Homo sapiens
atttttaaagcct

SEQ ID NO: 1255412 - DNA, 17 bp, Homo sapiens
atttttaaagtatatat

SEQ ID NO: 1255413 - DNA, 12 bp, Homo sapiens
atttttaaataa

SEQ ID NO: 1255414 - DNA, 20 bp, Homo sapiens
atttttaacacttaaatttc

SEQ ID NO: 1255415 - DNA, 21 bp, Homo sapiens
atttttaacacttaaatttct

SEQ ID NO: 1255416 - DNA, 20 bp, Homo sapiens
atttttaagaaaaattcaca

SEQ ID NO: 1255417 - DNA, 14 bp, Homo sapiens
atttttaagaactt

SEQ ID NO: 1255418 - DNA, 21 bp, Homo sapiens
atttttaagcaaaatattatt

SEQ ID NO: 1255419 - DNA, 19 bp, Homo sapiens
atttttaagtgctgcattt

SEQ ID NO: 1255420 - DNA, 23 bp, Homo sapiens
atttttaagtttttcactttggg

SEQ ID NO: 1255421 - DNA, 12 bp, Homo sapiens
atttttaatgat

SEQ ID NO: 1255422 - DNA, 11 bp, Homo sapiens
atttttaatgg

SEQ ID NO: 1255423 - DNA, 12 bp, Homo sapiens
atttttaatggg

SEQ ID NO: 1255424 - DNA, 15 bp, Homo sapiens
atttttaatgggggt

SEQ ID NO: 1255425 - DNA, 23 bp, Homo sapiens
atttttaatgggggtagcagctg

SEQ ID NO: 1255426 - DNA, 16 bp, Homo sapiens
atttttaatgtatcta

SEQ ID NO: 1255427 - DNA, 17 bp, Homo sapiens
atttttaatgtatctat

SEQ ID NO: 1255428 - DNA, 20 bp, Homo sapiens
atttttaatgtatctatttg

SEQ ID NO: 1255429 - DNA, 22 bp, Homo sapiens
atttttaatgtatctatttgta

SEQ ID NO: 1255430 - DNA, 23 bp, Homo sapiens
atttttaatgtatctatttgtac

SEQ ID NO: 1255431 - DNA, 22 bp, Homo sapiens
atttttaattaattgggccagc

SEQ ID NO: 1255432 - DNA, 18 bp, Homo sapiens
atttttaatttaaaaaag

SEQ ID NO: 1255433 - DNA, 16 bp, Homo sapiens
atttttacaaaactgc

SEQ ID NO: 1255434 - DNA, 13 bp, Homo sapiens
atttttacaataa

SEQ ID NO: 1255435 - DNA, 14 bp, Homo sapiens
atttttacaataaa

SEQ ID NO: 1255436 - DNA, 21 bp, Homo sapiens
atttttagaataagaatttgc

SEQ ID NO: 1255437 - DNA, 18 bp, Homo sapiens
atttttagccataatttt

SEQ ID NO: 1255438 - DNA, 20 bp, Homo sapiens
atttttagccccaaatctct

SEQ ID NO: 1255439 - DNA, 17 bp, Homo sapiens
atttttagtagagacgg

SEQ ID NO: 1255440 - DNA, 13 bp, Homo sapiens
atttttataaatt

SEQ ID NO: 1255441 - DNA, 18 bp, Homo sapiens
atttttataacatcttta

SEQ ID NO: 1255442 - DNA, 19 bp, Homo sapiens
atttttataattaaagatg

SEQ ID NO: 1255443 - DNA, 17 bp, Homo sapiens
atttttatacaaaccta

SEQ ID NO: 1255444 - DNA, 15 bp, Homo sapiens
atttttatacggaaa

SEQ ID NO: 1255445 - DNA, 15 bp, Homo sapiens
atttttatactttat

SEQ ID NO: 1255446 - DNA, 16 bp, Homo sapiens
atttttatactttatt

SEQ ID NO: 1255447 - DNA, 23 bp, Homo sapiens
atttttatataatatctaaagtt

SEQ ID NO: 1255448 - DNA, 17 bp, Homo sapiens
atttttatatcatgcaa

SEQ ID NO: 1255449 - DNA, 16 bp, Homo sapiens
atttttatatgaaata

SEQ ID NO: 1255450 - DNA, 15 bp, Homo sapiens
atttttatatttagt

SEQ ID NO: 1255451 - DNA, 17 bp, Homo sapiens
atttttatcatgaattc

SEQ ID NO: 1255452 - DNA, 12 bp, Homo sapiens
atttttatccat

SEQ ID NO: 1255453 - DNA, 17 bp, Homo sapiens
atttttatccatttctt

SEQ ID NO: 1255454 - DNA, 15 bp, Homo sapiens
atttttatgcagaca

SEQ ID NO: 1255455 - DNA, 17 bp, Homo sapiens
atttttatgtggtctta

SEQ ID NO: 1255456 - DNA, 14 bp, Homo sapiens
atttttattaaatg

SEQ ID NO: 1255457 - DNA, 17 bp, Homo sapiens
atttttattaaatgtat

SEQ ID NO: 1255458 - DNA, 17 bp, Homo sapiens
atttttattaattttag

SEQ ID NO: 1255459 - DNA, 15 bp, Homo sapiens
atttttattactttt

SEQ ID NO: 1255460 - DNA, 14 bp, Homo sapiens
atttttatttcaaa

SEQ ID NO: 1255461 - DNA, 13 bp, Homo sapiens
atttttatttctt

SEQ ID NO: 1255462 - DNA, 17 bp, Homo sapiens
atttttatttcttccta

SEQ ID NO: 1255463 - DNA, 14 bp, Homo sapiens
atttttatttcttt

SEQ ID NO: 1255464 - DNA, 16 bp, Homo sapiens
atttttatttcttttt

SEQ ID NO: 1255465 - DNA, 15 bp, Homo sapiens
atttttcaaagcaat

SEQ ID NO: 1255466 - DNA, 15 bp, Homo sapiens
atttttcaaatagat

SEQ ID NO: 1255467 - DNA, 21 bp, Homo sapiens
atttttcaaatagatttttga

SEQ ID NO: 1255468 - DNA, 23 bp, Homo sapiens
atttttcaaatagatttttgatt

SEQ ID NO: 1255469 - DNA, 15 bp, Homo sapiens
atttttcaaggaagg

SEQ ID NO: 1255470 - DNA, 12 bp, Homo sapiens
atttttcaatag

SEQ ID NO: 1255471 - DNA, 19 bp, Homo sapiens
atttttcaatagcgtgtgt

SEQ ID NO: 1255472 - DNA, 20 bp, Homo sapiens
atttttcaatatattgaact

SEQ ID NO: 1255473 - DNA, 11 bp, Homo sapiens
atttttcaatc

SEQ ID NO: 1255474 - DNA, 18 bp, Homo sapiens
atttttcatgataatgaa

SEQ ID NO: 1255475 - DNA, 13 bp, Homo sapiens
atttttccaacta

SEQ ID NO: 1255476 - DNA, 21 bp, Homo sapiens
atttttccaactactaataga

SEQ ID NO: 1255477 - DNA, 16 bp, Homo sapiens
atttttccaggactct

SEQ ID NO: 1255478 - DNA, 16 bp, Homo sapiens
atttttccatttgtat

SEQ ID NO: 1255479 - DNA, 16 bp, Homo sapiens
atttttcccagtattt

SEQ ID NO: 1255480 - DNA, 13 bp, Homo sapiens
atttttccctccg

SEQ ID NO: 1255481 - DNA, 17 bp, Homo sapiens
atttttccgtttgcttt

SEQ ID NO: 1255482 - DNA, 23 bp, Homo sapiens
atttttcctatgctattgacaat

SEQ ID NO: 1255483 - DNA, 14 bp, Homo sapiens
atttttcctgcatg

SEQ ID NO: 1255484 - DNA, 18 bp, Homo sapiens
atttttctaagtgtaacc

SEQ ID NO: 1255485 - DNA, 19 bp, Homo sapiens
atttttctaagtgtaacct

SEQ ID NO: 1255486 - DNA, 19 bp, Homo sapiens
atttttctataaatcagta

SEQ ID NO: 1255487 - DNA, 13 bp, Homo sapiens
atttttctatctg

SEQ ID NO: 1255488 - DNA, 10 bp, Homo sapiens
atttttctct

SEQ ID NO: 1255489 - DNA, 12 bp, Homo sapiens
atttttctcttc

SEQ ID NO: 1255490 - DNA, 14 bp, Homo sapiens
atttttctcttcat

SEQ ID NO: 1255491 - DNA, 13 bp, Homo sapiens
atttttctcttgt

SEQ ID NO: 1255492 - DNA, 17 bp, Homo sapiens
atttttctcttgtacca

SEQ ID NO: 1255493 - DNA, 19 bp, Homo sapiens
atttttcttagtgttgtgg

SEQ ID NO: 1255494 - DNA, 14 bp, Homo sapiens
atttttcttcttga

SEQ ID NO: 1255495 - DNA, 19 bp, Homo sapiens
atttttcttgctgttcagt

SEQ ID NO: 1255496 - DNA, 20 bp, Homo sapiens
atttttcttgttgcatcttt

SEQ ID NO: 1255497 - DNA, 15 bp, Homo sapiens
atttttctttaactg

SEQ ID NO: 1255498 - DNA, 15 bp, Homo sapiens
atttttctttacaaa

SEQ ID NO: 1255499 - DNA, 16 bp, Homo sapiens
atttttctttacaaaa

SEQ ID NO: 1255500 - DNA, 20 bp, Homo sapiens
atttttcttttattcttctt

SEQ ID NO: 1255501 - DNA, 14 bp, Homo sapiens
atttttgaaaaata

SEQ ID NO: 1255502 - DNA, 18 bp, Homo sapiens
atttttgaaaaatattgc

SEQ ID NO: 1255503 - DNA, 19 bp, Homo sapiens
atttttgaaaaatattgct

SEQ ID NO: 1255504 - DNA, 21 bp, Homo sapiens
atttttgaaaaatattgctaa

SEQ ID NO: 1255505 - DNA, 23 bp, Homo sapiens
atttttgaaaaatattgctaaaa

SEQ ID NO: 1255506 - DNA, 20 bp, Homo sapiens
atttttgaaactgcatttgt

SEQ ID NO: 1255507 - DNA, 18 bp, Homo sapiens
atttttgacactttttgt

SEQ ID NO: 1255508 - DNA, 13 bp, Homo sapiens
atttttgaggaat

SEQ ID NO: 1255509 - DNA, 23 bp, Homo sapiens
atttttgatgactacctcagaac

SEQ ID NO: 1255510 - DNA, 23 bp, Homo sapiens
atttttgatttatgcatggaaac

SEQ ID NO: 1255511 - DNA, 17 bp, Homo sapiens
atttttgcctatcttta

SEQ ID NO: 1255512 - DNA, 18 bp, Homo sapiens
atttttgcctcttccagt

SEQ ID NO: 1255513 - DNA, 19 bp, Homo sapiens
atttttggcagtctgaatt

SEQ ID NO: 1255514 - DNA, 20 bp, Homo sapiens
atttttggggcatcctggat

SEQ ID NO: 1255515 - DNA, 24 bp, Homo sapiens
atttttggggcatcctggatgatt

SEQ ID NO: 1255516 - DNA, 16 bp, Homo sapiens
atttttggggggagag

SEQ ID NO: 1255517 - DNA, 18 bp, Homo sapiens
atttttgggtttggccag

SEQ ID NO: 1255518 - DNA, 21 bp, Homo sapiens
atttttgggtttggccaggga

SEQ ID NO: 1255519 - DNA, 18 bp, Homo sapiens
atttttggtatttatgta

SEQ ID NO: 1255520 - DNA, 13 bp, Homo sapiens
atttttgtacata

SEQ ID NO: 1255521 - DNA, 17 bp, Homo sapiens
atttttgtacatattgt

SEQ ID NO: 1255522 - DNA, 13 bp, Homo sapiens
atttttgtacatc

SEQ ID NO: 1255523 - DNA, 14 bp, Homo sapiens
atttttgtacatcc

SEQ ID NO: 1255524 - DNA, 22 bp, Homo sapiens
atttttgtacatcccaaaggat

SEQ ID NO: 1255525 - DNA, 15 bp, Homo sapiens
atttttgtagtagcg

SEQ ID NO: 1255526 - DNA, 14 bp, Homo sapiens
atttttgtataaaa

SEQ ID NO: 1255527 - DNA, 20 bp, Homo sapiens
atttttgtataaaaaggaaa

SEQ ID NO: 1255528 - DNA, 21 bp, Homo sapiens
caaaccctaggttcccggtcc

SEQ ID NO: 1255529 - DNA, 15 bp, Homo sapiens
caaaccctcccagaa

SEQ ID NO: 1255530 - DNA, 22 bp, Homo sapiens
caaaccctggtggtattttatt

SEQ ID NO: 1255531 - DNA, 23 bp, Homo sapiens
caaaccctgtggggcctgatggt

SEQ ID NO: 1255532 - DNA, 15 bp, Homo sapiens
caaacccttaactga

SEQ ID NO: 1255533 - DNA, 17 bp, Homo sapiens
caaacccttaactgaca

SEQ ID NO: 1255534 - DNA, 18 bp, Homo sapiens
caaacccttcaactcctg

SEQ ID NO: 1255535 - DNA, 16 bp, Homo sapiens
caaaccctttgtatta

SEQ ID NO: 1255536 - DNA, 15 bp, Homo sapiens
caaacctaccaaaat

SEQ ID NO: 1255537 - DNA, 17 bp, Homo sapiens
caaacctaccaaaatgg

SEQ ID NO: 1255538 - DNA, 18 bp, Homo sapiens
caaacctagcttttaaaa

SEQ ID NO: 1255539 - DNA, 21 bp, Homo sapiens
caaacctagcttttaaaaaat

SEQ ID NO: 1255540 - DNA, 13 bp, Homo sapiens
caaacctccagcc

SEQ ID NO: 1255541 - DNA, 15 bp, Homo sapiens
caaaccttcctggga

SEQ ID NO: 1255542 - DNA, 14 bp, Homo sapiens
caaaccttgggccc

SEQ ID NO: 1255543 - DNA, 15 bp, Homo sapiens
caaacctttctggcc

SEQ ID NO: 1255544 - DNA, 20 bp, Homo sapiens
caaacgccctttcctcctca

SEQ ID NO: 1255545 - DNA, 13 bp, Homo sapiens
caaacgctaaaga

SEQ ID NO: 1255546 - DNA, 22 bp, Homo sapiens
caaacgctaaagagcccttgcc

SEQ ID NO: 1255547 - DNA, 23 bp, Homo sapiens
caaacgctaaagagcccttgcct

SEQ ID NO: 1255548 - DNA, 13 bp, Homo sapiens
caaacggagcccc

SEQ ID NO: 1255549 - DNA, 17 bp, Homo sapiens
caaacggagcccctgaa

SEQ ID NO: 1255550 - DNA, 22 bp, Homo sapiens
caaacggagcccctgaaagcct

SEQ ID NO: 1255551 - DNA, 18 bp, Homo sapiens
caaacgtctattttgtat

SEQ ID NO: 1255552 - DNA, 23 bp, Homo sapiens
caaacgtctattttgtatatttg

SEQ ID NO: 1255553 - DNA, 19 bp, Homo sapiens
caaacgtgttttttaaaaa

SEQ ID NO: 1255554 - DNA, 16 bp, Homo sapiens
caaactaaaggtgcac

SEQ ID NO: 1255555 - DNA, 15 bp, Homo sapiens
caaactaaattcaaa

SEQ ID NO: 1255556 - DNA, 17 bp, Homo sapiens
caaactacagaataatg

SEQ ID NO: 1255557 - DNA, 14 bp, Homo sapiens
caaactacctctgg

SEQ ID NO: 1255558 - DNA, 13 bp, Homo sapiens
caaactacttcat

SEQ ID NO: 1255559 - DNA, 19 bp, Homo sapiens
caaactagggccaagccca

SEQ ID NO: 1255560 - DNA, 19 bp, Homo sapiens
caaactatgggatccaagg

SEQ ID NO: 1255561 - DNA, 21 bp, Homo sapiens
caaactcaatgctttatttgt

SEQ ID NO: 1255562 - DNA, 14 bp, Homo sapiens
caaactcagatcct

SEQ ID NO: 1255563 - DNA, 18 bp, Homo sapiens
caaactcagatccttggt

SEQ ID NO: 1255564 - DNA, 23 bp, Homo sapiens
caaactcataacagtcttactgc

SEQ ID NO: 1255565 - DNA, 18 bp, Homo sapiens
caaactccccttccctgg

SEQ ID NO: 1255566 - DNA, 22 bp, Homo sapiens
caaactcctgggctcaagtgat

SEQ ID NO: 1255567 - DNA, 22 bp, Homo sapiens
caaactcgcttaggtagaaact

SEQ ID NO: 1255568 - DNA, 14 bp, Homo sapiens
caaactctctgaac

SEQ ID NO: 1255569 - DNA, 16 bp, Homo sapiens
caaactcttaattaga

SEQ ID NO: 1255570 - DNA, 22 bp, Homo sapiens
caaactcttcagttaattctta

SEQ ID NO: 1255571 - DNA, 19 bp, Homo sapiens
caaactgaaattcagagca

SEQ ID NO: 1255572 - DNA, 17 bp, Homo sapiens
caaactgaggaatttca

SEQ ID NO: 1255573 - DNA, 20 bp, Homo sapiens
caaactgatgctgaggatga

SEQ ID NO: 1255574 - DNA, 19 bp, Homo sapiens
caaactgatggaccgggtg

SEQ ID NO: 1255575 - DNA, 13 bp, Homo sapiens
caaactgcaatag

SEQ ID NO: 1255576 - DNA, 18 bp, Homo sapiens
caaactgcagctgtgagt

SEQ ID NO: 1255577 - DNA, 13 bp, Homo sapiens
caaactgctgcat

SEQ ID NO: 1255578 - DNA, 16 bp, Homo sapiens
caaactggtattctgt

SEQ ID NO: 1255579 - DNA, 19 bp, Homo sapiens
caaactggtattctgttct

SEQ ID NO: 1255580 - DNA, 14 bp, Homo sapiens
caaactgtaaataa

SEQ ID NO: 1255581 - DNA, 15 bp, Homo sapiens
caaactgtgaaaata

SEQ ID NO: 1255582 - DNA, 20 bp, Homo sapiens
caaactgtgaaaatagtgta

SEQ ID NO: 1255583 - DNA, 13 bp, Homo sapiens
caaacttactatt

SEQ ID NO: 1255584 - DNA, 18 bp, Homo sapiens
caaacttactattttgac

SEQ ID NO: 1255585 - DNA, 22 bp, Homo sapiens
caaacttgttcatttagataat

SEQ ID NO: 1255586 - DNA, 12 bp, Homo sapiens
caaactttaaaa

SEQ ID NO: 1255587 - DNA, 18 bp, Homo sapiens
caaactttaaaatgcgaa

SEQ ID NO: 1255588 - DNA, 20 bp, Homo sapiens
caaactttaaaatgcgaaat

SEQ ID NO: 1255589 - DNA, 21 bp, Homo sapiens
caaactttaggtttttttaat

SEQ ID NO: 1255590 - DNA, 23 bp, Homo sapiens
caaactttaggtttttttaatga

SEQ ID NO: 1255591 - DNA, 12 bp, Homo sapiens
caaactttgcat

SEQ ID NO: 1255592 - DNA, 16 bp, Homo sapiens
caaactttttccagca

SEQ ID NO: 1255593 - DNA, 20 bp, Homo sapiens
caaactttttccagcaaaat

SEQ ID NO: 1255594 - DNA, 23 bp, Homo sapiens
caaactttttccagcaaaatgga

SEQ ID NO: 1255595 - DNA, 17 bp, Homo sapiens
caaacttttttatatct

SEQ ID NO: 1255596 - DNA, 21 bp, Homo sapiens
caaagaaaaaaaaaaaagcca

SEQ ID NO: 1255597 - DNA, 21 bp, Homo sapiens
caaagaaaagtattgtttgga

SEQ ID NO: 1255598 - DNA, 18 bp, Homo sapiens
caaagaaaatgaaatgca

SEQ ID NO: 1255599 - DNA, 21 bp, Homo sapiens
caaagaaaatgaaatgcatat

SEQ ID NO: 1255600 - DNA, 13 bp, Homo sapiens
caaagaaaattcc

SEQ ID NO: 1255601 - DNA, 17 bp, Homo sapiens
caaagaaacaaagatgt

SEQ ID NO: 1255602 - DNA, 13 bp, Homo sapiens
caaagaaacaagc

SEQ ID NO: 1255603 - DNA, 14 bp, Homo sapiens
caaagaaagtgtat

SEQ ID NO: 1255604 - DNA, 19 bp, Homo sapiens
caaagaaatgggcctgcct

SEQ ID NO: 1255605 - DNA, 23 bp, Homo sapiens
caaagaaatgggcctgcctgcct

SEQ ID NO: 1255606 - DNA, 16 bp, Homo sapiens
caaagaaattcagaac

SEQ ID NO: 1255607 - DNA, 14 bp, Homo sapiens
caaagaacagatgg

SEQ ID NO: 1255608 - DNA, 19 bp, Homo sapiens
caaagaaccaaagaagaaa

SEQ ID NO: 1255609 - DNA, 11 bp, Homo sapiens
caaagaagaaa

SEQ ID NO: 1255610 - DNA, 15 bp, Homo sapiens
caaagaaggcaggga

SEQ ID NO: 1255611 - DNA, 21 bp, Homo sapiens
caaagaaggcatttgcagggt

SEQ ID NO: 1255612 - DNA, 11 bp, Homo sapiens
caaagaatatt

SEQ ID NO: 1255613 - DNA, 17 bp, Homo sapiens
caaagaattccaaagca

SEQ ID NO: 1255614 - DNA, 19 bp, Homo sapiens
caaagacaaaagtctgtct

SEQ ID NO: 1255615 - DNA, 15 bp, Homo sapiens
caaagaccacctcca

SEQ ID NO: 1255616 - DNA, 18 bp, Homo sapiens
caaagaccacctccaacc

SEQ ID NO: 1255617 - DNA, 17 bp, Homo sapiens
caaagacgtgtccgacc

SEQ ID NO: 1255618 - DNA, 12 bp, Homo sapiens
caaagactattt

SEQ ID NO: 1255619 - DNA, 22 bp, Homo sapiens
caaagactcctctgggcctggg

SEQ ID NO: 1255620 - DNA, 13 bp, Homo sapiens
caaagactccttg

SEQ ID NO: 1255621 - DNA, 23 bp, Homo sapiens
caaagactccttgtggactggct

SEQ ID NO: 1255622 - DNA, 12 bp, Homo sapiens
caaagactctga

SEQ ID NO: 1255623 - DNA, 13 bp, Homo sapiens
caaagactctgag

SEQ ID NO: 1255624 - DNA, 21 bp, Homo sapiens
caaagactctgagccaaggga

SEQ ID NO: 1255625 - DNA, 19 bp, Homo sapiens
caaagactgagtgttcaaa

SEQ ID NO: 1255626 - DNA, 14 bp, Homo sapiens
caaagactgtactg

SEQ ID NO: 1255627 - DNA, 21 bp, Homo sapiens
caaagactgtgaacagcttgc

SEQ ID NO: 1255628 - DNA, 22 bp, Homo sapiens
caaagacttaagcccagtgcac

SEQ ID NO: 1255629 - DNA, 20 bp, Homo sapiens
caaagacttagtatattttc

SEQ ID NO: 1255630 - DNA, 15 bp, Homo sapiens
caaagagaaaaagaa

SEQ ID NO: 1255631 - DNA, 20 bp, Homo sapiens
caaagagaaaaagaaatgca

SEQ ID NO: 1255632 - DNA, 15 bp, Homo sapiens
caaagagaaaactta

SEQ ID NO: 1255633 - DNA, 18 bp, Homo sapiens
caaagagaatgcccttct

SEQ ID NO: 1255634 - DNA, 18 bp, Homo sapiens
caaagagactggagcatc

SEQ ID NO: 1255635 - DNA, 13 bp, Homo sapiens
caaagagcctgga

SEQ ID NO: 1255636 - DNA, 15 bp, Homo sapiens
caaagagcctggaga

SEQ ID NO: 1255637 - DNA, 17 bp, Homo sapiens
caaagagcctggagaag

SEQ ID NO: 1255638 - DNA, 14 bp, Homo sapiens
caaagagccttcag

SEQ ID NO: 1255639 - DNA, 23 bp, Homo sapiens
caaagagcgagtcccctgcccgg

SEQ ID NO: 1255640 - DNA, 23 bp, Homo sapiens
caaagagctcccgaggaagcaca

SEQ ID NO: 1255641 - DNA, 19 bp, Homo sapiens
caaagaggcctttaaccat

SEQ ID NO: 1255642 - DNA, 22 bp, Homo sapiens
caaagaggctgaggctggcaca

SEQ ID NO: 1255643 - DNA, 12 bp, Homo sapiens
caaagaggctgc

SEQ ID NO: 1255644 - DNA, 13 bp, Homo sapiens
caaagaggctgcc

SEQ ID NO: 1255645 - DNA, 21 bp, Homo sapiens
caaagaggctgcccctctcac

SEQ ID NO: 1255646 - DNA, 22 bp, Homo sapiens
caaagaggggcgctgtcctgcg

SEQ ID NO: 1255647 - DNA, 18 bp, Homo sapiens
caaagagggggctctgcc

SEQ ID NO: 1255648 - DNA, 13 bp, Homo sapiens
caaagaggtattt

SEQ ID NO: 1255649 - DNA, 16 bp, Homo sapiens
caaagaggtatttatc

SEQ ID NO: 1255650 - DNA, 22 bp, Homo sapiens
caaatatttagatgtaattttg

SEQ ID NO: 1255651 - DNA, 23 bp, Homo sapiens
caaatattttagaagctaatgta

SEQ ID NO: 1255652 - DNA, 14 bp, Homo sapiens
caaatcaacagaag

SEQ ID NO: 1255653 - DNA, 21 bp, Homo sapiens
caaatcaacagaagcatttgt

SEQ ID NO: 1255654 - DNA, 17 bp, Homo sapiens
caaatcaatacactagt

SEQ ID NO: 1255655 - DNA, 16 bp, Homo sapiens
caaatcaattactggt

SEQ ID NO: 1255656 - DNA, 15 bp, Homo sapiens
caaatcacatatttt

SEQ ID NO: 1255657 - DNA, 19 bp, Homo sapiens
caaatcacatattttaaaa

SEQ ID NO: 1255658 - DNA, 18 bp, Homo sapiens
caaatcactgtatttatc

SEQ ID NO: 1255659 - DNA, 14 bp, Homo sapiens
caaatcagaacttt

SEQ ID NO: 1255660 - DNA, 14 bp, Homo sapiens
caaatcagaagtca

SEQ ID NO: 1255661 - DNA, 15 bp, Homo sapiens
caaatcagaagtcat

SEQ ID NO: 1255662 - DNA, 15 bp, Homo sapiens
caaatcaggggccag

SEQ ID NO: 1255663 - DNA, 17 bp, Homo sapiens
caaatcagtcttccttg

SEQ ID NO: 1255664 - DNA, 22 bp, Homo sapiens
caaatcagtcttccttgtggaa

SEQ ID NO: 1255665 - DNA, 15 bp, Homo sapiens
caaatcagtgatcta

SEQ ID NO: 1255666 - DNA, 18 bp, Homo sapiens
caaatcagtttgactact

SEQ ID NO: 1255667 - DNA, 16 bp, Homo sapiens
caaatcattatgtttc

SEQ ID NO: 1255668 - DNA, 16 bp, Homo sapiens
caaatccatccagaat

SEQ ID NO: 1255669 - DNA, 15 bp, Homo sapiens
caaatcccaaaccat

SEQ ID NO: 1255670 - DNA, 17 bp, Homo sapiens
caaatccgctctcttcc

SEQ ID NO: 1255671 - DNA, 19 bp, Homo sapiens
caaatccgctctcttcctg

SEQ ID NO: 1255672 - DNA, 22 bp, Homo sapiens
caaatccgctctcttcctgccc

SEQ ID NO: 1255673 - DNA, 21 bp, Homo sapiens
caaatcctggaaggacacagt

SEQ ID NO: 1255674 - DNA, 15 bp, Homo sapiens
caaatccttattgtt

SEQ ID NO: 1255675 - DNA, 17 bp, Homo sapiens
caaatccttattgttca

SEQ ID NO: 1255676 - DNA, 17 bp, Homo sapiens
caaatcctttctgcccc

SEQ ID NO: 1255677 - DNA, 21 bp, Homo sapiens
caaatcgtccagcgaccttcc

SEQ ID NO: 1255678 - DNA, 24 bp, Homo sapiens
caaatctattacttttgcaaactg

SEQ ID NO: 1255679 - DNA, 22 bp, Homo sapiens
caaatctattcagacaagcaac

SEQ ID NO: 1255680 - DNA, 21 bp, Homo sapiens
caaatctcaatgaagccagct

SEQ ID NO: 1255681 - DNA, 11 bp, Homo sapiens
caaatctcagc

SEQ ID NO: 1255682 - DNA, 13 bp, Homo sapiens
caaatctcagcaa

SEQ ID NO: 1255683 - DNA, 18 bp, Homo sapiens
caaatctcagcaaagcta

SEQ ID NO: 1255684 - DNA, 20 bp, Homo sapiens
caaatctcagcaaagctaca

SEQ ID NO: 1255685 - DNA, 23 bp, Homo sapiens
caaatctcagttgtttgcttctt

SEQ ID NO: 1255686 - DNA, 15 bp, Homo sapiens
caaatctcctgctga

SEQ ID NO: 1255687 - DNA, 15 bp, Homo sapiens
caaatctctcatatt

SEQ ID NO: 1255688 - DNA, 21 bp, Homo sapiens
caaatctgctttttaaagaat

SEQ ID NO: 1255689 - DNA, 13 bp, Homo sapiens
caaatctgtcctc

SEQ ID NO: 1255690 - DNA, 15 bp, Homo sapiens
caaatctgtcctctg

SEQ ID NO: 1255691 - DNA, 18 bp, Homo sapiens
caaatctgtcctctgtag

SEQ ID NO: 1255692 - DNA, 15 bp, Homo sapiens
caaatctgtgctctt

SEQ ID NO: 1255693 - DNA, 15 bp, Homo sapiens
caaatcttacaaaat

SEQ ID NO: 1255694 - DNA, 19 bp, Homo sapiens
caaatcttgttattgaagt

SEQ ID NO: 1255695 - DNA, 22 bp, Homo sapiens
caaatcttgttattgaagtgtt

SEQ ID NO: 1255696 - DNA, 23 bp, Homo sapiens
caaatcttgttattgaagtgttc

SEQ ID NO: 1255697 - DNA, 15 bp, Homo sapiens
caaatctttaagaat

SEQ ID NO: 1255698 - DNA, 19 bp, Homo sapiens
caaatctttaagaatagtt

SEQ ID NO: 1255699 - DNA, 18 bp, Homo sapiens
caaatctttctgtaaaca

SEQ ID NO: 1255700 - DNA, 12 bp, Homo sapiens
caaatgaaactc

SEQ ID NO: 1255701 - DNA, 13 bp, Homo sapiens
caaatgaaatgta

SEQ ID NO: 1255702 - DNA, 13 bp, Homo sapiens
caaatgaactttt

SEQ ID NO: 1255703 - DNA, 19 bp, Homo sapiens
caaatgaacttttacagaa

SEQ ID NO: 1255704 - DNA, 21 bp, Homo sapiens
caaatgaacttttacagaatg

SEQ ID NO: 1255705 - DNA, 12 bp, Homo sapiens
caaatgaagaaa

SEQ ID NO: 1255706 - DNA, 23 bp, Homo sapiens
caaatgaataatgcctttgtaac

SEQ ID NO: 1255707 - DNA, 13 bp, Homo sapiens
caaatgaatcatt

SEQ ID NO: 1255708 - DNA, 12 bp, Homo sapiens
caaatgacagat

SEQ ID NO: 1255709 - DNA, 22 bp, Homo sapiens
caaatgaccagcagattcaaat

SEQ ID NO: 1255710 - DNA, 18 bp, Homo sapiens
caaatgaggaaaccaaga

SEQ ID NO: 1255711 - DNA, 15 bp, Homo sapiens
caaatgagttcagga

SEQ ID NO: 1255712 - DNA, 22 bp, Homo sapiens
caaatgatcctagtaattgcct

SEQ ID NO: 1255713 - DNA, 12 bp, Homo sapiens
caaatgcaaatt

SEQ ID NO: 1255714 - DNA, 15 bp, Homo sapiens
caaatgcagggaggg

SEQ ID NO: 1255715 - DNA, 18 bp, Homo sapiens
caaatgcagtatatttct

SEQ ID NO: 1255716 - DNA, 16 bp, Homo sapiens
caaatgcatgaacaag

SEQ ID NO: 1255717 - DNA, 17 bp, Homo sapiens
caaatgcatgaacaagt

SEQ ID NO: 1255718 - DNA, 18 bp, Homo sapiens
caaatgcatggtgcagtt

SEQ ID NO: 1255719 - DNA, 21 bp, Homo sapiens
caaatgccaaacactagctct

SEQ ID NO: 1255720 - DNA, 14 bp, Homo sapiens
caaatgccagggcc

SEQ ID NO: 1255721 - DNA, 14 bp, Homo sapiens
caaatgcccaagga

SEQ ID NO: 1255722 - DNA, 18 bp, Homo sapiens
caaatgcccaaggatgcc

SEQ ID NO: 1255723 - DNA, 14 bp, Homo sapiens
caaatgcctgttgt

SEQ ID NO: 1255724 - DNA, 15 bp, Homo sapiens
caaatgccttcatga

SEQ ID NO: 1255725 - DNA, 15 bp, Homo sapiens
caaatggaaaatgta

SEQ ID NO: 1255726 - DNA, 16 bp, Homo sapiens
caaatggaaaatgtat

SEQ ID NO: 1255727 - DNA, 22 bp, Homo sapiens
caaatggaaagtaactcatttg

SEQ ID NO: 1255728 - DNA, 18 bp, Homo sapiens
caaatggaggcttttcac

SEQ ID NO: 1255729 - DNA, 19 bp, Homo sapiens
caaatggaggcttttcact

SEQ ID NO: 1255730 - DNA, 24 bp, Homo sapiens
caaatggccagttttctggtagga

SEQ ID NO: 1255731 - DNA, 24 bp, Homo sapiens
caaatgggagactctttgaaatga

SEQ ID NO: 1255732 - DNA, 13 bp, Homo sapiens
caaatggtatctt

SEQ ID NO: 1255733 - DNA, 13 bp, Homo sapiens
caaatggttctta

SEQ ID NO: 1255734 - DNA, 15 bp, Homo sapiens
caaatggttcttact

SEQ ID NO: 1255735 - DNA, 22 bp, Homo sapiens
caaatggttcttacttttcctg

SEQ ID NO: 1255736 - DNA, 23 bp, Homo sapiens
caaatggttcttacttttcctgg

SEQ ID NO: 1255737 - DNA, 13 bp, Homo sapiens
caaatgtaaaatt

SEQ ID NO: 1255738 - DNA, 14 bp, Homo sapiens
caaatgtaaaatta

SEQ ID NO: 1255739 - DNA, 20 bp, Homo sapiens
caaatgtaaatttactgagc

SEQ ID NO: 1255740 - DNA, 18 bp, Homo sapiens
caaatgtaattgaataaa

SEQ ID NO: 1255741 - DNA, 21 bp, Homo sapiens
caaatgtaattgaataaagtt

SEQ ID NO: 1255742 - DNA, 12 bp, Homo sapiens
caaatgtattga

SEQ ID NO: 1255743 - DNA, 15 bp, Homo sapiens
caaatgtcagagcta

SEQ ID NO: 1255744 - DNA, 18 bp, Homo sapiens
caaatgtcctccagaagc

SEQ ID NO: 1255745 - DNA, 15 bp, Homo sapiens
caaatgtgaaacgga

SEQ ID NO: 1255746 - DNA, 17 bp, Homo sapiens
caaatgtgccatactaa

SEQ ID NO: 1255747 - DNA, 14 bp, Homo sapiens
caaatgtggctcct

SEQ ID NO: 1255748 - DNA, 23 bp, Homo sapiens
caaatgtgtacatggcagagttt

SEQ ID NO: 1255749 - DNA, 15 bp, Homo sapiens
caaatgtgtcagaat

SEQ ID NO: 1255750 - DNA, 23 bp, Homo sapiens
caaatgtgtcagaataggaaaac

SEQ ID NO: 1255751 - DNA, 23 bp, Homo sapiens
caaatgttgacctttgaggtcta

SEQ ID NO: 1255752 - DNA, 12 bp, Homo sapiens
caaatgtttata

SEQ ID NO: 1255753 - DNA, 12 bp, Homo sapiens
caaatgtttcct

SEQ ID NO: 1255754 - DNA, 19 bp, Homo sapiens
caaatgtttccttaaacat

SEQ ID NO: 1255755 - DNA, 21 bp, Homo sapiens
caaatgtttccttaaacatga

SEQ ID NO: 1255756 - DNA, 15 bp, Homo sapiens
caaattaaaacaaat

SEQ ID NO: 1255757 - DNA, 19 bp, Homo sapiens
caaattaaaacaaatatac

SEQ ID NO: 1255758 - DNA, 23 bp, Homo sapiens
caaattaaaacaaatatacattt

SEQ ID NO: 1255759 - DNA, 13 bp, Homo sapiens
caaattaaaacat

SEQ ID NO: 1255760 - DNA, 23 bp, Homo sapiens
caaattaaaacatatttcatttt

SEQ ID NO: 1255761 - DNA, 15 bp, Homo sapiens
caaattaataatctt

SEQ ID NO: 1255762 - DNA, 16 bp, Homo sapiens
caaattaataatctta

SEQ ID NO: 1255763 - DNA, 15 bp, Homo sapiens
caaattaatctttct

SEQ ID NO: 1255764 - DNA, 11 bp, Homo sapiens
caaattagaaa

SEQ ID NO: 1255765 - DNA, 13 bp, Homo sapiens
caaattagaaaat

SEQ ID NO: 1255766 - DNA, 12 bp, Homo sapiens
caaattagaaac

SEQ ID NO: 1255767 - DNA, 23 bp, Homo sapiens
caaattagaaacaccattcatct

SEQ ID NO: 1255768 - DNA, 19 bp, Homo sapiens
caaattataagggccctgc

SEQ ID NO: 1255769 - DNA, 20 bp, Homo sapiens
caaattatatgctaattaaa

SEQ ID NO: 1255770 - DNA, 13 bp, Homo sapiens
caaattatatttg

SEQ ID NO: 1255771 - DNA, 22 bp, Homo sapiens
caaattatcttgatacattcaa

SEQ ID NO: 1255772 - DNA, 23 bp, Homo sapiens
caacctcactgccctccctcggc

SEQ ID NO: 1255773 - DNA, 18 bp, Homo sapiens
caacctcagggctcccag

SEQ ID NO: 1255774 - DNA, 19 bp, Homo sapiens
caacctcagggctcccagg

SEQ ID NO: 1255775 - DNA, 15 bp, Homo sapiens
caacctcagtaattt

SEQ ID NO: 1255776 - DNA, 14 bp, Homo sapiens
caacctcattgaca

SEQ ID NO: 1255777 - DNA, 20 bp, Homo sapiens
caacctccaactccctggtt

SEQ ID NO: 1255778 - DNA, 21 bp, Homo sapiens
caacctctcggccccatcgcc

SEQ ID NO: 1255779 - DNA, 23 bp, Homo sapiens
caacctctctgatcttgtgctca

SEQ ID NO: 1255780 - DNA, 18 bp, Homo sapiens
caacctcttctggctcaa

SEQ ID NO: 1255781 - DNA, 16 bp, Homo sapiens
caacctgaaatttatt

SEQ ID NO: 1255782 - DNA, 12 bp, Homo sapiens
caacctgaacct

SEQ ID NO: 1255783 - DNA, 17 bp, Homo sapiens
caacctgaatctttttt

SEQ ID NO: 1255784 - DNA, 21 bp, Homo sapiens
caacctgcctgacatttggag

SEQ ID NO: 1255785 - DNA, 14 bp, Homo sapiens
caacctgcctgtgc

SEQ ID NO: 1255786 - DNA, 17 bp, Homo sapiens
caacctgcctgtgcatg

SEQ ID NO: 1255787 - DNA, 23 bp, Homo sapiens
caacctgctctcctcttgccact

SEQ ID NO: 1255788 - DNA, 12 bp, Homo sapiens
caacctgctctg

SEQ ID NO: 1255789 - DNA, 18 bp, Homo sapiens
caacctgctctgtcccca

SEQ ID NO: 1255790 - DNA, 15 bp, Homo sapiens
caacctgtggctcag

SEQ ID NO: 1255791 - DNA, 19 bp, Homo sapiens
caacctgtggggtctgatg

SEQ ID NO: 1255792 - DNA, 18 bp, Homo sapiens
caacctgtgtgagagaat

SEQ ID NO: 1255793 - DNA, 22 bp, Homo sapiens
caacctgttacctactttgact

SEQ ID NO: 1255794 - DNA, 21 bp, Homo sapiens
caacctgttcttagagtgtag

SEQ ID NO: 1255795 - DNA, 21 bp, Homo sapiens
caaccttgtttattaaattgc

SEQ ID NO: 1255796 - DNA, 17 bp, Homo sapiens
caacctttcacctttgt

SEQ ID NO: 1255797 - DNA, 21 bp, Homo sapiens
caacctttcacctttgtgtat

SEQ ID NO: 1255798 - DNA, 22 bp, Homo sapiens
caacctttgtgtggctcctggt

SEQ ID NO: 1255799 - DNA, 13 bp, Homo sapiens
caacgaagaaaaa

SEQ ID NO: 1255800 - DNA, 13 bp, Homo sapiens
caacgagacacat

SEQ ID NO: 1255801 - DNA, 17 bp, Homo sapiens
caacgagacacattgcc

SEQ ID NO: 1255802 - DNA, 19 bp, Homo sapiens
caacgagacacattgcctt

SEQ ID NO: 1255803 - DNA, 20 bp, Homo sapiens
caacgagacacattgccttc

SEQ ID NO: 1255804 - DNA, 13 bp, Homo sapiens
caacgagcctcct

SEQ ID NO: 1255805 - DNA, 15 bp, Homo sapiens
caacgagcctcctca

SEQ ID NO: 1255806 - DNA, 15 bp, Homo sapiens
caacgcacaaatgac

SEQ ID NO: 1255807 - DNA, 21 bp, Homo sapiens
caacgcccctccaaacctcca

SEQ ID NO: 1255808 - DNA, 12 bp, Homo sapiens
caacgcccctgt

SEQ ID NO: 1255809 - DNA, 17 bp, Homo sapiens
caacgcccctgtggcca

SEQ ID NO: 1255810 - DNA, 22 bp, Homo sapiens
caacgcccctgtggccaactgc

SEQ ID NO: 1255811 - DNA, 18 bp, Homo sapiens
caacgccgagtgcactgc

SEQ ID NO: 1255812 - DNA, 20 bp, Homo sapiens
caacggaaagtgctgtctta

SEQ ID NO: 1255813 - DNA, 21 bp, Homo sapiens
caacggcccatagccttgggg

SEQ ID NO: 1255814 - DNA, 19 bp, Homo sapiens
caacggccctgcagccagc

SEQ ID NO: 1255815 - DNA, 20 bp, Homo sapiens
caacggccctgcagccagct

SEQ ID NO: 1255816 - DNA, 20 bp, Homo sapiens
caacggggtggggagggtga

SEQ ID NO: 1255817 - DNA, 15 bp, Homo sapiens
caacgtagcctgggc

SEQ ID NO: 1255818 - DNA, 19 bp, Homo sapiens
caacgtgggcttaaagcag

SEQ ID NO: 1255819 - DNA, 16 bp, Homo sapiens
caacgttactcagggc

SEQ ID NO: 1255820 - DNA, 17 bp, Homo sapiens
caactaaataacacaga

SEQ ID NO: 1255821 - DNA, 14 bp, Homo sapiens
caactaaggacaaa

SEQ ID NO: 1255822 - DNA, 17 bp, Homo sapiens
caactaattcaataaaa

SEQ ID NO: 1255823 - DNA, 17 bp, Homo sapiens
caactaattttatttct

SEQ ID NO: 1255824 - DNA, 18 bp, Homo sapiens
caactaattttatttcta

SEQ ID NO: 1255825 - DNA, 12 bp, Homo sapiens
caactagatttg

SEQ ID NO: 1255826 - DNA, 13 bp, Homo sapiens
caactagatttgt

SEQ ID NO: 1255827 - DNA, 19 bp, Homo sapiens
caactaggtatttaagact

SEQ ID NO: 1255828 - DNA, 15 bp, Homo sapiens
caactatccaagtgt

SEQ ID NO: 1255829 - DNA, 22 bp, Homo sapiens
caactatgatatggtaaaagtt

SEQ ID NO: 1255830 - DNA, 16 bp, Homo sapiens
caactcaaagatgatg

SEQ ID NO: 1255831 - DNA, 14 bp, Homo sapiens
caactcagcttcgg

SEQ ID NO: 1255832 - DNA, 13 bp, Homo sapiens
caactcatcattt

SEQ ID NO: 1255833 - DNA, 16 bp, Homo sapiens
caactcatcattttct

SEQ ID NO: 1255834 - DNA, 17 bp, Homo sapiens
caactccaacctctcgg

SEQ ID NO: 1255835 - DNA, 13 bp, Homo sapiens
caactccagcaac

SEQ ID NO: 1255836 - DNA, 22 bp, Homo sapiens
caactcccttaaggtctccaaa

SEQ ID NO: 1255837 - DNA, 12 bp, Homo sapiens
caactcctgatg

SEQ ID NO: 1255838 - DNA, 14 bp, Homo sapiens
caactcctggaagc

SEQ ID NO: 1255839 - DNA, 12 bp, Homo sapiens
caactcctggct

SEQ ID NO: 1255840 - DNA, 18 bp, Homo sapiens
caactccttttactgcgt

SEQ ID NO: 1255841 - DNA, 14 bp, Homo sapiens
caactcgctttagg

SEQ ID NO: 1255842 - DNA, 15 bp, Homo sapiens
caactcgggctcccg

SEQ ID NO: 1255843 - DNA, 21 bp, Homo sapiens
caactcgggggcgcctggagg

SEQ ID NO: 1255844 - DNA, 18 bp, Homo sapiens
caactctcactcctgaat

SEQ ID NO: 1255845 - DNA, 16 bp, Homo sapiens
caactctccactccat

SEQ ID NO: 1255846 - DNA, 19 bp, Homo sapiens
caactctccccagtgcctg

SEQ ID NO: 1255847 - DNA, 20 bp, Homo sapiens
caactctccccagtgcctgc

SEQ ID NO: 1255848 - DNA, 18 bp, Homo sapiens
caactctcccctgacctg

SEQ ID NO: 1255849 - DNA, 24 bp, Homo sapiens
caactctcccctgacctgtgagcc

SEQ ID NO: 1255850 - DNA, 16 bp, Homo sapiens
caactctgagcccata

SEQ ID NO: 1255851 - DNA, 14 bp, Homo sapiens
caactctgcactcc

SEQ ID NO: 1255852 - DNA, 13 bp, Homo sapiens
caactctgccttt

SEQ ID NO: 1255853 - DNA, 16 bp, Homo sapiens
caactcttcctcccct

SEQ ID NO: 1255854 - DNA, 19 bp, Homo sapiens
caactcttcctcccctctc

SEQ ID NO: 1255855 - DNA, 14 bp, Homo sapiens
caactctttgttat

SEQ ID NO: 1255856 - DNA, 13 bp, Homo sapiens
caactgaaaagac

SEQ ID NO: 1255857 - DNA, 23 bp, Homo sapiens
caactgaacgaccttacaaatga

SEQ ID NO: 1255858 - DNA, 23 bp, Homo sapiens
caactgaagccttcttctgccac

SEQ ID NO: 1255859 - DNA, 24 bp, Homo sapiens
caactgaagccttcttctgccact

SEQ ID NO: 1255860 - DNA, 21 bp, Homo sapiens
caactgaaggctaaaaagcaa

SEQ ID NO: 1255861 - DNA, 14 bp, Homo sapiens
caactgaaggggtg

SEQ ID NO: 1255862 - DNA, 15 bp, Homo sapiens
caactgacctgccag

SEQ ID NO: 1255863 - DNA, 19 bp, Homo sapiens
caactgagagtcatataca

SEQ ID NO: 1255864 - DNA, 14 bp, Homo sapiens
caactgaggcagac

SEQ ID NO: 1255865 - DNA, 19 bp, Homo sapiens
caactgattttgtatgtaa

SEQ ID NO: 1255866 - DNA, 20 bp, Homo sapiens
caactgattttgtatgtaaa

SEQ ID NO: 1255867 - DNA, 11 bp, Homo sapiens
caactgcacaa

SEQ ID NO: 1255868 - DNA, 15 bp, Homo sapiens
caactgcacatgaaa

SEQ ID NO: 1255869 - DNA, 12 bp, Homo sapiens
caactgccccag

SEQ ID NO: 1255870 - DNA, 13 bp, Homo sapiens
caactgccccagg

SEQ ID NO: 1255871 - DNA, 13 bp, Homo sapiens
caactgcccttcc

SEQ ID NO: 1255872 - DNA, 13 bp, Homo sapiens
caactgcctcagc

SEQ ID NO: 1255873 - DNA, 20 bp, Homo sapiens
caactgctaatgcaaattaa

SEQ ID NO: 1255874 - DNA, 13 bp, Homo sapiens
caactggacaaga

SEQ ID NO: 1255875 - DNA, 18 bp, Homo sapiens
caactggacaagatttcc

SEQ ID NO: 1255876 - DNA, 18 bp, Homo sapiens
caactggccctatttaga

SEQ ID NO: 1255877 - DNA, 13 bp, Homo sapiens
caactggctgaaa

SEQ ID NO: 1255878 - DNA, 15 bp, Homo sapiens
caactggctggccag

SEQ ID NO: 1255879 - DNA, 18 bp, Homo sapiens
caactggttagtgtgaaa

SEQ ID NO: 1255880 - DNA, 15 bp, Homo sapiens
caactgtaaagcaaa

SEQ ID NO: 1255881 - DNA, 13 bp, Homo sapiens
caactgtatatat

SEQ ID NO: 1255882 - DNA, 22 bp, Homo sapiens
caactgtgtgattaaaaggtat

SEQ ID NO: 1255883 - DNA, 12 bp, Homo sapiens
caactgtgttgt

SEQ ID NO: 1255884 - DNA, 14 bp, Homo sapiens
caactgtgttgtat

SEQ ID NO: 1255885 - DNA, 19 bp, Homo sapiens
caactgtgttgtattaaca

SEQ ID NO: 1255886 - DNA, 21 bp, Homo sapiens
caactgtgttgtattaacaaa

SEQ ID NO: 1255887 - DNA, 22 bp, Homo sapiens
caactgtgttgtattaacaaaa

SEQ ID NO: 1255888 - DNA, 15 bp, Homo sapiens
caacttaacatgaaa

SEQ ID NO: 1255889 - DNA, 14 bp, Homo sapiens
caacttaacatggg

SEQ ID NO: 1255890 - DNA, 21 bp, Homo sapiens
caacttaatgttctgaataat

SEQ ID NO: 1255891 - DNA, 18 bp, Homo sapiens
caacttacaaaaacactt

SEQ ID NO: 1255892 - DNA, 14 bp, Homo sapiens
caacttagctcagg

SEQ ID NO: 1255893 - DNA, 20 bp, Homo sapiens
caacttagctcaggtgcctt

SEQ ID NO: 1255894 - DNA, 23 bp, Homo sapiens
caaggccctcggagctggctgtg

SEQ ID NO: 1255895 - DNA, 21 bp, Homo sapiens
caaggccgaagctctggctga

SEQ ID NO: 1255896 - DNA, 23 bp, Homo sapiens
caaggccgaagctctggctgaac

SEQ ID NO: 1255897 - DNA, 19 bp, Homo sapiens
caaggccgagggccaggca

SEQ ID NO: 1255898 - DNA, 13 bp, Homo sapiens
caaggccgcggcc

SEQ ID NO: 1255899 - DNA, 15 bp, Homo sapiens
caaggccgcggccca

SEQ ID NO: 1255900 - DNA, 17 bp, Homo sapiens
caaggccgcggcccaga

SEQ ID NO: 1255901 - DNA, 19 bp, Homo sapiens
caaggccgctgttcaccca

SEQ ID NO: 1255902 - DNA, 23 bp, Homo sapiens
caaggcctccccaatccaggcca

SEQ ID NO: 1255903 - DNA, 12 bp, Homo sapiens
caaggcctctca

SEQ ID NO: 1255904 - DNA, 17 bp, Homo sapiens
caaggcctctcacccca

SEQ ID NO: 1255905 - DNA, 21 bp, Homo sapiens
caaggcctggtgtttcttgat

SEQ ID NO: 1255906 - DNA, 22 bp, Homo sapiens
caaggcctggtgtttcttgata

SEQ ID NO: 1255907 - DNA, 21 bp, Homo sapiens
caaggcctgtcagctaaagaa

SEQ ID NO: 1255908 - DNA, 22 bp, Homo sapiens
caaggccttcagtttatttcca

SEQ ID NO: 1255909 - DNA, 14 bp, Homo sapiens
caaggccttctcct

SEQ ID NO: 1255910 - DNA, 19 bp, Homo sapiens
caaggccttggtggagcag

SEQ ID NO: 1255911 - DNA, 20 bp, Homo sapiens
caaggccttggtggagcagc

SEQ ID NO: 1255912 - DNA, 13 bp, Homo sapiens
caaggcctttcct

SEQ ID NO: 1255913 - DNA, 19 bp, Homo sapiens
caaggcgggagcatctctt

SEQ ID NO: 1255914 - DNA, 22 bp, Homo sapiens
caaggcgtccgcgcgccagcac

SEQ ID NO: 1255915 - DNA, 15 bp, Homo sapiens
caaggctcactgcag

SEQ ID NO: 1255916 - DNA, 18 bp, Homo sapiens
caaggctcactgcagcgc

SEQ ID NO: 1255917 - DNA, 14 bp, Homo sapiens
caaggctctcccct

SEQ ID NO: 1255918 - DNA, 15 bp, Homo sapiens
caaggctctcccctc

SEQ ID NO: 1255919 - DNA, 20 bp, Homo sapiens
caaggctgaccaagagagaa

SEQ ID NO: 1255920 - DNA, 11 bp, Homo sapiens
caaggctgact

SEQ ID NO: 1255921 - DNA, 17 bp, Homo sapiens
caaggctgcagtgagcc

SEQ ID NO: 1255922 - DNA, 22 bp, Homo sapiens
caaggctgcagtgagccgagat

SEQ ID NO: 1255923 - DNA, 23 bp, Homo sapiens
caaggctggccagcaaggcaggt

SEQ ID NO: 1255924 - DNA, 13 bp, Homo sapiens
caaggctggggca

SEQ ID NO: 1255925 - DNA, 15 bp, Homo sapiens
caaggctggggcatg

SEQ ID NO: 1255926 - DNA, 22 bp, Homo sapiens
caaggctgggtaatgtgaaggc

SEQ ID NO: 1255927 - DNA, 20 bp, Homo sapiens
caagggaaaggggtgctttt

SEQ ID NO: 1255928 - DNA, 16 bp, Homo sapiens
caagggaacctgtgtc

SEQ ID NO: 1255929 - DNA, 15 bp, Homo sapiens
caagggacagcaagt

SEQ ID NO: 1255930 - DNA, 20 bp, Homo sapiens
caagggacagcaagtgagca

SEQ ID NO: 1255931 - DNA, 20 bp, Homo sapiens
caagggacaggtgggcctgg

SEQ ID NO: 1255932 - DNA, 21 bp, Homo sapiens
caagggacaggtgggcctggc

SEQ ID NO: 1255933 - DNA, 13 bp, Homo sapiens
caagggacctgct

SEQ ID NO: 1255934 - DNA, 10 bp, Homo sapiens
caagggagaa

SEQ ID NO: 1255935 - DNA, 18 bp, Homo sapiens
caagggagaaaagagaaa

SEQ ID NO: 1255936 - DNA, 16 bp, Homo sapiens
caagggaggcagtggc

SEQ ID NO: 1255937 - DNA, 15 bp, Homo sapiens
caagggagggaaggg

SEQ ID NO: 1255938 - DNA, 18 bp, Homo sapiens
caagggagggaagggcca

SEQ ID NO: 1255939 - DNA, 19 bp, Homo sapiens
caagggagggaagggccac

SEQ ID NO: 1255940 - DNA, 15 bp, Homo sapiens
caagggatggcacca

SEQ ID NO: 1255941 - DNA, 16 bp, Homo sapiens
caagggatggcaccac

SEQ ID NO: 1255942 - DNA, 22 bp, Homo sapiens
caagggatggcaccacttattt

SEQ ID NO: 1255943 - DNA, 20 bp, Homo sapiens
caagggcacaaactgcagct

SEQ ID NO: 1255944 - DNA, 21 bp, Homo sapiens
caagggcacaaactgcagctg

SEQ ID NO: 1255945 - DNA, 16 bp, Homo sapiens
caagggcatcaggcac

SEQ ID NO: 1255946 - DNA, 20 bp, Homo sapiens
caagggcatcaggcactggt

SEQ ID NO: 1255947 - DNA, 18 bp, Homo sapiens
caagggccaaacccactt

SEQ ID NO: 1255948 - DNA, 14 bp, Homo sapiens
caagggccatgctg

SEQ ID NO: 1255949 - DNA, 16 bp, Homo sapiens
caagggccccaggggc

SEQ ID NO: 1255950 - DNA, 21 bp, Homo sapiens
caagggccgtgcccttgccct

SEQ ID NO: 1255951 - DNA, 14 bp, Homo sapiens
caagggctccagca

SEQ ID NO: 1255952 - DNA, 20 bp, Homo sapiens
caagggctccagcatccagc

SEQ ID NO: 1255953 - DNA, 23 bp, Homo sapiens
caagggctccagcatccagcctg

SEQ ID NO: 1255954 - DNA, 14 bp, Homo sapiens
caagggctgtaggt

SEQ ID NO: 1255955 - DNA, 21 bp, Homo sapiens
caagggcttacacgtggagga

SEQ ID NO: 1255956 - DNA, 18 bp, Homo sapiens
caagggcttctgcaccct

SEQ ID NO: 1255957 - DNA, 23 bp, Homo sapiens
caagggcttctgcaccctccacc

SEQ ID NO: 1255958 - DNA, 19 bp, Homo sapiens
caaggggagtcaccttccc

SEQ ID NO: 1255959 - DNA, 15 bp, Homo sapiens
caaggggcagggagg

SEQ ID NO: 1255960 - DNA, 18 bp, Homo sapiens
caaggggcccaaattctt

SEQ ID NO: 1255961 - DNA, 22 bp, Homo sapiens
caaggggcccttggagcgtgga

SEQ ID NO: 1255962 - DNA, 14 bp, Homo sapiens
caaggggctgcgct

SEQ ID NO: 1255963 - DNA, 22 bp, Homo sapiens
caaggggctgcgctagcagccc

SEQ ID NO: 1255964 - DNA, 12 bp, Homo sapiens
caagggggcggg

SEQ ID NO: 1255965 - DNA, 22 bp, Homo sapiens
caagggggcggggactgctggc

SEQ ID NO: 1255966 - DNA, 12 bp, Homo sapiens
caagggggtgac

SEQ ID NO: 1255967 - DNA, 19 bp, Homo sapiens
caagggtatgggaagccat

SEQ ID NO: 1255968 - DNA, 23 bp, Homo sapiens
caagggtcattatgggttaggca

SEQ ID NO: 1255969 - DNA, 13 bp, Homo sapiens
caagggtgcctca

SEQ ID NO: 1255970 - DNA, 12 bp, Homo sapiens
caagggtggcag

SEQ ID NO: 1255971 - DNA, 21 bp, Homo sapiens
caagggtggcatcccagtggc

SEQ ID NO: 1255972 - DNA, 19 bp, Homo sapiens
caagggttcagagactcag

SEQ ID NO: 1255973 - DNA, 20 bp, Homo sapiens
caagggttggaggcaatgtg

SEQ ID NO: 1255974 - DNA, 23 bp, Homo sapiens
caagggtttcgactggtccagct

SEQ ID NO: 1255975 - DNA, 14 bp, Homo sapiens
caaggtactctggt

SEQ ID NO: 1255976 - DNA, 16 bp, Homo sapiens
caaggtactctggtga

SEQ ID NO: 1255977 - DNA, 15 bp, Homo sapiens
caaggtagccatccc

SEQ ID NO: 1255978 - DNA, 20 bp, Homo sapiens
caaggtaggctgcaaaatta

SEQ ID NO: 1255979 - DNA, 22 bp, Homo sapiens
caaggtatttctccagttggga

SEQ ID NO: 1255980 - DNA, 15 bp, Homo sapiens
caaggtcactcttgg

SEQ ID NO: 1255981 - DNA, 16 bp, Homo sapiens
caaggtcactcttggt

SEQ ID NO: 1255982 - DNA, 20 bp, Homo sapiens
caaggtcacttaaagggtct

SEQ ID NO: 1255983 - DNA, 13 bp, Homo sapiens
caaggtcagggag

SEQ ID NO: 1255984 - DNA, 22 bp, Homo sapiens
caaggtcagggaggggcaacca

SEQ ID NO: 1255985 - DNA, 14 bp, Homo sapiens
caaggtcatcaaac

SEQ ID NO: 1255986 - DNA, 14 bp, Homo sapiens
caaggtcatttttt

SEQ ID NO: 1255987 - DNA, 20 bp, Homo sapiens
caaggtcattttttttaaga

SEQ ID NO: 1255988 - DNA, 21 bp, Homo sapiens
caaggtccactccctgctcca

SEQ ID NO: 1255989 - DNA, 23 bp, Homo sapiens
caaggtccccccaccgctcagtg

SEQ ID NO: 1255990 - DNA, 16 bp, Homo sapiens
caaggtcccctccaca

SEQ ID NO: 1255991 - DNA, 20 bp, Homo sapiens
caaggtcctctgtcagtcac

SEQ ID NO: 1255992 - DNA, 15 bp, Homo sapiens
caaggtcctgctcaa

SEQ ID NO: 1255993 - DNA, 16 bp, Homo sapiens
caaggtcggtaagttg

SEQ ID NO: 1255994 - DNA, 18 bp, Homo sapiens
caaggtgcatatagaaaa

SEQ ID NO: 1255995 - DNA, 20 bp, Homo sapiens
caaggtgcatatagaaaaca

SEQ ID NO: 1255996 - DNA, 12 bp, Homo sapiens
caaggtgctaac

SEQ ID NO: 1255997 - DNA, 12 bp, Homo sapiens
caaggtggcaga

SEQ ID NO: 1255998 - DNA, 15 bp, Homo sapiens
caaggtggcagatgt

SEQ ID NO: 1255999 - DNA, 23 bp, Homo sapiens
caaggtggcagatgtcttccctg

SEQ ID NO: 1256000 - DNA, 17 bp, Homo sapiens
caaggtggccaaattat

SEQ ID NO: 1256001 - DNA, 16 bp, Homo sapiens
caaggtggcctctgcc

SEQ ID NO: 1256002 - DNA, 19 bp, Homo sapiens
caaggtggcctctgcctgg

SEQ ID NO: 1256003 - DNA, 12 bp, Homo sapiens
caaggtgggagg

SEQ ID NO: 1256004 - DNA, 22 bp, Homo sapiens
caaggtgggccttgctacctca

SEQ ID NO: 1256005 - DNA, 16 bp, Homo sapiens
caaggtgggctgagcc

SEQ ID NO: 1256006 - DNA, 18 bp, Homo sapiens
caaggtgggctgagccct

SEQ ID NO: 1256007 - DNA, 22 bp, Homo sapiens
caaggtggggggatcacaaggt

SEQ ID NO: 1256008 - DNA, 17 bp, Homo sapiens
caaggtggtgtgatctt

SEQ ID NO: 1256009 - DNA, 13 bp, Homo sapiens
caaggtgtccagg

SEQ ID NO: 1256010 - DNA, 17 bp, Homo sapiens
caaggtgtccagggtcc

SEQ ID NO: 1256011 - DNA, 12 bp, Homo sapiens
caaggtgtcttt

SEQ ID NO: 1256012 - DNA, 17 bp, Homo sapiens
caaggttatatgaatat

SEQ ID NO: 1256013 - DNA, 21 bp, Homo sapiens
caaggttatatgcactttctc

SEQ ID NO: 1256014 - DNA, 14 bp, Homo sapiens
caaggttccagagg

SEQ ID NO: 1256015 - DNA, 17 bp, Homo sapiens
caataacccagttactt

SEQ ID NO: 1256016 - DNA, 22 bp, Homo sapiens
caataactactgtgttcctggc

SEQ ID NO: 1256017 - DNA, 18 bp, Homo sapiens
caataactatttttcctc

SEQ ID NO: 1256018 - DNA, 17 bp, Homo sapiens
caataacttctatattt

SEQ ID NO: 1256019 - DNA, 14 bp, Homo sapiens
caataagaaaatgt

SEQ ID NO: 1256020 - DNA, 13 bp, Homo sapiens
caataagaaatga

SEQ ID NO: 1256021 - DNA, 14 bp, Homo sapiens
caataagaaatgaa

SEQ ID NO: 1256022 - DNA, 17 bp, Homo sapiens
caataagaaatgaacaa

SEQ ID NO: 1256023 - DNA, 13 bp, Homo sapiens
caataagacatgc

SEQ ID NO: 1256024 - DNA, 19 bp, Homo sapiens
caataagctggactagtgt

SEQ ID NO: 1256025 - DNA, 21 bp, Homo sapiens
caataagtgtgtggtagaaac

SEQ ID NO: 1256026 - DNA, 20 bp, Homo sapiens
caataataaaaaacaagaaa

SEQ ID NO: 1256027 - DNA, 14 bp, Homo sapiens
caataatatatttt

SEQ ID NO: 1256028 - DNA, 18 bp, Homo sapiens
caataatatattttctgt

SEQ ID NO: 1256029 - DNA, 20 bp, Homo sapiens
caataatatattttctgttt

SEQ ID NO: 1256030 - DNA, 20 bp, Homo sapiens
caataatggtcccatccagg

SEQ ID NO: 1256031 - DNA, 23 bp, Homo sapiens
caataatggtcccatccaggcag

SEQ ID NO: 1256032 - DNA, 22 bp, Homo sapiens
caataatttcaggttttgtaaa

SEQ ID NO: 1256033 - DNA, 15 bp, Homo sapiens
caataatttgtacaa

SEQ ID NO: 1256034 - DNA, 14 bp, Homo sapiens
caatacaaagatga

SEQ ID NO: 1256035 - DNA, 13 bp, Homo sapiens
caatacaaatgga

SEQ ID NO: 1256036 - DNA, 14 bp, Homo sapiens
caatacaaatggat

SEQ ID NO: 1256037 - DNA, 16 bp, Homo sapiens
caatacaaatggattt

SEQ ID NO: 1256038 - DNA, 21 bp, Homo sapiens
caatacaaatggattttggga

SEQ ID NO: 1256039 - DNA, 14 bp, Homo sapiens
caatacaactttac

SEQ ID NO: 1256040 - DNA, 21 bp, Homo sapiens
caatacaactttaccataaag

SEQ ID NO: 1256041 - DNA, 15 bp, Homo sapiens
caatacaatgtacaa

SEQ ID NO: 1256042 - DNA, 18 bp, Homo sapiens
caatacaatgtacaatta

SEQ ID NO: 1256043 - DNA, 19 bp, Homo sapiens
caatacaatgtacaattat

SEQ ID NO: 1256044 - DNA, 21 bp, Homo sapiens
caatacaatgtacaattatgt

SEQ ID NO: 1256045 - DNA, 22 bp, Homo sapiens
caatacacataagaccgtgtcc

SEQ ID NO: 1256046 - DNA, 17 bp, Homo sapiens
caatacactagttgttt

SEQ ID NO: 1256047 - DNA, 14 bp, Homo sapiens
caatacagcttcat

SEQ ID NO: 1256048 - DNA, 22 bp, Homo sapiens
caatacatatatctacacatac

SEQ ID NO: 1256049 - DNA, 17 bp, Homo sapiens
caatacatgctgctaat

SEQ ID NO: 1256050 - DNA, 17 bp, Homo sapiens
caatacatttgatttgt

SEQ ID NO: 1256051 - DNA, 17 bp, Homo sapiens
caataccctactgtggg

SEQ ID NO: 1256052 - DNA, 17 bp, Homo sapiens
caataccctagaagaaa

SEQ ID NO: 1256053 - DNA, 20 bp, Homo sapiens
caataccctagaagaaaacc

SEQ ID NO: 1256054 - DNA, 22 bp, Homo sapiens
caatacccttttaagtttaaaa

SEQ ID NO: 1256055 - DNA, 18 bp, Homo sapiens
caataccgctcagtattt

SEQ ID NO: 1256056 - DNA, 16 bp, Homo sapiens
caatacctgtactatg

SEQ ID NO: 1256057 - DNA, 21 bp, Homo sapiens
caatactaagaataacaagaa

SEQ ID NO: 1256058 - DNA, 21 bp, Homo sapiens
caatactgtatgccttctgta

SEQ ID NO: 1256059 - DNA, 17 bp, Homo sapiens
caatacttttgtccaat

SEQ ID NO: 1256060 - DNA, 22 bp, Homo sapiens
caatacttttgtccaatgtggt

SEQ ID NO: 1256061 - DNA, 23 bp, Homo sapiens
caatagaaactcaccatgtaaaa

SEQ ID NO: 1256062 - DNA, 15 bp, Homo sapiens
caatagaaagaaact

SEQ ID NO: 1256063 - DNA, 16 bp, Homo sapiens
caatagatctccagcg

SEQ ID NO: 1256064 - DNA, 21 bp, Homo sapiens
caatagatttaggagcagaaa

SEQ ID NO: 1256065 - DNA, 17 bp, Homo sapiens
caatagcacatatggaa

SEQ ID NO: 1256066 - DNA, 17 bp, Homo sapiens
caatagccactaacctt

SEQ ID NO: 1256067 - DNA, 24 bp, Homo sapiens
caatagccactaaccttgcctggt

SEQ ID NO: 1256068 - DNA, 23 bp, Homo sapiens
caatagccgatatcagaatttgt

SEQ ID NO: 1256069 - DNA, 16 bp, Homo sapiens
caatagcgtgtgtaga

SEQ ID NO: 1256070 - DNA, 17 bp, Homo sapiens
caataggcaaattaatc

SEQ ID NO: 1256071 - DNA, 15 bp, Homo sapiens
caatagggttaaatg

SEQ ID NO: 1256072 - DNA, 17 bp, Homo sapiens
caataggtctttctctc

SEQ ID NO: 1256073 - DNA, 18 bp, Homo sapiens
caataggtctttctctca

SEQ ID NO: 1256074 - DNA, 17 bp, Homo sapiens
caatagtattacccatg

SEQ ID NO: 1256075 - DNA, 14 bp, Homo sapiens
caatagtgtgttct

SEQ ID NO: 1256076 - DNA, 23 bp, Homo sapiens
caatataaaaggcaaatgtgtac

SEQ ID NO: 1256077 - DNA, 22 bp, Homo sapiens
caatataagcataaaagatcac

SEQ ID NO: 1256078 - DNA, 22 bp, Homo sapiens
caatatacaactgtaaagcaaa

SEQ ID NO: 1256079 - DNA, 16 bp, Homo sapiens
caatatattaccagca

SEQ ID NO: 1256080 - DNA, 15 bp, Homo sapiens
caatatattgaactt

SEQ ID NO: 1256081 - DNA, 16 bp, Homo sapiens
caatatcaatcacatt

SEQ ID NO: 1256082 - DNA, 13 bp, Homo sapiens
caatatcatgtct

SEQ ID NO: 1256083 - DNA, 18 bp, Homo sapiens
caatatcccaacattctg

SEQ ID NO: 1256084 - DNA, 19 bp, Homo sapiens
caatatcccaacattctgc

SEQ ID NO: 1256085 - DNA, 20 bp, Homo sapiens
caatatcccaacattctgca

SEQ ID NO: 1256086 - DNA, 19 bp, Homo sapiens
caatatccctcttgtaagt

SEQ ID NO: 1256087 - DNA, 21 bp, Homo sapiens
caatatgaattcaagaaagga

SEQ ID NO: 1256088 - DNA, 11 bp, Homo sapiens
caatatgctta

SEQ ID NO: 1256089 - DNA, 12 bp, Homo sapiens
caatatgtatgc

SEQ ID NO: 1256090 - DNA, 21 bp, Homo sapiens
caatatgtatgctttttacct

SEQ ID NO: 1256091 - DNA, 21 bp, Homo sapiens
caatatgtattgtaaacatgt

SEQ ID NO: 1256092 - DNA, 16 bp, Homo sapiens
caatatgtgagtgcct

SEQ ID NO: 1256093 - DNA, 14 bp, Homo sapiens
caatattaaataca

SEQ ID NO: 1256094 - DNA, 15 bp, Homo sapiens
caatattaaatacag

SEQ ID NO: 1256095 - DNA, 22 bp, Homo sapiens
caatattaaatacagacactaa

SEQ ID NO: 1256096 - DNA, 15 bp, Homo sapiens
caatattaaatctgc

SEQ ID NO: 1256097 - DNA, 22 bp, Homo sapiens
caatattataatttttttcaat

SEQ ID NO: 1256098 - DNA, 14 bp, Homo sapiens
caatattatactaa

SEQ ID NO: 1256099 - DNA, 22 bp, Homo sapiens
caatattatactaagaaaagat

SEQ ID NO: 1256100 - DNA, 13 bp, Homo sapiens
caatattcctgaa

SEQ ID NO: 1256101 - DNA, 21 bp, Homo sapiens
caatattcctgaatgaaatat

SEQ ID NO: 1256102 - DNA, 15 bp, Homo sapiens
caatattctgtaact

SEQ ID NO: 1256103 - DNA, 12 bp, Homo sapiens
caatattgtaat

SEQ ID NO: 1256104 - DNA, 15 bp, Homo sapiens
caatattgtacagtt

SEQ ID NO: 1256105 - DNA, 19 bp, Homo sapiens
caatattgtatatttttat

SEQ ID NO: 1256106 - DNA, 16 bp, Homo sapiens
caatattgtctccctt

SEQ ID NO: 1256107 - DNA, 14 bp, Homo sapiens
caatattgtttcta

SEQ ID NO: 1256108 - DNA, 17 bp, Homo sapiens
caatatttagaaaattt

SEQ ID NO: 1256109 - DNA, 18 bp, Homo sapiens
caatatttagaaaatttt

SEQ ID NO: 1256110 - DNA, 21 bp, Homo sapiens
caatatttagaaaattttgta

SEQ ID NO: 1256111 - DNA, 14 bp, Homo sapiens
caatatttagtaaa

SEQ ID NO: 1256112 - DNA, 19 bp, Homo sapiens
caatattttctttaatgct

SEQ ID NO: 1256113 - DNA, 17 bp, Homo sapiens
caatatttttattttta

SEQ ID NO: 1256114 - DNA, 17 bp, Homo sapiens
caatcaaataagtattt

SEQ ID NO: 1256115 - DNA, 23 bp, Homo sapiens
caatcaaataagtatttataata

SEQ ID NO: 1256116 - DNA, 18 bp, Homo sapiens
caatcaaggttataattt

SEQ ID NO: 1256117 - DNA, 20 bp, Homo sapiens
caatcaaggttataattttt

SEQ ID NO: 1256118 - DNA, 16 bp, Homo sapiens
caatcaatggtgcaaa

SEQ ID NO: 1256119 - DNA, 17 bp, Homo sapiens
caatcaatggtgcaaaa

SEQ ID NO: 1256120 - DNA, 16 bp, Homo sapiens
caatcacagctcactg

SEQ ID NO: 1256121 - DNA, 22 bp, Homo sapiens
caatcacagtctcagttctctt

SEQ ID NO: 1256122 - DNA, 19 bp, Homo sapiens
caatcacgagatcttcctt

SEQ ID NO: 1256123 - DNA, 20 bp, Homo sapiens
caatcacgagatcttccttc

SEQ ID NO: 1256124 - DNA, 24 bp, Homo sapiens
caatcacgagatcttccttccgct

SEQ ID NO: 1256125 - DNA, 23 bp, Homo sapiens
caatcactattcttaagcacttt

SEQ ID NO: 1256126 - DNA, 15 bp, Homo sapiens
caatcactttttgga

SEQ ID NO: 1256127 - DNA, 14 bp, Homo sapiens
caatcagagagcct

SEQ ID NO: 1256128 - DNA, 15 bp, Homo sapiens
caatcagctccttcc

SEQ ID NO: 1256129 - DNA, 18 bp, Homo sapiens
caatcagctccttcctgg

SEQ ID NO: 1256130 - DNA, 18 bp, Homo sapiens
caatcagcttttgttcta

SEQ ID NO: 1256131 - DNA, 21 bp, Homo sapiens
caatcagcttttgttctagac

SEQ ID NO: 1256132 - DNA, 22 bp, Homo sapiens
caatcagcttttgttctagact

SEQ ID NO: 1256133 - DNA, 15 bp, Homo sapiens
caatcaggattttaa

SEQ ID NO: 1256134 - DNA, 22 bp, Homo sapiens
caatcagtcccctcccatctgg

SEQ ID NO: 1256135 - DNA, 15 bp, Homo sapiens
caatcagttgacttt

SEQ ID NO: 1256136 - DNA, 21 bp, Homo sapiens
caattgcacgcggagtgagtt

SEQ ID NO: 1256137 - DNA, 16 bp, Homo sapiens
caattgcactgctgtt

SEQ ID NO: 1256138 - DNA, 23 bp, Homo sapiens
caattgcagcagacccagcagca

SEQ ID NO: 1256139 - DNA, 22 bp, Homo sapiens
caattgctttgtcatatagctg

SEQ ID NO: 1256140 - DNA, 19 bp, Homo sapiens
caattggattggaatgcag

SEQ ID NO: 1256141 - DNA, 16 bp, Homo sapiens
caattggcagtgactt

SEQ ID NO: 1256142 - DNA, 24 bp, Homo sapiens
caattgtattttatatgagagaat

SEQ ID NO: 1256143 - DNA, 12 bp, Homo sapiens
caattgtcttaa

SEQ ID NO: 1256144 - DNA, 13 bp, Homo sapiens
caattgtcttaaa

SEQ ID NO: 1256145 - DNA, 17 bp, Homo sapiens
caattgtcttaaaacca

SEQ ID NO: 1256146 - DNA, 13 bp, Homo sapiens
caattgtcttttt

SEQ ID NO: 1256147 - DNA, 17 bp, Homo sapiens
caattgttaattgtaat

SEQ ID NO: 1256148 - DNA, 21 bp, Homo sapiens
caattgttgacagttctgaag

SEQ ID NO: 1256149 - DNA, 24 bp, Homo sapiens
caattgttgacagttctgaagaat

SEQ ID NO: 1256150 - DNA, 17 bp, Homo sapiens
caatttacaaagtgtgt

SEQ ID NO: 1256151 - DNA, 15 bp, Homo sapiens
caatttacaagagct

SEQ ID NO: 1256152 - DNA, 15 bp, Homo sapiens
caatttagcaaactg

SEQ ID NO: 1256153 - DNA, 20 bp, Homo sapiens
caatttatccattcaatcat

SEQ ID NO: 1256154 - DNA, 15 bp, Homo sapiens
caatttatgggagaa

SEQ ID NO: 1256155 - DNA, 14 bp, Homo sapiens
caatttattaaaat

SEQ ID NO: 1256156 - DNA, 23 bp, Homo sapiens
caatttattaaaatgattgtaaa

SEQ ID NO: 1256157 - DNA, 13 bp, Homo sapiens
caatttattatgg

SEQ ID NO: 1256158 - DNA, 14 bp, Homo sapiens
caatttattcaaga

SEQ ID NO: 1256159 - DNA, 17 bp, Homo sapiens
caatttattcaagaaaa

SEQ ID NO: 1256160 - DNA, 13 bp, Homo sapiens
caatttattttat

SEQ ID NO: 1256161 - DNA, 17 bp, Homo sapiens
caatttcaaattactct

SEQ ID NO: 1256162 - DNA, 11 bp, Homo sapiens
caatttcagca

SEQ ID NO: 1256163 - DNA, 22 bp, Homo sapiens
caatttccatatagtctattca

SEQ ID NO: 1256164 - DNA, 16 bp, Homo sapiens
caatttcccggagcca

SEQ ID NO: 1256165 - DNA, 19 bp, Homo sapiens
caatttcctcatctgggtc

SEQ ID NO: 1256166 - DNA, 15 bp, Homo sapiens
caatttcctctccac

SEQ ID NO: 1256167 - DNA, 16 bp, Homo sapiens
caatttcctctccact

SEQ ID NO: 1256168 - DNA, 13 bp, Homo sapiens
caatttctgaaca

SEQ ID NO: 1256169 - DNA, 15 bp, Homo sapiens
caatttctgtgttgc

SEQ ID NO: 1256170 - DNA, 15 bp, Homo sapiens
caatttcttccttcc

SEQ ID NO: 1256171 - DNA, 17 bp, Homo sapiens
caatttgacaaaaccca

SEQ ID NO: 1256172 - DNA, 20 bp, Homo sapiens
caatttgatacataataaaa

SEQ ID NO: 1256173 - DNA, 22 bp, Homo sapiens
caatttgatacataataaaaaa

SEQ ID NO: 1256174 - DNA, 19 bp, Homo sapiens
caatttgcacaatatttct

SEQ ID NO: 1256175 - DNA, 21 bp, Homo sapiens
caatttggatatttggaggag

SEQ ID NO: 1256176 - DNA, 21 bp, Homo sapiens
caatttggatttaaaagcctg

SEQ ID NO: 1256177 - DNA, 13 bp, Homo sapiens
caatttggtaaaa

SEQ ID NO: 1256178 - DNA, 22 bp, Homo sapiens
caatttggtaaaaatgctgctc

SEQ ID NO: 1256179 - DNA, 14 bp, Homo sapiens
caatttgtatatca

SEQ ID NO: 1256180 - DNA, 17 bp, Homo sapiens
caatttgtctcctactc

SEQ ID NO: 1256181 - DNA, 21 bp, Homo sapiens
caatttgttaattcctatgaa

SEQ ID NO: 1256182 - DNA, 21 bp, Homo sapiens
caattttaaagttcttatttt

SEQ ID NO: 1256183 - DNA, 17 bp, Homo sapiens
caattttaatcccctgc

SEQ ID NO: 1256184 - DNA, 21 bp, Homo sapiens
caattttaatttagtaaatgt

SEQ ID NO: 1256185 - DNA, 20 bp, Homo sapiens
caattttagtcactaagact

SEQ ID NO: 1256186 - DNA, 22 bp, Homo sapiens
caattttagtcactaagacttt

SEQ ID NO: 1256187 - DNA, 16 bp, Homo sapiens
caattttagtgtatta

SEQ ID NO: 1256188 - DNA, 22 bp, Homo sapiens
caattttagtgtattaatcata

SEQ ID NO: 1256189 - DNA, 12 bp, Homo sapiens
caattttatgta

SEQ ID NO: 1256190 - DNA, 20 bp, Homo sapiens
caattttatgtattctttct

SEQ ID NO: 1256191 - DNA, 19 bp, Homo sapiens
caattttctggaatacatg

SEQ ID NO: 1256192 - DNA, 20 bp, Homo sapiens
caattttctggaatacatga

SEQ ID NO: 1256193 - DNA, 17 bp, Homo sapiens
caattttctttgtttct

SEQ ID NO: 1256194 - DNA, 11 bp, Homo sapiens
caattttgtaa

SEQ ID NO: 1256195 - DNA, 14 bp, Homo sapiens
caatttttcccagt

SEQ ID NO: 1256196 - DNA, 19 bp, Homo sapiens
caatttttggttgaataaa

SEQ ID NO: 1256197 - DNA, 13 bp, Homo sapiens
caattttttctca

SEQ ID NO: 1256198 - DNA, 15 bp, Homo sapiens
caattttttttaatt

SEQ ID NO: 1256199 - DNA, 20 bp, Homo sapiens
caattttttttattagtatt

SEQ ID NO: 1256200 - DNA, 14 bp, Homo sapiens
cacaaaaacaaaaa

SEQ ID NO: 1256201 - DNA, 22 bp, Homo sapiens
cacaaaaaggagcgggcagggc

SEQ ID NO: 1256202 - DNA, 16 bp, Homo sapiens
cacaaaacaacaaaaa

SEQ ID NO: 1256203 - DNA, 15 bp, Homo sapiens
cacaaaacattcatg

SEQ ID NO: 1256204 - DNA, 21 bp, Homo sapiens
cacaaaacctgtattactgaa

SEQ ID NO: 1256205 - DNA, 22 bp, Homo sapiens
cacaaaactacttttctaaaat

SEQ ID NO: 1256206 - DNA, 20 bp, Homo sapiens
cacaaaactccgcccccagc

SEQ ID NO: 1256207 - DNA, 23 bp, Homo sapiens
cacaaaactccgcccccagccta

SEQ ID NO: 1256208 - DNA, 14 bp, Homo sapiens
cacaaaacttgaaa

SEQ ID NO: 1256209 - DNA, 18 bp, Homo sapiens
cacaaaagaaaaaaaact

SEQ ID NO: 1256210 - DNA, 13 bp, Homo sapiens
cacaaaaggcatc

SEQ ID NO: 1256211 - DNA, 22 bp, Homo sapiens
cacaaaataaccaatcctggac

SEQ ID NO: 1256212 - DNA, 16 bp, Homo sapiens
cacaaaattgggaaag

SEQ ID NO: 1256213 - DNA, 15 bp, Homo sapiens
cacaaacattgctgc

SEQ ID NO: 1256214 - DNA, 21 bp, Homo sapiens
cacaaacattgctgcctttgt

SEQ ID NO: 1256215 - DNA, 18 bp, Homo sapiens
cacaaaccattttatttt

SEQ ID NO: 1256216 - DNA, 18 bp, Homo sapiens
cacaaacctactgcccac

SEQ ID NO: 1256217 - DNA, 18 bp, Homo sapiens
cacaaacggagcccctga

SEQ ID NO: 1256218 - DNA, 17 bp, Homo sapiens
cacaaacgggctcagca

SEQ ID NO: 1256219 - DNA, 14 bp, Homo sapiens
cacaaactgcagct

SEQ ID NO: 1256220 - DNA, 13 bp, Homo sapiens
cacaaactgtaaa

SEQ ID NO: 1256221 - DNA, 23 bp, Homo sapiens
cacaaactgtaaataaaaagaaa

SEQ ID NO: 1256222 - DNA, 13 bp, Homo sapiens
cacaaactgtgaa

SEQ ID NO: 1256223 - DNA, 19 bp, Homo sapiens
cacaaagaaaattcctata

SEQ ID NO: 1256224 - DNA, 16 bp, Homo sapiens
cacaaagcaaaggcag

SEQ ID NO: 1256225 - DNA, 20 bp, Homo sapiens
cacaaagcttctaaagcagg

SEQ ID NO: 1256226 - DNA, 16 bp, Homo sapiens
cacaaaggtataattt

SEQ ID NO: 1256227 - DNA, 18 bp, Homo sapiens
cacaaagtaatttggaaa

SEQ ID NO: 1256228 - DNA, 16 bp, Homo sapiens
cacaaagttctcagag

SEQ ID NO: 1256229 - DNA, 23 bp, Homo sapiens
cacaaatattatttgtgtttcct

SEQ ID NO: 1256230 - DNA, 18 bp, Homo sapiens
cacaaatcaaagcaaggg

SEQ ID NO: 1256231 - DNA, 16 bp, Homo sapiens
cacaaatgtcattgtc

SEQ ID NO: 1256232 - DNA, 14 bp, Homo sapiens
cacaaatgtggagt

SEQ ID NO: 1256233 - DNA, 16 bp, Homo sapiens
cacaaattagttatat

SEQ ID NO: 1256234 - DNA, 22 bp, Homo sapiens
cacaacacacagatttgagctc

SEQ ID NO: 1256235 - DNA, 17 bp, Homo sapiens
cacaacagccctgcctg

SEQ ID NO: 1256236 - DNA, 19 bp, Homo sapiens
cacaacagccctgcctgag

SEQ ID NO: 1256237 - DNA, 23 bp, Homo sapiens
cacaacagcctgacaacatttct

SEQ ID NO: 1256238 - DNA, 14 bp, Homo sapiens
cacaacagcctggg

SEQ ID NO: 1256239 - DNA, 18 bp, Homo sapiens
cacaacccaataggagtc

SEQ ID NO: 1256240 - DNA, 17 bp, Homo sapiens
cacaaccctgttttata

SEQ ID NO: 1256241 - DNA, 17 bp, Homo sapiens
cacaaccttctgtggct

SEQ ID NO: 1256242 - DNA, 18 bp, Homo sapiens
cacaaccttctgtggctc

SEQ ID NO: 1256243 - DNA, 19 bp, Homo sapiens
cacaaccttctgtggctca

SEQ ID NO: 1256244 - DNA, 16 bp, Homo sapiens
cacaaccttgcagtat

SEQ ID NO: 1256245 - DNA, 17 bp, Homo sapiens
cacaaccttgcagtatt

SEQ ID NO: 1256246 - DNA, 23 bp, Homo sapiens
cacaacgtgggcttaaagcagaa

SEQ ID NO: 1256247 - DNA, 23 bp, Homo sapiens
cacaactcactccttttaaagaa

SEQ ID NO: 1256248 - DNA, 22 bp, Homo sapiens
cacaactgctgtggccccctgt

SEQ ID NO: 1256249 - DNA, 22 bp, Homo sapiens
cacaactgtcccgttccccgct

SEQ ID NO: 1256250 - DNA, 15 bp, Homo sapiens
cacaacttgggttct

SEQ ID NO: 1256251 - DNA, 11 bp, Homo sapiens
cacaagaaatc

SEQ ID NO: 1256252 - DNA, 20 bp, Homo sapiens
cacaagaaatttgatttcta

SEQ ID NO: 1256253 - DNA, 19 bp, Homo sapiens
cacaagaagaccagactgt

SEQ ID NO: 1256254 - DNA, 12 bp, Homo sapiens
cacaagaatcta

SEQ ID NO: 1256255 - DNA, 17 bp, Homo sapiens
cacaagaggaagagaga

SEQ ID NO: 1256256 - DNA, 18 bp, Homo sapiens
cacaagatccgtggtttg

SEQ ID NO: 1256257 - DNA, 22 bp, Homo sapiens
cacaccacgtccttattggaat

SEQ ID NO: 1256258 - DNA, 18 bp, Homo sapiens
cacaccactaaccatccc

SEQ ID NO: 1256259 - DNA, 15 bp, Homo sapiens
cacaccactgccctg

SEQ ID NO: 1256260 - DNA, 16 bp, Homo sapiens
cacaccactgttgcct

SEQ ID NO: 1256261 - DNA, 13 bp, Homo sapiens
cacaccagagaac

SEQ ID NO: 1256262 - DNA, 13 bp, Homo sapiens
cacaccagcactt

SEQ ID NO: 1256263 - DNA, 15 bp, Homo sapiens
cacaccagccgctgc

SEQ ID NO: 1256264 - DNA, 21 bp, Homo sapiens
cacaccaggctgtgggcctca

SEQ ID NO: 1256265 - DNA, 13 bp, Homo sapiens
cacacccaccctt

SEQ ID NO: 1256266 - DNA, 22 bp, Homo sapiens
cacacccaggtctcttcctttg

SEQ ID NO: 1256267 - DNA, 15 bp, Homo sapiens
cacaccccaacatgc

SEQ ID NO: 1256268 - DNA, 20 bp, Homo sapiens
cacaccccagcccaccctgc

SEQ ID NO: 1256269 - DNA, 14 bp, Homo sapiens
cacacccccagaga

SEQ ID NO: 1256270 - DNA, 15 bp, Homo sapiens
cacacccccagagag

SEQ ID NO: 1256271 - DNA, 13 bp, Homo sapiens
cacacccctgtcc

SEQ ID NO: 1256272 - DNA, 18 bp, Homo sapiens
cacacccctgtcccaccc

SEQ ID NO: 1256273 - DNA, 19 bp, Homo sapiens
cacacccgaagtcctgtca

SEQ ID NO: 1256274 - DNA, 22 bp, Homo sapiens
cacacccgaagtcctgtcactg

SEQ ID NO: 1256275 - DNA, 16 bp, Homo sapiens
cacaccctgcccctgg

SEQ ID NO: 1256276 - DNA, 15 bp, Homo sapiens
cacacctagccagct

SEQ ID NO: 1256277 - DNA, 16 bp, Homo sapiens
cacacctcacgctctg

SEQ ID NO: 1256278 - DNA, 21 bp, Homo sapiens
cacacctcagttcccttggcc

SEQ ID NO: 1256279 - DNA, 14 bp, Homo sapiens
cacacctccctgaa

SEQ ID NO: 1256280 - DNA, 17 bp, Homo sapiens
cacacctccctgaacca

SEQ ID NO: 1256281 - DNA, 14 bp, Homo sapiens
cacacctcctgcct

SEQ ID NO: 1256282 - DNA, 16 bp, Homo sapiens
cacacctctgggggga

SEQ ID NO: 1256283 - DNA, 17 bp, Homo sapiens
cacacctgaatcagctg

SEQ ID NO: 1256284 - DNA, 23 bp, Homo sapiens
cacacctgaatcagctggacata

SEQ ID NO: 1256285 - DNA, 15 bp, Homo sapiens
cacacctggccttaa

SEQ ID NO: 1256286 - DNA, 16 bp, Homo sapiens
cacacctgggcccggg

SEQ ID NO: 1256287 - DNA, 23 bp, Homo sapiens
cacacctgggcccgggcaggcca

SEQ ID NO: 1256288 - DNA, 24 bp, Homo sapiens
cacacctgggcccgggcaggccag

SEQ ID NO: 1256289 - DNA, 20 bp, Homo sapiens
cacacctgggggacagaggc

SEQ ID NO: 1256290 - DNA, 23 bp, Homo sapiens
cacaccttttattgacacagaaa

SEQ ID NO: 1256291 - DNA, 19 bp, Homo sapiens
cacacgagcaaacccagag

SEQ ID NO: 1256292 - DNA, 16 bp, Homo sapiens
cacacgagttccagac

SEQ ID NO: 1256293 - DNA, 10 bp, Homo sapiens
cacacgatgc

SEQ ID NO: 1256294 - DNA, 19 bp, Homo sapiens
cacacgatgcatttaataa

SEQ ID NO: 1256295 - DNA, 22 bp, Homo sapiens
cacacgatgcatttaataaaga

SEQ ID NO: 1256296 - DNA, 20 bp, Homo sapiens
cacacgatgttgtcaaggat

SEQ ID NO: 1256297 - DNA, 23 bp, Homo sapiens
cacacgcacacacacacacagga

SEQ ID NO: 1256298 - DNA, 13 bp, Homo sapiens
cacacgcacgcac

SEQ ID NO: 1256299 - DNA, 15 bp, Homo sapiens
cacacgcacgcacac

SEQ ID NO: 1256300 - DNA, 19 bp, Homo sapiens
cacacgcacgcacacacac

SEQ ID NO: 1256301 - DNA, 21 bp, Homo sapiens
cacacgcacgcacacacacaa

SEQ ID NO: 1256302 - DNA, 18 bp, Homo sapiens
cacacgcactgcgcctgt

SEQ ID NO: 1256303 - DNA, 21 bp, Homo sapiens
cacacgcaggaactcccagca

SEQ ID NO: 1256304 - DNA, 18 bp, Homo sapiens
cacacgcatgggcattgc

SEQ ID NO: 1256305 - DNA, 23 bp, Homo sapiens
cacacgcatgggcattgcagcct

SEQ ID NO: 1256306 - DNA, 17 bp, Homo sapiens
cacacggactcccgggc

SEQ ID NO: 1256307 - DNA, 21 bp, Homo sapiens
cacacggcagcccccccctca

SEQ ID NO: 1256308 - DNA, 20 bp, Homo sapiens
cacacggttttggcagctga

SEQ ID NO: 1256309 - DNA, 22 bp, Homo sapiens
cacacgtatttatatttggaaa

SEQ ID NO: 1256310 - DNA, 18 bp, Homo sapiens
cacacgtgctgtgggcct

SEQ ID NO: 1256311 - DNA, 15 bp, Homo sapiens
cacacgtgtgtatga

SEQ ID NO: 1256312 - DNA, 17 bp, Homo sapiens
cacactaaactctgggg

SEQ ID NO: 1256313 - DNA, 19 bp, Homo sapiens
cacactaaactctggggct

SEQ ID NO: 1256314 - DNA, 21 bp, Homo sapiens
cacactaacctgggttccctt

SEQ ID NO: 1256315 - DNA, 18 bp, Homo sapiens
cacactaatctgaaagga

SEQ ID NO: 1256316 - DNA, 18 bp, Homo sapiens
cacactaccgaatgtgtc

SEQ ID NO: 1256317 - DNA, 14 bp, Homo sapiens
cacactagaattca

SEQ ID NO: 1256318 - DNA, 17 bp, Homo sapiens
cacactagcctctccag

SEQ ID NO: 1256319 - DNA, 21 bp, Homo sapiens
cacactagggactatcaggta

SEQ ID NO: 1256320 - DNA, 17 bp, Homo sapiens
cacactcaccagtggcc

SEQ ID NO: 1256321 - DNA, 20 bp, Homo sapiens
cacactcaccagtggccttt

SEQ ID NO: 1256322 - DNA, 17 bp, Homo sapiens
cacactcaccccagcct

SEQ ID NO: 1256323 - DNA, 13 bp, Homo sapiens
cacactcagtccc

SEQ ID NO: 1256324 - DNA, 12 bp, Homo sapiens
cacactccactc

SEQ ID NO: 1256325 - DNA, 18 bp, Homo sapiens
cacactccactctgattc

SEQ ID NO: 1256326 - DNA, 14 bp, Homo sapiens
cacactcccaaggt

SEQ ID NO: 1256327 - DNA, 12 bp, Homo sapiens
cacactcctggg

SEQ ID NO: 1256328 - DNA, 21 bp, Homo sapiens
cacactcctgggctctgaaca

SEQ ID NO: 1256329 - DNA, 14 bp, Homo sapiens
cacactctaaaccc

SEQ ID NO: 1256330 - DNA, 20 bp, Homo sapiens
cacactctctgcagcccagc

SEQ ID NO: 1256331 - DNA, 19 bp, Homo sapiens
cacactgatacataaaaat

SEQ ID NO: 1256332 - DNA, 19 bp, Homo sapiens
cacactgatggctcaagac

SEQ ID NO: 1256333 - DNA, 16 bp, Homo sapiens
cacactgatgggctgg

SEQ ID NO: 1256334 - DNA, 21 bp, Homo sapiens
cacactgatgggctggggcag

SEQ ID NO: 1256335 - DNA, 17 bp, Homo sapiens
cacactgcaagagcctt

SEQ ID NO: 1256336 - DNA, 18 bp, Homo sapiens
cacactgcaagagccttg

SEQ ID NO: 1256337 - DNA, 19 bp, Homo sapiens
cacactgcaagagccttgg

SEQ ID NO: 1256338 - DNA, 21 bp, Homo sapiens
cacactgcaagagccttggtg

SEQ ID NO: 1256339 - DNA, 14 bp, Homo sapiens
cacactgcacatct

SEQ ID NO: 1256340 - DNA, 19 bp, Homo sapiens
cacactggactccggccct

SEQ ID NO: 1256341 - DNA, 21 bp, Homo sapiens
cacactgggtgcgtctccagt

SEQ ID NO: 1256342 - DNA, 22 bp, Homo sapiens
cacactgggtggtggcctggtc

SEQ ID NO: 1256343 - DNA, 18 bp, Homo sapiens
cacactggtacttagagt

SEQ ID NO: 1256344 - DNA, 22 bp, Homo sapiens
cacactggtacttagagtttct

SEQ ID NO: 1256345 - DNA, 18 bp, Homo sapiens
cacactggtgctgagtga

SEQ ID NO: 1256346 - DNA, 14 bp, Homo sapiens
cacactggttctca

SEQ ID NO: 1256347 - DNA, 16 bp, Homo sapiens
cacactggttctcaat

SEQ ID NO: 1256348 - DNA, 21 bp, Homo sapiens
cacactgtcatgcttcatcat

SEQ ID NO: 1256349 - DNA, 16 bp, Homo sapiens
cacactgtctggggcc

SEQ ID NO: 1256350 - DNA, 21 bp, Homo sapiens
cacactgtgattttgccctcc

SEQ ID NO: 1256351 - DNA, 22 bp, Homo sapiens
cacactgtgattttgccctcct

SEQ ID NO: 1256352 - DNA, 23 bp, Homo sapiens
cacactgtgattttgccctcctg

SEQ ID NO: 1256353 - DNA, 18 bp, Homo sapiens
cacactgtggccaggcct

SEQ ID NO: 1256354 - DNA, 19 bp, Homo sapiens
cacactgtgtcctggtgct

SEQ ID NO: 1256355 - DNA, 23 bp, Homo sapiens
cacactgtgtcctggtgctctct

SEQ ID NO: 1256356 - DNA, 17 bp, Homo sapiens
cacactgtgtgaggctg

SEQ ID NO: 1256357 - DNA, 14 bp, Homo sapiens
cacacttacttttt

SEQ ID NO: 1256358 - DNA, 15 bp, Homo sapiens
cacacttatatttta

SEQ ID NO: 1256359 - DNA, 15 bp, Homo sapiens
cacacttatttatga

SEQ ID NO: 1256360 - DNA, 16 bp, Homo sapiens
cacacttatttatgaa

SEQ ID NO: 1256361 - DNA, 17 bp, Homo sapiens
cacacttatttatgaat

SEQ ID NO: 1256362 - DNA, 17 bp, Homo sapiens
cacacttcaggctcttc

SEQ ID NO: 1256363 - DNA, 21 bp, Homo sapiens
cacacttcaggctcttctcct

SEQ ID NO: 1256364 - DNA, 19 bp, Homo sapiens
cacacttcccacccccagg

SEQ ID NO: 1256365 - DNA, 17 bp, Homo sapiens
cacacttccccatcttt

SEQ ID NO: 1256366 - DNA, 15 bp, Homo sapiens
cacacttcctgtcca

SEQ ID NO: 1256367 - DNA, 19 bp, Homo sapiens
cacacttcctgtccagaga

SEQ ID NO: 1256368 - DNA, 22 bp, Homo sapiens
cacacttcttgaaacagcctgg

SEQ ID NO: 1256369 - DNA, 19 bp, Homo sapiens
cacacttgagaggatgaat

SEQ ID NO: 1256370 - DNA, 21 bp, Homo sapiens
cacacttgagaggatgaatgt

SEQ ID NO: 1256371 - DNA, 21 bp, Homo sapiens
cacacttgcatacatatatat

SEQ ID NO: 1256372 - DNA, 14 bp, Homo sapiens
cacacttgctgggg

SEQ ID NO: 1256373 - DNA, 18 bp, Homo sapiens
cacacttgtacccacagg

SEQ ID NO: 1256374 - DNA, 15 bp, Homo sapiens
cacacttgtgccagc

SEQ ID NO: 1256375 - DNA, 13 bp, Homo sapiens
cacacttgtgtgt

SEQ ID NO: 1256376 - DNA, 19 bp, Homo sapiens
cacacttgtgtgtgggctg

SEQ ID NO: 1256377 - DNA, 15 bp, Homo sapiens
cacacttgttccagc

SEQ ID NO: 1256378 - DNA, 12 bp, Homo sapiens
cacatctgtgtc

SEQ ID NO: 1256379 - DNA, 17 bp, Homo sapiens
cacatctgtgtcttgtt

SEQ ID NO: 1256380 - DNA, 20 bp, Homo sapiens
cacatcttaaattcatttct

SEQ ID NO: 1256381 - DNA, 15 bp, Homo sapiens
cacatcttacctctc

SEQ ID NO: 1256382 - DNA, 12 bp, Homo sapiens
cacatcttgctc

SEQ ID NO: 1256383 - DNA, 17 bp, Homo sapiens
cacatcttgctctgcat

SEQ ID NO: 1256384 - DNA, 16 bp, Homo sapiens
cacatctttactcagg

SEQ ID NO: 1256385 - DNA, 15 bp, Homo sapiens
cacatgaaaaatttt

SEQ ID NO: 1256386 - DNA, 22 bp, Homo sapiens
cacatgaattattacagtgttt

SEQ ID NO: 1256387 - DNA, 18 bp, Homo sapiens
cacatgacctccatttcc

SEQ ID NO: 1256388 - DNA, 17 bp, Homo sapiens
cacatgcaaggtcattt

SEQ ID NO: 1256389 - DNA, 21 bp, Homo sapiens
cacatgcacttttgggccttt

SEQ ID NO: 1256390 - DNA, 15 bp, Homo sapiens
cacatgcccctcccc

SEQ ID NO: 1256391 - DNA, 13 bp, Homo sapiens
cacatgccctcct

SEQ ID NO: 1256392 - DNA, 15 bp, Homo sapiens
cacatgccctcctgg

SEQ ID NO: 1256393 - DNA, 16 bp, Homo sapiens
cacatgccctcctgga

SEQ ID NO: 1256394 - DNA, 14 bp, Homo sapiens
cacatgcctgcgcc

SEQ ID NO: 1256395 - DNA, 21 bp, Homo sapiens
cacatgcctgcgcctgctgcc

SEQ ID NO: 1256396 - DNA, 18 bp, Homo sapiens
cacatgctaaagccagga

SEQ ID NO: 1256397 - DNA, 20 bp, Homo sapiens
cacatgctcaggctactata

SEQ ID NO: 1256398 - DNA, 20 bp, Homo sapiens
cacatgctgaggttttgaat

SEQ ID NO: 1256399 - DNA, 14 bp, Homo sapiens
cacatgctgcctgg

SEQ ID NO: 1256400 - DNA, 15 bp, Homo sapiens
cacatgctgcctggc

SEQ ID NO: 1256401 - DNA, 18 bp, Homo sapiens
cacatggaagcccaactg

SEQ ID NO: 1256402 - DNA, 22 bp, Homo sapiens
cacatggagccccctctgccgg

SEQ ID NO: 1256403 - DNA, 19 bp, Homo sapiens
cacatggccatagaggccc

SEQ ID NO: 1256404 - DNA, 21 bp, Homo sapiens
cacatggccatagaggcccag

SEQ ID NO: 1256405 - DNA, 15 bp, Homo sapiens
cacatgggactggga

SEQ ID NO: 1256406 - DNA, 13 bp, Homo sapiens
cacatgggctggg

SEQ ID NO: 1256407 - DNA, 15 bp, Homo sapiens
cacatgggctggggg

SEQ ID NO: 1256408 - DNA, 15 bp, Homo sapiens
cacatgggggagaga

SEQ ID NO: 1256409 - DNA, 22 bp, Homo sapiens
cacatggtgtctcccaacatgg

SEQ ID NO: 1256410 - DNA, 18 bp, Homo sapiens
cacatgtaaaatatgtaa

SEQ ID NO: 1256411 - DNA, 20 bp, Homo sapiens
cacatgtacataaactgtca

SEQ ID NO: 1256412 - DNA, 20 bp, Homo sapiens
cacatgtcaccgtggacctt

SEQ ID NO: 1256413 - DNA, 23 bp, Homo sapiens
cacatgtcaccgtggaccttcct

SEQ ID NO: 1256414 - DNA, 18 bp, Homo sapiens
cacatgtgaaaagcttaa

SEQ ID NO: 1256415 - DNA, 13 bp, Homo sapiens
cacatgtgccaca

SEQ ID NO: 1256416 - DNA, 20 bp, Homo sapiens
cacatgtgctgatgtttaca

SEQ ID NO: 1256417 - DNA, 11 bp, Homo sapiens
cacatgtgtgc

SEQ ID NO: 1256418 - DNA, 12 bp, Homo sapiens
cacatgtttcct

SEQ ID NO: 1256419 - DNA, 13 bp, Homo sapiens
cacattaaaaaat

SEQ ID NO: 1256420 - DNA, 16 bp, Homo sapiens
cacattaactccctcc

SEQ ID NO: 1256421 - DNA, 17 bp, Homo sapiens
cacattaactccctcca

SEQ ID NO: 1256422 - DNA, 22 bp, Homo sapiens
cacattaactccctccaccagc

SEQ ID NO: 1256423 - DNA, 24 bp, Homo sapiens
cacattaactccctccaccagcct

SEQ ID NO: 1256424 - DNA, 19 bp, Homo sapiens
cacattaatatttgctgac

SEQ ID NO: 1256425 - DNA, 15 bp, Homo sapiens
cacattaatctcaaa

SEQ ID NO: 1256426 - DNA, 19 bp, Homo sapiens
cacattaatctcaaagaga

SEQ ID NO: 1256427 - DNA, 13 bp, Homo sapiens
cacattaatgata

SEQ ID NO: 1256428 - DNA, 22 bp, Homo sapiens
cacattatcgggagcagtgtct

SEQ ID NO: 1256429 - DNA, 23 bp, Homo sapiens
cacattatttattaaaaatgttc

SEQ ID NO: 1256430 - DNA, 13 bp, Homo sapiens
cacattatttgca

SEQ ID NO: 1256431 - DNA, 14 bp, Homo sapiens
cacattcaggaaga

SEQ ID NO: 1256432 - DNA, 12 bp, Homo sapiens
cacattccagcc

SEQ ID NO: 1256433 - DNA, 23 bp, Homo sapiens
cacattccagccaggcccaggcc

SEQ ID NO: 1256434 - DNA, 18 bp, Homo sapiens
cacattccagggctgggg

SEQ ID NO: 1256435 - DNA, 16 bp, Homo sapiens
cacattcggctccctg

SEQ ID NO: 1256436 - DNA, 21 bp, Homo sapiens
cacattcggctccctggagcc

SEQ ID NO: 1256437 - DNA, 13 bp, Homo sapiens
cacattctacttc

SEQ ID NO: 1256438 - DNA, 13 bp, Homo sapiens
cacattctatttt

SEQ ID NO: 1256439 - DNA, 11 bp, Homo sapiens
cacattctgct

SEQ ID NO: 1256440 - DNA, 22 bp, Homo sapiens
cacattcttggcttaatcattt

SEQ ID NO: 1256441 - DNA, 17 bp, Homo sapiens
cacattctttataaaat

SEQ ID NO: 1256442 - DNA, 21 bp, Homo sapiens
cacattctttataaaatgtat

SEQ ID NO: 1256443 - DNA, 16 bp, Homo sapiens
cacattgacagtggtg

SEQ ID NO: 1256444 - DNA, 19 bp, Homo sapiens
cacattgatttttctataa

SEQ ID NO: 1256445 - DNA, 17 bp, Homo sapiens
cacattgcccatggctg

SEQ ID NO: 1256446 - DNA, 21 bp, Homo sapiens
cacattgcctgttctgcttcg

SEQ ID NO: 1256447 - DNA, 22 bp, Homo sapiens
cacattgcctgttctgcttcga

SEQ ID NO: 1256448 - DNA, 17 bp, Homo sapiens
cacattggaatgccttg

SEQ ID NO: 1256449 - DNA, 19 bp, Homo sapiens
cacattgtttgctgctatt

SEQ ID NO: 1256450 - DNA, 15 bp, Homo sapiens
cacatttacactaga

SEQ ID NO: 1256451 - DNA, 12 bp, Homo sapiens
cacatttcatga

SEQ ID NO: 1256452 - DNA, 13 bp, Homo sapiens
cacatttctggat

SEQ ID NO: 1256453 - DNA, 14 bp, Homo sapiens
cacatttctggatt

SEQ ID NO: 1256454 - DNA, 19 bp, Homo sapiens
cacatttggaatacttttt

SEQ ID NO: 1256455 - DNA, 17 bp, Homo sapiens
cacatttgggctcaggg

SEQ ID NO: 1256456 - DNA, 18 bp, Homo sapiens
cacatttgggctcagggt

SEQ ID NO: 1256457 - DNA, 19 bp, Homo sapiens
cacattttattttattatg

SEQ ID NO: 1256458 - DNA, 21 bp, Homo sapiens
cacattttccacggaaacaga

SEQ ID NO: 1256459 - DNA, 18 bp, Homo sapiens
cacatttttcagatataa

SEQ ID NO: 1256460 - DNA, 17 bp, Homo sapiens
cacattttttaaatgca

SEQ ID NO: 1256461 - DNA, 21 bp, Homo sapiens
cacatttttttctatgcataa

SEQ ID NO: 1256462 - DNA, 17 bp, Homo sapiens
caccaaaataagaaaag

SEQ ID NO: 1256463 - DNA, 13 bp, Homo sapiens
caccaaactgcct

SEQ ID NO: 1256464 - DNA, 17 bp, Homo sapiens
caccaaagagaatgccc

SEQ ID NO: 1256465 - DNA, 16 bp, Homo sapiens
caccaaatcatcctga

SEQ ID NO: 1256466 - DNA, 15 bp, Homo sapiens
caccaacagtgtgaa

SEQ ID NO: 1256467 - DNA, 22 bp, Homo sapiens
caccaacatcccattgccctgg

SEQ ID NO: 1256468 - DNA, 16 bp, Homo sapiens
caccaaccccgcggcc

SEQ ID NO: 1256469 - DNA, 18 bp, Homo sapiens
caccaactactacctgta

SEQ ID NO: 1256470 - DNA, 15 bp, Homo sapiens
caccaactctgcact

SEQ ID NO: 1256471 - DNA, 19 bp, Homo sapiens
caccaactctgcactccat

SEQ ID NO: 1256472 - DNA, 20 bp, Homo sapiens
caccaactctgcactccatg

SEQ ID NO: 1256473 - DNA, 13 bp, Homo sapiens
caccaacttgcca

SEQ ID NO: 1256474 - DNA, 15 bp, Homo sapiens
caccaagaaagcagg

SEQ ID NO: 1256475 - DNA, 15 bp, Homo sapiens
caccaagacagtgct

SEQ ID NO: 1256476 - DNA, 14 bp, Homo sapiens
caccaagcacagca

SEQ ID NO: 1256477 - DNA, 15 bp, Homo sapiens
caccaagcacagcag

SEQ ID NO: 1256478 - DNA, 17 bp, Homo sapiens
caccaagcacagcagcc

SEQ ID NO: 1256479 - DNA, 20 bp, Homo sapiens
caccaagctcacagttcctc

SEQ ID NO: 1256480 - DNA, 11 bp, Homo sapiens
caccaaggaaa

SEQ ID NO: 1256481 - DNA, 22 bp, Homo sapiens
caccaaggcagtgcatgcatgt

SEQ ID NO: 1256482 - DNA, 20 bp, Homo sapiens
caccaaggtcttcagccatc

SEQ ID NO: 1256483 - DNA, 13 bp, Homo sapiens
caccaagtgcaat

SEQ ID NO: 1256484 - DNA, 12 bp, Homo sapiens
caccacaaaata

SEQ ID NO: 1256485 - DNA, 15 bp, Homo sapiens
caccacactgggtgc

SEQ ID NO: 1256486 - DNA, 20 bp, Homo sapiens
caccacagacacacacacgc

SEQ ID NO: 1256487 - DNA, 17 bp, Homo sapiens
caccacagccagcacct

SEQ ID NO: 1256488 - DNA, 17 bp, Homo sapiens
caccacagtaagttcct

SEQ ID NO: 1256489 - DNA, 20 bp, Homo sapiens
caccacatagcatgcttcct

SEQ ID NO: 1256490 - DNA, 20 bp, Homo sapiens
caccacatcccttcatatca

SEQ ID NO: 1256491 - DNA, 21 bp, Homo sapiens
caccacatcctccgtccagcc

SEQ ID NO: 1256492 - DNA, 21 bp, Homo sapiens
caccaccaaatgccaagaaaa

SEQ ID NO: 1256493 - DNA, 14 bp, Homo sapiens
caccaccacactac

SEQ ID NO: 1256494 - DNA, 14 bp, Homo sapiens
caccaccaccccta

SEQ ID NO: 1256495 - DNA, 17 bp, Homo sapiens
caccaccactctcactc

SEQ ID NO: 1256496 - DNA, 16 bp, Homo sapiens
caccaccaggagcagc

SEQ ID NO: 1256497 - DNA, 21 bp, Homo sapiens
caccaccaggagcagcagcca

SEQ ID NO: 1256498 - DNA, 18 bp, Homo sapiens
caccaccagggtggacca

SEQ ID NO: 1256499 - DNA, 19 bp, Homo sapiens
caccacccagcccttcctt

SEQ ID NO: 1256500 - DNA, 23 bp, Homo sapiens
caccagtgttcctgaagctgctg

SEQ ID NO: 1256501 - DNA, 22 bp, Homo sapiens
caccagttaaaagcattttaat

SEQ ID NO: 1256502 - DNA, 17 bp, Homo sapiens
caccataggtagaatgt

SEQ ID NO: 1256503 - DNA, 20 bp, Homo sapiens
caccatcactcactcactcc

SEQ ID NO: 1256504 - DNA, 18 bp, Homo sapiens
caccatccaccttccctt

SEQ ID NO: 1256505 - DNA, 15 bp, Homo sapiens
caccatcctcagagg

SEQ ID NO: 1256506 - DNA, 22 bp, Homo sapiens
caccatcctcagaggctgagcc

SEQ ID NO: 1256507 - DNA, 18 bp, Homo sapiens
caccatctcaggccacct

SEQ ID NO: 1256508 - DNA, 20 bp, Homo sapiens
caccatctcaggccacctgc

SEQ ID NO: 1256509 - DNA, 21 bp, Homo sapiens
caccatctcaggccacctgcc

SEQ ID NO: 1256510 - DNA, 22 bp, Homo sapiens
caccatctcaggccacctgccc

SEQ ID NO: 1256511 - DNA, 13 bp, Homo sapiens
caccatctgcttg

SEQ ID NO: 1256512 - DNA, 18 bp, Homo sapiens
caccatgatgtgaagagt

SEQ ID NO: 1256513 - DNA, 20 bp, Homo sapiens
caccatgcaaatgtcttcca

SEQ ID NO: 1256514 - DNA, 23 bp, Homo sapiens
caccatgcactgtaaatatccct

SEQ ID NO: 1256515 - DNA, 13 bp, Homo sapiens
caccatgcagccc

SEQ ID NO: 1256516 - DNA, 15 bp, Homo sapiens
caccatgcttgcctg

SEQ ID NO: 1256517 - DNA, 18 bp, Homo sapiens
caccatggaccagcccat

SEQ ID NO: 1256518 - DNA, 13 bp, Homo sapiens
caccatggagacg

SEQ ID NO: 1256519 - DNA, 15 bp, Homo sapiens
caccatggtgactgc

SEQ ID NO: 1256520 - DNA, 15 bp, Homo sapiens
caccatgtgcaataa

SEQ ID NO: 1256521 - DNA, 15 bp, Homo sapiens
caccatgtgccatct

SEQ ID NO: 1256522 - DNA, 17 bp, Homo sapiens
caccatgttagccttag

SEQ ID NO: 1256523 - DNA, 23 bp, Homo sapiens
caccatgttggtcaggctggtct

SEQ ID NO: 1256524 - DNA, 22 bp, Homo sapiens
caccatgtttgagctcagaccc

SEQ ID NO: 1256525 - DNA, 19 bp, Homo sapiens
caccattatattttgaaag

SEQ ID NO: 1256526 - DNA, 20 bp, Homo sapiens
caccattcacatttgatgta

SEQ ID NO: 1256527 - DNA, 21 bp, Homo sapiens
caccattcacatttgatgtac

SEQ ID NO: 1256528 - DNA, 14 bp, Homo sapiens
caccattctcctgc

SEQ ID NO: 1256529 - DNA, 20 bp, Homo sapiens
caccattgtgaagcacctac

SEQ ID NO: 1256530 - DNA, 17 bp, Homo sapiens
caccatttaaaaatgtt

SEQ ID NO: 1256531 - DNA, 23 bp, Homo sapiens
cacccaaacacttctgctttcac

SEQ ID NO: 1256532 - DNA, 22 bp, Homo sapiens
cacccaaagcctgtcccaggac

SEQ ID NO: 1256533 - DNA, 23 bp, Homo sapiens
cacccaaagcctgtcccaggact

SEQ ID NO: 1256534 - DNA, 20 bp, Homo sapiens
cacccaacagctcagagatg

SEQ ID NO: 1256535 - DNA, 23 bp, Homo sapiens
cacccaaccctatctcctgacag

SEQ ID NO: 1256536 - DNA, 14 bp, Homo sapiens
cacccaagagagga

SEQ ID NO: 1256537 - DNA, 21 bp, Homo sapiens
cacccaatcaagggaagaagg

SEQ ID NO: 1256538 - DNA, 17 bp, Homo sapiens
cacccacaagcccgtga

SEQ ID NO: 1256539 - DNA, 23 bp, Homo sapiens
cacccacacactcgcccgcccac

SEQ ID NO: 1256540 - DNA, 15 bp, Homo sapiens
cacccacacagctgc

SEQ ID NO: 1256541 - DNA, 18 bp, Homo sapiens
cacccacacagctgccct

SEQ ID NO: 1256542 - DNA, 24 bp, Homo sapiens
cacccacacagctgccctagctga

SEQ ID NO: 1256543 - DNA, 13 bp, Homo sapiens
cacccacagggct

SEQ ID NO: 1256544 - DNA, 14 bp, Homo sapiens
cacccaccagctcc

SEQ ID NO: 1256545 - DNA, 16 bp, Homo sapiens
cacccaccccacagac

SEQ ID NO: 1256546 - DNA, 12 bp, Homo sapiens
cacccaccccca

SEQ ID NO: 1256547 - DNA, 13 bp, Homo sapiens
cacccacccccag

SEQ ID NO: 1256548 - DNA, 16 bp, Homo sapiens
cacccacccccaggcc

SEQ ID NO: 1256549 - DNA, 18 bp, Homo sapiens
cacccacccccaggcctc

SEQ ID NO: 1256550 - DNA, 20 bp, Homo sapiens
cacccacccccaggcctcct

SEQ ID NO: 1256551 - DNA, 16 bp, Homo sapiens
cacccacccctgcaca

SEQ ID NO: 1256552 - DNA, 13 bp, Homo sapiens
cacccaccctctg

SEQ ID NO: 1256553 - DNA, 14 bp, Homo sapiens
cacccaccctctgg

SEQ ID NO: 1256554 - DNA, 13 bp, Homo sapiens
cacccacctccac

SEQ ID NO: 1256555 - DNA, 20 bp, Homo sapiens
cacccacctccacccagccc

SEQ ID NO: 1256556 - DNA, 14 bp, Homo sapiens
cacccacctcctgc

SEQ ID NO: 1256557 - DNA, 22 bp, Homo sapiens
cacccacctgttttctgaaaca

SEQ ID NO: 1256558 - DNA, 21 bp, Homo sapiens
cacccacgcatacacacatgc

SEQ ID NO: 1256559 - DNA, 23 bp, Homo sapiens
cacccacgcatacacacatgccc

SEQ ID NO: 1256560 - DNA, 18 bp, Homo sapiens
cacccactcaccagggtc

SEQ ID NO: 1256561 - DNA, 13 bp, Homo sapiens
cacccactcctat

SEQ ID NO: 1256562 - DNA, 13 bp, Homo sapiens
cacccagagaaaa

SEQ ID NO: 1256563 - DNA, 17 bp, Homo sapiens
cacccagagcaccccct

SEQ ID NO: 1256564 - DNA, 14 bp, Homo sapiens
cacccagagggagt

SEQ ID NO: 1256565 - DNA, 22 bp, Homo sapiens
cacccagatcaggaaccagggc

SEQ ID NO: 1256566 - DNA, 23 bp, Homo sapiens
cacccagatcaggaaccagggcc

SEQ ID NO: 1256567 - DNA, 16 bp, Homo sapiens
cacccagcaccttgca

SEQ ID NO: 1256568 - DNA, 10 bp, Homo sapiens
cacccagccc

SEQ ID NO: 1256569 - DNA, 12 bp, Homo sapiens
cacccagcccat

SEQ ID NO: 1256570 - DNA, 11 bp, Homo sapiens
cacccagcccc

SEQ ID NO: 1256571 - DNA, 12 bp, Homo sapiens
cacccagcctgg

SEQ ID NO: 1256572 - DNA, 14 bp, Homo sapiens
cacccagctcagca

SEQ ID NO: 1256573 - DNA, 12 bp, Homo sapiens
cacccagctcca

SEQ ID NO: 1256574 - DNA, 13 bp, Homo sapiens
cacccagctccag

SEQ ID NO: 1256575 - DNA, 12 bp, Homo sapiens
cacccagctggt

SEQ ID NO: 1256576 - DNA, 22 bp, Homo sapiens
cacccaggctctggagccagag

SEQ ID NO: 1256577 - DNA, 23 bp, Homo sapiens
cacccaggctggagtgcggtggc

SEQ ID NO: 1256578 - DNA, 14 bp, Homo sapiens
cacccagggagctg

SEQ ID NO: 1256579 - DNA, 16 bp, Homo sapiens
cacccagggctccctc

SEQ ID NO: 1256580 - DNA, 19 bp, Homo sapiens
cacccaggtgatttcctct

SEQ ID NO: 1256581 - DNA, 18 bp, Homo sapiens
cacccagtgctgccatgc

SEQ ID NO: 1256582 - DNA, 19 bp, Homo sapiens
cacccagtgctgccatgcc

SEQ ID NO: 1256583 - DNA, 13 bp, Homo sapiens
cacccatatcatg

SEQ ID NO: 1256584 - DNA, 22 bp, Homo sapiens
cacccatcctaccaatgcatgc

SEQ ID NO: 1256585 - DNA, 14 bp, Homo sapiens
cacccatgaagaca

SEQ ID NO: 1256586 - DNA, 13 bp, Homo sapiens
cacccatgtgcca

SEQ ID NO: 1256587 - DNA, 21 bp, Homo sapiens
cacccattcccccatgtggct

SEQ ID NO: 1256588 - DNA, 15 bp, Homo sapiens
cacccattttcacat

SEQ ID NO: 1256589 - DNA, 13 bp, Homo sapiens
caccccaaacccc

SEQ ID NO: 1256590 - DNA, 16 bp, Homo sapiens
caccccaaaccccagc

SEQ ID NO: 1256591 - DNA, 18 bp, Homo sapiens
caccccaaagctttcctg

SEQ ID NO: 1256592 - DNA, 18 bp, Homo sapiens
caccccaacatgcctgca

SEQ ID NO: 1256593 - DNA, 12 bp, Homo sapiens
caccccaagaga

SEQ ID NO: 1256594 - DNA, 15 bp, Homo sapiens
caccccaatccctgc

SEQ ID NO: 1256595 - DNA, 18 bp, Homo sapiens
caccccaatccctgccac

SEQ ID NO: 1256596 - DNA, 19 bp, Homo sapiens
caccccaatccctgccact

SEQ ID NO: 1256597 - DNA, 20 bp, Homo sapiens
caccccacaccccagcccac

SEQ ID NO: 1256598 - DNA, 13 bp, Homo sapiens
caccccaccccct

SEQ ID NO: 1256599 - DNA, 15 bp, Homo sapiens
caccccactcccaca

SEQ ID NO: 1256600 - DNA, 17 bp, Homo sapiens
caccccagaaatcactg

SEQ ID NO: 1256601 - DNA, 16 bp, Homo sapiens
caccccagcaattatg

SEQ ID NO: 1256602 - DNA, 21 bp, Homo sapiens
caccccagcacagccacctcc

SEQ ID NO: 1256603 - DNA, 17 bp, Homo sapiens
caccccagcattccagc

SEQ ID NO: 1256604 - DNA, 21 bp, Homo sapiens
caccccagcattccagctctg

SEQ ID NO: 1256605 - DNA, 22 bp, Homo sapiens
caccccagcattccagctctgc

SEQ ID NO: 1256606 - DNA, 11 bp, Homo sapiens
caccccagccc

SEQ ID NO: 1256607 - DNA, 14 bp, Homo sapiens
caccccagcctcat

SEQ ID NO: 1256608 - DNA, 16 bp, Homo sapiens
caccccagcctcattg

SEQ ID NO: 1256609 - DNA, 18 bp, Homo sapiens
caccccagctccgacctc

SEQ ID NO: 1256610 - DNA, 11 bp, Homo sapiens
caccccaggac

SEQ ID NO: 1256611 - DNA, 20 bp, Homo sapiens
caccccaggacgccactcat

SEQ ID NO: 1256612 - DNA, 12 bp, Homo sapiens
caccccatccag

SEQ ID NO: 1256613 - DNA, 21 bp, Homo sapiens
caccccatcccacaccctgga

SEQ ID NO: 1256614 - DNA, 12 bp, Homo sapiens
caccccatgcca

SEQ ID NO: 1256615 - DNA, 13 bp, Homo sapiens
cacccccaacccc

SEQ ID NO: 1256616 - DNA, 14 bp, Homo sapiens
cacccccaacccgt

SEQ ID NO: 1256617 - DNA, 17 bp, Homo sapiens
cacccccacccacctcc

SEQ ID NO: 1256618 - DNA, 14 bp, Homo sapiens
cacccccaccccca

SEQ ID NO: 1256619 - DNA, 12 bp, Homo sapiens
cacccccagaga

SEQ ID NO: 1256620 - DNA, 12 bp, Homo sapiens
cacccccagcca

SEQ ID NO: 1256621 - DNA, 17 bp, Homo sapiens
cacccccagccaggcta

SEQ ID NO: 1256622 - DNA, 13 bp, Homo sapiens
cacccccagcccc

SEQ ID NO: 1256623 - DNA, 23 bp, Homo sapiens
caccgtgccaaccccacccagct

SEQ ID NO: 1256624 - DNA, 16 bp, Homo sapiens
caccgtgcctggccag

SEQ ID NO: 1256625 - DNA, 18 bp, Homo sapiens
caccgtgcctggccagat

SEQ ID NO: 1256626 - DNA, 20 bp, Homo sapiens
caccgtggaccttcctgcca

SEQ ID NO: 1256627 - DNA, 23 bp, Homo sapiens
caccgtggaccttcctgccacca

SEQ ID NO: 1256628 - DNA, 20 bp, Homo sapiens
caccgtggggaaggggtgca

SEQ ID NO: 1256629 - DNA, 18 bp, Homo sapiens
caccgtgtaaaccaaagc

SEQ ID NO: 1256630 - DNA, 20 bp, Homo sapiens
caccgtgtcaagctgctctg

SEQ ID NO: 1256631 - DNA, 12 bp, Homo sapiens
caccgtgtcctc

SEQ ID NO: 1256632 - DNA, 16 bp, Homo sapiens
caccgtgtcctcctct

SEQ ID NO: 1256633 - DNA, 19 bp, Homo sapiens
caccgtgtcctcctctgag

SEQ ID NO: 1256634 - DNA, 15 bp, Homo sapiens
caccgttctgtgcac

SEQ ID NO: 1256635 - DNA, 21 bp, Homo sapiens
caccgttggggattggggaag

SEQ ID NO: 1256636 - DNA, 13 bp, Homo sapiens
cacctaaagaaaa

SEQ ID NO: 1256637 - DNA, 22 bp, Homo sapiens
cacctaaagcctaccctattct

SEQ ID NO: 1256638 - DNA, 20 bp, Homo sapiens
cacctaaaggtgtatttaaa

SEQ ID NO: 1256639 - DNA, 15 bp, Homo sapiens
cacctaagcacttct

SEQ ID NO: 1256640 - DNA, 20 bp, Homo sapiens
cacctaagcacttctagaat

SEQ ID NO: 1256641 - DNA, 22 bp, Homo sapiens
cacctaagcacttctagaatgt

SEQ ID NO: 1256642 - DNA, 20 bp, Homo sapiens
cacctaatgtttatgagcca

SEQ ID NO: 1256643 - DNA, 21 bp, Homo sapiens
cacctaatgtttatgagccag

SEQ ID NO: 1256644 - DNA, 15 bp, Homo sapiens
cacctacacaggagt

SEQ ID NO: 1256645 - DNA, 16 bp, Homo sapiens
cacctacagtgtacag

SEQ ID NO: 1256646 - DNA, 17 bp, Homo sapiens
cacctaccatcagggac

SEQ ID NO: 1256647 - DNA, 15 bp, Homo sapiens
cacctaccatgctgc

SEQ ID NO: 1256648 - DNA, 14 bp, Homo sapiens
cacctactgcactt

SEQ ID NO: 1256649 - DNA, 19 bp, Homo sapiens
cacctacttgtgactgaag

SEQ ID NO: 1256650 - DNA, 23 bp, Homo sapiens
cacctagaacgtgcatccttgta

SEQ ID NO: 1256651 - DNA, 14 bp, Homo sapiens
cacctagagccaga

SEQ ID NO: 1256652 - DNA, 21 bp, Homo sapiens
cacctagcaacatatctctgc

SEQ ID NO: 1256653 - DNA, 22 bp, Homo sapiens
cacctagcaacatatctctgcc

SEQ ID NO: 1256654 - DNA, 12 bp, Homo sapiens
cacctagcagcc

SEQ ID NO: 1256655 - DNA, 15 bp, Homo sapiens
cacctagcagcctca

SEQ ID NO: 1256656 - DNA, 16 bp, Homo sapiens
cacctagcagcctcaa

SEQ ID NO: 1256657 - DNA, 12 bp, Homo sapiens
cacctagccagc

SEQ ID NO: 1256658 - DNA, 15 bp, Homo sapiens
cacctagctgtgcaa

SEQ ID NO: 1256659 - DNA, 15 bp, Homo sapiens
cacctagtgccccag

SEQ ID NO: 1256660 - DNA, 18 bp, Homo sapiens
cacctagtgccccagact

SEQ ID NO: 1256661 - DNA, 19 bp, Homo sapiens
cacctagtgccccagactg

SEQ ID NO: 1256662 - DNA, 22 bp, Homo sapiens
cacctagtgccccagactgagc

SEQ ID NO: 1256663 - DNA, 16 bp, Homo sapiens
cacctatagtcccagc

SEQ ID NO: 1256664 - DNA, 18 bp, Homo sapiens
cacctatctcagccatag

SEQ ID NO: 1256665 - DNA, 20 bp, Homo sapiens
cacctatctcgtgggagagc

SEQ ID NO: 1256666 - DNA, 17 bp, Homo sapiens
cacctatgagatggcca

SEQ ID NO: 1256667 - DNA, 22 bp, Homo sapiens
cacctatgagatggccatgctc

SEQ ID NO: 1256668 - DNA, 19 bp, Homo sapiens
cacctatgcctgtggtgaa

SEQ ID NO: 1256669 - DNA, 23 bp, Homo sapiens
cacctatgcctgtggtgaagtgt

SEQ ID NO: 1256670 - DNA, 13 bp, Homo sapiens
cacctatgttatt

SEQ ID NO: 1256671 - DNA, 13 bp, Homo sapiens
cacctatttccat

SEQ ID NO: 1256672 - DNA, 15 bp, Homo sapiens
cacctcaacccagag

SEQ ID NO: 1256673 - DNA, 23 bp, Homo sapiens
cacctcaaggtcatcaaacattt

SEQ ID NO: 1256674 - DNA, 21 bp, Homo sapiens
cacctcaccaaggatcggact

SEQ ID NO: 1256675 - DNA, 16 bp, Homo sapiens
cacctcacgctctgga

SEQ ID NO: 1256676 - DNA, 18 bp, Homo sapiens
cacctcacgctctggaca

SEQ ID NO: 1256677 - DNA, 11 bp, Homo sapiens
cacctcagaaa

SEQ ID NO: 1256678 - DNA, 17 bp, Homo sapiens
cacctcagagtggagtt

SEQ ID NO: 1256679 - DNA, 13 bp, Homo sapiens
cacctcagcctcc

SEQ ID NO: 1256680 - DNA, 13 bp, Homo sapiens
cacctcagcctgg

SEQ ID NO: 1256681 - DNA, 15 bp, Homo sapiens
cacctcagcctggag

SEQ ID NO: 1256682 - DNA, 18 bp, Homo sapiens
cacctcagcctggagagg

SEQ ID NO: 1256683 - DNA, 22 bp, Homo sapiens
cacctcagcctggagaggcctg

SEQ ID NO: 1256684 - DNA, 23 bp, Homo sapiens
cacctcagcctggagaggcctgg

SEQ ID NO: 1256685 - DNA, 15 bp, Homo sapiens
cacctcagccttgga

SEQ ID NO: 1256686 - DNA, 16 bp, Homo sapiens
cacctcatcactggac

SEQ ID NO: 1256687 - DNA, 12 bp, Homo sapiens
cacctcatgccc

SEQ ID NO: 1256688 - DNA, 20 bp, Homo sapiens
cacctcatgcccaccccctg

SEQ ID NO: 1256689 - DNA, 21 bp, Homo sapiens
cacctcatggattgccacagc

SEQ ID NO: 1256690 - DNA, 22 bp, Homo sapiens
cacctcatggattgccacagct

SEQ ID NO: 1256691 - DNA, 22 bp, Homo sapiens
cacctcattctgaaccctttcg

SEQ ID NO: 1256692 - DNA, 17 bp, Homo sapiens
cacctccaagcatttca

SEQ ID NO: 1256693 - DNA, 18 bp, Homo sapiens
cacctccaagcatttcat

SEQ ID NO: 1256694 - DNA, 13 bp, Homo sapiens
cacctccacccag

SEQ ID NO: 1256695 - DNA, 13 bp, Homo sapiens
cacctccacgcca

SEQ ID NO: 1256696 - DNA, 14 bp, Homo sapiens
cacctccacgccac

SEQ ID NO: 1256697 - DNA, 12 bp, Homo sapiens
cacctccagccc

SEQ ID NO: 1256698 - DNA, 14 bp, Homo sapiens
cacctccagcccgg

SEQ ID NO: 1256699 - DNA, 12 bp, Homo sapiens
cacctccaggca

SEQ ID NO: 1256700 - DNA, 13 bp, Homo sapiens
cacctccaggcag

SEQ ID NO: 1256701 - DNA, 14 bp, Homo sapiens
cacctccaggcagg

SEQ ID NO: 1256702 - DNA, 18 bp, Homo sapiens
cacctccaggcctgttgc

SEQ ID NO: 1256703 - DNA, 12 bp, Homo sapiens
cacctcccaggg

SEQ ID NO: 1256704 - DNA, 13 bp, Homo sapiens
cacctcccagggg

SEQ ID NO: 1256705 - DNA, 14 bp, Homo sapiens
cacctcccatttct

SEQ ID NO: 1256706 - DNA, 22 bp, Homo sapiens
cacctcccatttctgttgctgg

SEQ ID NO: 1256707 - DNA, 12 bp, Homo sapiens
cacctccccaca

SEQ ID NO: 1256708 - DNA, 18 bp, Homo sapiens
cacctccccacacacagg

SEQ ID NO: 1256709 - DNA, 19 bp, Homo sapiens
cacctccccacacacaggc

SEQ ID NO: 1256710 - DNA, 21 bp, Homo sapiens
cacctccccacacacaggcct

SEQ ID NO: 1256711 - DNA, 14 bp, Homo sapiens
cacctccccagcat

SEQ ID NO: 1256712 - DNA, 17 bp, Homo sapiens
cacctccccccactgca

SEQ ID NO: 1256713 - DNA, 18 bp, Homo sapiens
cacctccccccactgcag

SEQ ID NO: 1256714 - DNA, 15 bp, Homo sapiens
cacctccccctaccc

SEQ ID NO: 1256715 - DNA, 12 bp, Homo sapiens
cacctccccctt

SEQ ID NO: 1256716 - DNA, 15 bp, Homo sapiens
cacctccccctttca

SEQ ID NO: 1256717 - DNA, 18 bp, Homo sapiens
cacctcccctatccaccc

SEQ ID NO: 1256718 - DNA, 19 bp, Homo sapiens
cacctcccctatccaccca

SEQ ID NO: 1256719 - DNA, 17 bp, Homo sapiens
cacctcccgaagccacc

SEQ ID NO: 1256720 - DNA, 14 bp, Homo sapiens
cacctcccgccctc

SEQ ID NO: 1256721 - DNA, 23 bp, Homo sapiens
cacctccctaccaaaaattgcca

SEQ ID NO: 1256722 - DNA, 21 bp, Homo sapiens
cacctccctactcccctgggc

SEQ ID NO: 1256723 - DNA, 10 bp, Homo sapiens
cacctccctc

SEQ ID NO: 1256724 - DNA, 14 bp, Homo sapiens
cacctccctcccca

SEQ ID NO: 1256725 - DNA, 16 bp, Homo sapiens
cacctccctccccagc

SEQ ID NO: 1256726 - DNA, 23 bp, Homo sapiens
cacctccctccccagctccggag

SEQ ID NO: 1256727 - DNA, 14 bp, Homo sapiens
cacctccctgcctc

SEQ ID NO: 1256728 - DNA, 22 bp, Homo sapiens
cacctccctgcgcccttgaggg

SEQ ID NO: 1256729 - DNA, 23 bp, Homo sapiens
cacctccctgctcagtgcttggg

SEQ ID NO: 1256730 - DNA, 14 bp, Homo sapiens
cacctcccttccca

SEQ ID NO: 1256731 - DNA, 16 bp, Homo sapiens
cacctccgcttgccag

SEQ ID NO: 1256732 - DNA, 17 bp, Homo sapiens
cacctcctaccctccca

SEQ ID NO: 1256733 - DNA, 14 bp, Homo sapiens
cacctcctcatgta

SEQ ID NO: 1256734 - DNA, 17 bp, Homo sapiens
cacctcctccactcact

SEQ ID NO: 1256735 - DNA, 11 bp, Homo sapiens
cacctcctccc

SEQ ID NO: 1256736 - DNA, 13 bp, Homo sapiens
cacctcctccccc

SEQ ID NO: 1256737 - DNA, 14 bp, Homo sapiens
cacctcctccccct

SEQ ID NO: 1256738 - DNA, 18 bp, Homo sapiens
cacctcctctcactcccc

SEQ ID NO: 1256739 - DNA, 17 bp, Homo sapiens
cacctcctctgtgattt

SEQ ID NO: 1256740 - DNA, 19 bp, Homo sapiens
cacctcctgcggctcagcc

SEQ ID NO: 1256741 - DNA, 15 bp, Homo sapiens
cacctcgagaagtaa

SEQ ID NO: 1256742 - DNA, 12 bp, Homo sapiens
cacctcgctccc

SEQ ID NO: 1256743 - DNA, 13 bp, Homo sapiens
cacctcgctcccc

SEQ ID NO: 1256744 - DNA, 17 bp, Homo sapiens
cacctcgctcccctctg

SEQ ID NO: 1256745 - DNA, 17 bp, Homo sapiens
cacctcggcacacactg

SEQ ID NO: 1256746 - DNA, 20 bp, Homo sapiens
cacgcaggggccctgagcca

SEQ ID NO: 1256747 - DNA, 15 bp, Homo sapiens
cacgcatgggcattg

SEQ ID NO: 1256748 - DNA, 21 bp, Homo sapiens
cacgcatgggcattgcagcct

SEQ ID NO: 1256749 - DNA, 23 bp, Homo sapiens
cacgcatgggcattgcagccttg

SEQ ID NO: 1256750 - DNA, 16 bp, Homo sapiens
cacgccaacagccccc

SEQ ID NO: 1256751 - DNA, 22 bp, Homo sapiens
cacgccactgcactccagcctg

SEQ ID NO: 1256752 - DNA, 14 bp, Homo sapiens
cacgccactgcctc

SEQ ID NO: 1256753 - DNA, 13 bp, Homo sapiens
cacgccagctcct

SEQ ID NO: 1256754 - DNA, 18 bp, Homo sapiens
cacgccagctcctctctg

SEQ ID NO: 1256755 - DNA, 15 bp, Homo sapiens
cacgcccatgtgtga

SEQ ID NO: 1256756 - DNA, 23 bp, Homo sapiens
cacgcccatgtgtgagtgtgtgc

SEQ ID NO: 1256757 - DNA, 13 bp, Homo sapiens
cacgccccacact

SEQ ID NO: 1256758 - DNA, 17 bp, Homo sapiens
cacgccccgctgtgtcc

SEQ ID NO: 1256759 - DNA, 14 bp, Homo sapiens
cacgcccgtcctgc

SEQ ID NO: 1256760 - DNA, 16 bp, Homo sapiens
cacgcccgtcctgcct

SEQ ID NO: 1256761 - DNA, 20 bp, Homo sapiens
cacgcccgtcctgcctgtgg

SEQ ID NO: 1256762 - DNA, 19 bp, Homo sapiens
cacgccctctcctccccct

SEQ ID NO: 1256763 - DNA, 22 bp, Homo sapiens
cacgccgggagaagccaccttc

SEQ ID NO: 1256764 - DNA, 14 bp, Homo sapiens
cacgccgtctgtcc

SEQ ID NO: 1256765 - DNA, 18 bp, Homo sapiens
cacgcctatgatcccagc

SEQ ID NO: 1256766 - DNA, 23 bp, Homo sapiens
cacgcctatgccctgcccttcct

SEQ ID NO: 1256767 - DNA, 14 bp, Homo sapiens
cacgcctcccactg

SEQ ID NO: 1256768 - DNA, 16 bp, Homo sapiens
cacgcctcccactggg

SEQ ID NO: 1256769 - DNA, 17 bp, Homo sapiens
cacgcctcccactgggg

SEQ ID NO: 1256770 - DNA, 18 bp, Homo sapiens
cacgcctcccactggggt

SEQ ID NO: 1256771 - DNA, 22 bp, Homo sapiens
cacgcctgagagtggcactggg

SEQ ID NO: 1256772 - DNA, 19 bp, Homo sapiens
cacgcctgtaatcccagca

SEQ ID NO: 1256773 - DNA, 22 bp, Homo sapiens
cacgcctgtaatcccagcactt

SEQ ID NO: 1256774 - DNA, 20 bp, Homo sapiens
cacgcctgtaatcccagcag

SEQ ID NO: 1256775 - DNA, 21 bp, Homo sapiens
cacgcctgtaatcccagcagt

SEQ ID NO: 1256776 - DNA, 19 bp, Homo sapiens
cacgcctgtaatcctagca

SEQ ID NO: 1256777 - DNA, 17 bp, Homo sapiens
cacgcgtgattgaccct

SEQ ID NO: 1256778 - DNA, 16 bp, Homo sapiens
cacgcgttctgggagc

SEQ ID NO: 1256779 - DNA, 12 bp, Homo sapiens
cacgctcctgcc

SEQ ID NO: 1256780 - DNA, 15 bp, Homo sapiens
cacgctcctgccctc

SEQ ID NO: 1256781 - DNA, 18 bp, Homo sapiens
cacgctcctgccctcgtc

SEQ ID NO: 1256782 - DNA, 14 bp, Homo sapiens
cacgctctggacat

SEQ ID NO: 1256783 - DNA, 17 bp, Homo sapiens
cacgctgcccaggggct

SEQ ID NO: 1256784 - DNA, 13 bp, Homo sapiens
cacgctgcctggt

SEQ ID NO: 1256785 - DNA, 22 bp, Homo sapiens
cacgctgcctggtctgtctgga

SEQ ID NO: 1256786 - DNA, 18 bp, Homo sapiens
cacgctgtcctctcgagc

SEQ ID NO: 1256787 - DNA, 14 bp, Homo sapiens
cacgctgtctccag

SEQ ID NO: 1256788 - DNA, 19 bp, Homo sapiens
cacgctgtctccagacccc

SEQ ID NO: 1256789 - DNA, 23 bp, Homo sapiens
cacgctgtctccagacccccacc

SEQ ID NO: 1256790 - DNA, 20 bp, Homo sapiens
cacgctgtggccctggaggg

SEQ ID NO: 1256791 - DNA, 17 bp, Homo sapiens
cacgctttctagctgtt

SEQ ID NO: 1256792 - DNA, 14 bp, Homo sapiens
cacggaatggggaa

SEQ ID NO: 1256793 - DNA, 18 bp, Homo sapiens
cacggaccactcgaggcc

SEQ ID NO: 1256794 - DNA, 20 bp, Homo sapiens
cacggaccactcgaggcctg

SEQ ID NO: 1256795 - DNA, 17 bp, Homo sapiens
cacggacgtttccatca

SEQ ID NO: 1256796 - DNA, 14 bp, Homo sapiens
cacggactcccggg

SEQ ID NO: 1256797 - DNA, 17 bp, Homo sapiens
cacggactgaggtgcct

SEQ ID NO: 1256798 - DNA, 19 bp, Homo sapiens
cacggactgaggtgcctgc

SEQ ID NO: 1256799 - DNA, 19 bp, Homo sapiens
cacggagcccagccctccc

SEQ ID NO: 1256800 - DNA, 19 bp, Homo sapiens
cacggaggatgatgccagt

SEQ ID NO: 1256801 - DNA, 21 bp, Homo sapiens
cacggaggcatctgcaccctc

SEQ ID NO: 1256802 - DNA, 18 bp, Homo sapiens
cacggagggaggcaccat

SEQ ID NO: 1256803 - DNA, 22 bp, Homo sapiens
cacggagggggacggggctcag

SEQ ID NO: 1256804 - DNA, 23 bp, Homo sapiens
cacggagtcgtggggtgtgctgg

SEQ ID NO: 1256805 - DNA, 20 bp, Homo sapiens
cacggatccatgtagcagga

SEQ ID NO: 1256806 - DNA, 17 bp, Homo sapiens
cacggcagaccagaacg

SEQ ID NO: 1256807 - DNA, 13 bp, Homo sapiens
cacggcagccaca

SEQ ID NO: 1256808 - DNA, 19 bp, Homo sapiens
cacggcaggcgtgtggcag

SEQ ID NO: 1256809 - DNA, 22 bp, Homo sapiens
cacggcatcgcatccgtcctgg

SEQ ID NO: 1256810 - DNA, 19 bp, Homo sapiens
cacggccacatcaaagagg

SEQ ID NO: 1256811 - DNA, 14 bp, Homo sapiens
cacggccaccctcc

SEQ ID NO: 1256812 - DNA, 19 bp, Homo sapiens
cacggcccggcccctcacc

SEQ ID NO: 1256813 - DNA, 23 bp, Homo sapiens
cacggcccggcccctcaccctct

SEQ ID NO: 1256814 - DNA, 12 bp, Homo sapiens
cacggcctttct

SEQ ID NO: 1256815 - DNA, 20 bp, Homo sapiens
cacggcgggatcctccacag

SEQ ID NO: 1256816 - DNA, 23 bp, Homo sapiens
cacggcgggatcctccacagaga

SEQ ID NO: 1256817 - DNA, 15 bp, Homo sapiens
cacggcgttgtacct

SEQ ID NO: 1256818 - DNA, 17 bp, Homo sapiens
cacggcgtttttttaca

SEQ ID NO: 1256819 - DNA, 13 bp, Homo sapiens
cacggctggtcac

SEQ ID NO: 1256820 - DNA, 18 bp, Homo sapiens
cacgggatgcgtgggagg

SEQ ID NO: 1256821 - DNA, 20 bp, Homo sapiens
cacgggatgcgtgggaggca

SEQ ID NO: 1256822 - DNA, 21 bp, Homo sapiens
cacgggatgcgtgggaggcag

SEQ ID NO: 1256823 - DNA, 14 bp, Homo sapiens
cacgggccctgccc

SEQ ID NO: 1256824 - DNA, 15 bp, Homo sapiens
cacgggtggtccccg

SEQ ID NO: 1256825 - DNA, 17 bp, Homo sapiens
cacggtatttatagaga

SEQ ID NO: 1256826 - DNA, 17 bp, Homo sapiens
cacggtccgcggcctgc

SEQ ID NO: 1256827 - DNA, 15 bp, Homo sapiens
cacggtgaaacccca

SEQ ID NO: 1256828 - DNA, 20 bp, Homo sapiens
cacggtgacacaggtcaggg

SEQ ID NO: 1256829 - DNA, 22 bp, Homo sapiens
cacggtgacacaggtcagggct

SEQ ID NO: 1256830 - DNA, 17 bp, Homo sapiens
cacggtgactctgtcca

SEQ ID NO: 1256831 - DNA, 20 bp, Homo sapiens
cacggtgcccaaacaccagt

SEQ ID NO: 1256832 - DNA, 15 bp, Homo sapiens
cacggtgcgtggctg

SEQ ID NO: 1256833 - DNA, 19 bp, Homo sapiens
cacggtgcgtggctgtggc

SEQ ID NO: 1256834 - DNA, 23 bp, Homo sapiens
cacggtgtccaccatccccagct

SEQ ID NO: 1256835 - DNA, 15 bp, Homo sapiens
cacgtaaatattcat

SEQ ID NO: 1256836 - DNA, 22 bp, Homo sapiens
cacgtaagatacaagtttcaga

SEQ ID NO: 1256837 - DNA, 21 bp, Homo sapiens
cacgtacacaccacgtcctgg

SEQ ID NO: 1256838 - DNA, 14 bp, Homo sapiens
cacgtattgctgtg

SEQ ID NO: 1256839 - DNA, 19 bp, Homo sapiens
cacgtatttatatttggaa

SEQ ID NO: 1256840 - DNA, 19 bp, Homo sapiens
cacgtatttcacagagcac

SEQ ID NO: 1256841 - DNA, 18 bp, Homo sapiens
cacgtcatgtctctaaac

SEQ ID NO: 1256842 - DNA, 19 bp, Homo sapiens
cacgtcccaccccacctct

SEQ ID NO: 1256843 - DNA, 13 bp, Homo sapiens
cacgtcccgctgc

SEQ ID NO: 1256844 - DNA, 16 bp, Homo sapiens
cacgtcccgctgcctc

SEQ ID NO: 1256845 - DNA, 13 bp, Homo sapiens
cacgtcctgagaa

SEQ ID NO: 1256846 - DNA, 13 bp, Homo sapiens
cacgtctgccagg

SEQ ID NO: 1256847 - DNA, 20 bp, Homo sapiens
cacgtctgccaggcccatct

SEQ ID NO: 1256848 - DNA, 18 bp, Homo sapiens
cacgtctggccaggcact

SEQ ID NO: 1256849 - DNA, 22 bp, Homo sapiens
cacgtctggccaggcactgcct

SEQ ID NO: 1256850 - DNA, 17 bp, Homo sapiens
cacgtctggctccctgc

SEQ ID NO: 1256851 - DNA, 19 bp, Homo sapiens
cacgtctggctccctgccc

SEQ ID NO: 1256852 - DNA, 21 bp, Homo sapiens
cacgtctggctccctgcccct

SEQ ID NO: 1256853 - DNA, 18 bp, Homo sapiens
cacgtcttggtgcctttt

SEQ ID NO: 1256854 - DNA, 15 bp, Homo sapiens
cacgtgaaactgctg

SEQ ID NO: 1256855 - DNA, 22 bp, Homo sapiens
cacgtgaaatttgcctctgtcc

SEQ ID NO: 1256856 - DNA, 12 bp, Homo sapiens
cacgtgaatggc

SEQ ID NO: 1256857 - DNA, 14 bp, Homo sapiens
cacgtgacaggctc

SEQ ID NO: 1256858 - DNA, 15 bp, Homo sapiens
cacgtgacaggctcg

SEQ ID NO: 1256859 - DNA, 22 bp, Homo sapiens
cacgtgacaggctcgtcagcca

SEQ ID NO: 1256860 - DNA, 13 bp, Homo sapiens
cacgtgcaggaca

SEQ ID NO: 1256861 - DNA, 20 bp, Homo sapiens
cacgtgcaggacagctcttg

SEQ ID NO: 1256862 - DNA, 15 bp, Homo sapiens
cacgtgccaggcccg

SEQ ID NO: 1256863 - DNA, 16 bp, Homo sapiens
cacgtgccaggcccgg

SEQ ID NO: 1256864 - DNA, 17 bp, Homo sapiens
cacgtggagatagtgcc

SEQ ID NO: 1256865 - DNA, 20 bp, Homo sapiens
cacgtggaggaatgctcccc

SEQ ID NO: 1256866 - DNA, 18 bp, Homo sapiens
cacgtggcatgtggcctg

SEQ ID NO: 1256867 - DNA, 22 bp, Homo sapiens
cactcaccagggtccgcaccag

SEQ ID NO: 1256868 - DNA, 24 bp, Homo sapiens
cactcaccagggtccgcaccagct

SEQ ID NO: 1256869 - DNA, 14 bp, Homo sapiens
cactcaccagtggc

SEQ ID NO: 1256870 - DNA, 15 bp, Homo sapiens
cactcaccagtggcc

SEQ ID NO: 1256871 - DNA, 18 bp, Homo sapiens
cactcaccagtgtcccct

SEQ ID NO: 1256872 - DNA, 16 bp, Homo sapiens
cactcacccatgtgcc

SEQ ID NO: 1256873 - DNA, 22 bp, Homo sapiens
cactcacccttcctggcccagg

SEQ ID NO: 1256874 - DNA, 22 bp, Homo sapiens
cactcactaggcccccacttgc

SEQ ID NO: 1256875 - DNA, 13 bp, Homo sapiens
cactcactcactc

SEQ ID NO: 1256876 - DNA, 18 bp, Homo sapiens
cactcactccaagaccac

SEQ ID NO: 1256877 - DNA, 13 bp, Homo sapiens
cactcactgaggc

SEQ ID NO: 1256878 - DNA, 17 bp, Homo sapiens
cactcactgaggccatc

SEQ ID NO: 1256879 - DNA, 22 bp, Homo sapiens
cactcactgaggccatcagggc

SEQ ID NO: 1256880 - DNA, 13 bp, Homo sapiens
cactcagcacaag

SEQ ID NO: 1256881 - DNA, 15 bp, Homo sapiens
cactcagcacaaggc

SEQ ID NO: 1256882 - DNA, 15 bp, Homo sapiens
cactcagccatttcc

SEQ ID NO: 1256883 - DNA, 21 bp, Homo sapiens
cactcagccatttccccctcc

SEQ ID NO: 1256884 - DNA, 23 bp, Homo sapiens
cactcagccatttccccctcctc

SEQ ID NO: 1256885 - DNA, 22 bp, Homo sapiens
cactcagctcttggctccactg

SEQ ID NO: 1256886 - DNA, 21 bp, Homo sapiens
cactcagcttaattctccttc

SEQ ID NO: 1256887 - DNA, 21 bp, Homo sapiens
cactcaggaggctgaggcagg

SEQ ID NO: 1256888 - DNA, 14 bp, Homo sapiens
cactcaggccacag

SEQ ID NO: 1256889 - DNA, 20 bp, Homo sapiens
cactcaggccacagtggggc

SEQ ID NO: 1256890 - DNA, 12 bp, Homo sapiens
cactcagggcag

SEQ ID NO: 1256891 - DNA, 19 bp, Homo sapiens
cactcagggcagctgcctg

SEQ ID NO: 1256892 - DNA, 17 bp, Homo sapiens
cactcagtactgtacag

SEQ ID NO: 1256893 - DNA, 15 bp, Homo sapiens
cactcagtccactgt

SEQ ID NO: 1256894 - DNA, 23 bp, Homo sapiens
cactcagtcccccaccacactga

SEQ ID NO: 1256895 - DNA, 14 bp, Homo sapiens
cactcagtgagcct

SEQ ID NO: 1256896 - DNA, 16 bp, Homo sapiens
cactcagttgcagggt

SEQ ID NO: 1256897 - DNA, 20 bp, Homo sapiens
cactcatgcaaactgcttta

SEQ ID NO: 1256898 - DNA, 21 bp, Homo sapiens
cactcatgcaaactgctttat

SEQ ID NO: 1256899 - DNA, 22 bp, Homo sapiens
cactcatgcaaactgctttatt

SEQ ID NO: 1256900 - DNA, 16 bp, Homo sapiens
cactcatgtggactgg

SEQ ID NO: 1256901 - DNA, 18 bp, Homo sapiens
cactcattctgaattaat

SEQ ID NO: 1256902 - DNA, 19 bp, Homo sapiens
cactcattgctgagcctct

SEQ ID NO: 1256903 - DNA, 13 bp, Homo sapiens
cactcatttcatc

SEQ ID NO: 1256904 - DNA, 18 bp, Homo sapiens
cactcatttcatctcatt

SEQ ID NO: 1256905 - DNA, 22 bp, Homo sapiens
cactcatttcatctcatttaag

SEQ ID NO: 1256906 - DNA, 12 bp, Homo sapiens
cactccaaactc

SEQ ID NO: 1256907 - DNA, 19 bp, Homo sapiens
cactccaagaccaccaggg

SEQ ID NO: 1256908 - DNA, 20 bp, Homo sapiens
cactccaagaccaccagggt

SEQ ID NO: 1256909 - DNA, 15 bp, Homo sapiens
cactccaagccccct

SEQ ID NO: 1256910 - DNA, 20 bp, Homo sapiens
cactccaagccccctggcag

SEQ ID NO: 1256911 - DNA, 23 bp, Homo sapiens
cactccaataggtgctgagtgta

SEQ ID NO: 1256912 - DNA, 16 bp, Homo sapiens
cactccaatctgggtg

SEQ ID NO: 1256913 - DNA, 15 bp, Homo sapiens
cactccacagagtga

SEQ ID NO: 1256914 - DNA, 10 bp, Homo sapiens
cactccacca

SEQ ID NO: 1256915 - DNA, 14 bp, Homo sapiens
cactccaccaccca

SEQ ID NO: 1256916 - DNA, 15 bp, Homo sapiens
cactccaccacccaa

SEQ ID NO: 1256917 - DNA, 18 bp, Homo sapiens
cactccaccacccaaaag

SEQ ID NO: 1256918 - DNA, 12 bp, Homo sapiens
cactccaccatc

SEQ ID NO: 1256919 - DNA, 19 bp, Homo sapiens
cactccaccctgttagttt

SEQ ID NO: 1256920 - DNA, 16 bp, Homo sapiens
cactccacctccaccc

SEQ ID NO: 1256921 - DNA, 17 bp, Homo sapiens
cactccacctccaccca

SEQ ID NO: 1256922 - DNA, 13 bp, Homo sapiens
cactccactctga

SEQ ID NO: 1256923 - DNA, 23 bp, Homo sapiens
cactccacttgaagcacttaagt

SEQ ID NO: 1256924 - DNA, 16 bp, Homo sapiens
cactccagacccctgg

SEQ ID NO: 1256925 - DNA, 12 bp, Homo sapiens
cactccagcctg

SEQ ID NO: 1256926 - DNA, 14 bp, Homo sapiens
cactccagcctgag

SEQ ID NO: 1256927 - DNA, 13 bp, Homo sapiens
cactccagcctgg

SEQ ID NO: 1256928 - DNA, 23 bp, Homo sapiens
cactccagcctgggcgacagagc

SEQ ID NO: 1256929 - DNA, 21 bp, Homo sapiens
cactccagggacacacagcct

SEQ ID NO: 1256930 - DNA, 18 bp, Homo sapiens
cactccagtagctcctgg

SEQ ID NO: 1256931 - DNA, 16 bp, Homo sapiens
cactccagtgccagca

SEQ ID NO: 1256932 - DNA, 20 bp, Homo sapiens
cactccagttttctcctctg

SEQ ID NO: 1256933 - DNA, 23 bp, Homo sapiens
cactccatgcttagtcactgcct

SEQ ID NO: 1256934 - DNA, 14 bp, Homo sapiens
cactccatggccac

SEQ ID NO: 1256935 - DNA, 17 bp, Homo sapiens
cactccatggccacccc

SEQ ID NO: 1256936 - DNA, 19 bp, Homo sapiens
cactcccaagggacagcaa

SEQ ID NO: 1256937 - DNA, 22 bp, Homo sapiens
cactcccacctgacacaccagg

SEQ ID NO: 1256938 - DNA, 14 bp, Homo sapiens
cactcccataagct

SEQ ID NO: 1256939 - DNA, 16 bp, Homo sapiens
cactcccatctcctta

SEQ ID NO: 1256940 - DNA, 10 bp, Homo sapiens
cactccccac

SEQ ID NO: 1256941 - DNA, 15 bp, Homo sapiens
cactccccaccttca

SEQ ID NO: 1256942 - DNA, 15 bp, Homo sapiens
cactccccagagctg

SEQ ID NO: 1256943 - DNA, 19 bp, Homo sapiens
cactccccagagctgtgcc

SEQ ID NO: 1256944 - DNA, 20 bp, Homo sapiens
cactccccagagctgtgcca

SEQ ID NO: 1256945 - DNA, 15 bp, Homo sapiens
cactccccagcccca

SEQ ID NO: 1256946 - DNA, 17 bp, Homo sapiens
cactccccagccccagc

SEQ ID NO: 1256947 - DNA, 13 bp, Homo sapiens
cactccccaggga

SEQ ID NO: 1256948 - DNA, 14 bp, Homo sapiens
cactccccagggag

SEQ ID NO: 1256949 - DNA, 22 bp, Homo sapiens
cactccccagggagctctgggg

SEQ ID NO: 1256950 - DNA, 16 bp, Homo sapiens
cactccccatgccacg

SEQ ID NO: 1256951 - DNA, 18 bp, Homo sapiens
cactcccccacccatggg

SEQ ID NO: 1256952 - DNA, 23 bp, Homo sapiens
cactcccccacccatggggagga

SEQ ID NO: 1256953 - DNA, 15 bp, Homo sapiens
cactcccccacctga

SEQ ID NO: 1256954 - DNA, 15 bp, Homo sapiens
cactcccccttccct

SEQ ID NO: 1256955 - DNA, 21 bp, Homo sapiens
cactcccccttcccttggagg

SEQ ID NO: 1256956 - DNA, 22 bp, Homo sapiens
cactcccccttcccttggaggg

SEQ ID NO: 1256957 - DNA, 19 bp, Homo sapiens
cactccccgaagtcttttg

SEQ ID NO: 1256958 - DNA, 14 bp, Homo sapiens
cactccccgcggtt

SEQ ID NO: 1256959 - DNA, 14 bp, Homo sapiens
cactcccctagggg

SEQ ID NO: 1256960 - DNA, 22 bp, Homo sapiens
cactcccctcacacacaccccc

SEQ ID NO: 1256961 - DNA, 13 bp, Homo sapiens
cactcccgaaagc

SEQ ID NO: 1256962 - DNA, 19 bp, Homo sapiens
cactcccgaaagcctttcc

SEQ ID NO: 1256963 - DNA, 23 bp, Homo sapiens
cactcccgctgcacacagacggc

SEQ ID NO: 1256964 - DNA, 21 bp, Homo sapiens
cactcccggcactccatgctt

SEQ ID NO: 1256965 - DNA, 14 bp, Homo sapiens
cactccctaattta

SEQ ID NO: 1256966 - DNA, 20 bp, Homo sapiens
cactccctaatttatgtgct

SEQ ID NO: 1256967 - DNA, 12 bp, Homo sapiens
cactccctaccc

SEQ ID NO: 1256968 - DNA, 13 bp, Homo sapiens
cactccctaccca

SEQ ID NO: 1256969 - DNA, 11 bp, Homo sapiens
cactccctccc

SEQ ID NO: 1256970 - DNA, 13 bp, Homo sapiens
cactccctcccag

SEQ ID NO: 1256971 - DNA, 14 bp, Homo sapiens
cactccctcccaga

SEQ ID NO: 1256972 - DNA, 12 bp, Homo sapiens
cactccctgctc

SEQ ID NO: 1256973 - DNA, 14 bp, Homo sapiens
cactccctgctcca

SEQ ID NO: 1256974 - DNA, 18 bp, Homo sapiens
cactccctggccttgccc

SEQ ID NO: 1256975 - DNA, 11 bp, Homo sapiens
cactccctggg

SEQ ID NO: 1256976 - DNA, 19 bp, Homo sapiens
cactcccttgctggcccca

SEQ ID NO: 1256977 - DNA, 20 bp, Homo sapiens
cactcccttgggctccctgt

SEQ ID NO: 1256978 - DNA, 17 bp, Homo sapiens
cactccgcgccgatgcc

SEQ ID NO: 1256979 - DNA, 15 bp, Homo sapiens
cactccggtcagccc

SEQ ID NO: 1256980 - DNA, 20 bp, Homo sapiens
cactccggtgtgcctgcagc

SEQ ID NO: 1256981 - DNA, 14 bp, Homo sapiens
cactcctacctggt

SEQ ID NO: 1256982 - DNA, 14 bp, Homo sapiens
cactcctaggagag

SEQ ID NO: 1256983 - DNA, 17 bp, Homo sapiens
cactcctaggagagcca

SEQ ID NO: 1256984 - DNA, 19 bp, Homo sapiens
cactcctaggagagccaac

SEQ ID NO: 1256985 - DNA, 15 bp, Homo sapiens
cactcctccaaagga

SEQ ID NO: 1256986 - DNA, 14 bp, Homo sapiens
cactcctccagcca

SEQ ID NO: 1256987 - DNA, 13 bp, Homo sapiens
cactcctccctcc

SEQ ID NO: 1256988 - DNA, 14 bp, Homo sapiens
cactcctctccacc

SEQ ID NO: 1256989 - DNA, 17 bp, Homo sapiens
cactcctctccaccaga

SEQ ID NO: 1256990 - DNA, 15 bp, Homo sapiens
cactgctggctgcct

SEQ ID NO: 1256991 - DNA, 13 bp, Homo sapiens
cactgctgtccac

SEQ ID NO: 1256992 - DNA, 14 bp, Homo sapiens
cactgctgtcctct

SEQ ID NO: 1256993 - DNA, 15 bp, Homo sapiens
cactgctgtcctctc

SEQ ID NO: 1256994 - DNA, 18 bp, Homo sapiens
cactgctgtcctctcccc

SEQ ID NO: 1256995 - DNA, 22 bp, Homo sapiens
cactgctgtgagtgcgcctcac

SEQ ID NO: 1256996 - DNA, 19 bp, Homo sapiens
cactgctgttcctgctcca

SEQ ID NO: 1256997 - DNA, 19 bp, Homo sapiens
cactgcttctcggccagcc

SEQ ID NO: 1256998 - DNA, 21 bp, Homo sapiens
cactgcttctcggccagcccg

SEQ ID NO: 1256999 - DNA, 14 bp, Homo sapiens
cactgcttgaggaa

SEQ ID NO: 1257000 - DNA, 13 bp, Homo sapiens
cactgcttttccc

SEQ ID NO: 1257001 - DNA, 15 bp, Homo sapiens
cactggaaaaggtga

SEQ ID NO: 1257002 - DNA, 15 bp, Homo sapiens
cactggaaaggggag

SEQ ID NO: 1257003 - DNA, 17 bp, Homo sapiens
cactggaacatggctag

SEQ ID NO: 1257004 - DNA, 12 bp, Homo sapiens
cactggaatata

SEQ ID NO: 1257005 - DNA, 16 bp, Homo sapiens
cactggacaacactga

SEQ ID NO: 1257006 - DNA, 23 bp, Homo sapiens
cactggacaacactgattcctgg

SEQ ID NO: 1257007 - DNA, 21 bp, Homo sapiens
cactggaccccactggctgag

SEQ ID NO: 1257008 - DNA, 18 bp, Homo sapiens
cactggactcacctcccc

SEQ ID NO: 1257009 - DNA, 19 bp, Homo sapiens
cactggactccggccctcc

SEQ ID NO: 1257010 - DNA, 14 bp, Homo sapiens
cactggactgcatg

SEQ ID NO: 1257011 - DNA, 15 bp, Homo sapiens
cactggactgcatgg

SEQ ID NO: 1257012 - DNA, 22 bp, Homo sapiens
cactggactgcatggggaggca

SEQ ID NO: 1257013 - DNA, 20 bp, Homo sapiens
cactggagaagaatatcaaa

SEQ ID NO: 1257014 - DNA, 21 bp, Homo sapiens
cactggagaagaatatcaaat

SEQ ID NO: 1257015 - DNA, 21 bp, Homo sapiens
cactggagcaccaggcacgaa

SEQ ID NO: 1257016 - DNA, 15 bp, Homo sapiens
cactggagccacagg

SEQ ID NO: 1257017 - DNA, 18 bp, Homo sapiens
cactggagccacaggcag

SEQ ID NO: 1257018 - DNA, 13 bp, Homo sapiens
cactggagcccag

SEQ ID NO: 1257019 - DNA, 16 bp, Homo sapiens
cactggagctgggagg

SEQ ID NO: 1257020 - DNA, 18 bp, Homo sapiens
cactggaggagagaagaa

SEQ ID NO: 1257021 - DNA, 22 bp, Homo sapiens
cactggaggagagaagaatgag

SEQ ID NO: 1257022 - DNA, 15 bp, Homo sapiens
cactggaggagcagc

SEQ ID NO: 1257023 - DNA, 18 bp, Homo sapiens
cactggaggagcagcttc

SEQ ID NO: 1257024 - DNA, 18 bp, Homo sapiens
cactggaggttgaagcca

SEQ ID NO: 1257025 - DNA, 20 bp, Homo sapiens
cactggagtgcagggaggag

SEQ ID NO: 1257026 - DNA, 22 bp, Homo sapiens
cactggagttacattaatgtta

SEQ ID NO: 1257027 - DNA, 15 bp, Homo sapiens
cactggatgcagaaa

SEQ ID NO: 1257028 - DNA, 13 bp, Homo sapiens
cactggcagagca

SEQ ID NO: 1257029 - DNA, 18 bp, Homo sapiens
cactggcagagcacagcc

SEQ ID NO: 1257030 - DNA, 21 bp, Homo sapiens
cactggcagagcacagcccac

SEQ ID NO: 1257031 - DNA, 21 bp, Homo sapiens
cactggcatcgcagcttcctg

SEQ ID NO: 1257032 - DNA, 14 bp, Homo sapiens
cactggcattgtcc

SEQ ID NO: 1257033 - DNA, 17 bp, Homo sapiens
cactggccacagttgtt

SEQ ID NO: 1257034 - DNA, 14 bp, Homo sapiens
cactggccaccagg

SEQ ID NO: 1257035 - DNA, 15 bp, Homo sapiens
cactggccaccaggc

SEQ ID NO: 1257036 - DNA, 18 bp, Homo sapiens
cactggccaccaggctgg

SEQ ID NO: 1257037 - DNA, 22 bp, Homo sapiens
cactggccaccaggctggcgca

SEQ ID NO: 1257038 - DNA, 24 bp, Homo sapiens
cactggccaccaggctggcgcagc

SEQ ID NO: 1257039 - DNA, 20 bp, Homo sapiens
cactggccacccctccccag

SEQ ID NO: 1257040 - DNA, 11 bp, Homo sapiens
cactggccaga

SEQ ID NO: 1257041 - DNA, 16 bp, Homo sapiens
cactggccagagaggg

SEQ ID NO: 1257042 - DNA, 19 bp, Homo sapiens
cactggccagagagggccc

SEQ ID NO: 1257043 - DNA, 22 bp, Homo sapiens
cactggccagagagggcccagc

SEQ ID NO: 1257044 - DNA, 22 bp, Homo sapiens
cactggcccctagaatcagcct

SEQ ID NO: 1257045 - DNA, 15 bp, Homo sapiens
cactggctctccaag

SEQ ID NO: 1257046 - DNA, 21 bp, Homo sapiens
cactggctctccaagtgccag

SEQ ID NO: 1257047 - DNA, 17 bp, Homo sapiens
cactggctctcctggcc

SEQ ID NO: 1257048 - DNA, 22 bp, Homo sapiens
cactggctgaacttggagaggg

SEQ ID NO: 1257049 - DNA, 14 bp, Homo sapiens
cactggctgagaat

SEQ ID NO: 1257050 - DNA, 21 bp, Homo sapiens
cactggctgagcggatgcatc

SEQ ID NO: 1257051 - DNA, 14 bp, Homo sapiens
cactggctggcctg

SEQ ID NO: 1257052 - DNA, 17 bp, Homo sapiens
cactggctggcctgagc

SEQ ID NO: 1257053 - DNA, 23 bp, Homo sapiens
cactggctgggagtccttacctc

SEQ ID NO: 1257054 - DNA, 14 bp, Homo sapiens
cactggctggggca

SEQ ID NO: 1257055 - DNA, 20 bp, Homo sapiens
cactggctggggcagagggg

SEQ ID NO: 1257056 - DNA, 22 bp, Homo sapiens
cactggctgtcagtatgacatt

SEQ ID NO: 1257057 - DNA, 20 bp, Homo sapiens
cactggcttgaaggactgca

SEQ ID NO: 1257058 - DNA, 21 bp, Homo sapiens
cactgggaagaagcaagggca

SEQ ID NO: 1257059 - DNA, 14 bp, Homo sapiens
cactgggaagctgg

SEQ ID NO: 1257060 - DNA, 23 bp, Homo sapiens
cactgggaagctggagtgctgct

SEQ ID NO: 1257061 - DNA, 14 bp, Homo sapiens
cactgggaaggaaa

SEQ ID NO: 1257062 - DNA, 15 bp, Homo sapiens
cactgggaaggaaac

SEQ ID NO: 1257063 - DNA, 20 bp, Homo sapiens
cactgggaaggaaacaaatg

SEQ ID NO: 1257064 - DNA, 23 bp, Homo sapiens
cactgggaaggaaacaaatgtgt

SEQ ID NO: 1257065 - DNA, 19 bp, Homo sapiens
cactgggactcccagcaga

SEQ ID NO: 1257066 - DNA, 21 bp, Homo sapiens
cactgggactcccagcagagc

SEQ ID NO: 1257067 - DNA, 22 bp, Homo sapiens
cactgggactcccagcagagcc

SEQ ID NO: 1257068 - DNA, 12 bp, Homo sapiens
cactgggagagc

SEQ ID NO: 1257069 - DNA, 16 bp, Homo sapiens
cactgggagaggtgcc

SEQ ID NO: 1257070 - DNA, 21 bp, Homo sapiens
cactgggaggcagggctctcc

SEQ ID NO: 1257071 - DNA, 20 bp, Homo sapiens
cactgggatgagccgctgtg

SEQ ID NO: 1257072 - DNA, 14 bp, Homo sapiens
cactgggcacctgc

SEQ ID NO: 1257073 - DNA, 11 bp, Homo sapiens
cactgggcagg

SEQ ID NO: 1257074 - DNA, 16 bp, Homo sapiens
cactgggcaggttcct

SEQ ID NO: 1257075 - DNA, 21 bp, Homo sapiens
cactgggcaggttcctggggc

SEQ ID NO: 1257076 - DNA, 15 bp, Homo sapiens
cactgggccagccct

SEQ ID NO: 1257077 - DNA, 21 bp, Homo sapiens
cactgggcccctgtccccagt

SEQ ID NO: 1257078 - DNA, 12 bp, Homo sapiens
cactgggcctgg

SEQ ID NO: 1257079 - DNA, 13 bp, Homo sapiens
cactgggcctgga

SEQ ID NO: 1257080 - DNA, 14 bp, Homo sapiens
cactgggcctggag

SEQ ID NO: 1257081 - DNA, 20 bp, Homo sapiens
cactgggcgtctgactccct

SEQ ID NO: 1257082 - DNA, 15 bp, Homo sapiens
cactgggctctggac

SEQ ID NO: 1257083 - DNA, 17 bp, Homo sapiens
cactgggctctggacct

SEQ ID NO: 1257084 - DNA, 21 bp, Homo sapiens
cactggggaaaaataaacaat

SEQ ID NO: 1257085 - DNA, 18 bp, Homo sapiens
cactggggactttattta

SEQ ID NO: 1257086 - DNA, 22 bp, Homo sapiens
cactggggagcccgtctcagtg

SEQ ID NO: 1257087 - DNA, 15 bp, Homo sapiens
cactgggggagggga

SEQ ID NO: 1257088 - DNA, 21 bp, Homo sapiens
cactgggggaggggacattga

SEQ ID NO: 1257089 - DNA, 19 bp, Homo sapiens
cactggggtccagggagca

SEQ ID NO: 1257090 - DNA, 15 bp, Homo sapiens
cactggggtcctggg

SEQ ID NO: 1257091 - DNA, 18 bp, Homo sapiens
cactggggtcctggggcc

SEQ ID NO: 1257092 - DNA, 19 bp, Homo sapiens
cactggggtcctggggcct

SEQ ID NO: 1257093 - DNA, 21 bp, Homo sapiens
cactgggtacccaagtgaagg

SEQ ID NO: 1257094 - DNA, 18 bp, Homo sapiens
cactgggtctcactcctg

SEQ ID NO: 1257095 - DNA, 18 bp, Homo sapiens
cactgggtggggtgagga

SEQ ID NO: 1257096 - DNA, 19 bp, Homo sapiens
cactgggtggggtgaggac

SEQ ID NO: 1257097 - DNA, 17 bp, Homo sapiens
cactgggtggtggcctg

SEQ ID NO: 1257098 - DNA, 18 bp, Homo sapiens
cactgggtggtggcctgg

SEQ ID NO: 1257099 - DNA, 23 bp, Homo sapiens
cactgggtgttgatcttacaaga

SEQ ID NO: 1257100 - DNA, 22 bp, Homo sapiens
cactggtacttagagtttctgt

SEQ ID NO: 1257101 - DNA, 21 bp, Homo sapiens
cactggtaggttgggacacca

SEQ ID NO: 1257102 - DNA, 22 bp, Homo sapiens
cactggtaggttgggacaccag

SEQ ID NO: 1257103 - DNA, 13 bp, Homo sapiens
cactggtcagggc

SEQ ID NO: 1257104 - DNA, 16 bp, Homo sapiens
cactggtcagggcagt

SEQ ID NO: 1257105 - DNA, 18 bp, Homo sapiens
cactggtcagggcagtgg

SEQ ID NO: 1257106 - DNA, 19 bp, Homo sapiens
cactggtcagggcagtggc

SEQ ID NO: 1257107 - DNA, 20 bp, Homo sapiens
cactggtccaggtcttcagt

SEQ ID NO: 1257108 - DNA, 15 bp, Homo sapiens
cactggtctgtcttt

SEQ ID NO: 1257109 - DNA, 20 bp, Homo sapiens
cactggtctgtttgcatttg

SEQ ID NO: 1257110 - DNA, 17 bp, Homo sapiens
cactggtgaactgagct

SEQ ID NO: 1257111 - DNA, 19 bp, Homo sapiens
cactttaattgaagaactg

SEQ ID NO: 1257112 - DNA, 21 bp, Homo sapiens
cactttacaatgttcatccca

SEQ ID NO: 1257113 - DNA, 19 bp, Homo sapiens
cactttacacaagaatcta

SEQ ID NO: 1257114 - DNA, 19 bp, Homo sapiens
cactttacccacctagaac

SEQ ID NO: 1257115 - DNA, 20 bp, Homo sapiens
cactttacccacctagaaca

SEQ ID NO: 1257116 - DNA, 10 bp, Homo sapiens
cactttagac

SEQ ID NO: 1257117 - DNA, 14 bp, Homo sapiens
cactttagatgctg

SEQ ID NO: 1257118 - DNA, 15 bp, Homo sapiens
cactttagggctgta

SEQ ID NO: 1257119 - DNA, 18 bp, Homo sapiens
cactttataagtcattgt

SEQ ID NO: 1257120 - DNA, 20 bp, Homo sapiens
cactttataagtcattgtat

SEQ ID NO: 1257121 - DNA, 14 bp, Homo sapiens
cactttatattttc

SEQ ID NO: 1257122 - DNA, 19 bp, Homo sapiens
cactttattacaagatctt

SEQ ID NO: 1257123 - DNA, 12 bp, Homo sapiens
cactttcatttt

SEQ ID NO: 1257124 - DNA, 23 bp, Homo sapiens
cactttccactccctgcttagga

SEQ ID NO: 1257125 - DNA, 17 bp, Homo sapiens
cactttccacttcttcc

SEQ ID NO: 1257126 - DNA, 12 bp, Homo sapiens
cactttccctag

SEQ ID NO: 1257127 - DNA, 17 bp, Homo sapiens
cactttctaatgtttct

SEQ ID NO: 1257128 - DNA, 12 bp, Homo sapiens
cactttctcttc

SEQ ID NO: 1257129 - DNA, 15 bp, Homo sapiens
cactttctcttcaat

SEQ ID NO: 1257130 - DNA, 13 bp, Homo sapiens
cactttctgctgg

SEQ ID NO: 1257131 - DNA, 14 bp, Homo sapiens
cactttgaaaagtt

SEQ ID NO: 1257132 - DNA, 21 bp, Homo sapiens
cactttgaaaagttggaagga

SEQ ID NO: 1257133 - DNA, 16 bp, Homo sapiens
cactttgaaaatattt

SEQ ID NO: 1257134 - DNA, 21 bp, Homo sapiens
cactttgaaaatatttctatg

SEQ ID NO: 1257135 - DNA, 19 bp, Homo sapiens
cactttgaaatgtgtttct

SEQ ID NO: 1257136 - DNA, 18 bp, Homo sapiens
cactttgaagtctataaa

SEQ ID NO: 1257137 - DNA, 13 bp, Homo sapiens
cactttgacactt

SEQ ID NO: 1257138 - DNA, 17 bp, Homo sapiens
cactttgcaactccctg

SEQ ID NO: 1257139 - DNA, 14 bp, Homo sapiens
cactttgcacagct

SEQ ID NO: 1257140 - DNA, 17 bp, Homo sapiens
cactttgcacagctctc

SEQ ID NO: 1257141 - DNA, 21 bp, Homo sapiens
cactttgctctcaattaaagt

SEQ ID NO: 1257142 - DNA, 20 bp, Homo sapiens
cactttggaagtttgtgttc

SEQ ID NO: 1257143 - DNA, 13 bp, Homo sapiens
cactttggcttct

SEQ ID NO: 1257144 - DNA, 19 bp, Homo sapiens
cactttggcttctcctgtg

SEQ ID NO: 1257145 - DNA, 21 bp, Homo sapiens
cactttggcttctcctgtgac

SEQ ID NO: 1257146 - DNA, 12 bp, Homo sapiens
cactttgggagg

SEQ ID NO: 1257147 - DNA, 13 bp, Homo sapiens
cactttgggaggc

SEQ ID NO: 1257148 - DNA, 14 bp, Homo sapiens
cactttgggaggcc

SEQ ID NO: 1257149 - DNA, 16 bp, Homo sapiens
cactttgggaggccaa

SEQ ID NO: 1257150 - DNA, 23 bp, Homo sapiens
cactttgggaggctgaggcaggc

SEQ ID NO: 1257151 - DNA, 16 bp, Homo sapiens
cactttgtctgtacat

SEQ ID NO: 1257152 - DNA, 17 bp, Homo sapiens
cactttgtctgtacata

SEQ ID NO: 1257153 - DNA, 20 bp, Homo sapiens
cactttgttggcccttccag

SEQ ID NO: 1257154 - DNA, 21 bp, Homo sapiens
cactttgttggcccttccagt

SEQ ID NO: 1257155 - DNA, 23 bp, Homo sapiens
cactttgttggcccttccagtgg

SEQ ID NO: 1257156 - DNA, 17 bp, Homo sapiens
cactttgtttagaaaaa

SEQ ID NO: 1257157 - DNA, 18 bp, Homo sapiens
cactttgtttagaaaaaa

SEQ ID NO: 1257158 - DNA, 14 bp, Homo sapiens
cacttttaaaaaac

SEQ ID NO: 1257159 - DNA, 19 bp, Homo sapiens
cacttttaaaaaacaaaaa

SEQ ID NO: 1257160 - DNA, 23 bp, Homo sapiens
cacttttaaaaaacaaaaaaaga

SEQ ID NO: 1257161 - DNA, 15 bp, Homo sapiens
cacttttagaaatgc

SEQ ID NO: 1257162 - DNA, 17 bp, Homo sapiens
cacttttagaaatgcat

SEQ ID NO: 1257163 - DNA, 14 bp, Homo sapiens
cacttttattttca

SEQ ID NO: 1257164 - DNA, 13 bp, Homo sapiens
cacttttcatcct

SEQ ID NO: 1257165 - DNA, 20 bp, Homo sapiens
cacttttccttttcttaaaa

SEQ ID NO: 1257166 - DNA, 13 bp, Homo sapiens
cacttttcttctt

SEQ ID NO: 1257167 - DNA, 22 bp, Homo sapiens
cacttttgaagtcttccctcag

SEQ ID NO: 1257168 - DNA, 14 bp, Homo sapiens
cacttttgggcctt

SEQ ID NO: 1257169 - DNA, 14 bp, Homo sapiens
cacttttgttctgc

SEQ ID NO: 1257170 - DNA, 18 bp, Homo sapiens
cacttttgttctgcttta

SEQ ID NO: 1257171 - DNA, 20 bp, Homo sapiens
cacttttgttgcccaggctg

SEQ ID NO: 1257172 - DNA, 21 bp, Homo sapiens
cacttttgttgcccaggctgg

SEQ ID NO: 1257173 - DNA, 14 bp, Homo sapiens
cactttttatgcta

SEQ ID NO: 1257174 - DNA, 19 bp, Homo sapiens
cactttttgtattttttcc

SEQ ID NO: 1257175 - DNA, 14 bp, Homo sapiens
cacttttttataaa

SEQ ID NO: 1257176 - DNA, 18 bp, Homo sapiens
cactttttttctttttct

SEQ ID NO: 1257177 - DNA, 22 bp, Homo sapiens
cagaaaaaaaaaatgcatttac

SEQ ID NO: 1257178 - DNA, 22 bp, Homo sapiens
cagaaaaaaaagtgtctcaaag

SEQ ID NO: 1257179 - DNA, 14 bp, Homo sapiens
cagaaaaaaataac

SEQ ID NO: 1257180 - DNA, 15 bp, Homo sapiens
cagaaaaaaataact

SEQ ID NO: 1257181 - DNA, 18 bp, Homo sapiens
cagaaaaaaataactatt

SEQ ID NO: 1257182 - DNA, 20 bp, Homo sapiens
cagaaaaacaatcttattcc

SEQ ID NO: 1257183 - DNA, 22 bp, Homo sapiens
cagaaaaacaatggtaacattt

SEQ ID NO: 1257184 - DNA, 16 bp, Homo sapiens
cagaaaaactctggga

SEQ ID NO: 1257185 - DNA, 21 bp, Homo sapiens
cagaaaaagaaatgaacataa

SEQ ID NO: 1257186 - DNA, 17 bp, Homo sapiens
cagaaaaaggctgtgct

SEQ ID NO: 1257187 - DNA, 21 bp, Homo sapiens
cagaaaaataacttcaagcaa

SEQ ID NO: 1257188 - DNA, 18 bp, Homo sapiens
cagaaaaatgaaaagcaa

SEQ ID NO: 1257189 - DNA, 19 bp, Homo sapiens
cagaaaaatgaaaagcaat

SEQ ID NO: 1257190 - DNA, 16 bp, Homo sapiens
cagaaaacaacaaaag

SEQ ID NO: 1257191 - DNA, 17 bp, Homo sapiens
cagaaaacaacaaaaga

SEQ ID NO: 1257192 - DNA, 13 bp, Homo sapiens
cagaaaacagaga

SEQ ID NO: 1257193 - DNA, 22 bp, Homo sapiens
cagaaaacctctcctgacccct

SEQ ID NO: 1257194 - DNA, 16 bp, Homo sapiens
cagaaaagatgaattt

SEQ ID NO: 1257195 - DNA, 15 bp, Homo sapiens
cagaaaagcacctgc

SEQ ID NO: 1257196 - DNA, 16 bp, Homo sapiens
cagaaaagcacctgcc

SEQ ID NO: 1257197 - DNA, 19 bp, Homo sapiens
cagaaaagcacctgccgac

SEQ ID NO: 1257198 - DNA, 18 bp, Homo sapiens
cagaaaagggaagttgtg

SEQ ID NO: 1257199 - DNA, 13 bp, Homo sapiens
cagaaaagtgcct

SEQ ID NO: 1257200 - DNA, 19 bp, Homo sapiens
cagaaaagtgcctgagctg

SEQ ID NO: 1257201 - DNA, 12 bp, Homo sapiens
cagaaaataagg

SEQ ID NO: 1257202 - DNA, 17 bp, Homo sapiens
cagaaaattctgtgcct

SEQ ID NO: 1257203 - DNA, 16 bp, Homo sapiens
cagaaacaacagggga

SEQ ID NO: 1257204 - DNA, 19 bp, Homo sapiens
cagaaacagctgcttctcc

SEQ ID NO: 1257205 - DNA, 21 bp, Homo sapiens
cagaaacagggacaaagaaat

SEQ ID NO: 1257206 - DNA, 22 bp, Homo sapiens
cagaaacaggtgcatctgggga

SEQ ID NO: 1257207 - DNA, 14 bp, Homo sapiens
cagaaacagtggga

SEQ ID NO: 1257208 - DNA, 15 bp, Homo sapiens
cagaaacagtgggag

SEQ ID NO: 1257209 - DNA, 13 bp, Homo sapiens
cagaaacatctct

SEQ ID NO: 1257210 - DNA, 15 bp, Homo sapiens
cagaaaccaagccat

SEQ ID NO: 1257211 - DNA, 15 bp, Homo sapiens
cagaaaccagttatg

SEQ ID NO: 1257212 - DNA, 20 bp, Homo sapiens
cagaaacccggcttcctgtg

SEQ ID NO: 1257213 - DNA, 21 bp, Homo sapiens
cagaaacctatcctcactgcc

SEQ ID NO: 1257214 - DNA, 23 bp, Homo sapiens
cagaaacctatctcagggaggga

SEQ ID NO: 1257215 - DNA, 12 bp, Homo sapiens
cagaaactagaa

SEQ ID NO: 1257216 - DNA, 17 bp, Homo sapiens
cagaaactccttttgct

SEQ ID NO: 1257217 - DNA, 21 bp, Homo sapiens
cagaaactccttttgctgtct

SEQ ID NO: 1257218 - DNA, 18 bp, Homo sapiens
cagaaactgaaccaacag

SEQ ID NO: 1257219 - DNA, 22 bp, Homo sapiens
cagaaactggattaaaacaatt

SEQ ID NO: 1257220 - DNA, 20 bp, Homo sapiens
cagaaacttgtgaagtggaa

SEQ ID NO: 1257221 - DNA, 12 bp, Homo sapiens
cagaaagcaaca

SEQ ID NO: 1257222 - DNA, 16 bp, Homo sapiens
cagaaagcaacagtta

SEQ ID NO: 1257223 - DNA, 19 bp, Homo sapiens
cagaaagcactacaatcat

SEQ ID NO: 1257224 - DNA, 17 bp, Homo sapiens
cagaaagcctcctgccc

SEQ ID NO: 1257225 - DNA, 19 bp, Homo sapiens
cagaaagcctcctgccccc

SEQ ID NO: 1257226 - DNA, 15 bp, Homo sapiens
cagaaagcctctctc

SEQ ID NO: 1257227 - DNA, 19 bp, Homo sapiens
cagaaagcctgggtgacat

SEQ ID NO: 1257228 - DNA, 21 bp, Homo sapiens
cagaaagctgaggaacaggtt

SEQ ID NO: 1257229 - DNA, 14 bp, Homo sapiens
cagaaagctgcctg

SEQ ID NO: 1257230 - DNA, 12 bp, Homo sapiens
cagaaaggagac

SEQ ID NO: 1257231 - DNA, 12 bp, Homo sapiens
cagaaaggggct

SEQ ID NO: 1257232 - DNA, 22 bp, Homo sapiens
cagaaagggtgccagttgggct

SEQ ID NO: 1257233 - DNA, 14 bp, Homo sapiens
cagacgcagcagct

SEQ ID NO: 1257234 - DNA, 20 bp, Homo sapiens
cagacgcagcagctgggacc

SEQ ID NO: 1257235 - DNA, 16 bp, Homo sapiens
cagacgcctgaggaac

SEQ ID NO: 1257236 - DNA, 21 bp, Homo sapiens
cagacggccggccggacctct

SEQ ID NO: 1257237 - DNA, 23 bp, Homo sapiens
cagacggccggccggacctctga

SEQ ID NO: 1257238 - DNA, 18 bp, Homo sapiens
cagacggcctaggggtgg

SEQ ID NO: 1257239 - DNA, 18 bp, Homo sapiens
cagacgggaatgcctagg

SEQ ID NO: 1257240 - DNA, 13 bp, Homo sapiens
cagacggggctgg

SEQ ID NO: 1257241 - DNA, 19 bp, Homo sapiens
cagacggggctggagtgtg

SEQ ID NO: 1257242 - DNA, 17 bp, Homo sapiens
cagacggtctgtgtgct

SEQ ID NO: 1257243 - DNA, 19 bp, Homo sapiens
cagacgttaggcatttcct

SEQ ID NO: 1257244 - DNA, 22 bp, Homo sapiens
cagacgttaggcatttcctgct

SEQ ID NO: 1257245 - DNA, 23 bp, Homo sapiens
cagacgttaggcatttcctgctg

SEQ ID NO: 1257246 - DNA, 16 bp, Homo sapiens
cagacgttgcctgaga

SEQ ID NO: 1257247 - DNA, 14 bp, Homo sapiens
cagactaaaaagaa

SEQ ID NO: 1257248 - DNA, 15 bp, Homo sapiens
cagactaaaaagaat

SEQ ID NO: 1257249 - DNA, 16 bp, Homo sapiens
cagactagaagtattt

SEQ ID NO: 1257250 - DNA, 22 bp, Homo sapiens
cagactagatggacctgcctgc

SEQ ID NO: 1257251 - DNA, 21 bp, Homo sapiens
cagactagatgtagtattttt

SEQ ID NO: 1257252 - DNA, 15 bp, Homo sapiens
cagactagccactcc

SEQ ID NO: 1257253 - DNA, 18 bp, Homo sapiens
cagactcaagtacccatt

SEQ ID NO: 1257254 - DNA, 15 bp, Homo sapiens
cagactcacttgcca

SEQ ID NO: 1257255 - DNA, 15 bp, Homo sapiens
cagactcaggttcca

SEQ ID NO: 1257256 - DNA, 17 bp, Homo sapiens
cagactcaggttccaga

SEQ ID NO: 1257257 - DNA, 18 bp, Homo sapiens
cagactcaggttccagaa

SEQ ID NO: 1257258 - DNA, 19 bp, Homo sapiens
cagactcaggttccagaac

SEQ ID NO: 1257259 - DNA, 14 bp, Homo sapiens
cagactccagcccc

SEQ ID NO: 1257260 - DNA, 18 bp, Homo sapiens
cagactccagcccctgga

SEQ ID NO: 1257261 - DNA, 16 bp, Homo sapiens
cagactccggcctgta

SEQ ID NO: 1257262 - DNA, 18 bp, Homo sapiens
cagactcctcagatctga

SEQ ID NO: 1257263 - DNA, 16 bp, Homo sapiens
cagactcctgaggaca

SEQ ID NO: 1257264 - DNA, 23 bp, Homo sapiens
cagactccttcaacaattctaaa

SEQ ID NO: 1257265 - DNA, 17 bp, Homo sapiens
cagactcctttcctctg

SEQ ID NO: 1257266 - DNA, 22 bp, Homo sapiens
cagactcgattcatattgaata

SEQ ID NO: 1257267 - DNA, 14 bp, Homo sapiens
cagactctaggtta

SEQ ID NO: 1257268 - DNA, 21 bp, Homo sapiens
cagactctgagctgctcaccg

SEQ ID NO: 1257269 - DNA, 18 bp, Homo sapiens
cagactcttgcctgtttc

SEQ ID NO: 1257270 - DNA, 23 bp, Homo sapiens
cagactctttaataaattgctta

SEQ ID NO: 1257271 - DNA, 22 bp, Homo sapiens
cagactctttcgatacccagga

SEQ ID NO: 1257272 - DNA, 19 bp, Homo sapiens
cagactgaaacgccttgca

SEQ ID NO: 1257273 - DNA, 17 bp, Homo sapiens
cagactgaactcgcagg

SEQ ID NO: 1257274 - DNA, 23 bp, Homo sapiens
cagactgacagtttacagacgct

SEQ ID NO: 1257275 - DNA, 21 bp, Homo sapiens
cagactgacccccatctgagc

SEQ ID NO: 1257276 - DNA, 22 bp, Homo sapiens
cagactgacccccatctgagct

SEQ ID NO: 1257277 - DNA, 14 bp, Homo sapiens
cagactgagctctc

SEQ ID NO: 1257278 - DNA, 16 bp, Homo sapiens
cagactgagctctcca

SEQ ID NO: 1257279 - DNA, 17 bp, Homo sapiens
cagactgagctctccag

SEQ ID NO: 1257280 - DNA, 18 bp, Homo sapiens
cagactgagctctccagg

SEQ ID NO: 1257281 - DNA, 21 bp, Homo sapiens
cagactgagctctccaggcca

SEQ ID NO: 1257282 - DNA, 23 bp, Homo sapiens
cagactgagctctccaggccagg

SEQ ID NO: 1257283 - DNA, 17 bp, Homo sapiens
cagactgatgagcacat

SEQ ID NO: 1257284 - DNA, 18 bp, Homo sapiens
cagactgatgagcacatc

SEQ ID NO: 1257285 - DNA, 22 bp, Homo sapiens
cagactgatgagcacatctctc

SEQ ID NO: 1257286 - DNA, 14 bp, Homo sapiens
cagactgccccagc

SEQ ID NO: 1257287 - DNA, 18 bp, Homo sapiens
cagactgccccagccaac

SEQ ID NO: 1257288 - DNA, 16 bp, Homo sapiens
cagactgcttggccag

SEQ ID NO: 1257289 - DNA, 21 bp, Homo sapiens
cagactggaagacacttcaga

SEQ ID NO: 1257290 - DNA, 23 bp, Homo sapiens
cagactggagaaaacccctccca

SEQ ID NO: 1257291 - DNA, 18 bp, Homo sapiens
cagactggcaataaactc

SEQ ID NO: 1257292 - DNA, 16 bp, Homo sapiens
cagactgggcccaggc

SEQ ID NO: 1257293 - DNA, 19 bp, Homo sapiens
cagactgggcccaggcagg

SEQ ID NO: 1257294 - DNA, 22 bp, Homo sapiens
cagactgggcccaggcaggtct

SEQ ID NO: 1257295 - DNA, 23 bp, Homo sapiens
cagactgggcccaggcaggtctg

SEQ ID NO: 1257296 - DNA, 14 bp, Homo sapiens
cagactggggcatc

SEQ ID NO: 1257297 - DNA, 18 bp, Homo sapiens
cagactggggcatcctgt

SEQ ID NO: 1257298 - DNA, 16 bp, Homo sapiens
cagactgtaagatgtt

SEQ ID NO: 1257299 - DNA, 11 bp, Homo sapiens
cagactgtggt

SEQ ID NO: 1257300 - DNA, 23 bp, Homo sapiens
cagactgttagaaaatggacact

SEQ ID NO: 1257301 - DNA, 24 bp, Homo sapiens
cagactgttagaaaatggacactg

SEQ ID NO: 1257302 - DNA, 20 bp, Homo sapiens
cagactgttttactgtttta

SEQ ID NO: 1257303 - DNA, 23 bp, Homo sapiens
cagactgttttactgttttaatt

SEQ ID NO: 1257304 - DNA, 18 bp, Homo sapiens
cagacttaccaggaagca

SEQ ID NO: 1257305 - DNA, 21 bp, Homo sapiens
cagacttccaaatcctggaag

SEQ ID NO: 1257306 - DNA, 23 bp, Homo sapiens
cagacttccaaatcctggaagga

SEQ ID NO: 1257307 - DNA, 15 bp, Homo sapiens
cagacttctccagac

SEQ ID NO: 1257308 - DNA, 23 bp, Homo sapiens
cagacttctggaaggctggctga

SEQ ID NO: 1257309 - DNA, 13 bp, Homo sapiens
cagacttgagaac

SEQ ID NO: 1257310 - DNA, 18 bp, Homo sapiens
cagacttgcccaggtcac

SEQ ID NO: 1257311 - DNA, 17 bp, Homo sapiens
cagactttgagcctgca

SEQ ID NO: 1257312 - DNA, 21 bp, Homo sapiens
cagactttgagcctgcatctt

SEQ ID NO: 1257313 - DNA, 16 bp, Homo sapiens
cagactttggacagtg

SEQ ID NO: 1257314 - DNA, 19 bp, Homo sapiens
cagactttggacagtggcc

SEQ ID NO: 1257315 - DNA, 22 bp, Homo sapiens
cagactttggacagtggcctct

SEQ ID NO: 1257316 - DNA, 13 bp, Homo sapiens
cagacttttcaga

SEQ ID NO: 1257317 - DNA, 20 bp, Homo sapiens
cagacttttgcttacctttt

SEQ ID NO: 1257318 - DNA, 18 bp, Homo sapiens
cagagaaaaatgctcccc

SEQ ID NO: 1257319 - DNA, 20 bp, Homo sapiens
cagagaaaaatgctccccac

SEQ ID NO: 1257320 - DNA, 15 bp, Homo sapiens
cagagaaaatgaatt

SEQ ID NO: 1257321 - DNA, 21 bp, Homo sapiens
cagagaaaatgaattttttcc

SEQ ID NO: 1257322 - DNA, 13 bp, Homo sapiens
cagagaaaattaa

SEQ ID NO: 1257323 - DNA, 19 bp, Homo sapiens
cagagaaactaacttggtg

SEQ ID NO: 1257324 - DNA, 20 bp, Homo sapiens
cagagaaacttaagcaaagg

SEQ ID NO: 1257325 - DNA, 11 bp, Homo sapiens
cagagaaagaa

SEQ ID NO: 1257326 - DNA, 21 bp, Homo sapiens
cagagaaagaagagacaggag

SEQ ID NO: 1257327 - DNA, 16 bp, Homo sapiens
cagagaaatacaaaat

SEQ ID NO: 1257328 - DNA, 20 bp, Homo sapiens
cagagaaatctaagctgtgt

SEQ ID NO: 1257329 - DNA, 21 bp, Homo sapiens
cagagaacaatcactattctt

SEQ ID NO: 1257330 - DNA, 20 bp, Homo sapiens
cagagaactgcagacctcac

SEQ ID NO: 1257331 - DNA, 15 bp, Homo sapiens
cagagaagataatgt

SEQ ID NO: 1257332 - DNA, 21 bp, Homo sapiens
cagagaagctggaagcctgcc

SEQ ID NO: 1257333 - DNA, 13 bp, Homo sapiens
cagagaagctggg

SEQ ID NO: 1257334 - DNA, 23 bp, Homo sapiens
cagagaaggacggtgccaagggc

SEQ ID NO: 1257335 - DNA, 21 bp, Homo sapiens
cagagaaggcctcttgtgctc

SEQ ID NO: 1257336 - DNA, 17 bp, Homo sapiens
cagagaaggctatgtaa

SEQ ID NO: 1257337 - DNA, 11 bp, Homo sapiens
cagagaagggc

SEQ ID NO: 1257338 - DNA, 19 bp, Homo sapiens
cagagaatcatacttagca

SEQ ID NO: 1257339 - DNA, 16 bp, Homo sapiens
cagagaatctcttggg

SEQ ID NO: 1257340 - DNA, 18 bp, Homo sapiens
cagagaatggctgggtca

SEQ ID NO: 1257341 - DNA, 14 bp, Homo sapiens
cagagaattactat

SEQ ID NO: 1257342 - DNA, 20 bp, Homo sapiens
cagagaattactatttactt

SEQ ID NO: 1257343 - DNA, 15 bp, Homo sapiens
cagagaattctctta

SEQ ID NO: 1257344 - DNA, 14 bp, Homo sapiens
cagagaattcttag

SEQ ID NO: 1257345 - DNA, 15 bp, Homo sapiens
cagagaatttctacc

SEQ ID NO: 1257346 - DNA, 22 bp, Homo sapiens
cagagaatttctaccatttcag

SEQ ID NO: 1257347 - DNA, 12 bp, Homo sapiens
cagagacaaaat

SEQ ID NO: 1257348 - DNA, 22 bp, Homo sapiens
cagagacaacaggtaaaacagg

SEQ ID NO: 1257349 - DNA, 15 bp, Homo sapiens
cagagacaagtaatt

SEQ ID NO: 1257350 - DNA, 14 bp, Homo sapiens
cagagacacctgca

SEQ ID NO: 1257351 - DNA, 15 bp, Homo sapiens
cagagacacctgcac

SEQ ID NO: 1257352 - DNA, 17 bp, Homo sapiens
cagagacacctgcacct

SEQ ID NO: 1257353 - DNA, 14 bp, Homo sapiens
cagaggccatggca

SEQ ID NO: 1257354 - DNA, 22 bp, Homo sapiens
cagaggcccccagcccagggct

SEQ ID NO: 1257355 - DNA, 22 bp, Homo sapiens
cagaggcccccagtggggacag

SEQ ID NO: 1257356 - DNA, 14 bp, Homo sapiens
cagaggccctaggc

SEQ ID NO: 1257357 - DNA, 22 bp, Homo sapiens
cagaggccctaggcgggatggg

SEQ ID NO: 1257358 - DNA, 23 bp, Homo sapiens
cagaggccctgaagcctccgtgg

SEQ ID NO: 1257359 - DNA, 21 bp, Homo sapiens
cagaggccgcgcgtccagctg

SEQ ID NO: 1257360 - DNA, 22 bp, Homo sapiens
cagaggcctgctgccagtgcag

SEQ ID NO: 1257361 - DNA, 17 bp, Homo sapiens
cagaggctaagatgaga

SEQ ID NO: 1257362 - DNA, 20 bp, Homo sapiens
cagaggctactcttgactta

SEQ ID NO: 1257363 - DNA, 20 bp, Homo sapiens
cagaggctattattttcact

SEQ ID NO: 1257364 - DNA, 13 bp, Homo sapiens
cagaggctgagcc

SEQ ID NO: 1257365 - DNA, 13 bp, Homo sapiens
cagaggctgcctc

SEQ ID NO: 1257366 - DNA, 18 bp, Homo sapiens
cagaggctggaggcaggg

SEQ ID NO: 1257367 - DNA, 16 bp, Homo sapiens
cagaggcttcttcaga

SEQ ID NO: 1257368 - DNA, 23 bp, Homo sapiens
cagagggaaagtaaatatttcag

SEQ ID NO: 1257369 - DNA, 13 bp, Homo sapiens
cagagggaagcca

SEQ ID NO: 1257370 - DNA, 13 bp, Homo sapiens
cagagggacaggg

SEQ ID NO: 1257371 - DNA, 18 bp, Homo sapiens
cagagggaccaaattgct

SEQ ID NO: 1257372 - DNA, 21 bp, Homo sapiens
cagagggaccaaattgcttct

SEQ ID NO: 1257373 - DNA, 15 bp, Homo sapiens
cagagggagaatcca

SEQ ID NO: 1257374 - DNA, 19 bp, Homo sapiens
cagagggagaatccaaggg

SEQ ID NO: 1257375 - DNA, 22 bp, Homo sapiens
cagagggagacagggctgctcc

SEQ ID NO: 1257376 - DNA, 17 bp, Homo sapiens
cagagggcagaggctgg

SEQ ID NO: 1257377 - DNA, 16 bp, Homo sapiens
cagagggcatgctgaa

SEQ ID NO: 1257378 - DNA, 22 bp, Homo sapiens
cagagggcccaggcaggccacc

SEQ ID NO: 1257379 - DNA, 14 bp, Homo sapiens
cagagggctaggga

SEQ ID NO: 1257380 - DNA, 15 bp, Homo sapiens
cagagggctggaggc

SEQ ID NO: 1257381 - DNA, 18 bp, Homo sapiens
cagagggctggaggccca

SEQ ID NO: 1257382 - DNA, 23 bp, Homo sapiens
cagaggggaaaccagtgtagcct

SEQ ID NO: 1257383 - DNA, 16 bp, Homo sapiens
cagaggggactctggg

SEQ ID NO: 1257384 - DNA, 17 bp, Homo sapiens
cagaggggagcagcggc

SEQ ID NO: 1257385 - DNA, 22 bp, Homo sapiens
cagaggggagcagcggctctgg

SEQ ID NO: 1257386 - DNA, 13 bp, Homo sapiens
cagaggggcagcc

SEQ ID NO: 1257387 - DNA, 16 bp, Homo sapiens
cagaggggcagccgct

SEQ ID NO: 1257388 - DNA, 18 bp, Homo sapiens
cagaggggcagccgctag

SEQ ID NO: 1257389 - DNA, 21 bp, Homo sapiens
cagaggggcagccgctaggag

SEQ ID NO: 1257390 - DNA, 19 bp, Homo sapiens
cagagggggagtagccaag

SEQ ID NO: 1257391 - DNA, 20 bp, Homo sapiens
cagaggggtaggcagagcct

SEQ ID NO: 1257392 - DNA, 19 bp, Homo sapiens
cagagggtcccattgtgca

SEQ ID NO: 1257393 - DNA, 16 bp, Homo sapiens
cagagggtgtcaaaca

SEQ ID NO: 1257394 - DNA, 18 bp, Homo sapiens
cagaggtaaaagtgtgag

SEQ ID NO: 1257395 - DNA, 22 bp, Homo sapiens
cagaggtagtctcactgcttga

SEQ ID NO: 1257396 - DNA, 15 bp, Homo sapiens
cagaggtccacaaca

SEQ ID NO: 1257397 - DNA, 20 bp, Homo sapiens
cagaggtccacaacacacag

SEQ ID NO: 1257398 - DNA, 16 bp, Homo sapiens
cagaggtccagcccat

SEQ ID NO: 1257399 - DNA, 16 bp, Homo sapiens
cagaggtcccagcccc

SEQ ID NO: 1257400 - DNA, 17 bp, Homo sapiens
cagaggtcccagcccca

SEQ ID NO: 1257401 - DNA, 18 bp, Homo sapiens
cagaggtcccagccccag

SEQ ID NO: 1257402 - DNA, 19 bp, Homo sapiens
cagaggtcccagccccagg

SEQ ID NO: 1257403 - DNA, 22 bp, Homo sapiens
cagaggtcccagccccaggcct

SEQ ID NO: 1257404 - DNA, 13 bp, Homo sapiens
cagaggtctccca

SEQ ID NO: 1257405 - DNA, 15 bp, Homo sapiens
cagaggtctctgccg

SEQ ID NO: 1257406 - DNA, 22 bp, Homo sapiens
cagaggtgaaattccagatgag

SEQ ID NO: 1257407 - DNA, 18 bp, Homo sapiens
cagaggtgagaactcaga

SEQ ID NO: 1257408 - DNA, 21 bp, Homo sapiens
cagaggtgagaactcagaaga

SEQ ID NO: 1257409 - DNA, 22 bp, Homo sapiens
cagaggtgagaactcagaagag

SEQ ID NO: 1257410 - DNA, 14 bp, Homo sapiens
cagaggtgcttcac

SEQ ID NO: 1257411 - DNA, 23 bp, Homo sapiens
cagaggtggatgttatgaacagc

SEQ ID NO: 1257412 - DNA, 10 bp, Homo sapiens
cagaggtggc

SEQ ID NO: 1257413 - DNA, 15 bp, Homo sapiens
cagaggtggcccttg

SEQ ID NO: 1257414 - DNA, 12 bp, Homo sapiens
cagaggtgggca

SEQ ID NO: 1257415 - DNA, 17 bp, Homo sapiens
cagaggtgggcaggtgg

SEQ ID NO: 1257416 - DNA, 22 bp, Homo sapiens
cagaggtgggcaggtggtggca

SEQ ID NO: 1257417 - DNA, 23 bp, Homo sapiens
cagaggtgggcaggtggtggcac

SEQ ID NO: 1257418 - DNA, 20 bp, Homo sapiens
cagaggttatctgcctggcc

SEQ ID NO: 1257419 - DNA, 15 bp, Homo sapiens
cagaggttgcagtga

SEQ ID NO: 1257420 - DNA, 16 bp, Homo sapiens
cagaggtttaaatgta

SEQ ID NO: 1257421 - DNA, 14 bp, Homo sapiens
cagaggtttcttga

SEQ ID NO: 1257422 - DNA, 18 bp, Homo sapiens
cagaggtttgctgacagg

SEQ ID NO: 1257423 - DNA, 21 bp, Homo sapiens
cagaggttttaatgtctgttt

SEQ ID NO: 1257424 - DNA, 21 bp, Homo sapiens
cagagtaggtgggtaggagcc

SEQ ID NO: 1257425 - DNA, 22 bp, Homo sapiens
cagagtaggtgggtaggagccc

SEQ ID NO: 1257426 - DNA, 21 bp, Homo sapiens
cagagtatatttttgtctgca

SEQ ID NO: 1257427 - DNA, 23 bp, Homo sapiens
cagagtatatttttgtctgcagc

SEQ ID NO: 1257428 - DNA, 13 bp, Homo sapiens
cagagtatgaaca

SEQ ID NO: 1257429 - DNA, 19 bp, Homo sapiens
cagagtattgggattacag

SEQ ID NO: 1257430 - DNA, 14 bp, Homo sapiens
cagagtatttctgg

SEQ ID NO: 1257431 - DNA, 16 bp, Homo sapiens
cagagtccaatttaag

SEQ ID NO: 1257432 - DNA, 13 bp, Homo sapiens
cagagtccagtgc

SEQ ID NO: 1257433 - DNA, 14 bp, Homo sapiens
cagagtccagtgct

SEQ ID NO: 1257434 - DNA, 22 bp, Homo sapiens
cagagtccatttcccacatctt

SEQ ID NO: 1257435 - DNA, 17 bp, Homo sapiens
cagagtccggaggcagc

SEQ ID NO: 1257436 - DNA, 14 bp, Homo sapiens
cagagtctcccagt

SEQ ID NO: 1257437 - DNA, 15 bp, Homo sapiens
cagagtctcccagtg

SEQ ID NO: 1257438 - DNA, 16 bp, Homo sapiens
cagagtctcccagtgg

SEQ ID NO: 1257439 - DNA, 12 bp, Homo sapiens
cagagtctgagc

SEQ ID NO: 1257440 - DNA, 16 bp, Homo sapiens
cagagtctgggcctct

SEQ ID NO: 1257441 - DNA, 22 bp, Homo sapiens
cagagtcttgctctgtctccca

SEQ ID NO: 1257442 - DNA, 20 bp, Homo sapiens
cagagtgaaagggctatggc

SEQ ID NO: 1257443 - DNA, 16 bp, Homo sapiens
cagagtgaagaatctt

SEQ ID NO: 1257444 - DNA, 21 bp, Homo sapiens
cagagtgaatgtcccccatca

SEQ ID NO: 1257445 - DNA, 17 bp, Homo sapiens
cagagtgaccctcagct

SEQ ID NO: 1257446 - DNA, 14 bp, Homo sapiens
cagagtgagaccca

SEQ ID NO: 1257447 - DNA, 15 bp, Homo sapiens
cagagtgagacccag

SEQ ID NO: 1257448 - DNA, 15 bp, Homo sapiens
cagagtgagaccctg

SEQ ID NO: 1257449 - DNA, 23 bp, Homo sapiens
cagagtgcaagcccctgctccag

SEQ ID NO: 1257450 - DNA, 17 bp, Homo sapiens
cagagtgctgaggccag

SEQ ID NO: 1257451 - DNA, 16 bp, Homo sapiens
cagagtggactgcatt

SEQ ID NO: 1257452 - DNA, 17 bp, Homo sapiens
cagagtggactgcattt

SEQ ID NO: 1257453 - DNA, 18 bp, Homo sapiens
cagagtggactgcattta

SEQ ID NO: 1257454 - DNA, 19 bp, Homo sapiens
cagagtggagtctgagtct

SEQ ID NO: 1257455 - DNA, 23 bp, Homo sapiens
cagagtggagttgaaactgctat

SEQ ID NO: 1257456 - DNA, 13 bp, Homo sapiens
cagagtggcctgg

SEQ ID NO: 1257457 - DNA, 18 bp, Homo sapiens
cagagtggcctggccagg

SEQ ID NO: 1257458 - DNA, 23 bp, Homo sapiens
cagagtggcctggccaggagctc

SEQ ID NO: 1257459 - DNA, 19 bp, Homo sapiens
cagagtggcgtggcctccc

SEQ ID NO: 1257460 - DNA, 16 bp, Homo sapiens
cagagtggctcactgg

SEQ ID NO: 1257461 - DNA, 15 bp, Homo sapiens
cagagtgggacttgg

SEQ ID NO: 1257462 - DNA, 21 bp, Homo sapiens
cagagtgggacttggagagca

SEQ ID NO: 1257463 - DNA, 22 bp, Homo sapiens
cagagtgggagaggctgggagg

SEQ ID NO: 1257464 - DNA, 20 bp, Homo sapiens
cagagtggtcgagtgacaca

SEQ ID NO: 1257465 - DNA, 16 bp, Homo sapiens
cagagtggtttccaat

SEQ ID NO: 1257466 - DNA, 15 bp, Homo sapiens
cagagtgtagggggc

SEQ ID NO: 1257467 - DNA, 17 bp, Homo sapiens
cagagtgtgcagactga

SEQ ID NO: 1257468 - DNA, 16 bp, Homo sapiens
cagagttattgaatct

SEQ ID NO: 1257469 - DNA, 14 bp, Homo sapiens
cagagttcactata

SEQ ID NO: 1257470 - DNA, 23 bp, Homo sapiens
cagagttctcctggaggcagggg

SEQ ID NO: 1257471 - DNA, 15 bp, Homo sapiens
cagagttctgtgaag

SEQ ID NO: 1257472 - DNA, 16 bp, Homo sapiens
cagagttctgtgaaga

SEQ ID NO: 1257473 - DNA, 19 bp, Homo sapiens
cagagttctgtgaagagga

SEQ ID NO: 1257474 - DNA, 17 bp, Homo sapiens
cagcaagtacagcggct

SEQ ID NO: 1257475 - DNA, 13 bp, Homo sapiens
cagcaagtgtttg

SEQ ID NO: 1257476 - DNA, 17 bp, Homo sapiens
cagcaagttcacatgga

SEQ ID NO: 1257477 - DNA, 12 bp, Homo sapiens
cagcaataaaaa

SEQ ID NO: 1257478 - DNA, 21 bp, Homo sapiens
cagcaataaagcagcgtttct

SEQ ID NO: 1257479 - DNA, 14 bp, Homo sapiens
cagcaataagaaat

SEQ ID NO: 1257480 - DNA, 16 bp, Homo sapiens
cagcaataagaaatga

SEQ ID NO: 1257481 - DNA, 18 bp, Homo sapiens
cagcaataagaaatgaac

SEQ ID NO: 1257482 - DNA, 23 bp, Homo sapiens
cagcaataagaaatgaacaaaag

SEQ ID NO: 1257483 - DNA, 17 bp, Homo sapiens
cagcaatagagacggga

SEQ ID NO: 1257484 - DNA, 23 bp, Homo sapiens
cagcaatatattaccagcaagaa

SEQ ID NO: 1257485 - DNA, 15 bp, Homo sapiens
cagcaatatgtaaat

SEQ ID NO: 1257486 - DNA, 20 bp, Homo sapiens
cagcaatgacatctcagggg

SEQ ID NO: 1257487 - DNA, 16 bp, Homo sapiens
cagcaattatgaaaat

SEQ ID NO: 1257488 - DNA, 14 bp, Homo sapiens
cagcaatttaaatg

SEQ ID NO: 1257489 - DNA, 17 bp, Homo sapiens
cagcacaaacattgctg

SEQ ID NO: 1257490 - DNA, 20 bp, Homo sapiens
cagcacaaattagttatata

SEQ ID NO: 1257491 - DNA, 16 bp, Homo sapiens
cagcacaaggccatct

SEQ ID NO: 1257492 - DNA, 15 bp, Homo sapiens
cagcacaagggcaca

SEQ ID NO: 1257493 - DNA, 22 bp, Homo sapiens
cagcacaagggcacattgccca

SEQ ID NO: 1257494 - DNA, 18 bp, Homo sapiens
cagcacaattctgtccct

SEQ ID NO: 1257495 - DNA, 17 bp, Homo sapiens
cagcacaccaagtggct

SEQ ID NO: 1257496 - DNA, 15 bp, Homo sapiens
cagcacaccagccgc

SEQ ID NO: 1257497 - DNA, 14 bp, Homo sapiens
cagcacacctctgg

SEQ ID NO: 1257498 - DNA, 17 bp, Homo sapiens
cagcacacctctggggg

SEQ ID NO: 1257499 - DNA, 12 bp, Homo sapiens
cagcacagaatg

SEQ ID NO: 1257500 - DNA, 22 bp, Homo sapiens
cagcacagagtcgctggcatgt

SEQ ID NO: 1257501 - DNA, 12 bp, Homo sapiens
cagcacagccac

SEQ ID NO: 1257502 - DNA, 15 bp, Homo sapiens
cagcacagccacctc

SEQ ID NO: 1257503 - DNA, 18 bp, Homo sapiens
cagcacagccacctccgc

SEQ ID NO: 1257504 - DNA, 13 bp, Homo sapiens
cagcacagcccag

SEQ ID NO: 1257505 - DNA, 14 bp, Homo sapiens
cagcacagcccagg

SEQ ID NO: 1257506 - DNA, 18 bp, Homo sapiens
cagcacagcccagggcct

SEQ ID NO: 1257507 - DNA, 20 bp, Homo sapiens
cagcacagccctaccccgcc

SEQ ID NO: 1257508 - DNA, 17 bp, Homo sapiens
cagcacagcttagattt

SEQ ID NO: 1257509 - DNA, 13 bp, Homo sapiens
cagcacagcttga

SEQ ID NO: 1257510 - DNA, 15 bp, Homo sapiens
cagcacagcttgacc

SEQ ID NO: 1257511 - DNA, 20 bp, Homo sapiens
cagcacagcttgacctgagg

SEQ ID NO: 1257512 - DNA, 21 bp, Homo sapiens
cagcacagcttgacctgaggc

SEQ ID NO: 1257513 - DNA, 12 bp, Homo sapiens
cagcacaggaat

SEQ ID NO: 1257514 - DNA, 16 bp, Homo sapiens
cagcacaggggcccca

SEQ ID NO: 1257515 - DNA, 17 bp, Homo sapiens
cagcacaggggccccag

SEQ ID NO: 1257516 - DNA, 21 bp, Homo sapiens
cagcacaggggccccagatct

SEQ ID NO: 1257517 - DNA, 20 bp, Homo sapiens
cagcacatgcgggctcgccc

SEQ ID NO: 1257518 - DNA, 23 bp, Homo sapiens
cagcacatggccatagaggccca

SEQ ID NO: 1257519 - DNA, 15 bp, Homo sapiens
cagcaccaaccacag

SEQ ID NO: 1257520 - DNA, 14 bp, Homo sapiens
cagcaccacactgg

SEQ ID NO: 1257521 - DNA, 17 bp, Homo sapiens
cagcaccacactgggtg

SEQ ID NO: 1257522 - DNA, 15 bp, Homo sapiens
cagcaccaccacaca

SEQ ID NO: 1257523 - DNA, 13 bp, Homo sapiens
cagcaccacccta

SEQ ID NO: 1257524 - DNA, 21 bp, Homo sapiens
cagcaccaccctagtcccttc

SEQ ID NO: 1257525 - DNA, 14 bp, Homo sapiens
cagcaccactgctg

SEQ ID NO: 1257526 - DNA, 18 bp, Homo sapiens
cagcaccactgctgagga

SEQ ID NO: 1257527 - DNA, 14 bp, Homo sapiens
cagcaccagaatgt

SEQ ID NO: 1257528 - DNA, 14 bp, Homo sapiens
cagcacccccaccc

SEQ ID NO: 1257529 - DNA, 18 bp, Homo sapiens
cagcacccccacccacct

SEQ ID NO: 1257530 - DNA, 17 bp, Homo sapiens
cagcacccctagcatga

SEQ ID NO: 1257531 - DNA, 19 bp, Homo sapiens
cagcaccccttccatgtgg

SEQ ID NO: 1257532 - DNA, 22 bp, Homo sapiens
cagcaccccttccatgtggaga

SEQ ID NO: 1257533 - DNA, 16 bp, Homo sapiens
cagcaccctataaatc

SEQ ID NO: 1257534 - DNA, 12 bp, Homo sapiens
cagcaccctccc

SEQ ID NO: 1257535 - DNA, 17 bp, Homo sapiens
cagcaccctctcctggg

SEQ ID NO: 1257536 - DNA, 14 bp, Homo sapiens
cagcaccctgggtg

SEQ ID NO: 1257537 - DNA, 17 bp, Homo sapiens
cagcaccgtgccaaccc

SEQ ID NO: 1257538 - DNA, 16 bp, Homo sapiens
cagcaccgttctgtgc

SEQ ID NO: 1257539 - DNA, 14 bp, Homo sapiens
cagcacctccaggc

SEQ ID NO: 1257540 - DNA, 16 bp, Homo sapiens
cagcacctccaggcct

SEQ ID NO: 1257541 - DNA, 20 bp, Homo sapiens
cagcacctctcaggattgct

SEQ ID NO: 1257542 - DNA, 15 bp, Homo sapiens
cagcacctgtggctg

SEQ ID NO: 1257543 - DNA, 22 bp, Homo sapiens
cagcaccttcaagcgctccagg

SEQ ID NO: 1257544 - DNA, 20 bp, Homo sapiens
cagcaccttctttctggact

SEQ ID NO: 1257545 - DNA, 15 bp, Homo sapiens
cagcaccttgcagat

SEQ ID NO: 1257546 - DNA, 20 bp, Homo sapiens
cagcaccttgcagattttct

SEQ ID NO: 1257547 - DNA, 19 bp, Homo sapiens
cagcaccttggcccaggag

SEQ ID NO: 1257548 - DNA, 21 bp, Homo sapiens
cagcaccttggcccaggagct

SEQ ID NO: 1257549 - DNA, 13 bp, Homo sapiens
cagcacctttctc

SEQ ID NO: 1257550 - DNA, 15 bp, Homo sapiens
cagcacctttctctg

SEQ ID NO: 1257551 - DNA, 13 bp, Homo sapiens
cagcacgcaggcg

SEQ ID NO: 1257552 - DNA, 20 bp, Homo sapiens
cagcacggcccggcccctca

SEQ ID NO: 1257553 - DNA, 14 bp, Homo sapiens
cagcactaaacttg

SEQ ID NO: 1257554 - DNA, 10 bp, Homo sapiens
cagcactaac

SEQ ID NO: 1257555 - DNA, 19 bp, Homo sapiens
cagcactaaggccgtgtct

SEQ ID NO: 1257556 - DNA, 21 bp, Homo sapiens
cagcactaaggccgtgtctct

SEQ ID NO: 1257557 - DNA, 14 bp, Homo sapiens
cagcactactctgt

SEQ ID NO: 1257558 - DNA, 19 bp, Homo sapiens
cagcactatgctttccttc

SEQ ID NO: 1257559 - DNA, 17 bp, Homo sapiens
cagcactcacacaggac

SEQ ID NO: 1257560 - DNA, 13 bp, Homo sapiens
cagcactcagcct

SEQ ID NO: 1257561 - DNA, 18 bp, Homo sapiens
cagcactgatggaaaata

SEQ ID NO: 1257562 - DNA, 15 bp, Homo sapiens
cagcactgcctcctg

SEQ ID NO: 1257563 - DNA, 19 bp, Homo sapiens
cagcactgcttgaggaaaa

SEQ ID NO: 1257564 - DNA, 12 bp, Homo sapiens
cagcactggctc

SEQ ID NO: 1257565 - DNA, 16 bp, Homo sapiens
cagcactggctctctc

SEQ ID NO: 1257566 - DNA, 17 bp, Homo sapiens
cagcactggctctctcc

SEQ ID NO: 1257567 - DNA, 18 bp, Homo sapiens
cagcactggctctctcca

SEQ ID NO: 1257568 - DNA, 14 bp, Homo sapiens
cagcactgggaagc

SEQ ID NO: 1257569 - DNA, 17 bp, Homo sapiens
cagcactgggaagctgg

SEQ ID NO: 1257570 - DNA, 20 bp, Homo sapiens
cagcactgggaagctggagt

SEQ ID NO: 1257571 - DNA, 19 bp, Homo sapiens
cagcacttgtccagctgag

SEQ ID NO: 1257572 - DNA, 19 bp, Homo sapiens
cagcactttaaagaggctg

SEQ ID NO: 1257573 - DNA, 24 bp, Homo sapiens
cagcactttaaccctctcttccct

SEQ ID NO: 1257574 - DNA, 20 bp, Homo sapiens
cagcactttagatcacttga

SEQ ID NO: 1257575 - DNA, 15 bp, Homo sapiens
cagcactttgggagg

SEQ ID NO: 1257576 - DNA, 17 bp, Homo sapiens
cagcactttgggaggct

SEQ ID NO: 1257577 - DNA, 22 bp, Homo sapiens
cagcactttgggaggctgaggc

SEQ ID NO: 1257578 - DNA, 23 bp, Homo sapiens
cagcactttgggaggctgaggcg

SEQ ID NO: 1257579 - DNA, 17 bp, Homo sapiens
cagcagaaatgccccca

SEQ ID NO: 1257580 - DNA, 19 bp, Homo sapiens
cagcagaaatgccttaccc

SEQ ID NO: 1257581 - DNA, 18 bp, Homo sapiens
cagcagaacctgcacaca

SEQ ID NO: 1257582 - DNA, 21 bp, Homo sapiens
cagcagaacctgcacacagga

SEQ ID NO: 1257583 - DNA, 15 bp, Homo sapiens
cagcagaagcctcca

SEQ ID NO: 1257584 - DNA, 23 bp, Homo sapiens
cagcagaagcctccaagcacaga

SEQ ID NO: 1257585 - DNA, 18 bp, Homo sapiens
cagcagaatggaggcagg

SEQ ID NO: 1257586 - DNA, 19 bp, Homo sapiens
cagcagaatggaggcaggg

SEQ ID NO: 1257587 - DNA, 17 bp, Homo sapiens
cagcagacaaaatgaaa

SEQ ID NO: 1257588 - DNA, 14 bp, Homo sapiens
cagcagacagagcc

SEQ ID NO: 1257589 - DNA, 15 bp, Homo sapiens
cagcagacagagcca

SEQ ID NO: 1257590 - DNA, 16 bp, Homo sapiens
cagcagacagagccag

SEQ ID NO: 1257591 - DNA, 14 bp, Homo sapiens
cagcagactatgaa

SEQ ID NO: 1257592 - DNA, 17 bp, Homo sapiens
cagcagactcagctctg

SEQ ID NO: 1257593 - DNA, 23 bp, Homo sapiens
cagcagactcagctctgacattc

SEQ ID NO: 1257594 - DNA, 20 bp, Homo sapiens
cagcagagagagaggacaga

SEQ ID NO: 1257595 - DNA, 18 bp, Homo sapiens
cagcagaggcaggctggg

SEQ ID NO: 1257596 - DNA, 13 bp, Homo sapiens
cagcccccagcct

SEQ ID NO: 1257597 - DNA, 12 bp, Homo sapiens
cagcccccagga

SEQ ID NO: 1257598 - DNA, 18 bp, Homo sapiens
cagcccccaggatctggg

SEQ ID NO: 1257599 - DNA, 13 bp, Homo sapiens
cagcccccaggcc

SEQ ID NO: 1257600 - DNA, 14 bp, Homo sapiens
cagcccccaggcca

SEQ ID NO: 1257601 - DNA, 15 bp, Homo sapiens
cagcccccaggccag

SEQ ID NO: 1257602 - DNA, 14 bp, Homo sapiens
cagccccccagcac

SEQ ID NO: 1257603 - DNA, 19 bp, Homo sapiens
cagcccccccacccacccc

SEQ ID NO: 1257604 - DNA, 17 bp, Homo sapiens
cagcccccccctcaagg

SEQ ID NO: 1257605 - DNA, 18 bp, Homo sapiens
cagcccccccctcaaggg

SEQ ID NO: 1257606 - DNA, 19 bp, Homo sapiens
cagcccccgccccagagtg

SEQ ID NO: 1257607 - DNA, 23 bp, Homo sapiens
cagcccccgccccagagtggccc

SEQ ID NO: 1257608 - DNA, 21 bp, Homo sapiens
cagcccccgcgccctccctcc

SEQ ID NO: 1257609 - DNA, 20 bp, Homo sapiens
cagcccccgggacaccgtgg

SEQ ID NO: 1257610 - DNA, 24 bp, Homo sapiens
cagccccctccacaccagtggcct

SEQ ID NO: 1257611 - DNA, 16 bp, Homo sapiens
cagccccctccagctc

SEQ ID NO: 1257612 - DNA, 15 bp, Homo sapiens
cagccccctggatgg

SEQ ID NO: 1257613 - DNA, 14 bp, Homo sapiens
cagccccctgtggc

SEQ ID NO: 1257614 - DNA, 19 bp, Homo sapiens
cagccccgactccagccag

SEQ ID NO: 1257615 - DNA, 21 bp, Homo sapiens
cagccccgactccagccagcg

SEQ ID NO: 1257616 - DNA, 16 bp, Homo sapiens
cagccccgacttcctg

SEQ ID NO: 1257617 - DNA, 22 bp, Homo sapiens
cagccccgacttcctgactctc

SEQ ID NO: 1257618 - DNA, 16 bp, Homo sapiens
cagccccgagctgtcc

SEQ ID NO: 1257619 - DNA, 17 bp, Homo sapiens
cagccccgagctgtccc

SEQ ID NO: 1257620 - DNA, 21 bp, Homo sapiens
cagccccgcctgtcacaataa

SEQ ID NO: 1257621 - DNA, 16 bp, Homo sapiens
cagccccgcgcctcct

SEQ ID NO: 1257622 - DNA, 18 bp, Homo sapiens
cagccccgcgcctccttc

SEQ ID NO: 1257623 - DNA, 19 bp, Homo sapiens
cagccccgctcaggcctag

SEQ ID NO: 1257624 - DNA, 15 bp, Homo sapiens
cagccccgctcccac

SEQ ID NO: 1257625 - DNA, 17 bp, Homo sapiens
cagccccgctcccacct

SEQ ID NO: 1257626 - DNA, 17 bp, Homo sapiens
cagccccggcaagccac

SEQ ID NO: 1257627 - DNA, 19 bp, Homo sapiens
cagccccggcaagccacag

SEQ ID NO: 1257628 - DNA, 22 bp, Homo sapiens
cagccccgttttggggacgtga

SEQ ID NO: 1257629 - DNA, 22 bp, Homo sapiens
cagcccctacccctgccctgct

SEQ ID NO: 1257630 - DNA, 14 bp, Homo sapiens
cagcccctactgct

SEQ ID NO: 1257631 - DNA, 20 bp, Homo sapiens
cagcccctactgctgtgaac

SEQ ID NO: 1257632 - DNA, 24 bp, Homo sapiens
cagcccctagaaacccaagctcct

SEQ ID NO: 1257633 - DNA, 13 bp, Homo sapiens
cagcccctaggag

SEQ ID NO: 1257634 - DNA, 21 bp, Homo sapiens
cagcccctatagcactgagct

SEQ ID NO: 1257635 - DNA, 13 bp, Homo sapiens
cagcccctccacg

SEQ ID NO: 1257636 - DNA, 14 bp, Homo sapiens
cagcccctccagtc

SEQ ID NO: 1257637 - DNA, 22 bp, Homo sapiens
cagcccctcccaccacagcagg

SEQ ID NO: 1257638 - DNA, 12 bp, Homo sapiens
cagcccctcctc

SEQ ID NO: 1257639 - DNA, 15 bp, Homo sapiens
cagcccctcctctgc

SEQ ID NO: 1257640 - DNA, 16 bp, Homo sapiens
cagcccctcctctgcc

SEQ ID NO: 1257641 - DNA, 17 bp, Homo sapiens
cagcccctcctctgcca

SEQ ID NO: 1257642 - DNA, 22 bp, Homo sapiens
cagcccctcctctgccacctcc

SEQ ID NO: 1257643 - DNA, 12 bp, Homo sapiens
cagcccctcgag

SEQ ID NO: 1257644 - DNA, 16 bp, Homo sapiens
cagcccctcgaggcct

SEQ ID NO: 1257645 - DNA, 20 bp, Homo sapiens
cagcccctcgaggcctacag

SEQ ID NO: 1257646 - DNA, 22 bp, Homo sapiens
cagcccctcgaggcctacagag

SEQ ID NO: 1257647 - DNA, 21 bp, Homo sapiens
cagcccctctcccctctctgc

SEQ ID NO: 1257648 - DNA, 22 bp, Homo sapiens
cagcccctctggtcgctcctgc

SEQ ID NO: 1257649 - DNA, 18 bp, Homo sapiens
cagcccctcttcccttcc

SEQ ID NO: 1257650 - DNA, 18 bp, Homo sapiens
cagcccctgatctctgac

SEQ ID NO: 1257651 - DNA, 19 bp, Homo sapiens
cagcccctgatctctgacc

SEQ ID NO: 1257652 - DNA, 16 bp, Homo sapiens
cagcccctggacccct

SEQ ID NO: 1257653 - DNA, 13 bp, Homo sapiens
cagcccctgggaa

SEQ ID NO: 1257654 - DNA, 16 bp, Homo sapiens
cagcccctgggaacag

SEQ ID NO: 1257655 - DNA, 15 bp, Homo sapiens
cagcccctgggccct

SEQ ID NO: 1257656 - DNA, 16 bp, Homo sapiens
cagcccctgggccctt

SEQ ID NO: 1257657 - DNA, 20 bp, Homo sapiens
cagcccctgtttactggttc

SEQ ID NO: 1257658 - DNA, 15 bp, Homo sapiens
cagccccttctcaga

SEQ ID NO: 1257659 - DNA, 21 bp, Homo sapiens
cagccccttctcccagcacac

SEQ ID NO: 1257660 - DNA, 12 bp, Homo sapiens
cagccccttgct

SEQ ID NO: 1257661 - DNA, 22 bp, Homo sapiens
cagcccctttgcctctgtcctc

SEQ ID NO: 1257662 - DNA, 16 bp, Homo sapiens
cagccccttttctctg

SEQ ID NO: 1257663 - DNA, 19 bp, Homo sapiens
cagccccttttctctgctc

SEQ ID NO: 1257664 - DNA, 20 bp, Homo sapiens
cagccccttttctctgctct

SEQ ID NO: 1257665 - DNA, 15 bp, Homo sapiens
cagcccgaatgcctg

SEQ ID NO: 1257666 - DNA, 19 bp, Homo sapiens
cagcccgacaatgtcgagt

SEQ ID NO: 1257667 - DNA, 18 bp, Homo sapiens
cagcccgacagtgccatc

SEQ ID NO: 1257668 - DNA, 20 bp, Homo sapiens
cagcccgccgcccgcccctc

SEQ ID NO: 1257669 - DNA, 14 bp, Homo sapiens
cagcccgcctgccg

SEQ ID NO: 1257670 - DNA, 14 bp, Homo sapiens
cagcccgcggcctg

SEQ ID NO: 1257671 - DNA, 15 bp, Homo sapiens
cagcccgctctctgg

SEQ ID NO: 1257672 - DNA, 21 bp, Homo sapiens
cagcccgctctctggctgtct

SEQ ID NO: 1257673 - DNA, 15 bp, Homo sapiens
cagcccgctgagtgg

SEQ ID NO: 1257674 - DNA, 12 bp, Homo sapiens
cagcccggcctg

SEQ ID NO: 1257675 - DNA, 15 bp, Homo sapiens
cagcccggcgccacc

SEQ ID NO: 1257676 - DNA, 13 bp, Homo sapiens
cagcccggctgct

SEQ ID NO: 1257677 - DNA, 15 bp, Homo sapiens
cagcccggctgctgc

SEQ ID NO: 1257678 - DNA, 16 bp, Homo sapiens
cagcccggctgctgct

SEQ ID NO: 1257679 - DNA, 13 bp, Homo sapiens
cagcccggctggt

SEQ ID NO: 1257680 - DNA, 19 bp, Homo sapiens
cagcccggctggttttgta

SEQ ID NO: 1257681 - DNA, 19 bp, Homo sapiens
cagcccgggagcctaggac

SEQ ID NO: 1257682 - DNA, 21 bp, Homo sapiens
cagcccgggagcctaggacca

SEQ ID NO: 1257683 - DNA, 20 bp, Homo sapiens
cagcccgtgaagcagtgcct

SEQ ID NO: 1257684 - DNA, 21 bp, Homo sapiens
cagcccgtgaagcagtgcctc

SEQ ID NO: 1257685 - DNA, 18 bp, Homo sapiens
cagcccgtgtggcccctt

SEQ ID NO: 1257686 - DNA, 14 bp, Homo sapiens
cagccctaaacatc

SEQ ID NO: 1257687 - DNA, 18 bp, Homo sapiens
cagccctaaggatctctc

SEQ ID NO: 1257688 - DNA, 22 bp, Homo sapiens
cagccctaaggatctctcagga

SEQ ID NO: 1257689 - DNA, 21 bp, Homo sapiens
cagccctaccttaaggaaagt

SEQ ID NO: 1257690 - DNA, 14 bp, Homo sapiens
cagccctagctgtc

SEQ ID NO: 1257691 - DNA, 15 bp, Homo sapiens
cagccctatggatgt

SEQ ID NO: 1257692 - DNA, 15 bp, Homo sapiens
cagccctcacctctg

SEQ ID NO: 1257693 - DNA, 16 bp, Homo sapiens
cagccctcacctctga

SEQ ID NO: 1257694 - DNA, 18 bp, Homo sapiens
cagccctcacctctgagg

SEQ ID NO: 1257695 - DNA, 14 bp, Homo sapiens
cagccctcatcccg

SEQ ID NO: 1257696 - DNA, 17 bp, Homo sapiens
cagccctcatcccgagc

SEQ ID NO: 1257697 - DNA, 21 bp, Homo sapiens
cagccctccccatggagccag

SEQ ID NO: 1257698 - DNA, 17 bp, Homo sapiens
cagccctccctgcccct

SEQ ID NO: 1257699 - DNA, 20 bp, Homo sapiens
cagccctccctgtcctcctc

SEQ ID NO: 1257700 - DNA, 21 bp, Homo sapiens
cagccctccctgtcctcctcg

SEQ ID NO: 1257701 - DNA, 16 bp, Homo sapiens
cagccctcctcacccc

SEQ ID NO: 1257702 - DNA, 18 bp, Homo sapiens
cagccctcctctgcactc

SEQ ID NO: 1257703 - DNA, 14 bp, Homo sapiens
cagccctccttcag

SEQ ID NO: 1257704 - DNA, 11 bp, Homo sapiens
cagccctctgc

SEQ ID NO: 1257705 - DNA, 19 bp, Homo sapiens
cagccctctgcctcctccc

SEQ ID NO: 1257706 - DNA, 18 bp, Homo sapiens
cagccctcttgcccgcac

SEQ ID NO: 1257707 - DNA, 22 bp, Homo sapiens
cagccctgaggtgaaagggagc

SEQ ID NO: 1257708 - DNA, 12 bp, Homo sapiens
cagccctgagtg

SEQ ID NO: 1257709 - DNA, 13 bp, Homo sapiens
cagccctgagtgg

SEQ ID NO: 1257710 - DNA, 21 bp, Homo sapiens
cagccctgctttgggctgccc

SEQ ID NO: 1257711 - DNA, 16 bp, Homo sapiens
cagccctggccaagct

SEQ ID NO: 1257712 - DNA, 16 bp, Homo sapiens
cagccctggcctggct

SEQ ID NO: 1257713 - DNA, 18 bp, Homo sapiens
cagccctggcctttttct

SEQ ID NO: 1257714 - DNA, 12 bp, Homo sapiens
cagccctgggaa

SEQ ID NO: 1257715 - DNA, 17 bp, Homo sapiens
cagccctgggccccacc

SEQ ID NO: 1257716 - DNA, 22 bp, Homo sapiens
cagccctgggccccaccaccta

SEQ ID NO: 1257717 - DNA, 23 bp, Homo sapiens
cagccctgggccccaccacctag

SEQ ID NO: 1257718 - DNA, 22 bp, Homo sapiens
cagccttgaactcctggcctca

SEQ ID NO: 1257719 - DNA, 16 bp, Homo sapiens
cagccttgagccctgg

SEQ ID NO: 1257720 - DNA, 11 bp, Homo sapiens
cagccttgcac

SEQ ID NO: 1257721 - DNA, 14 bp, Homo sapiens
cagccttgcacacc

SEQ ID NO: 1257722 - DNA, 17 bp, Homo sapiens
cagccttgcacacccac

SEQ ID NO: 1257723 - DNA, 20 bp, Homo sapiens
cagccttgcacacccactgc

SEQ ID NO: 1257724 - DNA, 21 bp, Homo sapiens
cagccttgcacacccactgcc

SEQ ID NO: 1257725 - DNA, 20 bp, Homo sapiens
cagccttgcgctgtcccagg

SEQ ID NO: 1257726 - DNA, 17 bp, Homo sapiens
cagccttgggcctttca

SEQ ID NO: 1257727 - DNA, 21 bp, Homo sapiens
cagccttgggggggctgcctt

SEQ ID NO: 1257728 - DNA, 20 bp, Homo sapiens
cagccttgtaaataaccaca

SEQ ID NO: 1257729 - DNA, 14 bp, Homo sapiens
cagccttgtttctg

SEQ ID NO: 1257730 - DNA, 19 bp, Homo sapiens
cagcctttaggtctttagt

SEQ ID NO: 1257731 - DNA, 13 bp, Homo sapiens
cagcctttccaag

SEQ ID NO: 1257732 - DNA, 16 bp, Homo sapiens
cagcctttccagcctc

SEQ ID NO: 1257733 - DNA, 17 bp, Homo sapiens
cagcctttgctccctcc

SEQ ID NO: 1257734 - DNA, 15 bp, Homo sapiens
cagcctttgggtcct

SEQ ID NO: 1257735 - DNA, 19 bp, Homo sapiens
cagcctttgggtcctgggc

SEQ ID NO: 1257736 - DNA, 20 bp, Homo sapiens
cagcctttgggtcctgggca

SEQ ID NO: 1257737 - DNA, 17 bp, Homo sapiens
cagcctttgttaacctt

SEQ ID NO: 1257738 - DNA, 22 bp, Homo sapiens
cagcctttgttaaccttaaata

SEQ ID NO: 1257739 - DNA, 20 bp, Homo sapiens
cagcctttttgtttcaatga

SEQ ID NO: 1257740 - DNA, 21 bp, Homo sapiens
cagcgaaaggatgtaaacagt

SEQ ID NO: 1257741 - DNA, 13 bp, Homo sapiens
cagcgacccttgg

SEQ ID NO: 1257742 - DNA, 16 bp, Homo sapiens
cagcgaccgccccctc

SEQ ID NO: 1257743 - DNA, 13 bp, Homo sapiens
cagcgacctctct

SEQ ID NO: 1257744 - DNA, 14 bp, Homo sapiens
cagcgacctctctg

SEQ ID NO: 1257745 - DNA, 19 bp, Homo sapiens
cagcgacctctctgcctct

SEQ ID NO: 1257746 - DNA, 15 bp, Homo sapiens
cagcgactggatgct

SEQ ID NO: 1257747 - DNA, 19 bp, Homo sapiens
cagcgactggatgctcgcc

SEQ ID NO: 1257748 - DNA, 21 bp, Homo sapiens
cagcgactggatgctcgccat

SEQ ID NO: 1257749 - DNA, 19 bp, Homo sapiens
cagcgagagagtttcaaaa

SEQ ID NO: 1257750 - DNA, 13 bp, Homo sapiens
cagcgagaggcag

SEQ ID NO: 1257751 - DNA, 14 bp, Homo sapiens
cagcgagaggcagc

SEQ ID NO: 1257752 - DNA, 16 bp, Homo sapiens
cagcgagccacaggaa

SEQ ID NO: 1257753 - DNA, 21 bp, Homo sapiens
cagcgaggtgggagaggcctc

SEQ ID NO: 1257754 - DNA, 18 bp, Homo sapiens
cagcgatgtatgcagcta

SEQ ID NO: 1257755 - DNA, 16 bp, Homo sapiens
cagcgcaggctgcaga

SEQ ID NO: 1257756 - DNA, 13 bp, Homo sapiens
cagcgcagggctg

SEQ ID NO: 1257757 - DNA, 18 bp, Homo sapiens
cagcgccaagtgcgtgcc

SEQ ID NO: 1257758 - DNA, 19 bp, Homo sapiens
cagcgccaggctgaccaca

SEQ ID NO: 1257759 - DNA, 20 bp, Homo sapiens
cagcgccaggctgaccacag

SEQ ID NO: 1257760 - DNA, 18 bp, Homo sapiens
cagcgccagggcccaggc

SEQ ID NO: 1257761 - DNA, 15 bp, Homo sapiens
cagcgcccaggcctg

SEQ ID NO: 1257762 - DNA, 21 bp, Homo sapiens
cagcgcccaggcctgctggca

SEQ ID NO: 1257763 - DNA, 17 bp, Homo sapiens
cagcgcccccatctgtc

SEQ ID NO: 1257764 - DNA, 19 bp, Homo sapiens
cagcgcccccatctgtctt

SEQ ID NO: 1257765 - DNA, 17 bp, Homo sapiens
cagcgcccgctgggctg

SEQ ID NO: 1257766 - DNA, 22 bp, Homo sapiens
cagcgcctagtggggtctccct

SEQ ID NO: 1257767 - DNA, 23 bp, Homo sapiens
cagcgcctagtggggtctccctc

SEQ ID NO: 1257768 - DNA, 14 bp, Homo sapiens
cagcgcctccctcc

SEQ ID NO: 1257769 - DNA, 13 bp, Homo sapiens
cagcgcctccctt

SEQ ID NO: 1257770 - DNA, 12 bp, Homo sapiens
cagcgctcgcca

SEQ ID NO: 1257771 - DNA, 15 bp, Homo sapiens
cagcgctcgccacgc

SEQ ID NO: 1257772 - DNA, 16 bp, Homo sapiens
cagcgctcggcccgga

SEQ ID NO: 1257773 - DNA, 21 bp, Homo sapiens
cagcgctcggcccggagcagc

SEQ ID NO: 1257774 - DNA, 21 bp, Homo sapiens
cagcggagtctgtcctgtgac

SEQ ID NO: 1257775 - DNA, 18 bp, Homo sapiens
cagcggattgctctggag

SEQ ID NO: 1257776 - DNA, 23 bp, Homo sapiens
cagcggattgctctggagcagcc

SEQ ID NO: 1257777 - DNA, 13 bp, Homo sapiens
cagcggcccctcc

SEQ ID NO: 1257778 - DNA, 16 bp, Homo sapiens
cagcggcccctcccac

SEQ ID NO: 1257779 - DNA, 14 bp, Homo sapiens
cagcggcccctgca

SEQ ID NO: 1257780 - DNA, 14 bp, Homo sapiens
cagcggccctgtca

SEQ ID NO: 1257781 - DNA, 16 bp, Homo sapiens
cagcggcctcagggtc

SEQ ID NO: 1257782 - DNA, 23 bp, Homo sapiens
cagcggccttgaagacagagcaa

SEQ ID NO: 1257783 - DNA, 20 bp, Homo sapiens
cagcggctcacgcctgtaat

SEQ ID NO: 1257784 - DNA, 14 bp, Homo sapiens
cagcggctcccctc

SEQ ID NO: 1257785 - DNA, 18 bp, Homo sapiens
cagcggcttagccaagcc

SEQ ID NO: 1257786 - DNA, 16 bp, Homo sapiens
cagcgggaatggcagc

SEQ ID NO: 1257787 - DNA, 22 bp, Homo sapiens
cagcgggaatggcagctgccac

SEQ ID NO: 1257788 - DNA, 23 bp, Homo sapiens
cagcgggaatggcagctgccacg

SEQ ID NO: 1257789 - DNA, 13 bp, Homo sapiens
cagcgggagacct

SEQ ID NO: 1257790 - DNA, 13 bp, Homo sapiens
cagcgggcaggtt

SEQ ID NO: 1257791 - DNA, 20 bp, Homo sapiens
cagcggtccctgcagaagcc

SEQ ID NO: 1257792 - DNA, 15 bp, Homo sapiens
cagcggtgggaagga

SEQ ID NO: 1257793 - DNA, 16 bp, Homo sapiens
cagcggtgggaaggaa

SEQ ID NO: 1257794 - DNA, 17 bp, Homo sapiens
cagcggttcctgtgcag

SEQ ID NO: 1257795 - DNA, 19 bp, Homo sapiens
cagcgtcactctacctaat

SEQ ID NO: 1257796 - DNA, 16 bp, Homo sapiens
cagcgtcaggcctacc

SEQ ID NO: 1257797 - DNA, 14 bp, Homo sapiens
cagcgtcccagtct

SEQ ID NO: 1257798 - DNA, 13 bp, Homo sapiens
cagcgtccctggc

SEQ ID NO: 1257799 - DNA, 14 bp, Homo sapiens
cagcgtccctggcg

SEQ ID NO: 1257800 - DNA, 15 bp, Homo sapiens
cagcgtcctcctctg

SEQ ID NO: 1257801 - DNA, 14 bp, Homo sapiens
cagcgtctgcaggg

SEQ ID NO: 1257802 - DNA, 16 bp, Homo sapiens
cagcgtctgcagggtg

SEQ ID NO: 1257803 - DNA, 17 bp, Homo sapiens
cagcgtgacaatatact

SEQ ID NO: 1257804 - DNA, 20 bp, Homo sapiens
cagcgtgctggcgacactca

SEQ ID NO: 1257805 - DNA, 13 bp, Homo sapiens
cagcgtggcccag

SEQ ID NO: 1257806 - DNA, 14 bp, Homo sapiens
cagcgtggcccagg

SEQ ID NO: 1257807 - DNA, 23 bp, Homo sapiens
cagcgtggcccaggccgggaaga

SEQ ID NO: 1257808 - DNA, 16 bp, Homo sapiens
cagcgtgggctctgcc

SEQ ID NO: 1257809 - DNA, 17 bp, Homo sapiens
cagcgtgtggagcagag

SEQ ID NO: 1257810 - DNA, 22 bp, Homo sapiens
cagcgtgtggagcagagctctc

SEQ ID NO: 1257811 - DNA, 18 bp, Homo sapiens
cagcgttcccttctcccc

SEQ ID NO: 1257812 - DNA, 20 bp, Homo sapiens
cagcgttcccttctccccct

SEQ ID NO: 1257813 - DNA, 21 bp, Homo sapiens
cagcgttcccttctccccctt

SEQ ID NO: 1257814 - DNA, 23 bp, Homo sapiens
cagcgttgggtttgctcatgtaa

SEQ ID NO: 1257815 - DNA, 22 bp, Homo sapiens
cagcgtttagtttctagaggcc

SEQ ID NO: 1257816 - DNA, 16 bp, Homo sapiens
cagcgtttctatgaca

SEQ ID NO: 1257817 - DNA, 20 bp, Homo sapiens
cagcgtttgaggggctggcc

SEQ ID NO: 1257818 - DNA, 22 bp, Homo sapiens
cagcgtttgaggggctggcctt

SEQ ID NO: 1257819 - DNA, 18 bp, Homo sapiens
cagctaaaataagctcag

SEQ ID NO: 1257820 - DNA, 22 bp, Homo sapiens
cagctaaaccaaggactgagca

SEQ ID NO: 1257821 - DNA, 15 bp, Homo sapiens
cagctaaatgcaggg

SEQ ID NO: 1257822 - DNA, 16 bp, Homo sapiens
cagctaaatgtaactt

SEQ ID NO: 1257823 - DNA, 18 bp, Homo sapiens
cagctaaattttctgaaa

SEQ ID NO: 1257824 - DNA, 21 bp, Homo sapiens
cagctaactccgagagcagtg

SEQ ID NO: 1257825 - DNA, 18 bp, Homo sapiens
cagctaagctaggaatga

SEQ ID NO: 1257826 - DNA, 14 bp, Homo sapiens
cagctaagctcacg

SEQ ID NO: 1257827 - DNA, 19 bp, Homo sapiens
cagctaaggacatttccca

SEQ ID NO: 1257828 - DNA, 21 bp, Homo sapiens
cagctaaggaggggaaaaaaa

SEQ ID NO: 1257829 - DNA, 19 bp, Homo sapiens
cagctaatcagcattctca

SEQ ID NO: 1257830 - DNA, 12 bp, Homo sapiens
cagctaatctgt

SEQ ID NO: 1257831 - DNA, 19 bp, Homo sapiens
cagctaatctgtagggctg

SEQ ID NO: 1257832 - DNA, 21 bp, Homo sapiens
cagctaatctgtagggctgga

SEQ ID NO: 1257833 - DNA, 22 bp, Homo sapiens
cagctaattcaggtcattttgt

SEQ ID NO: 1257834 - DNA, 14 bp, Homo sapiens
cagctaattctact

SEQ ID NO: 1257835 - DNA, 16 bp, Homo sapiens
cagctaattgagacca

SEQ ID NO: 1257836 - DNA, 16 bp, Homo sapiens
cagctacattcctcag

SEQ ID NO: 1257837 - DNA, 18 bp, Homo sapiens
cagctacattcctcagct

SEQ ID NO: 1257838 - DNA, 18 bp, Homo sapiens
cagctacccactatcctt

SEQ ID NO: 1257839 - DNA, 24 bp, Homo sapiens
cagctacccaggaggctgaggtgg

SEQ ID NO: 1257840 - DNA, 22 bp, Homo sapiens
cagcttgggtcaggttcttgcc

SEQ ID NO: 1257841 - DNA, 23 bp, Homo sapiens
cagcttggtattgcagagaagat

SEQ ID NO: 1257842 - DNA, 21 bp, Homo sapiens
cagcttgttgtcccaatgaaa

SEQ ID NO: 1257843 - DNA, 15 bp, Homo sapiens
cagctttaaacaaat

SEQ ID NO: 1257844 - DNA, 21 bp, Homo sapiens
cagctttacatgcaatttatt

SEQ ID NO: 1257845 - DNA, 22 bp, Homo sapiens
cagctttactgccttcctcctt

SEQ ID NO: 1257846 - DNA, 19 bp, Homo sapiens
cagctttaggggtggtggg

SEQ ID NO: 1257847 - DNA, 13 bp, Homo sapiens
cagctttatgttc

SEQ ID NO: 1257848 - DNA, 17 bp, Homo sapiens
cagctttcaagtgcctt

SEQ ID NO: 1257849 - DNA, 19 bp, Homo sapiens
cagctttcagagccagtga

SEQ ID NO: 1257850 - DNA, 21 bp, Homo sapiens
cagctttcatctttgtggatg

SEQ ID NO: 1257851 - DNA, 17 bp, Homo sapiens
cagctttcatgattagc

SEQ ID NO: 1257852 - DNA, 16 bp, Homo sapiens
cagctttctcgcgccc

SEQ ID NO: 1257853 - DNA, 22 bp, Homo sapiens
cagctttgactttatctcctgc

SEQ ID NO: 1257854 - DNA, 18 bp, Homo sapiens
cagctttgagaagccttc

SEQ ID NO: 1257855 - DNA, 19 bp, Homo sapiens
cagctttgagaagccttca

SEQ ID NO: 1257856 - DNA, 13 bp, Homo sapiens
cagctttgcaccc

SEQ ID NO: 1257857 - DNA, 15 bp, Homo sapiens
cagctttgccttcca

SEQ ID NO: 1257858 - DNA, 22 bp, Homo sapiens
cagctttgctaccaaagcacct

SEQ ID NO: 1257859 - DNA, 21 bp, Homo sapiens
cagctttgctccgctcccacc

SEQ ID NO: 1257860 - DNA, 14 bp, Homo sapiens
cagctttgctgctg

SEQ ID NO: 1257861 - DNA, 20 bp, Homo sapiens
cagctttggggacttccgct

SEQ ID NO: 1257862 - DNA, 23 bp, Homo sapiens
cagctttggggacttccgctccc

SEQ ID NO: 1257863 - DNA, 12 bp, Homo sapiens
cagctttgtttg

SEQ ID NO: 1257864 - DNA, 15 bp, Homo sapiens
cagcttttcccagga

SEQ ID NO: 1257865 - DNA, 16 bp, Homo sapiens
cagcttttcctcaggg

SEQ ID NO: 1257866 - DNA, 16 bp, Homo sapiens
cagcttttcctccctt

SEQ ID NO: 1257867 - DNA, 17 bp, Homo sapiens
cagcttttctttttctg

SEQ ID NO: 1257868 - DNA, 23 bp, Homo sapiens
caggaaaaaaaattctgttgttc

SEQ ID NO: 1257869 - DNA, 14 bp, Homo sapiens
caggaaaaaaactt

SEQ ID NO: 1257870 - DNA, 15 bp, Homo sapiens
caggaaaaaaacttt

SEQ ID NO: 1257871 - DNA, 14 bp, Homo sapiens
caggaaaaaccaac

SEQ ID NO: 1257872 - DNA, 22 bp, Homo sapiens
caggaaaaaccaacaggtttat

SEQ ID NO: 1257873 - DNA, 13 bp, Homo sapiens
caggaaaaaccga

SEQ ID NO: 1257874 - DNA, 14 bp, Homo sapiens
caggaaaaataaac

SEQ ID NO: 1257875 - DNA, 16 bp, Homo sapiens
caggaaaacctgcaga

SEQ ID NO: 1257876 - DNA, 17 bp, Homo sapiens
caggaaaatcctctggc

SEQ ID NO: 1257877 - DNA, 23 bp, Homo sapiens
caggaaaatgtatccagaggaat

SEQ ID NO: 1257878 - DNA, 16 bp, Homo sapiens
caggaaacaagggaag

SEQ ID NO: 1257879 - DNA, 21 bp, Homo sapiens
caggaaacagactaaaaagaa

SEQ ID NO: 1257880 - DNA, 23 bp, Homo sapiens
caggaaaccacaaccttgcagta

SEQ ID NO: 1257881 - DNA, 15 bp, Homo sapiens
caggaaaccctggct

SEQ ID NO: 1257882 - DNA, 20 bp, Homo sapiens
caggaaactccacatctgcc

SEQ ID NO: 1257883 - DNA, 21 bp, Homo sapiens
caggaaactccacatctgcct

SEQ ID NO: 1257884 - DNA, 22 bp, Homo sapiens
caggaaactccacatctgcctt

SEQ ID NO: 1257885 - DNA, 18 bp, Homo sapiens
caggaaagagcagtcaga

SEQ ID NO: 1257886 - DNA, 23 bp, Homo sapiens
caggaaagagcagtcagagtcca

SEQ ID NO: 1257887 - DNA, 22 bp, Homo sapiens
caggaaagccacacggagaggc

SEQ ID NO: 1257888 - DNA, 14 bp, Homo sapiens
caggaaagccacat

SEQ ID NO: 1257889 - DNA, 17 bp, Homo sapiens
caggaaagccctccccc

SEQ ID NO: 1257890 - DNA, 20 bp, Homo sapiens
caggaaagccctcccccttc

SEQ ID NO: 1257891 - DNA, 18 bp, Homo sapiens
caggaaaggcccagccac

SEQ ID NO: 1257892 - DNA, 19 bp, Homo sapiens
caggaaaggccccaatctt

SEQ ID NO: 1257893 - DNA, 13 bp, Homo sapiens
caggaaaggctgt

SEQ ID NO: 1257894 - DNA, 19 bp, Homo sapiens
caggaaagtgtctgcagta

SEQ ID NO: 1257895 - DNA, 13 bp, Homo sapiens
caggaaataaagt

SEQ ID NO: 1257896 - DNA, 16 bp, Homo sapiens
caggaaatatatatgt

SEQ ID NO: 1257897 - DNA, 17 bp, Homo sapiens
caggaacaacagcatct

SEQ ID NO: 1257898 - DNA, 23 bp, Homo sapiens
caggaacagctatgggagcccca

SEQ ID NO: 1257899 - DNA, 17 bp, Homo sapiens
caggaacagtggctggg

SEQ ID NO: 1257900 - DNA, 14 bp, Homo sapiens
caggaacatacaga

SEQ ID NO: 1257901 - DNA, 19 bp, Homo sapiens
caggaaccacaccacatct

SEQ ID NO: 1257902 - DNA, 15 bp, Homo sapiens
caggaaccagggcct

SEQ ID NO: 1257903 - DNA, 16 bp, Homo sapiens
caggaaccagggcctc

SEQ ID NO: 1257904 - DNA, 21 bp, Homo sapiens
caggaacgagcactggccaga

SEQ ID NO: 1257905 - DNA, 21 bp, Homo sapiens
caggaacgctctcctcgagcc

SEQ ID NO: 1257906 - DNA, 16 bp, Homo sapiens
caggaacggccctgca

SEQ ID NO: 1257907 - DNA, 20 bp, Homo sapiens
caggaacgttgccacaccaa

SEQ ID NO: 1257908 - DNA, 14 bp, Homo sapiens
caggaactgtcatg

SEQ ID NO: 1257909 - DNA, 14 bp, Homo sapiens
caggaagaaagaat

SEQ ID NO: 1257910 - DNA, 20 bp, Homo sapiens
caggaagactggacccccag

SEQ ID NO: 1257911 - DNA, 14 bp, Homo sapiens
caggaagaggccca

SEQ ID NO: 1257912 - DNA, 19 bp, Homo sapiens
caggaagatcccccagaaa

SEQ ID NO: 1257913 - DNA, 21 bp, Homo sapiens
caggaagatgaaagaggaggt

SEQ ID NO: 1257914 - DNA, 17 bp, Homo sapiens
caggaagcaccccatgc

SEQ ID NO: 1257915 - DNA, 12 bp, Homo sapiens
caggaagcaggg

SEQ ID NO: 1257916 - DNA, 16 bp, Homo sapiens
caggaagcagggagag

SEQ ID NO: 1257917 - DNA, 19 bp, Homo sapiens
caggaagcattcagagagc

SEQ ID NO: 1257918 - DNA, 13 bp, Homo sapiens
caggaagccagag

SEQ ID NO: 1257919 - DNA, 18 bp, Homo sapiens
caggaagcccaattgctg

SEQ ID NO: 1257920 - DNA, 19 bp, Homo sapiens
caggaagcctgcagtcctg

SEQ ID NO: 1257921 - DNA, 13 bp, Homo sapiens
caggaagctctct

SEQ ID NO: 1257922 - DNA, 14 bp, Homo sapiens
caggaagctggcag

SEQ ID NO: 1257923 - DNA, 14 bp, Homo sapiens
caggaaggaagtca

SEQ ID NO: 1257924 - DNA, 15 bp, Homo sapiens
caggaaggaccccac

SEQ ID NO: 1257925 - DNA, 19 bp, Homo sapiens
caggaaggactatgaaaag

SEQ ID NO: 1257926 - DNA, 13 bp, Homo sapiens
caggaaggagagc

SEQ ID NO: 1257927 - DNA, 14 bp, Homo sapiens
caggaaggagagcc

SEQ ID NO: 1257928 - DNA, 15 bp, Homo sapiens
caggaaggagagcct

SEQ ID NO: 1257929 - DNA, 17 bp, Homo sapiens
caggaaggaggggagag

SEQ ID NO: 1257930 - DNA, 12 bp, Homo sapiens
caggaaggcagc

SEQ ID NO: 1257931 - DNA, 14 bp, Homo sapiens
caggaaggcagctg

SEQ ID NO: 1257932 - DNA, 22 bp, Homo sapiens
caggaagggaaagcgggcagcc

SEQ ID NO: 1257933 - DNA, 22 bp, Homo sapiens
caggaagggcctacagcccatt

SEQ ID NO: 1257934 - DNA, 23 bp, Homo sapiens
caggaagggggtccacccagcaa

SEQ ID NO: 1257935 - DNA, 17 bp, Homo sapiens
caggaaggtgcctggcc

SEQ ID NO: 1257936 - DNA, 20 bp, Homo sapiens
caggaagtcagtcacgtttc

SEQ ID NO: 1257937 - DNA, 16 bp, Homo sapiens
caggaagtccagccac

SEQ ID NO: 1257938 - DNA, 16 bp, Homo sapiens
caggaagtcttcaggg

SEQ ID NO: 1257939 - DNA, 10 bp, Homo sapiens
caggaagtga

SEQ ID NO: 1257940 - DNA, 17 bp, Homo sapiens
caggaataggcatttgc

SEQ ID NO: 1257941 - DNA, 22 bp, Homo sapiens
caggaatatcccaaacttcgga

SEQ ID NO: 1257942 - DNA, 14 bp, Homo sapiens
caggaatgctgggc

SEQ ID NO: 1257943 - DNA, 15 bp, Homo sapiens
caggaatgctgggcc

SEQ ID NO: 1257944 - DNA, 12 bp, Homo sapiens
caggaatggggg

SEQ ID NO: 1257945 - DNA, 19 bp, Homo sapiens
caggaatggggggcgggcc

SEQ ID NO: 1257946 - DNA, 22 bp, Homo sapiens
caggaatggggggcgggccagg

SEQ ID NO: 1257947 - DNA, 23 bp, Homo sapiens
caggaatggggggcgggccaggg

SEQ ID NO: 1257948 - DNA, 13 bp, Homo sapiens
caggaatgggggt

SEQ ID NO: 1257949 - DNA, 21 bp, Homo sapiens
caggaatgtgtggcctgcaca

SEQ ID NO: 1257950 - DNA, 18 bp, Homo sapiens
caggaatgttaaagtcag

SEQ ID NO: 1257951 - DNA, 16 bp, Homo sapiens
caggaattctcaagac

SEQ ID NO: 1257952 - DNA, 18 bp, Homo sapiens
caggacaaaggctgacag

SEQ ID NO: 1257953 - DNA, 13 bp, Homo sapiens
caggacaaggcct

SEQ ID NO: 1257954 - DNA, 19 bp, Homo sapiens
caggacacatcccggcctc

SEQ ID NO: 1257955 - DNA, 14 bp, Homo sapiens
caggacagcagcac

SEQ ID NO: 1257956 - DNA, 15 bp, Homo sapiens
caggacagcagcact

SEQ ID NO: 1257957 - DNA, 22 bp, Homo sapiens
caggacagtgcttcagcctgag

SEQ ID NO: 1257958 - DNA, 14 bp, Homo sapiens
caggacagtttatc

SEQ ID NO: 1257959 - DNA, 22 bp, Homo sapiens
caggacagtttatcctgtctga

SEQ ID NO: 1257960 - DNA, 20 bp, Homo sapiens
caggacatgcggtagccagc

SEQ ID NO: 1257961 - DNA, 18 bp, Homo sapiens
caggacatttctctaaga

SEQ ID NO: 1257962 - DNA, 18 bp, Homo sapiens
caggcacacagcagcccc

SEQ ID NO: 1257963 - DNA, 13 bp, Homo sapiens
caggcacacagct

SEQ ID NO: 1257964 - DNA, 20 bp, Homo sapiens
caggcacatacacctcgtca

SEQ ID NO: 1257965 - DNA, 15 bp, Homo sapiens
caggcaccaaaagaa

SEQ ID NO: 1257966 - DNA, 23 bp, Homo sapiens
caggcaccaccaggagcagcagc

SEQ ID NO: 1257967 - DNA, 17 bp, Homo sapiens
caggcaccccctggaga

SEQ ID NO: 1257968 - DNA, 21 bp, Homo sapiens
caggcaccccctggagagaag

SEQ ID NO: 1257969 - DNA, 20 bp, Homo sapiens
caggcacccggggccagaga

SEQ ID NO: 1257970 - DNA, 23 bp, Homo sapiens
caggcacccggggccagagacat

SEQ ID NO: 1257971 - DNA, 18 bp, Homo sapiens
caggcaccctcagggagc

SEQ ID NO: 1257972 - DNA, 21 bp, Homo sapiens
caggcacccttctttcctctt

SEQ ID NO: 1257973 - DNA, 13 bp, Homo sapiens
caggcaccgagaa

SEQ ID NO: 1257974 - DNA, 16 bp, Homo sapiens
caggcaccgagaatgt

SEQ ID NO: 1257975 - DNA, 20 bp, Homo sapiens
caggcaccgccacgtcccag

SEQ ID NO: 1257976 - DNA, 22 bp, Homo sapiens
caggcaccgccacgtcccagca

SEQ ID NO: 1257977 - DNA, 23 bp, Homo sapiens
caggcaccgccacgtcccagcat

SEQ ID NO: 1257978 - DNA, 16 bp, Homo sapiens
caggcaccgggctggc

SEQ ID NO: 1257979 - DNA, 18 bp, Homo sapiens
caggcaccgggctggctg

SEQ ID NO: 1257980 - DNA, 14 bp, Homo sapiens
caggcacctaccac

SEQ ID NO: 1257981 - DNA, 21 bp, Homo sapiens
caggcacctggcctgctggga

SEQ ID NO: 1257982 - DNA, 19 bp, Homo sapiens
caggcacctgtagtcccag

SEQ ID NO: 1257983 - DNA, 19 bp, Homo sapiens
caggcaccttcttggcgct

SEQ ID NO: 1257984 - DNA, 19 bp, Homo sapiens
caggcacgaacccacctgc

SEQ ID NO: 1257985 - DNA, 18 bp, Homo sapiens
caggcacggcccgcagcc

SEQ ID NO: 1257986 - DNA, 19 bp, Homo sapiens
caggcacgggtggtccccg

SEQ ID NO: 1257987 - DNA, 14 bp, Homo sapiens
caggcacggtttgg

SEQ ID NO: 1257988 - DNA, 20 bp, Homo sapiens
caggcactgaacaggctggg

SEQ ID NO: 1257989 - DNA, 20 bp, Homo sapiens
caggcactgagaatgatagt

SEQ ID NO: 1257990 - DNA, 17 bp, Homo sapiens
caggcactgccttctcc

SEQ ID NO: 1257991 - DNA, 16 bp, Homo sapiens
caggcactgctgccca

SEQ ID NO: 1257992 - DNA, 14 bp, Homo sapiens
caggcactgtggcc

SEQ ID NO: 1257993 - DNA, 11 bp, Homo sapiens
caggcactgtt

SEQ ID NO: 1257994 - DNA, 15 bp, Homo sapiens
caggcagaatggctg

SEQ ID NO: 1257995 - DNA, 10 bp, Homo sapiens
caggcagaca

SEQ ID NO: 1257996 - DNA, 17 bp, Homo sapiens
caggcagacaaccttgt

SEQ ID NO: 1257997 - DNA, 22 bp, Homo sapiens
caggcagacaagagctgctgtc

SEQ ID NO: 1257998 - DNA, 14 bp, Homo sapiens
caggcagacacgga

SEQ ID NO: 1257999 - DNA, 16 bp, Homo sapiens
caggcagacacggatc

SEQ ID NO: 1258000 - DNA, 14 bp, Homo sapiens
caggcagagaatca

SEQ ID NO: 1258001 - DNA, 23 bp, Homo sapiens
caggcagagaatcatacttagca

SEQ ID NO: 1258002 - DNA, 22 bp, Homo sapiens
caggcagagagtacagactgca

SEQ ID NO: 1258003 - DNA, 17 bp, Homo sapiens
caggcagagctgagggc

SEQ ID NO: 1258004 - DNA, 19 bp, Homo sapiens
caggcagagctgagggccc

SEQ ID NO: 1258005 - DNA, 22 bp, Homo sapiens
caggcagagctgagggccctgt

SEQ ID NO: 1258006 - DNA, 22 bp, Homo sapiens
caggcagagctggagcccccag

SEQ ID NO: 1258007 - DNA, 12 bp, Homo sapiens
caggcagagtgg

SEQ ID NO: 1258008 - DNA, 15 bp, Homo sapiens
caggcagatctgtgc

SEQ ID NO: 1258009 - DNA, 18 bp, Homo sapiens
caggcagatctgtgcccc

SEQ ID NO: 1258010 - DNA, 21 bp, Homo sapiens
caggcagatctgtgccccatg

SEQ ID NO: 1258011 - DNA, 16 bp, Homo sapiens
caggcagcacagtgtg

SEQ ID NO: 1258012 - DNA, 13 bp, Homo sapiens
caggcagcaccac

SEQ ID NO: 1258013 - DNA, 15 bp, Homo sapiens
caggcagccaccagt

SEQ ID NO: 1258014 - DNA, 16 bp, Homo sapiens
caggcagccacgtctc

SEQ ID NO: 1258015 - DNA, 17 bp, Homo sapiens
caggcagccacgtctca

SEQ ID NO: 1258016 - DNA, 14 bp, Homo sapiens
caggcagcccagca

SEQ ID NO: 1258017 - DNA, 15 bp, Homo sapiens
caggcagcccagcag

SEQ ID NO: 1258018 - DNA, 19 bp, Homo sapiens
caggcagcctcctttgtgt

SEQ ID NO: 1258019 - DNA, 13 bp, Homo sapiens
caggcagcctgga

SEQ ID NO: 1258020 - DNA, 12 bp, Homo sapiens
caggcagcgatg

SEQ ID NO: 1258021 - DNA, 22 bp, Homo sapiens
caggcagcgcagggctggcacg

SEQ ID NO: 1258022 - DNA, 22 bp, Homo sapiens
caggcagctccctcctgcacac

SEQ ID NO: 1258023 - DNA, 16 bp, Homo sapiens
caggcagctgagacca

SEQ ID NO: 1258024 - DNA, 18 bp, Homo sapiens
caggcagctggatgagac

SEQ ID NO: 1258025 - DNA, 14 bp, Homo sapiens
caggcagcttccaa

SEQ ID NO: 1258026 - DNA, 13 bp, Homo sapiens
caggcaggaacaa

SEQ ID NO: 1258027 - DNA, 20 bp, Homo sapiens
caggcaggaacaaacagggc

SEQ ID NO: 1258028 - DNA, 12 bp, Homo sapiens
caggcaggaagt

SEQ ID NO: 1258029 - DNA, 21 bp, Homo sapiens
caggcaggccaaggccttctc

SEQ ID NO: 1258030 - DNA, 15 bp, Homo sapiens
caggcaggccaggct

SEQ ID NO: 1258031 - DNA, 17 bp, Homo sapiens
caggcaggcggctcctc

SEQ ID NO: 1258032 - DNA, 21 bp, Homo sapiens
caggcaggcggctcctcctca

SEQ ID NO: 1258033 - DNA, 24 bp, Homo sapiens
caggcaggcggctcctcctcaccc

SEQ ID NO: 1258034 - DNA, 12 bp, Homo sapiens
caggcaggctgt

SEQ ID NO: 1258035 - DNA, 13 bp, Homo sapiens
caggcaggctgtg

SEQ ID NO: 1258036 - DNA, 13 bp, Homo sapiens
caggcagggaggg

SEQ ID NO: 1258037 - DNA, 22 bp, Homo sapiens
caggcagggctgcagagggaga

SEQ ID NO: 1258038 - DNA, 16 bp, Homo sapiens
caggcaggggcatctg

SEQ ID NO: 1258039 - DNA, 20 bp, Homo sapiens
caggcaggggcatctgtctg

SEQ ID NO: 1258040 - DNA, 18 bp, Homo sapiens
caggcaggggtgagagca

SEQ ID NO: 1258041 - DNA, 22 bp, Homo sapiens
caggcaggggtgagagcaccca

SEQ ID NO: 1258042 - DNA, 18 bp, Homo sapiens
caggcaggggtgggagag

SEQ ID NO: 1258043 - DNA, 20 bp, Homo sapiens
caggcaggggtgggagagcc

SEQ ID NO: 1258044 - DNA, 17 bp, Homo sapiens
caggcaggggtgggggt

SEQ ID NO: 1258045 - DNA, 14 bp, Homo sapiens
caggcaggtgcctg

SEQ ID NO: 1258046 - DNA, 15 bp, Homo sapiens
caggcaggtgggatg

SEQ ID NO: 1258047 - DNA, 15 bp, Homo sapiens
caggcagtccaggcc

SEQ ID NO: 1258048 - DNA, 19 bp, Homo sapiens
caggcagtcgggggctggc

SEQ ID NO: 1258049 - DNA, 23 bp, Homo sapiens
caggcagtgcatgtgaagcatgc

SEQ ID NO: 1258050 - DNA, 18 bp, Homo sapiens
caggcagttaggtgctga

SEQ ID NO: 1258051 - DNA, 17 bp, Homo sapiens
caggcagttggccagag

SEQ ID NO: 1258052 - DNA, 21 bp, Homo sapiens
caggcatagaggcttctccgc

SEQ ID NO: 1258053 - DNA, 17 bp, Homo sapiens
caggcataggcctgggt

SEQ ID NO: 1258054 - DNA, 16 bp, Homo sapiens
caggcatatgtttccc

SEQ ID NO: 1258055 - DNA, 23 bp, Homo sapiens
caggcatatgtttccccatctct

SEQ ID NO: 1258056 - DNA, 12 bp, Homo sapiens
caggcatcctcc

SEQ ID NO: 1258057 - DNA, 14 bp, Homo sapiens
caggcatctccttg

SEQ ID NO: 1258058 - DNA, 19 bp, Homo sapiens
caggcatctgttagcagag

SEQ ID NO: 1258059 - DNA, 20 bp, Homo sapiens
caggcatgagccactgcacc

SEQ ID NO: 1258060 - DNA, 13 bp, Homo sapiens
caggcatgcagct

SEQ ID NO: 1258061 - DNA, 22 bp, Homo sapiens
caggcatgcagctgcctggggc

SEQ ID NO: 1258062 - DNA, 14 bp, Homo sapiens
caggcatgcctgtg

SEQ ID NO: 1258063 - DNA, 16 bp, Homo sapiens
caggcatgcctgtgtg

SEQ ID NO: 1258064 - DNA, 14 bp, Homo sapiens
caggcatggggggt

SEQ ID NO: 1258065 - DNA, 14 bp, Homo sapiens
caggcatgtgccac

SEQ ID NO: 1258066 - DNA, 15 bp, Homo sapiens
caggcattgaggaag

SEQ ID NO: 1258067 - DNA, 16 bp, Homo sapiens
caggcattgctttgcc

SEQ ID NO: 1258068 - DNA, 16 bp, Homo sapiens
caggccaacagcacct

SEQ ID NO: 1258069 - DNA, 21 bp, Homo sapiens
caggccaagagcagaggcagc

SEQ ID NO: 1258070 - DNA, 22 bp, Homo sapiens
caggccacagtggggctgcagg

SEQ ID NO: 1258071 - DNA, 23 bp, Homo sapiens
caggccaccatattcagtgctgt

SEQ ID NO: 1258072 - DNA, 15 bp, Homo sapiens
caggccacctgcccc

SEQ ID NO: 1258073 - DNA, 13 bp, Homo sapiens
caggccactgtgg

SEQ ID NO: 1258074 - DNA, 15 bp, Homo sapiens
caggccactgtggcc

SEQ ID NO: 1258075 - DNA, 16 bp, Homo sapiens
caggccactgtggcca

SEQ ID NO: 1258076 - DNA, 22 bp, Homo sapiens
caggccactgtggccagagctg

SEQ ID NO: 1258077 - DNA, 20 bp, Homo sapiens
caggccagagggcagtggcc

SEQ ID NO: 1258078 - DNA, 17 bp, Homo sapiens
caggccagatggcccct

SEQ ID NO: 1258079 - DNA, 12 bp, Homo sapiens
caggccagccca

SEQ ID NO: 1258080 - DNA, 13 bp, Homo sapiens
caggccagcccag

SEQ ID NO: 1258081 - DNA, 14 bp, Homo sapiens
caggccagcccagc

SEQ ID NO: 1258082 - DNA, 16 bp, Homo sapiens
caggccagcccagcca

SEQ ID NO: 1258083 - DNA, 21 bp, Homo sapiens
caggccagcccccccacccac

SEQ ID NO: 1258084 - DNA, 11 bp, Homo sapiens
cagggagggcc

SEQ ID NO: 1258085 - DNA, 18 bp, Homo sapiens
cagggagggccagggagg

SEQ ID NO: 1258086 - DNA, 19 bp, Homo sapiens
cagggagggccagggaggc

SEQ ID NO: 1258087 - DNA, 21 bp, Homo sapiens
cagggagggccggcggctctg

SEQ ID NO: 1258088 - DNA, 16 bp, Homo sapiens
cagggaggggaagagg

SEQ ID NO: 1258089 - DNA, 21 bp, Homo sapiens
cagggaggggactatttatga

SEQ ID NO: 1258090 - DNA, 17 bp, Homo sapiens
cagggaggggaggcaga

SEQ ID NO: 1258091 - DNA, 16 bp, Homo sapiens
cagggaggggcaacca

SEQ ID NO: 1258092 - DNA, 12 bp, Homo sapiens
cagggaggggct

SEQ ID NO: 1258093 - DNA, 16 bp, Homo sapiens
cagggaggggctgggg

SEQ ID NO: 1258094 - DNA, 22 bp, Homo sapiens
cagggagggggacctgtccccc

SEQ ID NO: 1258095 - DNA, 22 bp, Homo sapiens
cagggaggtgggggcctcctca

SEQ ID NO: 1258096 - DNA, 15 bp, Homo sapiens
cagggagtccagggt

SEQ ID NO: 1258097 - DNA, 13 bp, Homo sapiens
cagggagtcccct

SEQ ID NO: 1258098 - DNA, 22 bp, Homo sapiens
cagggagtcccctccccggccc

SEQ ID NO: 1258099 - DNA, 13 bp, Homo sapiens
cagggagtccttg

SEQ ID NO: 1258100 - DNA, 20 bp, Homo sapiens
cagggagtgagcagctactg

SEQ ID NO: 1258101 - DNA, 23 bp, Homo sapiens
cagggagtgagcagctactgtaa

SEQ ID NO: 1258102 - DNA, 14 bp, Homo sapiens
cagggagtgctggc

SEQ ID NO: 1258103 - DNA, 17 bp, Homo sapiens
cagggagtgctggctca

SEQ ID NO: 1258104 - DNA, 22 bp, Homo sapiens
cagggagtgctggctcacagta

SEQ ID NO: 1258105 - DNA, 15 bp, Homo sapiens
cagggatattgcctt

SEQ ID NO: 1258106 - DNA, 19 bp, Homo sapiens
cagggatcactggctggcc

SEQ ID NO: 1258107 - DNA, 19 bp, Homo sapiens
cagggatcttgcattccca

SEQ ID NO: 1258108 - DNA, 17 bp, Homo sapiens
cagggatgatggcagag

SEQ ID NO: 1258109 - DNA, 20 bp, Homo sapiens
cagggatgccctggaggtgg

SEQ ID NO: 1258110 - DNA, 22 bp, Homo sapiens
cagggatgccctggaggtggct

SEQ ID NO: 1258111 - DNA, 23 bp, Homo sapiens
cagggatgccctggaggtggctg

SEQ ID NO: 1258112 - DNA, 14 bp, Homo sapiens
cagggatgctgggc

SEQ ID NO: 1258113 - DNA, 20 bp, Homo sapiens
cagggatgctgggctgggcc

SEQ ID NO: 1258114 - DNA, 16 bp, Homo sapiens
cagggatgctggtggc

SEQ ID NO: 1258115 - DNA, 22 bp, Homo sapiens
cagggatgctggtggctggtga

SEQ ID NO: 1258116 - DNA, 14 bp, Homo sapiens
cagggatggagatg

SEQ ID NO: 1258117 - DNA, 19 bp, Homo sapiens
cagggatggagatgggaag

SEQ ID NO: 1258118 - DNA, 14 bp, Homo sapiens
cagggattctctca

SEQ ID NO: 1258119 - DNA, 23 bp, Homo sapiens
cagggcaaaagggcagctgtgat

SEQ ID NO: 1258120 - DNA, 21 bp, Homo sapiens
cagggcaaaatcgccataggc

SEQ ID NO: 1258121 - DNA, 17 bp, Homo sapiens
cagggcaaggacacagc

SEQ ID NO: 1258122 - DNA, 17 bp, Homo sapiens
cagggcaatgccatcag

SEQ ID NO: 1258123 - DNA, 20 bp, Homo sapiens
cagggcaatgccatcagccc

SEQ ID NO: 1258124 - DNA, 14 bp, Homo sapiens
cagggcacagatga

SEQ ID NO: 1258125 - DNA, 15 bp, Homo sapiens
cagggcacagctgcc

SEQ ID NO: 1258126 - DNA, 19 bp, Homo sapiens
cagggcacagctgccctgc

SEQ ID NO: 1258127 - DNA, 16 bp, Homo sapiens
cagggcacggggacct

SEQ ID NO: 1258128 - DNA, 19 bp, Homo sapiens
cagggcacggggacctgga

SEQ ID NO: 1258129 - DNA, 22 bp, Homo sapiens
cagggcacggggacctggatag

SEQ ID NO: 1258130 - DNA, 13 bp, Homo sapiens
cagggcactgact

SEQ ID NO: 1258131 - DNA, 13 bp, Homo sapiens
cagggcagagcag

SEQ ID NO: 1258132 - DNA, 12 bp, Homo sapiens
cagggcagagga

SEQ ID NO: 1258133 - DNA, 19 bp, Homo sapiens
cagggcagcaagggacctg

SEQ ID NO: 1258134 - DNA, 14 bp, Homo sapiens
cagggcagcagccg

SEQ ID NO: 1258135 - DNA, 13 bp, Homo sapiens
cagggcagcagtg

SEQ ID NO: 1258136 - DNA, 17 bp, Homo sapiens
cagggcagcctccacct

SEQ ID NO: 1258137 - DNA, 17 bp, Homo sapiens
cagggcagcgccaggct

SEQ ID NO: 1258138 - DNA, 19 bp, Homo sapiens
cagggcagcgccaggctga

SEQ ID NO: 1258139 - DNA, 12 bp, Homo sapiens
cagggcagcggc

SEQ ID NO: 1258140 - DNA, 13 bp, Homo sapiens
cagggcagctgcc

SEQ ID NO: 1258141 - DNA, 14 bp, Homo sapiens
cagggcagctgcct

SEQ ID NO: 1258142 - DNA, 23 bp, Homo sapiens
cagggcagctgcctggccatgct

SEQ ID NO: 1258143 - DNA, 17 bp, Homo sapiens
cagggcagggcagcctg

SEQ ID NO: 1258144 - DNA, 13 bp, Homo sapiens
cagggcagggccc

SEQ ID NO: 1258145 - DNA, 16 bp, Homo sapiens
cagggcagggctctga

SEQ ID NO: 1258146 - DNA, 19 bp, Homo sapiens
cagggcagggctctgatat

SEQ ID NO: 1258147 - DNA, 12 bp, Homo sapiens
cagggcagggtc

SEQ ID NO: 1258148 - DNA, 20 bp, Homo sapiens
cagggcagggtctgggctgg

SEQ ID NO: 1258149 - DNA, 17 bp, Homo sapiens
cagggcagggtgggcag

SEQ ID NO: 1258150 - DNA, 21 bp, Homo sapiens
cagggcagtcattggctgtct

SEQ ID NO: 1258151 - DNA, 13 bp, Homo sapiens
cagggcagtggcc

SEQ ID NO: 1258152 - DNA, 23 bp, Homo sapiens
cagggcagtggccaagcctgctg

SEQ ID NO: 1258153 - DNA, 14 bp, Homo sapiens
cagggcatctcctg

SEQ ID NO: 1258154 - DNA, 20 bp, Homo sapiens
cagggcatggccaggtggcc

SEQ ID NO: 1258155 - DNA, 13 bp, Homo sapiens
cagggccaaccct

SEQ ID NO: 1258156 - DNA, 22 bp, Homo sapiens
cagggccaacttgagggcccag

SEQ ID NO: 1258157 - DNA, 16 bp, Homo sapiens
cagggccaatccccag

SEQ ID NO: 1258158 - DNA, 23 bp, Homo sapiens
cagggccacgctccagctgcccc

SEQ ID NO: 1258159 - DNA, 16 bp, Homo sapiens
cagggccacgtgccag

SEQ ID NO: 1258160 - DNA, 18 bp, Homo sapiens
cagggccacgtgccaggc

SEQ ID NO: 1258161 - DNA, 13 bp, Homo sapiens
cagggccactccc

SEQ ID NO: 1258162 - DNA, 21 bp, Homo sapiens
cagggccagaaggagggcaga

SEQ ID NO: 1258163 - DNA, 22 bp, Homo sapiens
cagggccagaaggagggcagag

SEQ ID NO: 1258164 - DNA, 23 bp, Homo sapiens
cagggccagaaggagggcagagc

SEQ ID NO: 1258165 - DNA, 23 bp, Homo sapiens
cagggccagactggaagacactt

SEQ ID NO: 1258166 - DNA, 16 bp, Homo sapiens
cagggccagggcaatg

SEQ ID NO: 1258167 - DNA, 17 bp, Homo sapiens
cagggccagggcaatgc

SEQ ID NO: 1258168 - DNA, 19 bp, Homo sapiens
cagggccagggcaatgcca

SEQ ID NO: 1258169 - DNA, 12 bp, Homo sapiens
cagggccagggt

SEQ ID NO: 1258170 - DNA, 13 bp, Homo sapiens
cagggccagggtt

SEQ ID NO: 1258171 - DNA, 12 bp, Homo sapiens
cagggccaggtg

SEQ ID NO: 1258172 - DNA, 15 bp, Homo sapiens
cagggccagtggggc

SEQ ID NO: 1258173 - DNA, 21 bp, Homo sapiens
cagggccagtggggcctgtgg

SEQ ID NO: 1258174 - DNA, 14 bp, Homo sapiens
cagggccatgcaga

SEQ ID NO: 1258175 - DNA, 17 bp, Homo sapiens
cagggccatgcagacct

SEQ ID NO: 1258176 - DNA, 17 bp, Homo sapiens
cagggccatgcctgccc

SEQ ID NO: 1258177 - DNA, 16 bp, Homo sapiens
cagggccatgctgagg

SEQ ID NO: 1258178 - DNA, 21 bp, Homo sapiens
cagggccatgtcagacacaga

SEQ ID NO: 1258179 - DNA, 17 bp, Homo sapiens
cagggcccaagtccctg

SEQ ID NO: 1258180 - DNA, 21 bp, Homo sapiens
cagggcccaccttggaccctg

SEQ ID NO: 1258181 - DNA, 14 bp, Homo sapiens
cagggcccacgtgt

SEQ ID NO: 1258182 - DNA, 18 bp, Homo sapiens
cagggcccagagcccttg

SEQ ID NO: 1258183 - DNA, 13 bp, Homo sapiens
cagggcccaggcc

SEQ ID NO: 1258184 - DNA, 18 bp, Homo sapiens
cagggcccaggccatgtg

SEQ ID NO: 1258185 - DNA, 20 bp, Homo sapiens
cagggcccaggccatgtggc

SEQ ID NO: 1258186 - DNA, 23 bp, Homo sapiens
cagggcccaggccatgtggcctg

SEQ ID NO: 1258187 - DNA, 17 bp, Homo sapiens
cagggcccaggcctgga

SEQ ID NO: 1258188 - DNA, 18 bp, Homo sapiens
cagggcccaggcctggag

SEQ ID NO: 1258189 - DNA, 19 bp, Homo sapiens
cagggcccaggcctggagc

SEQ ID NO: 1258190 - DNA, 13 bp, Homo sapiens
cagggccccagaa

SEQ ID NO: 1258191 - DNA, 17 bp, Homo sapiens
cagggccccagaaggca

SEQ ID NO: 1258192 - DNA, 21 bp, Homo sapiens
cagggccccagaaggcaggga

SEQ ID NO: 1258193 - DNA, 20 bp, Homo sapiens
cagggccccaggcattgcca

SEQ ID NO: 1258194 - DNA, 16 bp, Homo sapiens
cagggcccccatctca

SEQ ID NO: 1258195 - DNA, 22 bp, Homo sapiens
cagggcccccctccccccactt

SEQ ID NO: 1258196 - DNA, 19 bp, Homo sapiens
cagggcccctccctctgcc

SEQ ID NO: 1258197 - DNA, 17 bp, Homo sapiens
cagggcccgggcaccca

SEQ ID NO: 1258198 - DNA, 12 bp, Homo sapiens
cagggccctccc

SEQ ID NO: 1258199 - DNA, 17 bp, Homo sapiens
cagggccctcccagccc

SEQ ID NO: 1258200 - DNA, 23 bp, Homo sapiens
cagggccctcccagcccattgct

SEQ ID NO: 1258201 - DNA, 21 bp, Homo sapiens
cagggccctgagctcggtgga

SEQ ID NO: 1258202 - DNA, 14 bp, Homo sapiens
cagggccctgcaga

SEQ ID NO: 1258203 - DNA, 17 bp, Homo sapiens
cagggccctgccccagg

SEQ ID NO: 1258204 - DNA, 19 bp, Homo sapiens
cagggccctgccccaggcc

SEQ ID NO: 1258205 - DNA, 21 bp, Homo sapiens
cagggccctgccccaggcctg

SEQ ID NO: 1258206 - DNA, 17 bp, Homo sapiens
cagggtcttttcatctg

SEQ ID NO: 1258207 - DNA, 17 bp, Homo sapiens
cagggtgaactgcaaag

SEQ ID NO: 1258208 - DNA, 18 bp, Homo sapiens
cagggtgaactgcaaagc

SEQ ID NO: 1258209 - DNA, 22 bp, Homo sapiens
cagggtgacgcctgagacagca

SEQ ID NO: 1258210 - DNA, 15 bp, Homo sapiens
cagggtgagaagcta

SEQ ID NO: 1258211 - DNA, 15 bp, Homo sapiens
cagggtgcagcccaa

SEQ ID NO: 1258212 - DNA, 14 bp, Homo sapiens
cagggtgcagtgtg

SEQ ID NO: 1258213 - DNA, 21 bp, Homo sapiens
cagggtgctaaagccaaccag

SEQ ID NO: 1258214 - DNA, 20 bp, Homo sapiens
cagggtgctgatgggaagga

SEQ ID NO: 1258215 - DNA, 16 bp, Homo sapiens
cagggtggaccaggcc

SEQ ID NO: 1258216 - DNA, 18 bp, Homo sapiens
cagggtggaccaggcctg

SEQ ID NO: 1258217 - DNA, 13 bp, Homo sapiens
cagggtggaggaa

SEQ ID NO: 1258218 - DNA, 16 bp, Homo sapiens
cagggtggaggaaggt

SEQ ID NO: 1258219 - DNA, 12 bp, Homo sapiens
cagggtggcagc

SEQ ID NO: 1258220 - DNA, 21 bp, Homo sapiens
cagggtggcgtccactcggct

SEQ ID NO: 1258221 - DNA, 12 bp, Homo sapiens
cagggtgggaag

SEQ ID NO: 1258222 - DNA, 20 bp, Homo sapiens
cagggtgggaagaaagaatg

SEQ ID NO: 1258223 - DNA, 17 bp, Homo sapiens
cagggtgggaagagaag

SEQ ID NO: 1258224 - DNA, 18 bp, Homo sapiens
cagggtgggatggaggag

SEQ ID NO: 1258225 - DNA, 18 bp, Homo sapiens
cagggtgggcagcctatg

SEQ ID NO: 1258226 - DNA, 18 bp, Homo sapiens
cagggtgggccactctcc

SEQ ID NO: 1258227 - DNA, 20 bp, Homo sapiens
cagggtgggccactctcccc

SEQ ID NO: 1258228 - DNA, 13 bp, Homo sapiens
cagggtgggctgg

SEQ ID NO: 1258229 - DNA, 17 bp, Homo sapiens
cagggtgggctggggac

SEQ ID NO: 1258230 - DNA, 21 bp, Homo sapiens
cagggtgggctggggactctg

SEQ ID NO: 1258231 - DNA, 20 bp, Homo sapiens
cagggtgggcttcctgccct

SEQ ID NO: 1258232 - DNA, 17 bp, Homo sapiens
cagggtggtgctgggac

SEQ ID NO: 1258233 - DNA, 19 bp, Homo sapiens
cagggtggtgctgggactg

SEQ ID NO: 1258234 - DNA, 16 bp, Homo sapiens
cagggtgtcctgaggt

SEQ ID NO: 1258235 - DNA, 23 bp, Homo sapiens
cagggtgtgactcgggagctgca

SEQ ID NO: 1258236 - DNA, 19 bp, Homo sapiens
cagggtgtggccctgccat

SEQ ID NO: 1258237 - DNA, 22 bp, Homo sapiens
cagggtgtggggccatgcctcc

SEQ ID NO: 1258238 - DNA, 23 bp, Homo sapiens
cagggttctcttagcaactcaga

SEQ ID NO: 1258239 - DNA, 20 bp, Homo sapiens
cagggttctgctcggcttct

SEQ ID NO: 1258240 - DNA, 19 bp, Homo sapiens
cagggtttctctgcagatg

SEQ ID NO: 1258241 - DNA, 23 bp, Homo sapiens
cagggttttgccccaagtcctca

SEQ ID NO: 1258242 - DNA, 12 bp, Homo sapiens
caggtaagatgt

SEQ ID NO: 1258243 - DNA, 20 bp, Homo sapiens
caggtaatatacctggttta

SEQ ID NO: 1258244 - DNA, 23 bp, Homo sapiens
caggtaatgagggactggaacca

SEQ ID NO: 1258245 - DNA, 21 bp, Homo sapiens
caggtacagaaaacatgttta

SEQ ID NO: 1258246 - DNA, 21 bp, Homo sapiens
caggtacagcgggctgtgccc

SEQ ID NO: 1258247 - DNA, 16 bp, Homo sapiens
caggtaccaaggaaat

SEQ ID NO: 1258248 - DNA, 19 bp, Homo sapiens
caggtaccacccttcagac

SEQ ID NO: 1258249 - DNA, 20 bp, Homo sapiens
caggtaccacccttcagacc

SEQ ID NO: 1258250 - DNA, 13 bp, Homo sapiens
caggtactgcatt

SEQ ID NO: 1258251 - DNA, 13 bp, Homo sapiens
caggtactttggt

SEQ ID NO: 1258252 - DNA, 22 bp, Homo sapiens
caggtagaaggttgacacagtt

SEQ ID NO: 1258253 - DNA, 20 bp, Homo sapiens
caggtagaattatctaattt

SEQ ID NO: 1258254 - DNA, 23 bp, Homo sapiens
caggtagaattatctaatttata

SEQ ID NO: 1258255 - DNA, 19 bp, Homo sapiens
caggtagatcgcttgagcc

SEQ ID NO: 1258256 - DNA, 21 bp, Homo sapiens
caggtagatcgcttgagccca

SEQ ID NO: 1258257 - DNA, 18 bp, Homo sapiens
caggtagcaagagagcag

SEQ ID NO: 1258258 - DNA, 22 bp, Homo sapiens
caggtagcacagattttgaatc

SEQ ID NO: 1258259 - DNA, 19 bp, Homo sapiens
caggtagctgggattacag

SEQ ID NO: 1258260 - DNA, 20 bp, Homo sapiens
caggtaggcccttgtcctgc

SEQ ID NO: 1258261 - DNA, 16 bp, Homo sapiens
caggtagggaaataat

SEQ ID NO: 1258262 - DNA, 16 bp, Homo sapiens
caggtagtactgggaa

SEQ ID NO: 1258263 - DNA, 23 bp, Homo sapiens
caggtagttgcaattgaattaaa

SEQ ID NO: 1258264 - DNA, 15 bp, Homo sapiens
caggtatatactttg

SEQ ID NO: 1258265 - DNA, 18 bp, Homo sapiens
caggtatatactttgaaa

SEQ ID NO: 1258266 - DNA, 16 bp, Homo sapiens
caggtatctccaggat

SEQ ID NO: 1258267 - DNA, 22 bp, Homo sapiens
caggtatctccaggattgaaga

SEQ ID NO: 1258268 - DNA, 23 bp, Homo sapiens
caggtatggaagggtttgtggct

SEQ ID NO: 1258269 - DNA, 14 bp, Homo sapiens
caggtatggctctg

SEQ ID NO: 1258270 - DNA, 15 bp, Homo sapiens
caggtatgttgcctt

SEQ ID NO: 1258271 - DNA, 16 bp, Homo sapiens
caggtatgttgccttt

SEQ ID NO: 1258272 - DNA, 19 bp, Homo sapiens
caggtattacacaagccaa

SEQ ID NO: 1258273 - DNA, 16 bp, Homo sapiens
caggtcaataaactta

SEQ ID NO: 1258274 - DNA, 19 bp, Homo sapiens
caggtcaccatcctcagag

SEQ ID NO: 1258275 - DNA, 20 bp, Homo sapiens
caggtcaccgggagggctgc

SEQ ID NO: 1258276 - DNA, 15 bp, Homo sapiens
caggtcactgtcact

SEQ ID NO: 1258277 - DNA, 17 bp, Homo sapiens
caggtcagccctgtgtc

SEQ ID NO: 1258278 - DNA, 15 bp, Homo sapiens
caggtcagctgggag

SEQ ID NO: 1258279 - DNA, 16 bp, Homo sapiens
caggtcagctgggagc

SEQ ID NO: 1258280 - DNA, 16 bp, Homo sapiens
caggtcagctgttact

SEQ ID NO: 1258281 - DNA, 18 bp, Homo sapiens
caggtcagctgttacttt

SEQ ID NO: 1258282 - DNA, 18 bp, Homo sapiens
caggtcaggggctcccta

SEQ ID NO: 1258283 - DNA, 19 bp, Homo sapiens
caggtcaggggctccctac

SEQ ID NO: 1258284 - DNA, 23 bp, Homo sapiens
caggtccaaacccttcaactcct

SEQ ID NO: 1258285 - DNA, 16 bp, Homo sapiens
caggtccagctctgga

SEQ ID NO: 1258286 - DNA, 23 bp, Homo sapiens
caggtccagctctggaggggagg

SEQ ID NO: 1258287 - DNA, 15 bp, Homo sapiens
caggtccaggccagt

SEQ ID NO: 1258288 - DNA, 18 bp, Homo sapiens
caggtccaggccagtggg

SEQ ID NO: 1258289 - DNA, 19 bp, Homo sapiens
caggtcccacgtctggcca

SEQ ID NO: 1258290 - DNA, 14 bp, Homo sapiens
caggtcccagcgag

SEQ ID NO: 1258291 - DNA, 17 bp, Homo sapiens
caggtcccagcgagcca

SEQ ID NO: 1258292 - DNA, 16 bp, Homo sapiens
caggtccccatggctt

SEQ ID NO: 1258293 - DNA, 17 bp, Homo sapiens
caggtccccatggcttg

SEQ ID NO: 1258294 - DNA, 19 bp, Homo sapiens
caggtcccccgactgcctg

SEQ ID NO: 1258295 - DNA, 20 bp, Homo sapiens
caggtcctcagagaatttct

SEQ ID NO: 1258296 - DNA, 23 bp, Homo sapiens
caggtcctgcccatgtgtcccct

SEQ ID NO: 1258297 - DNA, 15 bp, Homo sapiens
caggtcctgtctctg

SEQ ID NO: 1258298 - DNA, 16 bp, Homo sapiens
caggtcctgtctctgc

SEQ ID NO: 1258299 - DNA, 18 bp, Homo sapiens
caggtctagactttctca

SEQ ID NO: 1258300 - DNA, 19 bp, Homo sapiens
caggtctcccacgtgggag

SEQ ID NO: 1258301 - DNA, 11 bp, Homo sapiens
caggtctcctc

SEQ ID NO: 1258302 - DNA, 14 bp, Homo sapiens
caggtctgcaaggg

SEQ ID NO: 1258303 - DNA, 19 bp, Homo sapiens
caggtctgcaagggcccag

SEQ ID NO: 1258304 - DNA, 22 bp, Homo sapiens
caggtctgcaagggcccagagt

SEQ ID NO: 1258305 - DNA, 23 bp, Homo sapiens
caggtctgcaagggcccagagtg

SEQ ID NO: 1258306 - DNA, 14 bp, Homo sapiens
caggtcttcatatt

SEQ ID NO: 1258307 - DNA, 22 bp, Homo sapiens
caggtcttgactcatggcagct

SEQ ID NO: 1258308 - DNA, 21 bp, Homo sapiens
caggtcttggagctgagcctc

SEQ ID NO: 1258309 - DNA, 23 bp, Homo sapiens
caggtcttggagctgagcctctc

SEQ ID NO: 1258310 - DNA, 19 bp, Homo sapiens
caggtctttcctaaggctg

SEQ ID NO: 1258311 - DNA, 16 bp, Homo sapiens
caggtcttttctttgg

SEQ ID NO: 1258312 - DNA, 14 bp, Homo sapiens
caggtgacagatca

SEQ ID NO: 1258313 - DNA, 17 bp, Homo sapiens
caggtgaccttctggga

SEQ ID NO: 1258314 - DNA, 17 bp, Homo sapiens
caggtgagaacatccat

SEQ ID NO: 1258315 - DNA, 21 bp, Homo sapiens
caggtgagaagcagaggaagg

SEQ ID NO: 1258316 - DNA, 15 bp, Homo sapiens
caggtgaggggcagg

SEQ ID NO: 1258317 - DNA, 18 bp, Homo sapiens
caggtgaggggcaggacc

SEQ ID NO: 1258318 - DNA, 20 bp, Homo sapiens
caggtgaggggcaggacctg

SEQ ID NO: 1258319 - DNA, 21 bp, Homo sapiens
caggtgaggtctgttcctttt

SEQ ID NO: 1258320 - DNA, 17 bp, Homo sapiens
caggtgatcaaaataaa

SEQ ID NO: 1258321 - DNA, 22 bp, Homo sapiens
caggtgatctgtttgaggagag

SEQ ID NO: 1258322 - DNA, 17 bp, Homo sapiens
caggtgatgctctggct

SEQ ID NO: 1258323 - DNA, 19 bp, Homo sapiens
caggtgatgctctggcttg

SEQ ID NO: 1258324 - DNA, 20 bp, Homo sapiens
caggtgcaatctactggaaa

SEQ ID NO: 1258325 - DNA, 20 bp, Homo sapiens
caggtgcacacatcaccagg

SEQ ID NO: 1258326 - DNA, 15 bp, Homo sapiens
cagtctgctgccctc

SEQ ID NO: 1258327 - DNA, 22 bp, Homo sapiens
cagtctgctgccctccatcccg

SEQ ID NO: 1258328 - DNA, 12 bp, Homo sapiens
cagtctggccac

SEQ ID NO: 1258329 - DNA, 17 bp, Homo sapiens
cagtctggccactgtca

SEQ ID NO: 1258330 - DNA, 23 bp, Homo sapiens
cagtctggtttatataaggcagt

SEQ ID NO: 1258331 - DNA, 18 bp, Homo sapiens
cagtctgtctactgtggt

SEQ ID NO: 1258332 - DNA, 16 bp, Homo sapiens
cagtctgttcactgca

SEQ ID NO: 1258333 - DNA, 17 bp, Homo sapiens
cagtctgttcactgcat

SEQ ID NO: 1258334 - DNA, 16 bp, Homo sapiens
cagtcttactctgtct

SEQ ID NO: 1258335 - DNA, 20 bp, Homo sapiens
cagtcttactctgtctccca

SEQ ID NO: 1258336 - DNA, 17 bp, Homo sapiens
cagtcttccacaaagaa

SEQ ID NO: 1258337 - DNA, 20 bp, Homo sapiens
cagtcttccacaaagaaaat

SEQ ID NO: 1258338 - DNA, 17 bp, Homo sapiens
cagtcttccttgtggaa

SEQ ID NO: 1258339 - DNA, 22 bp, Homo sapiens
cagtcttgaatttctaaaaaac

SEQ ID NO: 1258340 - DNA, 15 bp, Homo sapiens
cagtcttgcaacagt

SEQ ID NO: 1258341 - DNA, 11 bp, Homo sapiens
cagtcttggtg

SEQ ID NO: 1258342 - DNA, 17 bp, Homo sapiens
cagtcttggtggttcta

SEQ ID NO: 1258343 - DNA, 17 bp, Homo sapiens
cagtcttgtattaagtt

SEQ ID NO: 1258344 - DNA, 14 bp, Homo sapiens
cagtctttgctcag

SEQ ID NO: 1258345 - DNA, 15 bp, Homo sapiens
cagtctttgctcagt

SEQ ID NO: 1258346 - DNA, 17 bp, Homo sapiens
cagtgaaaagattttat

SEQ ID NO: 1258347 - DNA, 17 bp, Homo sapiens
cagtgaaatacatcctt

SEQ ID NO: 1258348 - DNA, 22 bp, Homo sapiens
cagtgaaattttggtgaatgtg

SEQ ID NO: 1258349 - DNA, 15 bp, Homo sapiens
cagtgaacattccca

SEQ ID NO: 1258350 - DNA, 18 bp, Homo sapiens
cagtgaacattcccagcc

SEQ ID NO: 1258351 - DNA, 23 bp, Homo sapiens
cagtgaaccaaagagactggagc

SEQ ID NO: 1258352 - DNA, 15 bp, Homo sapiens
cagtgaactcctgcc

SEQ ID NO: 1258353 - DNA, 17 bp, Homo sapiens
cagtgaagacttcttgg

SEQ ID NO: 1258354 - DNA, 18 bp, Homo sapiens
cagtgaagggttttgtgt

SEQ ID NO: 1258355 - DNA, 22 bp, Homo sapiens
cagtgaaggtggggagaagctg

SEQ ID NO: 1258356 - DNA, 15 bp, Homo sapiens
cagtgaatccctggg

SEQ ID NO: 1258357 - DNA, 20 bp, Homo sapiens
cagtgaattgacccatgttc

SEQ ID NO: 1258358 - DNA, 12 bp, Homo sapiens
cagtgaattgtc

SEQ ID NO: 1258359 - DNA, 19 bp, Homo sapiens
cagtgacaaaatgggagga

SEQ ID NO: 1258360 - DNA, 22 bp, Homo sapiens
cagtgacaaaatgggaggagga

SEQ ID NO: 1258361 - DNA, 14 bp, Homo sapiens
cagtgacaaaccat

SEQ ID NO: 1258362 - DNA, 15 bp, Homo sapiens
cagtgacagacaggc

SEQ ID NO: 1258363 - DNA, 17 bp, Homo sapiens
cagtgacagacaggctc

SEQ ID NO: 1258364 - DNA, 18 bp, Homo sapiens
cagtgacagagttcacta

SEQ ID NO: 1258365 - DNA, 20 bp, Homo sapiens
cagtgacagagttcactata

SEQ ID NO: 1258366 - DNA, 19 bp, Homo sapiens
cagtgacctgctgggtaaa

SEQ ID NO: 1258367 - DNA, 21 bp, Homo sapiens
cagtgacctttgacctcggtg

SEQ ID NO: 1258368 - DNA, 22 bp, Homo sapiens
cagtgacgtgcacctgtactca

SEQ ID NO: 1258369 - DNA, 17 bp, Homo sapiens
cagtgactccctgggag

SEQ ID NO: 1258370 - DNA, 19 bp, Homo sapiens
cagtgactcgacaaaggcc

SEQ ID NO: 1258371 - DNA, 23 bp, Homo sapiens
cagtgactcgacaaaggccacag

SEQ ID NO: 1258372 - DNA, 14 bp, Homo sapiens
cagtgactgaaacc

SEQ ID NO: 1258373 - DNA, 24 bp, Homo sapiens
cagtgactgttgtagcattttcct

SEQ ID NO: 1258374 - DNA, 13 bp, Homo sapiens
cagtgacttctga

SEQ ID NO: 1258375 - DNA, 16 bp, Homo sapiens
cagtgacttctgagat

SEQ ID NO: 1258376 - DNA, 22 bp, Homo sapiens
cagtgacttgttctgagtaagt

SEQ ID NO: 1258377 - DNA, 17 bp, Homo sapiens
cagtgactttacaggag

SEQ ID NO: 1258378 - DNA, 14 bp, Homo sapiens
cagtgactttgtat

SEQ ID NO: 1258379 - DNA, 16 bp, Homo sapiens
cagtgactttgtatag

SEQ ID NO: 1258380 - DNA, 22 bp, Homo sapiens
cagtgagaactctctccctggt

SEQ ID NO: 1258381 - DNA, 19 bp, Homo sapiens
cagtgagaagctgaggcct

SEQ ID NO: 1258382 - DNA, 20 bp, Homo sapiens
cagtgagaagctgaggccta

SEQ ID NO: 1258383 - DNA, 14 bp, Homo sapiens
cagtgagatagaat

SEQ ID NO: 1258384 - DNA, 18 bp, Homo sapiens
cagtgagcagggtggggt

SEQ ID NO: 1258385 - DNA, 19 bp, Homo sapiens
cagtgagcccctccccagc

SEQ ID NO: 1258386 - DNA, 21 bp, Homo sapiens
cagtgagcccctccccagcca

SEQ ID NO: 1258387 - DNA, 22 bp, Homo sapiens
cagtgagcccctccccagccag

SEQ ID NO: 1258388 - DNA, 24 bp, Homo sapiens
cagtgagccgagattgcaccactg

SEQ ID NO: 1258389 - DNA, 15 bp, Homo sapiens
cagtgagcctcctgt

SEQ ID NO: 1258390 - DNA, 16 bp, Homo sapiens
cagtgagcgcttgggc

SEQ ID NO: 1258391 - DNA, 16 bp, Homo sapiens
cagtgagctctagcaa

SEQ ID NO: 1258392 - DNA, 15 bp, Homo sapiens
cagtgaggagggtgg

SEQ ID NO: 1258393 - DNA, 17 bp, Homo sapiens
cagtgaggcaggagaag

SEQ ID NO: 1258394 - DNA, 13 bp, Homo sapiens
cagtgaggcccag

SEQ ID NO: 1258395 - DNA, 21 bp, Homo sapiens
cagtgagggagggctgtcatc

SEQ ID NO: 1258396 - DNA, 13 bp, Homo sapiens
cagtgagggctgg

SEQ ID NO: 1258397 - DNA, 15 bp, Homo sapiens
cagtgagggctgggc

SEQ ID NO: 1258398 - DNA, 18 bp, Homo sapiens
cagtgagggctgggccca

SEQ ID NO: 1258399 - DNA, 23 bp, Homo sapiens
cagtgaggggccctccatgcgca

SEQ ID NO: 1258400 - DNA, 23 bp, Homo sapiens
cagtgagggtaagtattttcctg

SEQ ID NO: 1258401 - DNA, 18 bp, Homo sapiens
cagtgagtcgagattgca

SEQ ID NO: 1258402 - DNA, 15 bp, Homo sapiens
cagtgagtctcttca

SEQ ID NO: 1258403 - DNA, 18 bp, Homo sapiens
cagtgagtgaatcaggca

SEQ ID NO: 1258404 - DNA, 19 bp, Homo sapiens
cagtgagtgaatcaggcaa

SEQ ID NO: 1258405 - DNA, 18 bp, Homo sapiens
cagtgagtgccatgcttt

SEQ ID NO: 1258406 - DNA, 22 bp, Homo sapiens
cagtgagttacagcgagaggca

SEQ ID NO: 1258407 - DNA, 23 bp, Homo sapiens
cagtgatatatttctatgtgtat

SEQ ID NO: 1258408 - DNA, 17 bp, Homo sapiens
cagtgatgacttgctgt

SEQ ID NO: 1258409 - DNA, 11 bp, Homo sapiens
cagtgatgatg

SEQ ID NO: 1258410 - DNA, 17 bp, Homo sapiens
cagtgatgatgttttga

SEQ ID NO: 1258411 - DNA, 20 bp, Homo sapiens
cagtgatgccgggcgccagg

SEQ ID NO: 1258412 - DNA, 14 bp, Homo sapiens
cagtgcacatttca

SEQ ID NO: 1258413 - DNA, 19 bp, Homo sapiens
cagtgcacctccctcccca

SEQ ID NO: 1258414 - DNA, 17 bp, Homo sapiens
cagtgcacctgcctcag

SEQ ID NO: 1258415 - DNA, 18 bp, Homo sapiens
cagtgcacctgcctcagc

SEQ ID NO: 1258416 - DNA, 19 bp, Homo sapiens
cagtgcacctgcctcagct

SEQ ID NO: 1258417 - DNA, 12 bp, Homo sapiens
cagtgcagacag

SEQ ID NO: 1258418 - DNA, 20 bp, Homo sapiens
cagtgcagagccttctcaga

SEQ ID NO: 1258419 - DNA, 12 bp, Homo sapiens
cagtgcagccac

SEQ ID NO: 1258420 - DNA, 14 bp, Homo sapiens
cagtgcagccactg

SEQ ID NO: 1258421 - DNA, 15 bp, Homo sapiens
cagtgcagccactgg

SEQ ID NO: 1258422 - DNA, 17 bp, Homo sapiens
cagtgcagcttgcagtc

SEQ ID NO: 1258423 - DNA, 13 bp, Homo sapiens
cagtgcagggctg

SEQ ID NO: 1258424 - DNA, 18 bp, Homo sapiens
cagtgcagtccatttcct

SEQ ID NO: 1258425 - DNA, 20 bp, Homo sapiens
cagtgcagtccatttcctaa

SEQ ID NO: 1258426 - DNA, 17 bp, Homo sapiens
cagtgcagtgatacatg

SEQ ID NO: 1258427 - DNA, 22 bp, Homo sapiens
cagtgcagtgatacatgtactc

SEQ ID NO: 1258428 - DNA, 10 bp, Homo sapiens
cagtgcagtt

SEQ ID NO: 1258429 - DNA, 22 bp, Homo sapiens
cagtgcagtttctaagcatgta

SEQ ID NO: 1258430 - DNA, 21 bp, Homo sapiens
cagtgcagtttcttttcacat

SEQ ID NO: 1258431 - DNA, 10 bp, Homo sapiens
cagtgcatca

SEQ ID NO: 1258432 - DNA, 14 bp, Homo sapiens
cagtgcatcattac

SEQ ID NO: 1258433 - DNA, 21 bp, Homo sapiens
cagtgcatcattactgttcca

SEQ ID NO: 1258434 - DNA, 23 bp, Homo sapiens
cagtgcatccccacgacccctgc

SEQ ID NO: 1258435 - DNA, 12 bp, Homo sapiens
cagtgcatctca

SEQ ID NO: 1258436 - DNA, 15 bp, Homo sapiens
cagtgcatctcagcc

SEQ ID NO: 1258437 - DNA, 19 bp, Homo sapiens
cagtgcatgtgaagcatgc

SEQ ID NO: 1258438 - DNA, 20 bp, Homo sapiens
cagtgcatgtgaagcatgct

SEQ ID NO: 1258439 - DNA, 22 bp, Homo sapiens
cagtgcatgtgaagcatgcttt

SEQ ID NO: 1258440 - DNA, 10 bp, Homo sapiens
cagtgccaac

SEQ ID NO: 1258441 - DNA, 21 bp, Homo sapiens
cagtgccacagcctgctggca

SEQ ID NO: 1258442 - DNA, 23 bp, Homo sapiens
cagtgccacagcctgctggcagg

SEQ ID NO: 1258443 - DNA, 24 bp, Homo sapiens
cagtgccacagcctgctggcaggg

SEQ ID NO: 1258444 - DNA, 14 bp, Homo sapiens
cagtgccacctatg

SEQ ID NO: 1258445 - DNA, 21 bp, Homo sapiens
cagtgccacctatgcctgtgg

SEQ ID NO: 1258446 - DNA, 24 bp, Homo sapiens
cagtgccacctatgcctgtggtga

SEQ ID NO: 1258447 - DNA, 15 bp, Homo sapiens
cagtggggcctgtgg

SEQ ID NO: 1258448 - DNA, 23 bp, Homo sapiens
cagtgggtgatgcttttgctgct

SEQ ID NO: 1258449 - DNA, 22 bp, Homo sapiens
cagtgggtggcacctcctgaga

SEQ ID NO: 1258450 - DNA, 17 bp, Homo sapiens
cagtggtaagaatagta

SEQ ID NO: 1258451 - DNA, 19 bp, Homo sapiens
cagtggtagctctggctta

SEQ ID NO: 1258452 - DNA, 13 bp, Homo sapiens
cagtggtgggcgg

SEQ ID NO: 1258453 - DNA, 19 bp, Homo sapiens
cagtggtggttttctgttc

SEQ ID NO: 1258454 - DNA, 14 bp, Homo sapiens
cagtggttatttag

SEQ ID NO: 1258455 - DNA, 13 bp, Homo sapiens
cagtggttgctgt

SEQ ID NO: 1258456 - DNA, 22 bp, Homo sapiens
cagtggtttgagacactggttt

SEQ ID NO: 1258457 - DNA, 19 bp, Homo sapiens
cagtgtaatccaggggtgt

SEQ ID NO: 1258458 - DNA, 21 bp, Homo sapiens
cagtgtacacgtctggacccc

SEQ ID NO: 1258459 - DNA, 15 bp, Homo sapiens
cagtgtacagtcttg

SEQ ID NO: 1258460 - DNA, 18 bp, Homo sapiens
cagtgtacagtcttgtat

SEQ ID NO: 1258461 - DNA, 20 bp, Homo sapiens
cagtgtacatggaataacat

SEQ ID NO: 1258462 - DNA, 23 bp, Homo sapiens
cagtgtacatggaataacatgta

SEQ ID NO: 1258463 - DNA, 13 bp, Homo sapiens
cagtgtagatttt

SEQ ID NO: 1258464 - DNA, 19 bp, Homo sapiens
cagtgtagcatcttcctct

SEQ ID NO: 1258465 - DNA, 22 bp, Homo sapiens
cagtgtataaatccaatatcat

SEQ ID NO: 1258466 - DNA, 19 bp, Homo sapiens
cagtgtatggggcagcttc

SEQ ID NO: 1258467 - DNA, 18 bp, Homo sapiens
cagtgtcaagttgtgctt

SEQ ID NO: 1258468 - DNA, 19 bp, Homo sapiens
cagtgtcaagttgtgcttg

SEQ ID NO: 1258469 - DNA, 14 bp, Homo sapiens
cagtgtcactggtc

SEQ ID NO: 1258470 - DNA, 23 bp, Homo sapiens
cagtgtcattttattttttccct

SEQ ID NO: 1258471 - DNA, 19 bp, Homo sapiens
cagtgtcctgtgctttctg

SEQ ID NO: 1258472 - DNA, 19 bp, Homo sapiens
cagtgtctataaaagaaac

SEQ ID NO: 1258473 - DNA, 15 bp, Homo sapiens
cagtgtctcacagcc

SEQ ID NO: 1258474 - DNA, 19 bp, Homo sapiens
cagtgtctgcctttaaata

SEQ ID NO: 1258475 - DNA, 23 bp, Homo sapiens
cagtgtctgtatcggagacagtg

SEQ ID NO: 1258476 - DNA, 14 bp, Homo sapiens
cagtgtctgtcagc

SEQ ID NO: 1258477 - DNA, 15 bp, Homo sapiens
cagtgtctgtgccat

SEQ ID NO: 1258478 - DNA, 16 bp, Homo sapiens
cagtgtctgtgccatg

SEQ ID NO: 1258479 - DNA, 14 bp, Homo sapiens
cagtgtcttccata

SEQ ID NO: 1258480 - DNA, 15 bp, Homo sapiens
cagtgtcttccataa

SEQ ID NO: 1258481 - DNA, 18 bp, Homo sapiens
cagtgtcttccataatgt

SEQ ID NO: 1258482 - DNA, 20 bp, Homo sapiens
cagtgtcttccataatgtat

SEQ ID NO: 1258483 - DNA, 23 bp, Homo sapiens
cagtgtcttccataatgtataaa

SEQ ID NO: 1258484 - DNA, 19 bp, Homo sapiens
cagtgtctttctagccata

SEQ ID NO: 1258485 - DNA, 19 bp, Homo sapiens
cagtgtgaatagcctggcc

SEQ ID NO: 1258486 - DNA, 20 bp, Homo sapiens
cagtgtgaggacctccctgt

SEQ ID NO: 1258487 - DNA, 22 bp, Homo sapiens
cagtgtgaggacctccctgtct

SEQ ID NO: 1258488 - DNA, 17 bp, Homo sapiens
cagtgtgaggccagggc

SEQ ID NO: 1258489 - DNA, 18 bp, Homo sapiens
cagtgtgaggccagggca

SEQ ID NO: 1258490 - DNA, 22 bp, Homo sapiens
cagtgtgatcccaagtgccagt

SEQ ID NO: 1258491 - DNA, 21 bp, Homo sapiens
cagtgtgcacgagtgggaagg

SEQ ID NO: 1258492 - DNA, 20 bp, Homo sapiens
cagtgtgcacgcctgcaggc

SEQ ID NO: 1258493 - DNA, 23 bp, Homo sapiens
cagtgtgcactaaggggcccggc

SEQ ID NO: 1258494 - DNA, 19 bp, Homo sapiens
cagtgtgcagggtggaagg

SEQ ID NO: 1258495 - DNA, 21 bp, Homo sapiens
cagtgtgctttgcattttctg

SEQ ID NO: 1258496 - DNA, 18 bp, Homo sapiens
cagtgtggagaccctgcc

SEQ ID NO: 1258497 - DNA, 13 bp, Homo sapiens
cagtgtggagagg

SEQ ID NO: 1258498 - DNA, 15 bp, Homo sapiens
cagtgtggagagggg

SEQ ID NO: 1258499 - DNA, 17 bp, Homo sapiens
cagtgtggagaggggtg

SEQ ID NO: 1258500 - DNA, 23 bp, Homo sapiens
cagtgtggagaggggtgcaccca

SEQ ID NO: 1258501 - DNA, 13 bp, Homo sapiens
cagtgtggagtgg

SEQ ID NO: 1258502 - DNA, 13 bp, Homo sapiens
cagtgtggagttc

SEQ ID NO: 1258503 - DNA, 16 bp, Homo sapiens
cagtgtggccaggctg

SEQ ID NO: 1258504 - DNA, 21 bp, Homo sapiens
cagtgtgggaatgcggcaaga

SEQ ID NO: 1258505 - DNA, 19 bp, Homo sapiens
cagtgtggggataaagaca

SEQ ID NO: 1258506 - DNA, 20 bp, Homo sapiens
cagtgtggggggacagacag

SEQ ID NO: 1258507 - DNA, 21 bp, Homo sapiens
cagtgtggggggacagacagg

SEQ ID NO: 1258508 - DNA, 18 bp, Homo sapiens
cagtgtggtttgggaaag

SEQ ID NO: 1258509 - DNA, 13 bp, Homo sapiens
cagtgtgtggggg

SEQ ID NO: 1258510 - DNA, 21 bp, Homo sapiens
cagtgtgtgggggagattctg

SEQ ID NO: 1258511 - DNA, 16 bp, Homo sapiens
cagtgttaaatgaaat

SEQ ID NO: 1258512 - DNA, 14 bp, Homo sapiens
cagtgttaaatgtg

SEQ ID NO: 1258513 - DNA, 19 bp, Homo sapiens
cagtgttaaatgtgatgaa

SEQ ID NO: 1258514 - DNA, 17 bp, Homo sapiens
cagtgttacctgtgtgc

SEQ ID NO: 1258515 - DNA, 16 bp, Homo sapiens
cagtgttacttgcagg

SEQ ID NO: 1258516 - DNA, 19 bp, Homo sapiens
cagtgttagtgctggtcag

SEQ ID NO: 1258517 - DNA, 14 bp, Homo sapiens
cagtgttattttct

SEQ ID NO: 1258518 - DNA, 23 bp, Homo sapiens
cagtgttcctgaagctgctgtgt

SEQ ID NO: 1258519 - DNA, 18 bp, Homo sapiens
cagtgttgagccttttcc

SEQ ID NO: 1258520 - DNA, 19 bp, Homo sapiens
cagtgttgcatatgagcct

SEQ ID NO: 1258521 - DNA, 16 bp, Homo sapiens
cagtgttgcctcctcc

SEQ ID NO: 1258522 - DNA, 18 bp, Homo sapiens
cagtgttgcctcctccca

SEQ ID NO: 1258523 - DNA, 19 bp, Homo sapiens
cagtgttgcctcctcccat

SEQ ID NO: 1258524 - DNA, 23 bp, Homo sapiens
cagtgttggctgtgtgacagaat

SEQ ID NO: 1258525 - DNA, 14 bp, Homo sapiens
cagtgttgtgcccc

SEQ ID NO: 1258526 - DNA, 19 bp, Homo sapiens
cagtgttgtggatttaaca

SEQ ID NO: 1258527 - DNA, 23 bp, Homo sapiens
cagtgttgtgggcttcctgctgg

SEQ ID NO: 1258528 - DNA, 15 bp, Homo sapiens
cagtgttgtttgtaa

SEQ ID NO: 1258529 - DNA, 18 bp, Homo sapiens
cagtgttgtttgtaaata

SEQ ID NO: 1258530 - DNA, 20 bp, Homo sapiens
cagtgttgtttgtaaataag

SEQ ID NO: 1258531 - DNA, 23 bp, Homo sapiens
cagtgttgtttgtaaataagaga

SEQ ID NO: 1258532 - DNA, 15 bp, Homo sapiens
cagtgtttatattgg

SEQ ID NO: 1258533 - DNA, 18 bp, Homo sapiens
cagtgtttatcctttcat

SEQ ID NO: 1258534 - DNA, 15 bp, Homo sapiens
cagtgtttcccataa

SEQ ID NO: 1258535 - DNA, 14 bp, Homo sapiens
cagtgtttcctttt

SEQ ID NO: 1258536 - DNA, 19 bp, Homo sapiens
cagtgttttataggagaga

SEQ ID NO: 1258537 - DNA, 19 bp, Homo sapiens
cagtgttttcagaagaaat

SEQ ID NO: 1258538 - DNA, 18 bp, Homo sapiens
cagtgttttctttgagga

SEQ ID NO: 1258539 - DNA, 22 bp, Homo sapiens
cagtgttttggactccatctct

SEQ ID NO: 1258540 - DNA, 15 bp, Homo sapiens
cagttaaaaaaaatt

SEQ ID NO: 1258541 - DNA, 18 bp, Homo sapiens
cagttaaaatcacatttt

SEQ ID NO: 1258542 - DNA, 20 bp, Homo sapiens
cagttaaataaatagaaaga

SEQ ID NO: 1258543 - DNA, 16 bp, Homo sapiens
cagttaactttcagaa

SEQ ID NO: 1258544 - DNA, 22 bp, Homo sapiens
cagttaactttcagaagagatg

SEQ ID NO: 1258545 - DNA, 18 bp, Homo sapiens
cagttaatactccagaga

SEQ ID NO: 1258546 - DNA, 21 bp, Homo sapiens
cagttaatactccagagacag

SEQ ID NO: 1258547 - DNA, 14 bp, Homo sapiens
cagttaatttatat

SEQ ID NO: 1258548 - DNA, 12 bp, Homo sapiens
cagttaattttt

SEQ ID NO: 1258549 - DNA, 13 bp, Homo sapiens
cagttaatttttc

SEQ ID NO: 1258550 - DNA, 19 bp, Homo sapiens
cagttaatttttccaacta

SEQ ID NO: 1258551 - DNA, 11 bp, Homo sapiens
cagttacaaag

SEQ ID NO: 1258552 - DNA, 15 bp, Homo sapiens
cagttacacaggaac

SEQ ID NO: 1258553 - DNA, 21 bp, Homo sapiens
cagttacacaggaaccctaaa

SEQ ID NO: 1258554 - DNA, 22 bp, Homo sapiens
cagttaccaaacattacaaaaa

SEQ ID NO: 1258555 - DNA, 21 bp, Homo sapiens
cagttacccactcggtcccag

SEQ ID NO: 1258556 - DNA, 22 bp, Homo sapiens
cagttactatagtggtgagatg

SEQ ID NO: 1258557 - DNA, 14 bp, Homo sapiens
cagttactcagaat

SEQ ID NO: 1258558 - DNA, 17 bp, Homo sapiens
cagttactcagccctgg

SEQ ID NO: 1258559 - DNA, 18 bp, Homo sapiens
cagttactcagccctggg

SEQ ID NO: 1258560 - DNA, 13 bp, Homo sapiens
cagttactctgaa

SEQ ID NO: 1258561 - DNA, 15 bp, Homo sapiens
cagttagagcagcct

SEQ ID NO: 1258562 - DNA, 17 bp, Homo sapiens
cagttagagcagcctcg

SEQ ID NO: 1258563 - DNA, 16 bp, Homo sapiens
cagttagttgtgaaag

SEQ ID NO: 1258564 - DNA, 13 bp, Homo sapiens
cagttatatgata

SEQ ID NO: 1258565 - DNA, 17 bp, Homo sapiens
cagttatatgatattct

SEQ ID NO: 1258566 - DNA, 13 bp, Homo sapiens
cagttatcctttg

SEQ ID NO: 1258567 - DNA, 15 bp, Homo sapiens
cagttatcctttgtg

SEQ ID NO: 1258568 - DNA, 14 bp, Homo sapiens
catactgtattttt

SEQ ID NO: 1258569 - DNA, 18 bp, Homo sapiens
catactgtctctggagtg

SEQ ID NO: 1258570 - DNA, 12 bp, Homo sapiens
catactgtgtat

SEQ ID NO: 1258571 - DNA, 18 bp, Homo sapiens
catactgtgtatgtttta

SEQ ID NO: 1258572 - DNA, 18 bp, Homo sapiens
catactgttgatacaaac

SEQ ID NO: 1258573 - DNA, 22 bp, Homo sapiens
catacttaaaatatctctaaaa

SEQ ID NO: 1258574 - DNA, 19 bp, Homo sapiens
catacttaacatttcattg

SEQ ID NO: 1258575 - DNA, 17 bp, Homo sapiens
catactttatcaatgtg

SEQ ID NO: 1258576 - DNA, 15 bp, Homo sapiens
catactttctctcta

SEQ ID NO: 1258577 - DNA, 14 bp, Homo sapiens
catactttgacaag

SEQ ID NO: 1258578 - DNA, 17 bp, Homo sapiens
catactttgacaaggaa

SEQ ID NO: 1258579 - DNA, 19 bp, Homo sapiens
catactttgacaaggaaaa

SEQ ID NO: 1258580 - DNA, 13 bp, Homo sapiens
catactttgtctg

SEQ ID NO: 1258581 - DNA, 14 bp, Homo sapiens
catactttgtctga

SEQ ID NO: 1258582 - DNA, 18 bp, Homo sapiens
catactttgtctgaaaaa

SEQ ID NO: 1258583 - DNA, 13 bp, Homo sapiens
catagaaaaatgt

SEQ ID NO: 1258584 - DNA, 13 bp, Homo sapiens
catagaaaaggcg

SEQ ID NO: 1258585 - DNA, 22 bp, Homo sapiens
catagaaaattgaaacacagag

SEQ ID NO: 1258586 - DNA, 23 bp, Homo sapiens
catagaaatgtaacttttgtaag

SEQ ID NO: 1258587 - DNA, 12 bp, Homo sapiens
catagaacactt

SEQ ID NO: 1258588 - DNA, 17 bp, Homo sapiens
catagaaggaagtgtgt

SEQ ID NO: 1258589 - DNA, 18 bp, Homo sapiens
catagaaggaagtgtgtt

SEQ ID NO: 1258590 - DNA, 15 bp, Homo sapiens
catagacagaagaaa

SEQ ID NO: 1258591 - DNA, 17 bp, Homo sapiens
catagacatttcaaaat

SEQ ID NO: 1258592 - DNA, 14 bp, Homo sapiens
catagaccctgagg

SEQ ID NO: 1258593 - DNA, 13 bp, Homo sapiens
catagagaggcct

SEQ ID NO: 1258594 - DNA, 14 bp, Homo sapiens
catagagaggcctg

SEQ ID NO: 1258595 - DNA, 18 bp, Homo sapiens
catagagagggagaagaa

SEQ ID NO: 1258596 - DNA, 17 bp, Homo sapiens
catagagatctattttt

SEQ ID NO: 1258597 - DNA, 15 bp, Homo sapiens
catagagctttttaa

SEQ ID NO: 1258598 - DNA, 23 bp, Homo sapiens
catagagctttttaatagcacta

SEQ ID NO: 1258599 - DNA, 16 bp, Homo sapiens
catagaggcccaggca

SEQ ID NO: 1258600 - DNA, 22 bp, Homo sapiens
catagaggcttctccgccagcc

SEQ ID NO: 1258601 - DNA, 23 bp, Homo sapiens
catagaggcttctccgccagcct

SEQ ID NO: 1258602 - DNA, 16 bp, Homo sapiens
catagaggttttgtat

SEQ ID NO: 1258603 - DNA, 19 bp, Homo sapiens
catagatcagccattaaaa

SEQ ID NO: 1258604 - DNA, 20 bp, Homo sapiens
catagatcagccattaaaat

SEQ ID NO: 1258605 - DNA, 21 bp, Homo sapiens
catagatcagccattaaaata

SEQ ID NO: 1258606 - DNA, 15 bp, Homo sapiens
catagatcttctgaa

SEQ ID NO: 1258607 - DNA, 23 bp, Homo sapiens
catagattattataaactataaa

SEQ ID NO: 1258608 - DNA, 14 bp, Homo sapiens
catagattcacctg

SEQ ID NO: 1258609 - DNA, 23 bp, Homo sapiens
catagattcacctgtaaaacttt

SEQ ID NO: 1258610 - DNA, 17 bp, Homo sapiens
catagatttattttaca

SEQ ID NO: 1258611 - DNA, 17 bp, Homo sapiens
catagcagatctgtttt

SEQ ID NO: 1258612 - DNA, 19 bp, Homo sapiens
catagcaggggcaccttcc

SEQ ID NO: 1258613 - DNA, 16 bp, Homo sapiens
catagcataatatgaa

SEQ ID NO: 1258614 - DNA, 19 bp, Homo sapiens
catagcatagccagcattc

SEQ ID NO: 1258615 - DNA, 19 bp, Homo sapiens
catagcatgcttcctttct

SEQ ID NO: 1258616 - DNA, 20 bp, Homo sapiens
catagcatgcttcctttctc

SEQ ID NO: 1258617 - DNA, 15 bp, Homo sapiens
catagcatgtcaact

SEQ ID NO: 1258618 - DNA, 15 bp, Homo sapiens
catagcattaactaa

SEQ ID NO: 1258619 - DNA, 23 bp, Homo sapiens
catagcattaactaatctattgg

SEQ ID NO: 1258620 - DNA, 21 bp, Homo sapiens
catagccaaagccaggcctga

SEQ ID NO: 1258621 - DNA, 22 bp, Homo sapiens
catagccaatggacaagcagtg

SEQ ID NO: 1258622 - DNA, 19 bp, Homo sapiens
catagcccatgttaagtcc

SEQ ID NO: 1258623 - DNA, 13 bp, Homo sapiens
catagccccagta

SEQ ID NO: 1258624 - DNA, 16 bp, Homo sapiens
catagcccctgccccg

SEQ ID NO: 1258625 - DNA, 19 bp, Homo sapiens
catagccctggtgctcctg

SEQ ID NO: 1258626 - DNA, 22 bp, Homo sapiens
catagccttggggttggacatc

SEQ ID NO: 1258627 - DNA, 18 bp, Homo sapiens
catagcgccgtgctgtaa

SEQ ID NO: 1258628 - DNA, 20 bp, Homo sapiens
catagcgccgtgctgtaaat

SEQ ID NO: 1258629 - DNA, 18 bp, Homo sapiens
catagcgtcctgccctgc

SEQ ID NO: 1258630 - DNA, 22 bp, Homo sapiens
catagctattttccttgctttt

SEQ ID NO: 1258631 - DNA, 17 bp, Homo sapiens
catagctcactgcagcc

SEQ ID NO: 1258632 - DNA, 18 bp, Homo sapiens
catagctcactgcagcct

SEQ ID NO: 1258633 - DNA, 20 bp, Homo sapiens
catagctccttggagcaggc

SEQ ID NO: 1258634 - DNA, 14 bp, Homo sapiens
catagctctccttc

SEQ ID NO: 1258635 - DNA, 21 bp, Homo sapiens
catagctgttttagctgaggg

SEQ ID NO: 1258636 - DNA, 22 bp, Homo sapiens
catagcttgcctaatggctttc

SEQ ID NO: 1258637 - DNA, 24 bp, Homo sapiens
cataggaagggaccaaggcaaggc

SEQ ID NO: 1258638 - DNA, 17 bp, Homo sapiens
cataggaagtggctggt

SEQ ID NO: 1258639 - DNA, 20 bp, Homo sapiens
cataggaagtggctggtctg

SEQ ID NO: 1258640 - DNA, 16 bp, Homo sapiens
cataggacctttccac

SEQ ID NO: 1258641 - DNA, 18 bp, Homo sapiens
cataggacctttccacca

SEQ ID NO: 1258642 - DNA, 20 bp, Homo sapiens
cataggactaccgcaggccc

SEQ ID NO: 1258643 - DNA, 20 bp, Homo sapiens
cataggcccagccagggtgt

SEQ ID NO: 1258644 - DNA, 14 bp, Homo sapiens
cataggcctgggtg

SEQ ID NO: 1258645 - DNA, 18 bp, Homo sapiens
cataggcggtcatgtgtg

SEQ ID NO: 1258646 - DNA, 17 bp, Homo sapiens
cataggctggtggcctt

SEQ ID NO: 1258647 - DNA, 18 bp, Homo sapiens
cataggctggtggccttg

SEQ ID NO: 1258648 - DNA, 20 bp, Homo sapiens
cataggctggtggccttggg

SEQ ID NO: 1258649 - DNA, 17 bp, Homo sapiens
catagggattgtccctg

SEQ ID NO: 1258650 - DNA, 20 bp, Homo sapiens
catagggtctgcagcctgct

SEQ ID NO: 1258651 - DNA, 22 bp, Homo sapiens
catagggtctgcagcctgctgg

SEQ ID NO: 1258652 - DNA, 22 bp, Homo sapiens
catagggtgctctgaggtcaat

SEQ ID NO: 1258653 - DNA, 23 bp, Homo sapiens
cataggtagaatgtaaagcttgt

SEQ ID NO: 1258654 - DNA, 17 bp, Homo sapiens
cataggtcactggctct

SEQ ID NO: 1258655 - DNA, 21 bp, Homo sapiens
cataggtcactggctctccaa

SEQ ID NO: 1258656 - DNA, 16 bp, Homo sapiens
cataggtccctgacat

SEQ ID NO: 1258657 - DNA, 21 bp, Homo sapiens
cataggtctctttgctttctg

SEQ ID NO: 1258658 - DNA, 23 bp, Homo sapiens
cataggttaaaaaaaaaagtcac

SEQ ID NO: 1258659 - DNA, 18 bp, Homo sapiens
cataggtttctctccctc

SEQ ID NO: 1258660 - DNA, 16 bp, Homo sapiens
catagtaccaatcatt

SEQ ID NO: 1258661 - DNA, 16 bp, Homo sapiens
catagtagaacgctat

SEQ ID NO: 1258662 - DNA, 17 bp, Homo sapiens
catagtaggcactaaat

SEQ ID NO: 1258663 - DNA, 20 bp, Homo sapiens
catagtaggcactaaataca

SEQ ID NO: 1258664 - DNA, 13 bp, Homo sapiens
catagtagttttt

SEQ ID NO: 1258665 - DNA, 20 bp, Homo sapiens
catagtagtttttacagctg

SEQ ID NO: 1258666 - DNA, 20 bp, Homo sapiens
catagtatccatattttatt

SEQ ID NO: 1258667 - DNA, 13 bp, Homo sapiens
catagtcctcagg

SEQ ID NO: 1258668 - DNA, 20 bp, Homo sapiens
catagtctgaagtgaagtac

SEQ ID NO: 1258669 - DNA, 15 bp, Homo sapiens
catagtgagatccca

SEQ ID NO: 1258670 - DNA, 22 bp, Homo sapiens
catagtgatggttcccctgttc

SEQ ID NO: 1258671 - DNA, 19 bp, Homo sapiens
catagtgcaaaactgtgtc

SEQ ID NO: 1258672 - DNA, 15 bp, Homo sapiens
catagtggtgcagag

SEQ ID NO: 1258673 - DNA, 18 bp, Homo sapiens
catagttatttttctctt

SEQ ID NO: 1258674 - DNA, 20 bp, Homo sapiens
catagttgtagacaaagtac

SEQ ID NO: 1258675 - DNA, 20 bp, Homo sapiens
catataaacatcacacacac

SEQ ID NO: 1258676 - DNA, 21 bp, Homo sapiens
catataaaggttatgaaacat

SEQ ID NO: 1258677 - DNA, 12 bp, Homo sapiens
catataaagtat

SEQ ID NO: 1258678 - DNA, 11 bp, Homo sapiens
catataagaca

SEQ ID NO: 1258679 - DNA, 18 bp, Homo sapiens
catataagacaaatattc

SEQ ID NO: 1258680 - DNA, 23 bp, Homo sapiens
catataagtttgaaggaaacagt

SEQ ID NO: 1258681 - DNA, 24 bp, Homo sapiens
catataagtttgaaggaaacagtt

SEQ ID NO: 1258682 - DNA, 13 bp, Homo sapiens
catataattttca

SEQ ID NO: 1258683 - DNA, 23 bp, Homo sapiens
catatacacgaatagacatcaaa

SEQ ID NO: 1258684 - DNA, 19 bp, Homo sapiens
catatagaaaacaaaggag

SEQ ID NO: 1258685 - DNA, 16 bp, Homo sapiens
catatagacacataca

SEQ ID NO: 1258686 - DNA, 20 bp, Homo sapiens
catatagatttagttttgta

SEQ ID NO: 1258687 - DNA, 22 bp, Homo sapiens
catatagcattgataatcttca

SEQ ID NO: 1258688 - DNA, 20 bp, Homo sapiens
catcattactgttccagatt

SEQ ID NO: 1258689 - DNA, 21 bp, Homo sapiens
catcattacttgggaaatttt

SEQ ID NO: 1258690 - DNA, 10 bp, Homo sapiens
catcattaga

SEQ ID NO: 1258691 - DNA, 21 bp, Homo sapiens
catcattatttgcagagacag

SEQ ID NO: 1258692 - DNA, 14 bp, Homo sapiens
catcattccctctc

SEQ ID NO: 1258693 - DNA, 16 bp, Homo sapiens
catcattccctctcat

SEQ ID NO: 1258694 - DNA, 17 bp, Homo sapiens
catcattccttgagaaa

SEQ ID NO: 1258695 - DNA, 14 bp, Homo sapiens
catcattctgtgtc

SEQ ID NO: 1258696 - DNA, 15 bp, Homo sapiens
catcattcttgtggg

SEQ ID NO: 1258697 - DNA, 23 bp, Homo sapiens
catcattcttgtgggagacagca

SEQ ID NO: 1258698 - DNA, 13 bp, Homo sapiens
catcattgtatat

SEQ ID NO: 1258699 - DNA, 14 bp, Homo sapiens
catcattgtatata

SEQ ID NO: 1258700 - DNA, 20 bp, Homo sapiens
catcattttccatatcctgg

SEQ ID NO: 1258701 - DNA, 13 bp, Homo sapiens
catccaaagttcc

SEQ ID NO: 1258702 - DNA, 12 bp, Homo sapiens
catccaaatcta

SEQ ID NO: 1258703 - DNA, 16 bp, Homo sapiens
catccaaattaagttt

SEQ ID NO: 1258704 - DNA, 13 bp, Homo sapiens
catccaacaagaa

SEQ ID NO: 1258705 - DNA, 23 bp, Homo sapiens
catccaacaagaagaaatatgaa

SEQ ID NO: 1258706 - DNA, 14 bp, Homo sapiens
catccaactccagc

SEQ ID NO: 1258707 - DNA, 22 bp, Homo sapiens
catccaaggaagggatgtattt

SEQ ID NO: 1258708 - DNA, 21 bp, Homo sapiens
catccaaggagaaacagagac

SEQ ID NO: 1258709 - DNA, 16 bp, Homo sapiens
catccaaggcaaacaa

SEQ ID NO: 1258710 - DNA, 21 bp, Homo sapiens
catccaaggccaggttctccg

SEQ ID NO: 1258711 - DNA, 16 bp, Homo sapiens
catccaagtctttctt

SEQ ID NO: 1258712 - DNA, 14 bp, Homo sapiens
catccaatcctcac

SEQ ID NO: 1258713 - DNA, 15 bp, Homo sapiens
catccaatcctcact

SEQ ID NO: 1258714 - DNA, 18 bp, Homo sapiens
catccaatcctcactggg

SEQ ID NO: 1258715 - DNA, 21 bp, Homo sapiens
catccaatcctcactgggtgg

SEQ ID NO: 1258716 - DNA, 17 bp, Homo sapiens
catccacatgggagccg

SEQ ID NO: 1258717 - DNA, 15 bp, Homo sapiens
catccacccagtgct

SEQ ID NO: 1258718 - DNA, 18 bp, Homo sapiens
catccacccagtgctgcc

SEQ ID NO: 1258719 - DNA, 20 bp, Homo sapiens
catccacccagtgctgccat

SEQ ID NO: 1258720 - DNA, 14 bp, Homo sapiens
catccaccccatcc

SEQ ID NO: 1258721 - DNA, 17 bp, Homo sapiens
catccacccgctgcccc

SEQ ID NO: 1258722 - DNA, 19 bp, Homo sapiens
catccacccgctgcccctc

SEQ ID NO: 1258723 - DNA, 17 bp, Homo sapiens
catccacctcatcactg

SEQ ID NO: 1258724 - DNA, 21 bp, Homo sapiens
catccacctcatcactggact

SEQ ID NO: 1258725 - DNA, 15 bp, Homo sapiens
catccaccttccctt

SEQ ID NO: 1258726 - DNA, 18 bp, Homo sapiens
catccacgtggcctctct

SEQ ID NO: 1258727 - DNA, 20 bp, Homo sapiens
catccactagtgcaaatcat

SEQ ID NO: 1258728 - DNA, 17 bp, Homo sapiens
catccactctaccctcc

SEQ ID NO: 1258729 - DNA, 22 bp, Homo sapiens
catccactctaccctcccaccc

SEQ ID NO: 1258730 - DNA, 12 bp, Homo sapiens
catccagacagt

SEQ ID NO: 1258731 - DNA, 17 bp, Homo sapiens
catccagaggaataaaa

SEQ ID NO: 1258732 - DNA, 13 bp, Homo sapiens
catccagatgtgg

SEQ ID NO: 1258733 - DNA, 14 bp, Homo sapiens
catccagatgtggc

SEQ ID NO: 1258734 - DNA, 16 bp, Homo sapiens
catccagatgtggcta

SEQ ID NO: 1258735 - DNA, 13 bp, Homo sapiens
catccagccacgg

SEQ ID NO: 1258736 - DNA, 14 bp, Homo sapiens
catccagccacgga

SEQ ID NO: 1258737 - DNA, 17 bp, Homo sapiens
catccagccacggaggg

SEQ ID NO: 1258738 - DNA, 23 bp, Homo sapiens
catccagccacggagggaggcac

SEQ ID NO: 1258739 - DNA, 16 bp, Homo sapiens
catccagccagacccc

SEQ ID NO: 1258740 - DNA, 22 bp, Homo sapiens
catccagccagaccccacgctg

SEQ ID NO: 1258741 - DNA, 18 bp, Homo sapiens
catccagcgagagagttt

SEQ ID NO: 1258742 - DNA, 20 bp, Homo sapiens
catccagcgagagagtttca

SEQ ID NO: 1258743 - DNA, 15 bp, Homo sapiens
catccagctcactca

SEQ ID NO: 1258744 - DNA, 16 bp, Homo sapiens
catccagctgcccctc

SEQ ID NO: 1258745 - DNA, 17 bp, Homo sapiens
catccagctgcccctcc

SEQ ID NO: 1258746 - DNA, 13 bp, Homo sapiens
catccagggggca

SEQ ID NO: 1258747 - DNA, 15 bp, Homo sapiens
catccagggtctggc

SEQ ID NO: 1258748 - DNA, 16 bp, Homo sapiens
catccagggtctggca

SEQ ID NO: 1258749 - DNA, 23 bp, Homo sapiens
catccagtctcccaacttgtatt

SEQ ID NO: 1258750 - DNA, 19 bp, Homo sapiens
catccagtgacaaaccatc

SEQ ID NO: 1258751 - DNA, 22 bp, Homo sapiens
catccagtgtctcacagccctg

SEQ ID NO: 1258752 - DNA, 21 bp, Homo sapiens
catccagtttgttctccgggt

SEQ ID NO: 1258753 - DNA, 17 bp, Homo sapiens
catccataaagaagcaa

SEQ ID NO: 1258754 - DNA, 18 bp, Homo sapiens
catccatagtagtatgat

SEQ ID NO: 1258755 - DNA, 15 bp, Homo sapiens
catccatagtgcact

SEQ ID NO: 1258756 - DNA, 16 bp, Homo sapiens
catccatctccaggga

SEQ ID NO: 1258757 - DNA, 16 bp, Homo sapiens
catccatctgtccgtc

SEQ ID NO: 1258758 - DNA, 23 bp, Homo sapiens
catccatctgtccgtccagagcc

SEQ ID NO: 1258759 - DNA, 20 bp, Homo sapiens
catccatgccctcccaggac

SEQ ID NO: 1258760 - DNA, 21 bp, Homo sapiens
catccatgccctcccaggacc

SEQ ID NO: 1258761 - DNA, 22 bp, Homo sapiens
catccatggccgggcttggtgg

SEQ ID NO: 1258762 - DNA, 15 bp, Homo sapiens
catccatgtttgtaa

SEQ ID NO: 1258763 - DNA, 18 bp, Homo sapiens
catccatgtttgtaaaac

SEQ ID NO: 1258764 - DNA, 19 bp, Homo sapiens
catccattcctcagggaca

SEQ ID NO: 1258765 - DNA, 23 bp, Homo sapiens
catccatttcatctatttctgag

SEQ ID NO: 1258766 - DNA, 12 bp, Homo sapiens
catccatttctt

SEQ ID NO: 1258767 - DNA, 15 bp, Homo sapiens
catccatttctttta

SEQ ID NO: 1258768 - DNA, 14 bp, Homo sapiens
catcccaaacttta

SEQ ID NO: 1258769 - DNA, 22 bp, Homo sapiens
catcccaaactttaaaatgcga

SEQ ID NO: 1258770 - DNA, 17 bp, Homo sapiens
catcccaacagccaaga

SEQ ID NO: 1258771 - DNA, 13 bp, Homo sapiens
catcccacagtgg

SEQ ID NO: 1258772 - DNA, 11 bp, Homo sapiens
catcccactta

SEQ ID NO: 1258773 - DNA, 17 bp, Homo sapiens
catcccacttcctttcc

SEQ ID NO: 1258774 - DNA, 18 bp, Homo sapiens
catcccacttcctttcct

SEQ ID NO: 1258775 - DNA, 19 bp, Homo sapiens
catcccacttcctttccta

SEQ ID NO: 1258776 - DNA, 22 bp, Homo sapiens
catcccacttcctttcctactg

SEQ ID NO: 1258777 - DNA, 15 bp, Homo sapiens
catcccagcacctgc

SEQ ID NO: 1258778 - DNA, 20 bp, Homo sapiens
catcccagcacctgcctcct

SEQ ID NO: 1258779 - DNA, 14 bp, Homo sapiens
catcccagcagccc

SEQ ID NO: 1258780 - DNA, 18 bp, Homo sapiens
catcccagcagcccaagc

SEQ ID NO: 1258781 - DNA, 11 bp, Homo sapiens
catcccagcct

SEQ ID NO: 1258782 - DNA, 12 bp, Homo sapiens
catcccagcctg

SEQ ID NO: 1258783 - DNA, 18 bp, Homo sapiens
catcccagcctgtggtta

SEQ ID NO: 1258784 - DNA, 12 bp, Homo sapiens
catcccagcctt

SEQ ID NO: 1258785 - DNA, 17 bp, Homo sapiens
catcccagcttgccccc

SEQ ID NO: 1258786 - DNA, 14 bp, Homo sapiens
catcccaggggacc

SEQ ID NO: 1258787 - DNA, 18 bp, Homo sapiens
catcccagggtcccaccc

SEQ ID NO: 1258788 - DNA, 21 bp, Homo sapiens
catcccagggtcccaccccca

SEQ ID NO: 1258789 - DNA, 20 bp, Homo sapiens
catcccagtggcctcaaccc

SEQ ID NO: 1258790 - DNA, 17 bp, Homo sapiens
catcccatgaacacact

SEQ ID NO: 1258791 - DNA, 15 bp, Homo sapiens
catcccatgtattta

SEQ ID NO: 1258792 - DNA, 12 bp, Homo sapiens
catcccattgcc

SEQ ID NO: 1258793 - DNA, 22 bp, Homo sapiens
catcccattgctagcaggattg

SEQ ID NO: 1258794 - DNA, 19 bp, Homo sapiens
catcccattttcatcctga

SEQ ID NO: 1258795 - DNA, 20 bp, Homo sapiens
catccccaactccatggggt

SEQ ID NO: 1258796 - DNA, 20 bp, Homo sapiens
catccccaccactgatatca

SEQ ID NO: 1258797 - DNA, 12 bp, Homo sapiens
catccccaccag

SEQ ID NO: 1258798 - DNA, 15 bp, Homo sapiens
catccccaccagctc

SEQ ID NO: 1258799 - DNA, 15 bp, Homo sapiens
catccccagagccca

SEQ ID NO: 1258800 - DNA, 14 bp, Homo sapiens
catccccagccagg

SEQ ID NO: 1258801 - DNA, 20 bp, Homo sapiens
catccccaggtccccaaact

SEQ ID NO: 1258802 - DNA, 16 bp, Homo sapiens
catccccatcctccag

SEQ ID NO: 1258803 - DNA, 21 bp, Homo sapiens
catccccatcctccagcttct

SEQ ID NO: 1258804 - DNA, 17 bp, Homo sapiens
catccccatcggccctg

SEQ ID NO: 1258805 - DNA, 21 bp, Homo sapiens
catccccatcggccctgtccc

SEQ ID NO: 1258806 - DNA, 22 bp, Homo sapiens
catccccatcggccctgtcccc

SEQ ID NO: 1258807 - DNA, 13 bp, Homo sapiens
catccccccaccc

SEQ ID NO: 1258808 - DNA, 17 bp, Homo sapiens
catcccccctgctgccc

SEQ ID NO: 1258809 - DNA, 18 bp, Homo sapiens
catccccctcctctccct

SEQ ID NO: 1258810 - DNA, 22 bp, Homo sapiens
catctctctacctccaccctgc

SEQ ID NO: 1258811 - DNA, 15 bp, Homo sapiens
catctctctgccctc

SEQ ID NO: 1258812 - DNA, 16 bp, Homo sapiens
catctctctgccctct

SEQ ID NO: 1258813 - DNA, 23 bp, Homo sapiens
catctctctgccctctccctgtg

SEQ ID NO: 1258814 - DNA, 11 bp, Homo sapiens
catctctctgg

SEQ ID NO: 1258815 - DNA, 15 bp, Homo sapiens
catctctctggcttc

SEQ ID NO: 1258816 - DNA, 13 bp, Homo sapiens
catctctgacttt

SEQ ID NO: 1258817 - DNA, 12 bp, Homo sapiens
catctctgcagt

SEQ ID NO: 1258818 - DNA, 22 bp, Homo sapiens
catctctgcagtttttcccaag

SEQ ID NO: 1258819 - DNA, 11 bp, Homo sapiens
catctctggaa

SEQ ID NO: 1258820 - DNA, 19 bp, Homo sapiens
catctctggaaggggcagc

SEQ ID NO: 1258821 - DNA, 23 bp, Homo sapiens
catctctggaaggggcagccctg

SEQ ID NO: 1258822 - DNA, 17 bp, Homo sapiens
catctctggagccagag

SEQ ID NO: 1258823 - DNA, 18 bp, Homo sapiens
catctctggagccagaga

SEQ ID NO: 1258824 - DNA, 15 bp, Homo sapiens
catctctggcccaga

SEQ ID NO: 1258825 - DNA, 23 bp, Homo sapiens
catctctggttttcttgccaccc

SEQ ID NO: 1258826 - DNA, 19 bp, Homo sapiens
catctctgtgaagcctctc

SEQ ID NO: 1258827 - DNA, 20 bp, Homo sapiens
catctcttaggtgagacagt

SEQ ID NO: 1258828 - DNA, 10 bp, Homo sapiens
catctcttca

SEQ ID NO: 1258829 - DNA, 11 bp, Homo sapiens
catctcttcag

SEQ ID NO: 1258830 - DNA, 15 bp, Homo sapiens
catctcttcaggttc

SEQ ID NO: 1258831 - DNA, 16 bp, Homo sapiens
catctcttccccagag

SEQ ID NO: 1258832 - DNA, 17 bp, Homo sapiens
catctcttccccagaga

SEQ ID NO: 1258833 - DNA, 23 bp, Homo sapiens
catctcttcctacccaaccactc

SEQ ID NO: 1258834 - DNA, 14 bp, Homo sapiens
catctcttgaaacc

SEQ ID NO: 1258835 - DNA, 19 bp, Homo sapiens
catctctttgaattttctg

SEQ ID NO: 1258836 - DNA, 16 bp, Homo sapiens
catctgaaagccacgt

SEQ ID NO: 1258837 - DNA, 22 bp, Homo sapiens
catctgaaggggcaaattcttt

SEQ ID NO: 1258838 - DNA, 13 bp, Homo sapiens
catctgacagcag

SEQ ID NO: 1258839 - DNA, 17 bp, Homo sapiens
catctgacagcaggcca

SEQ ID NO: 1258840 - DNA, 17 bp, Homo sapiens
catctgaccagcagcgc

SEQ ID NO: 1258841 - DNA, 12 bp, Homo sapiens
catctgactcac

SEQ ID NO: 1258842 - DNA, 21 bp, Homo sapiens
catctgagaggctctccgtgc

SEQ ID NO: 1258843 - DNA, 15 bp, Homo sapiens
catctgattaaaaca

SEQ ID NO: 1258844 - DNA, 17 bp, Homo sapiens
catctgcaccccttctc

SEQ ID NO: 1258845 - DNA, 13 bp, Homo sapiens
catctgcaccctt

SEQ ID NO: 1258846 - DNA, 15 bp, Homo sapiens
catctgcacccttct

SEQ ID NO: 1258847 - DNA, 17 bp, Homo sapiens
catctgcacccttcttt

SEQ ID NO: 1258848 - DNA, 19 bp, Homo sapiens
catctgcacccttcttttc

SEQ ID NO: 1258849 - DNA, 12 bp, Homo sapiens
catctgcccagg

SEQ ID NO: 1258850 - DNA, 13 bp, Homo sapiens
catctgcccctcc

SEQ ID NO: 1258851 - DNA, 15 bp, Homo sapiens
catctgcccctcccc

SEQ ID NO: 1258852 - DNA, 17 bp, Homo sapiens
catctgcccctccccca

SEQ ID NO: 1258853 - DNA, 16 bp, Homo sapiens
catctgccctccctgt

SEQ ID NO: 1258854 - DNA, 18 bp, Homo sapiens
catctgcctctggaaaac

SEQ ID NO: 1258855 - DNA, 16 bp, Homo sapiens
catctgcctgtaatta

SEQ ID NO: 1258856 - DNA, 16 bp, Homo sapiens
catctgctaagtaatt

SEQ ID NO: 1258857 - DNA, 12 bp, Homo sapiens
catctgctaata

SEQ ID NO: 1258858 - DNA, 16 bp, Homo sapiens
catctgctctagggaa

SEQ ID NO: 1258859 - DNA, 21 bp, Homo sapiens
catctgctgcagttaccacag

SEQ ID NO: 1258860 - DNA, 13 bp, Homo sapiens
catctgctgtgtg

SEQ ID NO: 1258861 - DNA, 16 bp, Homo sapiens
catctgctgtgtggaa

SEQ ID NO: 1258862 - DNA, 18 bp, Homo sapiens
catctgcttggttggctg

SEQ ID NO: 1258863 - DNA, 21 bp, Homo sapiens
catctggaaggggatcccacc

SEQ ID NO: 1258864 - DNA, 15 bp, Homo sapiens
catctggctgcacag

SEQ ID NO: 1258865 - DNA, 20 bp, Homo sapiens
catctggctgtctagaatgt

SEQ ID NO: 1258866 - DNA, 21 bp, Homo sapiens
catctggctgtctagaatgtg

SEQ ID NO: 1258867 - DNA, 12 bp, Homo sapiens
catctgggaaag

SEQ ID NO: 1258868 - DNA, 16 bp, Homo sapiens
catctgggattcccac

SEQ ID NO: 1258869 - DNA, 20 bp, Homo sapiens
catctgggctcctccagggt

SEQ ID NO: 1258870 - DNA, 18 bp, Homo sapiens
catctgggtagctgtaag

SEQ ID NO: 1258871 - DNA, 15 bp, Homo sapiens
catctggtcttgttt

SEQ ID NO: 1258872 - DNA, 16 bp, Homo sapiens
catctggtcttgtttc

SEQ ID NO: 1258873 - DNA, 22 bp, Homo sapiens
catctgtaaatatcccagagaa

SEQ ID NO: 1258874 - DNA, 19 bp, Homo sapiens
catctgtaactctaaaaga

SEQ ID NO: 1258875 - DNA, 14 bp, Homo sapiens
catctgtaagagct

SEQ ID NO: 1258876 - DNA, 19 bp, Homo sapiens
catctgtaagagcttgctc

SEQ ID NO: 1258877 - DNA, 20 bp, Homo sapiens
catctgtataagtaagaaaa

SEQ ID NO: 1258878 - DNA, 21 bp, Homo sapiens
catctgtataagtaagaaaat

SEQ ID NO: 1258879 - DNA, 21 bp, Homo sapiens
catctgtataccctctgtttc

SEQ ID NO: 1258880 - DNA, 22 bp, Homo sapiens
catctgtccacatccccagagc

SEQ ID NO: 1258881 - DNA, 23 bp, Homo sapiens
catctgtccacatccccagagcc

SEQ ID NO: 1258882 - DNA, 12 bp, Homo sapiens
catctgtccagc

SEQ ID NO: 1258883 - DNA, 17 bp, Homo sapiens
catctgtccgtccagag

SEQ ID NO: 1258884 - DNA, 13 bp, Homo sapiens
catctgtcctcac

SEQ ID NO: 1258885 - DNA, 19 bp, Homo sapiens
catctgtcctcaccctgtg

SEQ ID NO: 1258886 - DNA, 23 bp, Homo sapiens
catctgtctccctccccaaatgg

SEQ ID NO: 1258887 - DNA, 11 bp, Homo sapiens
catctgtcttc

SEQ ID NO: 1258888 - DNA, 13 bp, Homo sapiens
catctgtgaataa

SEQ ID NO: 1258889 - DNA, 13 bp, Homo sapiens
catctgtgcgtgt

SEQ ID NO: 1258890 - DNA, 13 bp, Homo sapiens
catctgtggagct

SEQ ID NO: 1258891 - DNA, 15 bp, Homo sapiens
catctgtggagctgc

SEQ ID NO: 1258892 - DNA, 20 bp, Homo sapiens
catctgtggagctgccacag

SEQ ID NO: 1258893 - DNA, 17 bp, Homo sapiens
catctgtgtgcagcaac

SEQ ID NO: 1258894 - DNA, 23 bp, Homo sapiens
catctgtgtgcgtggtgtggccc

SEQ ID NO: 1258895 - DNA, 18 bp, Homo sapiens
catctgttagcagagtct

SEQ ID NO: 1258896 - DNA, 17 bp, Homo sapiens
catctgttatcctgcta

SEQ ID NO: 1258897 - DNA, 23 bp, Homo sapiens
catctgtttacctggcagtggct

SEQ ID NO: 1258898 - DNA, 19 bp, Homo sapiens
catctgtttgaagattata

SEQ ID NO: 1258899 - DNA, 13 bp, Homo sapiens
catcttaaaagct

SEQ ID NO: 1258900 - DNA, 12 bp, Homo sapiens
catcttaaacta

SEQ ID NO: 1258901 - DNA, 14 bp, Homo sapiens
catcttacctctca

SEQ ID NO: 1258902 - DNA, 13 bp, Homo sapiens
catcttactgaag

SEQ ID NO: 1258903 - DNA, 9 bp, Homo sapiens
catcttcag

SEQ ID NO: 1258904 - DNA, 11 bp, Homo sapiens
catcttcagga

SEQ ID NO: 1258905 - DNA, 15 bp, Homo sapiens
catcttcagttgtct

SEQ ID NO: 1258906 - DNA, 20 bp, Homo sapiens
catcttcagttgtctctgat

SEQ ID NO: 1258907 - DNA, 22 bp, Homo sapiens
catcttcagttgtctctgatgc

SEQ ID NO: 1258908 - DNA, 15 bp, Homo sapiens
catcttcataatttg

SEQ ID NO: 1258909 - DNA, 20 bp, Homo sapiens
catcttccacctgtgccctc

SEQ ID NO: 1258910 - DNA, 15 bp, Homo sapiens
catcttccaggatgg

SEQ ID NO: 1258911 - DNA, 10 bp, Homo sapiens
catcttccca

SEQ ID NO: 1258912 - DNA, 12 bp, Homo sapiens
catcttcccagc

SEQ ID NO: 1258913 - DNA, 14 bp, Homo sapiens
catcttcccagcag

SEQ ID NO: 1258914 - DNA, 17 bp, Homo sapiens
catcttcctgctgctgt

SEQ ID NO: 1258915 - DNA, 13 bp, Homo sapiens
catcttcctgtgt

SEQ ID NO: 1258916 - DNA, 14 bp, Homo sapiens
catcttcctgtgtc

SEQ ID NO: 1258917 - DNA, 15 bp, Homo sapiens
catcttcctgtgtcc

SEQ ID NO: 1258918 - DNA, 17 bp, Homo sapiens
catcttctgccttagtc

SEQ ID NO: 1258919 - DNA, 12 bp, Homo sapiens
catcttctggct

SEQ ID NO: 1258920 - DNA, 13 bp, Homo sapiens
catcttctggctt

SEQ ID NO: 1258921 - DNA, 16 bp, Homo sapiens
catcttctgtgaaata

SEQ ID NO: 1258922 - DNA, 17 bp, Homo sapiens
catcttctgtgaaatat

SEQ ID NO: 1258923 - DNA, 14 bp, Homo sapiens
catcttcttcacca

SEQ ID NO: 1258924 - DNA, 19 bp, Homo sapiens
catcttcttcaccatttgg

SEQ ID NO: 1258925 - DNA, 13 bp, Homo sapiens
catcttcttccct

SEQ ID NO: 1258926 - DNA, 14 bp, Homo sapiens
catcttcttccctt

SEQ ID NO: 1258927 - DNA, 15 bp, Homo sapiens
catcttcttccctta

SEQ ID NO: 1258928 - DNA, 21 bp, Homo sapiens
catcttcttgcatctaatgaa

SEQ ID NO: 1258929 - DNA, 19 bp, Homo sapiens
catcttgatctttgagccc

SEQ ID NO: 1258930 - DNA, 20 bp, Homo sapiens
catcttgatctttgagccca

SEQ ID NO: 1258931 - DNA, 21 bp, Homo sapiens
catcttgatctttgagcccat

SEQ ID NO: 1258932 - DNA, 22 bp, Homo sapiens
catcttgatctttgagcccatt

SEQ ID NO: 1258933 - DNA, 22 bp, Homo sapiens
catgactggctgtctgcctgta

SEQ ID NO: 1258934 - DNA, 13 bp, Homo sapiens
catgactgggcct

SEQ ID NO: 1258935 - DNA, 22 bp, Homo sapiens
catgactgggcctcccttgggc

SEQ ID NO: 1258936 - DNA, 19 bp, Homo sapiens
catgactgtgaccaccttc

SEQ ID NO: 1258937 - DNA, 22 bp, Homo sapiens
catgactgtgaccaccttctgt

SEQ ID NO: 1258938 - DNA, 23 bp, Homo sapiens
catgactgtttcttttgtaaaga

SEQ ID NO: 1258939 - DNA, 20 bp, Homo sapiens
catgacttattatgcataaa

SEQ ID NO: 1258940 - DNA, 19 bp, Homo sapiens
catgacttgggctttctga

SEQ ID NO: 1258941 - DNA, 14 bp, Homo sapiens
catgacttgtgtgt

SEQ ID NO: 1258942 - DNA, 13 bp, Homo sapiens
catgagaaagaat

SEQ ID NO: 1258943 - DNA, 16 bp, Homo sapiens
catgagaacaaacaga

SEQ ID NO: 1258944 - DNA, 11 bp, Homo sapiens
catgagaagcc

SEQ ID NO: 1258945 - DNA, 17 bp, Homo sapiens
catgagaatttgcaaca

SEQ ID NO: 1258946 - DNA, 19 bp, Homo sapiens
catgagaccactgttatca

SEQ ID NO: 1258947 - DNA, 18 bp, Homo sapiens
catgagactgatccctgg

SEQ ID NO: 1258948 - DNA, 17 bp, Homo sapiens
catgagccactgcacct

SEQ ID NO: 1258949 - DNA, 14 bp, Homo sapiens
catgagccactgtg

SEQ ID NO: 1258950 - DNA, 21 bp, Homo sapiens
catgagccactgtgcttggcc

SEQ ID NO: 1258951 - DNA, 15 bp, Homo sapiens
catgagcctgctgga

SEQ ID NO: 1258952 - DNA, 19 bp, Homo sapiens
catgagcctgctggaagcc

SEQ ID NO: 1258953 - DNA, 22 bp, Homo sapiens
catgagcctgctggaagcccag

SEQ ID NO: 1258954 - DNA, 19 bp, Homo sapiens
catgagctccagaccccca

SEQ ID NO: 1258955 - DNA, 20 bp, Homo sapiens
catgagctcggggtccacca

SEQ ID NO: 1258956 - DNA, 21 bp, Homo sapiens
catgagctcggggtccaccag

SEQ ID NO: 1258957 - DNA, 23 bp, Homo sapiens
catgagctgctcattacagttct

SEQ ID NO: 1258958 - DNA, 13 bp, Homo sapiens
catgagctgctgt

SEQ ID NO: 1258959 - DNA, 15 bp, Homo sapiens
catgagctgctgtgc

SEQ ID NO: 1258960 - DNA, 14 bp, Homo sapiens
catgagcttttata

SEQ ID NO: 1258961 - DNA, 22 bp, Homo sapiens
catgaggacatgatggagcgca

SEQ ID NO: 1258962 - DNA, 20 bp, Homo sapiens
catgaggagggtgggggagg

SEQ ID NO: 1258963 - DNA, 16 bp, Homo sapiens
catgaggagttgctgt

SEQ ID NO: 1258964 - DNA, 22 bp, Homo sapiens
catgaggcaatgtcaggaacag

SEQ ID NO: 1258965 - DNA, 24 bp, Homo sapiens
catgaggcaatgtcaggaacagaa

SEQ ID NO: 1258966 - DNA, 14 bp, Homo sapiens
catgaggccatctc

SEQ ID NO: 1258967 - DNA, 17 bp, Homo sapiens
catgaggccatctcagg

SEQ ID NO: 1258968 - DNA, 18 bp, Homo sapiens
catgagggatcacagggc

SEQ ID NO: 1258969 - DNA, 15 bp, Homo sapiens
catgaggggagagga

SEQ ID NO: 1258970 - DNA, 20 bp, Homo sapiens
catgaggtactggtcccttc

SEQ ID NO: 1258971 - DNA, 21 bp, Homo sapiens
catgagtagataatttcaggg

SEQ ID NO: 1258972 - DNA, 15 bp, Homo sapiens
catgagtatctgtgg

SEQ ID NO: 1258973 - DNA, 20 bp, Homo sapiens
catgagtccttgaaaatatt

SEQ ID NO: 1258974 - DNA, 21 bp, Homo sapiens
catgagtccttgaaaatattt

SEQ ID NO: 1258975 - DNA, 19 bp, Homo sapiens
catgagttatcatgaattt

SEQ ID NO: 1258976 - DNA, 21 bp, Homo sapiens
catgataagaacagagtgcct

SEQ ID NO: 1258977 - DNA, 16 bp, Homo sapiens
catgatacatttttat

SEQ ID NO: 1258978 - DNA, 17 bp, Homo sapiens
catgatactcatttctt

SEQ ID NO: 1258979 - DNA, 19 bp, Homo sapiens
catgatataactttagaaa

SEQ ID NO: 1258980 - DNA, 21 bp, Homo sapiens
catgatccacactttgggctt

SEQ ID NO: 1258981 - DNA, 21 bp, Homo sapiens
catgatccctgtgttgtctct

SEQ ID NO: 1258982 - DNA, 17 bp, Homo sapiens
catgatctccctgccgc

SEQ ID NO: 1258983 - DNA, 18 bp, Homo sapiens
catgatctccctgccgcc

SEQ ID NO: 1258984 - DNA, 19 bp, Homo sapiens
catgatctccctgccgcct

SEQ ID NO: 1258985 - DNA, 15 bp, Homo sapiens
catgatcttgagcaa

SEQ ID NO: 1258986 - DNA, 16 bp, Homo sapiens
catgatgccctcccct

SEQ ID NO: 1258987 - DNA, 14 bp, Homo sapiens
catgatgctagcca

SEQ ID NO: 1258988 - DNA, 18 bp, Homo sapiens
catgatgggaaaatattt

SEQ ID NO: 1258989 - DNA, 20 bp, Homo sapiens
catgatgggaatagggagac

SEQ ID NO: 1258990 - DNA, 23 bp, Homo sapiens
catgatggttattttcttttctt

SEQ ID NO: 1258991 - DNA, 20 bp, Homo sapiens
catgatgtccttggactcca

SEQ ID NO: 1258992 - DNA, 15 bp, Homo sapiens
catgatgtgaagagt

SEQ ID NO: 1258993 - DNA, 19 bp, Homo sapiens
catgatgttaaccagaata

SEQ ID NO: 1258994 - DNA, 13 bp, Homo sapiens
catgatgtttgcc

SEQ ID NO: 1258995 - DNA, 17 bp, Homo sapiens
catgatgtttgcccaaa

SEQ ID NO: 1258996 - DNA, 23 bp, Homo sapiens
catgattaaccacttcagctgac

SEQ ID NO: 1258997 - DNA, 21 bp, Homo sapiens
catgattatagcaactaatgt

SEQ ID NO: 1258998 - DNA, 16 bp, Homo sapiens
catgattcatgccaat

SEQ ID NO: 1258999 - DNA, 16 bp, Homo sapiens
catgattggcttaaag

SEQ ID NO: 1259000 - DNA, 22 bp, Homo sapiens
catgattggcttaaagtgaagg

SEQ ID NO: 1259001 - DNA, 16 bp, Homo sapiens
catgatttacagagaa

SEQ ID NO: 1259002 - DNA, 20 bp, Homo sapiens
catgatttacagagaagtga

SEQ ID NO: 1259003 - DNA, 18 bp, Homo sapiens
catgatttagggaagcag

SEQ ID NO: 1259004 - DNA, 12 bp, Homo sapiens
catgatttatat

SEQ ID NO: 1259005 - DNA, 17 bp, Homo sapiens
catgatttccttgaatg

SEQ ID NO: 1259006 - DNA, 17 bp, Homo sapiens
catgatttgtcccagcc

SEQ ID NO: 1259007 - DNA, 23 bp, Homo sapiens
catgatttgtcccagcctggggc

SEQ ID NO: 1259008 - DNA, 19 bp, Homo sapiens
catgattttaagaggcttt

SEQ ID NO: 1259009 - DNA, 21 bp, Homo sapiens
catgattttaagtttctctgc

SEQ ID NO: 1259010 - DNA, 17 bp, Homo sapiens
catgattttacaagtat

SEQ ID NO: 1259011 - DNA, 20 bp, Homo sapiens
catgattttacaagtataac

SEQ ID NO: 1259012 - DNA, 16 bp, Homo sapiens
catgcaaatgctgtat

SEQ ID NO: 1259013 - DNA, 14 bp, Homo sapiens
catgcaaggggaaa

SEQ ID NO: 1259014 - DNA, 19 bp, Homo sapiens
catgcaaggggaaaatctc

SEQ ID NO: 1259015 - DNA, 19 bp, Homo sapiens
catgcaataatgtgcaaat

SEQ ID NO: 1259016 - DNA, 16 bp, Homo sapiens
catgcaatgacatctt

SEQ ID NO: 1259017 - DNA, 11 bp, Homo sapiens
catgcacacac

SEQ ID NO: 1259018 - DNA, 12 bp, Homo sapiens
catgcacacggc

SEQ ID NO: 1259019 - DNA, 23 bp, Homo sapiens
catgcacacggctggtcactctg

SEQ ID NO: 1259020 - DNA, 15 bp, Homo sapiens
catgcacagctgctt

SEQ ID NO: 1259021 - DNA, 23 bp, Homo sapiens
catgcacagctgcttgtcctgct

SEQ ID NO: 1259022 - DNA, 21 bp, Homo sapiens
catgcacatgccttaagccag

SEQ ID NO: 1259023 - DNA, 20 bp, Homo sapiens
catgcaccaggactggctgt

SEQ ID NO: 1259024 - DNA, 21 bp, Homo sapiens
catgcacgggcatgcacacgg

SEQ ID NO: 1259025 - DNA, 12 bp, Homo sapiens
catgcactgagg

SEQ ID NO: 1259026 - DNA, 15 bp, Homo sapiens
catgcactgatgttg

SEQ ID NO: 1259027 - DNA, 23 bp, Homo sapiens
catgcactgtaaatatccctccc

SEQ ID NO: 1259028 - DNA, 14 bp, Homo sapiens
catgcacttaaaga

SEQ ID NO: 1259029 - DNA, 13 bp, Homo sapiens
catgcactttaat

SEQ ID NO: 1259030 - DNA, 22 bp, Homo sapiens
catgcactttaattgaagaact

SEQ ID NO: 1259031 - DNA, 23 bp, Homo sapiens
catgcactttaattgaagaactg

SEQ ID NO: 1259032 - DNA, 21 bp, Homo sapiens
catgcagacctcatgcccagc

SEQ ID NO: 1259033 - DNA, 17 bp, Homo sapiens
catgcagactcctcaga

SEQ ID NO: 1259034 - DNA, 22 bp, Homo sapiens
catgcagactcctcagatctga

SEQ ID NO: 1259035 - DNA, 19 bp, Homo sapiens
catgcagatggggctcccg

SEQ ID NO: 1259036 - DNA, 17 bp, Homo sapiens
catgcagccactgtgct

SEQ ID NO: 1259037 - DNA, 19 bp, Homo sapiens
catgcagcccatgcccacc

SEQ ID NO: 1259038 - DNA, 16 bp, Homo sapiens
catgcagcccctgggc

SEQ ID NO: 1259039 - DNA, 12 bp, Homo sapiens
catgcagccttg

SEQ ID NO: 1259040 - DNA, 18 bp, Homo sapiens
catgcagccttggggcat

SEQ ID NO: 1259041 - DNA, 15 bp, Homo sapiens
catgcagctgcaccc

SEQ ID NO: 1259042 - DNA, 14 bp, Homo sapiens
catgcagctgcctg

SEQ ID NO: 1259043 - DNA, 15 bp, Homo sapiens
catgcagctgcctgg

SEQ ID NO: 1259044 - DNA, 16 bp, Homo sapiens
catgcagctgcctggg

SEQ ID NO: 1259045 - DNA, 19 bp, Homo sapiens
catgcagctgcctggggcc

SEQ ID NO: 1259046 - DNA, 16 bp, Homo sapiens
catgcaggaagaggcc

SEQ ID NO: 1259047 - DNA, 15 bp, Homo sapiens
catgcaggaggtgga

SEQ ID NO: 1259048 - DNA, 14 bp, Homo sapiens
catgcagttcctgg

SEQ ID NO: 1259049 - DNA, 15 bp, Homo sapiens
catgcatactttatt

SEQ ID NO: 1259050 - DNA, 16 bp, Homo sapiens
catgcatgtcctgtaa

SEQ ID NO: 1259051 - DNA, 18 bp, Homo sapiens
catgcatgtcctgtaaag

SEQ ID NO: 1259052 - DNA, 11 bp, Homo sapiens
catgcattgtt

SEQ ID NO: 1259053 - DNA, 14 bp, Homo sapiens
catgcatttcaagc

SEQ ID NO: 1259054 - DNA, 23 bp, Homo sapiens
catggctgtgtttgcagcctgct

SEQ ID NO: 1259055 - DNA, 13 bp, Homo sapiens
catggcttcctcc

SEQ ID NO: 1259056 - DNA, 21 bp, Homo sapiens
catggcttgttctctggaacc

SEQ ID NO: 1259057 - DNA, 17 bp, Homo sapiens
catggctttcatcctgt

SEQ ID NO: 1259058 - DNA, 20 bp, Homo sapiens
catggctttcatcctgtgtc

SEQ ID NO: 1259059 - DNA, 21 bp, Homo sapiens
catggctttcatcctgtgtcc

SEQ ID NO: 1259060 - DNA, 16 bp, Homo sapiens
catgggaacgcagcct

SEQ ID NO: 1259061 - DNA, 18 bp, Homo sapiens
catgggaacgcagcctcc

SEQ ID NO: 1259062 - DNA, 21 bp, Homo sapiens
catgggaagatgtctcagagc

SEQ ID NO: 1259063 - DNA, 14 bp, Homo sapiens
catgggaaggggag

SEQ ID NO: 1259064 - DNA, 18 bp, Homo sapiens
catgggacctcctccctc

SEQ ID NO: 1259065 - DNA, 12 bp, Homo sapiens
catgggagccag

SEQ ID NO: 1259066 - DNA, 17 bp, Homo sapiens
catgggagccagctgct

SEQ ID NO: 1259067 - DNA, 20 bp, Homo sapiens
catgggagccagctgctttt

SEQ ID NO: 1259068 - DNA, 14 bp, Homo sapiens
catgggaggctcac

SEQ ID NO: 1259069 - DNA, 17 bp, Homo sapiens
catgggagggatcagcc

SEQ ID NO: 1259070 - DNA, 20 bp, Homo sapiens
catgggagggatcagccccg

SEQ ID NO: 1259071 - DNA, 23 bp, Homo sapiens
catgggaggtgaggattccaaaa

SEQ ID NO: 1259072 - DNA, 15 bp, Homo sapiens
catgggcagagccca

SEQ ID NO: 1259073 - DNA, 22 bp, Homo sapiens
catgggccagagcctcggccct

SEQ ID NO: 1259074 - DNA, 20 bp, Homo sapiens
catgggcccaggcctcacca

SEQ ID NO: 1259075 - DNA, 16 bp, Homo sapiens
catgggcccgctgcct

SEQ ID NO: 1259076 - DNA, 18 bp, Homo sapiens
catgggcccgctgcctct

SEQ ID NO: 1259077 - DNA, 12 bp, Homo sapiens
catgggcctctc

SEQ ID NO: 1259078 - DNA, 14 bp, Homo sapiens
catgggcctctctg

SEQ ID NO: 1259079 - DNA, 17 bp, Homo sapiens
catgggcctctctgggg

SEQ ID NO: 1259080 - DNA, 19 bp, Homo sapiens
catgggcctctctggggga

SEQ ID NO: 1259081 - DNA, 21 bp, Homo sapiens
catgggcctctctgggggagg

SEQ ID NO: 1259082 - DNA, 10 bp, Homo sapiens
catgggcctg

SEQ ID NO: 1259083 - DNA, 11 bp, Homo sapiens
catgggcctgg

SEQ ID NO: 1259084 - DNA, 16 bp, Homo sapiens
catgggcgcaggccca

SEQ ID NO: 1259085 - DNA, 20 bp, Homo sapiens
catgggcgcaggcccagtga

SEQ ID NO: 1259086 - DNA, 19 bp, Homo sapiens
catgggctagtgtgagtgg

SEQ ID NO: 1259087 - DNA, 20 bp, Homo sapiens
catgggcttggacttcctgg

SEQ ID NO: 1259088 - DNA, 21 bp, Homo sapiens
catggggaaaccctggagcca

SEQ ID NO: 1259089 - DNA, 22 bp, Homo sapiens
catggggaaaccctggagccat

SEQ ID NO: 1259090 - DNA, 18 bp, Homo sapiens
catggggaaggcagaggc

SEQ ID NO: 1259091 - DNA, 19 bp, Homo sapiens
catggggaaggcagaggct

SEQ ID NO: 1259092 - DNA, 10 bp, Homo sapiens
catggggagg

SEQ ID NO: 1259093 - DNA, 19 bp, Homo sapiens
catggggaggcagcagagc

SEQ ID NO: 1259094 - DNA, 20 bp, Homo sapiens
catggggagggattctggtt

SEQ ID NO: 1259095 - DNA, 22 bp, Homo sapiens
catggggagtaataggaccaga

SEQ ID NO: 1259096 - DNA, 19 bp, Homo sapiens
catggggatcaattttcat

SEQ ID NO: 1259097 - DNA, 19 bp, Homo sapiens
catggggatctggggggtg

SEQ ID NO: 1259098 - DNA, 14 bp, Homo sapiens
catggggcaagcca

SEQ ID NO: 1259099 - DNA, 18 bp, Homo sapiens
catggggcaagccagggc

SEQ ID NO: 1259100 - DNA, 20 bp, Homo sapiens
catggggcaagccagggccc

SEQ ID NO: 1259101 - DNA, 22 bp, Homo sapiens
catggggcaagccagggcccag

SEQ ID NO: 1259102 - DNA, 15 bp, Homo sapiens
catggggcatgtcct

SEQ ID NO: 1259103 - DNA, 20 bp, Homo sapiens
catggggcatgtcctttcca

SEQ ID NO: 1259104 - DNA, 15 bp, Homo sapiens
catggggcccctggc

SEQ ID NO: 1259105 - DNA, 14 bp, Homo sapiens
catgggggcaccgg

SEQ ID NO: 1259106 - DNA, 23 bp, Homo sapiens
catgggggcaccgggctccatgc

SEQ ID NO: 1259107 - DNA, 14 bp, Homo sapiens
catgggggtgagac

SEQ ID NO: 1259108 - DNA, 20 bp, Homo sapiens
catggggtcagccccaaggg

SEQ ID NO: 1259109 - DNA, 13 bp, Homo sapiens
catggggtccttg

SEQ ID NO: 1259110 - DNA, 16 bp, Homo sapiens
catggggttcgagact

SEQ ID NO: 1259111 - DNA, 17 bp, Homo sapiens
catggggttcgagactc

SEQ ID NO: 1259112 - DNA, 23 bp, Homo sapiens
catggggtttttattatttttac

SEQ ID NO: 1259113 - DNA, 21 bp, Homo sapiens
catgggtccagggcctgacac

SEQ ID NO: 1259114 - DNA, 21 bp, Homo sapiens
catgggtcctagcccttccct

SEQ ID NO: 1259115 - DNA, 13 bp, Homo sapiens
catgggtctggcc

SEQ ID NO: 1259116 - DNA, 11 bp, Homo sapiens
catgggtgggg

SEQ ID NO: 1259117 - DNA, 18 bp, Homo sapiens
catgggtgtgcccttggg

SEQ ID NO: 1259118 - DNA, 14 bp, Homo sapiens
catgggttggcagg

SEQ ID NO: 1259119 - DNA, 20 bp, Homo sapiens
catggtaatgacagatgcaa

SEQ ID NO: 1259120 - DNA, 15 bp, Homo sapiens
catggtcacacactg

SEQ ID NO: 1259121 - DNA, 17 bp, Homo sapiens
catggtcacacactgat

SEQ ID NO: 1259122 - DNA, 15 bp, Homo sapiens
catggtcacagtcct

SEQ ID NO: 1259123 - DNA, 16 bp, Homo sapiens
catggtcacagtccta

SEQ ID NO: 1259124 - DNA, 14 bp, Homo sapiens
catggtccctgcct

SEQ ID NO: 1259125 - DNA, 17 bp, Homo sapiens
catggtcccttaaggca

SEQ ID NO: 1259126 - DNA, 16 bp, Homo sapiens
catggtcggaaaacat

SEQ ID NO: 1259127 - DNA, 13 bp, Homo sapiens
catggtctttgct

SEQ ID NO: 1259128 - DNA, 14 bp, Homo sapiens
catggtctttgcta

SEQ ID NO: 1259129 - DNA, 11 bp, Homo sapiens
catggtgaaaa

SEQ ID NO: 1259130 - DNA, 18 bp, Homo sapiens
catggtgaaaagctccat

SEQ ID NO: 1259131 - DNA, 19 bp, Homo sapiens
catggtgaaaccccgtctc

SEQ ID NO: 1259132 - DNA, 16 bp, Homo sapiens
catggtgaaagggttt

SEQ ID NO: 1259133 - DNA, 14 bp, Homo sapiens
catggtgaagtgct

SEQ ID NO: 1259134 - DNA, 15 bp, Homo sapiens
catggtgcagggaga

SEQ ID NO: 1259135 - DNA, 15 bp, Homo sapiens
catggtgcctgagag

SEQ ID NO: 1259136 - DNA, 18 bp, Homo sapiens
catggtgcctgagaggca

SEQ ID NO: 1259137 - DNA, 14 bp, Homo sapiens
catggtgctagtgg

SEQ ID NO: 1259138 - DNA, 21 bp, Homo sapiens
catggtgctagtgggccctct

SEQ ID NO: 1259139 - DNA, 13 bp, Homo sapiens
catggtggaaggg

SEQ ID NO: 1259140 - DNA, 13 bp, Homo sapiens
catggtggagggc

SEQ ID NO: 1259141 - DNA, 19 bp, Homo sapiens
catggtggagggcacttca

SEQ ID NO: 1259142 - DNA, 21 bp, Homo sapiens
catggtggagggcacttcagg

SEQ ID NO: 1259143 - DNA, 19 bp, Homo sapiens
catggtggctcatgcctgt

SEQ ID NO: 1259144 - DNA, 22 bp, Homo sapiens
catggtgggtccatgggcagag

SEQ ID NO: 1259145 - DNA, 19 bp, Homo sapiens
catggtgtatgtggttttt

SEQ ID NO: 1259146 - DNA, 16 bp, Homo sapiens
catggtgtctcccaac

SEQ ID NO: 1259147 - DNA, 18 bp, Homo sapiens
catggtgtctcccaacat

SEQ ID NO: 1259148 - DNA, 20 bp, Homo sapiens
catggtgtctcccaacatgg

SEQ ID NO: 1259149 - DNA, 23 bp, Homo sapiens
catggtgtgaaagtcagatgccc

SEQ ID NO: 1259150 - DNA, 18 bp, Homo sapiens
catggtgtgatcgtctga

SEQ ID NO: 1259151 - DNA, 13 bp, Homo sapiens
catggtgtggcca

SEQ ID NO: 1259152 - DNA, 22 bp, Homo sapiens
catggtgtggccatcactcagc

SEQ ID NO: 1259153 - DNA, 16 bp, Homo sapiens
catggtgtggggggct

SEQ ID NO: 1259154 - DNA, 14 bp, Homo sapiens
catggtgtgttaca

SEQ ID NO: 1259155 - DNA, 21 bp, Homo sapiens
catggttacaatcattgctga

SEQ ID NO: 1259156 - DNA, 17 bp, Homo sapiens
catggttaccatgtctt

SEQ ID NO: 1259157 - DNA, 14 bp, Homo sapiens
catggttgagaaat

SEQ ID NO: 1259158 - DNA, 22 bp, Homo sapiens
catggtttaaaagaaaaaatga

SEQ ID NO: 1259159 - DNA, 17 bp, Homo sapiens
catgtaaaacagaaaaa

SEQ ID NO: 1259160 - DNA, 16 bp, Homo sapiens
catgtaaaagagtcat

SEQ ID NO: 1259161 - DNA, 15 bp, Homo sapiens
catgtaaaatatgta

SEQ ID NO: 1259162 - DNA, 15 bp, Homo sapiens
catgtaaactgtgca

SEQ ID NO: 1259163 - DNA, 16 bp, Homo sapiens
catgtaaactgtgcac

SEQ ID NO: 1259164 - DNA, 15 bp, Homo sapiens
catgtaaaggccttt

SEQ ID NO: 1259165 - DNA, 12 bp, Homo sapiens
catgtaaatgct

SEQ ID NO: 1259166 - DNA, 16 bp, Homo sapiens
catgtaacagttgtgt

SEQ ID NO: 1259167 - DNA, 12 bp, Homo sapiens
catgtaacattg

SEQ ID NO: 1259168 - DNA, 17 bp, Homo sapiens
catgtaaccggcatgtt

SEQ ID NO: 1259169 - DNA, 18 bp, Homo sapiens
catgtaaccggcatgttt

SEQ ID NO: 1259170 - DNA, 21 bp, Homo sapiens
catgtaactatttcttcagag

SEQ ID NO: 1259171 - DNA, 20 bp, Homo sapiens
catgtaaggtcttcttgtgt

SEQ ID NO: 1259172 - DNA, 17 bp, Homo sapiens
catgtaataaattcaaa

SEQ ID NO: 1259173 - DNA, 19 bp, Homo sapiens
catgtaataaattcaaaac

SEQ ID NO: 1259174 - DNA, 15 bp, Homo sapiens
catgtaatgtggtca

SEQ ID NO: 1259175 - DNA, 18 bp, Homo sapiens
catgtaattaagtactat

SEQ ID NO: 1259176 - DNA, 13 bp, Homo sapiens
cattaagtaaatg

SEQ ID NO: 1259177 - DNA, 15 bp, Homo sapiens
cattaagtaaatgct

SEQ ID NO: 1259178 - DNA, 16 bp, Homo sapiens
cattaagtaaatgctg

SEQ ID NO: 1259179 - DNA, 16 bp, Homo sapiens
cattaagtaatctttt

SEQ ID NO: 1259180 - DNA, 16 bp, Homo sapiens
cattaagtcagtggct

SEQ ID NO: 1259181 - DNA, 15 bp, Homo sapiens
cattaatagcagcct

SEQ ID NO: 1259182 - DNA, 17 bp, Homo sapiens
cattaatagcagccttt

SEQ ID NO: 1259183 - DNA, 16 bp, Homo sapiens
cattaatatttgctga

SEQ ID NO: 1259184 - DNA, 23 bp, Homo sapiens
cattaatcaatcatctgtgtgaa

SEQ ID NO: 1259185 - DNA, 19 bp, Homo sapiens
cattaatccacatgtttca

SEQ ID NO: 1259186 - DNA, 23 bp, Homo sapiens
cattaatgagatgttattactgt

SEQ ID NO: 1259187 - DNA, 14 bp, Homo sapiens
cattaatgcccagc

SEQ ID NO: 1259188 - DNA, 17 bp, Homo sapiens
cattaatgcctgctttt

SEQ ID NO: 1259189 - DNA, 19 bp, Homo sapiens
cattaatgcctgctttttg

SEQ ID NO: 1259190 - DNA, 22 bp, Homo sapiens
cattaatgtttatttagctctg

SEQ ID NO: 1259191 - DNA, 15 bp, Homo sapiens
cattaatgtttctat

SEQ ID NO: 1259192 - DNA, 13 bp, Homo sapiens
cattaattacata

SEQ ID NO: 1259193 - DNA, 13 bp, Homo sapiens
cattaattattaa

SEQ ID NO: 1259194 - DNA, 21 bp, Homo sapiens
cattaattattattgctgttg

SEQ ID NO: 1259195 - DNA, 12 bp, Homo sapiens
cattaattctat

SEQ ID NO: 1259196 - DNA, 16 bp, Homo sapiens
cattaattttgtgcat

SEQ ID NO: 1259197 - DNA, 17 bp, Homo sapiens
cattaattttgtgcatt

SEQ ID NO: 1259198 - DNA, 20 bp, Homo sapiens
cattaattttgtgcattctt

SEQ ID NO: 1259199 - DNA, 15 bp, Homo sapiens
cattacagagaggag

SEQ ID NO: 1259200 - DNA, 18 bp, Homo sapiens
cattacagagaggagaaa

SEQ ID NO: 1259201 - DNA, 16 bp, Homo sapiens
cattacagttctttcc

SEQ ID NO: 1259202 - DNA, 22 bp, Homo sapiens
cattacagttctttcctctttc

SEQ ID NO: 1259203 - DNA, 17 bp, Homo sapiens
cattacatggctgtggt

SEQ ID NO: 1259204 - DNA, 11 bp, Homo sapiens
cattacatgtt

SEQ ID NO: 1259205 - DNA, 14 bp, Homo sapiens
cattacatgtttaa

SEQ ID NO: 1259206 - DNA, 16 bp, Homo sapiens
cattacattattaaac

SEQ ID NO: 1259207 - DNA, 13 bp, Homo sapiens
cattacccttccc

SEQ ID NO: 1259208 - DNA, 15 bp, Homo sapiens
cattacccttccctg

SEQ ID NO: 1259209 - DNA, 17 bp, Homo sapiens
cattacgtgagccaggt

SEQ ID NO: 1259210 - DNA, 15 bp, Homo sapiens
cattacgtgcattta

SEQ ID NO: 1259211 - DNA, 16 bp, Homo sapiens
cattacgtgcatttaa

SEQ ID NO: 1259212 - DNA, 19 bp, Homo sapiens
cattactacactggtgtgt

SEQ ID NO: 1259213 - DNA, 13 bp, Homo sapiens
cattactggtaaa

SEQ ID NO: 1259214 - DNA, 15 bp, Homo sapiens
cattactgttccaga

SEQ ID NO: 1259215 - DNA, 20 bp, Homo sapiens
cattacttgctttcaattga

SEQ ID NO: 1259216 - DNA, 14 bp, Homo sapiens
cattagaaatattt

SEQ ID NO: 1259217 - DNA, 19 bp, Homo sapiens
cattagaattatttaaaca

SEQ ID NO: 1259218 - DNA, 19 bp, Homo sapiens
cattagagcccatttcaat

SEQ ID NO: 1259219 - DNA, 12 bp, Homo sapiens
cattagagctta

SEQ ID NO: 1259220 - DNA, 17 bp, Homo sapiens
cattagcagtttgcttt

SEQ ID NO: 1259221 - DNA, 12 bp, Homo sapiens
cattagccaagg

SEQ ID NO: 1259222 - DNA, 21 bp, Homo sapiens
cattaggaattgtttatacac

SEQ ID NO: 1259223 - DNA, 23 bp, Homo sapiens
cattaggaattgtttatacacaa

SEQ ID NO: 1259224 - DNA, 20 bp, Homo sapiens
cattaggaccttagaatttt

SEQ ID NO: 1259225 - DNA, 17 bp, Homo sapiens
cattaggcaaagtacaa

SEQ ID NO: 1259226 - DNA, 16 bp, Homo sapiens
cattaggccagcaacg

SEQ ID NO: 1259227 - DNA, 21 bp, Homo sapiens
cattagtacacagcaccagaa

SEQ ID NO: 1259228 - DNA, 22 bp, Homo sapiens
cattagtcatgtttatctgctt

SEQ ID NO: 1259229 - DNA, 23 bp, Homo sapiens
cattagtgtccccccttgaagca

SEQ ID NO: 1259230 - DNA, 13 bp, Homo sapiens
cattataaaaaga

SEQ ID NO: 1259231 - DNA, 17 bp, Homo sapiens
cattataaaccttcaga

SEQ ID NO: 1259232 - DNA, 16 bp, Homo sapiens
cattataaccttaatt

SEQ ID NO: 1259233 - DNA, 18 bp, Homo sapiens
cattataactgaaggaga

SEQ ID NO: 1259234 - DNA, 15 bp, Homo sapiens
cattataatctcaaa

SEQ ID NO: 1259235 - DNA, 20 bp, Homo sapiens
cattataatctcaaaggaga

SEQ ID NO: 1259236 - DNA, 14 bp, Homo sapiens
cattatatttgcat

SEQ ID NO: 1259237 - DNA, 19 bp, Homo sapiens
cattatcactttaaagccc

SEQ ID NO: 1259238 - DNA, 22 bp, Homo sapiens
cattatcgccttttgacagctg

SEQ ID NO: 1259239 - DNA, 18 bp, Homo sapiens
cattatcgggagcagtgt

SEQ ID NO: 1259240 - DNA, 20 bp, Homo sapiens
cattatcgggagcagtgtct

SEQ ID NO: 1259241 - DNA, 21 bp, Homo sapiens
cattatcgggagcagtgtctt

SEQ ID NO: 1259242 - DNA, 23 bp, Homo sapiens
cattatctagatactgtatcatg

SEQ ID NO: 1259243 - DNA, 13 bp, Homo sapiens
cattatctatgca

SEQ ID NO: 1259244 - DNA, 16 bp, Homo sapiens
cattatctcacttagt

SEQ ID NO: 1259245 - DNA, 13 bp, Homo sapiens
cattatctgagtt

SEQ ID NO: 1259246 - DNA, 13 bp, Homo sapiens
cattatctggaat

SEQ ID NO: 1259247 - DNA, 15 bp, Homo sapiens
cattatgaaaaacat

SEQ ID NO: 1259248 - DNA, 13 bp, Homo sapiens
cattatgattctt

SEQ ID NO: 1259249 - DNA, 16 bp, Homo sapiens
cattatgatttcatta

SEQ ID NO: 1259250 - DNA, 14 bp, Homo sapiens
cattatgcaaataa

SEQ ID NO: 1259251 - DNA, 22 bp, Homo sapiens
cattatgcacttttagaaatgc

SEQ ID NO: 1259252 - DNA, 23 bp, Homo sapiens
cattatgccacttccttttaact

SEQ ID NO: 1259253 - DNA, 14 bp, Homo sapiens
cattatgctttgaa

SEQ ID NO: 1259254 - DNA, 16 bp, Homo sapiens
cattatgctttgaact

SEQ ID NO: 1259255 - DNA, 18 bp, Homo sapiens
cattatgggttcttcccc

SEQ ID NO: 1259256 - DNA, 17 bp, Homo sapiens
cattatgtatttataat

SEQ ID NO: 1259257 - DNA, 22 bp, Homo sapiens
cattatgtatttataatttaaa

SEQ ID NO: 1259258 - DNA, 19 bp, Homo sapiens
cattatgtccactgtgtat

SEQ ID NO: 1259259 - DNA, 17 bp, Homo sapiens
cattatgtgagtttcct

SEQ ID NO: 1259260 - DNA, 14 bp, Homo sapiens
cattatgttcatgt

SEQ ID NO: 1259261 - DNA, 16 bp, Homo sapiens
cattatgttcatgtaa

SEQ ID NO: 1259262 - DNA, 20 bp, Homo sapiens
cattatgtttcctaactgtg

SEQ ID NO: 1259263 - DNA, 14 bp, Homo sapiens
cattattcataaaa

SEQ ID NO: 1259264 - DNA, 18 bp, Homo sapiens
cattattggaatataatt

SEQ ID NO: 1259265 - DNA, 14 bp, Homo sapiens
cattattggaatta

SEQ ID NO: 1259266 - DNA, 17 bp, Homo sapiens
cattattggaattaacc

SEQ ID NO: 1259267 - DNA, 22 bp, Homo sapiens
cattattggaattaacctggtg

SEQ ID NO: 1259268 - DNA, 12 bp, Homo sapiens
cattatttaata

SEQ ID NO: 1259269 - DNA, 13 bp, Homo sapiens
cattatttaatgt

SEQ ID NO: 1259270 - DNA, 14 bp, Homo sapiens
cattatttaatgtt

SEQ ID NO: 1259271 - DNA, 16 bp, Homo sapiens
cattatttaatgtttg

SEQ ID NO: 1259272 - DNA, 20 bp, Homo sapiens
cattatttaatttgtatgct

SEQ ID NO: 1259273 - DNA, 23 bp, Homo sapiens
cattatttattaaaaatgttctc

SEQ ID NO: 1259274 - DNA, 13 bp, Homo sapiens
cattatttattgt

SEQ ID NO: 1259275 - DNA, 18 bp, Homo sapiens
cattatttattgttaaat

SEQ ID NO: 1259276 - DNA, 18 bp, Homo sapiens
cattattttctgtcagat

SEQ ID NO: 1259277 - DNA, 13 bp, Homo sapiens
cattatttttaga

SEQ ID NO: 1259278 - DNA, 20 bp, Homo sapiens
cattatttttccactttgtt

SEQ ID NO: 1259279 - DNA, 14 bp, Homo sapiens
cattcaaaaatttc

SEQ ID NO: 1259280 - DNA, 20 bp, Homo sapiens
cattcaaaacgtgatgtttt

SEQ ID NO: 1259281 - DNA, 23 bp, Homo sapiens
cattcaaaatagggtatattttc

SEQ ID NO: 1259282 - DNA, 14 bp, Homo sapiens
cattcaaatcagtg

SEQ ID NO: 1259283 - DNA, 17 bp, Homo sapiens
cattcaaatcagtgatc

SEQ ID NO: 1259284 - DNA, 19 bp, Homo sapiens
cattcaaatcagtgatcta

SEQ ID NO: 1259285 - DNA, 18 bp, Homo sapiens
cattcaaatgacgcctga

SEQ ID NO: 1259286 - DNA, 17 bp, Homo sapiens
cattcaagcctgtgaat

SEQ ID NO: 1259287 - DNA, 18 bp, Homo sapiens
cattcaagcctgtgaata

SEQ ID NO: 1259288 - DNA, 14 bp, Homo sapiens
cattcaagctattt

SEQ ID NO: 1259289 - DNA, 17 bp, Homo sapiens
cattcaagtgtaaaata

SEQ ID NO: 1259290 - DNA, 16 bp, Homo sapiens
cattcaatacaagtgt

SEQ ID NO: 1259291 - DNA, 17 bp, Homo sapiens
cattcaatctttggagg

SEQ ID NO: 1259292 - DNA, 13 bp, Homo sapiens
cattcaatgttta

SEQ ID NO: 1259293 - DNA, 13 bp, Homo sapiens
cattcacaagcct

SEQ ID NO: 1259294 - DNA, 15 bp, Homo sapiens
cattcacaagcctcc

SEQ ID NO: 1259295 - DNA, 17 bp, Homo sapiens
cattcacaagcctcctg

SEQ ID NO: 1259296 - DNA, 21 bp, Homo sapiens
cattcacaagcctcctgtacc

SEQ ID NO: 1259297 - DNA, 15 bp, Homo sapiens
cattcacagcccaga

SEQ ID NO: 1259298 - DNA, 15 bp, Homo sapiens
cattcacatttagaa

SEQ ID NO: 1259299 - DNA, 17 bp, Homo sapiens
cattggagcattttcaa

SEQ ID NO: 1259300 - DNA, 16 bp, Homo sapiens
cattggatcttttact

SEQ ID NO: 1259301 - DNA, 15 bp, Homo sapiens
cattggcccctgagc

SEQ ID NO: 1259302 - DNA, 15 bp, Homo sapiens
cattggcctcttgtc

SEQ ID NO: 1259303 - DNA, 18 bp, Homo sapiens
cattggcctcttgtccct

SEQ ID NO: 1259304 - DNA, 22 bp, Homo sapiens
cattggcctcttgtcccttggc

SEQ ID NO: 1259305 - DNA, 19 bp, Homo sapiens
cattgggcacagtccagac

SEQ ID NO: 1259306 - DNA, 22 bp, Homo sapiens
cattgggctgacacctaccatg

SEQ ID NO: 1259307 - DNA, 16 bp, Homo sapiens
cattggggtggggctt

SEQ ID NO: 1259308 - DNA, 21 bp, Homo sapiens
cattggggttccgcactttcc

SEQ ID NO: 1259309 - DNA, 19 bp, Homo sapiens
cattgggtttggggccatg

SEQ ID NO: 1259310 - DNA, 15 bp, Homo sapiens
cattggtccaccctt

SEQ ID NO: 1259311 - DNA, 19 bp, Homo sapiens
cattggttcttcctttccc

SEQ ID NO: 1259312 - DNA, 15 bp, Homo sapiens
cattgtaaaagcatt

SEQ ID NO: 1259313 - DNA, 21 bp, Homo sapiens
cattgtaaaccacaaggctgt

SEQ ID NO: 1259314 - DNA, 10 bp, Homo sapiens
cattgtaaag

SEQ ID NO: 1259315 - DNA, 14 bp, Homo sapiens
cattgtaaagtatg

SEQ ID NO: 1259316 - DNA, 15 bp, Homo sapiens
cattgtaaatctgaa

SEQ ID NO: 1259317 - DNA, 16 bp, Homo sapiens
cattgtaaatctgaag

SEQ ID NO: 1259318 - DNA, 19 bp, Homo sapiens
cattgtaaatctgaagaaa

SEQ ID NO: 1259319 - DNA, 21 bp, Homo sapiens
cattgtaaatctgaagaaagt

SEQ ID NO: 1259320 - DNA, 20 bp, Homo sapiens
cattgtaactattaaccttt

SEQ ID NO: 1259321 - DNA, 20 bp, Homo sapiens
cattgtaatattaactaaat

SEQ ID NO: 1259322 - DNA, 18 bp, Homo sapiens
cattgtaatgttactgat

SEQ ID NO: 1259323 - DNA, 14 bp, Homo sapiens
cattgtaatttgaa

SEQ ID NO: 1259324 - DNA, 16 bp, Homo sapiens
cattgtactacctgtg

SEQ ID NO: 1259325 - DNA, 18 bp, Homo sapiens
cattgtactccagcctgg

SEQ ID NO: 1259326 - DNA, 19 bp, Homo sapiens
cattgtagagcttctggca

SEQ ID NO: 1259327 - DNA, 19 bp, Homo sapiens
cattgtatagatataatga

SEQ ID NO: 1259328 - DNA, 15 bp, Homo sapiens
cattgtatatatgtg

SEQ ID NO: 1259329 - DNA, 16 bp, Homo sapiens
cattgtatatatgtgt

SEQ ID NO: 1259330 - DNA, 17 bp, Homo sapiens
cattgtatatatgtgtg

SEQ ID NO: 1259331 - DNA, 20 bp, Homo sapiens
cattgtatatatgtgtgttt

SEQ ID NO: 1259332 - DNA, 14 bp, Homo sapiens
cattgtatatgtga

SEQ ID NO: 1259333 - DNA, 16 bp, Homo sapiens
cattgtatctgtcttt

SEQ ID NO: 1259334 - DNA, 15 bp, Homo sapiens
cattgtatgatgtgt

SEQ ID NO: 1259335 - DNA, 16 bp, Homo sapiens
cattgtatgatgtgtt

SEQ ID NO: 1259336 - DNA, 17 bp, Homo sapiens
cattgtatgatgtgttg

SEQ ID NO: 1259337 - DNA, 16 bp, Homo sapiens
cattgtatgcagggag

SEQ ID NO: 1259338 - DNA, 18 bp, Homo sapiens
cattgtatgcagggagca

SEQ ID NO: 1259339 - DNA, 15 bp, Homo sapiens
cattgtattagatct

SEQ ID NO: 1259340 - DNA, 14 bp, Homo sapiens
cattgtccagctgg

SEQ ID NO: 1259341 - DNA, 19 bp, Homo sapiens
cattgtccccaatgaatat

SEQ ID NO: 1259342 - DNA, 21 bp, Homo sapiens
cattgtcctccttttcacttt

SEQ ID NO: 1259343 - DNA, 22 bp, Homo sapiens
cattgtcgtataggcatgtaaa

SEQ ID NO: 1259344 - DNA, 19 bp, Homo sapiens
cattgtctcctatatattt

SEQ ID NO: 1259345 - DNA, 17 bp, Homo sapiens
cattgtctccttccaca

SEQ ID NO: 1259346 - DNA, 21 bp, Homo sapiens
cattgtcttgttatgtacaaa

SEQ ID NO: 1259347 - DNA, 15 bp, Homo sapiens
cattgtgaagcacct

SEQ ID NO: 1259348 - DNA, 13 bp, Homo sapiens
cattgtgagctct

SEQ ID NO: 1259349 - DNA, 15 bp, Homo sapiens
cattgtgagctctgg

SEQ ID NO: 1259350 - DNA, 16 bp, Homo sapiens
cattgtgattggcctg

SEQ ID NO: 1259351 - DNA, 12 bp, Homo sapiens
cattgtgattta

SEQ ID NO: 1259352 - DNA, 22 bp, Homo sapiens
cattgtgcagaaaagctcagag

SEQ ID NO: 1259353 - DNA, 14 bp, Homo sapiens
cattgtgccaagcc

SEQ ID NO: 1259354 - DNA, 18 bp, Homo sapiens
cattgtgccaagccttct

SEQ ID NO: 1259355 - DNA, 13 bp, Homo sapiens
cattgtggctcct

SEQ ID NO: 1259356 - DNA, 15 bp, Homo sapiens
cattgtgtggcctgg

SEQ ID NO: 1259357 - DNA, 14 bp, Homo sapiens
cattgttacctcta

SEQ ID NO: 1259358 - DNA, 11 bp, Homo sapiens
cattgttccac

SEQ ID NO: 1259359 - DNA, 23 bp, Homo sapiens
cattgttcccttcctcttcctgc

SEQ ID NO: 1259360 - DNA, 20 bp, Homo sapiens
cattgttcttattctggcat

SEQ ID NO: 1259361 - DNA, 13 bp, Homo sapiens
cattgttgagcta

SEQ ID NO: 1259362 - DNA, 16 bp, Homo sapiens
cattgttgaggtggtc

SEQ ID NO: 1259363 - DNA, 18 bp, Homo sapiens
cattgttgaggtggtctg

SEQ ID NO: 1259364 - DNA, 13 bp, Homo sapiens
cattgttgtcaag

SEQ ID NO: 1259365 - DNA, 16 bp, Homo sapiens
cattgttgtcaaggaa

SEQ ID NO: 1259366 - DNA, 16 bp, Homo sapiens
cattgttgtgtctgtg

SEQ ID NO: 1259367 - DNA, 17 bp, Homo sapiens
cattgtttattaacaaa

SEQ ID NO: 1259368 - DNA, 14 bp, Homo sapiens
cattgtttgaaaca

SEQ ID NO: 1259369 - DNA, 18 bp, Homo sapiens
cattgtttgaaacaaaga

SEQ ID NO: 1259370 - DNA, 20 bp, Homo sapiens
cattgtttgaaacaaagaag

SEQ ID NO: 1259371 - DNA, 14 bp, Homo sapiens
cattgtttgctgct

SEQ ID NO: 1259372 - DNA, 18 bp, Homo sapiens
cattgtttgcttattgtt

SEQ ID NO: 1259373 - DNA, 14 bp, Homo sapiens
cattgttttctttt

SEQ ID NO: 1259374 - DNA, 23 bp, Homo sapiens
cattgttttcttttacagactag

SEQ ID NO: 1259375 - DNA, 14 bp, Homo sapiens
cattgttttgaaac

SEQ ID NO: 1259376 - DNA, 22 bp, Homo sapiens
catttaaaaaggtttaaaacta

SEQ ID NO: 1259377 - DNA, 20 bp, Homo sapiens
catttaaaaatatatagctt

SEQ ID NO: 1259378 - DNA, 23 bp, Homo sapiens
catttaaaacagacactggcatg

SEQ ID NO: 1259379 - DNA, 12 bp, Homo sapiens
catttaaaagat

SEQ ID NO: 1259380 - DNA, 15 bp, Homo sapiens
catttaaaatgatta

SEQ ID NO: 1259381 - DNA, 14 bp, Homo sapiens
catttaaacttttt

SEQ ID NO: 1259382 - DNA, 19 bp, Homo sapiens
catttaaactttttaaaat

SEQ ID NO: 1259383 - DNA, 17 bp, Homo sapiens
catttaaagagatttcc

SEQ ID NO: 1259384 - DNA, 16 bp, Homo sapiens
catttaaagctaaatt

SEQ ID NO: 1259385 - DNA, 18 bp, Homo sapiens
catttaaagctaaatttt

SEQ ID NO: 1259386 - DNA, 23 bp, Homo sapiens
catttaaataaaactttccaaat

SEQ ID NO: 1259387 - DNA, 18 bp, Homo sapiens
catttaaatacagtcttc

SEQ ID NO: 1259388 - DNA, 16 bp, Homo sapiens
catttaaatgtgtaca

SEQ ID NO: 1259389 - DNA, 12 bp, Homo sapiens
catttaaattcc

SEQ ID NO: 1259390 - DNA, 13 bp, Homo sapiens
catttaaattcca

SEQ ID NO: 1259391 - DNA, 18 bp, Homo sapiens
catttaaatttgatttcc

SEQ ID NO: 1259392 - DNA, 17 bp, Homo sapiens
catttaaattttttggc

SEQ ID NO: 1259393 - DNA, 10 bp, Homo sapiens
catttaacat

SEQ ID NO: 1259394 - DNA, 11 bp, Homo sapiens
catttaacata

SEQ ID NO: 1259395 - DNA, 15 bp, Homo sapiens
catttaacttacatt

SEQ ID NO: 1259396 - DNA, 18 bp, Homo sapiens
catttaagagactcttta

SEQ ID NO: 1259397 - DNA, 19 bp, Homo sapiens
catttaagagactctttat

SEQ ID NO: 1259398 - DNA, 15 bp, Homo sapiens
catttaagggaaaaa

SEQ ID NO: 1259399 - DNA, 20 bp, Homo sapiens
catttaagtatcttgtgctt

SEQ ID NO: 1259400 - DNA, 12 bp, Homo sapiens
catttaagtttc

SEQ ID NO: 1259401 - DNA, 21 bp, Homo sapiens
catttaataaaactgcgagga

SEQ ID NO: 1259402 - DNA, 13 bp, Homo sapiens
catttaataaaga

SEQ ID NO: 1259403 - DNA, 14 bp, Homo sapiens
catttaataaagaa

SEQ ID NO: 1259404 - DNA, 15 bp, Homo sapiens
catttaataaagaaa

SEQ ID NO: 1259405 - DNA, 17 bp, Homo sapiens
catttaataaagaaata

SEQ ID NO: 1259406 - DNA, 19 bp, Homo sapiens
catttaataaagaaatatt

SEQ ID NO: 1259407 - DNA, 12 bp, Homo sapiens
catttaataata

SEQ ID NO: 1259408 - DNA, 13 bp, Homo sapiens
catttaataatat

SEQ ID NO: 1259409 - DNA, 13 bp, Homo sapiens
catttaatagact

SEQ ID NO: 1259410 - DNA, 14 bp, Homo sapiens
catttaatcccagg

SEQ ID NO: 1259411 - DNA, 21 bp, Homo sapiens
catttaatggcagctagtgcc

SEQ ID NO: 1259412 - DNA, 22 bp, Homo sapiens
catttaatggggaggacaaaat

SEQ ID NO: 1259413 - DNA, 15 bp, Homo sapiens
catttacaaactgaa

SEQ ID NO: 1259414 - DNA, 19 bp, Homo sapiens
catttacaaactgaagagt

SEQ ID NO: 1259415 - DNA, 23 bp, Homo sapiens
catttacaataaatattctgcat

SEQ ID NO: 1259416 - DNA, 15 bp, Homo sapiens
catttacaggagggc

SEQ ID NO: 1259417 - DNA, 17 bp, Homo sapiens
catttacagtctctttc

SEQ ID NO: 1259418 - DNA, 20 bp, Homo sapiens
catttacagtctctttcttc

SEQ ID NO: 1259419 - DNA, 23 bp, Homo sapiens
catttacagtctctttcttcctt

SEQ ID NO: 1259420 - DNA, 23 bp, Homo sapiens
catttacatagtgcaaaactgtg

SEQ ID NO: 1259421 - DNA, 15 bp, Homo sapiens
catttacatgtcatt

SEQ ID NO: 1259422 - DNA, 15 bp, Homo sapiens
ccaaacccagaaaga

SEQ ID NO: 1259423 - DNA, 16 bp, Homo sapiens
ccaaacccagccactg

SEQ ID NO: 1259424 - DNA, 16 bp, Homo sapiens
ccaaacccatgaggca

SEQ ID NO: 1259425 - DNA, 12 bp, Homo sapiens
ccaaaccccagc

SEQ ID NO: 1259426 - DNA, 13 bp, Homo sapiens
ccaaaccccagcc

SEQ ID NO: 1259427 - DNA, 16 bp, Homo sapiens
ccaaaccccagcccca

SEQ ID NO: 1259428 - DNA, 13 bp, Homo sapiens
ccaaaccctaggt

SEQ ID NO: 1259429 - DNA, 23 bp, Homo sapiens
ccaaaccctaggttcccggtccc

SEQ ID NO: 1259430 - DNA, 15 bp, Homo sapiens
ccaaacccttaactg

SEQ ID NO: 1259431 - DNA, 17 bp, Homo sapiens
ccaaacccttgctttcc

SEQ ID NO: 1259432 - DNA, 14 bp, Homo sapiens
ccaaacctccagcc

SEQ ID NO: 1259433 - DNA, 17 bp, Homo sapiens
ccaaacctccagcctcc

SEQ ID NO: 1259434 - DNA, 18 bp, Homo sapiens
ccaaacctccagcctccc

SEQ ID NO: 1259435 - DNA, 14 bp, Homo sapiens
ccaaacctgtcttg

SEQ ID NO: 1259436 - DNA, 19 bp, Homo sapiens
ccaaaccttgggccctgga

SEQ ID NO: 1259437 - DNA, 21 bp, Homo sapiens
ccaaacgccctttcctcctca

SEQ ID NO: 1259438 - DNA, 12 bp, Homo sapiens
ccaaactcccct

SEQ ID NO: 1259439 - DNA, 13 bp, Homo sapiens
ccaaactcccctt

SEQ ID NO: 1259440 - DNA, 17 bp, Homo sapiens
ccaaactgatccagtat

SEQ ID NO: 1259441 - DNA, 15 bp, Homo sapiens
ccaaacttgttcatt

SEQ ID NO: 1259442 - DNA, 17 bp, Homo sapiens
ccaaacttgttcattta

SEQ ID NO: 1259443 - DNA, 18 bp, Homo sapiens
ccaaagaaacaagctgtg

SEQ ID NO: 1259444 - DNA, 20 bp, Homo sapiens
ccaaagaaacaagctgtgca

SEQ ID NO: 1259445 - DNA, 16 bp, Homo sapiens
ccaaagaacttgattt

SEQ ID NO: 1259446 - DNA, 21 bp, Homo sapiens
ccaaagaacttgatttgcatg

SEQ ID NO: 1259447 - DNA, 16 bp, Homo sapiens
ccaaagaaggcaggga

SEQ ID NO: 1259448 - DNA, 21 bp, Homo sapiens
ccaaagaataagtgtctttct

SEQ ID NO: 1259449 - DNA, 23 bp, Homo sapiens
ccaaagaattcctgaagccagat

SEQ ID NO: 1259450 - DNA, 16 bp, Homo sapiens
ccaaagaattggaatc

SEQ ID NO: 1259451 - DNA, 17 bp, Homo sapiens
ccaaagactgtactggc

SEQ ID NO: 1259452 - DNA, 16 bp, Homo sapiens
ccaaagagcctggaga

SEQ ID NO: 1259453 - DNA, 20 bp, Homo sapiens
ccaaagagcctggagaagct

SEQ ID NO: 1259454 - DNA, 22 bp, Homo sapiens
ccaaagagcctggagaagctga

SEQ ID NO: 1259455 - DNA, 17 bp, Homo sapiens
ccaaagagcctttccaa

SEQ ID NO: 1259456 - DNA, 22 bp, Homo sapiens
ccaaagaggctgcccctctcac

SEQ ID NO: 1259457 - DNA, 23 bp, Homo sapiens
ccaaagaggctgcccctctcacc

SEQ ID NO: 1259458 - DNA, 23 bp, Homo sapiens
ccaaagattaggtcgttttccaa

SEQ ID NO: 1259459 - DNA, 11 bp, Homo sapiens
ccaaagcaaaa

SEQ ID NO: 1259460 - DNA, 20 bp, Homo sapiens
ccaaagcaaaacatcacatt

SEQ ID NO: 1259461 - DNA, 22 bp, Homo sapiens
ccaaagcaaaacatcacattcc

SEQ ID NO: 1259462 - DNA, 14 bp, Homo sapiens
ccaaagcagacagc

SEQ ID NO: 1259463 - DNA, 13 bp, Homo sapiens
ccaaagccccatg

SEQ ID NO: 1259464 - DNA, 23 bp, Homo sapiens
ccaaagcctagacaacctttctg

SEQ ID NO: 1259465 - DNA, 19 bp, Homo sapiens
ccaaagctagggtggccct

SEQ ID NO: 1259466 - DNA, 13 bp, Homo sapiens
ccaaagctgcctg

SEQ ID NO: 1259467 - DNA, 20 bp, Homo sapiens
ccaaagctgcctgtgccatg

SEQ ID NO: 1259468 - DNA, 21 bp, Homo sapiens
ccaaagctgttggtctgtccc

SEQ ID NO: 1259469 - DNA, 12 bp, Homo sapiens
ccaaagctttat

SEQ ID NO: 1259470 - DNA, 14 bp, Homo sapiens
ccaaagctttcctg

SEQ ID NO: 1259471 - DNA, 15 bp, Homo sapiens
ccaaagctttcctgc

SEQ ID NO: 1259472 - DNA, 17 bp, Homo sapiens
ccaaaggaaatccaaaa

SEQ ID NO: 1259473 - DNA, 13 bp, Homo sapiens
ccaaaggaaggaa

SEQ ID NO: 1259474 - DNA, 15 bp, Homo sapiens
ccaaaggaaggaacg

SEQ ID NO: 1259475 - DNA, 17 bp, Homo sapiens
ccaaaggaggctggcag

SEQ ID NO: 1259476 - DNA, 21 bp, Homo sapiens
ccaaaggatgagaatgtgacc

SEQ ID NO: 1259477 - DNA, 22 bp, Homo sapiens
ccaaaggcattttattgcttga

SEQ ID NO: 1259478 - DNA, 14 bp, Homo sapiens
ccaaaggcccaggg

SEQ ID NO: 1259479 - DNA, 13 bp, Homo sapiens
ccaaaggctggtg

SEQ ID NO: 1259480 - DNA, 21 bp, Homo sapiens
ccaaaggctggtggcaagtgc

SEQ ID NO: 1259481 - DNA, 21 bp, Homo sapiens
ccaaagggaaaactcttcatt

SEQ ID NO: 1259482 - DNA, 18 bp, Homo sapiens
ccaaagggaagtgaggcc

SEQ ID NO: 1259483 - DNA, 20 bp, Homo sapiens
ccaaagggaagtgaggccca

SEQ ID NO: 1259484 - DNA, 21 bp, Homo sapiens
ccaaagggaagtgaggcccaa

SEQ ID NO: 1259485 - DNA, 20 bp, Homo sapiens
ccaaagggaatactcacatt

SEQ ID NO: 1259486 - DNA, 14 bp, Homo sapiens
ccaaaggggagcca

SEQ ID NO: 1259487 - DNA, 15 bp, Homo sapiens
ccaaaggggctgctg

SEQ ID NO: 1259488 - DNA, 16 bp, Homo sapiens
ccaaaggggctgctgg

SEQ ID NO: 1259489 - DNA, 17 bp, Homo sapiens
ccaaaggggctgctggg

SEQ ID NO: 1259490 - DNA, 15 bp, Homo sapiens
ccaaaggtgaaggaa

SEQ ID NO: 1259491 - DNA, 20 bp, Homo sapiens
ccaaaggtgaaggaatatat

SEQ ID NO: 1259492 - DNA, 15 bp, Homo sapiens
ccaaagtaccacact

SEQ ID NO: 1259493 - DNA, 18 bp, Homo sapiens
ccaaagtaccacactgag

SEQ ID NO: 1259494 - DNA, 20 bp, Homo sapiens
ccaaagtagtcctggcagct

SEQ ID NO: 1259495 - DNA, 14 bp, Homo sapiens
ccaaagtcccttcc

SEQ ID NO: 1259496 - DNA, 21 bp, Homo sapiens
ccaaagtctgccgcccacctc

SEQ ID NO: 1259497 - DNA, 20 bp, Homo sapiens
ccaaagtgcagcccttcctc

SEQ ID NO: 1259498 - DNA, 21 bp, Homo sapiens
ccaaagtgcagcccttcctcc

SEQ ID NO: 1259499 - DNA, 23 bp, Homo sapiens
ccaaagtgccactcattcctgta

SEQ ID NO: 1259500 - DNA, 15 bp, Homo sapiens
ccaaagtgcctggga

SEQ ID NO: 1259501 - DNA, 12 bp, Homo sapiens
ccaaagtgctgg

SEQ ID NO: 1259502 - DNA, 22 bp, Homo sapiens
ccaaagtgctgggattacaggc

SEQ ID NO: 1259503 - DNA, 18 bp, Homo sapiens
ccaaagtggagctgggag

SEQ ID NO: 1259504 - DNA, 19 bp, Homo sapiens
ccaaagtgtcttttgacat

SEQ ID NO: 1259505 - DNA, 16 bp, Homo sapiens
ccaaagttcaacttgg

SEQ ID NO: 1259506 - DNA, 19 bp, Homo sapiens
ccaaagttgttgtaacctg

SEQ ID NO: 1259507 - DNA, 23 bp, Homo sapiens
ccaaagttgttgtaacctgctgt

SEQ ID NO: 1259508 - DNA, 14 bp, Homo sapiens
ccaaataaaaaaca

SEQ ID NO: 1259509 - DNA, 19 bp, Homo sapiens
ccaaataaatcatcctcat

SEQ ID NO: 1259510 - DNA, 17 bp, Homo sapiens
ccaaatacccaaatgtc

SEQ ID NO: 1259511 - DNA, 19 bp, Homo sapiens
ccaaatagccccagactgg

SEQ ID NO: 1259512 - DNA, 23 bp, Homo sapiens
ccaaatagccccagactgggccc

SEQ ID NO: 1259513 - DNA, 15 bp, Homo sapiens
ccaaatataagacat

SEQ ID NO: 1259514 - DNA, 23 bp, Homo sapiens
ccaaatatgcactttccctagaa

SEQ ID NO: 1259515 - DNA, 18 bp, Homo sapiens
ccaaatattaaagattct

SEQ ID NO: 1259516 - DNA, 20 bp, Homo sapiens
ccaaatattattcaagtgcc

SEQ ID NO: 1259517 - DNA, 11 bp, Homo sapiens
ccaaatatttt

SEQ ID NO: 1259518 - DNA, 15 bp, Homo sapiens
ccaaatcatcctgaa

SEQ ID NO: 1259519 - DNA, 16 bp, Homo sapiens
ccaaatcatcctgaat

SEQ ID NO: 1259520 - DNA, 17 bp, Homo sapiens
ccaaatccacaagccat

SEQ ID NO: 1259521 - DNA, 15 bp, Homo sapiens
ccaaatcccagggaa

SEQ ID NO: 1259522 - DNA, 16 bp, Homo sapiens
ccaaatcccagggaag

SEQ ID NO: 1259523 - DNA, 15 bp, Homo sapiens
ccaaatccgctctct

SEQ ID NO: 1259524 - DNA, 16 bp, Homo sapiens
ccaaatccgctctctt

SEQ ID NO: 1259525 - DNA, 18 bp, Homo sapiens
ccaaatccgctctcttcc

SEQ ID NO: 1259526 - DNA, 19 bp, Homo sapiens
ccaaatccgctctcttcct

SEQ ID NO: 1259527 - DNA, 22 bp, Homo sapiens
ccaaatccgctctcttcctgcc

SEQ ID NO: 1259528 - DNA, 15 bp, Homo sapiens
ccaaatcctggaagg

SEQ ID NO: 1259529 - DNA, 21 bp, Homo sapiens
ccaaatcctggaaggacacag

SEQ ID NO: 1259530 - DNA, 20 bp, Homo sapiens
ccaaatctagccagagccct

SEQ ID NO: 1259531 - DNA, 22 bp, Homo sapiens
ccaaatctcaatgaagccagct

SEQ ID NO: 1259532 - DNA, 15 bp, Homo sapiens
ccaaatctcagttgt

SEQ ID NO: 1259533 - DNA, 22 bp, Homo sapiens
ccaaatgcctgttgtatttatg

SEQ ID NO: 1259534 - DNA, 20 bp, Homo sapiens
ccaaatggagaagctgcagg

SEQ ID NO: 1259535 - DNA, 16 bp, Homo sapiens
ccaaatggctgctttg

SEQ ID NO: 1259536 - DNA, 18 bp, Homo sapiens
ccaaatggctgctttgac

SEQ ID NO: 1259537 - DNA, 23 bp, Homo sapiens
ccaaatggttcttacttttcctg

SEQ ID NO: 1259538 - DNA, 22 bp, Homo sapiens
ccaaatgtcggggttggggtgg

SEQ ID NO: 1259539 - DNA, 23 bp, Homo sapiens
ccaaatgtcggggttggggtggg

SEQ ID NO: 1259540 - DNA, 19 bp, Homo sapiens
ccaaatgtgccatactaat

SEQ ID NO: 1259541 - DNA, 17 bp, Homo sapiens
ccaaatgtgtacacctg

SEQ ID NO: 1259542 - DNA, 15 bp, Homo sapiens
ccaaatgttaactgc

SEQ ID NO: 1259543 - DNA, 17 bp, Homo sapiens
ccaaggaatcagcagga

SEQ ID NO: 1259544 - DNA, 18 bp, Homo sapiens
ccaaggaatgtgtccaag

SEQ ID NO: 1259545 - DNA, 23 bp, Homo sapiens
ccaaggacatgagtctgtaggag

SEQ ID NO: 1259546 - DNA, 18 bp, Homo sapiens
ccaaggacccctcacctt

SEQ ID NO: 1259547 - DNA, 22 bp, Homo sapiens
ccaaggactgagcaccctctgg

SEQ ID NO: 1259548 - DNA, 15 bp, Homo sapiens
ccaaggactgagggc

SEQ ID NO: 1259549 - DNA, 17 bp, Homo sapiens
ccaaggactgagggcag

SEQ ID NO: 1259550 - DNA, 18 bp, Homo sapiens
ccaaggagaaacagagac

SEQ ID NO: 1259551 - DNA, 19 bp, Homo sapiens
ccaaggagaaacagagaca

SEQ ID NO: 1259552 - DNA, 21 bp, Homo sapiens
ccaaggagaccaagtcctggc

SEQ ID NO: 1259553 - DNA, 12 bp, Homo sapiens
ccaaggagcaca

SEQ ID NO: 1259554 - DNA, 17 bp, Homo sapiens
ccaaggagcacaggtcc

SEQ ID NO: 1259555 - DNA, 13 bp, Homo sapiens
ccaaggagcagag

SEQ ID NO: 1259556 - DNA, 16 bp, Homo sapiens
ccaaggagctgctata

SEQ ID NO: 1259557 - DNA, 22 bp, Homo sapiens
ccaaggagctgctatagcctgg

SEQ ID NO: 1259558 - DNA, 19 bp, Homo sapiens
ccaaggagcttacccaagc

SEQ ID NO: 1259559 - DNA, 13 bp, Homo sapiens
ccaaggaggcctg

SEQ ID NO: 1259560 - DNA, 20 bp, Homo sapiens
ccaaggagggtgagtgcaag

SEQ ID NO: 1259561 - DNA, 22 bp, Homo sapiens
ccaaggagtcactgagaccaag

SEQ ID NO: 1259562 - DNA, 11 bp, Homo sapiens
ccaaggatccc

SEQ ID NO: 1259563 - DNA, 23 bp, Homo sapiens
ccaaggatcggactctgcccctg

SEQ ID NO: 1259564 - DNA, 18 bp, Homo sapiens
ccaaggatgccccgtccc

SEQ ID NO: 1259565 - DNA, 22 bp, Homo sapiens
ccaaggcaaggcaggtgcctcc

SEQ ID NO: 1259566 - DNA, 22 bp, Homo sapiens
ccaaggcagaggcctgggctgg

SEQ ID NO: 1259567 - DNA, 18 bp, Homo sapiens
ccaaggcagcctccagag

SEQ ID NO: 1259568 - DNA, 23 bp, Homo sapiens
ccaaggcagcctccagagccagc

SEQ ID NO: 1259569 - DNA, 21 bp, Homo sapiens
ccaaggcagctcttctggagt

SEQ ID NO: 1259570 - DNA, 11 bp, Homo sapiens
ccaaggcaggt

SEQ ID NO: 1259571 - DNA, 16 bp, Homo sapiens
ccaaggcagtgcatgc

SEQ ID NO: 1259572 - DNA, 17 bp, Homo sapiens
ccaaggcagtgcatgca

SEQ ID NO: 1259573 - DNA, 18 bp, Homo sapiens
ccaaggccagagtggcct

SEQ ID NO: 1259574 - DNA, 19 bp, Homo sapiens
ccaaggccagagtggcctg

SEQ ID NO: 1259575 - DNA, 13 bp, Homo sapiens
ccaaggccaggtt

SEQ ID NO: 1259576 - DNA, 11 bp, Homo sapiens
ccaaggccagt

SEQ ID NO: 1259577 - DNA, 19 bp, Homo sapiens
ccaaggccccagggacaga

SEQ ID NO: 1259578 - DNA, 17 bp, Homo sapiens
ccaaggccgaagctctg

SEQ ID NO: 1259579 - DNA, 23 bp, Homo sapiens
ccaaggccgccagcgtgtggagc

SEQ ID NO: 1259580 - DNA, 16 bp, Homo sapiens
ccaaggccgcggccca

SEQ ID NO: 1259581 - DNA, 17 bp, Homo sapiens
ccaaggccgcggcccag

SEQ ID NO: 1259582 - DNA, 16 bp, Homo sapiens
ccaaggccttctcctc

SEQ ID NO: 1259583 - DNA, 23 bp, Homo sapiens
ccaaggcgtccgcgcgccagcac

SEQ ID NO: 1259584 - DNA, 16 bp, Homo sapiens
ccaaggctcactgcag

SEQ ID NO: 1259585 - DNA, 15 bp, Homo sapiens
ccaaggctctcccct

SEQ ID NO: 1259586 - DNA, 16 bp, Homo sapiens
ccaaggctctcccctc

SEQ ID NO: 1259587 - DNA, 14 bp, Homo sapiens
ccaaggctggggga

SEQ ID NO: 1259588 - DNA, 22 bp, Homo sapiens
ccaagggaaaggggtgctttta

SEQ ID NO: 1259589 - DNA, 16 bp, Homo sapiens
ccaagggacagcaagt

SEQ ID NO: 1259590 - DNA, 23 bp, Homo sapiens
ccaagggacagcaagtgagcaga

SEQ ID NO: 1259591 - DNA, 19 bp, Homo sapiens
ccaagggacaggtgggcct

SEQ ID NO: 1259592 - DNA, 21 bp, Homo sapiens
ccaagggacaggtgggcctgg

SEQ ID NO: 1259593 - DNA, 22 bp, Homo sapiens
ccaagggacaggtgggcctggc

SEQ ID NO: 1259594 - DNA, 14 bp, Homo sapiens
ccaagggagggaag

SEQ ID NO: 1259595 - DNA, 16 bp, Homo sapiens
ccaagggagggaaggg

SEQ ID NO: 1259596 - DNA, 22 bp, Homo sapiens
ccaagggagggaagggccaccc

SEQ ID NO: 1259597 - DNA, 23 bp, Homo sapiens
ccaagggagggtgcagccctctt

SEQ ID NO: 1259598 - DNA, 24 bp, Homo sapiens
ccaagggagttaggctattcacaa

SEQ ID NO: 1259599 - DNA, 13 bp, Homo sapiens
ccaagggatctgg

SEQ ID NO: 1259600 - DNA, 18 bp, Homo sapiens
ccaagggccccaggggca

SEQ ID NO: 1259601 - DNA, 18 bp, Homo sapiens
ccaagggccgactaagag

SEQ ID NO: 1259602 - DNA, 19 bp, Homo sapiens
ccaagggcctcccaccaga

SEQ ID NO: 1259603 - DNA, 20 bp, Homo sapiens
ccaagggcctcccaccagag

SEQ ID NO: 1259604 - DNA, 22 bp, Homo sapiens
ccaagggcctcccaccagagac

SEQ ID NO: 1259605 - DNA, 23 bp, Homo sapiens
ccaagggcttctgcaccctccac

SEQ ID NO: 1259606 - DNA, 21 bp, Homo sapiens
ccaagggctttgttttgcaca

SEQ ID NO: 1259607 - DNA, 22 bp, Homo sapiens
ccaaggggatttttatgtctgg

SEQ ID NO: 1259608 - DNA, 20 bp, Homo sapiens
ccaaggggctgcgctagcag

SEQ ID NO: 1259609 - DNA, 22 bp, Homo sapiens
ccaaggggctgcgctagcagcc

SEQ ID NO: 1259610 - DNA, 23 bp, Homo sapiens
ccaaggggctgcgctagcagccc

SEQ ID NO: 1259611 - DNA, 22 bp, Homo sapiens
ccaagggggcggggactgctgg

SEQ ID NO: 1259612 - DNA, 21 bp, Homo sapiens
ccaaggggtgggcctgtgaat

SEQ ID NO: 1259613 - DNA, 23 bp, Homo sapiens
ccaagggttcagagactcagggc

SEQ ID NO: 1259614 - DNA, 18 bp, Homo sapiens
ccaagggttgagagccag

SEQ ID NO: 1259615 - DNA, 21 bp, Homo sapiens
ccaagggtttcgactggtcca

SEQ ID NO: 1259616 - DNA, 14 bp, Homo sapiens
ccaaggtcccctcc

SEQ ID NO: 1259617 - DNA, 15 bp, Homo sapiens
ccaaggtcccctcca

SEQ ID NO: 1259618 - DNA, 23 bp, Homo sapiens
ccaaggtcccctccacatcccag

SEQ ID NO: 1259619 - DNA, 16 bp, Homo sapiens
ccaaggtcctgctcaa

SEQ ID NO: 1259620 - DNA, 19 bp, Homo sapiens
ccaaggtggagggaaggat

SEQ ID NO: 1259621 - DNA, 17 bp, Homo sapiens
ccaaggtggcagatgtc

SEQ ID NO: 1259622 - DNA, 18 bp, Homo sapiens
ccaaggtgggaggattgc

SEQ ID NO: 1259623 - DNA, 20 bp, Homo sapiens
ccaaggtgggtagatcacga

SEQ ID NO: 1259624 - DNA, 13 bp, Homo sapiens
ccaaggttccaga

SEQ ID NO: 1259625 - DNA, 18 bp, Homo sapiens
ccaaggtttataaagcag

SEQ ID NO: 1259626 - DNA, 20 bp, Homo sapiens
ccaaggttttataaggctga

SEQ ID NO: 1259627 - DNA, 21 bp, Homo sapiens
ccaaggttttataaggctgat

SEQ ID NO: 1259628 - DNA, 16 bp, Homo sapiens
ccaagtaaaatgtttt

SEQ ID NO: 1259629 - DNA, 20 bp, Homo sapiens
ccaagtaaccaggccccagc

SEQ ID NO: 1259630 - DNA, 21 bp, Homo sapiens
ccaagtaaccaggccccagcc

SEQ ID NO: 1259631 - DNA, 20 bp, Homo sapiens
ccaagtaactgggattacag

SEQ ID NO: 1259632 - DNA, 14 bp, Homo sapiens
ccaagtagctggga

SEQ ID NO: 1259633 - DNA, 15 bp, Homo sapiens
ccaagtagctgggat

SEQ ID NO: 1259634 - DNA, 21 bp, Homo sapiens
ccaagtatgaagtataaatct

SEQ ID NO: 1259635 - DNA, 13 bp, Homo sapiens
ccaagtatgcctt

SEQ ID NO: 1259636 - DNA, 17 bp, Homo sapiens
ccaagtcaacactcttc

SEQ ID NO: 1259637 - DNA, 13 bp, Homo sapiens
ccaagtcaggcca

SEQ ID NO: 1259638 - DNA, 14 bp, Homo sapiens
ccaagtcaggccag

SEQ ID NO: 1259639 - DNA, 18 bp, Homo sapiens
ccaagtccaacctgcctg

SEQ ID NO: 1259640 - DNA, 20 bp, Homo sapiens
ccaagtccaacctgcctgtg

SEQ ID NO: 1259641 - DNA, 15 bp, Homo sapiens
ccaagtccactgtcc

SEQ ID NO: 1259642 - DNA, 18 bp, Homo sapiens
ccaagtccactgtcctcc

SEQ ID NO: 1259643 - DNA, 18 bp, Homo sapiens
ccaagtcctccctctcta

SEQ ID NO: 1259644 - DNA, 20 bp, Homo sapiens
ccaagtcctgaagaggcggg

SEQ ID NO: 1259645 - DNA, 22 bp, Homo sapiens
ccaagtcctggctacatcccag

SEQ ID NO: 1259646 - DNA, 17 bp, Homo sapiens
ccaagtctctctgtgaa

SEQ ID NO: 1259647 - DNA, 21 bp, Homo sapiens
ccaagtctctctgtgaataca

SEQ ID NO: 1259648 - DNA, 13 bp, Homo sapiens
ccaagtcttctcc

SEQ ID NO: 1259649 - DNA, 20 bp, Homo sapiens
ccaagtgaaggttcccaagg

SEQ ID NO: 1259650 - DNA, 23 bp, Homo sapiens
ccaagtgaccagggaagtgtgtg

SEQ ID NO: 1259651 - DNA, 23 bp, Homo sapiens
ccaagtgatccttccacctcagt

SEQ ID NO: 1259652 - DNA, 17 bp, Homo sapiens
ccaagtgcactttctaa

SEQ ID NO: 1259653 - DNA, 14 bp, Homo sapiens
ccaagtgcaggctg

SEQ ID NO: 1259654 - DNA, 16 bp, Homo sapiens
ccaagtgccagaggtg

SEQ ID NO: 1259655 - DNA, 22 bp, Homo sapiens
ccaagtgccagaggtgggcagg

SEQ ID NO: 1259656 - DNA, 23 bp, Homo sapiens
ccaagtgccagaggtgggcaggt

SEQ ID NO: 1259657 - DNA, 13 bp, Homo sapiens
ccaagtgcctcac

SEQ ID NO: 1259658 - DNA, 19 bp, Homo sapiens
ccaagtgcctgcttttgat

SEQ ID NO: 1259659 - DNA, 16 bp, Homo sapiens
ccaagtggacagtctg

SEQ ID NO: 1259660 - DNA, 13 bp, Homo sapiens
ccaagtggctccc

SEQ ID NO: 1259661 - DNA, 16 bp, Homo sapiens
ccaagtggctcccaca

SEQ ID NO: 1259662 - DNA, 20 bp, Homo sapiens
ccaagtggctgggtgccctc

SEQ ID NO: 1259663 - DNA, 18 bp, Homo sapiens
ccacagccggtcagagga

SEQ ID NO: 1259664 - DNA, 16 bp, Homo sapiens
ccacagcctcccctgc

SEQ ID NO: 1259665 - DNA, 17 bp, Homo sapiens
ccacagcctgctggcag

SEQ ID NO: 1259666 - DNA, 23 bp, Homo sapiens
ccacagcctgctggcagggccag

SEQ ID NO: 1259667 - DNA, 19 bp, Homo sapiens
ccacagcgagggcagctgc

SEQ ID NO: 1259668 - DNA, 18 bp, Homo sapiens
ccacagcgccagcctcag

SEQ ID NO: 1259669 - DNA, 23 bp, Homo sapiens
ccacagcgccagcctcagactgg

SEQ ID NO: 1259670 - DNA, 15 bp, Homo sapiens
ccacagcgtccctgg

SEQ ID NO: 1259671 - DNA, 16 bp, Homo sapiens
ccacagcgtccctggc

SEQ ID NO: 1259672 - DNA, 21 bp, Homo sapiens
ccacagcgtgctggcgacact

SEQ ID NO: 1259673 - DNA, 14 bp, Homo sapiens
ccacagctcaactc

SEQ ID NO: 1259674 - DNA, 19 bp, Homo sapiens
ccacagctcccaccccacc

SEQ ID NO: 1259675 - DNA, 15 bp, Homo sapiens
ccacagctctgggcc

SEQ ID NO: 1259676 - DNA, 18 bp, Homo sapiens
ccacagctctgggcctct

SEQ ID NO: 1259677 - DNA, 19 bp, Homo sapiens
ccacagctctgggcctctt

SEQ ID NO: 1259678 - DNA, 14 bp, Homo sapiens
ccacagctgcagct

SEQ ID NO: 1259679 - DNA, 20 bp, Homo sapiens
ccacagctgcagctgatcca

SEQ ID NO: 1259680 - DNA, 13 bp, Homo sapiens
ccacagctgctgt

SEQ ID NO: 1259681 - DNA, 14 bp, Homo sapiens
ccacagctgctgtt

SEQ ID NO: 1259682 - DNA, 20 bp, Homo sapiens
ccacagctgctgttctcagg

SEQ ID NO: 1259683 - DNA, 15 bp, Homo sapiens
ccacagctttgcacc

SEQ ID NO: 1259684 - DNA, 13 bp, Homo sapiens
ccacagcttttgc

SEQ ID NO: 1259685 - DNA, 20 bp, Homo sapiens
ccacaggaacaacagcatct

SEQ ID NO: 1259686 - DNA, 16 bp, Homo sapiens
ccacaggaacggccct

SEQ ID NO: 1259687 - DNA, 17 bp, Homo sapiens
ccacaggaacggccctg

SEQ ID NO: 1259688 - DNA, 19 bp, Homo sapiens
ccacaggaacggccctgca

SEQ ID NO: 1259689 - DNA, 21 bp, Homo sapiens
ccacaggaacggccctgcagg

SEQ ID NO: 1259690 - DNA, 19 bp, Homo sapiens
ccacaggaagcctgcagtc

SEQ ID NO: 1259691 - DNA, 23 bp, Homo sapiens
ccacaggaagcctgcagtcctgg

SEQ ID NO: 1259692 - DNA, 23 bp, Homo sapiens
ccacaggactgagccctctcact

SEQ ID NO: 1259693 - DNA, 20 bp, Homo sapiens
ccacaggagtgggaaaacac

SEQ ID NO: 1259694 - DNA, 20 bp, Homo sapiens
ccacaggagttgtgagccct

SEQ ID NO: 1259695 - DNA, 19 bp, Homo sapiens
ccacaggcacacaggtctc

SEQ ID NO: 1259696 - DNA, 19 bp, Homo sapiens
ccacaggcaggggtgagag

SEQ ID NO: 1259697 - DNA, 15 bp, Homo sapiens
ccacaggcagtccag

SEQ ID NO: 1259698 - DNA, 15 bp, Homo sapiens
ccacaggcccttcct

SEQ ID NO: 1259699 - DNA, 18 bp, Homo sapiens
ccacaggcccttcctctc

SEQ ID NO: 1259700 - DNA, 19 bp, Homo sapiens
ccacaggcccttcctctcc

SEQ ID NO: 1259701 - DNA, 23 bp, Homo sapiens
ccacaggcccttcctctccactg

SEQ ID NO: 1259702 - DNA, 15 bp, Homo sapiens
ccacaggcttaggga

SEQ ID NO: 1259703 - DNA, 19 bp, Homo sapiens
ccacaggcttagggacagg

SEQ ID NO: 1259704 - DNA, 18 bp, Homo sapiens
ccacagggcttgttttcc

SEQ ID NO: 1259705 - DNA, 19 bp, Homo sapiens
ccacagggcttgttttcca

SEQ ID NO: 1259706 - DNA, 14 bp, Homo sapiens
ccacaggggcaggc

SEQ ID NO: 1259707 - DNA, 18 bp, Homo sapiens
ccacaggggcaggcctgg

SEQ ID NO: 1259708 - DNA, 22 bp, Homo sapiens
ccacaggggcaggcctgggacc

SEQ ID NO: 1259709 - DNA, 16 bp, Homo sapiens
ccacaggggccaccac

SEQ ID NO: 1259710 - DNA, 18 bp, Homo sapiens
ccacagggttcaaaatgt

SEQ ID NO: 1259711 - DNA, 21 bp, Homo sapiens
ccacaggtgcgggaccatctg

SEQ ID NO: 1259712 - DNA, 22 bp, Homo sapiens
ccacaggtttccccaaggcctc

SEQ ID NO: 1259713 - DNA, 16 bp, Homo sapiens
ccacagtaagttccta

SEQ ID NO: 1259714 - DNA, 20 bp, Homo sapiens
ccacagtcccccacccacct

SEQ ID NO: 1259715 - DNA, 14 bp, Homo sapiens
ccacagtgaaagtt

SEQ ID NO: 1259716 - DNA, 18 bp, Homo sapiens
ccacagtggggctgcagg

SEQ ID NO: 1259717 - DNA, 14 bp, Homo sapiens
ccacagtgggtggc

SEQ ID NO: 1259718 - DNA, 12 bp, Homo sapiens
ccacagtgtctg

SEQ ID NO: 1259719 - DNA, 12 bp, Homo sapiens
ccacagttaatt

SEQ ID NO: 1259720 - DNA, 17 bp, Homo sapiens
ccacataatttttgtac

SEQ ID NO: 1259721 - DNA, 16 bp, Homo sapiens
ccacatcattctgtgt

SEQ ID NO: 1259722 - DNA, 18 bp, Homo sapiens
ccacatccaactccagca

SEQ ID NO: 1259723 - DNA, 20 bp, Homo sapiens
ccacatccacacacgcagga

SEQ ID NO: 1259724 - DNA, 22 bp, Homo sapiens
ccacatccacacacgcaggaac

SEQ ID NO: 1259725 - DNA, 14 bp, Homo sapiens
ccacatcccactgg

SEQ ID NO: 1259726 - DNA, 20 bp, Homo sapiens
ccacatcccactggatctgg

SEQ ID NO: 1259727 - DNA, 12 bp, Homo sapiens
ccacatcccagg

SEQ ID NO: 1259728 - DNA, 13 bp, Homo sapiens
ccacatcccaggc

SEQ ID NO: 1259729 - DNA, 18 bp, Homo sapiens
ccacatcccaggcttcac

SEQ ID NO: 1259730 - DNA, 16 bp, Homo sapiens
ccacatccccagagcc

SEQ ID NO: 1259731 - DNA, 18 bp, Homo sapiens
ccacatccccagagccca

SEQ ID NO: 1259732 - DNA, 19 bp, Homo sapiens
ccacatccccagagcccag

SEQ ID NO: 1259733 - DNA, 23 bp, Homo sapiens
ccacatccccagagcccagctct

SEQ ID NO: 1259734 - DNA, 17 bp, Homo sapiens
ccacatccctttgaaac

SEQ ID NO: 1259735 - DNA, 15 bp, Homo sapiens
ccacatccttctcac

SEQ ID NO: 1259736 - DNA, 15 bp, Homo sapiens
ccacatctaagcctg

SEQ ID NO: 1259737 - DNA, 12 bp, Homo sapiens
ccacatctgcct

SEQ ID NO: 1259738 - DNA, 13 bp, Homo sapiens
ccacatctgcctc

SEQ ID NO: 1259739 - DNA, 14 bp, Homo sapiens
ccacatctgcctta

SEQ ID NO: 1259740 - DNA, 22 bp, Homo sapiens
ccacatctgccttaaaaccaaa

SEQ ID NO: 1259741 - DNA, 23 bp, Homo sapiens
ccacatctgccttaaaaccaaag

SEQ ID NO: 1259742 - DNA, 13 bp, Homo sapiens
ccacatctgctct

SEQ ID NO: 1259743 - DNA, 22 bp, Homo sapiens
ccacatctgtcctcaccctgtg

SEQ ID NO: 1259744 - DNA, 23 bp, Homo sapiens
ccacatctgtcctcaccctgtgg

SEQ ID NO: 1259745 - DNA, 14 bp, Homo sapiens
ccacatcttgctct

SEQ ID NO: 1259746 - DNA, 18 bp, Homo sapiens
ccacatcttgctctgcat

SEQ ID NO: 1259747 - DNA, 20 bp, Homo sapiens
ccacatgaggccatctcagg

SEQ ID NO: 1259748 - DNA, 22 bp, Homo sapiens
ccacatgcctgcgcctgctgcc

SEQ ID NO: 1259749 - DNA, 16 bp, Homo sapiens
ccacatgctgcctggc

SEQ ID NO: 1259750 - DNA, 17 bp, Homo sapiens
ccacatgctgcctggca

SEQ ID NO: 1259751 - DNA, 22 bp, Homo sapiens
ccacatgctgcctggcacagac

SEQ ID NO: 1259752 - DNA, 16 bp, Homo sapiens
ccacatggagccccct

SEQ ID NO: 1259753 - DNA, 15 bp, Homo sapiens
ccacatgggctgggg

SEQ ID NO: 1259754 - DNA, 12 bp, Homo sapiens
ccacatgtccca

SEQ ID NO: 1259755 - DNA, 22 bp, Homo sapiens
ccacatgttactggataaattg

SEQ ID NO: 1259756 - DNA, 21 bp, Homo sapiens
ccacatgttctaggtttcagc

SEQ ID NO: 1259757 - DNA, 20 bp, Homo sapiens
ccacattaaagaagacctga

SEQ ID NO: 1259758 - DNA, 15 bp, Homo sapiens
ccacattgatttttc

SEQ ID NO: 1259759 - DNA, 16 bp, Homo sapiens
ccacattgatttttct

SEQ ID NO: 1259760 - DNA, 12 bp, Homo sapiens
ccacatttgatg

SEQ ID NO: 1259761 - DNA, 13 bp, Homo sapiens
ccacatttggaat

SEQ ID NO: 1259762 - DNA, 19 bp, Homo sapiens
ccacatttggaatactttt

SEQ ID NO: 1259763 - DNA, 12 bp, Homo sapiens
ccaccaaagctg

SEQ ID NO: 1259764 - DNA, 13 bp, Homo sapiens
ccaccaaagctgc

SEQ ID NO: 1259765 - DNA, 12 bp, Homo sapiens
ccaccaacccat

SEQ ID NO: 1259766 - DNA, 15 bp, Homo sapiens
ccaccaaccctcaga

SEQ ID NO: 1259767 - DNA, 15 bp, Homo sapiens
ccaccaactctgcac

SEQ ID NO: 1259768 - DNA, 17 bp, Homo sapiens
ccaccaactctgcactc

SEQ ID NO: 1259769 - DNA, 17 bp, Homo sapiens
ccaccaagagggacgcc

SEQ ID NO: 1259770 - DNA, 21 bp, Homo sapiens
ccaccaagagggacgcctggg

SEQ ID NO: 1259771 - DNA, 19 bp, Homo sapiens
ccaccaaggggctcttgaa

SEQ ID NO: 1259772 - DNA, 15 bp, Homo sapiens
ccaccaatctgccct

SEQ ID NO: 1259773 - DNA, 16 bp, Homo sapiens
ccaccaatctgccctt

SEQ ID NO: 1259774 - DNA, 17 bp, Homo sapiens
ccaccacaccgcagaag

SEQ ID NO: 1259775 - DNA, 18 bp, Homo sapiens
ccaccacagccagcacct

SEQ ID NO: 1259776 - DNA, 15 bp, Homo sapiens
ccaccacatctgcca

SEQ ID NO: 1259777 - DNA, 13 bp, Homo sapiens
ccaccacccaacc

SEQ ID NO: 1259778 - DNA, 12 bp, Homo sapiens
ccaccaccccat

SEQ ID NO: 1259779 - DNA, 21 bp, Homo sapiens
ccaccacctaggccactcctc

SEQ ID NO: 1259780 - DNA, 22 bp, Homo sapiens
ccaccacctaggccactcctcc

SEQ ID NO: 1259781 - DNA, 17 bp, Homo sapiens
ccaccacctccctcacc

SEQ ID NO: 1259782 - DNA, 15 bp, Homo sapiens
ccaccacctctgtgg

SEQ ID NO: 1259783 - DNA, 19 bp, Homo sapiens
ccaccacctgacggctggg

SEQ ID NO: 1259784 - DNA, 17 bp, Homo sapiens
ccaccacgcatgctcag

SEQ ID NO: 1259785 - DNA, 17 bp, Homo sapiens
ccacgccccagcccgac

SEQ ID NO: 1259786 - DNA, 19 bp, Homo sapiens
ccacgcccgactagcaggc

SEQ ID NO: 1259787 - DNA, 20 bp, Homo sapiens
ccacgcccgactagcaggca

SEQ ID NO: 1259788 - DNA, 20 bp, Homo sapiens
ccacgcccggctaatgtttg

SEQ ID NO: 1259789 - DNA, 20 bp, Homo sapiens
ccacgcccgtcctgcctgtg

SEQ ID NO: 1259790 - DNA, 21 bp, Homo sapiens
ccacgcccgtcctgcctgtgg

SEQ ID NO: 1259791 - DNA, 23 bp, Homo sapiens
ccacgcccgtcctgcctgtggcg

SEQ ID NO: 1259792 - DNA, 14 bp, Homo sapiens
ccacgccgccctcc

SEQ ID NO: 1259793 - DNA, 18 bp, Homo sapiens
ccacgccggcctctgctg

SEQ ID NO: 1259794 - DNA, 23 bp, Homo sapiens
ccacgcctatgccctgcccttcc

SEQ ID NO: 1259795 - DNA, 15 bp, Homo sapiens
ccacgcctcctggcc

SEQ ID NO: 1259796 - DNA, 19 bp, Homo sapiens
ccacgcctcctggccagac

SEQ ID NO: 1259797 - DNA, 19 bp, Homo sapiens
ccacgcctcttgaccaggc

SEQ ID NO: 1259798 - DNA, 20 bp, Homo sapiens
ccacgcctgtcctcctggaa

SEQ ID NO: 1259799 - DNA, 21 bp, Homo sapiens
ccacgcctgtcctcctggaag

SEQ ID NO: 1259800 - DNA, 12 bp, Homo sapiens
ccacgctcctgc

SEQ ID NO: 1259801 - DNA, 16 bp, Homo sapiens
ccacgctcctgccctc

SEQ ID NO: 1259802 - DNA, 17 bp, Homo sapiens
ccacgctgtggccctgg

SEQ ID NO: 1259803 - DNA, 13 bp, Homo sapiens
ccacggaaacaga

SEQ ID NO: 1259804 - DNA, 17 bp, Homo sapiens
ccacggaaacagaactc

SEQ ID NO: 1259805 - DNA, 12 bp, Homo sapiens
ccacggaccccc

SEQ ID NO: 1259806 - DNA, 14 bp, Homo sapiens
ccacggagggaggc

SEQ ID NO: 1259807 - DNA, 17 bp, Homo sapiens
ccacggagggaggcacc

SEQ ID NO: 1259808 - DNA, 21 bp, Homo sapiens
ccacggagggaggcaccatgc

SEQ ID NO: 1259809 - DNA, 16 bp, Homo sapiens
ccacggccaccactgc

SEQ ID NO: 1259810 - DNA, 22 bp, Homo sapiens
ccacggccaccctccttcccgc

SEQ ID NO: 1259811 - DNA, 18 bp, Homo sapiens
ccacgggaagtttagaga

SEQ ID NO: 1259812 - DNA, 19 bp, Homo sapiens
ccacggtccgcggcctgca

SEQ ID NO: 1259813 - DNA, 18 bp, Homo sapiens
ccacggtctgagctagct

SEQ ID NO: 1259814 - DNA, 17 bp, Homo sapiens
ccacggtctgttcttga

SEQ ID NO: 1259815 - DNA, 16 bp, Homo sapiens
ccacggtgcgtggctg

SEQ ID NO: 1259816 - DNA, 17 bp, Homo sapiens
ccacggtgcgtggctgt

SEQ ID NO: 1259817 - DNA, 19 bp, Homo sapiens
ccacggtgcgtggctgtgg

SEQ ID NO: 1259818 - DNA, 17 bp, Homo sapiens
ccacgtagggggctctg

SEQ ID NO: 1259819 - DNA, 14 bp, Homo sapiens
ccacgtcccagcat

SEQ ID NO: 1259820 - DNA, 15 bp, Homo sapiens
ccacgtcccagcatc

SEQ ID NO: 1259821 - DNA, 22 bp, Homo sapiens
ccacgtcctccaagctcacgac

SEQ ID NO: 1259822 - DNA, 21 bp, Homo sapiens
ccacgtcctcgaattctcaga

SEQ ID NO: 1259823 - DNA, 17 bp, Homo sapiens
ccacgtctgccaggccc

SEQ ID NO: 1259824 - DNA, 17 bp, Homo sapiens
ccacgtctggccaggca

SEQ ID NO: 1259825 - DNA, 18 bp, Homo sapiens
ccacgtctggccaggcac

SEQ ID NO: 1259826 - DNA, 14 bp, Homo sapiens
ccacgtctttcctg

SEQ ID NO: 1259827 - DNA, 17 bp, Homo sapiens
ccacgtctttcctgcta

SEQ ID NO: 1259828 - DNA, 20 bp, Homo sapiens
ccacgtgagagaatctgcct

SEQ ID NO: 1259829 - DNA, 23 bp, Homo sapiens
ccacgtgatttccagtgagtgta

SEQ ID NO: 1259830 - DNA, 14 bp, Homo sapiens
ccacgtgccaggcc

SEQ ID NO: 1259831 - DNA, 16 bp, Homo sapiens
ccacgtgccaggcccg

SEQ ID NO: 1259832 - DNA, 23 bp, Homo sapiens
ccacgtgccaggcccggggctgg

SEQ ID NO: 1259833 - DNA, 16 bp, Homo sapiens
ccacgtggggctcact

SEQ ID NO: 1259834 - DNA, 23 bp, Homo sapiens
ccacgtgtatagtatctgtatat

SEQ ID NO: 1259835 - DNA, 12 bp, Homo sapiens
ccacgtgtccgt

SEQ ID NO: 1259836 - DNA, 20 bp, Homo sapiens
ccacgtgtccgtccaccctt

SEQ ID NO: 1259837 - DNA, 23 bp, Homo sapiens
ccacgtgtccgtccacccttcca

SEQ ID NO: 1259838 - DNA, 17 bp, Homo sapiens
ccacgtgtgctgtggcc

SEQ ID NO: 1259839 - DNA, 21 bp, Homo sapiens
ccacgtgtggcctccgtcctg

SEQ ID NO: 1259840 - DNA, 15 bp, Homo sapiens
ccacgttcagggagg

SEQ ID NO: 1259841 - DNA, 16 bp, Homo sapiens
ccacgttccacagttg

SEQ ID NO: 1259842 - DNA, 22 bp, Homo sapiens
ccactaaaagatcgcagtttgc

SEQ ID NO: 1259843 - DNA, 14 bp, Homo sapiens
ccactaaagcttca

SEQ ID NO: 1259844 - DNA, 17 bp, Homo sapiens
ccactaaagtgtcaagg

SEQ ID NO: 1259845 - DNA, 21 bp, Homo sapiens
ccactaaatctccaagacctg

SEQ ID NO: 1259846 - DNA, 17 bp, Homo sapiens
ccactaaccatccccaa

SEQ ID NO: 1259847 - DNA, 17 bp, Homo sapiens
ccactaaccttgcctgg

SEQ ID NO: 1259848 - DNA, 18 bp, Homo sapiens
ccactaactcctgagaaa

SEQ ID NO: 1259849 - DNA, 13 bp, Homo sapiens
ccactaagcagag

SEQ ID NO: 1259850 - DNA, 16 bp, Homo sapiens
ccactaagcagaggag

SEQ ID NO: 1259851 - DNA, 18 bp, Homo sapiens
ccactaagcagaggaggg

SEQ ID NO: 1259852 - DNA, 22 bp, Homo sapiens
ccactaagcagaggaggggccg

SEQ ID NO: 1259853 - DNA, 19 bp, Homo sapiens
ccactacactccagcctga

SEQ ID NO: 1259854 - DNA, 12 bp, Homo sapiens
ccactaccagcc

SEQ ID NO: 1259855 - DNA, 17 bp, Homo sapiens
ccactaccagccagcct

SEQ ID NO: 1259856 - DNA, 15 bp, Homo sapiens
ccactagacccactg

SEQ ID NO: 1259857 - DNA, 15 bp, Homo sapiens
ccactagagggccca

SEQ ID NO: 1259858 - DNA, 14 bp, Homo sapiens
ccactagcttactg

SEQ ID NO: 1259859 - DNA, 20 bp, Homo sapiens
ccactaggactctgaggctc

SEQ ID NO: 1259860 - DNA, 14 bp, Homo sapiens
ccactaggtgtccc

SEQ ID NO: 1259861 - DNA, 14 bp, Homo sapiens
ccactagtgcaaat

SEQ ID NO: 1259862 - DNA, 13 bp, Homo sapiens
ccactatcacata

SEQ ID NO: 1259863 - DNA, 16 bp, Homo sapiens
ccactatccttcgtga

SEQ ID NO: 1259864 - DNA, 12 bp, Homo sapiens
ccactattttca

SEQ ID NO: 1259865 - DNA, 17 bp, Homo sapiens
ccactcaaaatatgtca

SEQ ID NO: 1259866 - DNA, 13 bp, Homo sapiens
ccactcaccagcc

SEQ ID NO: 1259867 - DNA, 15 bp, Homo sapiens
ccactcaccagccct

SEQ ID NO: 1259868 - DNA, 16 bp, Homo sapiens
ccactcaccagtgtcc

SEQ ID NO: 1259869 - DNA, 15 bp, Homo sapiens
ccactcacccccttt

SEQ ID NO: 1259870 - DNA, 22 bp, Homo sapiens
ccactcaccccctttgctgtga

SEQ ID NO: 1259871 - DNA, 14 bp, Homo sapiens
ccactcacccttcc

SEQ ID NO: 1259872 - DNA, 22 bp, Homo sapiens
ccactcacccttcctggcccag

SEQ ID NO: 1259873 - DNA, 22 bp, Homo sapiens
ccactcactaggcccccacttg

SEQ ID NO: 1259874 - DNA, 14 bp, Homo sapiens
ccactcactccagc

SEQ ID NO: 1259875 - DNA, 22 bp, Homo sapiens
ccactcactgctgtgagtgcgc

SEQ ID NO: 1259876 - DNA, 15 bp, Homo sapiens
ccactcagaggcccc

SEQ ID NO: 1259877 - DNA, 18 bp, Homo sapiens
ccactcagaggcccccag

SEQ ID NO: 1259878 - DNA, 13 bp, Homo sapiens
ccactcagcccct

SEQ ID NO: 1259879 - DNA, 15 bp, Homo sapiens
ccactcagcccctag

SEQ ID NO: 1259880 - DNA, 11 bp, Homo sapiens
ccactcaggcc

SEQ ID NO: 1259881 - DNA, 16 bp, Homo sapiens
ccactcaggccacagt

SEQ ID NO: 1259882 - DNA, 19 bp, Homo sapiens
ccactcaggggaccccact

SEQ ID NO: 1259883 - DNA, 14 bp, Homo sapiens
ccactcagtgcctc

SEQ ID NO: 1259884 - DNA, 15 bp, Homo sapiens
ccactcatttcatct

SEQ ID NO: 1259885 - DNA, 16 bp, Homo sapiens
ccactccaagccccct

SEQ ID NO: 1259886 - DNA, 14 bp, Homo sapiens
ccactccagcccgc

SEQ ID NO: 1259887 - DNA, 13 bp, Homo sapiens
ccactccagctct

SEQ ID NO: 1259888 - DNA, 20 bp, Homo sapiens
ccactccagtccactcctga

SEQ ID NO: 1259889 - DNA, 21 bp, Homo sapiens
ccactccagttttctcctctg

SEQ ID NO: 1259890 - DNA, 17 bp, Homo sapiens
ccactcccaaagctcag

SEQ ID NO: 1259891 - DNA, 16 bp, Homo sapiens
ccactcccatctcctt

SEQ ID NO: 1259892 - DNA, 16 bp, Homo sapiens
ccactccccaccttca

SEQ ID NO: 1259893 - DNA, 13 bp, Homo sapiens
ccactccccagcc

SEQ ID NO: 1259894 - DNA, 22 bp, Homo sapiens
ccactccccagccccagcccct

SEQ ID NO: 1259895 - DNA, 23 bp, Homo sapiens
ccactcccccacccatggggagg

SEQ ID NO: 1259896 - DNA, 16 bp, Homo sapiens
ccactcccccacctga

SEQ ID NO: 1259897 - DNA, 16 bp, Homo sapiens
ccactcccccttccct

SEQ ID NO: 1259898 - DNA, 16 bp, Homo sapiens
ccactcccctcacaca

SEQ ID NO: 1259899 - DNA, 21 bp, Homo sapiens
ccactcccgaaagcctttcct

SEQ ID NO: 1259900 - DNA, 21 bp, Homo sapiens
ccactcccgggccaagacaga

SEQ ID NO: 1259901 - DNA, 23 bp, Homo sapiens
ccactcccgggccaagacagatg

SEQ ID NO: 1259902 - DNA, 15 bp, Homo sapiens
ccactccctgagctt

SEQ ID NO: 1259903 - DNA, 13 bp, Homo sapiens
ccactccctgctc

SEQ ID NO: 1259904 - DNA, 16 bp, Homo sapiens
ccactccctgctccac

SEQ ID NO: 1259905 - DNA, 17 bp, Homo sapiens
ccactccctgctccacg

SEQ ID NO: 1259906 - DNA, 17 bp, Homo sapiens
ccactccgagaggtggg

SEQ ID NO: 1259907 - DNA, 22 bp, Homo sapiens
ccagagcccttcactgccatga

SEQ ID NO: 1259908 - DNA, 22 bp, Homo sapiens
ccagagccggcatccttgcctg

SEQ ID NO: 1259909 - DNA, 16 bp, Homo sapiens
ccagagccgggaggaa

SEQ ID NO: 1259910 - DNA, 13 bp, Homo sapiens
ccagagcctctgg

SEQ ID NO: 1259911 - DNA, 18 bp, Homo sapiens
ccagagcctctggcccct

SEQ ID NO: 1259912 - DNA, 19 bp, Homo sapiens
ccagagcctctggcccctc

SEQ ID NO: 1259913 - DNA, 21 bp, Homo sapiens
ccagagcctggctgcccatca

SEQ ID NO: 1259914 - DNA, 23 bp, Homo sapiens
ccagagcgaggaaaggattttac

SEQ ID NO: 1259915 - DNA, 22 bp, Homo sapiens
ccagagcggaggctgtgtgcct

SEQ ID NO: 1259916 - DNA, 19 bp, Homo sapiens
ccagagctagggctgctgc

SEQ ID NO: 1259917 - DNA, 18 bp, Homo sapiens
ccagagctcatcccccct

SEQ ID NO: 1259918 - DNA, 22 bp, Homo sapiens
ccagagctcatcccccctgctg

SEQ ID NO: 1259919 - DNA, 23 bp, Homo sapiens
ccagagctcatcccccctgctgc

SEQ ID NO: 1259920 - DNA, 23 bp, Homo sapiens
ccagagctgccgacttggagact

SEQ ID NO: 1259921 - DNA, 14 bp, Homo sapiens
ccagagctggaagg

SEQ ID NO: 1259922 - DNA, 18 bp, Homo sapiens
ccagagctggaaggcagg

SEQ ID NO: 1259923 - DNA, 19 bp, Homo sapiens
ccagagctggaaggcaggg

SEQ ID NO: 1259924 - DNA, 21 bp, Homo sapiens
ccagagctggaaggcagggca

SEQ ID NO: 1259925 - DNA, 12 bp, Homo sapiens
ccagagctggcc

SEQ ID NO: 1259926 - DNA, 13 bp, Homo sapiens
ccagagctggcct

SEQ ID NO: 1259927 - DNA, 14 bp, Homo sapiens
ccagagctggcctc

SEQ ID NO: 1259928 - DNA, 21 bp, Homo sapiens
ccagagctggcctcccccaac

SEQ ID NO: 1259929 - DNA, 18 bp, Homo sapiens
ccagagctgtgccagcag

SEQ ID NO: 1259930 - DNA, 21 bp, Homo sapiens
ccagagctgtgcctgctcagc

SEQ ID NO: 1259931 - DNA, 23 bp, Homo sapiens
ccagagctgtgcctgctcagcag

SEQ ID NO: 1259932 - DNA, 20 bp, Homo sapiens
ccagagctgtttggatacag

SEQ ID NO: 1259933 - DNA, 17 bp, Homo sapiens
ccagagcttattggcca

SEQ ID NO: 1259934 - DNA, 20 bp, Homo sapiens
ccagagcttattggccactg

SEQ ID NO: 1259935 - DNA, 14 bp, Homo sapiens
ccagaggaactgtc

SEQ ID NO: 1259936 - DNA, 17 bp, Homo sapiens
ccagaggaaggaaaagg

SEQ ID NO: 1259937 - DNA, 22 bp, Homo sapiens
ccagaggaaggggccagaggct

SEQ ID NO: 1259938 - DNA, 17 bp, Homo sapiens
ccagaggaatcctggca

SEQ ID NO: 1259939 - DNA, 20 bp, Homo sapiens
ccagaggaatcctggcagcc

SEQ ID NO: 1259940 - DNA, 21 bp, Homo sapiens
ccagaggaatcctggcagccc

SEQ ID NO: 1259941 - DNA, 22 bp, Homo sapiens
ccagaggaatcctggcagccca

SEQ ID NO: 1259942 - DNA, 23 bp, Homo sapiens
ccagaggaatgatgggcttttgt

SEQ ID NO: 1259943 - DNA, 21 bp, Homo sapiens
ccagaggaattgattgtcagc

SEQ ID NO: 1259944 - DNA, 14 bp, Homo sapiens
ccagaggacacagg

SEQ ID NO: 1259945 - DNA, 16 bp, Homo sapiens
ccagaggacagctctg

SEQ ID NO: 1259946 - DNA, 16 bp, Homo sapiens
ccagaggaccgagaga

SEQ ID NO: 1259947 - DNA, 17 bp, Homo sapiens
ccagaggagccaccagt

SEQ ID NO: 1259948 - DNA, 19 bp, Homo sapiens
ccagaggagccaccagttc

SEQ ID NO: 1259949 - DNA, 16 bp, Homo sapiens
ccagaggagggcagag

SEQ ID NO: 1259950 - DNA, 13 bp, Homo sapiens
ccagaggagggga

SEQ ID NO: 1259951 - DNA, 20 bp, Homo sapiens
ccagaggaggggacttgtag

SEQ ID NO: 1259952 - DNA, 21 bp, Homo sapiens
ccagaggcccccagcccaggg

SEQ ID NO: 1259953 - DNA, 13 bp, Homo sapiens
ccagaggccttgt

SEQ ID NO: 1259954 - DNA, 13 bp, Homo sapiens
ccagaggctccca

SEQ ID NO: 1259955 - DNA, 18 bp, Homo sapiens
ccagaggctcccaatcag

SEQ ID NO: 1259956 - DNA, 11 bp, Homo sapiens
ccagaggctcg

SEQ ID NO: 1259957 - DNA, 14 bp, Homo sapiens
ccagaggctgcaga

SEQ ID NO: 1259958 - DNA, 17 bp, Homo sapiens
ccagaggctgggagtcc

SEQ ID NO: 1259959 - DNA, 19 bp, Homo sapiens
ccagaggctgggagtccct

SEQ ID NO: 1259960 - DNA, 15 bp, Homo sapiens
ccagaggctgggttc

SEQ ID NO: 1259961 - DNA, 11 bp, Homo sapiens
ccagagggcca

SEQ ID NO: 1259962 - DNA, 18 bp, Homo sapiens
ccagagggccagcaggct

SEQ ID NO: 1259963 - DNA, 19 bp, Homo sapiens
ccagagggccagcaggctc

SEQ ID NO: 1259964 - DNA, 21 bp, Homo sapiens
ccagagggccagcaggctcct

SEQ ID NO: 1259965 - DNA, 23 bp, Homo sapiens
ccagaggggtgggttcctcttcc

SEQ ID NO: 1259966 - DNA, 17 bp, Homo sapiens
ccagagggtgtggcttt

SEQ ID NO: 1259967 - DNA, 21 bp, Homo sapiens
ccagaggtattcctctcttaa

SEQ ID NO: 1259968 - DNA, 14 bp, Homo sapiens
ccagaggtccagcc

SEQ ID NO: 1259969 - DNA, 19 bp, Homo sapiens
ccagaggtccagcccatct

SEQ ID NO: 1259970 - DNA, 23 bp, Homo sapiens
ccagaggtcctccgtagggtctt

SEQ ID NO: 1259971 - DNA, 11 bp, Homo sapiens
ccagaggtgga

SEQ ID NO: 1259972 - DNA, 14 bp, Homo sapiens
ccagaggtggccct

SEQ ID NO: 1259973 - DNA, 15 bp, Homo sapiens
ccagaggtggccctt

SEQ ID NO: 1259974 - DNA, 16 bp, Homo sapiens
ccagaggtggcccttg

SEQ ID NO: 1259975 - DNA, 21 bp, Homo sapiens
ccagaggtgggatcctccctc

SEQ ID NO: 1259976 - DNA, 19 bp, Homo sapiens
ccagaggtgggcaggtggt

SEQ ID NO: 1259977 - DNA, 20 bp, Homo sapiens
ccagaggttatctgcctggc

SEQ ID NO: 1259978 - DNA, 21 bp, Homo sapiens
ccagaggttatctgcctggcc

SEQ ID NO: 1259979 - DNA, 20 bp, Homo sapiens
ccagagtagagccaggtgct

SEQ ID NO: 1259980 - DNA, 22 bp, Homo sapiens
ccagagtagagccaggtgctta

SEQ ID NO: 1259981 - DNA, 21 bp, Homo sapiens
ccagagtcaccttttctgtgg

SEQ ID NO: 1259982 - DNA, 18 bp, Homo sapiens
ccagagtccggaggcagc

SEQ ID NO: 1259983 - DNA, 13 bp, Homo sapiens
ccagagtctgagc

SEQ ID NO: 1259984 - DNA, 18 bp, Homo sapiens
ccagagtgctgtcgggac

SEQ ID NO: 1259985 - DNA, 20 bp, Homo sapiens
ccagagtgctgtcgggacca

SEQ ID NO: 1259986 - DNA, 20 bp, Homo sapiens
ccagagtgctttaaaaaatt

SEQ ID NO: 1259987 - DNA, 15 bp, Homo sapiens
ccagagtggagtctg

SEQ ID NO: 1259988 - DNA, 18 bp, Homo sapiens
ccagagtgggagaggctg

SEQ ID NO: 1259989 - DNA, 24 bp, Homo sapiens
ccagagtgggagaggctgggaggt

SEQ ID NO: 1259990 - DNA, 21 bp, Homo sapiens
ccagagtggggatgacatgca

SEQ ID NO: 1259991 - DNA, 20 bp, Homo sapiens
ccagagtgtagggggccttg

SEQ ID NO: 1259992 - DNA, 12 bp, Homo sapiens
ccagagtgtgaa

SEQ ID NO: 1259993 - DNA, 20 bp, Homo sapiens
ccagagtgtgcagactgatg

SEQ ID NO: 1259994 - DNA, 17 bp, Homo sapiens
ccagagttcctgcggag

SEQ ID NO: 1259995 - DNA, 14 bp, Homo sapiens
ccagataaatagaa

SEQ ID NO: 1259996 - DNA, 16 bp, Homo sapiens
ccagataaatagaact

SEQ ID NO: 1259997 - DNA, 20 bp, Homo sapiens
ccagataaatagaactatct

SEQ ID NO: 1259998 - DNA, 17 bp, Homo sapiens
ccagataaggcaagcca

SEQ ID NO: 1259999 - DNA, 21 bp, Homo sapiens
ccagataaggcaagccagtca

SEQ ID NO: 1260000 - DNA, 21 bp, Homo sapiens
ccagatacttcccattttgga

SEQ ID NO: 1260001 - DNA, 14 bp, Homo sapiens
ccagatagagaaat

SEQ ID NO: 1260002 - DNA, 14 bp, Homo sapiens
ccagatagagctgg

SEQ ID NO: 1260003 - DNA, 18 bp, Homo sapiens
ccagatagagctgggtgg

SEQ ID NO: 1260004 - DNA, 17 bp, Homo sapiens
ccagatagtgtagctga

SEQ ID NO: 1260005 - DNA, 21 bp, Homo sapiens
ccagatatgaacagggcccag

SEQ ID NO: 1260006 - DNA, 19 bp, Homo sapiens
ccagatattcaagtcacct

SEQ ID NO: 1260007 - DNA, 15 bp, Homo sapiens
ccagatcactgccac

SEQ ID NO: 1260008 - DNA, 14 bp, Homo sapiens
ccagatcaggaacc

SEQ ID NO: 1260009 - DNA, 15 bp, Homo sapiens
ccagatcaggaacca

SEQ ID NO: 1260010 - DNA, 19 bp, Homo sapiens
ccagatcaggaaccagggc

SEQ ID NO: 1260011 - DNA, 20 bp, Homo sapiens
ccagatcaggaaccagggcc

SEQ ID NO: 1260012 - DNA, 17 bp, Homo sapiens
ccagatccagactgtaa

SEQ ID NO: 1260013 - DNA, 18 bp, Homo sapiens
ccagatccagtatcttgt

SEQ ID NO: 1260014 - DNA, 20 bp, Homo sapiens
ccagatccagtatcttgttt

SEQ ID NO: 1260015 - DNA, 13 bp, Homo sapiens
ccagatcctgggt

SEQ ID NO: 1260016 - DNA, 18 bp, Homo sapiens
ccagatcgatcctggatt

SEQ ID NO: 1260017 - DNA, 16 bp, Homo sapiens
ccagatctgcctgggc

SEQ ID NO: 1260018 - DNA, 20 bp, Homo sapiens
ccagatctgcctgggcctgt

SEQ ID NO: 1260019 - DNA, 24 bp, Homo sapiens
ccagatctgcctgggcctgtgcag

SEQ ID NO: 1260020 - DNA, 16 bp, Homo sapiens
ccagatctttctcttc

SEQ ID NO: 1260021 - DNA, 18 bp, Homo sapiens
ccagatctttctcttccc

SEQ ID NO: 1260022 - DNA, 23 bp, Homo sapiens
ccagatgaggatccgaaacggca

SEQ ID NO: 1260023 - DNA, 16 bp, Homo sapiens
ccagatgattttcctc

SEQ ID NO: 1260024 - DNA, 14 bp, Homo sapiens
ccagatgcaacctc

SEQ ID NO: 1260025 - DNA, 17 bp, Homo sapiens
ccagatgcaacctcact

SEQ ID NO: 1260026 - DNA, 14 bp, Homo sapiens
ccagatgcagggca

SEQ ID NO: 1260027 - DNA, 15 bp, Homo sapiens
ccagatgcagggcag

SEQ ID NO: 1260028 - DNA, 13 bp, Homo sapiens
ccagcccctggcc

SEQ ID NO: 1260029 - DNA, 16 bp, Homo sapiens
ccagcccctggggccc

SEQ ID NO: 1260030 - DNA, 18 bp, Homo sapiens
ccagcccctggggcccag

SEQ ID NO: 1260031 - DNA, 21 bp, Homo sapiens
ccagcccctggggcccagccc

SEQ ID NO: 1260032 - DNA, 13 bp, Homo sapiens
ccagcccctgtcc

SEQ ID NO: 1260033 - DNA, 22 bp, Homo sapiens
ccagcccctgtttactggttct

SEQ ID NO: 1260034 - DNA, 16 bp, Homo sapiens
ccagccccttctcaga

SEQ ID NO: 1260035 - DNA, 21 bp, Homo sapiens
ccagccccttctcccagcaca

SEQ ID NO: 1260036 - DNA, 17 bp, Homo sapiens
ccagcccctttgcctct

SEQ ID NO: 1260037 - DNA, 21 bp, Homo sapiens
ccagcccctttgcctctgtcc

SEQ ID NO: 1260038 - DNA, 21 bp, Homo sapiens
ccagcccgacagtgccatccc

SEQ ID NO: 1260039 - DNA, 22 bp, Homo sapiens
ccagcccgacagtgccatcccc

SEQ ID NO: 1260040 - DNA, 16 bp, Homo sapiens
ccagcccgccgcccgc

SEQ ID NO: 1260041 - DNA, 14 bp, Homo sapiens
ccagcccgcggcct

SEQ ID NO: 1260042 - DNA, 17 bp, Homo sapiens
ccagcccgcggcctgga

SEQ ID NO: 1260043 - DNA, 18 bp, Homo sapiens
ccagcccgcggcctggac

SEQ ID NO: 1260044 - DNA, 17 bp, Homo sapiens
ccagcccggctggtttt

SEQ ID NO: 1260045 - DNA, 14 bp, Homo sapiens
ccagcccgggagcc

SEQ ID NO: 1260046 - DNA, 15 bp, Homo sapiens
ccagcccgggagcct

SEQ ID NO: 1260047 - DNA, 17 bp, Homo sapiens
ccagcccgggagcctag

SEQ ID NO: 1260048 - DNA, 20 bp, Homo sapiens
ccagccctagctgtcccatg

SEQ ID NO: 1260049 - DNA, 14 bp, Homo sapiens
ccagccctccccat

SEQ ID NO: 1260050 - DNA, 20 bp, Homo sapiens
ccagccctccctgtcctcct

SEQ ID NO: 1260051 - DNA, 16 bp, Homo sapiens
ccagccctcctacgca

SEQ ID NO: 1260052 - DNA, 17 bp, Homo sapiens
ccagccctccttcaggg

SEQ ID NO: 1260053 - DNA, 18 bp, Homo sapiens
ccagccctgcccaccctc

SEQ ID NO: 1260054 - DNA, 17 bp, Homo sapiens
ccagccctgctggggat

SEQ ID NO: 1260055 - DNA, 20 bp, Homo sapiens
ccagccctgctggggatccc

SEQ ID NO: 1260056 - DNA, 12 bp, Homo sapiens
ccagccctggga

SEQ ID NO: 1260057 - DNA, 22 bp, Homo sapiens
ccagccctgggaaccactccca

SEQ ID NO: 1260058 - DNA, 16 bp, Homo sapiens
ccagccctgggcttgg

SEQ ID NO: 1260059 - DNA, 20 bp, Homo sapiens
ccagccctgggcttggctct

SEQ ID NO: 1260060 - DNA, 13 bp, Homo sapiens
ccagccctgtcct

SEQ ID NO: 1260061 - DNA, 18 bp, Homo sapiens
ccagccctgtggaaggga

SEQ ID NO: 1260062 - DNA, 11 bp, Homo sapiens
ccagcccttag

SEQ ID NO: 1260063 - DNA, 17 bp, Homo sapiens
ccagcccttcagacgag

SEQ ID NO: 1260064 - DNA, 13 bp, Homo sapiens
ccagcccttccct

SEQ ID NO: 1260065 - DNA, 16 bp, Homo sapiens
ccagcccttccctggc

SEQ ID NO: 1260066 - DNA, 12 bp, Homo sapiens
ccagcccttcct

SEQ ID NO: 1260067 - DNA, 16 bp, Homo sapiens
ccagcccttccttggg

SEQ ID NO: 1260068 - DNA, 22 bp, Homo sapiens
ccagcccttccttgggcgtctc

SEQ ID NO: 1260069 - DNA, 13 bp, Homo sapiens
ccagcccttctgc

SEQ ID NO: 1260070 - DNA, 14 bp, Homo sapiens
ccagcccttctgcc

SEQ ID NO: 1260071 - DNA, 19 bp, Homo sapiens
ccagcccttctgcctttct

SEQ ID NO: 1260072 - DNA, 20 bp, Homo sapiens
ccagccctttgggaggctga

SEQ ID NO: 1260073 - DNA, 14 bp, Homo sapiens
ccagccgccatgct

SEQ ID NO: 1260074 - DNA, 18 bp, Homo sapiens
ccagccgccatgctcctg

SEQ ID NO: 1260075 - DNA, 20 bp, Homo sapiens
ccagccgccattgccaccag

SEQ ID NO: 1260076 - DNA, 18 bp, Homo sapiens
ccagccgcccacccccac

SEQ ID NO: 1260077 - DNA, 14 bp, Homo sapiens
ccagccgctgcagg

SEQ ID NO: 1260078 - DNA, 22 bp, Homo sapiens
ccagccgctgcagggctcccat

SEQ ID NO: 1260079 - DNA, 14 bp, Homo sapiens
ccagccggcctctc

SEQ ID NO: 1260080 - DNA, 23 bp, Homo sapiens
ccagccggcctctctggcctccc

SEQ ID NO: 1260081 - DNA, 16 bp, Homo sapiens
ccagccggtgcctggc

SEQ ID NO: 1260082 - DNA, 16 bp, Homo sapiens
ccagcctagcctggct

SEQ ID NO: 1260083 - DNA, 15 bp, Homo sapiens
ccagcctagtcaggg

SEQ ID NO: 1260084 - DNA, 15 bp, Homo sapiens
ccagcctcagaaggc

SEQ ID NO: 1260085 - DNA, 13 bp, Homo sapiens
ccagcctcagcct

SEQ ID NO: 1260086 - DNA, 18 bp, Homo sapiens
ccagcctcagtgccactt

SEQ ID NO: 1260087 - DNA, 19 bp, Homo sapiens
ccagcctcatctctttgtt

SEQ ID NO: 1260088 - DNA, 23 bp, Homo sapiens
ccagcctcattgtgccaagcctt

SEQ ID NO: 1260089 - DNA, 16 bp, Homo sapiens
ccagcctccagagaag

SEQ ID NO: 1260090 - DNA, 18 bp, Homo sapiens
ccagcctccagagaagcc

SEQ ID NO: 1260091 - DNA, 19 bp, Homo sapiens
ccagcctccagagaagccc

SEQ ID NO: 1260092 - DNA, 15 bp, Homo sapiens
ccagcctccatgctg

SEQ ID NO: 1260093 - DNA, 12 bp, Homo sapiens
ccagcctcccca

SEQ ID NO: 1260094 - DNA, 15 bp, Homo sapiens
ccagcctcccctccc

SEQ ID NO: 1260095 - DNA, 18 bp, Homo sapiens
ccagcctcccctcccctg

SEQ ID NO: 1260096 - DNA, 14 bp, Homo sapiens
ccagcctcctctgg

SEQ ID NO: 1260097 - DNA, 15 bp, Homo sapiens
ccagcctcctctgga

SEQ ID NO: 1260098 - DNA, 23 bp, Homo sapiens
ccagcctcctctggacggcaggc

SEQ ID NO: 1260099 - DNA, 13 bp, Homo sapiens
ccagcctccttgc

SEQ ID NO: 1260100 - DNA, 20 bp, Homo sapiens
ccagcctccttgctgacccc

SEQ ID NO: 1260101 - DNA, 19 bp, Homo sapiens
ccagcctcgttggaagagg

SEQ ID NO: 1260102 - DNA, 22 bp, Homo sapiens
ccagcctcgttggaagaggaac

SEQ ID NO: 1260103 - DNA, 16 bp, Homo sapiens
ccagcctctcccggct

SEQ ID NO: 1260104 - DNA, 20 bp, Homo sapiens
ccagcctctcccggctgcct

SEQ ID NO: 1260105 - DNA, 23 bp, Homo sapiens
ccagcctctcccggctgcctgcc

SEQ ID NO: 1260106 - DNA, 17 bp, Homo sapiens
ccagcctgacctgagac

SEQ ID NO: 1260107 - DNA, 18 bp, Homo sapiens
ccagcctgacctgagact

SEQ ID NO: 1260108 - DNA, 12 bp, Homo sapiens
ccagcctgagca

SEQ ID NO: 1260109 - DNA, 18 bp, Homo sapiens
ccagcctgccccctatct

SEQ ID NO: 1260110 - DNA, 20 bp, Homo sapiens
ccagcctgcctggcaggctg

SEQ ID NO: 1260111 - DNA, 12 bp, Homo sapiens
ccagcctgctga

SEQ ID NO: 1260112 - DNA, 18 bp, Homo sapiens
ccagcctgctgagagccc

SEQ ID NO: 1260113 - DNA, 20 bp, Homo sapiens
ccagcctgctgagagccccc

SEQ ID NO: 1260114 - DNA, 21 bp, Homo sapiens
ccagcctgctgagagccccca

SEQ ID NO: 1260115 - DNA, 16 bp, Homo sapiens
ccagcctggccagaca

SEQ ID NO: 1260116 - DNA, 21 bp, Homo sapiens
ccagcctggctctgccccctc

SEQ ID NO: 1260117 - DNA, 13 bp, Homo sapiens
ccagcctggcttc

SEQ ID NO: 1260118 - DNA, 19 bp, Homo sapiens
ccagcctggcttctggagc

SEQ ID NO: 1260119 - DNA, 13 bp, Homo sapiens
ccagcctgggaca

SEQ ID NO: 1260120 - DNA, 14 bp, Homo sapiens
ccagcctgggactc

SEQ ID NO: 1260121 - DNA, 19 bp, Homo sapiens
ccagcctgggactcccagt

SEQ ID NO: 1260122 - DNA, 15 bp, Homo sapiens
ccagcctgggagccc

SEQ ID NO: 1260123 - DNA, 17 bp, Homo sapiens
ccagcctgggagcccag

SEQ ID NO: 1260124 - DNA, 22 bp, Homo sapiens
ccagcctgggcagccaggctgc

SEQ ID NO: 1260125 - DNA, 18 bp, Homo sapiens
ccagcctgggcccatctc

SEQ ID NO: 1260126 - DNA, 22 bp, Homo sapiens
ccagcctgggcccatctccctg

SEQ ID NO: 1260127 - DNA, 18 bp, Homo sapiens
ccagcctggggctccctc

SEQ ID NO: 1260128 - DNA, 20 bp, Homo sapiens
ccagcctggggctccctctc

SEQ ID NO: 1260129 - DNA, 22 bp, Homo sapiens
ccagcctggggctccctctctg

SEQ ID NO: 1260130 - DNA, 23 bp, Homo sapiens
ccagcctgtatcttgtctgagac

SEQ ID NO: 1260131 - DNA, 12 bp, Homo sapiens
ccagcctgtcac

SEQ ID NO: 1260132 - DNA, 16 bp, Homo sapiens
ccagcctgtcctggta

SEQ ID NO: 1260133 - DNA, 13 bp, Homo sapiens
ccagcctgtggtt

SEQ ID NO: 1260134 - DNA, 23 bp, Homo sapiens
ccagccttaatagacttctctta

SEQ ID NO: 1260135 - DNA, 19 bp, Homo sapiens
ccagccttgagccctggct

SEQ ID NO: 1260136 - DNA, 20 bp, Homo sapiens
ccagccttgagccctggctg

SEQ ID NO: 1260137 - DNA, 16 bp, Homo sapiens
ccagcctttgctccct

SEQ ID NO: 1260138 - DNA, 18 bp, Homo sapiens
ccagcctttgctccctcc

SEQ ID NO: 1260139 - DNA, 21 bp, Homo sapiens
ccagcgagagagtttcaaaag

SEQ ID NO: 1260140 - DNA, 15 bp, Homo sapiens
ccagcgagccacagg

SEQ ID NO: 1260141 - DNA, 16 bp, Homo sapiens
ccagcgaggaggctcc

SEQ ID NO: 1260142 - DNA, 20 bp, Homo sapiens
ccagcgaggtgggagaggcc

SEQ ID NO: 1260143 - DNA, 22 bp, Homo sapiens
ccagcgaggtgggagaggcctc

SEQ ID NO: 1260144 - DNA, 23 bp, Homo sapiens
ccagcgaggtgggagaggcctca

SEQ ID NO: 1260145 - DNA, 19 bp, Homo sapiens
ccagcgatttttgaggatt

SEQ ID NO: 1260146 - DNA, 12 bp, Homo sapiens
ccagcgccaggg

SEQ ID NO: 1260147 - DNA, 17 bp, Homo sapiens
ccagcgccagggcccag

SEQ ID NO: 1260148 - DNA, 18 bp, Homo sapiens
ccagcgccagggcccagg

SEQ ID NO: 1260149 - DNA, 20 bp, Homo sapiens
ccagcgccagggcccaggcc

SEQ ID NO: 1260150 - DNA, 18 bp, Homo sapiens
ccaggactatagcccagg

SEQ ID NO: 1260151 - DNA, 19 bp, Homo sapiens
ccaggactatagcccaggt

SEQ ID NO: 1260152 - DNA, 19 bp, Homo sapiens
ccaggactccccaggccag

SEQ ID NO: 1260153 - DNA, 21 bp, Homo sapiens
ccaggactccccaggccaggc

SEQ ID NO: 1260154 - DNA, 18 bp, Homo sapiens
ccaggactccctcctcac

SEQ ID NO: 1260155 - DNA, 13 bp, Homo sapiens
ccaggactctggc

SEQ ID NO: 1260156 - DNA, 17 bp, Homo sapiens
ccaggacttggggtcag

SEQ ID NO: 1260157 - DNA, 17 bp, Homo sapiens
ccaggagaaagccgggg

SEQ ID NO: 1260158 - DNA, 21 bp, Homo sapiens
ccaggagaagctcagctgcat

SEQ ID NO: 1260159 - DNA, 19 bp, Homo sapiens
ccaggagaagggctggggc

SEQ ID NO: 1260160 - DNA, 21 bp, Homo sapiens
ccaggagaagggggctctgcc

SEQ ID NO: 1260161 - DNA, 16 bp, Homo sapiens
ccaggagagagccagg

SEQ ID NO: 1260162 - DNA, 16 bp, Homo sapiens
ccaggagagccagccc

SEQ ID NO: 1260163 - DNA, 20 bp, Homo sapiens
ccaggagagccagccctccc

SEQ ID NO: 1260164 - DNA, 22 bp, Homo sapiens
ccaggagagcccccaccagcag

SEQ ID NO: 1260165 - DNA, 17 bp, Homo sapiens
ccaggagagcctggggg

SEQ ID NO: 1260166 - DNA, 16 bp, Homo sapiens
ccaggagatggcccca

SEQ ID NO: 1260167 - DNA, 18 bp, Homo sapiens
ccaggagatggccccaac

SEQ ID NO: 1260168 - DNA, 12 bp, Homo sapiens
ccaggagcaaat

SEQ ID NO: 1260169 - DNA, 17 bp, Homo sapiens
ccaggagcacctggacc

SEQ ID NO: 1260170 - DNA, 18 bp, Homo sapiens
ccaggagcagatggacag

SEQ ID NO: 1260171 - DNA, 18 bp, Homo sapiens
ccaggagcagcagccagc

SEQ ID NO: 1260172 - DNA, 21 bp, Homo sapiens
ccaggagcagcagccagcacc

SEQ ID NO: 1260173 - DNA, 22 bp, Homo sapiens
ccaggagcaggacctactagga

SEQ ID NO: 1260174 - DNA, 16 bp, Homo sapiens
ccaggagcaggcacgg

SEQ ID NO: 1260175 - DNA, 13 bp, Homo sapiens
ccaggagctaatc

SEQ ID NO: 1260176 - DNA, 15 bp, Homo sapiens
ccaggagctctgcgc

SEQ ID NO: 1260177 - DNA, 23 bp, Homo sapiens
ccaggagctctgcgccaggcaga

SEQ ID NO: 1260178 - DNA, 13 bp, Homo sapiens
ccaggagctcttc

SEQ ID NO: 1260179 - DNA, 18 bp, Homo sapiens
ccaggagctcttcaggcc

SEQ ID NO: 1260180 - DNA, 19 bp, Homo sapiens
ccaggagctgagtcacctc

SEQ ID NO: 1260181 - DNA, 18 bp, Homo sapiens
ccaggagctgatggcagc

SEQ ID NO: 1260182 - DNA, 15 bp, Homo sapiens
ccaggagctgtcacc

SEQ ID NO: 1260183 - DNA, 24 bp, Homo sapiens
ccaggaggaagtcgggaggcgtgg

SEQ ID NO: 1260184 - DNA, 19 bp, Homo sapiens
ccaggaggaccgcctgccc

SEQ ID NO: 1260185 - DNA, 20 bp, Homo sapiens
ccaggaggaccgcctgccct

SEQ ID NO: 1260186 - DNA, 21 bp, Homo sapiens
ccaggagggaggcaggggagg

SEQ ID NO: 1260187 - DNA, 19 bp, Homo sapiens
ccaggagggcacagcaggg

SEQ ID NO: 1260188 - DNA, 22 bp, Homo sapiens
ccaggagggcacagcaggggag

SEQ ID NO: 1260189 - DNA, 16 bp, Homo sapiens
ccaggaggggcctggg

SEQ ID NO: 1260190 - DNA, 18 bp, Homo sapiens
ccaggaggggcctgggca

SEQ ID NO: 1260191 - DNA, 19 bp, Homo sapiens
ccaggaggggcctgggcag

SEQ ID NO: 1260192 - DNA, 20 bp, Homo sapiens
ccaggaggttggtgactgaa

SEQ ID NO: 1260193 - DNA, 21 bp, Homo sapiens
ccaggaggtttttttgtcaac

SEQ ID NO: 1260194 - DNA, 13 bp, Homo sapiens
ccaggagtctgtg

SEQ ID NO: 1260195 - DNA, 21 bp, Homo sapiens
ccaggagtttgaggctgcagc

SEQ ID NO: 1260196 - DNA, 15 bp, Homo sapiens
ccaggataaggagac

SEQ ID NO: 1260197 - DNA, 20 bp, Homo sapiens
ccaggataaggagactgagg

SEQ ID NO: 1260198 - DNA, 21 bp, Homo sapiens
ccaggataaggagactgaggc

SEQ ID NO: 1260199 - DNA, 21 bp, Homo sapiens
ccaggatactggcacagaggt

SEQ ID NO: 1260200 - DNA, 17 bp, Homo sapiens
ccaggatccagaagggg

SEQ ID NO: 1260201 - DNA, 21 bp, Homo sapiens
ccaggatgataagttcctttc

SEQ ID NO: 1260202 - DNA, 20 bp, Homo sapiens
ccaggatgctaaagatgatg

SEQ ID NO: 1260203 - DNA, 22 bp, Homo sapiens
ccaggatggaggggtggtcctg

SEQ ID NO: 1260204 - DNA, 22 bp, Homo sapiens
ccaggatggatgcatcacactc

SEQ ID NO: 1260205 - DNA, 22 bp, Homo sapiens
ccaggatggtctcgatctcctg

SEQ ID NO: 1260206 - DNA, 15 bp, Homo sapiens
ccaggattcccccag

SEQ ID NO: 1260207 - DNA, 18 bp, Homo sapiens
ccaggattcccccagcca

SEQ ID NO: 1260208 - DNA, 19 bp, Homo sapiens
ccaggattccttaaacctg

SEQ ID NO: 1260209 - DNA, 18 bp, Homo sapiens
ccaggattgaagagcatt

SEQ ID NO: 1260210 - DNA, 18 bp, Homo sapiens
ccaggatttataaagcaa

SEQ ID NO: 1260211 - DNA, 20 bp, Homo sapiens
ccaggatttattttactttg

SEQ ID NO: 1260212 - DNA, 15 bp, Homo sapiens
ccaggcaagcagctg

SEQ ID NO: 1260213 - DNA, 23 bp, Homo sapiens
ccaggcaaggctgacttctctga

SEQ ID NO: 1260214 - DNA, 15 bp, Homo sapiens
ccaggcacacacagc

SEQ ID NO: 1260215 - DNA, 15 bp, Homo sapiens
ccaggcaccaccagg

SEQ ID NO: 1260216 - DNA, 19 bp, Homo sapiens
ccaggcaccaccaggagca

SEQ ID NO: 1260217 - DNA, 22 bp, Homo sapiens
ccaggcaccaccaggagcagca

SEQ ID NO: 1260218 - DNA, 19 bp, Homo sapiens
ccaggcacccagctttgtc

SEQ ID NO: 1260219 - DNA, 14 bp, Homo sapiens
ccaggcaccctcag

SEQ ID NO: 1260220 - DNA, 15 bp, Homo sapiens
ccaggcaccctcagg

SEQ ID NO: 1260221 - DNA, 17 bp, Homo sapiens
ccaggcaccctcaggga

SEQ ID NO: 1260222 - DNA, 13 bp, Homo sapiens
ccaggcacccttc

SEQ ID NO: 1260223 - DNA, 21 bp, Homo sapiens
ccaggcacccttctttcctct

SEQ ID NO: 1260224 - DNA, 22 bp, Homo sapiens
ccaggcacccttctttcctctt

SEQ ID NO: 1260225 - DNA, 14 bp, Homo sapiens
ccaggcacctggcc

SEQ ID NO: 1260226 - DNA, 21 bp, Homo sapiens
ccaggcacctggcctgctggg

SEQ ID NO: 1260227 - DNA, 22 bp, Homo sapiens
ccaggcacgaacccacctgctg

SEQ ID NO: 1260228 - DNA, 19 bp, Homo sapiens
ccaggcactgccttctcct

SEQ ID NO: 1260229 - DNA, 12 bp, Homo sapiens
ccaggcagagct

SEQ ID NO: 1260230 - DNA, 16 bp, Homo sapiens
ccaggcagagctgagg

SEQ ID NO: 1260231 - DNA, 22 bp, Homo sapiens
ccaggcagaggttttaatgtct

SEQ ID NO: 1260232 - DNA, 17 bp, Homo sapiens
ccaggcagatctgtgcc

SEQ ID NO: 1260233 - DNA, 20 bp, Homo sapiens
ccaggcagatctgtgcccca

SEQ ID NO: 1260234 - DNA, 12 bp, Homo sapiens
ccaggcagccac

SEQ ID NO: 1260235 - DNA, 16 bp, Homo sapiens
ccaggcagccaccagt

SEQ ID NO: 1260236 - DNA, 19 bp, Homo sapiens
ccaggcagccaccagtgga

SEQ ID NO: 1260237 - DNA, 23 bp, Homo sapiens
ccaggcagccaccagtggaccta

SEQ ID NO: 1260238 - DNA, 12 bp, Homo sapiens
ccaggcagcctc

SEQ ID NO: 1260239 - DNA, 17 bp, Homo sapiens
ccaggcagctccctcct

SEQ ID NO: 1260240 - DNA, 18 bp, Homo sapiens
ccaggcagctgagaccag

SEQ ID NO: 1260241 - DNA, 20 bp, Homo sapiens
ccaggcagctgagaccaggg

SEQ ID NO: 1260242 - DNA, 18 bp, Homo sapiens
ccaggcaggccaggctgc

SEQ ID NO: 1260243 - DNA, 23 bp, Homo sapiens
ccaggcagggccaacccttctcc

SEQ ID NO: 1260244 - DNA, 15 bp, Homo sapiens
ccaggcaggtctgca

SEQ ID NO: 1260245 - DNA, 17 bp, Homo sapiens
ccaggcagtcgggggct

SEQ ID NO: 1260246 - DNA, 23 bp, Homo sapiens
ccaggcagtcgggggctggccta

SEQ ID NO: 1260247 - DNA, 17 bp, Homo sapiens
ccaggcatctccttggg

SEQ ID NO: 1260248 - DNA, 20 bp, Homo sapiens
ccaggcatctccttgggctg

SEQ ID NO: 1260249 - DNA, 14 bp, Homo sapiens
ccaggcatgcagct

SEQ ID NO: 1260250 - DNA, 15 bp, Homo sapiens
ccaggcatgcagctg

SEQ ID NO: 1260251 - DNA, 18 bp, Homo sapiens
ccaggcattggctcagcc

SEQ ID NO: 1260252 - DNA, 13 bp, Homo sapiens
ccaggccaaagcc

SEQ ID NO: 1260253 - DNA, 16 bp, Homo sapiens
ccaggccaacagcacc

SEQ ID NO: 1260254 - DNA, 17 bp, Homo sapiens
ccaggccacctccccag

SEQ ID NO: 1260255 - DNA, 21 bp, Homo sapiens
ccaggccacctccccagcatt

SEQ ID NO: 1260256 - DNA, 14 bp, Homo sapiens
ccaggccactgtgg

SEQ ID NO: 1260257 - DNA, 16 bp, Homo sapiens
ccaggccactgtggcc

SEQ ID NO: 1260258 - DNA, 18 bp, Homo sapiens
ccaggccactgtggccag

SEQ ID NO: 1260259 - DNA, 11 bp, Homo sapiens
ccaggccagcc

SEQ ID NO: 1260260 - DNA, 19 bp, Homo sapiens
ccaggccagcccccccacc

SEQ ID NO: 1260261 - DNA, 12 bp, Homo sapiens
ccaggccagcct

SEQ ID NO: 1260262 - DNA, 15 bp, Homo sapiens
ccaggccagcctccg

SEQ ID NO: 1260263 - DNA, 16 bp, Homo sapiens
ccaggccagcctccga

SEQ ID NO: 1260264 - DNA, 19 bp, Homo sapiens
ccaggccagcctccgagag

SEQ ID NO: 1260265 - DNA, 23 bp, Homo sapiens
ccaggccagcctccgagagggag

SEQ ID NO: 1260266 - DNA, 15 bp, Homo sapiens
ccaggccagctgcct

SEQ ID NO: 1260267 - DNA, 18 bp, Homo sapiens
ccaggccaggtgaggtcc

SEQ ID NO: 1260268 - DNA, 15 bp, Homo sapiens
ccaggccagtgggcc

SEQ ID NO: 1260269 - DNA, 18 bp, Homo sapiens
ccaggccagtgggcctgg

SEQ ID NO: 1260270 - DNA, 18 bp, Homo sapiens
ccaggccatgtggcctgc

SEQ ID NO: 1260271 - DNA, 16 bp, Homo sapiens
cccaatccctgccact

SEQ ID NO: 1260272 - DNA, 20 bp, Homo sapiens
cccaatccctgccactgggc

SEQ ID NO: 1260273 - DNA, 21 bp, Homo sapiens
cccaatccctttattaccccc

SEQ ID NO: 1260274 - DNA, 15 bp, Homo sapiens
cccaatcggactgcc

SEQ ID NO: 1260275 - DNA, 16 bp, Homo sapiens
cccaatcgggtccaga

SEQ ID NO: 1260276 - DNA, 21 bp, Homo sapiens
cccaatctctacccctttctt

SEQ ID NO: 1260277 - DNA, 20 bp, Homo sapiens
cccaatcttaccagatgcta

SEQ ID NO: 1260278 - DNA, 23 bp, Homo sapiens
cccaatctttctatataaaatgt

SEQ ID NO: 1260279 - DNA, 22 bp, Homo sapiens
cccaatgagactctagggtcca

SEQ ID NO: 1260280 - DNA, 22 bp, Homo sapiens
cccaatgctttgggaggccaag

SEQ ID NO: 1260281 - DNA, 20 bp, Homo sapiens
cccaatgtatgtgtggctgt

SEQ ID NO: 1260282 - DNA, 16 bp, Homo sapiens
cccaatgtctcccaca

SEQ ID NO: 1260283 - DNA, 17 bp, Homo sapiens
cccaatgtctcccacac

SEQ ID NO: 1260284 - DNA, 19 bp, Homo sapiens
cccaattacagggtgactc

SEQ ID NO: 1260285 - DNA, 21 bp, Homo sapiens
cccaattacagggtgactcac

SEQ ID NO: 1260286 - DNA, 22 bp, Homo sapiens
cccaattactattccctttgac

SEQ ID NO: 1260287 - DNA, 15 bp, Homo sapiens
cccaattgagaaaaa

SEQ ID NO: 1260288 - DNA, 18 bp, Homo sapiens
cccaattgggaatgcaat

SEQ ID NO: 1260289 - DNA, 13 bp, Homo sapiens
cccacaaagcctt

SEQ ID NO: 1260290 - DNA, 22 bp, Homo sapiens
cccacaaagccttatcaagtgt

SEQ ID NO: 1260291 - DNA, 21 bp, Homo sapiens
cccacaaaggagagctagcag

SEQ ID NO: 1260292 - DNA, 15 bp, Homo sapiens
cccacaagctgcctc

SEQ ID NO: 1260293 - DNA, 20 bp, Homo sapiens
cccacaatcacaagaagatt

SEQ ID NO: 1260294 - DNA, 22 bp, Homo sapiens
cccacaattaaaccgcatgtga

SEQ ID NO: 1260295 - DNA, 15 bp, Homo sapiens
cccacacactcgccc

SEQ ID NO: 1260296 - DNA, 21 bp, Homo sapiens
cccacacagctgccctagctg

SEQ ID NO: 1260297 - DNA, 15 bp, Homo sapiens
cccacacccagggct

SEQ ID NO: 1260298 - DNA, 16 bp, Homo sapiens
cccacacccagggcta

SEQ ID NO: 1260299 - DNA, 20 bp, Homo sapiens
cccacaccgtcttccttcag

SEQ ID NO: 1260300 - DNA, 13 bp, Homo sapiens
cccacacctcctc

SEQ ID NO: 1260301 - DNA, 12 bp, Homo sapiens
cccacacctggg

SEQ ID NO: 1260302 - DNA, 22 bp, Homo sapiens
cccacacggaggcatctgcacc

SEQ ID NO: 1260303 - DNA, 23 bp, Homo sapiens
cccacacggaggcatctgcaccc

SEQ ID NO: 1260304 - DNA, 15 bp, Homo sapiens
cccacacggcagccc

SEQ ID NO: 1260305 - DNA, 13 bp, Homo sapiens
cccacactgaggc

SEQ ID NO: 1260306 - DNA, 19 bp, Homo sapiens
cccacactgtggccaggcc

SEQ ID NO: 1260307 - DNA, 14 bp, Homo sapiens
cccacacttccctg

SEQ ID NO: 1260308 - DNA, 19 bp, Homo sapiens
cccacacttgagaggatga

SEQ ID NO: 1260309 - DNA, 19 bp, Homo sapiens
cccacacttgttccagctc

SEQ ID NO: 1260310 - DNA, 12 bp, Homo sapiens
cccacagacctg

SEQ ID NO: 1260311 - DNA, 15 bp, Homo sapiens
cccacagacctgcag

SEQ ID NO: 1260312 - DNA, 15 bp, Homo sapiens
cccacagactgcccc

SEQ ID NO: 1260313 - DNA, 19 bp, Homo sapiens
cccacagactgccccagcc

SEQ ID NO: 1260314 - DNA, 20 bp, Homo sapiens
cccacagagatgcatgcgca

SEQ ID NO: 1260315 - DNA, 12 bp, Homo sapiens
cccacagagcct

SEQ ID NO: 1260316 - DNA, 14 bp, Homo sapiens
cccacagcgagcct

SEQ ID NO: 1260317 - DNA, 14 bp, Homo sapiens
cccacagctacctg

SEQ ID NO: 1260318 - DNA, 19 bp, Homo sapiens
cccacagctacctgagacg

SEQ ID NO: 1260319 - DNA, 12 bp, Homo sapiens
cccacagctccc

SEQ ID NO: 1260320 - DNA, 15 bp, Homo sapiens
cccacagctcccacc

SEQ ID NO: 1260321 - DNA, 19 bp, Homo sapiens
cccacagctcccaccccac

SEQ ID NO: 1260322 - DNA, 17 bp, Homo sapiens
cccacagctctgggcct

SEQ ID NO: 1260323 - DNA, 20 bp, Homo sapiens
cccacaggacatttctctaa

SEQ ID NO: 1260324 - DNA, 16 bp, Homo sapiens
cccacaggcccttcct

SEQ ID NO: 1260325 - DNA, 14 bp, Homo sapiens
cccacaggcctgtt

SEQ ID NO: 1260326 - DNA, 15 bp, Homo sapiens
cccacaggcctgttc

SEQ ID NO: 1260327 - DNA, 21 bp, Homo sapiens
cccacaggtgaggggcaggac

SEQ ID NO: 1260328 - DNA, 12 bp, Homo sapiens
cccacaggtgcg

SEQ ID NO: 1260329 - DNA, 22 bp, Homo sapiens
cccacaggtgcgggaccatctg

SEQ ID NO: 1260330 - DNA, 20 bp, Homo sapiens
cccacagtgagaggggaggg

SEQ ID NO: 1260331 - DNA, 20 bp, Homo sapiens
cccacagttttaataagaac

SEQ ID NO: 1260332 - DNA, 19 bp, Homo sapiens
cccacatcccactggatct

SEQ ID NO: 1260333 - DNA, 20 bp, Homo sapiens
cccacatccttctcactgcc

SEQ ID NO: 1260334 - DNA, 11 bp, Homo sapiens
cccacatcttt

SEQ ID NO: 1260335 - DNA, 18 bp, Homo sapiens
cccacatgaggccatctc

SEQ ID NO: 1260336 - DNA, 22 bp, Homo sapiens
cccacatgaggccatctcagga

SEQ ID NO: 1260337 - DNA, 23 bp, Homo sapiens
cccacatgaggccatctcaggag

SEQ ID NO: 1260338 - DNA, 17 bp, Homo sapiens
cccacatgggacctggc

SEQ ID NO: 1260339 - DNA, 16 bp, Homo sapiens
cccaccaacctccagt

SEQ ID NO: 1260340 - DNA, 14 bp, Homo sapiens
cccaccaactctgc

SEQ ID NO: 1260341 - DNA, 16 bp, Homo sapiens
cccaccaactctgcac

SEQ ID NO: 1260342 - DNA, 16 bp, Homo sapiens
cccaccaatctgccct

SEQ ID NO: 1260343 - DNA, 22 bp, Homo sapiens
cccaccacctaggccactcctc

SEQ ID NO: 1260344 - DNA, 20 bp, Homo sapiens
cccaccaccttggactcctc

SEQ ID NO: 1260345 - DNA, 23 bp, Homo sapiens
cccaccaccttggactcctccca

SEQ ID NO: 1260346 - DNA, 23 bp, Homo sapiens
cccaccacgcatgctcagtgcct

SEQ ID NO: 1260347 - DNA, 23 bp, Homo sapiens
cccaccactaggactctgaggct

SEQ ID NO: 1260348 - DNA, 12 bp, Homo sapiens
cccaccagccag

SEQ ID NO: 1260349 - DNA, 13 bp, Homo sapiens
cccaccagccagc

SEQ ID NO: 1260350 - DNA, 14 bp, Homo sapiens
cccaccagccagcc

SEQ ID NO: 1260351 - DNA, 17 bp, Homo sapiens
cccaccagccagccctg

SEQ ID NO: 1260352 - DNA, 21 bp, Homo sapiens
cccaccagccagccctggccc

SEQ ID NO: 1260353 - DNA, 16 bp, Homo sapiens
cccaccagctccacac

SEQ ID NO: 1260354 - DNA, 21 bp, Homo sapiens
cccaccaggagcacctggacc

SEQ ID NO: 1260355 - DNA, 17 bp, Homo sapiens
cccaccatcaccaccgc

SEQ ID NO: 1260356 - DNA, 12 bp, Homo sapiens
cccaccattcct

SEQ ID NO: 1260357 - DNA, 17 bp, Homo sapiens
cccaccattctacctga

SEQ ID NO: 1260358 - DNA, 12 bp, Homo sapiens
cccacccaagag

SEQ ID NO: 1260359 - DNA, 17 bp, Homo sapiens
cccacccaagagaggaa

SEQ ID NO: 1260360 - DNA, 18 bp, Homo sapiens
cccacccacacagctgcc

SEQ ID NO: 1260361 - DNA, 16 bp, Homo sapiens
cccacccaccccacag

SEQ ID NO: 1260362 - DNA, 15 bp, Homo sapiens
cccacccacccccag

SEQ ID NO: 1260363 - DNA, 16 bp, Homo sapiens
cccacccacccccagg

SEQ ID NO: 1260364 - DNA, 14 bp, Homo sapiens
cccacccacccgcc

SEQ ID NO: 1260365 - DNA, 12 bp, Homo sapiens
cccacccacctc

SEQ ID NO: 1260366 - DNA, 14 bp, Homo sapiens
cccacccacctcca

SEQ ID NO: 1260367 - DNA, 15 bp, Homo sapiens
cccacccacctccac

SEQ ID NO: 1260368 - DNA, 12 bp, Homo sapiens
cccacccacgca

SEQ ID NO: 1260369 - DNA, 15 bp, Homo sapiens
cccacccagctccag

SEQ ID NO: 1260370 - DNA, 12 bp, Homo sapiens
cccacccagctg

SEQ ID NO: 1260371 - DNA, 14 bp, Homo sapiens
cccacccagggagc

SEQ ID NO: 1260372 - DNA, 15 bp, Homo sapiens
cccacccagggagct

SEQ ID NO: 1260373 - DNA, 23 bp, Homo sapiens
cccacccagggctccctcctgga

SEQ ID NO: 1260374 - DNA, 17 bp, Homo sapiens
cccacccatcttcctgc

SEQ ID NO: 1260375 - DNA, 14 bp, Homo sapiens
cccaccccacactt

SEQ ID NO: 1260376 - DNA, 18 bp, Homo sapiens
cccaccccacagactccg

SEQ ID NO: 1260377 - DNA, 13 bp, Homo sapiens
cccaccccactca

SEQ ID NO: 1260378 - DNA, 23 bp, Homo sapiens
cccaccccactcaggggacccca

SEQ ID NO: 1260379 - DNA, 19 bp, Homo sapiens
cccaccccagcacagccac

SEQ ID NO: 1260380 - DNA, 14 bp, Homo sapiens
cccaccccagccta

SEQ ID NO: 1260381 - DNA, 18 bp, Homo sapiens
cccaccccatccagccag

SEQ ID NO: 1260382 - DNA, 14 bp, Homo sapiens
cccacccccaggcc

SEQ ID NO: 1260383 - DNA, 12 bp, Homo sapiens
cccacccccagt

SEQ ID NO: 1260384 - DNA, 15 bp, Homo sapiens
cccaccccccagcct

SEQ ID NO: 1260385 - DNA, 13 bp, Homo sapiens
cccacccccctcc

SEQ ID NO: 1260386 - DNA, 14 bp, Homo sapiens
cccacccccctcct

SEQ ID NO: 1260387 - DNA, 16 bp, Homo sapiens
cccacccccctcctcc

SEQ ID NO: 1260388 - DNA, 18 bp, Homo sapiens
cccacccccctcctcccc

SEQ ID NO: 1260389 - DNA, 20 bp, Homo sapiens
cccacccccgggatcctgcc

SEQ ID NO: 1260390 - DNA, 13 bp, Homo sapiens
cccaccccctcaa

SEQ ID NO: 1260391 - DNA, 15 bp, Homo sapiens
cccaccccctcaagc

SEQ ID NO: 1260392 - DNA, 19 bp, Homo sapiens
cccaccccctccccagggg

SEQ ID NO: 1260393 - DNA, 15 bp, Homo sapiens
cccagcctgggccca

SEQ ID NO: 1260394 - DNA, 17 bp, Homo sapiens
cccagcctggggctccc

SEQ ID NO: 1260395 - DNA, 14 bp, Homo sapiens
cccagcctgtcctg

SEQ ID NO: 1260396 - DNA, 19 bp, Homo sapiens
cccagcctgtcctggtaca

SEQ ID NO: 1260397 - DNA, 20 bp, Homo sapiens
cccagcctgtcctggtacag

SEQ ID NO: 1260398 - DNA, 19 bp, Homo sapiens
cccagcctgtggttacagt

SEQ ID NO: 1260399 - DNA, 16 bp, Homo sapiens
cccagcgacacagaag

SEQ ID NO: 1260400 - DNA, 13 bp, Homo sapiens
cccagcgagccac

SEQ ID NO: 1260401 - DNA, 16 bp, Homo sapiens
cccagcgagccacagg

SEQ ID NO: 1260402 - DNA, 14 bp, Homo sapiens
cccagcgctcgcca

SEQ ID NO: 1260403 - DNA, 21 bp, Homo sapiens
cccagcgctcgccacgctcag

SEQ ID NO: 1260404 - DNA, 14 bp, Homo sapiens
cccagcggcccctc

SEQ ID NO: 1260405 - DNA, 19 bp, Homo sapiens
cccagcgtcaggcctacct

SEQ ID NO: 1260406 - DNA, 24 bp, Homo sapiens
cccagctacattcctcagctgcca

SEQ ID NO: 1260407 - DNA, 13 bp, Homo sapiens
cccagctacccct

SEQ ID NO: 1260408 - DNA, 21 bp, Homo sapiens
cccagctactcaagaggctga

SEQ ID NO: 1260409 - DNA, 22 bp, Homo sapiens
cccagctactcgggaggctgag

SEQ ID NO: 1260410 - DNA, 16 bp, Homo sapiens
cccagctactctgtcc

SEQ ID NO: 1260411 - DNA, 18 bp, Homo sapiens
cccagctactctgtccag

SEQ ID NO: 1260412 - DNA, 18 bp, Homo sapiens
cccagctacttgggaggc

SEQ ID NO: 1260413 - DNA, 22 bp, Homo sapiens
cccagctaggaagagcaggact

SEQ ID NO: 1260414 - DNA, 9 bp, Homo sapiens
cccagctcc

SEQ ID NO: 1260415 - DNA, 13 bp, Homo sapiens
cccagctccagca

SEQ ID NO: 1260416 - DNA, 19 bp, Homo sapiens
cccagctccaggcccaccg

SEQ ID NO: 1260417 - DNA, 13 bp, Homo sapiens
cccagctccaggg

SEQ ID NO: 1260418 - DNA, 23 bp, Homo sapiens
cccagctcccgtgtaaataattt

SEQ ID NO: 1260419 - DNA, 14 bp, Homo sapiens
cccagctccctgca

SEQ ID NO: 1260420 - DNA, 22 bp, Homo sapiens
cccagctcccttgggaaggaca

SEQ ID NO: 1260421 - DNA, 13 bp, Homo sapiens
cccagctcctctg

SEQ ID NO: 1260422 - DNA, 21 bp, Homo sapiens
cccagctccttggctgcagcc

SEQ ID NO: 1260423 - DNA, 21 bp, Homo sapiens
cccagctccttttgtccccag

SEQ ID NO: 1260424 - DNA, 18 bp, Homo sapiens
cccagctctaagcagcca

SEQ ID NO: 1260425 - DNA, 14 bp, Homo sapiens
cccagctctagaca

SEQ ID NO: 1260426 - DNA, 16 bp, Homo sapiens
cccagctctccctctg

SEQ ID NO: 1260427 - DNA, 13 bp, Homo sapiens
cccagctctctga

SEQ ID NO: 1260428 - DNA, 14 bp, Homo sapiens
cccagctctctgac

SEQ ID NO: 1260429 - DNA, 16 bp, Homo sapiens
cccagctctctgacgc

SEQ ID NO: 1260430 - DNA, 13 bp, Homo sapiens
cccagctctggat

SEQ ID NO: 1260431 - DNA, 14 bp, Homo sapiens
cccagctcttgctc

SEQ ID NO: 1260432 - DNA, 20 bp, Homo sapiens
cccagctcttgctctcttgt

SEQ ID NO: 1260433 - DNA, 17 bp, Homo sapiens
cccagctgactgtggcc

SEQ ID NO: 1260434 - DNA, 13 bp, Homo sapiens
cccagctgcacct

SEQ ID NO: 1260435 - DNA, 20 bp, Homo sapiens
cccagctgctcccctgccac

SEQ ID NO: 1260436 - DNA, 18 bp, Homo sapiens
cccagctgggctctgcca

SEQ ID NO: 1260437 - DNA, 19 bp, Homo sapiens
cccagctgggctctgccac

SEQ ID NO: 1260438 - DNA, 22 bp, Homo sapiens
cccagctgggctctgccaccct

SEQ ID NO: 1260439 - DNA, 17 bp, Homo sapiens
cccagctgggtcaggca

SEQ ID NO: 1260440 - DNA, 16 bp, Homo sapiens
cccagctggtgggaag

SEQ ID NO: 1260441 - DNA, 22 bp, Homo sapiens
cccagctggtgggaagcgtctg

SEQ ID NO: 1260442 - DNA, 17 bp, Homo sapiens
cccagctgtagccatgg

SEQ ID NO: 1260443 - DNA, 21 bp, Homo sapiens
cccagctgtgctgtggagaga

SEQ ID NO: 1260444 - DNA, 12 bp, Homo sapiens
cccagcttcctg

SEQ ID NO: 1260445 - DNA, 20 bp, Homo sapiens
cccagcttctctctccctgt

SEQ ID NO: 1260446 - DNA, 23 bp, Homo sapiens
cccagcttctctctccctgtcac

SEQ ID NO: 1260447 - DNA, 15 bp, Homo sapiens
cccagcttgctgagg

SEQ ID NO: 1260448 - DNA, 17 bp, Homo sapiens
cccagcttgtaggagct

SEQ ID NO: 1260449 - DNA, 15 bp, Homo sapiens
cccaggaaagaggca

SEQ ID NO: 1260450 - DNA, 16 bp, Homo sapiens
cccaggaaagaggcat

SEQ ID NO: 1260451 - DNA, 15 bp, Homo sapiens
cccaggaagcaggga

SEQ ID NO: 1260452 - DNA, 23 bp, Homo sapiens
cccaggaagccggtgcctgggtg

SEQ ID NO: 1260453 - DNA, 20 bp, Homo sapiens
cccaggaccaagccacagca

SEQ ID NO: 1260454 - DNA, 17 bp, Homo sapiens
cccaggaccagctgggg

SEQ ID NO: 1260455 - DNA, 19 bp, Homo sapiens
cccaggaccagctggggcg

SEQ ID NO: 1260456 - DNA, 17 bp, Homo sapiens
cccaggacccctcagct

SEQ ID NO: 1260457 - DNA, 15 bp, Homo sapiens
cccaggacgcttctg

SEQ ID NO: 1260458 - DNA, 14 bp, Homo sapiens
cccaggactctggc

SEQ ID NO: 1260459 - DNA, 15 bp, Homo sapiens
cccaggactctggca

SEQ ID NO: 1260460 - DNA, 16 bp, Homo sapiens
cccaggagacagacca

SEQ ID NO: 1260461 - DNA, 21 bp, Homo sapiens
cccaggagagccagccctccc

SEQ ID NO: 1260462 - DNA, 20 bp, Homo sapiens
cccaggagagcccccaccag

SEQ ID NO: 1260463 - DNA, 21 bp, Homo sapiens
cccaggagagcccccaccagc

SEQ ID NO: 1260464 - DNA, 18 bp, Homo sapiens
cccaggagcaacagccta

SEQ ID NO: 1260465 - DNA, 15 bp, Homo sapiens
cccaggagctctgcg

SEQ ID NO: 1260466 - DNA, 16 bp, Homo sapiens
cccaggagctctgcgc

SEQ ID NO: 1260467 - DNA, 17 bp, Homo sapiens
cccaggagctctgcgcc

SEQ ID NO: 1260468 - DNA, 21 bp, Homo sapiens
cccaggagctctgcgccaggc

SEQ ID NO: 1260469 - DNA, 23 bp, Homo sapiens
cccaggagctctgcgccaggcag

SEQ ID NO: 1260470 - DNA, 18 bp, Homo sapiens
cccaggagctgagtcacc

SEQ ID NO: 1260471 - DNA, 19 bp, Homo sapiens
cccaggagctgagtcacct

SEQ ID NO: 1260472 - DNA, 14 bp, Homo sapiens
cccaggagggaggg

SEQ ID NO: 1260473 - DNA, 19 bp, Homo sapiens
cccaggagttcgagaccaa

SEQ ID NO: 1260474 - DNA, 20 bp, Homo sapiens
cccaggagttttaagtccag

SEQ ID NO: 1260475 - DNA, 19 bp, Homo sapiens
cccaggatactggcacaga

SEQ ID NO: 1260476 - DNA, 13 bp, Homo sapiens
cccaggattcccc

SEQ ID NO: 1260477 - DNA, 20 bp, Homo sapiens
cccaggcaaatcagttacta

SEQ ID NO: 1260478 - DNA, 14 bp, Homo sapiens
cccaggcaagcagc

SEQ ID NO: 1260479 - DNA, 16 bp, Homo sapiens
cccaggcaccaccagg

SEQ ID NO: 1260480 - DNA, 17 bp, Homo sapiens
cccaggcaccaccagga

SEQ ID NO: 1260481 - DNA, 18 bp, Homo sapiens
cccaggcaccaccaggag

SEQ ID NO: 1260482 - DNA, 22 bp, Homo sapiens
cccaggcaccaccaggagcagc

SEQ ID NO: 1260483 - DNA, 20 bp, Homo sapiens
cccaggcagacaaccttgtc

SEQ ID NO: 1260484 - DNA, 13 bp, Homo sapiens
cccaggcagccac

SEQ ID NO: 1260485 - DNA, 13 bp, Homo sapiens
cccaggcagcctc

SEQ ID NO: 1260486 - DNA, 18 bp, Homo sapiens
cccaggcagctatttcag

SEQ ID NO: 1260487 - DNA, 15 bp, Homo sapiens
cccaggcagggccaa

SEQ ID NO: 1260488 - DNA, 13 bp, Homo sapiens
cccaggcaggtct

SEQ ID NO: 1260489 - DNA, 16 bp, Homo sapiens
cccaggcaggtctgca

SEQ ID NO: 1260490 - DNA, 23 bp, Homo sapiens
cccaggcatctccttgggctggg

SEQ ID NO: 1260491 - DNA, 17 bp, Homo sapiens
cccaggcatctgcctct

SEQ ID NO: 1260492 - DNA, 16 bp, Homo sapiens
cccaggcatgcagctg

SEQ ID NO: 1260493 - DNA, 19 bp, Homo sapiens
cccaggcatgcagctgcct

SEQ ID NO: 1260494 - DNA, 11 bp, Homo sapiens
cccaggccacc

SEQ ID NO: 1260495 - DNA, 19 bp, Homo sapiens
cccaggccagcccccccac

SEQ ID NO: 1260496 - DNA, 20 bp, Homo sapiens
cccaggccaggccaccagga

SEQ ID NO: 1260497 - DNA, 13 bp, Homo sapiens
cccaggccatgtg

SEQ ID NO: 1260498 - DNA, 15 bp, Homo sapiens
cccaggccatgtggc

SEQ ID NO: 1260499 - DNA, 16 bp, Homo sapiens
cccaggccatgtggcc

SEQ ID NO: 1260500 - DNA, 18 bp, Homo sapiens
cccaggccatgtggcctg

SEQ ID NO: 1260501 - DNA, 11 bp, Homo sapiens
cccaggcccac

SEQ ID NO: 1260502 - DNA, 16 bp, Homo sapiens
cccaggcccagccctc

SEQ ID NO: 1260503 - DNA, 10 bp, Homo sapiens
cccaggcccc

SEQ ID NO: 1260504 - DNA, 20 bp, Homo sapiens
cccaggcccccggctttcct

SEQ ID NO: 1260505 - DNA, 15 bp, Homo sapiens
cccaggccctccatg

SEQ ID NO: 1260506 - DNA, 19 bp, Homo sapiens
cccaggccctccatgggct

SEQ ID NO: 1260507 - DNA, 14 bp, Homo sapiens
cccaggccctccca

SEQ ID NO: 1260508 - DNA, 15 bp, Homo sapiens
cccaggccctccctg

SEQ ID NO: 1260509 - DNA, 20 bp, Homo sapiens
cccaggcccttggctgcagg

SEQ ID NO: 1260510 - DNA, 13 bp, Homo sapiens
cccaggccgcagc

SEQ ID NO: 1260511 - DNA, 14 bp, Homo sapiens
cccaggccggagcc

SEQ ID NO: 1260512 - DNA, 14 bp, Homo sapiens
cccaggccggccca

SEQ ID NO: 1260513 - DNA, 15 bp, Homo sapiens
cccaggccgggaaga

SEQ ID NO: 1260514 - DNA, 22 bp, Homo sapiens
cccaggccgggaagagccacct

SEQ ID NO: 1260515 - DNA, 20 bp, Homo sapiens
cccatcggtgtccatttata

SEQ ID NO: 1260516 - DNA, 19 bp, Homo sapiens
cccatcgtctcggccttca

SEQ ID NO: 1260517 - DNA, 22 bp, Homo sapiens
cccatcgtctcggccttcacaa

SEQ ID NO: 1260518 - DNA, 22 bp, Homo sapiens
cccatctcatcctggcacgccc

SEQ ID NO: 1260519 - DNA, 22 bp, Homo sapiens
cccatctcatgcccctggctgg

SEQ ID NO: 1260520 - DNA, 14 bp, Homo sapiens
cccatctccaggga

SEQ ID NO: 1260521 - DNA, 13 bp, Homo sapiens
cccatctccccct

SEQ ID NO: 1260522 - DNA, 12 bp, Homo sapiens
cccatctccctg

SEQ ID NO: 1260523 - DNA, 14 bp, Homo sapiens
cccatctccctgcc

SEQ ID NO: 1260524 - DNA, 15 bp, Homo sapiens
cccatctccctgcct

SEQ ID NO: 1260525 - DNA, 19 bp, Homo sapiens
cccatctccttacctctgg

SEQ ID NO: 1260526 - DNA, 19 bp, Homo sapiens
cccatctctacaaaaagca

SEQ ID NO: 1260527 - DNA, 13 bp, Homo sapiens
cccatctctccct

SEQ ID NO: 1260528 - DNA, 13 bp, Homo sapiens
cccatctgcaccc

SEQ ID NO: 1260529 - DNA, 18 bp, Homo sapiens
cccatctgccctccctgt

SEQ ID NO: 1260530 - DNA, 23 bp, Homo sapiens
cccatctgggagtccccttttct

SEQ ID NO: 1260531 - DNA, 13 bp, Homo sapiens
cccatcttccacc

SEQ ID NO: 1260532 - DNA, 15 bp, Homo sapiens
cccatcttcctgctg

SEQ ID NO: 1260533 - DNA, 19 bp, Homo sapiens
cccatcttgatctttgagc

SEQ ID NO: 1260534 - DNA, 22 bp, Homo sapiens
cccatcttgatctttgagccca

SEQ ID NO: 1260535 - DNA, 12 bp, Homo sapiens
cccatcttgctt

SEQ ID NO: 1260536 - DNA, 19 bp, Homo sapiens
cccatctttgatccttctg

SEQ ID NO: 1260537 - DNA, 20 bp, Homo sapiens
cccatctttgatccttctga

SEQ ID NO: 1260538 - DNA, 22 bp, Homo sapiens
cccatgaacttaaaatgaaagt

SEQ ID NO: 1260539 - DNA, 19 bp, Homo sapiens
cccatgaagacaggacagt

SEQ ID NO: 1260540 - DNA, 14 bp, Homo sapiens
cccatgacccaccc

SEQ ID NO: 1260541 - DNA, 15 bp, Homo sapiens
cccatgacccacccc

SEQ ID NO: 1260542 - DNA, 19 bp, Homo sapiens
cccatgacccacccctgtg

SEQ ID NO: 1260543 - DNA, 16 bp, Homo sapiens
cccatgactcttggag

SEQ ID NO: 1260544 - DNA, 22 bp, Homo sapiens
cccatgactttatatggatgat

SEQ ID NO: 1260545 - DNA, 13 bp, Homo sapiens
cccatgagcctgc

SEQ ID NO: 1260546 - DNA, 15 bp, Homo sapiens
cccatgagcctgccc

SEQ ID NO: 1260547 - DNA, 16 bp, Homo sapiens
cccatgagcctgcccg

SEQ ID NO: 1260548 - DNA, 19 bp, Homo sapiens
cccatgagctcggggtcca

SEQ ID NO: 1260549 - DNA, 22 bp, Homo sapiens
cccatgagctcggggtccacca

SEQ ID NO: 1260550 - DNA, 23 bp, Homo sapiens
cccatgagttggggtctggcagc

SEQ ID NO: 1260551 - DNA, 14 bp, Homo sapiens
cccatgcaggccct

SEQ ID NO: 1260552 - DNA, 17 bp, Homo sapiens
cccatgcaggtggtgtc

SEQ ID NO: 1260553 - DNA, 15 bp, Homo sapiens
cccatgcccacctgc

SEQ ID NO: 1260554 - DNA, 23 bp, Homo sapiens
cccatgcccccttcgctcctcct

SEQ ID NO: 1260555 - DNA, 23 bp, Homo sapiens
cccatgcctggtcccaagacagt

SEQ ID NO: 1260556 - DNA, 12 bp, Homo sapiens
cccatgcctgtc

SEQ ID NO: 1260557 - DNA, 19 bp, Homo sapiens
cccatgcctgtccagcctg

SEQ ID NO: 1260558 - DNA, 20 bp, Homo sapiens
cccatgcgtgccgcctgctc

SEQ ID NO: 1260559 - DNA, 22 bp, Homo sapiens
cccatgcgtgccgcctgctcct

SEQ ID NO: 1260560 - DNA, 15 bp, Homo sapiens
cccatgctctgcccc

SEQ ID NO: 1260561 - DNA, 17 bp, Homo sapiens
cccatgctctgccccaa

SEQ ID NO: 1260562 - DNA, 20 bp, Homo sapiens
cccatgcttacgtgatcctc

SEQ ID NO: 1260563 - DNA, 15 bp, Homo sapiens
cccatggacactcca

SEQ ID NO: 1260564 - DNA, 16 bp, Homo sapiens
cccatggacactccag

SEQ ID NO: 1260565 - DNA, 21 bp, Homo sapiens
cccatggacactccagtgcca

SEQ ID NO: 1260566 - DNA, 22 bp, Homo sapiens
cccatggacactccagtgccag

SEQ ID NO: 1260567 - DNA, 15 bp, Homo sapiens
cccatggacaggctg

SEQ ID NO: 1260568 - DNA, 18 bp, Homo sapiens
cccatggcccccaataaa

SEQ ID NO: 1260569 - DNA, 19 bp, Homo sapiens
cccatggcccccaataaag

SEQ ID NO: 1260570 - DNA, 16 bp, Homo sapiens
cccatgggagccaggc

SEQ ID NO: 1260571 - DNA, 17 bp, Homo sapiens
cccatgggctcccactg

SEQ ID NO: 1260572 - DNA, 23 bp, Homo sapiens
cccatgggctgagtggggagcag

SEQ ID NO: 1260573 - DNA, 15 bp, Homo sapiens
cccatgggctgtgtc

SEQ ID NO: 1260574 - DNA, 23 bp, Homo sapiens
cccatgggctgtgtcctaaggcc

SEQ ID NO: 1260575 - DNA, 21 bp, Homo sapiens
cccatgggcttggacttcctg

SEQ ID NO: 1260576 - DNA, 13 bp, Homo sapiens
cccatggggagga

SEQ ID NO: 1260577 - DNA, 22 bp, Homo sapiens
cccatgggttgtgtgtttattt

SEQ ID NO: 1260578 - DNA, 17 bp, Homo sapiens
cccatggtgctaggaag

SEQ ID NO: 1260579 - DNA, 14 bp, Homo sapiens
cccatggtggcctc

SEQ ID NO: 1260580 - DNA, 23 bp, Homo sapiens
cccatgtagccccctggcctctg

SEQ ID NO: 1260581 - DNA, 22 bp, Homo sapiens
cccatgtcttctgctgttcttc

SEQ ID NO: 1260582 - DNA, 13 bp, Homo sapiens
cccatgtgccaag

SEQ ID NO: 1260583 - DNA, 16 bp, Homo sapiens
cccatgtggcagccca

SEQ ID NO: 1260584 - DNA, 19 bp, Homo sapiens
cccatgtggcagcccatgg

SEQ ID NO: 1260585 - DNA, 17 bp, Homo sapiens
cccatgtgtcccctcac

SEQ ID NO: 1260586 - DNA, 23 bp, Homo sapiens
cccatgtgtcccctcactctgtc

SEQ ID NO: 1260587 - DNA, 21 bp, Homo sapiens
cccatgtgtcctggttcccgt

SEQ ID NO: 1260588 - DNA, 23 bp, Homo sapiens
cccatgttagctacacagtgcag

SEQ ID NO: 1260589 - DNA, 18 bp, Homo sapiens
cccatgttctgcccccag

SEQ ID NO: 1260590 - DNA, 14 bp, Homo sapiens
cccatgttgtaatg

SEQ ID NO: 1260591 - DNA, 20 bp, Homo sapiens
cccatgtttaaactttgtgc

SEQ ID NO: 1260592 - DNA, 17 bp, Homo sapiens
cccattattatttctgt

SEQ ID NO: 1260593 - DNA, 20 bp, Homo sapiens
cccattcatattaagacagt

SEQ ID NO: 1260594 - DNA, 14 bp, Homo sapiens
cccattccctggga

SEQ ID NO: 1260595 - DNA, 13 bp, Homo sapiens
cccattcctccct

SEQ ID NO: 1260596 - DNA, 19 bp, Homo sapiens
cccattctagatcctgcac

SEQ ID NO: 1260597 - DNA, 21 bp, Homo sapiens
cccattctagatcctgcaccc

SEQ ID NO: 1260598 - DNA, 14 bp, Homo sapiens
cccattctcccagt

SEQ ID NO: 1260599 - DNA, 17 bp, Homo sapiens
cccattctctctcctgt

SEQ ID NO: 1260600 - DNA, 14 bp, Homo sapiens
cccattcttctggg

SEQ ID NO: 1260601 - DNA, 21 bp, Homo sapiens
cccattcttttgtaatttaaa

SEQ ID NO: 1260602 - DNA, 22 bp, Homo sapiens
cccattcttttgtaatttaaat

SEQ ID NO: 1260603 - DNA, 18 bp, Homo sapiens
cccattggagcacctggg

SEQ ID NO: 1260604 - DNA, 19 bp, Homo sapiens
cccattggagcacctgggc

SEQ ID NO: 1260605 - DNA, 17 bp, Homo sapiens
cccattggccgagctcc

SEQ ID NO: 1260606 - DNA, 21 bp, Homo sapiens
cccattggccgagctcctggg

SEQ ID NO: 1260607 - DNA, 22 bp, Homo sapiens
cccattggccgagctcctgggg

SEQ ID NO: 1260608 - DNA, 14 bp, Homo sapiens
cccattgtccctct

SEQ ID NO: 1260609 - DNA, 15 bp, Homo sapiens
cccattgtccctctg

SEQ ID NO: 1260610 - DNA, 23 bp, Homo sapiens
cccattgtcctccttttcacttt

SEQ ID NO: 1260611 - DNA, 17 bp, Homo sapiens
cccattgttgtcaagga

SEQ ID NO: 1260612 - DNA, 20 bp, Homo sapiens
cccatttaaatttttttcct

SEQ ID NO: 1260613 - DNA, 12 bp, Homo sapiens
cccatttcagct

SEQ ID NO: 1260614 - DNA, 21 bp, Homo sapiens
cccatttcaggaatttaaaat

SEQ ID NO: 1260615 - DNA, 14 bp, Homo sapiens
cccatttcccatct

SEQ ID NO: 1260616 - DNA, 18 bp, Homo sapiens
cccatttcctcacactaa

SEQ ID NO: 1260617 - DNA, 12 bp, Homo sapiens
cccatttcctga

SEQ ID NO: 1260618 - DNA, 14 bp, Homo sapiens
cccatttctctaca

SEQ ID NO: 1260619 - DNA, 14 bp, Homo sapiens
cccatttctgcctc

SEQ ID NO: 1260620 - DNA, 17 bp, Homo sapiens
cccatttctgcctcgct

SEQ ID NO: 1260621 - DNA, 23 bp, Homo sapiens
cccatttctgcctcgctcaccgc

SEQ ID NO: 1260622 - DNA, 16 bp, Homo sapiens
cccatttctgttgctg

SEQ ID NO: 1260623 - DNA, 14 bp, Homo sapiens
cccatttcttgcta

SEQ ID NO: 1260624 - DNA, 21 bp, Homo sapiens
cccatttgagaagctgaggct

SEQ ID NO: 1260625 - DNA, 13 bp, Homo sapiens
cccatttgtccca

SEQ ID NO: 1260626 - DNA, 15 bp, Homo sapiens
cccattttcatcctg

SEQ ID NO: 1260627 - DNA, 18 bp, Homo sapiens
cccattttcatcctgagc

SEQ ID NO: 1260628 - DNA, 19 bp, Homo sapiens
cccattttcatcctgagcc

SEQ ID NO: 1260629 - DNA, 19 bp, Homo sapiens
cccattttccccttcctca

SEQ ID NO: 1260630 - DNA, 15 bp, Homo sapiens
cccattttcctctga

SEQ ID NO: 1260631 - DNA, 12 bp, Homo sapiens
cccattttgcaa

SEQ ID NO: 1260632 - DNA, 17 bp, Homo sapiens
cccatttttgctaatta

SEQ ID NO: 1260633 - DNA, 20 bp, Homo sapiens
ccccaaaaccacagccctgt

SEQ ID NO: 1260634 - DNA, 23 bp, Homo sapiens
ccccaaaaccacagccctgtcag

SEQ ID NO: 1260635 - DNA, 19 bp, Homo sapiens
ccccaaaagcgtgagctta

SEQ ID NO: 1260636 - DNA, 13 bp, Homo sapiens
ccccaggccaggt

SEQ ID NO: 1260637 - DNA, 14 bp, Homo sapiens
ccccaggccaggta

SEQ ID NO: 1260638 - DNA, 12 bp, Homo sapiens
ccccaggcccag

SEQ ID NO: 1260639 - DNA, 18 bp, Homo sapiens
ccccaggcccagccctcc

SEQ ID NO: 1260640 - DNA, 14 bp, Homo sapiens
ccccaggccccaga

SEQ ID NO: 1260641 - DNA, 20 bp, Homo sapiens
ccccaggcccgcgggcacag

SEQ ID NO: 1260642 - DNA, 14 bp, Homo sapiens
ccccaggccctact

SEQ ID NO: 1260643 - DNA, 13 bp, Homo sapiens
ccccaggccctcc

SEQ ID NO: 1260644 - DNA, 17 bp, Homo sapiens
ccccaggccggagccca

SEQ ID NO: 1260645 - DNA, 14 bp, Homo sapiens
ccccaggcctccag

SEQ ID NO: 1260646 - DNA, 13 bp, Homo sapiens
ccccaggcctcct

SEQ ID NO: 1260647 - DNA, 17 bp, Homo sapiens
ccccaggcctcctaggg

SEQ ID NO: 1260648 - DNA, 21 bp, Homo sapiens
ccccaggcctggacgggccct

SEQ ID NO: 1260649 - DNA, 23 bp, Homo sapiens
ccccaggcctggcctcgcctgcc

SEQ ID NO: 1260650 - DNA, 16 bp, Homo sapiens
ccccaggcctggctcc

SEQ ID NO: 1260651 - DNA, 13 bp, Homo sapiens
ccccaggccttgt

SEQ ID NO: 1260652 - DNA, 15 bp, Homo sapiens
ccccaggctcgtgga

SEQ ID NO: 1260653 - DNA, 11 bp, Homo sapiens
ccccaggctgg

SEQ ID NO: 1260654 - DNA, 11 bp, Homo sapiens
ccccagggagt

SEQ ID NO: 1260655 - DNA, 12 bp, Homo sapiens
ccccagggcagc

SEQ ID NO: 1260656 - DNA, 14 bp, Homo sapiens
ccccagggcagggt

SEQ ID NO: 1260657 - DNA, 13 bp, Homo sapiens
ccccagggcccct

SEQ ID NO: 1260658 - DNA, 23 bp, Homo sapiens
ccccagggcccctccctctgccc

SEQ ID NO: 1260659 - DNA, 16 bp, Homo sapiens
ccccagggcctccagg

SEQ ID NO: 1260660 - DNA, 16 bp, Homo sapiens
ccccagggcctgcgga

SEQ ID NO: 1260661 - DNA, 14 bp, Homo sapiens
ccccagggcctggg

SEQ ID NO: 1260662 - DNA, 18 bp, Homo sapiens
ccccaggggaaaatgaag

SEQ ID NO: 1260663 - DNA, 19 bp, Homo sapiens
ccccaggggcagcaaggcc

SEQ ID NO: 1260664 - DNA, 16 bp, Homo sapiens
ccccagggtcttccct

SEQ ID NO: 1260665 - DNA, 19 bp, Homo sapiens
ccccagggtcttccctacc

SEQ ID NO: 1260666 - DNA, 12 bp, Homo sapiens
ccccagggtggt

SEQ ID NO: 1260667 - DNA, 14 bp, Homo sapiens
ccccaggtcagccc

SEQ ID NO: 1260668 - DNA, 15 bp, Homo sapiens
ccccaggtcagccct

SEQ ID NO: 1260669 - DNA, 22 bp, Homo sapiens
ccccaggtcagccctgtgtctg

SEQ ID NO: 1260670 - DNA, 17 bp, Homo sapiens
ccccaggtccagctctg

SEQ ID NO: 1260671 - DNA, 22 bp, Homo sapiens
ccccaggtcctgtctctgcaca

SEQ ID NO: 1260672 - DNA, 15 bp, Homo sapiens
ccccaggtcttcctg

SEQ ID NO: 1260673 - DNA, 19 bp, Homo sapiens
ccccaggtcttcctgcttt

SEQ ID NO: 1260674 - DNA, 15 bp, Homo sapiens
ccccaggtcttttct

SEQ ID NO: 1260675 - DNA, 20 bp, Homo sapiens
ccccaggtggctgacccagt

SEQ ID NO: 1260676 - DNA, 22 bp, Homo sapiens
ccccaggtggttatggagaggg

SEQ ID NO: 1260677 - DNA, 14 bp, Homo sapiens
ccccagtacctcca

SEQ ID NO: 1260678 - DNA, 18 bp, Homo sapiens
ccccagtacctccaagca

SEQ ID NO: 1260679 - DNA, 19 bp, Homo sapiens
ccccagtccccacccctgc

SEQ ID NO: 1260680 - DNA, 18 bp, Homo sapiens
ccccagtccccagccctg

SEQ ID NO: 1260681 - DNA, 14 bp, Homo sapiens
ccccagtcctcact

SEQ ID NO: 1260682 - DNA, 14 bp, Homo sapiens
ccccagtctccagg

SEQ ID NO: 1260683 - DNA, 15 bp, Homo sapiens
ccccagtctccaggg

SEQ ID NO: 1260684 - DNA, 15 bp, Homo sapiens
ccccagtgacagcta

SEQ ID NO: 1260685 - DNA, 13 bp, Homo sapiens
ccccagtgcctgc

SEQ ID NO: 1260686 - DNA, 21 bp, Homo sapiens
ccccagtggggacagggaggg

SEQ ID NO: 1260687 - DNA, 14 bp, Homo sapiens
ccccagttctgctc

SEQ ID NO: 1260688 - DNA, 16 bp, Homo sapiens
ccccagttctgctcct

SEQ ID NO: 1260689 - DNA, 21 bp, Homo sapiens
ccccagttctgctcctctcca

SEQ ID NO: 1260690 - DNA, 13 bp, Homo sapiens
ccccagtttcttc

SEQ ID NO: 1260691 - DNA, 15 bp, Homo sapiens
ccccagtttcttctt

SEQ ID NO: 1260692 - DNA, 21 bp, Homo sapiens
ccccagtttggggtgccaaga

SEQ ID NO: 1260693 - DNA, 16 bp, Homo sapiens
ccccataactcaatgg

SEQ ID NO: 1260694 - DNA, 18 bp, Homo sapiens
ccccataataaccctgcc

SEQ ID NO: 1260695 - DNA, 20 bp, Homo sapiens
ccccataataaccctgccag

SEQ ID NO: 1260696 - DNA, 21 bp, Homo sapiens
ccccataataaccctgccagt

SEQ ID NO: 1260697 - DNA, 22 bp, Homo sapiens
ccccataattttttttttcctt

SEQ ID NO: 1260698 - DNA, 22 bp, Homo sapiens
ccccatacttggctgcttcctg

SEQ ID NO: 1260699 - DNA, 21 bp, Homo sapiens
ccccatcacctctactgtctc

SEQ ID NO: 1260700 - DNA, 13 bp, Homo sapiens
ccccatcactgcg

SEQ ID NO: 1260701 - DNA, 22 bp, Homo sapiens
ccccatcattactggtaaagcc

SEQ ID NO: 1260702 - DNA, 12 bp, Homo sapiens
ccccatcccagg

SEQ ID NO: 1260703 - DNA, 15 bp, Homo sapiens
ccccatcccagggtc

SEQ ID NO: 1260704 - DNA, 22 bp, Homo sapiens
ccccatcccagggtcccacccc

SEQ ID NO: 1260705 - DNA, 21 bp, Homo sapiens
ccccatcccattttcatcctg

SEQ ID NO: 1260706 - DNA, 13 bp, Homo sapiens
ccccatccccacc

SEQ ID NO: 1260707 - DNA, 14 bp, Homo sapiens
ccccatccccacca

SEQ ID NO: 1260708 - DNA, 15 bp, Homo sapiens
ccccatccccaccag

SEQ ID NO: 1260709 - DNA, 13 bp, Homo sapiens
ccccatccctggg

SEQ ID NO: 1260710 - DNA, 16 bp, Homo sapiens
ccccatcctccagctt

SEQ ID NO: 1260711 - DNA, 17 bp, Homo sapiens
ccccatcggccctgtcc

SEQ ID NO: 1260712 - DNA, 18 bp, Homo sapiens
ccccatcggccctgtccc

SEQ ID NO: 1260713 - DNA, 17 bp, Homo sapiens
ccccatctccccaggcc

SEQ ID NO: 1260714 - DNA, 13 bp, Homo sapiens
ccccatctccctg

SEQ ID NO: 1260715 - DNA, 14 bp, Homo sapiens
ccccatctccctgc

SEQ ID NO: 1260716 - DNA, 18 bp, Homo sapiens
ccccatctcggggctgct

SEQ ID NO: 1260717 - DNA, 13 bp, Homo sapiens
ccccatctctcat

SEQ ID NO: 1260718 - DNA, 15 bp, Homo sapiens
ccccatctctgagtg

SEQ ID NO: 1260719 - DNA, 17 bp, Homo sapiens
ccccatgagctcggggt

SEQ ID NO: 1260720 - DNA, 18 bp, Homo sapiens
ccccatgaggaaggaaca

SEQ ID NO: 1260721 - DNA, 20 bp, Homo sapiens
ccccatgcacctcagggcca

SEQ ID NO: 1260722 - DNA, 13 bp, Homo sapiens
ccccatgccaaag

SEQ ID NO: 1260723 - DNA, 22 bp, Homo sapiens
ccccatgccaaagctagggtgg

SEQ ID NO: 1260724 - DNA, 16 bp, Homo sapiens
ccccatgccacgttcc

SEQ ID NO: 1260725 - DNA, 12 bp, Homo sapiens
ccccatgcctgt

SEQ ID NO: 1260726 - DNA, 14 bp, Homo sapiens
ccccatgctctgcc

SEQ ID NO: 1260727 - DNA, 14 bp, Homo sapiens
ccccatgctgcctt

SEQ ID NO: 1260728 - DNA, 19 bp, Homo sapiens
ccccatggagctgggctaa

SEQ ID NO: 1260729 - DNA, 23 bp, Homo sapiens
ccccatggcttgttctctggaac

SEQ ID NO: 1260730 - DNA, 15 bp, Homo sapiens
ccccatgggctccca

SEQ ID NO: 1260731 - DNA, 18 bp, Homo sapiens
ccccatgggctcccactg

SEQ ID NO: 1260732 - DNA, 13 bp, Homo sapiens
ccccatgggcttg

SEQ ID NO: 1260733 - DNA, 14 bp, Homo sapiens
ccccatgggcttgg

SEQ ID NO: 1260734 - DNA, 22 bp, Homo sapiens
ccccatgggcttggacttcctg

SEQ ID NO: 1260735 - DNA, 15 bp, Homo sapiens
ccccatggggtcctt

SEQ ID NO: 1260736 - DNA, 16 bp, Homo sapiens
ccccatgtggcagccc

SEQ ID NO: 1260737 - DNA, 19 bp, Homo sapiens
ccccatgttgtaatgctgc

SEQ ID NO: 1260738 - DNA, 23 bp, Homo sapiens
ccccattcctgggaaatattccc

SEQ ID NO: 1260739 - DNA, 13 bp, Homo sapiens
ccccattccttgc

SEQ ID NO: 1260740 - DNA, 19 bp, Homo sapiens
ccccattctttccttctct

SEQ ID NO: 1260741 - DNA, 17 bp, Homo sapiens
ccccatttcccatctgc

SEQ ID NO: 1260742 - DNA, 22 bp, Homo sapiens
ccccatttcccatctgcacccc

SEQ ID NO: 1260743 - DNA, 13 bp, Homo sapiens
ccccatttcctca

SEQ ID NO: 1260744 - DNA, 16 bp, Homo sapiens
ccccatttcctcacac

SEQ ID NO: 1260745 - DNA, 12 bp, Homo sapiens
ccccatttcctg

SEQ ID NO: 1260746 - DNA, 20 bp, Homo sapiens
ccccatttctatttatttac

SEQ ID NO: 1260747 - DNA, 15 bp, Homo sapiens
ccccatttctgcctc

SEQ ID NO: 1260748 - DNA, 17 bp, Homo sapiens
ccccatttctgcctcgc

SEQ ID NO: 1260749 - DNA, 18 bp, Homo sapiens
ccccatttctgcctcgct

SEQ ID NO: 1260750 - DNA, 14 bp, Homo sapiens
ccccatttgtccca

SEQ ID NO: 1260751 - DNA, 20 bp, Homo sapiens
cccccaacacctgctgcgct

SEQ ID NO: 1260752 - DNA, 21 bp, Homo sapiens
cccccaacactgtgccctggt

SEQ ID NO: 1260753 - DNA, 23 bp, Homo sapiens
cccccaaccaagtggctcccaca

SEQ ID NO: 1260754 - DNA, 21 bp, Homo sapiens
cccccaacttgagatgtatga

SEQ ID NO: 1260755 - DNA, 18 bp, Homo sapiens
cccccaaggttctccaac

SEQ ID NO: 1260756 - DNA, 16 bp, Homo sapiens
cccccaataaaggcag

SEQ ID NO: 1260757 - DNA, 18 bp, Homo sapiens
cccccaataaaggcagct

SEQ ID NO: 1260758 - DNA, 19 bp, Homo sapiens
cccccaataaaggcagctg

SEQ ID NO: 1260759 - DNA, 18 bp, Homo sapiens
cccctctttctctttctt

SEQ ID NO: 1260760 - DNA, 16 bp, Homo sapiens
cccctctttgcacagc

SEQ ID NO: 1260761 - DNA, 14 bp, Homo sapiens
cccctgactcatca

SEQ ID NO: 1260762 - DNA, 23 bp, Homo sapiens
cccctgagaccacccccaaacac

SEQ ID NO: 1260763 - DNA, 17 bp, Homo sapiens
cccctgagagtttcctc

SEQ ID NO: 1260764 - DNA, 13 bp, Homo sapiens
cccctgagcccca

SEQ ID NO: 1260765 - DNA, 13 bp, Homo sapiens
cccctgaggactg

SEQ ID NO: 1260766 - DNA, 16 bp, Homo sapiens
cccctgaggactggag

SEQ ID NO: 1260767 - DNA, 21 bp, Homo sapiens
cccctgagttgggcagccagg

SEQ ID NO: 1260768 - DNA, 14 bp, Homo sapiens
cccctgatagaaga

SEQ ID NO: 1260769 - DNA, 15 bp, Homo sapiens
cccctgatctctgac

SEQ ID NO: 1260770 - DNA, 22 bp, Homo sapiens
cccctgatctctgacctctgct

SEQ ID NO: 1260771 - DNA, 23 bp, Homo sapiens
cccctgatctctgacctctgctg

SEQ ID NO: 1260772 - DNA, 17 bp, Homo sapiens
cccctgcaaaaagaaaa

SEQ ID NO: 1260773 - DNA, 21 bp, Homo sapiens
cccctgcaaaaagaaaaaaag

SEQ ID NO: 1260774 - DNA, 17 bp, Homo sapiens
cccctgcaaagcccagc

SEQ ID NO: 1260775 - DNA, 18 bp, Homo sapiens
cccctgcaaagcccagct

SEQ ID NO: 1260776 - DNA, 23 bp, Homo sapiens
cccctgcaagaagcgccgactcc

SEQ ID NO: 1260777 - DNA, 11 bp, Homo sapiens
cccctgcacag

SEQ ID NO: 1260778 - DNA, 13 bp, Homo sapiens
cccctgcacagtt

SEQ ID NO: 1260779 - DNA, 15 bp, Homo sapiens
cccctgcactaggca

SEQ ID NO: 1260780 - DNA, 19 bp, Homo sapiens
cccctgcagtttggccctg

SEQ ID NO: 1260781 - DNA, 23 bp, Homo sapiens
cccctgcagtttggccctggagc

SEQ ID NO: 1260782 - DNA, 24 bp, Homo sapiens
cccctgcatctatcgagtttgcaa

SEQ ID NO: 1260783 - DNA, 20 bp, Homo sapiens
cccctgccaccaggccacct

SEQ ID NO: 1260784 - DNA, 12 bp, Homo sapiens
cccctgccaccg

SEQ ID NO: 1260785 - DNA, 22 bp, Homo sapiens
cccctgccactcacccttcctg

SEQ ID NO: 1260786 - DNA, 13 bp, Homo sapiens
cccctgccagccg

SEQ ID NO: 1260787 - DNA, 22 bp, Homo sapiens
cccctgccagccgaccctcctg

SEQ ID NO: 1260788 - DNA, 24 bp, Homo sapiens
cccctgccagccgaccctcctggc

SEQ ID NO: 1260789 - DNA, 15 bp, Homo sapiens
cccctgccagggcag

SEQ ID NO: 1260790 - DNA, 23 bp, Homo sapiens
cccctgccagggcagggccccag

SEQ ID NO: 1260791 - DNA, 15 bp, Homo sapiens
cccctgccagtgcct

SEQ ID NO: 1260792 - DNA, 17 bp, Homo sapiens
cccctgccagtgcctta

SEQ ID NO: 1260793 - DNA, 22 bp, Homo sapiens
cccctgccccgtcaccatctca

SEQ ID NO: 1260794 - DNA, 13 bp, Homo sapiens
cccctgcccgcca

SEQ ID NO: 1260795 - DNA, 13 bp, Homo sapiens
cccctgccctcgt

SEQ ID NO: 1260796 - DNA, 14 bp, Homo sapiens
cccctgccctcgtg

SEQ ID NO: 1260797 - DNA, 15 bp, Homo sapiens
cccctgccctcgtgg

SEQ ID NO: 1260798 - DNA, 22 bp, Homo sapiens
cccctgccctcgtggccagccc

SEQ ID NO: 1260799 - DNA, 23 bp, Homo sapiens
cccctgccctcgtggccagcccg

SEQ ID NO: 1260800 - DNA, 13 bp, Homo sapiens
cccctgccctgca

SEQ ID NO: 1260801 - DNA, 13 bp, Homo sapiens
cccctgccctgct

SEQ ID NO: 1260802 - DNA, 14 bp, Homo sapiens
cccctgccctgtgc

SEQ ID NO: 1260803 - DNA, 15 bp, Homo sapiens
cccctgccctgtgcc

SEQ ID NO: 1260804 - DNA, 17 bp, Homo sapiens
cccctgcctcccatgcc

SEQ ID NO: 1260805 - DNA, 17 bp, Homo sapiens
cccctgcctcccattct

SEQ ID NO: 1260806 - DNA, 12 bp, Homo sapiens
cccctgcctcct

SEQ ID NO: 1260807 - DNA, 17 bp, Homo sapiens
cccctgcctcctgccac

SEQ ID NO: 1260808 - DNA, 12 bp, Homo sapiens
cccctgcctcga

SEQ ID NO: 1260809 - DNA, 22 bp, Homo sapiens
cccctgcctcgagggccgcctg

SEQ ID NO: 1260810 - DNA, 10 bp, Homo sapiens
cccctgcctg

SEQ ID NO: 1260811 - DNA, 12 bp, Homo sapiens
cccctgcctgac

SEQ ID NO: 1260812 - DNA, 14 bp, Homo sapiens
cccctgcctgacag

SEQ ID NO: 1260813 - DNA, 20 bp, Homo sapiens
cccctgcctgacagccttcc

SEQ ID NO: 1260814 - DNA, 13 bp, Homo sapiens
cccctgcctgcca

SEQ ID NO: 1260815 - DNA, 14 bp, Homo sapiens
cccctgcctgccat

SEQ ID NO: 1260816 - DNA, 15 bp, Homo sapiens
cccctgcctgccatg

SEQ ID NO: 1260817 - DNA, 19 bp, Homo sapiens
cccctgctactcctgtgct

SEQ ID NO: 1260818 - DNA, 15 bp, Homo sapiens
cccctgctccaccag

SEQ ID NO: 1260819 - DNA, 18 bp, Homo sapiens
cccctgctcccagcctgc

SEQ ID NO: 1260820 - DNA, 23 bp, Homo sapiens
cccctgctctacccatgagcctg

SEQ ID NO: 1260821 - DNA, 13 bp, Homo sapiens
cccctgctgacct

SEQ ID NO: 1260822 - DNA, 15 bp, Homo sapiens
cccctgctgaccttg

SEQ ID NO: 1260823 - DNA, 13 bp, Homo sapiens
cccctgctgccca

SEQ ID NO: 1260824 - DNA, 12 bp, Homo sapiens
cccctgctgcct

SEQ ID NO: 1260825 - DNA, 13 bp, Homo sapiens
cccctggaaccag

SEQ ID NO: 1260826 - DNA, 20 bp, Homo sapiens
cccctggaagagcccagtct

SEQ ID NO: 1260827 - DNA, 16 bp, Homo sapiens
cccctggacccctggg

SEQ ID NO: 1260828 - DNA, 17 bp, Homo sapiens
cccctggacccctgggg

SEQ ID NO: 1260829 - DNA, 14 bp, Homo sapiens
cccctggacttctt

SEQ ID NO: 1260830 - DNA, 11 bp, Homo sapiens
cccctggagcc

SEQ ID NO: 1260831 - DNA, 19 bp, Homo sapiens
cccctggagtgtgtcagag

SEQ ID NO: 1260832 - DNA, 22 bp, Homo sapiens
cccctggagtgtgtcagagccc

SEQ ID NO: 1260833 - DNA, 20 bp, Homo sapiens
cccctggatgtcccctgtcc

SEQ ID NO: 1260834 - DNA, 21 bp, Homo sapiens
cccctggatgtcccctgtccc

SEQ ID NO: 1260835 - DNA, 21 bp, Homo sapiens
cccctggcagcacagcccagg

SEQ ID NO: 1260836 - DNA, 23 bp, Homo sapiens
cccctggcagctgcccctcctgg

SEQ ID NO: 1260837 - DNA, 12 bp, Homo sapiens
cccctggccagc

SEQ ID NO: 1260838 - DNA, 13 bp, Homo sapiens
cccctggccagct

SEQ ID NO: 1260839 - DNA, 14 bp, Homo sapiens
cccctggccagctc

SEQ ID NO: 1260840 - DNA, 16 bp, Homo sapiens
cccctggcccagcggc

SEQ ID NO: 1260841 - DNA, 17 bp, Homo sapiens
cccctggcccagcggcc

SEQ ID NO: 1260842 - DNA, 15 bp, Homo sapiens
cccctggcccatctc

SEQ ID NO: 1260843 - DNA, 20 bp, Homo sapiens
cccctggcccatctcagcct

SEQ ID NO: 1260844 - DNA, 13 bp, Homo sapiens
cccctggcctgcc

SEQ ID NO: 1260845 - DNA, 12 bp, Homo sapiens
cccctggctctg

SEQ ID NO: 1260846 - DNA, 23 bp, Homo sapiens
cccctggctgggacgtggctcag

SEQ ID NO: 1260847 - DNA, 22 bp, Homo sapiens
cccctggcttttcactgctggc

SEQ ID NO: 1260848 - DNA, 10 bp, Homo sapiens
cccctgggat

SEQ ID NO: 1260849 - DNA, 17 bp, Homo sapiens
cccctgggatgctgacc

SEQ ID NO: 1260850 - DNA, 19 bp, Homo sapiens
cccctgggatgctgaccca

SEQ ID NO: 1260851 - DNA, 21 bp, Homo sapiens
cccctgggatgctgacccagg

SEQ ID NO: 1260852 - DNA, 23 bp, Homo sapiens
cccctgggatgctgacccaggaa

SEQ ID NO: 1260853 - DNA, 22 bp, Homo sapiens
cccctgggcagatgtcccccac

SEQ ID NO: 1260854 - DNA, 22 bp, Homo sapiens
cccctgggcatcttctggcttg

SEQ ID NO: 1260855 - DNA, 23 bp, Homo sapiens
cccctgggcatcttctggcttga

SEQ ID NO: 1260856 - DNA, 13 bp, Homo sapiens
cccctgggctctg

SEQ ID NO: 1260857 - DNA, 15 bp, Homo sapiens
cccctgggctggggc

SEQ ID NO: 1260858 - DNA, 16 bp, Homo sapiens
cccctgggcttggcct

SEQ ID NO: 1260859 - DNA, 11 bp, Homo sapiens
cccctggggac

SEQ ID NO: 1260860 - DNA, 17 bp, Homo sapiens
cccctggggacagagcc

SEQ ID NO: 1260861 - DNA, 21 bp, Homo sapiens
cccctggggatcttgccccct

SEQ ID NO: 1260862 - DNA, 20 bp, Homo sapiens
cccctggggcttctcctgac

SEQ ID NO: 1260863 - DNA, 20 bp, Homo sapiens
cccctgggggtttcacctgg

SEQ ID NO: 1260864 - DNA, 15 bp, Homo sapiens
cccctggggtggcca

SEQ ID NO: 1260865 - DNA, 19 bp, Homo sapiens
cccctggggtggccaccag

SEQ ID NO: 1260866 - DNA, 17 bp, Homo sapiens
cccctggggtggccagg

SEQ ID NO: 1260867 - DNA, 18 bp, Homo sapiens
cccctggggtggccaggg

SEQ ID NO: 1260868 - DNA, 21 bp, Homo sapiens
cccctggggtggccagggctt

SEQ ID NO: 1260869 - DNA, 23 bp, Homo sapiens
cccctggggtgggatctgagctc

SEQ ID NO: 1260870 - DNA, 21 bp, Homo sapiens
cccctgggtgggtggtgggga

SEQ ID NO: 1260871 - DNA, 14 bp, Homo sapiens
cccctggtcttctc

SEQ ID NO: 1260872 - DNA, 11 bp, Homo sapiens
cccctgtacac

SEQ ID NO: 1260873 - DNA, 16 bp, Homo sapiens
cccctgtacacaactc

SEQ ID NO: 1260874 - DNA, 16 bp, Homo sapiens
cccctgtacccagctc

SEQ ID NO: 1260875 - DNA, 14 bp, Homo sapiens
cccctgtactccag

SEQ ID NO: 1260876 - DNA, 22 bp, Homo sapiens
cccctgtagggaaaccttggag

SEQ ID NO: 1260877 - DNA, 12 bp, Homo sapiens
cccctgtcccac

SEQ ID NO: 1260878 - DNA, 15 bp, Homo sapiens
cccctgtcccacctg

SEQ ID NO: 1260879 - DNA, 22 bp, Homo sapiens
cccctgtcccatgcaggccctt

SEQ ID NO: 1260880 - DNA, 18 bp, Homo sapiens
cccctgtcccattctaga

SEQ ID NO: 1260881 - DNA, 17 bp, Homo sapiens
cccggccacagctgctg

SEQ ID NO: 1260882 - DNA, 13 bp, Homo sapiens
cccggcccagcct

SEQ ID NO: 1260883 - DNA, 18 bp, Homo sapiens
cccggccccggccccagc

SEQ ID NO: 1260884 - DNA, 14 bp, Homo sapiens
cccggcccctcacc

SEQ ID NO: 1260885 - DNA, 12 bp, Homo sapiens
cccggccctcac

SEQ ID NO: 1260886 - DNA, 13 bp, Homo sapiens
cccggccctcact

SEQ ID NO: 1260887 - DNA, 21 bp, Homo sapiens
cccggccctcccccagctcct

SEQ ID NO: 1260888 - DNA, 14 bp, Homo sapiens
cccggcctcttcca

SEQ ID NO: 1260889 - DNA, 16 bp, Homo sapiens
cccggctaatgtttgt

SEQ ID NO: 1260890 - DNA, 13 bp, Homo sapiens
cccggctgcctgc

SEQ ID NO: 1260891 - DNA, 14 bp, Homo sapiens
cccggctgcctgcc

SEQ ID NO: 1260892 - DNA, 21 bp, Homo sapiens
cccggctgggtcggccctgcc

SEQ ID NO: 1260893 - DNA, 15 bp, Homo sapiens
cccggcttcctgtgc

SEQ ID NO: 1260894 - DNA, 16 bp, Homo sapiens
cccggctttcctccgg

SEQ ID NO: 1260895 - DNA, 12 bp, Homo sapiens
cccgggagccta

SEQ ID NO: 1260896 - DNA, 18 bp, Homo sapiens
cccgggagcctaggacca

SEQ ID NO: 1260897 - DNA, 14 bp, Homo sapiens
cccgggagcggagg

SEQ ID NO: 1260898 - DNA, 21 bp, Homo sapiens
cccgggcaagacttttctttg

SEQ ID NO: 1260899 - DNA, 23 bp, Homo sapiens
cccgggcccccgccccgcccccg

SEQ ID NO: 1260900 - DNA, 20 bp, Homo sapiens
cccgggcccgttgaggatga

SEQ ID NO: 1260901 - DNA, 14 bp, Homo sapiens
cccgggccggacct

SEQ ID NO: 1260902 - DNA, 18 bp, Homo sapiens
cccgggcctcagggtcct

SEQ ID NO: 1260903 - DNA, 20 bp, Homo sapiens
cccgggctctggccaccctg

SEQ ID NO: 1260904 - DNA, 23 bp, Homo sapiens
cccgggctgcctgggctgttggc

SEQ ID NO: 1260905 - DNA, 16 bp, Homo sapiens
cccggggaccctgtga

SEQ ID NO: 1260906 - DNA, 21 bp, Homo sapiens
cccggggaccctgtgacatgg

SEQ ID NO: 1260907 - DNA, 17 bp, Homo sapiens
cccggggagctgcagag

SEQ ID NO: 1260908 - DNA, 20 bp, Homo sapiens
cccggggagctgcagagcag

SEQ ID NO: 1260909 - DNA, 17 bp, Homo sapiens
cccggggcaaggtctcc

SEQ ID NO: 1260910 - DNA, 19 bp, Homo sapiens
cccggggcagctgccagag

SEQ ID NO: 1260911 - DNA, 16 bp, Homo sapiens
cccggggccagagaca

SEQ ID NO: 1260912 - DNA, 12 bp, Homo sapiens
cccggggctggc

SEQ ID NO: 1260913 - DNA, 17 bp, Homo sapiens
cccggggctggcaagca

SEQ ID NO: 1260914 - DNA, 22 bp, Homo sapiens
cccggggctggcaagcagggaa

SEQ ID NO: 1260915 - DNA, 18 bp, Homo sapiens
cccgggttgggtcaccag

SEQ ID NO: 1260916 - DNA, 22 bp, Homo sapiens
cccggtcccttgagacctcagc

SEQ ID NO: 1260917 - DNA, 17 bp, Homo sapiens
cccggtggtttgccatg

SEQ ID NO: 1260918 - DNA, 19 bp, Homo sapiens
cccggtgtatcctggccct

SEQ ID NO: 1260919 - DNA, 18 bp, Homo sapiens
cccggttcagacccctgc

SEQ ID NO: 1260920 - DNA, 14 bp, Homo sapiens
cccggttgctggtc

SEQ ID NO: 1260921 - DNA, 16 bp, Homo sapiens
cccggttgctggtcag

SEQ ID NO: 1260922 - DNA, 15 bp, Homo sapiens
cccgtaggcagcctc

SEQ ID NO: 1260923 - DNA, 16 bp, Homo sapiens
cccgtaggcagcctct

SEQ ID NO: 1260924 - DNA, 22 bp, Homo sapiens
cccgtaggcagcctctctgcta

SEQ ID NO: 1260925 - DNA, 14 bp, Homo sapiens
cccgtagtctcctg

SEQ ID NO: 1260926 - DNA, 17 bp, Homo sapiens
cccgtcaccatctcagg

SEQ ID NO: 1260927 - DNA, 18 bp, Homo sapiens
cccgtcccctaaccccca

SEQ ID NO: 1260928 - DNA, 23 bp, Homo sapiens
cccgtcccctaacccccagtcct

SEQ ID NO: 1260929 - DNA, 15 bp, Homo sapiens
cccgtcccctgcagc

SEQ ID NO: 1260930 - DNA, 12 bp, Homo sapiens
cccgtcctccct

SEQ ID NO: 1260931 - DNA, 13 bp, Homo sapiens
cccgtcctccctc

SEQ ID NO: 1260932 - DNA, 14 bp, Homo sapiens
cccgtcctccctca

SEQ ID NO: 1260933 - DNA, 16 bp, Homo sapiens
cccgtcctccctcagc

SEQ ID NO: 1260934 - DNA, 14 bp, Homo sapiens
cccgtcctgcctgt

SEQ ID NO: 1260935 - DNA, 15 bp, Homo sapiens
cccgtcctgcctgtg

SEQ ID NO: 1260936 - DNA, 20 bp, Homo sapiens
cccgtcgaggggctctcagc

SEQ ID NO: 1260937 - DNA, 20 bp, Homo sapiens
cccgtcggactgcccccaga

SEQ ID NO: 1260938 - DNA, 16 bp, Homo sapiens
cccgtcggagctgcct

SEQ ID NO: 1260939 - DNA, 21 bp, Homo sapiens
cccgtctggggttcagcccct

SEQ ID NO: 1260940 - DNA, 23 bp, Homo sapiens
cccgtctggggttcagcccctcc

SEQ ID NO: 1260941 - DNA, 12 bp, Homo sapiens
cccgtcttcagc

SEQ ID NO: 1260942 - DNA, 22 bp, Homo sapiens
cccgtcttgtaaaaaggggagg

SEQ ID NO: 1260943 - DNA, 15 bp, Homo sapiens
cccgtgaagcagtgc

SEQ ID NO: 1260944 - DNA, 11 bp, Homo sapiens
cccgtgcagta

SEQ ID NO: 1260945 - DNA, 18 bp, Homo sapiens
cccgtgcagtacaggcaa

SEQ ID NO: 1260946 - DNA, 20 bp, Homo sapiens
cccgtgcatcccccctgctc

SEQ ID NO: 1260947 - DNA, 12 bp, Homo sapiens
cccgtgccaccc

SEQ ID NO: 1260948 - DNA, 22 bp, Homo sapiens
cccgtgcccccgcctgccaccg

SEQ ID NO: 1260949 - DNA, 13 bp, Homo sapiens
cccgtgcctgggc

SEQ ID NO: 1260950 - DNA, 15 bp, Homo sapiens
cccgtggacacccca

SEQ ID NO: 1260951 - DNA, 17 bp, Homo sapiens
cccgtggacaccccaga

SEQ ID NO: 1260952 - DNA, 21 bp, Homo sapiens
cccgtggcctggcatctgtgt

SEQ ID NO: 1260953 - DNA, 19 bp, Homo sapiens
cccgtggcttggcatctgt

SEQ ID NO: 1260954 - DNA, 22 bp, Homo sapiens
cccgtgtgaatgtagcttccac

SEQ ID NO: 1260955 - DNA, 17 bp, Homo sapiens
cccgtgtggccccttca

SEQ ID NO: 1260956 - DNA, 21 bp, Homo sapiens
cccgtgtggtaccttcagccc

SEQ ID NO: 1260957 - DNA, 11 bp, Homo sapiens
cccgtgtgtat

SEQ ID NO: 1260958 - DNA, 17 bp, Homo sapiens
cccgtgtgtggttggaa

SEQ ID NO: 1260959 - DNA, 16 bp, Homo sapiens
cccgtttctccaccta

SEQ ID NO: 1260960 - DNA, 18 bp, Homo sapiens
ccctaaacccctgtccca

SEQ ID NO: 1260961 - DNA, 23 bp, Homo sapiens
ccctaaactccaggatttataaa

SEQ ID NO: 1260962 - DNA, 15 bp, Homo sapiens
ccctaaactgcagcc

SEQ ID NO: 1260963 - DNA, 12 bp, Homo sapiens
ccctaaactgta

SEQ ID NO: 1260964 - DNA, 19 bp, Homo sapiens
ccctaaagcaaatctgcca

SEQ ID NO: 1260965 - DNA, 20 bp, Homo sapiens
ccctaaagcaaatctgccac

SEQ ID NO: 1260966 - DNA, 13 bp, Homo sapiens
ccctaaagcctca

SEQ ID NO: 1260967 - DNA, 22 bp, Homo sapiens
ccctaaagtgtatttttttact

SEQ ID NO: 1260968 - DNA, 12 bp, Homo sapiens
ccctaaccccca

SEQ ID NO: 1260969 - DNA, 18 bp, Homo sapiens
ccctaagactgccttcag

SEQ ID NO: 1260970 - DNA, 14 bp, Homo sapiens
ccctaagccagcct

SEQ ID NO: 1260971 - DNA, 16 bp, Homo sapiens
ccctaagccagcctgg

SEQ ID NO: 1260972 - DNA, 16 bp, Homo sapiens
ccctaagcccccaggg

SEQ ID NO: 1260973 - DNA, 19 bp, Homo sapiens
ccctaagttattacctctc

SEQ ID NO: 1260974 - DNA, 19 bp, Homo sapiens
ccctaatttatgtgctata

SEQ ID NO: 1260975 - DNA, 18 bp, Homo sapiens
ccctacaaacctgtattt

SEQ ID NO: 1260976 - DNA, 15 bp, Homo sapiens
ccctacacctccctc

SEQ ID NO: 1260977 - DNA, 13 bp, Homo sapiens
ccctacagcattg

SEQ ID NO: 1260978 - DNA, 14 bp, Homo sapiens
ccctacatgtattg

SEQ ID NO: 1260979 - DNA, 16 bp, Homo sapiens
ccctacattccccaga

SEQ ID NO: 1260980 - DNA, 19 bp, Homo sapiens
ccctacattccccagagtg

SEQ ID NO: 1260981 - DNA, 13 bp, Homo sapiens
ccctaccagctcc

SEQ ID NO: 1260982 - DNA, 19 bp, Homo sapiens
ccctacccaatgtctccca

SEQ ID NO: 1260983 - DNA, 13 bp, Homo sapiens
ccctacccaccga

SEQ ID NO: 1260984 - DNA, 16 bp, Homo sapiens
ccctacccctggctgt

SEQ ID NO: 1260985 - DNA, 14 bp, Homo sapiens
ccctaccctggact

SEQ ID NO: 1260986 - DNA, 21 bp, Homo sapiens
ccctaccgagtctcttctcca

SEQ ID NO: 1260987 - DNA, 18 bp, Homo sapiens
ccctaccgatggtcccag

SEQ ID NO: 1260988 - DNA, 15 bp, Homo sapiens
ccctacctccctcct

SEQ ID NO: 1260989 - DNA, 23 bp, Homo sapiens
ccctacctgattggtgcaaccct

SEQ ID NO: 1260990 - DNA, 23 bp, Homo sapiens
ccctactattcagtggcgagaaa

SEQ ID NO: 1260991 - DNA, 14 bp, Homo sapiens
ccctactccactgc

SEQ ID NO: 1260992 - DNA, 16 bp, Homo sapiens
ccctactccctgcaga

SEQ ID NO: 1260993 - DNA, 18 bp, Homo sapiens
ccctactccctgcagatg

SEQ ID NO: 1260994 - DNA, 19 bp, Homo sapiens
ccctactccctgcagatgc

SEQ ID NO: 1260995 - DNA, 21 bp, Homo sapiens
ccctactccctgcagatgcca

SEQ ID NO: 1260996 - DNA, 13 bp, Homo sapiens
ccctactcctgcg

SEQ ID NO: 1260997 - DNA, 18 bp, Homo sapiens
ccctactgaaccctgcct

SEQ ID NO: 1260998 - DNA, 22 bp, Homo sapiens
ccctactgaaccctgcctcttg

SEQ ID NO: 1260999 - DNA, 13 bp, Homo sapiens
ccctactgtgggg

SEQ ID NO: 1261000 - DNA, 20 bp, Homo sapiens
ccctactttgcttccgccac

SEQ ID NO: 1261001 - DNA, 22 bp, Homo sapiens
ccctactttgcttccgccactc

SEQ ID NO: 1261002 - DNA, 17 bp, Homo sapiens
ccctagaaacccaagct

SEQ ID NO: 1261003 - DNA, 14 bp, Homo sapiens
ccctccacagctgc

SEQ ID NO: 1261004 - DNA, 19 bp, Homo sapiens
ccctccacatcccagcagc

SEQ ID NO: 1261005 - DNA, 18 bp, Homo sapiens
ccctccaccagcctgctg

SEQ ID NO: 1261006 - DNA, 14 bp, Homo sapiens
ccctccaccccaca

SEQ ID NO: 1261007 - DNA, 15 bp, Homo sapiens
ccctccaccccagga

SEQ ID NO: 1261008 - DNA, 14 bp, Homo sapiens
ccctccaccgagcc

SEQ ID NO: 1261009 - DNA, 15 bp, Homo sapiens
ccctccaccgagcca

SEQ ID NO: 1261010 - DNA, 17 bp, Homo sapiens
ccctccaccgagccacg

SEQ ID NO: 1261011 - DNA, 13 bp, Homo sapiens
ccctccacctcaa

SEQ ID NO: 1261012 - DNA, 17 bp, Homo sapiens
ccctccacgcctcctgg

SEQ ID NO: 1261013 - DNA, 20 bp, Homo sapiens
ccctccacgcctcctggcca

SEQ ID NO: 1261014 - DNA, 15 bp, Homo sapiens
ccctccacggtccgc

SEQ ID NO: 1261015 - DNA, 22 bp, Homo sapiens
ccctccacggtccgcggcctgc

SEQ ID NO: 1261016 - DNA, 16 bp, Homo sapiens
ccctccacgtgtccgt

SEQ ID NO: 1261017 - DNA, 21 bp, Homo sapiens
ccctccactcagctgtcctgc

SEQ ID NO: 1261018 - DNA, 14 bp, Homo sapiens
ccctccagaccctg

SEQ ID NO: 1261019 - DNA, 19 bp, Homo sapiens
ccctccagaccctgcctga

SEQ ID NO: 1261020 - DNA, 22 bp, Homo sapiens
ccctccagaccctgcctgagcc

SEQ ID NO: 1261021 - DNA, 12 bp, Homo sapiens
ccctccagctca

SEQ ID NO: 1261022 - DNA, 12 bp, Homo sapiens
ccctccaggaga

SEQ ID NO: 1261023 - DNA, 23 bp, Homo sapiens
ccctccaggagagagccaggatg

SEQ ID NO: 1261024 - DNA, 14 bp, Homo sapiens
ccctccatccccat

SEQ ID NO: 1261025 - DNA, 11 bp, Homo sapiens
ccctccatccg

SEQ ID NO: 1261026 - DNA, 13 bp, Homo sapiens
ccctccatgggct

SEQ ID NO: 1261027 - DNA, 20 bp, Homo sapiens
ccctccatggtcctgtctgt

SEQ ID NO: 1261028 - DNA, 24 bp, Homo sapiens
ccctccattgggcacagtccagac

SEQ ID NO: 1261029 - DNA, 11 bp, Homo sapiens
ccctcccaaca

SEQ ID NO: 1261030 - DNA, 16 bp, Homo sapiens
ccctcccaacctcaat

SEQ ID NO: 1261031 - DNA, 21 bp, Homo sapiens
ccctcccaagcgttcctggcc

SEQ ID NO: 1261032 - DNA, 12 bp, Homo sapiens
ccctcccacaca

SEQ ID NO: 1261033 - DNA, 17 bp, Homo sapiens
ccctcccacacttccca

SEQ ID NO: 1261034 - DNA, 21 bp, Homo sapiens
ccctcccaccagaacgcaccc

SEQ ID NO: 1261035 - DNA, 13 bp, Homo sapiens
ccctcccactccc

SEQ ID NO: 1261036 - DNA, 10 bp, Homo sapiens
ccctcccaga

SEQ ID NO: 1261037 - DNA, 23 bp, Homo sapiens
ccctcccagaaaaactggctctg

SEQ ID NO: 1261038 - DNA, 14 bp, Homo sapiens
ccctcccagacagg

SEQ ID NO: 1261039 - DNA, 19 bp, Homo sapiens
ccctcccagacaggccctc

SEQ ID NO: 1261040 - DNA, 12 bp, Homo sapiens
ccctcccagccc

SEQ ID NO: 1261041 - DNA, 14 bp, Homo sapiens
ccctcccagcccat

SEQ ID NO: 1261042 - DNA, 17 bp, Homo sapiens
ccctcccagcccattgc

SEQ ID NO: 1261043 - DNA, 13 bp, Homo sapiens
ccctcccagtcct

SEQ ID NO: 1261044 - DNA, 21 bp, Homo sapiens
ccctcccagtcctccagacca

SEQ ID NO: 1261045 - DNA, 14 bp, Homo sapiens
ccctcccagttttc

SEQ ID NO: 1261046 - DNA, 20 bp, Homo sapiens
ccctccccaaggatgaccac

SEQ ID NO: 1261047 - DNA, 13 bp, Homo sapiens
ccctccccaccca

SEQ ID NO: 1261048 - DNA, 17 bp, Homo sapiens
ccctccccacccaagag

SEQ ID NO: 1261049 - DNA, 12 bp, Homo sapiens
ccctccccagaa

SEQ ID NO: 1261050 - DNA, 15 bp, Homo sapiens
ccctccccaggctgg

SEQ ID NO: 1261051 - DNA, 16 bp, Homo sapiens
ccctcccccaaccccc

SEQ ID NO: 1261052 - DNA, 13 bp, Homo sapiens
ccctcccccagca

SEQ ID NO: 1261053 - DNA, 23 bp, Homo sapiens
ccctcccccagccatgccagctg

SEQ ID NO: 1261054 - DNA, 15 bp, Homo sapiens
ccctcccccagctgc

SEQ ID NO: 1261055 - DNA, 15 bp, Homo sapiens
ccctccccccagact

SEQ ID NO: 1261056 - DNA, 16 bp, Homo sapiens
ccctccccccagactc

SEQ ID NO: 1261057 - DNA, 13 bp, Homo sapiens
ccctccccctcaa

SEQ ID NO: 1261058 - DNA, 14 bp, Homo sapiens
ccctccccctgcca

SEQ ID NO: 1261059 - DNA, 15 bp, Homo sapiens
ccctcccccttgtcc

SEQ ID NO: 1261060 - DNA, 21 bp, Homo sapiens
ccctccccgcccctgtggccc

SEQ ID NO: 1261061 - DNA, 21 bp, Homo sapiens
ccctccccgtccctgtccccc

SEQ ID NO: 1261062 - DNA, 14 bp, Homo sapiens
ccctcccctcagag

SEQ ID NO: 1261063 - DNA, 13 bp, Homo sapiens
ccctcccctcagc

SEQ ID NO: 1261064 - DNA, 23 bp, Homo sapiens
ccctcccctcagcctgcccacct

SEQ ID NO: 1261065 - DNA, 14 bp, Homo sapiens
ccctcccctcagcg

SEQ ID NO: 1261066 - DNA, 16 bp, Homo sapiens
ccctcccctctcagaa

SEQ ID NO: 1261067 - DNA, 15 bp, Homo sapiens
ccctcccctctcttg

SEQ ID NO: 1261068 - DNA, 13 bp, Homo sapiens
ccctcccctgccc

SEQ ID NO: 1261069 - DNA, 16 bp, Homo sapiens
ccctcccctgccctag

SEQ ID NO: 1261070 - DNA, 19 bp, Homo sapiens
ccctcccgcaccttcctcc

SEQ ID NO: 1261071 - DNA, 21 bp, Homo sapiens
ccctcccgcaccttcctcctc

SEQ ID NO: 1261072 - DNA, 16 bp, Homo sapiens
ccctcccggcatggga

SEQ ID NO: 1261073 - DNA, 14 bp, Homo sapiens
ccctcccggctgcc

SEQ ID NO: 1261074 - DNA, 13 bp, Homo sapiens
ccctccctaccct

SEQ ID NO: 1261075 - DNA, 12 bp, Homo sapiens
ccctccctagcc

SEQ ID NO: 1261076 - DNA, 13 bp, Homo sapiens
ccctccctcccag

SEQ ID NO: 1261077 - DNA, 17 bp, Homo sapiens
ccctccctccctctttc

SEQ ID NO: 1261078 - DNA, 15 bp, Homo sapiens
ccctccctcccttcc

SEQ ID NO: 1261079 - DNA, 15 bp, Homo sapiens
ccctccctcgtgggc

SEQ ID NO: 1261080 - DNA, 13 bp, Homo sapiens
ccctccctctgcc

SEQ ID NO: 1261081 - DNA, 16 bp, Homo sapiens
ccctccctctgcccca

SEQ ID NO: 1261082 - DNA, 20 bp, Homo sapiens
ccctccctgactccctgtgg

SEQ ID NO: 1261083 - DNA, 16 bp, Homo sapiens
ccctccctgcaggggc

SEQ ID NO: 1261084 - DNA, 11 bp, Homo sapiens
ccctccctgcc

SEQ ID NO: 1261085 - DNA, 14 bp, Homo sapiens
ccctccctgcccct

SEQ ID NO: 1261086 - DNA, 14 bp, Homo sapiens
ccctccctgcctga

SEQ ID NO: 1261087 - DNA, 20 bp, Homo sapiens
ccctccctgcctgagggcag

SEQ ID NO: 1261088 - DNA, 18 bp, Homo sapiens
ccctccctgcctgctcct

SEQ ID NO: 1261089 - DNA, 20 bp, Homo sapiens
ccctccctgcttgcacactt

SEQ ID NO: 1261090 - DNA, 19 bp, Homo sapiens
ccctcccttccttgggcag

SEQ ID NO: 1261091 - DNA, 20 bp, Homo sapiens
ccctcccttccttgggcaga

SEQ ID NO: 1261092 - DNA, 17 bp, Homo sapiens
ccctcccttctccctgg

SEQ ID NO: 1261093 - DNA, 12 bp, Homo sapiens
ccctcccttgga

SEQ ID NO: 1261094 - DNA, 19 bp, Homo sapiens
ccctcccttggaaacctgc

SEQ ID NO: 1261095 - DNA, 21 bp, Homo sapiens
ccctccgaccacttccagggg

SEQ ID NO: 1261096 - DNA, 13 bp, Homo sapiens
ccctccgacctct

SEQ ID NO: 1261097 - DNA, 16 bp, Homo sapiens
ccctccgccgtgccgg

SEQ ID NO: 1261098 - DNA, 17 bp, Homo sapiens
ccctccgcctcccatcc

SEQ ID NO: 1261099 - DNA, 21 bp, Homo sapiens
ccctccgggcaggggagccag

SEQ ID NO: 1261100 - DNA, 17 bp, Homo sapiens
ccctccgtgatccatcc

SEQ ID NO: 1261101 - DNA, 14 bp, Homo sapiens
ccctccgttgacag

SEQ ID NO: 1261102 - DNA, 12 bp, Homo sapiens
ccctcctagcac

SEQ ID NO: 1261103 - DNA, 12 bp, Homo sapiens
ccctcctagctc

SEQ ID NO: 1261104 - DNA, 21 bp, Homo sapiens
ccctcctagctctcccagtga

SEQ ID NO: 1261105 - DNA, 20 bp, Homo sapiens
ccctcctatcacctcccctc

SEQ ID NO: 1261106 - DNA, 22 bp, Homo sapiens
ccctcctcagcgagaggcagca

SEQ ID NO: 1261107 - DNA, 16 bp, Homo sapiens
ccctcctccactccac

SEQ ID NO: 1261108 - DNA, 21 bp, Homo sapiens
ccctcctccagcccctgtccc

SEQ ID NO: 1261109 - DNA, 19 bp, Homo sapiens
ccctcctcccatgtcactg

SEQ ID NO: 1261110 - DNA, 14 bp, Homo sapiens
ccctcctcccccag

SEQ ID NO: 1261111 - DNA, 22 bp, Homo sapiens
ccctcctcccccggctgggcct

SEQ ID NO: 1261112 - DNA, 23 bp, Homo sapiens
ccctcctcccccggctgggcctc

SEQ ID NO: 1261113 - DNA, 17 bp, Homo sapiens
ccctcctccccctttgg

SEQ ID NO: 1261114 - DNA, 21 bp, Homo sapiens
ccctcctccctccaagcctgg

SEQ ID NO: 1261115 - DNA, 18 bp, Homo sapiens
ccctcctctagccatccc

SEQ ID NO: 1261116 - DNA, 23 bp, Homo sapiens
ccctcctctagccatcccttggg

SEQ ID NO: 1261117 - DNA, 13 bp, Homo sapiens
ccctcctctccca

SEQ ID NO: 1261118 - DNA, 14 bp, Homo sapiens
ccctcctctcccat

SEQ ID NO: 1261119 - DNA, 15 bp, Homo sapiens
ccctcctctcccatc

SEQ ID NO: 1261120 - DNA, 16 bp, Homo sapiens
ccctcctctgccacct

SEQ ID NO: 1261121 - DNA, 13 bp, Homo sapiens
ccctcctctgctg

SEQ ID NO: 1261122 - DNA, 15 bp, Homo sapiens
ccctcctctgctggg

SEQ ID NO: 1261123 - DNA, 13 bp, Homo sapiens
ccctcctctggca

SEQ ID NO: 1261124 - DNA, 13 bp, Homo sapiens
ccctcctcttccc

SEQ ID NO: 1261125 - DNA, 14 bp, Homo sapiens
ccctcctcttccct

SEQ ID NO: 1261126 - DNA, 22 bp, Homo sapiens
ccctcctgagggaggacctggg

SEQ ID NO: 1261127 - DNA, 12 bp, Homo sapiens
ccctgaggaggc

SEQ ID NO: 1261128 - DNA, 14 bp, Homo sapiens
ccctgaggaggccg

SEQ ID NO: 1261129 - DNA, 16 bp, Homo sapiens
ccctgaggccctgggc

SEQ ID NO: 1261130 - DNA, 20 bp, Homo sapiens
ccctgaggcggaggctgtgc

SEQ ID NO: 1261131 - DNA, 14 bp, Homo sapiens
ccctgaggggctgg

SEQ ID NO: 1261132 - DNA, 18 bp, Homo sapiens
ccctgaggggctgggctg

SEQ ID NO: 1261133 - DNA, 19 bp, Homo sapiens
ccctgaggggctgggctgg

SEQ ID NO: 1261134 - DNA, 21 bp, Homo sapiens
ccctgaggtcagggagtgctg

SEQ ID NO: 1261135 - DNA, 18 bp, Homo sapiens
ccctgaggtgaaagggag

SEQ ID NO: 1261136 - DNA, 16 bp, Homo sapiens
ccctgagtcaccagga

SEQ ID NO: 1261137 - DNA, 18 bp, Homo sapiens
ccctgagtccgcctgcgc

SEQ ID NO: 1261138 - DNA, 15 bp, Homo sapiens
ccctgagtctggacc

SEQ ID NO: 1261139 - DNA, 21 bp, Homo sapiens
ccctgagtctggacctccatc

SEQ ID NO: 1261140 - DNA, 19 bp, Homo sapiens
ccctgagtggatctccaag

SEQ ID NO: 1261141 - DNA, 20 bp, Homo sapiens
ccctgagtggatctccaagg

SEQ ID NO: 1261142 - DNA, 21 bp, Homo sapiens
ccctgagtggtcactggtcag

SEQ ID NO: 1261143 - DNA, 22 bp, Homo sapiens
ccctgatcccattttcctctga

SEQ ID NO: 1261144 - DNA, 13 bp, Homo sapiens
ccctgatctctga

SEQ ID NO: 1261145 - DNA, 18 bp, Homo sapiens
ccctgatctctgacctct

SEQ ID NO: 1261146 - DNA, 19 bp, Homo sapiens
ccctgatgcagcctgtggc

SEQ ID NO: 1261147 - DNA, 13 bp, Homo sapiens
ccctgatggcctt

SEQ ID NO: 1261148 - DNA, 20 bp, Homo sapiens
ccctgatggcctttggaccc

SEQ ID NO: 1261149 - DNA, 19 bp, Homo sapiens
ccctgatgtgacattccat

SEQ ID NO: 1261150 - DNA, 18 bp, Homo sapiens
ccctgattcatactcctt

SEQ ID NO: 1261151 - DNA, 19 bp, Homo sapiens
ccctgattcatactccttt

SEQ ID NO: 1261152 - DNA, 18 bp, Homo sapiens
ccctgattgacctgctcc

SEQ ID NO: 1261153 - DNA, 19 bp, Homo sapiens
ccctgattgacctgctccg

SEQ ID NO: 1261154 - DNA, 21 bp, Homo sapiens
ccctgattgacctgctccgct

SEQ ID NO: 1261155 - DNA, 24 bp, Homo sapiens
ccctgattgacctgctccgctgct

SEQ ID NO: 1261156 - DNA, 21 bp, Homo sapiens
ccctgatttaatatgcaaagt

SEQ ID NO: 1261157 - DNA, 24 bp, Homo sapiens
ccctgcaaacagaacagggtcatg

SEQ ID NO: 1261158 - DNA, 16 bp, Homo sapiens
ccctgcaaaggactgt

SEQ ID NO: 1261159 - DNA, 18 bp, Homo sapiens
ccctgcaagaccacggag

SEQ ID NO: 1261160 - DNA, 22 bp, Homo sapiens
ccctgcacaggcacacagggcc

SEQ ID NO: 1261161 - DNA, 17 bp, Homo sapiens
ccctgcaccctcctagg

SEQ ID NO: 1261162 - DNA, 12 bp, Homo sapiens
ccctgcaccctg

SEQ ID NO: 1261163 - DNA, 13 bp, Homo sapiens
ccctgcaccctgg

SEQ ID NO: 1261164 - DNA, 19 bp, Homo sapiens
ccctgcaccgccgcagaag

SEQ ID NO: 1261165 - DNA, 14 bp, Homo sapiens
ccctgcacctgctg

SEQ ID NO: 1261166 - DNA, 21 bp, Homo sapiens
ccctgcactaaagccagcctg

SEQ ID NO: 1261167 - DNA, 22 bp, Homo sapiens
ccctgcactcccgaccttagct

SEQ ID NO: 1261168 - DNA, 20 bp, Homo sapiens
ccctgcagaagccagaaggt

SEQ ID NO: 1261169 - DNA, 13 bp, Homo sapiens
ccctgcagacctc

SEQ ID NO: 1261170 - DNA, 14 bp, Homo sapiens
ccctgcagacctca

SEQ ID NO: 1261171 - DNA, 19 bp, Homo sapiens
ccctgcagacctcaagcca

SEQ ID NO: 1261172 - DNA, 17 bp, Homo sapiens
ccctgcagagcaataac

SEQ ID NO: 1261173 - DNA, 20 bp, Homo sapiens
ccctgcagatgccaccctag

SEQ ID NO: 1261174 - DNA, 14 bp, Homo sapiens
ccctgcagcccaaa

SEQ ID NO: 1261175 - DNA, 14 bp, Homo sapiens
ccctgcagcctggg

SEQ ID NO: 1261176 - DNA, 16 bp, Homo sapiens
ccctgcagcctgggtc

SEQ ID NO: 1261177 - DNA, 17 bp, Homo sapiens
ccctgcagcctgggtct

SEQ ID NO: 1261178 - DNA, 14 bp, Homo sapiens
ccctgcaggagcag

SEQ ID NO: 1261179 - DNA, 15 bp, Homo sapiens
ccctgcaggagcagg

SEQ ID NO: 1261180 - DNA, 20 bp, Homo sapiens
ccctgcaggagcagggcggc

SEQ ID NO: 1261181 - DNA, 17 bp, Homo sapiens
ccctgcaggcacagagg

SEQ ID NO: 1261182 - DNA, 20 bp, Homo sapiens
ccctgcaggcacagaggagg

SEQ ID NO: 1261183 - DNA, 19 bp, Homo sapiens
ccctgcagtttggccctgg

SEQ ID NO: 1261184 - DNA, 22 bp, Homo sapiens
ccctgcagtttggccctggagc

SEQ ID NO: 1261185 - DNA, 21 bp, Homo sapiens
ccctgcataatgttaagcttt

SEQ ID NO: 1261186 - DNA, 16 bp, Homo sapiens
ccctgcatcctgaggc

SEQ ID NO: 1261187 - DNA, 20 bp, Homo sapiens
ccctgcatcctgaggccagt

SEQ ID NO: 1261188 - DNA, 18 bp, Homo sapiens
ccctgcatctgaccagca

SEQ ID NO: 1261189 - DNA, 14 bp, Homo sapiens
ccctgcatgctgcc

SEQ ID NO: 1261190 - DNA, 18 bp, Homo sapiens
ccctgccacagccagagg

SEQ ID NO: 1261191 - DNA, 14 bp, Homo sapiens
ccctgccaccaggc

SEQ ID NO: 1261192 - DNA, 21 bp, Homo sapiens
ccctgccaccgactgcccagc

SEQ ID NO: 1261193 - DNA, 17 bp, Homo sapiens
ccctgccacctccctga

SEQ ID NO: 1261194 - DNA, 18 bp, Homo sapiens
ccctgccacgtcccgctg

SEQ ID NO: 1261195 - DNA, 21 bp, Homo sapiens
ccctgccacgtcccgctgcct

SEQ ID NO: 1261196 - DNA, 20 bp, Homo sapiens
ccctgccactcactaggccc

SEQ ID NO: 1261197 - DNA, 14 bp, Homo sapiens
ccctgccactgggc

SEQ ID NO: 1261198 - DNA, 21 bp, Homo sapiens
ccctgccactgggctctggac

SEQ ID NO: 1261199 - DNA, 23 bp, Homo sapiens
ccctgccagccgaccctcctggc

SEQ ID NO: 1261200 - DNA, 19 bp, Homo sapiens
ccctgccagtgccagggtg

SEQ ID NO: 1261201 - DNA, 14 bp, Homo sapiens
ccctgccagtgcct

SEQ ID NO: 1261202 - DNA, 16 bp, Homo sapiens
ccctgccatccccctc

SEQ ID NO: 1261203 - DNA, 14 bp, Homo sapiens
ccctgccatcttcc

SEQ ID NO: 1261204 - DNA, 18 bp, Homo sapiens
ccctgccatcttcccagc

SEQ ID NO: 1261205 - DNA, 16 bp, Homo sapiens
ccctgccattggcctc

SEQ ID NO: 1261206 - DNA, 17 bp, Homo sapiens
ccctgcccaaaccctta

SEQ ID NO: 1261207 - DNA, 21 bp, Homo sapiens
ccctgcccaaactccccttcc

SEQ ID NO: 1261208 - DNA, 14 bp, Homo sapiens
ccctgcccaagggc

SEQ ID NO: 1261209 - DNA, 13 bp, Homo sapiens
ccctgcccaagtg

SEQ ID NO: 1261210 - DNA, 18 bp, Homo sapiens
ccctgcccacccccggga

SEQ ID NO: 1261211 - DNA, 16 bp, Homo sapiens
ccctgcccagcctgtg

SEQ ID NO: 1261212 - DNA, 21 bp, Homo sapiens
ccctgcccaggtggcctcctg

SEQ ID NO: 1261213 - DNA, 23 bp, Homo sapiens
ccctgcccaggtggcctcctggc

SEQ ID NO: 1261214 - DNA, 19 bp, Homo sapiens
ccctgcccatactgagcct

SEQ ID NO: 1261215 - DNA, 12 bp, Homo sapiens
ccctgccccaaa

SEQ ID NO: 1261216 - DNA, 13 bp, Homo sapiens
ccctgccccaaat

SEQ ID NO: 1261217 - DNA, 14 bp, Homo sapiens
ccctgccccagccc

SEQ ID NO: 1261218 - DNA, 18 bp, Homo sapiens
ccctgccccaggcctgga

SEQ ID NO: 1261219 - DNA, 15 bp, Homo sapiens
ccctgcccccatctc

SEQ ID NO: 1261220 - DNA, 19 bp, Homo sapiens
ccctgccccctcgggggcc

SEQ ID NO: 1261221 - DNA, 22 bp, Homo sapiens
ccctgccccgccccccagagcc

SEQ ID NO: 1261222 - DNA, 15 bp, Homo sapiens
ccctgccccgtcacc

SEQ ID NO: 1261223 - DNA, 21 bp, Homo sapiens
ccctgccccgtcaccatctca

SEQ ID NO: 1261224 - DNA, 11 bp, Homo sapiens
ccctgccccta

SEQ ID NO: 1261225 - DNA, 17 bp, Homo sapiens
ccctgcccctaagttat

SEQ ID NO: 1261226 - DNA, 23 bp, Homo sapiens
ccctgcccctaggatgctgcagc

SEQ ID NO: 1261227 - DNA, 22 bp, Homo sapiens
ccctgcccctccccaaaagaaa

SEQ ID NO: 1261228 - DNA, 18 bp, Homo sapiens
ccctgcccctcccttcaa

SEQ ID NO: 1261229 - DNA, 19 bp, Homo sapiens
ccctgcccctgccccgtca

SEQ ID NO: 1261230 - DNA, 15 bp, Homo sapiens
ccctgccccttgcca

SEQ ID NO: 1261231 - DNA, 14 bp, Homo sapiens
ccctgcccgccaca

SEQ ID NO: 1261232 - DNA, 16 bp, Homo sapiens
ccctgcccgctcccaa

SEQ ID NO: 1261233 - DNA, 19 bp, Homo sapiens
ccctgcccggggagctgca

SEQ ID NO: 1261234 - DNA, 21 bp, Homo sapiens
ccctgcccggggagctgcaga

SEQ ID NO: 1261235 - DNA, 22 bp, Homo sapiens
ccctgcccggtggtttgccatg

SEQ ID NO: 1261236 - DNA, 10 bp, Homo sapiens
ccctgccctc

SEQ ID NO: 1261237 - DNA, 15 bp, Homo sapiens
ccctgccctcatggg

SEQ ID NO: 1261238 - DNA, 14 bp, Homo sapiens
ccctgccctcccct

SEQ ID NO: 1261239 - DNA, 17 bp, Homo sapiens
ccctgccctcccctgtc

SEQ ID NO: 1261240 - DNA, 16 bp, Homo sapiens
ccctgccctcgtggcc

SEQ ID NO: 1261241 - DNA, 11 bp, Homo sapiens
ccctgccctgc

SEQ ID NO: 1261242 - DNA, 15 bp, Homo sapiens
ccctgccctgctcct

SEQ ID NO: 1261243 - DNA, 16 bp, Homo sapiens
ccctgccctgctccta

SEQ ID NO: 1261244 - DNA, 18 bp, Homo sapiens
ccctgccctggtccaggg

SEQ ID NO: 1261245 - DNA, 15 bp, Homo sapiens
ccctgccctgtgccg

SEQ ID NO: 1261246 - DNA, 17 bp, Homo sapiens
ccctgcccttcctcagg

SEQ ID NO: 1261247 - DNA, 16 bp, Homo sapiens
ccctgcccttctcaag

SEQ ID NO: 1261248 - DNA, 16 bp, Homo sapiens
ccctgcccttggcacc

SEQ ID NO: 1261249 - DNA, 14 bp, Homo sapiens
ccctgtatggcact

SEQ ID NO: 1261250 - DNA, 21 bp, Homo sapiens
ccctgtcaagttaacaaggaa

SEQ ID NO: 1261251 - DNA, 18 bp, Homo sapiens
ccctgtcacacactggac

SEQ ID NO: 1261252 - DNA, 19 bp, Homo sapiens
ccctgtcacacactggacc

SEQ ID NO: 1261253 - DNA, 17 bp, Homo sapiens
ccctgtcagaggctaag

SEQ ID NO: 1261254 - DNA, 20 bp, Homo sapiens
ccctgtcagtttcccctctc

SEQ ID NO: 1261255 - DNA, 12 bp, Homo sapiens
ccctgtcccacc

SEQ ID NO: 1261256 - DNA, 17 bp, Homo sapiens
ccctgtcccaccaactc

SEQ ID NO: 1261257 - DNA, 22 bp, Homo sapiens
ccctgtcccaccaactctgcac

SEQ ID NO: 1261258 - DNA, 19 bp, Homo sapiens
ccctgtcccacccacacag

SEQ ID NO: 1261259 - DNA, 15 bp, Homo sapiens
ccctgtcccacctgg

SEQ ID NO: 1261260 - DNA, 12 bp, Homo sapiens
ccctgtcccagg

SEQ ID NO: 1261261 - DNA, 13 bp, Homo sapiens
ccctgtcccaggc

SEQ ID NO: 1261262 - DNA, 21 bp, Homo sapiens
ccctgtcccaggccggcccag

SEQ ID NO: 1261263 - DNA, 14 bp, Homo sapiens
ccctgtcccagggc

SEQ ID NO: 1261264 - DNA, 16 bp, Homo sapiens
ccctgtcccagggccc

SEQ ID NO: 1261265 - DNA, 21 bp, Homo sapiens
ccctgtcccagggccctccca

SEQ ID NO: 1261266 - DNA, 22 bp, Homo sapiens
ccctgtcccagggccctcccag

SEQ ID NO: 1261267 - DNA, 23 bp, Homo sapiens
ccctgtcccagggccctcccagc

SEQ ID NO: 1261268 - DNA, 13 bp, Homo sapiens
ccctgtcccatgc

SEQ ID NO: 1261269 - DNA, 13 bp, Homo sapiens
ccctgtcccattc

SEQ ID NO: 1261270 - DNA, 17 bp, Homo sapiens
ccctgtcccattctaga

SEQ ID NO: 1261271 - DNA, 17 bp, Homo sapiens
ccctgtccccaggccca

SEQ ID NO: 1261272 - DNA, 18 bp, Homo sapiens
ccctgtccccaggcccag

SEQ ID NO: 1261273 - DNA, 15 bp, Homo sapiens
ccctgtcccccagca

SEQ ID NO: 1261274 - DNA, 18 bp, Homo sapiens
ccctgtcccccagctctg

SEQ ID NO: 1261275 - DNA, 12 bp, Homo sapiens
ccctgtccctgc

SEQ ID NO: 1261276 - DNA, 18 bp, Homo sapiens
ccctgtcccttcctttct

SEQ ID NO: 1261277 - DNA, 14 bp, Homo sapiens
ccctgtcctggtgg

SEQ ID NO: 1261278 - DNA, 23 bp, Homo sapiens
ccctgtcctggtggtattttcaa

SEQ ID NO: 1261279 - DNA, 14 bp, Homo sapiens
ccctgtccttccct

SEQ ID NO: 1261280 - DNA, 16 bp, Homo sapiens
ccctgtcgagacactt

SEQ ID NO: 1261281 - DNA, 23 bp, Homo sapiens
ccctgtcgcccacccagctggtc

SEQ ID NO: 1261282 - DNA, 14 bp, Homo sapiens
ccctgtctaaaaaa

SEQ ID NO: 1261283 - DNA, 17 bp, Homo sapiens
ccctgtctagagaggga

SEQ ID NO: 1261284 - DNA, 17 bp, Homo sapiens
ccctgtctataaatccc

SEQ ID NO: 1261285 - DNA, 14 bp, Homo sapiens
ccctgtctccagct

SEQ ID NO: 1261286 - DNA, 17 bp, Homo sapiens
ccctgtctccagctgcc

SEQ ID NO: 1261287 - DNA, 20 bp, Homo sapiens
ccctgtctccagggccccca

SEQ ID NO: 1261288 - DNA, 18 bp, Homo sapiens
ccctgtctcccggctccc

SEQ ID NO: 1261289 - DNA, 21 bp, Homo sapiens
ccctgtcttctgggcacagtg

SEQ ID NO: 1261290 - DNA, 16 bp, Homo sapiens
ccctgtcttgctgtca

SEQ ID NO: 1261291 - DNA, 19 bp, Homo sapiens
ccctgtgacatggtgcctg

SEQ ID NO: 1261292 - DNA, 20 bp, Homo sapiens
ccctgtgacatggtgcctga

SEQ ID NO: 1261293 - DNA, 17 bp, Homo sapiens
ccctgtgcagaccttac

SEQ ID NO: 1261294 - DNA, 23 bp, Homo sapiens
ccctgtgcccccagcctcagccc

SEQ ID NO: 1261295 - DNA, 20 bp, Homo sapiens
ccctgtgcctaacaccagcg

SEQ ID NO: 1261296 - DNA, 21 bp, Homo sapiens
ccctgtgcctaacaccagcgt

SEQ ID NO: 1261297 - DNA, 18 bp, Homo sapiens
ccctgtgctccgtgcctc

SEQ ID NO: 1261298 - DNA, 20 bp, Homo sapiens
ccctgtgctccgtgcctcca

SEQ ID NO: 1261299 - DNA, 19 bp, Homo sapiens
ccctgtgctgcggggcctt

SEQ ID NO: 1261300 - DNA, 16 bp, Homo sapiens
ccctgtgctggtgtcc

SEQ ID NO: 1261301 - DNA, 20 bp, Homo sapiens
ccctgtgctggtgtcctgac

SEQ ID NO: 1261302 - DNA, 23 bp, Homo sapiens
ccctgtgctggtgtcctgaccac

SEQ ID NO: 1261303 - DNA, 18 bp, Homo sapiens
ccctgtggaagcatggct

SEQ ID NO: 1261304 - DNA, 23 bp, Homo sapiens
ccctgtggaagcatggctgtctg

SEQ ID NO: 1261305 - DNA, 18 bp, Homo sapiens
ccctgtggaagggactag

SEQ ID NO: 1261306 - DNA, 19 bp, Homo sapiens
ccctgtggaatgggctcaa

SEQ ID NO: 1261307 - DNA, 23 bp, Homo sapiens
ccctgtggaatgggctcaaggtt

SEQ ID NO: 1261308 - DNA, 17 bp, Homo sapiens
ccctgtggagcccgcac

SEQ ID NO: 1261309 - DNA, 21 bp, Homo sapiens
ccctgtggagtccagctctac

SEQ ID NO: 1261310 - DNA, 22 bp, Homo sapiens
ccctgtggagtccagctctact

SEQ ID NO: 1261311 - DNA, 20 bp, Homo sapiens
ccctgtggccaactgcaaaa

SEQ ID NO: 1261312 - DNA, 14 bp, Homo sapiens
ccctgtggccgcca

SEQ ID NO: 1261313 - DNA, 13 bp, Homo sapiens
ccctgtgggaccg

SEQ ID NO: 1261314 - DNA, 21 bp, Homo sapiens
ccctgtggggcaggagtgcca

SEQ ID NO: 1261315 - DNA, 18 bp, Homo sapiens
ccctgtggggcctgatgg

SEQ ID NO: 1261316 - DNA, 19 bp, Homo sapiens
ccctgtgggtgtctccctc

SEQ ID NO: 1261317 - DNA, 16 bp, Homo sapiens
ccctgtgtcagagcct

SEQ ID NO: 1261318 - DNA, 17 bp, Homo sapiens
ccctgtgtcagagccta

SEQ ID NO: 1261319 - DNA, 23 bp, Homo sapiens
ccctgtgtctgtcacaggctggg

SEQ ID NO: 1261320 - DNA, 20 bp, Homo sapiens
ccctgtgtggatgctgagct

SEQ ID NO: 1261321 - DNA, 19 bp, Homo sapiens
ccctgtgttacccaggctg

SEQ ID NO: 1261322 - DNA, 15 bp, Homo sapiens
ccctgtgttctgggc

SEQ ID NO: 1261323 - DNA, 15 bp, Homo sapiens
ccctgtgttgtctct

SEQ ID NO: 1261324 - DNA, 21 bp, Homo sapiens
ccctgtgttgtctctagagca

SEQ ID NO: 1261325 - DNA, 23 bp, Homo sapiens
ccctgtgttgtctctagagcagg

SEQ ID NO: 1261326 - DNA, 17 bp, Homo sapiens
ccctgttatctgctaga

SEQ ID NO: 1261327 - DNA, 13 bp, Homo sapiens
ccctgttcactct

SEQ ID NO: 1261328 - DNA, 17 bp, Homo sapiens
ccctgttcagctactcc

SEQ ID NO: 1261329 - DNA, 12 bp, Homo sapiens
ccctgttcattg

SEQ ID NO: 1261330 - DNA, 14 bp, Homo sapiens
ccctgttcctggag

SEQ ID NO: 1261331 - DNA, 15 bp, Homo sapiens
ccctgttcctggagg

SEQ ID NO: 1261332 - DNA, 14 bp, Homo sapiens
ccctgttctcttca

SEQ ID NO: 1261333 - DNA, 22 bp, Homo sapiens
ccctgttgaattttgttctctg

SEQ ID NO: 1261334 - DNA, 23 bp, Homo sapiens
ccctgttgaggtgggtgggcctg

SEQ ID NO: 1261335 - DNA, 18 bp, Homo sapiens
ccctgttggcagctctag

SEQ ID NO: 1261336 - DNA, 14 bp, Homo sapiens
ccctgtttcctgag

SEQ ID NO: 1261337 - DNA, 15 bp, Homo sapiens
ccctgtttctccaca

SEQ ID NO: 1261338 - DNA, 15 bp, Homo sapiens
ccctgtttgcatgag

SEQ ID NO: 1261339 - DNA, 14 bp, Homo sapiens
ccctgttttatact

SEQ ID NO: 1261340 - DNA, 14 bp, Homo sapiens
ccctgttttctgag

SEQ ID NO: 1261341 - DNA, 17 bp, Homo sapiens
ccctgttttctgagccc

SEQ ID NO: 1261342 - DNA, 18 bp, Homo sapiens
ccctgttttctgagcccg

SEQ ID NO: 1261343 - DNA, 20 bp, Homo sapiens
ccctgttttctgagcccggg

SEQ ID NO: 1261344 - DNA, 15 bp, Homo sapiens
ccctgttttctgttt

SEQ ID NO: 1261345 - DNA, 11 bp, Homo sapiens
cccttaaaatt

SEQ ID NO: 1261346 - DNA, 21 bp, Homo sapiens
cccttaaagaaaattgcatga

SEQ ID NO: 1261347 - DNA, 15 bp, Homo sapiens
cccttaacccaagga

SEQ ID NO: 1261348 - DNA, 17 bp, Homo sapiens
cccttaacccaaggagc

SEQ ID NO: 1261349 - DNA, 17 bp, Homo sapiens
cccttaaccccaaggac

SEQ ID NO: 1261350 - DNA, 14 bp, Homo sapiens
cccttaactccaag

SEQ ID NO: 1261351 - DNA, 14 bp, Homo sapiens
cccttaactgacat

SEQ ID NO: 1261352 - DNA, 21 bp, Homo sapiens
cccttaaggcacagtgggagc

SEQ ID NO: 1261353 - DNA, 20 bp, Homo sapiens
cccttaataaaaatatatat

SEQ ID NO: 1261354 - DNA, 18 bp, Homo sapiens
cccttacagcctctgact

SEQ ID NO: 1261355 - DNA, 17 bp, Homo sapiens
cccttaccccttagcct

SEQ ID NO: 1261356 - DNA, 19 bp, Homo sapiens
cccttaccctcctctgctg

SEQ ID NO: 1261357 - DNA, 21 bp, Homo sapiens
cccttagaagagagccagtaa

SEQ ID NO: 1261358 - DNA, 18 bp, Homo sapiens
cccttagagattgcccca

SEQ ID NO: 1261359 - DNA, 20 bp, Homo sapiens
cccttagagattgccccaga

SEQ ID NO: 1261360 - DNA, 21 bp, Homo sapiens
cccttagagattgccccagag

SEQ ID NO: 1261361 - DNA, 19 bp, Homo sapiens
cccttagcaccttcagggc

SEQ ID NO: 1261362 - DNA, 18 bp, Homo sapiens
cccttagcctctcccacc

SEQ ID NO: 1261363 - DNA, 22 bp, Homo sapiens
cccttagggaagttgtctcctt

SEQ ID NO: 1261364 - DNA, 18 bp, Homo sapiens
cccttagtcccccaactc

SEQ ID NO: 1261365 - DNA, 21 bp, Homo sapiens
cccttatgagcgtcactgccc

SEQ ID NO: 1261366 - DNA, 22 bp, Homo sapiens
cccttatgcccggcgccgggca

SEQ ID NO: 1261367 - DNA, 14 bp, Homo sapiens
cccttcaaccattc

SEQ ID NO: 1261368 - DNA, 18 bp, Homo sapiens
cccttcaaccattcccca

SEQ ID NO: 1261369 - DNA, 18 bp, Homo sapiens
cccttcaactcctggctc

SEQ ID NO: 1261370 - DNA, 13 bp, Homo sapiens
ccgactgcccagc

SEQ ID NO: 1261371 - DNA, 16 bp, Homo sapiens
ccgactgcccagccac

SEQ ID NO: 1261372 - DNA, 21 bp, Homo sapiens
ccgactgcccagccactccaa

SEQ ID NO: 1261373 - DNA, 14 bp, Homo sapiens
ccgactgcctgtct

SEQ ID NO: 1261374 - DNA, 16 bp, Homo sapiens
ccgactgcctgtctcc

SEQ ID NO: 1261375 - DNA, 16 bp, Homo sapiens
ccgacttcccctgggc

SEQ ID NO: 1261376 - DNA, 17 bp, Homo sapiens
ccgagaaggaagcctcc

SEQ ID NO: 1261377 - DNA, 15 bp, Homo sapiens
ccgagacatgaatac

SEQ ID NO: 1261378 - DNA, 16 bp, Homo sapiens
ccgagaccgcagaggg

SEQ ID NO: 1261379 - DNA, 22 bp, Homo sapiens
ccgagagaggcgcgtctgcccc

SEQ ID NO: 1261380 - DNA, 20 bp, Homo sapiens
ccgagagcagtgggcaggtg

SEQ ID NO: 1261381 - DNA, 13 bp, Homo sapiens
ccgagagcctgct

SEQ ID NO: 1261382 - DNA, 15 bp, Homo sapiens
ccgagaggtgggcca

SEQ ID NO: 1261383 - DNA, 16 bp, Homo sapiens
ccgagagtagccgaga

SEQ ID NO: 1261384 - DNA, 15 bp, Homo sapiens
ccgagatcacaccac

SEQ ID NO: 1261385 - DNA, 21 bp, Homo sapiens
ccgagatcacgccactgcact

SEQ ID NO: 1261386 - DNA, 19 bp, Homo sapiens
ccgagattgcaccactgca

SEQ ID NO: 1261387 - DNA, 14 bp, Homo sapiens
ccgagccctgactc

SEQ ID NO: 1261388 - DNA, 15 bp, Homo sapiens
ccgagccctgactcc

SEQ ID NO: 1261389 - DNA, 19 bp, Homo sapiens
ccgagcgctttctggaaaa

SEQ ID NO: 1261390 - DNA, 14 bp, Homo sapiens
ccgagctcctgggg

SEQ ID NO: 1261391 - DNA, 16 bp, Homo sapiens
ccgagctggtgcatta

SEQ ID NO: 1261392 - DNA, 21 bp, Homo sapiens
ccgagcttgggataaagcaag

SEQ ID NO: 1261393 - DNA, 19 bp, Homo sapiens
ccgagctttgaaaattcag

SEQ ID NO: 1261394 - DNA, 17 bp, Homo sapiens
ccgaggacccaggaaag

SEQ ID NO: 1261395 - DNA, 15 bp, Homo sapiens
ccgaggagctgggcc

SEQ ID NO: 1261396 - DNA, 14 bp, Homo sapiens
ccgaggcagggtca

SEQ ID NO: 1261397 - DNA, 20 bp, Homo sapiens
ccgaggcgggtggatcacga

SEQ ID NO: 1261398 - DNA, 13 bp, Homo sapiens
ccgaggctccccg

SEQ ID NO: 1261399 - DNA, 14 bp, Homo sapiens
ccgaggctgcccca

SEQ ID NO: 1261400 - DNA, 15 bp, Homo sapiens
ccgaggctgccccag

SEQ ID NO: 1261401 - DNA, 18 bp, Homo sapiens
ccgaggctgccccaggcc

SEQ ID NO: 1261402 - DNA, 21 bp, Homo sapiens
ccgaggctgccccaggccgga

SEQ ID NO: 1261403 - DNA, 14 bp, Homo sapiens
ccgaggctgctaga

SEQ ID NO: 1261404 - DNA, 14 bp, Homo sapiens
ccgaggctggagct

SEQ ID NO: 1261405 - DNA, 16 bp, Homo sapiens
ccgagggccaggcaga

SEQ ID NO: 1261406 - DNA, 16 bp, Homo sapiens
ccgagggcgaaggcca

SEQ ID NO: 1261407 - DNA, 12 bp, Homo sapiens
ccgagggcggcc

SEQ ID NO: 1261408 - DNA, 16 bp, Homo sapiens
ccgagggcggccaggg

SEQ ID NO: 1261409 - DNA, 22 bp, Homo sapiens
ccgagggcggccagggacagac

SEQ ID NO: 1261410 - DNA, 18 bp, Homo sapiens
ccgagggctcagaagagc

SEQ ID NO: 1261411 - DNA, 20 bp, Homo sapiens
ccgagggctcagaagagcag

SEQ ID NO: 1261412 - DNA, 11 bp, Homo sapiens
ccgagggctga

SEQ ID NO: 1261413 - DNA, 13 bp, Homo sapiens
ccgagggctgagc

SEQ ID NO: 1261414 - DNA, 23 bp, Homo sapiens
ccgagggctgaggagcagccagg

SEQ ID NO: 1261415 - DNA, 18 bp, Homo sapiens
ccgaggggagggcaggat

SEQ ID NO: 1261416 - DNA, 16 bp, Homo sapiens
ccgagggtcctggctc

SEQ ID NO: 1261417 - DNA, 23 bp, Homo sapiens
ccgagggtcctggctcctgaggg

SEQ ID NO: 1261418 - DNA, 15 bp, Homo sapiens
ccgaggttgtgggga

SEQ ID NO: 1261419 - DNA, 21 bp, Homo sapiens
ccgagtacaaggacagacagc

SEQ ID NO: 1261420 - DNA, 17 bp, Homo sapiens
ccgagtagaaaatgtga

SEQ ID NO: 1261421 - DNA, 16 bp, Homo sapiens
ccgagtagctgggatt

SEQ ID NO: 1261422 - DNA, 19 bp, Homo sapiens
ccgagtagctgggattaca

SEQ ID NO: 1261423 - DNA, 19 bp, Homo sapiens
ccgagtcattcgttctgtg

SEQ ID NO: 1261424 - DNA, 12 bp, Homo sapiens
ccgagtccaagc

SEQ ID NO: 1261425 - DNA, 14 bp, Homo sapiens
ccgagtctgggaca

SEQ ID NO: 1261426 - DNA, 13 bp, Homo sapiens
ccgagtgcactgc

SEQ ID NO: 1261427 - DNA, 21 bp, Homo sapiens
ccgagtggggcctgcctggtc

SEQ ID NO: 1261428 - DNA, 15 bp, Homo sapiens
ccgatattctccctg

SEQ ID NO: 1261429 - DNA, 20 bp, Homo sapiens
ccgatcaacatttatgacct

SEQ ID NO: 1261430 - DNA, 20 bp, Homo sapiens
ccgatccccgacagtggctc

SEQ ID NO: 1261431 - DNA, 17 bp, Homo sapiens
ccgatgattcttaacac

SEQ ID NO: 1261432 - DNA, 23 bp, Homo sapiens
ccgatgattcttaacacagcctt

SEQ ID NO: 1261433 - DNA, 22 bp, Homo sapiens
ccgatgctccagccaacccctg

SEQ ID NO: 1261434 - DNA, 11 bp, Homo sapiens
ccgatgctgct

SEQ ID NO: 1261435 - DNA, 13 bp, Homo sapiens
ccgatgctgcttt

SEQ ID NO: 1261436 - DNA, 12 bp, Homo sapiens
ccgatggagccc

SEQ ID NO: 1261437 - DNA, 19 bp, Homo sapiens
ccgatgggagtctccctcc

SEQ ID NO: 1261438 - DNA, 18 bp, Homo sapiens
ccgatggtcccaggaagc

SEQ ID NO: 1261439 - DNA, 18 bp, Homo sapiens
ccgatggtctctctccct

SEQ ID NO: 1261440 - DNA, 15 bp, Homo sapiens
ccgatgtgtctccca

SEQ ID NO: 1261441 - DNA, 20 bp, Homo sapiens
ccgatgtgtctcccagaact

SEQ ID NO: 1261442 - DNA, 14 bp, Homo sapiens
ccgattctctgccc

SEQ ID NO: 1261443 - DNA, 13 bp, Homo sapiens
ccgatttctgtaa

SEQ ID NO: 1261444 - DNA, 14 bp, Homo sapiens
ccgatttctgtaaa

SEQ ID NO: 1261445 - DNA, 16 bp, Homo sapiens
ccgatttctgtaaact

SEQ ID NO: 1261446 - DNA, 18 bp, Homo sapiens
ccgcacagctcaggaggc

SEQ ID NO: 1261447 - DNA, 22 bp, Homo sapiens
ccgcaccagctgctctgcccct

SEQ ID NO: 1261448 - DNA, 14 bp, Homo sapiens
ccgcaccccagtgc

SEQ ID NO: 1261449 - DNA, 16 bp, Homo sapiens
ccgcacccctccctgc

SEQ ID NO: 1261450 - DNA, 14 bp, Homo sapiens
ccgcaccctgcacc

SEQ ID NO: 1261451 - DNA, 17 bp, Homo sapiens
ccgcaccctgcacctgc

SEQ ID NO: 1261452 - DNA, 23 bp, Homo sapiens
ccgcacctgtcggtggctgcctt

SEQ ID NO: 1261453 - DNA, 13 bp, Homo sapiens
ccgcactgcagac

SEQ ID NO: 1261454 - DNA, 17 bp, Homo sapiens
ccgcactttccacttct

SEQ ID NO: 1261455 - DNA, 14 bp, Homo sapiens
ccgcagaagccctg

SEQ ID NO: 1261456 - DNA, 14 bp, Homo sapiens
ccgcagacaccttg

SEQ ID NO: 1261457 - DNA, 17 bp, Homo sapiens
ccgcagacggtctgtgt

SEQ ID NO: 1261458 - DNA, 20 bp, Homo sapiens
ccgcagacggtctgtgtgct

SEQ ID NO: 1261459 - DNA, 18 bp, Homo sapiens
ccgcagactgcttggcca

SEQ ID NO: 1261460 - DNA, 23 bp, Homo sapiens
ccgcagatgacacgcgctctcca

SEQ ID NO: 1261461 - DNA, 20 bp, Homo sapiens
ccgcagccagccggtgcctg

SEQ ID NO: 1261462 - DNA, 14 bp, Homo sapiens
ccgcagcccgcctg

SEQ ID NO: 1261463 - DNA, 17 bp, Homo sapiens
ccgcagcccgcctgccg

SEQ ID NO: 1261464 - DNA, 20 bp, Homo sapiens
ccgcagcccgtgaagcagtg

SEQ ID NO: 1261465 - DNA, 20 bp, Homo sapiens
ccgcagcgcccccatctgtc

SEQ ID NO: 1261466 - DNA, 14 bp, Homo sapiens
ccgcagctcttgcc

SEQ ID NO: 1261467 - DNA, 17 bp, Homo sapiens
ccgcagctcttgccctt

SEQ ID NO: 1261468 - DNA, 22 bp, Homo sapiens
ccgcagctcttgcccttccctg

SEQ ID NO: 1261469 - DNA, 22 bp, Homo sapiens
ccgcaggagggaggcggggagg

SEQ ID NO: 1261470 - DNA, 14 bp, Homo sapiens
ccgcaggcccggac

SEQ ID NO: 1261471 - DNA, 19 bp, Homo sapiens
ccgcaggcccggactcacc

SEQ ID NO: 1261472 - DNA, 17 bp, Homo sapiens
ccgcagggccatgcaga

SEQ ID NO: 1261473 - DNA, 13 bp, Homo sapiens
ccgcagggcccac

SEQ ID NO: 1261474 - DNA, 23 bp, Homo sapiens
ccgcagggcccaccttggaccct

SEQ ID NO: 1261475 - DNA, 19 bp, Homo sapiens
ccgcaggggtttgggtggg

SEQ ID NO: 1261476 - DNA, 13 bp, Homo sapiens
ccgcagtccccag

SEQ ID NO: 1261477 - DNA, 18 bp, Homo sapiens
ccgcagtccccagccctt

SEQ ID NO: 1261478 - DNA, 13 bp, Homo sapiens
ccgcatatgcatg

SEQ ID NO: 1261479 - DNA, 20 bp, Homo sapiens
ccgcatatgcatgccaggct

SEQ ID NO: 1261480 - DNA, 15 bp, Homo sapiens
ccgcatgtgtgcctg

SEQ ID NO: 1261481 - DNA, 23 bp, Homo sapiens
ccgcattcagtgcacctgcctca

SEQ ID NO: 1261482 - DNA, 13 bp, Homo sapiens
ccgcattccctga

SEQ ID NO: 1261483 - DNA, 14 bp, Homo sapiens
ccgcattccctgag

SEQ ID NO: 1261484 - DNA, 23 bp, Homo sapiens
ccgcattccctgagtcaccagga

SEQ ID NO: 1261485 - DNA, 16 bp, Homo sapiens
ccgcattggtgactca

SEQ ID NO: 1261486 - DNA, 11 bp, Homo sapiens
ccgccacagcc

SEQ ID NO: 1261487 - DNA, 15 bp, Homo sapiens
ccgccacccccatct

SEQ ID NO: 1261488 - DNA, 15 bp, Homo sapiens
ccgccaccctgcccc

SEQ ID NO: 1261489 - DNA, 23 bp, Homo sapiens
ccgccacctatctcgtgggagag

SEQ ID NO: 1261490 - DNA, 14 bp, Homo sapiens
ccgccacggccacc

SEQ ID NO: 1261491 - DNA, 14 bp, Homo sapiens
ccgccacgtcccag

SEQ ID NO: 1261492 - DNA, 21 bp, Homo sapiens
ccgccacgtcccagcatccct

SEQ ID NO: 1261493 - DNA, 22 bp, Homo sapiens
ccggcggctctgagcaggggca

SEQ ID NO: 1261494 - DNA, 23 bp, Homo sapiens
ccggcggctctgagcaggggcag

SEQ ID NO: 1261495 - DNA, 15 bp, Homo sapiens
ccggctaatgtttgt

SEQ ID NO: 1261496 - DNA, 18 bp, Homo sapiens
ccggctaatttttgtaat

SEQ ID NO: 1261497 - DNA, 22 bp, Homo sapiens
ccggctaatttttgtattttta

SEQ ID NO: 1261498 - DNA, 23 bp, Homo sapiens
ccggctatgggggcactgaggac

SEQ ID NO: 1261499 - DNA, 17 bp, Homo sapiens
ccggctctcacctggcc

SEQ ID NO: 1261500 - DNA, 14 bp, Homo sapiens
ccggctgcctagcc

SEQ ID NO: 1261501 - DNA, 16 bp, Homo sapiens
ccggctgcctagccct

SEQ ID NO: 1261502 - DNA, 20 bp, Homo sapiens
ccggctgctcctccagccct

SEQ ID NO: 1261503 - DNA, 14 bp, Homo sapiens
ccggctgctgcttg

SEQ ID NO: 1261504 - DNA, 11 bp, Homo sapiens
ccggctggtga

SEQ ID NO: 1261505 - DNA, 23 bp, Homo sapiens
ccggctggttttgtaagatgctg

SEQ ID NO: 1261506 - DNA, 13 bp, Homo sapiens
ccggctgtggagc

SEQ ID NO: 1261507 - DNA, 17 bp, Homo sapiens
ccggcttgccacacccc

SEQ ID NO: 1261508 - DNA, 22 bp, Homo sapiens
ccggctttcctccggagcctca

SEQ ID NO: 1261509 - DNA, 17 bp, Homo sapiens
ccgggaagagccacctg

SEQ ID NO: 1261510 - DNA, 18 bp, Homo sapiens
ccgggaagagccacctgg

SEQ ID NO: 1261511 - DNA, 21 bp, Homo sapiens
ccgggaagttttacagcaagg

SEQ ID NO: 1261512 - DNA, 22 bp, Homo sapiens
ccgggaccaaactcacggacca

SEQ ID NO: 1261513 - DNA, 20 bp, Homo sapiens
ccgggaccaccctgagccgg

SEQ ID NO: 1261514 - DNA, 19 bp, Homo sapiens
ccgggactctccccctttc

SEQ ID NO: 1261515 - DNA, 16 bp, Homo sapiens
ccgggagaagccacct

SEQ ID NO: 1261516 - DNA, 17 bp, Homo sapiens
ccgggagaagccacctt

SEQ ID NO: 1261517 - DNA, 23 bp, Homo sapiens
ccgggagaaggcatgagaaagaa

SEQ ID NO: 1261518 - DNA, 17 bp, Homo sapiens
ccgggagaggactctgc

SEQ ID NO: 1261519 - DNA, 14 bp, Homo sapiens
ccgggagctggcgg

SEQ ID NO: 1261520 - DNA, 22 bp, Homo sapiens
ccgggaggaaaaggcccctgca

SEQ ID NO: 1261521 - DNA, 23 bp, Homo sapiens
ccgggaggaaaaggcccctgcaa

SEQ ID NO: 1261522 - DNA, 13 bp, Homo sapiens
ccgggaggcagag

SEQ ID NO: 1261523 - DNA, 20 bp, Homo sapiens
ccgggaggcagagaggagtg

SEQ ID NO: 1261524 - DNA, 17 bp, Homo sapiens
ccgggatattatagaaa

SEQ ID NO: 1261525 - DNA, 14 bp, Homo sapiens
ccgggatcctgccc

SEQ ID NO: 1261526 - DNA, 18 bp, Homo sapiens
ccgggatcctgcccccaa

SEQ ID NO: 1261527 - DNA, 18 bp, Homo sapiens
ccgggcaaatgccagggc

SEQ ID NO: 1261528 - DNA, 22 bp, Homo sapiens
ccgggcaaatggctgagatgga

SEQ ID NO: 1261529 - DNA, 14 bp, Homo sapiens
ccgggcactggcac

SEQ ID NO: 1261530 - DNA, 16 bp, Homo sapiens
ccgggcactggcactg

SEQ ID NO: 1261531 - DNA, 14 bp, Homo sapiens
ccgggcaggccagc

SEQ ID NO: 1261532 - DNA, 14 bp, Homo sapiens
ccgggcaggggagc

SEQ ID NO: 1261533 - DNA, 22 bp, Homo sapiens
ccgggcaggggagccagggtag

SEQ ID NO: 1261534 - DNA, 15 bp, Homo sapiens
ccgggcaggtcctgc

SEQ ID NO: 1261535 - DNA, 14 bp, Homo sapiens
ccgggcatggtggc

SEQ ID NO: 1261536 - DNA, 17 bp, Homo sapiens
ccgggccacgccccagc

SEQ ID NO: 1261537 - DNA, 13 bp, Homo sapiens
ccgggcccccgcc

SEQ ID NO: 1261538 - DNA, 17 bp, Homo sapiens
ccgggcccccgccccgc

SEQ ID NO: 1261539 - DNA, 13 bp, Homo sapiens
ccgggccctccct

SEQ ID NO: 1261540 - DNA, 14 bp, Homo sapiens
ccgggccctccctt

SEQ ID NO: 1261541 - DNA, 20 bp, Homo sapiens
ccgggccgaccctgcggcct

SEQ ID NO: 1261542 - DNA, 14 bp, Homo sapiens
ccgggcctgcacag

SEQ ID NO: 1261543 - DNA, 13 bp, Homo sapiens
ccgggcctggggc

SEQ ID NO: 1261544 - DNA, 20 bp, Homo sapiens
ccgggcgtgtgaagaacacc

SEQ ID NO: 1261545 - DNA, 19 bp, Homo sapiens
ccgggctccatgcctctgg

SEQ ID NO: 1261546 - DNA, 16 bp, Homo sapiens
ccgggctctggccacc

SEQ ID NO: 1261547 - DNA, 18 bp, Homo sapiens
ccgggctctggccaccct

SEQ ID NO: 1261548 - DNA, 21 bp, Homo sapiens
ccgggctgagggcctgctgga

SEQ ID NO: 1261549 - DNA, 11 bp, Homo sapiens
ccgggctgcag

SEQ ID NO: 1261550 - DNA, 14 bp, Homo sapiens
ccgggctgcaggtg

SEQ ID NO: 1261551 - DNA, 16 bp, Homo sapiens
ccgggctgcctgggct

SEQ ID NO: 1261552 - DNA, 14 bp, Homo sapiens
ccgggctggccctg

SEQ ID NO: 1261553 - DNA, 16 bp, Homo sapiens
ccgggctggccctgtg

SEQ ID NO: 1261554 - DNA, 14 bp, Homo sapiens
ccgggctggctgct

SEQ ID NO: 1261555 - DNA, 23 bp, Homo sapiens
ccgggctggctgcttgcagccag

SEQ ID NO: 1261556 - DNA, 15 bp, Homo sapiens
ccggggaccctgtga

SEQ ID NO: 1261557 - DNA, 15 bp, Homo sapiens
ccggggagcgcccgc

SEQ ID NO: 1261558 - DNA, 12 bp, Homo sapiens
ccggggagctgc

SEQ ID NO: 1261559 - DNA, 17 bp, Homo sapiens
ccggggagctgcagagc

SEQ ID NO: 1261560 - DNA, 10 bp, Homo sapiens
ccggggaggg

SEQ ID NO: 1261561 - DNA, 20 bp, Homo sapiens
ccggggagggggcacggcag

SEQ ID NO: 1261562 - DNA, 17 bp, Homo sapiens
ccggggcaagagggaag

SEQ ID NO: 1261563 - DNA, 23 bp, Homo sapiens
ccggggcaaggtctccttactct

SEQ ID NO: 1261564 - DNA, 19 bp, Homo sapiens
ccggggcagctgccagaga

SEQ ID NO: 1261565 - DNA, 20 bp, Homo sapiens
ccggggcagctgccagagaa

SEQ ID NO: 1261566 - DNA, 17 bp, Homo sapiens
ccggggccccactggct

SEQ ID NO: 1261567 - DNA, 19 bp, Homo sapiens
ccggggcccctcaccccaa

SEQ ID NO: 1261568 - DNA, 20 bp, Homo sapiens
ccggggcctggacctatgca

SEQ ID NO: 1261569 - DNA, 19 bp, Homo sapiens
ccggggctggcggctactc

SEQ ID NO: 1261570 - DNA, 15 bp, Homo sapiens
ccgggggaggaaggg

SEQ ID NO: 1261571 - DNA, 11 bp, Homo sapiens
ccgggggaggg

SEQ ID NO: 1261572 - DNA, 18 bp, Homo sapiens
ccgggggaggggccctca

SEQ ID NO: 1261573 - DNA, 19 bp, Homo sapiens
ccgggggaggggccctcag

SEQ ID NO: 1261574 - DNA, 16 bp, Homo sapiens
ccgggggccccacctc

SEQ ID NO: 1261575 - DNA, 14 bp, Homo sapiens
ccggggggagggga

SEQ ID NO: 1261576 - DNA, 18 bp, Homo sapiens
ccggggggaggggacaga

SEQ ID NO: 1261577 - DNA, 19 bp, Homo sapiens
ccggggggaggggacagag

SEQ ID NO: 1261578 - DNA, 20 bp, Homo sapiens
ccggggggaggggacagagc

SEQ ID NO: 1261579 - DNA, 15 bp, Homo sapiens
ccgggggtggctctg

SEQ ID NO: 1261580 - DNA, 15 bp, Homo sapiens
ccggggtccaggccc

SEQ ID NO: 1261581 - DNA, 14 bp, Homo sapiens
ccggggtctgtgct

SEQ ID NO: 1261582 - DNA, 17 bp, Homo sapiens
ccggggtctgtgctgtg

SEQ ID NO: 1261583 - DNA, 22 bp, Homo sapiens
ccggggtggggtgcactcgcca

SEQ ID NO: 1261584 - DNA, 19 bp, Homo sapiens
ccggggtgtaacttcctgc

SEQ ID NO: 1261585 - DNA, 20 bp, Homo sapiens
ccggggtgtaacttcctgct

SEQ ID NO: 1261586 - DNA, 19 bp, Homo sapiens
ccggggttccccacacagg

SEQ ID NO: 1261587 - DNA, 14 bp, Homo sapiens
ccgggtcactgctg

SEQ ID NO: 1261588 - DNA, 16 bp, Homo sapiens
ccgggtcactgctgta

SEQ ID NO: 1261589 - DNA, 22 bp, Homo sapiens
ccgggtgcctcagagcaggctc

SEQ ID NO: 1261590 - DNA, 14 bp, Homo sapiens
ccgggtgggcctgg

SEQ ID NO: 1261591 - DNA, 19 bp, Homo sapiens
ccgggtgggcctggcctga

SEQ ID NO: 1261592 - DNA, 19 bp, Homo sapiens
ccgggtgtgcctgccctgg

SEQ ID NO: 1261593 - DNA, 22 bp, Homo sapiens
ccgggtgtggcctcagccctca

SEQ ID NO: 1261594 - DNA, 23 bp, Homo sapiens
ccgggttcgcaccattctcctgc

SEQ ID NO: 1261595 - DNA, 21 bp, Homo sapiens
ccgggtttagtatatgtcttg

SEQ ID NO: 1261596 - DNA, 20 bp, Homo sapiens
ccgggtttggcgggccaagg

SEQ ID NO: 1261597 - DNA, 15 bp, Homo sapiens
ccggtaactgtcctg

SEQ ID NO: 1261598 - DNA, 18 bp, Homo sapiens
ccggtaactgtcctgtcc

SEQ ID NO: 1261599 - DNA, 19 bp, Homo sapiens
ccggtaactgtcctgtcct

SEQ ID NO: 1261600 - DNA, 12 bp, Homo sapiens
ccggtcagtgcc

SEQ ID NO: 1261601 - DNA, 14 bp, Homo sapiens
ccggtccagctggc

SEQ ID NO: 1261602 - DNA, 21 bp, Homo sapiens
ccggtccagctggcctggaca

SEQ ID NO: 1261603 - DNA, 13 bp, Homo sapiens
ccggtccccacag

SEQ ID NO: 1261604 - DNA, 19 bp, Homo sapiens
ccggtcccctgcctggaac

SEQ ID NO: 1261605 - DNA, 17 bp, Homo sapiens
ccggtccggcgccccgc

SEQ ID NO: 1261606 - DNA, 17 bp, Homo sapiens
ccggtcgggcagccagc

SEQ ID NO: 1261607 - DNA, 16 bp, Homo sapiens
ccggtgctccctctgt

SEQ ID NO: 1261608 - DNA, 15 bp, Homo sapiens
ccggtgctgcaggag

SEQ ID NO: 1261609 - DNA, 19 bp, Homo sapiens
ccggtgctgggggcacagc

SEQ ID NO: 1261610 - DNA, 23 bp, Homo sapiens
ccggtgcttccaacaaggacagc

SEQ ID NO: 1261611 - DNA, 18 bp, Homo sapiens
ccggtgcttctggaaact

SEQ ID NO: 1261612 - DNA, 13 bp, Homo sapiens
ccggtggtgcccg

SEQ ID NO: 1261613 - DNA, 17 bp, Homo sapiens
ccggtggtttgccatgt

SEQ ID NO: 1261614 - DNA, 12 bp, Homo sapiens
ccggtgtccctg

SEQ ID NO: 1261615 - DNA, 17 bp, Homo sapiens
cctagaacatccctggg

SEQ ID NO: 1261616 - DNA, 19 bp, Homo sapiens
cctagaacatccctgggca

SEQ ID NO: 1261617 - DNA, 22 bp, Homo sapiens
cctagaacatccctgggcaagt

SEQ ID NO: 1261618 - DNA, 15 bp, Homo sapiens
cctagaactgtgcct

SEQ ID NO: 1261619 - DNA, 16 bp, Homo sapiens
cctagaagaaaacccg

SEQ ID NO: 1261620 - DNA, 22 bp, Homo sapiens
cctagaagaaccaaatacctca

SEQ ID NO: 1261621 - DNA, 22 bp, Homo sapiens
cctagaagagcacagagccctg

SEQ ID NO: 1261622 - DNA, 16 bp, Homo sapiens
cctagaattttctccc

SEQ ID NO: 1261623 - DNA, 23 bp, Homo sapiens
cctagacaacctttctgtagcct

SEQ ID NO: 1261624 - DNA, 13 bp, Homo sapiens
cctagaccagcag

SEQ ID NO: 1261625 - DNA, 23 bp, Homo sapiens
cctagaccagcagacagagccag

SEQ ID NO: 1261626 - DNA, 19 bp, Homo sapiens
cctagaccagtttgcatga

SEQ ID NO: 1261627 - DNA, 19 bp, Homo sapiens
cctagacctaaacggctca

SEQ ID NO: 1261628 - DNA, 16 bp, Homo sapiens
cctagacctccccctc

SEQ ID NO: 1261629 - DNA, 14 bp, Homo sapiens
cctagactgcatcc

SEQ ID NO: 1261630 - DNA, 19 bp, Homo sapiens
cctagactgtaaacctctc

SEQ ID NO: 1261631 - DNA, 13 bp, Homo sapiens
cctagacttgaaa

SEQ ID NO: 1261632 - DNA, 15 bp, Homo sapiens
cctagagcacactgt

SEQ ID NO: 1261633 - DNA, 19 bp, Homo sapiens
cctagagcactctcacccc

SEQ ID NO: 1261634 - DNA, 22 bp, Homo sapiens
cctagagcactctcaccccaag

SEQ ID NO: 1261635 - DNA, 12 bp, Homo sapiens
cctagagccaga

SEQ ID NO: 1261636 - DNA, 20 bp, Homo sapiens
cctagaggccaaattctttt

SEQ ID NO: 1261637 - DNA, 13 bp, Homo sapiens
cctagagggaggg

SEQ ID NO: 1261638 - DNA, 22 bp, Homo sapiens
cctagagtctagggcacaaaga

SEQ ID NO: 1261639 - DNA, 15 bp, Homo sapiens
cctagagtgtagcct

SEQ ID NO: 1261640 - DNA, 17 bp, Homo sapiens
cctagatccacacacag

SEQ ID NO: 1261641 - DNA, 19 bp, Homo sapiens
cctagatccacacacagag

SEQ ID NO: 1261642 - DNA, 21 bp, Homo sapiens
cctagatccacgtgtggcctc

SEQ ID NO: 1261643 - DNA, 20 bp, Homo sapiens
cctagatgcacgtggggccc

SEQ ID NO: 1261644 - DNA, 23 bp, Homo sapiens
cctagatgcacgtggggcccact

SEQ ID NO: 1261645 - DNA, 22 bp, Homo sapiens
cctagcaagtaagaatggccaa

SEQ ID NO: 1261646 - DNA, 20 bp, Homo sapiens
cctagcacaaggagtgcccg

SEQ ID NO: 1261647 - DNA, 21 bp, Homo sapiens
cctagcacaaggagtgcccgc

SEQ ID NO: 1261648 - DNA, 22 bp, Homo sapiens
cctagcacacctgaatcagctg

SEQ ID NO: 1261649 - DNA, 17 bp, Homo sapiens
cctagcagacagaaact

SEQ ID NO: 1261650 - DNA, 12 bp, Homo sapiens
cctagcagcacc

SEQ ID NO: 1261651 - DNA, 23 bp, Homo sapiens
cctagcagcaccgttctgtgcac

SEQ ID NO: 1261652 - DNA, 17 bp, Homo sapiens
cctagcaggctgttcca

SEQ ID NO: 1261653 - DNA, 22 bp, Homo sapiens
cctagcattgcacttggcctca

SEQ ID NO: 1261654 - DNA, 16 bp, Homo sapiens
cctagccattcctggt

SEQ ID NO: 1261655 - DNA, 21 bp, Homo sapiens
cctagcccagactctgagctg

SEQ ID NO: 1261656 - DNA, 13 bp, Homo sapiens
cctagcccctctc

SEQ ID NO: 1261657 - DNA, 14 bp, Homo sapiens
cctagcccctctct

SEQ ID NO: 1261658 - DNA, 13 bp, Homo sapiens
cctagccctctca

SEQ ID NO: 1261659 - DNA, 12 bp, Homo sapiens
cctagcccttcc

SEQ ID NO: 1261660 - DNA, 16 bp, Homo sapiens
cctagcccttccagcc

SEQ ID NO: 1261661 - DNA, 18 bp, Homo sapiens
cctagcccttccagcctg

SEQ ID NO: 1261662 - DNA, 23 bp, Homo sapiens
cctagcccttccagcctgggaca

SEQ ID NO: 1261663 - DNA, 19 bp, Homo sapiens
cctagccgacctcagcctt

SEQ ID NO: 1261664 - DNA, 18 bp, Homo sapiens
cctagcctggatggcccc

SEQ ID NO: 1261665 - DNA, 22 bp, Homo sapiens
cctagcctggatggcccctcct

SEQ ID NO: 1261666 - DNA, 18 bp, Homo sapiens
cctagccttatcctctga

SEQ ID NO: 1261667 - DNA, 19 bp, Homo sapiens
cctagccttatcctctgat

SEQ ID NO: 1261668 - DNA, 17 bp, Homo sapiens
cctagcgatctctcctg

SEQ ID NO: 1261669 - DNA, 15 bp, Homo sapiens
cctagcggagcccag

SEQ ID NO: 1261670 - DNA, 22 bp, Homo sapiens
cctagctacactgagcagggag

SEQ ID NO: 1261671 - DNA, 15 bp, Homo sapiens
cctagctcctgccac

SEQ ID NO: 1261672 - DNA, 22 bp, Homo sapiens
cctagctcctgccacatggagc

SEQ ID NO: 1261673 - DNA, 17 bp, Homo sapiens
cctagctctcccagtga

SEQ ID NO: 1261674 - DNA, 22 bp, Homo sapiens
cctagctctcccagtgaactcc

SEQ ID NO: 1261675 - DNA, 21 bp, Homo sapiens
cctagctctggaggtgctgct

SEQ ID NO: 1261676 - DNA, 18 bp, Homo sapiens
cctagctgtcccatgggg

SEQ ID NO: 1261677 - DNA, 16 bp, Homo sapiens
cctagctgtgccccct

SEQ ID NO: 1261678 - DNA, 20 bp, Homo sapiens
cctagctgtgccccctctgg

SEQ ID NO: 1261679 - DNA, 18 bp, Homo sapiens
cctagctttagaccctgg

SEQ ID NO: 1261680 - DNA, 20 bp, Homo sapiens
cctagctttagaccctgggt

SEQ ID NO: 1261681 - DNA, 20 bp, Homo sapiens
cctagctttatatatggaca

SEQ ID NO: 1261682 - DNA, 14 bp, Homo sapiens
cctagcttttaaaa

SEQ ID NO: 1261683 - DNA, 21 bp, Homo sapiens
cctaggaccactcagccccta

SEQ ID NO: 1261684 - DNA, 19 bp, Homo sapiens
cctaggacgccaacttctc

SEQ ID NO: 1261685 - DNA, 15 bp, Homo sapiens
cctaggagagccaac

SEQ ID NO: 1261686 - DNA, 14 bp, Homo sapiens
cctaggaggctggc

SEQ ID NO: 1261687 - DNA, 14 bp, Homo sapiens
cctaggatgctgca

SEQ ID NO: 1261688 - DNA, 21 bp, Homo sapiens
cctaggattccccctgccctg

SEQ ID NO: 1261689 - DNA, 15 bp, Homo sapiens
cctaggcagcctgca

SEQ ID NO: 1261690 - DNA, 19 bp, Homo sapiens
cctaggcagcctgcaggga

SEQ ID NO: 1261691 - DNA, 20 bp, Homo sapiens
cctaggccaaatgcacaagc

SEQ ID NO: 1261692 - DNA, 16 bp, Homo sapiens
cctaggccactcctcc

SEQ ID NO: 1261693 - DNA, 17 bp, Homo sapiens
cctaggccactcctcca

SEQ ID NO: 1261694 - DNA, 18 bp, Homo sapiens
cctaggccactcctccaa

SEQ ID NO: 1261695 - DNA, 14 bp, Homo sapiens
cctaggctgaggtt

SEQ ID NO: 1261696 - DNA, 22 bp, Homo sapiens
cctaggctgaggttagagagat

SEQ ID NO: 1261697 - DNA, 14 bp, Homo sapiens
cctaggctggaagc

SEQ ID NO: 1261698 - DNA, 14 bp, Homo sapiens
cctagggaaaagtt

SEQ ID NO: 1261699 - DNA, 11 bp, Homo sapiens
cctagggagcc

SEQ ID NO: 1261700 - DNA, 14 bp, Homo sapiens
cctagggcctggtc

SEQ ID NO: 1261701 - DNA, 21 bp, Homo sapiens
cctagggcgacgtcttcagag

SEQ ID NO: 1261702 - DNA, 18 bp, Homo sapiens
cctaggggacacttccct

SEQ ID NO: 1261703 - DNA, 14 bp, Homo sapiens
cctagggggacggg

SEQ ID NO: 1261704 - DNA, 15 bp, Homo sapiens
cctagggggtgtcag

SEQ ID NO: 1261705 - DNA, 23 bp, Homo sapiens
cctagggggtgtcagaagctggg

SEQ ID NO: 1261706 - DNA, 15 bp, Homo sapiens
cctaggggtcaggga

SEQ ID NO: 1261707 - DNA, 15 bp, Homo sapiens
cctaggtccaagccc

SEQ ID NO: 1261708 - DNA, 22 bp, Homo sapiens
cctaggtcccttcccgacccag

SEQ ID NO: 1261709 - DNA, 23 bp, Homo sapiens
cctaggtcccttcccgacccagc

SEQ ID NO: 1261710 - DNA, 14 bp, Homo sapiens
cctaggtcctctga

SEQ ID NO: 1261711 - DNA, 21 bp, Homo sapiens
cctaggtgttgtcagcaggca

SEQ ID NO: 1261712 - DNA, 19 bp, Homo sapiens
cctaggttcccggtcccga

SEQ ID NO: 1261713 - DNA, 18 bp, Homo sapiens
cctaggttccctgttctt

SEQ ID NO: 1261714 - DNA, 14 bp, Homo sapiens
cctaggttctgtta

SEQ ID NO: 1261715 - DNA, 19 bp, Homo sapiens
cctagtagctgggattaca

SEQ ID NO: 1261716 - DNA, 20 bp, Homo sapiens
cctagtcagggcacagctgc

SEQ ID NO: 1261717 - DNA, 14 bp, Homo sapiens
cctagtcccttccc

SEQ ID NO: 1261718 - DNA, 21 bp, Homo sapiens
cctagtcccttcccctccctg

SEQ ID NO: 1261719 - DNA, 18 bp, Homo sapiens
cctagtgaaggcttctct

SEQ ID NO: 1261720 - DNA, 21 bp, Homo sapiens
cctagtgaaggcttctctctg

SEQ ID NO: 1261721 - DNA, 15 bp, Homo sapiens
cctagtgccccagac

SEQ ID NO: 1261722 - DNA, 17 bp, Homo sapiens
cctagtggatgactgtt

SEQ ID NO: 1261723 - DNA, 14 bp, Homo sapiens
cctagtgggagtta

SEQ ID NO: 1261724 - DNA, 21 bp, Homo sapiens
cctagtggggtctccctctcc

SEQ ID NO: 1261725 - DNA, 16 bp, Homo sapiens
cctagtttcctctcct

SEQ ID NO: 1261726 - DNA, 17 bp, Homo sapiens
cctagtttcctctcctt

SEQ ID NO: 1261727 - DNA, 13 bp, Homo sapiens
cctagttttccat

SEQ ID NO: 1261728 - DNA, 15 bp, Homo sapiens
cctagttttctcctc

SEQ ID NO: 1261729 - DNA, 16 bp, Homo sapiens
cctagttttctcctcc

SEQ ID NO: 1261730 - DNA, 16 bp, Homo sapiens
cctataaaatgcccat

SEQ ID NO: 1261731 - DNA, 14 bp, Homo sapiens
cctataaaattaaa

SEQ ID NO: 1261732 - DNA, 17 bp, Homo sapiens
cctataaaattaaatgc

SEQ ID NO: 1261733 - DNA, 21 bp, Homo sapiens
cctataaaattaaatgccttg

SEQ ID NO: 1261734 - DNA, 14 bp, Homo sapiens
cctataagaagcct

SEQ ID NO: 1261735 - DNA, 14 bp, Homo sapiens
cctataagaggaat

SEQ ID NO: 1261736 - DNA, 15 bp, Homo sapiens
cctcagcctctgcaa

SEQ ID NO: 1261737 - DNA, 16 bp, Homo sapiens
cctcagcctctgcaac

SEQ ID NO: 1261738 - DNA, 22 bp, Homo sapiens
cctcagcctctgcaactgcaag

SEQ ID NO: 1261739 - DNA, 17 bp, Homo sapiens
cctcagcctggagaggc

SEQ ID NO: 1261740 - DNA, 13 bp, Homo sapiens
cctcagcctgggg

SEQ ID NO: 1261741 - DNA, 14 bp, Homo sapiens
cctcagcctggggc

SEQ ID NO: 1261742 - DNA, 18 bp, Homo sapiens
cctcagcctggggctctc

SEQ ID NO: 1261743 - DNA, 12 bp, Homo sapiens
cctcagcctgtg

SEQ ID NO: 1261744 - DNA, 16 bp, Homo sapiens
cctcagcctgtgctgc

SEQ ID NO: 1261745 - DNA, 12 bp, Homo sapiens
cctcagccttaa

SEQ ID NO: 1261746 - DNA, 22 bp, Homo sapiens
cctcagccttccccttgcccag

SEQ ID NO: 1261747 - DNA, 14 bp, Homo sapiens
cctcagccttggga

SEQ ID NO: 1261748 - DNA, 14 bp, Homo sapiens
cctcagcgcaggct

SEQ ID NO: 1261749 - DNA, 20 bp, Homo sapiens
cctcagctccccggcactgc

SEQ ID NO: 1261750 - DNA, 18 bp, Homo sapiens
cctcagctctgggagagg

SEQ ID NO: 1261751 - DNA, 13 bp, Homo sapiens
cctcagctgcaca

SEQ ID NO: 1261752 - DNA, 14 bp, Homo sapiens
cctcagctgcacat

SEQ ID NO: 1261753 - DNA, 18 bp, Homo sapiens
cctcagctgcacattcct

SEQ ID NO: 1261754 - DNA, 22 bp, Homo sapiens
cctcagctgcatggagcctgga

SEQ ID NO: 1261755 - DNA, 16 bp, Homo sapiens
cctcagctgccaagca

SEQ ID NO: 1261756 - DNA, 13 bp, Homo sapiens
cctcagctgcctc

SEQ ID NO: 1261757 - DNA, 14 bp, Homo sapiens
cctcagctgcctca

SEQ ID NO: 1261758 - DNA, 17 bp, Homo sapiens
cctcagctgcctcactt

SEQ ID NO: 1261759 - DNA, 19 bp, Homo sapiens
cctcagctgcctcacttcc

SEQ ID NO: 1261760 - DNA, 19 bp, Homo sapiens
cctcagctgtcacctgctc

SEQ ID NO: 1261761 - DNA, 22 bp, Homo sapiens
cctcagcttgggcttcttcctc

SEQ ID NO: 1261762 - DNA, 15 bp, Homo sapiens
cctcaggaaggacat

SEQ ID NO: 1261763 - DNA, 19 bp, Homo sapiens
cctcaggagccgaagccca

SEQ ID NO: 1261764 - DNA, 15 bp, Homo sapiens
cctcaggagggcagg

SEQ ID NO: 1261765 - DNA, 16 bp, Homo sapiens
cctcaggagggcaggc

SEQ ID NO: 1261766 - DNA, 20 bp, Homo sapiens
cctcaggcacacagctactc

SEQ ID NO: 1261767 - DNA, 14 bp, Homo sapiens
cctcaggcagctca

SEQ ID NO: 1261768 - DNA, 11 bp, Homo sapiens
cctcaggcagg

SEQ ID NO: 1261769 - DNA, 15 bp, Homo sapiens
cctcaggcaggaagg

SEQ ID NO: 1261770 - DNA, 12 bp, Homo sapiens
cctcaggcaggt

SEQ ID NO: 1261771 - DNA, 14 bp, Homo sapiens
cctcaggccaccct

SEQ ID NO: 1261772 - DNA, 20 bp, Homo sapiens
cctcaggccaccctccacga

SEQ ID NO: 1261773 - DNA, 22 bp, Homo sapiens
cctcaggccagggctcaccagc

SEQ ID NO: 1261774 - DNA, 17 bp, Homo sapiens
cctcaggccattcccca

SEQ ID NO: 1261775 - DNA, 18 bp, Homo sapiens
cctcaggccattccccaa

SEQ ID NO: 1261776 - DNA, 15 bp, Homo sapiens
cctcaggctccccag

SEQ ID NO: 1261777 - DNA, 18 bp, Homo sapiens
cctcaggcttgagggagg

SEQ ID NO: 1261778 - DNA, 22 bp, Homo sapiens
cctcagggacagagacacctgc

SEQ ID NO: 1261779 - DNA, 23 bp, Homo sapiens
cctcagggacagagacacctgca

SEQ ID NO: 1261780 - DNA, 24 bp, Homo sapiens
cctcagggacagagacacctgcac

SEQ ID NO: 1261781 - DNA, 17 bp, Homo sapiens
cctcagggagcagggaa

SEQ ID NO: 1261782 - DNA, 19 bp, Homo sapiens
cctcagggagcagggaagg

SEQ ID NO: 1261783 - DNA, 16 bp, Homo sapiens
cctcagggagcctccc

SEQ ID NO: 1261784 - DNA, 16 bp, Homo sapiens
cctcagggagcgatcc

SEQ ID NO: 1261785 - DNA, 23 bp, Homo sapiens
cctcagggatcttgcattcccag

SEQ ID NO: 1261786 - DNA, 16 bp, Homo sapiens
cctcagggcccctggg

SEQ ID NO: 1261787 - DNA, 15 bp, Homo sapiens
cctcagggctcccag

SEQ ID NO: 1261788 - DNA, 17 bp, Homo sapiens
cctcagggctcccaggg

SEQ ID NO: 1261789 - DNA, 18 bp, Homo sapiens
cctcagggctcccagggg

SEQ ID NO: 1261790 - DNA, 16 bp, Homo sapiens
cctcagggctgtccca

SEQ ID NO: 1261791 - DNA, 17 bp, Homo sapiens
cctcagggctgtcccag

SEQ ID NO: 1261792 - DNA, 18 bp, Homo sapiens
cctcagggctgtcccagc

SEQ ID NO: 1261793 - DNA, 13 bp, Homo sapiens
cctcaggggcacc

SEQ ID NO: 1261794 - DNA, 16 bp, Homo sapiens
cctcaggggcctctct

SEQ ID NO: 1261795 - DNA, 15 bp, Homo sapiens
cctcagggggccagc

SEQ ID NO: 1261796 - DNA, 20 bp, Homo sapiens
cctcagggggccagctgggg

SEQ ID NO: 1261797 - DNA, 20 bp, Homo sapiens
cctcagggtctaaggagcgc

SEQ ID NO: 1261798 - DNA, 18 bp, Homo sapiens
cctcaggtacagcgggct

SEQ ID NO: 1261799 - DNA, 11 bp, Homo sapiens
cctcaggtcag

SEQ ID NO: 1261800 - DNA, 14 bp, Homo sapiens
cctcaggtcagctg

SEQ ID NO: 1261801 - DNA, 21 bp, Homo sapiens
cctcaggtggccagcctggat

SEQ ID NO: 1261802 - DNA, 16 bp, Homo sapiens
cctcaggtggccatgc

SEQ ID NO: 1261803 - DNA, 21 bp, Homo sapiens
cctcaggtggccatgcctcag

SEQ ID NO: 1261804 - DNA, 17 bp, Homo sapiens
cctcaggtgtgcctgtt

SEQ ID NO: 1261805 - DNA, 20 bp, Homo sapiens
cctcagtaacatttctgttc

SEQ ID NO: 1261806 - DNA, 22 bp, Homo sapiens
cctcagtaacatttctgttctc

SEQ ID NO: 1261807 - DNA, 19 bp, Homo sapiens
cctcagtatatttaaactc

SEQ ID NO: 1261808 - DNA, 19 bp, Homo sapiens
cctcagtatttatgtaatt

SEQ ID NO: 1261809 - DNA, 17 bp, Homo sapiens
cctcagtcacccccact

SEQ ID NO: 1261810 - DNA, 21 bp, Homo sapiens
cctcagtcagttcccggagca

SEQ ID NO: 1261811 - DNA, 14 bp, Homo sapiens
cctcagtctccctc

SEQ ID NO: 1261812 - DNA, 19 bp, Homo sapiens
cctcagtgaaggtggtggg

SEQ ID NO: 1261813 - DNA, 14 bp, Homo sapiens
cctcagtgccactt

SEQ ID NO: 1261814 - DNA, 22 bp, Homo sapiens
cctcagtgccacttgacattcc

SEQ ID NO: 1261815 - DNA, 20 bp, Homo sapiens
cctcagtggactttccaccc

SEQ ID NO: 1261816 - DNA, 21 bp, Homo sapiens
cctcagtggactttccacccc

SEQ ID NO: 1261817 - DNA, 21 bp, Homo sapiens
cctcagtggatcttcagaact

SEQ ID NO: 1261818 - DNA, 12 bp, Homo sapiens
cctcagtgggaa

SEQ ID NO: 1261819 - DNA, 15 bp, Homo sapiens
cctcagttacacagg

SEQ ID NO: 1261820 - DNA, 19 bp, Homo sapiens
cctcagttacacaggaacc

SEQ ID NO: 1261821 - DNA, 23 bp, Homo sapiens
cctcagttcaacctggtggcacc

SEQ ID NO: 1261822 - DNA, 17 bp, Homo sapiens
cctcagttcccagctcc

SEQ ID NO: 1261823 - DNA, 19 bp, Homo sapiens
cctcagttcccagctcccc

SEQ ID NO: 1261824 - DNA, 19 bp, Homo sapiens
cctcagttcccttggcctc

SEQ ID NO: 1261825 - DNA, 14 bp, Homo sapiens
cctcagttccttca

SEQ ID NO: 1261826 - DNA, 23 bp, Homo sapiens
cctcagtttaatccttctagttt

SEQ ID NO: 1261827 - DNA, 13 bp, Homo sapiens
cctcagttttcct

SEQ ID NO: 1261828 - DNA, 17 bp, Homo sapiens
cctcagttttccttctg

SEQ ID NO: 1261829 - DNA, 19 bp, Homo sapiens
cctcagttttccttctgtt

SEQ ID NO: 1261830 - DNA, 21 bp, Homo sapiens
cctcatacacataattttgtg

SEQ ID NO: 1261831 - DNA, 22 bp, Homo sapiens
cctcatactcctgggctcaagc

SEQ ID NO: 1261832 - DNA, 19 bp, Homo sapiens
cctcatagcatagccagca

SEQ ID NO: 1261833 - DNA, 22 bp, Homo sapiens
cctcatagtaataagatggctg

SEQ ID NO: 1261834 - DNA, 18 bp, Homo sapiens
cctcatcaccatcgtgtt

SEQ ID NO: 1261835 - DNA, 20 bp, Homo sapiens
cctcatcactggactgcatg

SEQ ID NO: 1261836 - DNA, 15 bp, Homo sapiens
cctcatcaggatgaa

SEQ ID NO: 1261837 - DNA, 19 bp, Homo sapiens
cctcatcaggatgaaccca

SEQ ID NO: 1261838 - DNA, 23 bp, Homo sapiens
cctcatcaggatgaacccaggac

SEQ ID NO: 1261839 - DNA, 16 bp, Homo sapiens
cctcatcatccacccg

SEQ ID NO: 1261840 - DNA, 15 bp, Homo sapiens
cctcatccaaagttc

SEQ ID NO: 1261841 - DNA, 22 bp, Homo sapiens
cctcatccagggcccagcggtc

SEQ ID NO: 1261842 - DNA, 16 bp, Homo sapiens
cctcatccatgcactt

SEQ ID NO: 1261843 - DNA, 14 bp, Homo sapiens
cctcatccgaggca

SEQ ID NO: 1261844 - DNA, 15 bp, Homo sapiens
cctcatccgaggcag

SEQ ID NO: 1261845 - DNA, 15 bp, Homo sapiens
cctcatcctgcttct

SEQ ID NO: 1261846 - DNA, 18 bp, Homo sapiens
cctcatcctgcttctctt

SEQ ID NO: 1261847 - DNA, 12 bp, Homo sapiens
cctcatcctttc

SEQ ID NO: 1261848 - DNA, 13 bp, Homo sapiens
cctcatctcattc

SEQ ID NO: 1261849 - DNA, 11 bp, Homo sapiens
cctcatctcct

SEQ ID NO: 1261850 - DNA, 13 bp, Homo sapiens
cctcatctctgaa

SEQ ID NO: 1261851 - DNA, 21 bp, Homo sapiens
cctcatctctgaaaattctgg

SEQ ID NO: 1261852 - DNA, 19 bp, Homo sapiens
cctcatctgagaggctctc

SEQ ID NO: 1261853 - DNA, 17 bp, Homo sapiens
cctcatctgtccctccg

SEQ ID NO: 1261854 - DNA, 15 bp, Homo sapiens
cctcatctgtggagc

SEQ ID NO: 1261855 - DNA, 13 bp, Homo sapiens
cctcatcttctct

SEQ ID NO: 1261856 - DNA, 17 bp, Homo sapiens
cctcatcttcttcacca

SEQ ID NO: 1261857 - DNA, 19 bp, Homo sapiens
cctcatcttggagcttttt

SEQ ID NO: 1261858 - DNA, 15 bp, Homo sapiens
cctccctgtgccccc

SEQ ID NO: 1261859 - DNA, 20 bp, Homo sapiens
cctccctgtgcccccagcct

SEQ ID NO: 1261860 - DNA, 21 bp, Homo sapiens
cctccctgtgcccccagcctc

SEQ ID NO: 1261861 - DNA, 22 bp, Homo sapiens
cctccctgtgcccccagcctca

SEQ ID NO: 1261862 - DNA, 13 bp, Homo sapiens
cctcccttacaga

SEQ ID NO: 1261863 - DNA, 15 bp, Homo sapiens
cctcccttcacaggg

SEQ ID NO: 1261864 - DNA, 13 bp, Homo sapiens
cctcccttcccac

SEQ ID NO: 1261865 - DNA, 17 bp, Homo sapiens
cctcccttcccagtggg

SEQ ID NO: 1261866 - DNA, 20 bp, Homo sapiens
cctcccttccgaccctctgg

SEQ ID NO: 1261867 - DNA, 12 bp, Homo sapiens
cctcccttcctt

SEQ ID NO: 1261868 - DNA, 21 bp, Homo sapiens
cctcccttccttttccctgct

SEQ ID NO: 1261869 - DNA, 10 bp, Homo sapiens
cctcccttct

SEQ ID NO: 1261870 - DNA, 18 bp, Homo sapiens
cctcccttctccctggat

SEQ ID NO: 1261871 - DNA, 15 bp, Homo sapiens
cctcccttctgctac

SEQ ID NO: 1261872 - DNA, 16 bp, Homo sapiens
cctcccttgccccagg

SEQ ID NO: 1261873 - DNA, 19 bp, Homo sapiens
cctcccttggaaacctgcc

SEQ ID NO: 1261874 - DNA, 15 bp, Homo sapiens
cctcccttggcgtgg

SEQ ID NO: 1261875 - DNA, 14 bp, Homo sapiens
cctcccttgtcctt

SEQ ID NO: 1261876 - DNA, 14 bp, Homo sapiens
cctccgacctctct

SEQ ID NO: 1261877 - DNA, 20 bp, Homo sapiens
cctccgagaggcagccagac

SEQ ID NO: 1261878 - DNA, 14 bp, Homo sapiens
cctccgaggctccc

SEQ ID NO: 1261879 - DNA, 16 bp, Homo sapiens
cctccgatccttcctc

SEQ ID NO: 1261880 - DNA, 19 bp, Homo sapiens
cctccgatccttcctccca

SEQ ID NO: 1261881 - DNA, 15 bp, Homo sapiens
cctccgatgcctggc

SEQ ID NO: 1261882 - DNA, 18 bp, Homo sapiens
cctccgcagtgtctccac

SEQ ID NO: 1261883 - DNA, 20 bp, Homo sapiens
cctccgccagaccccgtggc

SEQ ID NO: 1261884 - DNA, 15 bp, Homo sapiens
cctccgccctgccac

SEQ ID NO: 1261885 - DNA, 14 bp, Homo sapiens
cctccgcctccagg

SEQ ID NO: 1261886 - DNA, 19 bp, Homo sapiens
cctccgccttcactccggt

SEQ ID NO: 1261887 - DNA, 21 bp, Homo sapiens
cctccgccttcccagcagcgg

SEQ ID NO: 1261888 - DNA, 17 bp, Homo sapiens
cctccgccttctcccac

SEQ ID NO: 1261889 - DNA, 22 bp, Homo sapiens
cctccggagcctcatgttctct

SEQ ID NO: 1261890 - DNA, 18 bp, Homo sapiens
cctccggaggagcagcct

SEQ ID NO: 1261891 - DNA, 18 bp, Homo sapiens
cctccggccatactgcct

SEQ ID NO: 1261892 - DNA, 15 bp, Homo sapiens
cctccggcctcccct

SEQ ID NO: 1261893 - DNA, 18 bp, Homo sapiens
cctccgggacctggtgct

SEQ ID NO: 1261894 - DNA, 13 bp, Homo sapiens
cctccgggcaggg

SEQ ID NO: 1261895 - DNA, 21 bp, Homo sapiens
cctccgtagggtctttcttgg

SEQ ID NO: 1261896 - DNA, 17 bp, Homo sapiens
cctccgtccacccaggc

SEQ ID NO: 1261897 - DNA, 19 bp, Homo sapiens
cctccgtccacccaggctg

SEQ ID NO: 1261898 - DNA, 15 bp, Homo sapiens
cctccgtccatatca

SEQ ID NO: 1261899 - DNA, 18 bp, Homo sapiens
cctccgtcctgtcactga

SEQ ID NO: 1261900 - DNA, 18 bp, Homo sapiens
cctccgtgatccatccat

SEQ ID NO: 1261901 - DNA, 20 bp, Homo sapiens
cctccgtttatgggccttgc

SEQ ID NO: 1261902 - DNA, 17 bp, Homo sapiens
cctcctaaggctcccca

SEQ ID NO: 1261903 - DNA, 19 bp, Homo sapiens
cctcctaccccttcctgtc

SEQ ID NO: 1261904 - DNA, 23 bp, Homo sapiens
cctcctaccccttcctgtcctgc

SEQ ID NO: 1261905 - DNA, 13 bp, Homo sapiens
cctcctaccctcc

SEQ ID NO: 1261906 - DNA, 16 bp, Homo sapiens
cctcctaccctgcgcc

SEQ ID NO: 1261907 - DNA, 13 bp, Homo sapiens
cctcctacctcag

SEQ ID NO: 1261908 - DNA, 22 bp, Homo sapiens
cctcctacctcagcctcctggg

SEQ ID NO: 1261909 - DNA, 21 bp, Homo sapiens
cctcctacgcagatgctgtca

SEQ ID NO: 1261910 - DNA, 21 bp, Homo sapiens
cctcctagaggtgggcagctg

SEQ ID NO: 1261911 - DNA, 22 bp, Homo sapiens
cctcctagcacaaggagtgccc

SEQ ID NO: 1261912 - DNA, 16 bp, Homo sapiens
cctcctagctctccca

SEQ ID NO: 1261913 - DNA, 19 bp, Homo sapiens
cctcctaggaaaccagctc

SEQ ID NO: 1261914 - DNA, 13 bp, Homo sapiens
cctcctaggctgg

SEQ ID NO: 1261915 - DNA, 13 bp, Homo sapiens
cctcctaggggaa

SEQ ID NO: 1261916 - DNA, 15 bp, Homo sapiens
cctcctaggggaagg

SEQ ID NO: 1261917 - DNA, 19 bp, Homo sapiens
cctcctaggggaagggggt

SEQ ID NO: 1261918 - DNA, 20 bp, Homo sapiens
cctcctaggggaagggggtg

SEQ ID NO: 1261919 - DNA, 19 bp, Homo sapiens
cctcctatccttggagagc

SEQ ID NO: 1261920 - DNA, 18 bp, Homo sapiens
cctcctatgtgtgcctcc

SEQ ID NO: 1261921 - DNA, 15 bp, Homo sapiens
cctcctcaccccgtc

SEQ ID NO: 1261922 - DNA, 13 bp, Homo sapiens
cctcctcacctca

SEQ ID NO: 1261923 - DNA, 16 bp, Homo sapiens
cctcctcacctcatgc

SEQ ID NO: 1261924 - DNA, 19 bp, Homo sapiens
cctcctcacctcatgccca

SEQ ID NO: 1261925 - DNA, 16 bp, Homo sapiens
cctcctcacctctgga

SEQ ID NO: 1261926 - DNA, 21 bp, Homo sapiens
cctcctcacctctggactggc

SEQ ID NO: 1261927 - DNA, 22 bp, Homo sapiens
cctcctcacctctggactggct

SEQ ID NO: 1261928 - DNA, 23 bp, Homo sapiens
cctcctcagccatgggaacctca

SEQ ID NO: 1261929 - DNA, 13 bp, Homo sapiens
cctcctcagcctc

SEQ ID NO: 1261930 - DNA, 15 bp, Homo sapiens
cctcctcagcctctg

SEQ ID NO: 1261931 - DNA, 20 bp, Homo sapiens
cctcctcagcctctgcaact

SEQ ID NO: 1261932 - DNA, 19 bp, Homo sapiens
cctcctcaggcacacagct

SEQ ID NO: 1261933 - DNA, 12 bp, Homo sapiens
cctcctcagggg

SEQ ID NO: 1261934 - DNA, 18 bp, Homo sapiens
cctcctcagggggtagga

SEQ ID NO: 1261935 - DNA, 16 bp, Homo sapiens
cctcctcatcagtgtg

SEQ ID NO: 1261936 - DNA, 22 bp, Homo sapiens
cctcctcatcagtgtgtaaata

SEQ ID NO: 1261937 - DNA, 13 bp, Homo sapiens
cctcctcatcccg

SEQ ID NO: 1261938 - DNA, 20 bp, Homo sapiens
cctcctcatcccgtgttctc

SEQ ID NO: 1261939 - DNA, 23 bp, Homo sapiens
cctcctcatcccgtgttctcctt

SEQ ID NO: 1261940 - DNA, 20 bp, Homo sapiens
cctcctcatgtacataccct

SEQ ID NO: 1261941 - DNA, 12 bp, Homo sapiens
cctcctccactc

SEQ ID NO: 1261942 - DNA, 15 bp, Homo sapiens
cctcctccactcact

SEQ ID NO: 1261943 - DNA, 13 bp, Homo sapiens
cctcctccacttg

SEQ ID NO: 1261944 - DNA, 14 bp, Homo sapiens
cctcctccacttgg

SEQ ID NO: 1261945 - DNA, 20 bp, Homo sapiens
cctcctccagcccctgtccc

SEQ ID NO: 1261946 - DNA, 14 bp, Homo sapiens
cctcctccatcacc

SEQ ID NO: 1261947 - DNA, 23 bp, Homo sapiens
cctcctcccacccggctgcagag

SEQ ID NO: 1261948 - DNA, 15 bp, Homo sapiens
cctcctcccactggg

SEQ ID NO: 1261949 - DNA, 15 bp, Homo sapiens
cctcctcccagggcc

SEQ ID NO: 1261950 - DNA, 21 bp, Homo sapiens
cctcctcccatccagcgtctg

SEQ ID NO: 1261951 - DNA, 12 bp, Homo sapiens
cctcctcccatg

SEQ ID NO: 1261952 - DNA, 21 bp, Homo sapiens
cctcctcccccggctgggcct

SEQ ID NO: 1261953 - DNA, 15 bp, Homo sapiens
cctcctccccctttg

SEQ ID NO: 1261954 - DNA, 17 bp, Homo sapiens
cctcctccccctttggg

SEQ ID NO: 1261955 - DNA, 21 bp, Homo sapiens
cctcctccccctttggggtag

SEQ ID NO: 1261956 - DNA, 13 bp, Homo sapiens
cctcctccctcca

SEQ ID NO: 1261957 - DNA, 17 bp, Homo sapiens
cctcctccctccaagcc

SEQ ID NO: 1261958 - DNA, 23 bp, Homo sapiens
cctcctccctccaagcctggcac

SEQ ID NO: 1261959 - DNA, 14 bp, Homo sapiens
cctcctccctgcat

SEQ ID NO: 1261960 - DNA, 16 bp, Homo sapiens
cctcctccctgcatct

SEQ ID NO: 1261961 - DNA, 13 bp, Homo sapiens
cctcctcgctcct

SEQ ID NO: 1261962 - DNA, 14 bp, Homo sapiens
cctcctcgctcctc

SEQ ID NO: 1261963 - DNA, 20 bp, Homo sapiens
cctcctcggagagcagcagc

SEQ ID NO: 1261964 - DNA, 16 bp, Homo sapiens
cctcctctacctctct

SEQ ID NO: 1261965 - DNA, 21 bp, Homo sapiens
cctcctctagccatcccttgg

SEQ ID NO: 1261966 - DNA, 13 bp, Homo sapiens
cctcctctcactc

SEQ ID NO: 1261967 - DNA, 13 bp, Homo sapiens
cctcctctcagtg

SEQ ID NO: 1261968 - DNA, 12 bp, Homo sapiens
cctcctctccat

SEQ ID NO: 1261969 - DNA, 13 bp, Homo sapiens
cctcctctcccat

SEQ ID NO: 1261970 - DNA, 19 bp, Homo sapiens
cctcctctcccatccccct

SEQ ID NO: 1261971 - DNA, 13 bp, Homo sapiens
cctcctctccctg

SEQ ID NO: 1261972 - DNA, 23 bp, Homo sapiens
cctcctctgaggaagcagttggg

SEQ ID NO: 1261973 - DNA, 13 bp, Homo sapiens
cctcctctgccac

SEQ ID NO: 1261974 - DNA, 13 bp, Homo sapiens
cctcctctgccta

SEQ ID NO: 1261975 - DNA, 14 bp, Homo sapiens
cctcctctgcctac

SEQ ID NO: 1261976 - DNA, 18 bp, Homo sapiens
cctcctctgcctacagcc

SEQ ID NO: 1261977 - DNA, 12 bp, Homo sapiens
cctcctctgctg

SEQ ID NO: 1261978 - DNA, 13 bp, Homo sapiens
cctcctctgctgg

SEQ ID NO: 1261979 - DNA, 12 bp, Homo sapiens
cctcctctggca

SEQ ID NO: 1261980 - DNA, 12 bp, Homo sapiens
cctcctctgtcc

SEQ ID NO: 1261981 - DNA, 10 bp, Homo sapiens
cctctccctg

SEQ ID NO: 1261982 - DNA, 15 bp, Homo sapiens
cctctccctgaccct

SEQ ID NO: 1261983 - DNA, 15 bp, Homo sapiens
cctctccctgcatcc

SEQ ID NO: 1261984 - DNA, 18 bp, Homo sapiens
cctctccctgcatcctga

SEQ ID NO: 1261985 - DNA, 21 bp, Homo sapiens
cctctccctgcatcctgaggc

SEQ ID NO: 1261986 - DNA, 21 bp, Homo sapiens
cctctccctgtgttctgggct

SEQ ID NO: 1261987 - DNA, 14 bp, Homo sapiens
cctctcccttccct

SEQ ID NO: 1261988 - DNA, 15 bp, Homo sapiens
cctctcccttccctc

SEQ ID NO: 1261989 - DNA, 17 bp, Homo sapiens
cctctcccttcccttcc

SEQ ID NO: 1261990 - DNA, 15 bp, Homo sapiens
cctctcctactcact

SEQ ID NO: 1261991 - DNA, 16 bp, Homo sapiens
cctctcctcccagctg

SEQ ID NO: 1261992 - DNA, 17 bp, Homo sapiens
cctctcctcccagctgc

SEQ ID NO: 1261993 - DNA, 20 bp, Homo sapiens
cctctcctcccagctgcttt

SEQ ID NO: 1261994 - DNA, 16 bp, Homo sapiens
cctctcctcctcagct

SEQ ID NO: 1261995 - DNA, 13 bp, Homo sapiens
cctctcctgaccc

SEQ ID NO: 1261996 - DNA, 15 bp, Homo sapiens
cctctcctgccctct

SEQ ID NO: 1261997 - DNA, 14 bp, Homo sapiens
cctctcctgggggt

SEQ ID NO: 1261998 - DNA, 13 bp, Homo sapiens
cctctccttccca

SEQ ID NO: 1261999 - DNA, 13 bp, Homo sapiens
cctctccttcctg

SEQ ID NO: 1262000 - DNA, 21 bp, Homo sapiens
cctctccttcgtatcccgagt

SEQ ID NO: 1262001 - DNA, 23 bp, Homo sapiens
cctctccttgggctcctggctgc

SEQ ID NO: 1262002 - DNA, 14 bp, Homo sapiens
cctctcgagcccag

SEQ ID NO: 1262003 - DNA, 15 bp, Homo sapiens
cctctcgagcccaga

SEQ ID NO: 1262004 - DNA, 16 bp, Homo sapiens
cctctcgagggcaggg

SEQ ID NO: 1262005 - DNA, 18 bp, Homo sapiens
cctctcgccatgatcaga

SEQ ID NO: 1262006 - DNA, 15 bp, Homo sapiens
cctctcgccccatcc

SEQ ID NO: 1262007 - DNA, 21 bp, Homo sapiens
cctctcgccccatccctgctt

SEQ ID NO: 1262008 - DNA, 17 bp, Homo sapiens
cctctcggaaggctggc

SEQ ID NO: 1262009 - DNA, 19 bp, Homo sapiens
cctctcggccccatcgccc

SEQ ID NO: 1262010 - DNA, 16 bp, Homo sapiens
cctctcggctggaaga

SEQ ID NO: 1262011 - DNA, 19 bp, Homo sapiens
cctctcggtggccagcagg

SEQ ID NO: 1262012 - DNA, 18 bp, Homo sapiens
cctctctaagccacagct

SEQ ID NO: 1262013 - DNA, 23 bp, Homo sapiens
cctctctaagccacagcttcttc

SEQ ID NO: 1262014 - DNA, 16 bp, Homo sapiens
cctctctacttcccct

SEQ ID NO: 1262015 - DNA, 17 bp, Homo sapiens
cctctctatcctctctt

SEQ ID NO: 1262016 - DNA, 14 bp, Homo sapiens
cctctctcatgaga

SEQ ID NO: 1262017 - DNA, 15 bp, Homo sapiens
cctctctcctctccg

SEQ ID NO: 1262018 - DNA, 16 bp, Homo sapiens
cctctctcctctccgc

SEQ ID NO: 1262019 - DNA, 23 bp, Homo sapiens
cctctctccttatagacacttgc

SEQ ID NO: 1262020 - DNA, 16 bp, Homo sapiens
cctctctcggagccct

SEQ ID NO: 1262021 - DNA, 12 bp, Homo sapiens
cctctctctgct

SEQ ID NO: 1262022 - DNA, 13 bp, Homo sapiens
cctctctctgtgg

SEQ ID NO: 1262023 - DNA, 17 bp, Homo sapiens
cctctctctgtggggct

SEQ ID NO: 1262024 - DNA, 16 bp, Homo sapiens
cctctctcttcccagc

SEQ ID NO: 1262025 - DNA, 20 bp, Homo sapiens
cctctctcttctgctccacc

SEQ ID NO: 1262026 - DNA, 12 bp, Homo sapiens
cctctctgaagc

SEQ ID NO: 1262027 - DNA, 22 bp, Homo sapiens
cctctctgaagcgactctcctg

SEQ ID NO: 1262028 - DNA, 18 bp, Homo sapiens
cctctctgatgtcccagt

SEQ ID NO: 1262029 - DNA, 17 bp, Homo sapiens
cctctctgcagacttcc

SEQ ID NO: 1262030 - DNA, 23 bp, Homo sapiens
cctctctgcagacttcccagcta

SEQ ID NO: 1262031 - DNA, 16 bp, Homo sapiens
cctctctgcatctgac

SEQ ID NO: 1262032 - DNA, 10 bp, Homo sapiens
cctctctgct

SEQ ID NO: 1262033 - DNA, 13 bp, Homo sapiens
cctctctggcctc

SEQ ID NO: 1262034 - DNA, 18 bp, Homo sapiens
cctctctggcctcccacc

SEQ ID NO: 1262035 - DNA, 13 bp, Homo sapiens
cctctctgggacc

SEQ ID NO: 1262036 - DNA, 12 bp, Homo sapiens
cctctctggggg

SEQ ID NO: 1262037 - DNA, 15 bp, Homo sapiens
cctctctgggggagg

SEQ ID NO: 1262038 - DNA, 16 bp, Homo sapiens
cctctctgggggaggc

SEQ ID NO: 1262039 - DNA, 21 bp, Homo sapiens
cctctcttaagatgtccaggg

SEQ ID NO: 1262040 - DNA, 16 bp, Homo sapiens
cctctcttccgggagc

SEQ ID NO: 1262041 - DNA, 19 bp, Homo sapiens
cctctcttccgggagctgg

SEQ ID NO: 1262042 - DNA, 11 bp, Homo sapiens
cctctcttgca

SEQ ID NO: 1262043 - DNA, 21 bp, Homo sapiens
cctctcttgcacccgcctctc

SEQ ID NO: 1262044 - DNA, 18 bp, Homo sapiens
cctctcttgccccttgtc

SEQ ID NO: 1262045 - DNA, 12 bp, Homo sapiens
cctctctttctc

SEQ ID NO: 1262046 - DNA, 21 bp, Homo sapiens
cctctcttttcctctctgtct

SEQ ID NO: 1262047 - DNA, 20 bp, Homo sapiens
cctctgaaattaaagaaatg

SEQ ID NO: 1262048 - DNA, 15 bp, Homo sapiens
cctctgaacttgcct

SEQ ID NO: 1262049 - DNA, 21 bp, Homo sapiens
cctctgaagagaccttggctg

SEQ ID NO: 1262050 - DNA, 19 bp, Homo sapiens
cctctgacagcagcctgtg

SEQ ID NO: 1262051 - DNA, 20 bp, Homo sapiens
cctctgacagcagcctgtga

SEQ ID NO: 1262052 - DNA, 14 bp, Homo sapiens
cctctgaccctcct

SEQ ID NO: 1262053 - DNA, 19 bp, Homo sapiens
cctctgacgcaccactgcc

SEQ ID NO: 1262054 - DNA, 19 bp, Homo sapiens
cctctgacgtccacctcct

SEQ ID NO: 1262055 - DNA, 19 bp, Homo sapiens
cctctgagaattccaagga

SEQ ID NO: 1262056 - DNA, 11 bp, Homo sapiens
cctctgagcct

SEQ ID NO: 1262057 - DNA, 15 bp, Homo sapiens
cctctgaggaagcag

SEQ ID NO: 1262058 - DNA, 18 bp, Homo sapiens
cctctgaggaagcagttg

SEQ ID NO: 1262059 - DNA, 11 bp, Homo sapiens
cctctgaggac

SEQ ID NO: 1262060 - DNA, 14 bp, Homo sapiens
cctctgaggacaga

SEQ ID NO: 1262061 - DNA, 18 bp, Homo sapiens
cctctgagttttgatgct

SEQ ID NO: 1262062 - DNA, 21 bp, Homo sapiens
cctctgataatatattttcaa

SEQ ID NO: 1262063 - DNA, 18 bp, Homo sapiens
cctctgatacccagagca

SEQ ID NO: 1262064 - DNA, 15 bp, Homo sapiens
cctctgatacctcaa

SEQ ID NO: 1262065 - DNA, 24 bp, Homo sapiens
cctctgattttggcatgtggagac

SEQ ID NO: 1262066 - DNA, 19 bp, Homo sapiens
cctctgcacaagctgcacc

SEQ ID NO: 1262067 - DNA, 20 bp, Homo sapiens
cctctgcacaagctgcaccc

SEQ ID NO: 1262068 - DNA, 16 bp, Homo sapiens
cctctgcacccagaac

SEQ ID NO: 1262069 - DNA, 22 bp, Homo sapiens
cctctgcagctgacctctgttg

SEQ ID NO: 1262070 - DNA, 19 bp, Homo sapiens
cctctgcattttgtacaaa

SEQ ID NO: 1262071 - DNA, 11 bp, Homo sapiens
cctctgccacc

SEQ ID NO: 1262072 - DNA, 13 bp, Homo sapiens
cctctgccacctc

SEQ ID NO: 1262073 - DNA, 15 bp, Homo sapiens
cctctgccacctccc

SEQ ID NO: 1262074 - DNA, 20 bp, Homo sapiens
cctctgccacctcccctatc

SEQ ID NO: 1262075 - DNA, 19 bp, Homo sapiens
cctctgccagtcgggagag

SEQ ID NO: 1262076 - DNA, 14 bp, Homo sapiens
cctctgccatgttt

SEQ ID NO: 1262077 - DNA, 18 bp, Homo sapiens
cctctgccatgtttttcc

SEQ ID NO: 1262078 - DNA, 17 bp, Homo sapiens
cctctgcccagcttggg

SEQ ID NO: 1262079 - DNA, 23 bp, Homo sapiens
cctctgcccagcttgggcccagc

SEQ ID NO: 1262080 - DNA, 13 bp, Homo sapiens
cctctgcccaggg

SEQ ID NO: 1262081 - DNA, 15 bp, Homo sapiens
cctctgccccaagca

SEQ ID NO: 1262082 - DNA, 21 bp, Homo sapiens
cctctgccccaagcagccagc

SEQ ID NO: 1262083 - DNA, 19 bp, Homo sapiens
cctctgccccatcctccag

SEQ ID NO: 1262084 - DNA, 22 bp, Homo sapiens
cctctgccccatcctccagcag

SEQ ID NO: 1262085 - DNA, 18 bp, Homo sapiens
cctctgcccctcccccag

SEQ ID NO: 1262086 - DNA, 14 bp, Homo sapiens
cctctgcccgcaga

SEQ ID NO: 1262087 - DNA, 15 bp, Homo sapiens
cctctgcccgcagag

SEQ ID NO: 1262088 - DNA, 17 bp, Homo sapiens
cctctgcccgcagagcc

SEQ ID NO: 1262089 - DNA, 23 bp, Homo sapiens
cctctgccctcattactgggcct

SEQ ID NO: 1262090 - DNA, 12 bp, Homo sapiens
cctctgcccttc

SEQ ID NO: 1262091 - DNA, 16 bp, Homo sapiens
cctctgcccttcccct

SEQ ID NO: 1262092 - DNA, 19 bp, Homo sapiens
cctctgcccttcctgcagg

SEQ ID NO: 1262093 - DNA, 23 bp, Homo sapiens
cctctgccgctgcttccaggctg

SEQ ID NO: 1262094 - DNA, 18 bp, Homo sapiens
cctctgcctacagccagg

SEQ ID NO: 1262095 - DNA, 11 bp, Homo sapiens
cctctgcctgc

SEQ ID NO: 1262096 - DNA, 12 bp, Homo sapiens
cctctgcctgca

SEQ ID NO: 1262097 - DNA, 14 bp, Homo sapiens
cctctgcctgcact

SEQ ID NO: 1262098 - DNA, 16 bp, Homo sapiens
cctctgcctgcactcc

SEQ ID NO: 1262099 - DNA, 23 bp, Homo sapiens
cctctgcctgcactccctggcct

SEQ ID NO: 1262100 - DNA, 12 bp, Homo sapiens
cctctgcctgcc

SEQ ID NO: 1262101 - DNA, 13 bp, Homo sapiens
cctctgcctgggc

SEQ ID NO: 1262102 - DNA, 15 bp, Homo sapiens
cctctgcctgtccct

SEQ ID NO: 1262103 - DNA, 16 bp, Homo sapiens
cctctgcctgtccctc

SEQ ID NO: 1262104 - DNA, 18 bp, Homo sapiens
cctgagccccgccctctt

SEQ ID NO: 1262105 - DNA, 20 bp, Homo sapiens
cctgagccccgccctcttcc

SEQ ID NO: 1262106 - DNA, 21 bp, Homo sapiens
cctgagccccgccctcttcct

SEQ ID NO: 1262107 - DNA, 13 bp, Homo sapiens
cctgagccccttc

SEQ ID NO: 1262108 - DNA, 17 bp, Homo sapiens
cctgagcccgcagccca

SEQ ID NO: 1262109 - DNA, 19 bp, Homo sapiens
cctgagcccgcagcccaga

SEQ ID NO: 1262110 - DNA, 17 bp, Homo sapiens
cctgagccctactccct

SEQ ID NO: 1262111 - DNA, 16 bp, Homo sapiens
cctgagccggccccag

SEQ ID NO: 1262112 - DNA, 21 bp, Homo sapiens
cctgagcgctgtggactgtcc

SEQ ID NO: 1262113 - DNA, 22 bp, Homo sapiens
cctgagcgctgtggactgtcct

SEQ ID NO: 1262114 - DNA, 17 bp, Homo sapiens
cctgagcggcaccctgg

SEQ ID NO: 1262115 - DNA, 21 bp, Homo sapiens
cctgagcggcaccctggtctg

SEQ ID NO: 1262116 - DNA, 18 bp, Homo sapiens
cctgagctattttcctct

SEQ ID NO: 1262117 - DNA, 20 bp, Homo sapiens
cctgagctattttcctctgg

SEQ ID NO: 1262118 - DNA, 22 bp, Homo sapiens
cctgagctattttcctctggcc

SEQ ID NO: 1262119 - DNA, 19 bp, Homo sapiens
cctgagctcggtggaccca

SEQ ID NO: 1262120 - DNA, 21 bp, Homo sapiens
cctgagctcggtggacccagg

SEQ ID NO: 1262121 - DNA, 12 bp, Homo sapiens
cctgagctggcc

SEQ ID NO: 1262122 - DNA, 23 bp, Homo sapiens
cctgagctggcctgtctgcgtgg

SEQ ID NO: 1262123 - DNA, 17 bp, Homo sapiens
cctgagctggggaagcc

SEQ ID NO: 1262124 - DNA, 14 bp, Homo sapiens
cctgagctggggcc

SEQ ID NO: 1262125 - DNA, 15 bp, Homo sapiens
cctgagctggggcca

SEQ ID NO: 1262126 - DNA, 16 bp, Homo sapiens
cctgagcttggccaga

SEQ ID NO: 1262127 - DNA, 18 bp, Homo sapiens
cctgagctttggggacag

SEQ ID NO: 1262128 - DNA, 17 bp, Homo sapiens
cctgaggacagctgtcc

SEQ ID NO: 1262129 - DNA, 18 bp, Homo sapiens
cctgaggacctctcagca

SEQ ID NO: 1262130 - DNA, 14 bp, Homo sapiens
cctgaggagacatc

SEQ ID NO: 1262131 - DNA, 21 bp, Homo sapiens
cctgaggagccctgaggacct

SEQ ID NO: 1262132 - DNA, 12 bp, Homo sapiens
cctgaggaggag

SEQ ID NO: 1262133 - DNA, 17 bp, Homo sapiens
cctgaggaggaggacac

SEQ ID NO: 1262134 - DNA, 19 bp, Homo sapiens
cctgaggaggaggacacag

SEQ ID NO: 1262135 - DNA, 12 bp, Homo sapiens
cctgaggaggcc

SEQ ID NO: 1262136 - DNA, 14 bp, Homo sapiens
cctgaggaggccgc

SEQ ID NO: 1262137 - DNA, 15 bp, Homo sapiens
cctgaggatgagctg

SEQ ID NO: 1262138 - DNA, 16 bp, Homo sapiens
cctgaggcaaggagtt

SEQ ID NO: 1262139 - DNA, 14 bp, Homo sapiens
cctgaggcaggaga

SEQ ID NO: 1262140 - DNA, 21 bp, Homo sapiens
cctgaggccaggacgtctggg

SEQ ID NO: 1262141 - DNA, 12 bp, Homo sapiens
cctgaggccagt

SEQ ID NO: 1262142 - DNA, 13 bp, Homo sapiens
cctgaggccagtg

SEQ ID NO: 1262143 - DNA, 20 bp, Homo sapiens
cctgaggccagtggcccccg

SEQ ID NO: 1262144 - DNA, 15 bp, Homo sapiens
cctgaggccctgggc

SEQ ID NO: 1262145 - DNA, 13 bp, Homo sapiens
cctgaggcctaga

SEQ ID NO: 1262146 - DNA, 15 bp, Homo sapiens
cctgaggcggaggct

SEQ ID NO: 1262147 - DNA, 14 bp, Homo sapiens
cctgaggctgagac

SEQ ID NO: 1262148 - DNA, 16 bp, Homo sapiens
cctgaggctgtggtca

SEQ ID NO: 1262149 - DNA, 17 bp, Homo sapiens
cctgagggaggacctgg

SEQ ID NO: 1262150 - DNA, 22 bp, Homo sapiens
cctgagggaggacctggggcac

SEQ ID NO: 1262151 - DNA, 19 bp, Homo sapiens
cctgagggcccctctgccc

SEQ ID NO: 1262152 - DNA, 20 bp, Homo sapiens
cctgagggcccctctgccca

SEQ ID NO: 1262153 - DNA, 22 bp, Homo sapiens
cctgagggcccctctgcccagc

SEQ ID NO: 1262154 - DNA, 23 bp, Homo sapiens
cctgagggcccctctgcccagct

SEQ ID NO: 1262155 - DNA, 20 bp, Homo sapiens
cctgagggctaattctggga

SEQ ID NO: 1262156 - DNA, 17 bp, Homo sapiens
cctgaggggctgggctg

SEQ ID NO: 1262157 - DNA, 17 bp, Homo sapiens
cctgaggggctggggag

SEQ ID NO: 1262158 - DNA, 21 bp, Homo sapiens
cctgaggggctggggaggggg

SEQ ID NO: 1262159 - DNA, 15 bp, Homo sapiens
cctgagggtggagac

SEQ ID NO: 1262160 - DNA, 16 bp, Homo sapiens
cctgagggtggagact

SEQ ID NO: 1262161 - DNA, 16 bp, Homo sapiens
cctgagggttttctca

SEQ ID NO: 1262162 - DNA, 15 bp, Homo sapiens
cctgaggtcccctcg

SEQ ID NO: 1262163 - DNA, 22 bp, Homo sapiens
cctgaggtgggagaatcactta

SEQ ID NO: 1262164 - DNA, 15 bp, Homo sapiens
cctgaggtgggccca

SEQ ID NO: 1262165 - DNA, 16 bp, Homo sapiens
cctgaggtgggcccag

SEQ ID NO: 1262166 - DNA, 23 bp, Homo sapiens
cctgaggtgggcccaggaccagc

SEQ ID NO: 1262167 - DNA, 16 bp, Homo sapiens
cctgaggtgggctggg

SEQ ID NO: 1262168 - DNA, 15 bp, Homo sapiens
cctgaggtgtggggg

SEQ ID NO: 1262169 - DNA, 17 bp, Homo sapiens
cctgaggtgtgggggct

SEQ ID NO: 1262170 - DNA, 21 bp, Homo sapiens
cctgaggtgtgggggctgcag

SEQ ID NO: 1262171 - DNA, 23 bp, Homo sapiens
cctgaggtgtgggggctgcagca

SEQ ID NO: 1262172 - DNA, 20 bp, Homo sapiens
cctgagtaatcgcttaaaga

SEQ ID NO: 1262173 - DNA, 15 bp, Homo sapiens
cctgagtagctggat

SEQ ID NO: 1262174 - DNA, 20 bp, Homo sapiens
cctgagtagctggattacag

SEQ ID NO: 1262175 - DNA, 17 bp, Homo sapiens
cctgagtagctgggcct

SEQ ID NO: 1262176 - DNA, 22 bp, Homo sapiens
cctgagtagctgggcctgtgca

SEQ ID NO: 1262177 - DNA, 18 bp, Homo sapiens
cctgagtcacccatgaag

SEQ ID NO: 1262178 - DNA, 23 bp, Homo sapiens
cctgagtcaccctacctgtgcct

SEQ ID NO: 1262179 - DNA, 14 bp, Homo sapiens
cctgagtcagtgct

SEQ ID NO: 1262180 - DNA, 18 bp, Homo sapiens
cctgagtctcctgtgccc

SEQ ID NO: 1262181 - DNA, 17 bp, Homo sapiens
cctgagtgagtgtgtgt

SEQ ID NO: 1262182 - DNA, 20 bp, Homo sapiens
cctgagtgagtgtgtgtgct

SEQ ID NO: 1262183 - DNA, 22 bp, Homo sapiens
cctgagtgagtgtgtgtgcttg

SEQ ID NO: 1262184 - DNA, 20 bp, Homo sapiens
cctgagtggatctccaagga

SEQ ID NO: 1262185 - DNA, 23 bp, Homo sapiens
cctgagtggatctccaaggacca

SEQ ID NO: 1262186 - DNA, 20 bp, Homo sapiens
cctgagtggtcactggtcag

SEQ ID NO: 1262187 - DNA, 23 bp, Homo sapiens
cctgagtggtcactggtcagggc

SEQ ID NO: 1262188 - DNA, 14 bp, Homo sapiens
cctgagtggtgcca

SEQ ID NO: 1262189 - DNA, 16 bp, Homo sapiens
cctgagtggtgccaaa

SEQ ID NO: 1262190 - DNA, 14 bp, Homo sapiens
cctgagttcatcca

SEQ ID NO: 1262191 - DNA, 20 bp, Homo sapiens
cctgagttgcttttcagctg

SEQ ID NO: 1262192 - DNA, 16 bp, Homo sapiens
cctgagttggagctca

SEQ ID NO: 1262193 - DNA, 22 bp, Homo sapiens
cctgataaacattaaacactgt

SEQ ID NO: 1262194 - DNA, 18 bp, Homo sapiens
cctgataaagcacagctg

SEQ ID NO: 1262195 - DNA, 19 bp, Homo sapiens
cctgataagcttcaaagct

SEQ ID NO: 1262196 - DNA, 16 bp, Homo sapiens
cctgatactttagcca

SEQ ID NO: 1262197 - DNA, 20 bp, Homo sapiens
cctgatcaagtcaccggagc

SEQ ID NO: 1262198 - DNA, 14 bp, Homo sapiens
cctgatcagaccac

SEQ ID NO: 1262199 - DNA, 13 bp, Homo sapiens
cctgatccctcca

SEQ ID NO: 1262200 - DNA, 14 bp, Homo sapiens
cctgatccctccac

SEQ ID NO: 1262201 - DNA, 21 bp, Homo sapiens
cctgatccgtccgaggctgct

SEQ ID NO: 1262202 - DNA, 17 bp, Homo sapiens
cctgatctctcagcccc

SEQ ID NO: 1262203 - DNA, 12 bp, Homo sapiens
cctgatctctga

SEQ ID NO: 1262204 - DNA, 13 bp, Homo sapiens
cctgatctctgac

SEQ ID NO: 1262205 - DNA, 22 bp, Homo sapiens
cctgatctctgacctctgctga

SEQ ID NO: 1262206 - DNA, 20 bp, Homo sapiens
cctgatctcttcctgttttg

SEQ ID NO: 1262207 - DNA, 17 bp, Homo sapiens
cctgatgagactccact

SEQ ID NO: 1262208 - DNA, 19 bp, Homo sapiens
cctgatgagactccactca

SEQ ID NO: 1262209 - DNA, 16 bp, Homo sapiens
cctgatgcccaggtca

SEQ ID NO: 1262210 - DNA, 17 bp, Homo sapiens
cctgatgcccaggtcac

SEQ ID NO: 1262211 - DNA, 15 bp, Homo sapiens
cctgatgccccttcc

SEQ ID NO: 1262212 - DNA, 16 bp, Homo sapiens
cctgatgccccttccc

SEQ ID NO: 1262213 - DNA, 22 bp, Homo sapiens
cctgatgccttttggaccttgg

SEQ ID NO: 1262214 - DNA, 16 bp, Homo sapiens
cctgatgctccctccc

SEQ ID NO: 1262215 - DNA, 20 bp, Homo sapiens
cctgatgctccctcccctgc

SEQ ID NO: 1262216 - DNA, 19 bp, Homo sapiens
cctgatgcttttgtctaat

SEQ ID NO: 1262217 - DNA, 14 bp, Homo sapiens
cctgatggaccctc

SEQ ID NO: 1262218 - DNA, 17 bp, Homo sapiens
cctgatggacctgcccc

SEQ ID NO: 1262219 - DNA, 18 bp, Homo sapiens
cctgatggacctgccccg

SEQ ID NO: 1262220 - DNA, 20 bp, Homo sapiens
cctgatggagtgtgcagaca

SEQ ID NO: 1262221 - DNA, 23 bp, Homo sapiens
cctgatggagtgtgcagacagcc

SEQ ID NO: 1262222 - DNA, 21 bp, Homo sapiens
cctgatggccaagggggtgga

SEQ ID NO: 1262223 - DNA, 13 bp, Homo sapiens
cctgatggcccaa

SEQ ID NO: 1262224 - DNA, 18 bp, Homo sapiens
cctgatggtacaggaaag

SEQ ID NO: 1262225 - DNA, 20 bp, Homo sapiens
cctgcccccttctcccacac

SEQ ID NO: 1262226 - DNA, 14 bp, Homo sapiens
cctgccccgccccc

SEQ ID NO: 1262227 - DNA, 18 bp, Homo sapiens
cctgccccgcccccagtc

SEQ ID NO: 1262228 - DNA, 19 bp, Homo sapiens
cctgccccgccccccagag

SEQ ID NO: 1262229 - DNA, 21 bp, Homo sapiens
cctgccccgccccccagagcc

SEQ ID NO: 1262230 - DNA, 13 bp, Homo sapiens
cctgccccgcctt

SEQ ID NO: 1262231 - DNA, 22 bp, Homo sapiens
cctgccccggacctacctccct

SEQ ID NO: 1262232 - DNA, 23 bp, Homo sapiens
cctgccccggacctacctccctc

SEQ ID NO: 1262233 - DNA, 23 bp, Homo sapiens
cctgccccgtcggactgccccca

SEQ ID NO: 1262234 - DNA, 24 bp, Homo sapiens
cctgcccctaggatgctgcagcag

SEQ ID NO: 1262235 - DNA, 15 bp, Homo sapiens
cctgcccctcccttc

SEQ ID NO: 1262236 - DNA, 15 bp, Homo sapiens
cctgcccctctcccg

SEQ ID NO: 1262237 - DNA, 14 bp, Homo sapiens
cctgcccctctgtt

SEQ ID NO: 1262238 - DNA, 23 bp, Homo sapiens
cctgcccctctgttctctcccct

SEQ ID NO: 1262239 - DNA, 15 bp, Homo sapiens
cctgcccctctttct

SEQ ID NO: 1262240 - DNA, 19 bp, Homo sapiens
cctgcccctctttctcttt

SEQ ID NO: 1262241 - DNA, 11 bp, Homo sapiens
cctgcccctgc

SEQ ID NO: 1262242 - DNA, 15 bp, Homo sapiens
cctgcccctgctgct

SEQ ID NO: 1262243 - DNA, 21 bp, Homo sapiens
cctgcccctggtgccctgaga

SEQ ID NO: 1262244 - DNA, 13 bp, Homo sapiens
cctgcccctgtcc

SEQ ID NO: 1262245 - DNA, 13 bp, Homo sapiens
cctgcccgctccc

SEQ ID NO: 1262246 - DNA, 14 bp, Homo sapiens
cctgcccgctccca

SEQ ID NO: 1262247 - DNA, 15 bp, Homo sapiens
cctgcccgctcccaa

SEQ ID NO: 1262248 - DNA, 15 bp, Homo sapiens
cctgcccggggagct

SEQ ID NO: 1262249 - DNA, 19 bp, Homo sapiens
cctgcccggggagctgcag

SEQ ID NO: 1262250 - DNA, 20 bp, Homo sapiens
cctgcccggggagctgcaga

SEQ ID NO: 1262251 - DNA, 23 bp, Homo sapiens
cctgcccggtggtttgccatgtc

SEQ ID NO: 1262252 - DNA, 20 bp, Homo sapiens
cctgccctacagaggtctct

SEQ ID NO: 1262253 - DNA, 18 bp, Homo sapiens
cctgccctagagcacact

SEQ ID NO: 1262254 - DNA, 24 bp, Homo sapiens
cctgccctagagcacactgtagca

SEQ ID NO: 1262255 - DNA, 14 bp, Homo sapiens
cctgccctcaaggg

SEQ ID NO: 1262256 - DNA, 13 bp, Homo sapiens
cctgccctcatgg

SEQ ID NO: 1262257 - DNA, 14 bp, Homo sapiens
cctgccctcccatg

SEQ ID NO: 1262258 - DNA, 13 bp, Homo sapiens
cctgccctcccct

SEQ ID NO: 1262259 - DNA, 15 bp, Homo sapiens
cctgccctccggagg

SEQ ID NO: 1262260 - DNA, 20 bp, Homo sapiens
cctgccctccggaggagcag

SEQ ID NO: 1262261 - DNA, 22 bp, Homo sapiens
cctgccctccggaggagcagcc

SEQ ID NO: 1262262 - DNA, 22 bp, Homo sapiens
cctgccctcgtctccctggcca

SEQ ID NO: 1262263 - DNA, 15 bp, Homo sapiens
cctgccctcgtggcc

SEQ ID NO: 1262264 - DNA, 16 bp, Homo sapiens
cctgccctcgtggcca

SEQ ID NO: 1262265 - DNA, 18 bp, Homo sapiens
cctgccctcgtggccagc

SEQ ID NO: 1262266 - DNA, 21 bp, Homo sapiens
cctgccctctgctctgcctgg

SEQ ID NO: 1262267 - DNA, 16 bp, Homo sapiens
cctgccctgcccaagt

SEQ ID NO: 1262268 - DNA, 14 bp, Homo sapiens
cctgccctgcccag

SEQ ID NO: 1262269 - DNA, 16 bp, Homo sapiens
cctgccctgcctgggc

SEQ ID NO: 1262270 - DNA, 13 bp, Homo sapiens
cctgccctgcctt

SEQ ID NO: 1262271 - DNA, 17 bp, Homo sapiens
cctgccctgccttgccg

SEQ ID NO: 1262272 - DNA, 18 bp, Homo sapiens
cctgccctgctcctaagg

SEQ ID NO: 1262273 - DNA, 12 bp, Homo sapiens
cctgccctggag

SEQ ID NO: 1262274 - DNA, 13 bp, Homo sapiens
cctgccctgggga

SEQ ID NO: 1262275 - DNA, 14 bp, Homo sapiens
cctgccctggggag

SEQ ID NO: 1262276 - DNA, 15 bp, Homo sapiens
cctgccctggggaga

SEQ ID NO: 1262277 - DNA, 16 bp, Homo sapiens
cctgccctggggagaa

SEQ ID NO: 1262278 - DNA, 15 bp, Homo sapiens
cctgccctgtccctg

SEQ ID NO: 1262279 - DNA, 21 bp, Homo sapiens
cctgccctgtccctgtccccc

SEQ ID NO: 1262280 - DNA, 15 bp, Homo sapiens
cctgcccttcctcag

SEQ ID NO: 1262281 - DNA, 15 bp, Homo sapiens
cctgcccttgaaccc

SEQ ID NO: 1262282 - DNA, 23 bp, Homo sapiens
cctgcccttgaaccccctccctg

SEQ ID NO: 1262283 - DNA, 15 bp, Homo sapiens
cctgcccttggcacc

SEQ ID NO: 1262284 - DNA, 17 bp, Homo sapiens
cctgcccttggcaccac

SEQ ID NO: 1262285 - DNA, 14 bp, Homo sapiens
cctgccgcctcaat

SEQ ID NO: 1262286 - DNA, 16 bp, Homo sapiens
cctgccgggctgaggg

SEQ ID NO: 1262287 - DNA, 20 bp, Homo sapiens
cctgccgggctgagggcctg

SEQ ID NO: 1262288 - DNA, 22 bp, Homo sapiens
cctgccggtgggaccctgtccg

SEQ ID NO: 1262289 - DNA, 16 bp, Homo sapiens
cctgccgtcaccacca

SEQ ID NO: 1262290 - DNA, 18 bp, Homo sapiens
cctgccgtcaccaccacc

SEQ ID NO: 1262291 - DNA, 16 bp, Homo sapiens
cctgccgtgcatggct

SEQ ID NO: 1262292 - DNA, 20 bp, Homo sapiens
cctgcctaagggagagtggt

SEQ ID NO: 1262293 - DNA, 20 bp, Homo sapiens
cctgcctacacacacagcct

SEQ ID NO: 1262294 - DNA, 15 bp, Homo sapiens
cctgcctcagccagg

SEQ ID NO: 1262295 - DNA, 19 bp, Homo sapiens
cctgcctcagccttctgag

SEQ ID NO: 1262296 - DNA, 20 bp, Homo sapiens
cctgcctcagccttctgagt

SEQ ID NO: 1262297 - DNA, 14 bp, Homo sapiens
cctgcctcagctac

SEQ ID NO: 1262298 - DNA, 15 bp, Homo sapiens
cctgcctccaggaac

SEQ ID NO: 1262299 - DNA, 16 bp, Homo sapiens
cctgcctcccatgcct

SEQ ID NO: 1262300 - DNA, 18 bp, Homo sapiens
cctgcctcccatgcctgg

SEQ ID NO: 1262301 - DNA, 18 bp, Homo sapiens
cctgcctcccattctgca

SEQ ID NO: 1262302 - DNA, 15 bp, Homo sapiens
cctgcctccctttct

SEQ ID NO: 1262303 - DNA, 11 bp, Homo sapiens
cctgcctccta

SEQ ID NO: 1262304 - DNA, 13 bp, Homo sapiens
cctgcctcctcat

SEQ ID NO: 1262305 - DNA, 16 bp, Homo sapiens
cctgcctcctcatcag

SEQ ID NO: 1262306 - DNA, 18 bp, Homo sapiens
cctgcctcctgccacccc

SEQ ID NO: 1262307 - DNA, 21 bp, Homo sapiens
cctgcctcctggaggaccaga

SEQ ID NO: 1262308 - DNA, 13 bp, Homo sapiens
cctgcctctgtgt

SEQ ID NO: 1262309 - DNA, 21 bp, Homo sapiens
cctgcctctgtgtagccgccc

SEQ ID NO: 1262310 - DNA, 22 bp, Homo sapiens
cctgcctctgtgtagccgccct

SEQ ID NO: 1262311 - DNA, 17 bp, Homo sapiens
cctgcctcttgtttctg

SEQ ID NO: 1262312 - DNA, 16 bp, Homo sapiens
cctgcctgacccatcc

SEQ ID NO: 1262313 - DNA, 18 bp, Homo sapiens
cctgcctgagcccaggag

SEQ ID NO: 1262314 - DNA, 19 bp, Homo sapiens
cctgcctgagcccaggagc

SEQ ID NO: 1262315 - DNA, 21 bp, Homo sapiens
cctgcctgagcccaggagctg

SEQ ID NO: 1262316 - DNA, 12 bp, Homo sapiens
cctgcctgagga

SEQ ID NO: 1262317 - DNA, 13 bp, Homo sapiens
cctgcctgaggag

SEQ ID NO: 1262318 - DNA, 15 bp, Homo sapiens
cctgcctgaggagga

SEQ ID NO: 1262319 - DNA, 16 bp, Homo sapiens
cctgcctgagggcagt

SEQ ID NO: 1262320 - DNA, 19 bp, Homo sapiens
cctgcctgagggcccctct

SEQ ID NO: 1262321 - DNA, 20 bp, Homo sapiens
cctgcctgagtttccagcct

SEQ ID NO: 1262322 - DNA, 15 bp, Homo sapiens
cctgcctgcacctcc

SEQ ID NO: 1262323 - DNA, 14 bp, Homo sapiens
cctgcctgccaccc

SEQ ID NO: 1262324 - DNA, 12 bp, Homo sapiens
cctgcctgccat

SEQ ID NO: 1262325 - DNA, 14 bp, Homo sapiens
cctgcctgcctcca

SEQ ID NO: 1262326 - DNA, 13 bp, Homo sapiens
cctgcctgcctct

SEQ ID NO: 1262327 - DNA, 12 bp, Homo sapiens
cctgcctgctcc

SEQ ID NO: 1262328 - DNA, 12 bp, Homo sapiens
cctgcctggcca

SEQ ID NO: 1262329 - DNA, 18 bp, Homo sapiens
cctgcctggccaggcaga

SEQ ID NO: 1262330 - DNA, 15 bp, Homo sapiens
cctgcctggcccctc

SEQ ID NO: 1262331 - DNA, 14 bp, Homo sapiens
cctgcctgggcctt

SEQ ID NO: 1262332 - DNA, 22 bp, Homo sapiens
cctgcctggggtggcctggccc

SEQ ID NO: 1262333 - DNA, 14 bp, Homo sapiens
cctgcctgtctgcc

SEQ ID NO: 1262334 - DNA, 16 bp, Homo sapiens
cctgcctgtctgcccc

SEQ ID NO: 1262335 - DNA, 13 bp, Homo sapiens
cctgcctgtctgt

SEQ ID NO: 1262336 - DNA, 17 bp, Homo sapiens
cctgcctgtctgtctct

SEQ ID NO: 1262337 - DNA, 13 bp, Homo sapiens
cctgcctgtgcat

SEQ ID NO: 1262338 - DNA, 23 bp, Homo sapiens
cctgcctgtgcccgcatgtgtgc

SEQ ID NO: 1262339 - DNA, 12 bp, Homo sapiens
cctgcctgtgct

SEQ ID NO: 1262340 - DNA, 23 bp, Homo sapiens
cctgcctgtggcgccgtctccag

SEQ ID NO: 1262341 - DNA, 20 bp, Homo sapiens
cctgcctgttggcaggccca

SEQ ID NO: 1262342 - DNA, 21 bp, Homo sapiens
cctgcctgttggcaggcccac

SEQ ID NO: 1262343 - DNA, 16 bp, Homo sapiens
cctgccttagcaatgg

SEQ ID NO: 1262344 - DNA, 12 bp, Homo sapiens
cctgccttcctc

SEQ ID NO: 1262345 - DNA, 16 bp, Homo sapiens
cctgccttcctcctgg

SEQ ID NO: 1262346 - DNA, 16 bp, Homo sapiens
cctgccttgaagccac

SEQ ID NO: 1262347 - DNA, 19 bp, Homo sapiens
cctgccttgaagccactga

SEQ ID NO: 1262348 - DNA, 23 bp, Homo sapiens
cctggacccctggggtggccagg

SEQ ID NO: 1262349 - DNA, 17 bp, Homo sapiens
cctggaccgagatgtga

SEQ ID NO: 1262350 - DNA, 18 bp, Homo sapiens
cctggaccgagatgtgag

SEQ ID NO: 1262351 - DNA, 15 bp, Homo sapiens
cctggacctatgcag

SEQ ID NO: 1262352 - DNA, 13 bp, Homo sapiens
cctggacctgagt

SEQ ID NO: 1262353 - DNA, 21 bp, Homo sapiens
cctggacctgccctgggccac

SEQ ID NO: 1262354 - DNA, 13 bp, Homo sapiens
cctggacctgcct

SEQ ID NO: 1262355 - DNA, 18 bp, Homo sapiens
cctggaccttgacagagc

SEQ ID NO: 1262356 - DNA, 19 bp, Homo sapiens
cctggaccttgacagagca

SEQ ID NO: 1262357 - DNA, 23 bp, Homo sapiens
cctggaccttgacagagcagcta

SEQ ID NO: 1262358 - DNA, 19 bp, Homo sapiens
cctggaccttttgttttct

SEQ ID NO: 1262359 - DNA, 14 bp, Homo sapiens
cctggacgggccct

SEQ ID NO: 1262360 - DNA, 19 bp, Homo sapiens
cctggacgggccctccttc

SEQ ID NO: 1262361 - DNA, 22 bp, Homo sapiens
cctggacgggccctccttccct

SEQ ID NO: 1262362 - DNA, 23 bp, Homo sapiens
cctggactaaaggcatccttgtc

SEQ ID NO: 1262363 - DNA, 22 bp, Homo sapiens
cctggactagagggacctctcc

SEQ ID NO: 1262364 - DNA, 21 bp, Homo sapiens
cctggactctaagctggagct

SEQ ID NO: 1262365 - DNA, 12 bp, Homo sapiens
cctggactctgc

SEQ ID NO: 1262366 - DNA, 15 bp, Homo sapiens
cctggactctgcccc

SEQ ID NO: 1262367 - DNA, 21 bp, Homo sapiens
cctggactgagccaaggaggc

SEQ ID NO: 1262368 - DNA, 13 bp, Homo sapiens
cctggactgggag

SEQ ID NO: 1262369 - DNA, 14 bp, Homo sapiens
cctggactttcctg

SEQ ID NO: 1262370 - DNA, 13 bp, Homo sapiens
cctggagaactag

SEQ ID NO: 1262371 - DNA, 11 bp, Homo sapiens
cctggagaagc

SEQ ID NO: 1262372 - DNA, 16 bp, Homo sapiens
cctggagacaaggtgc

SEQ ID NO: 1262373 - DNA, 21 bp, Homo sapiens
cctggagaccacactgcacac

SEQ ID NO: 1262374 - DNA, 13 bp, Homo sapiens
cctggagaggcct

SEQ ID NO: 1262375 - DNA, 14 bp, Homo sapiens
cctggagaggcctg

SEQ ID NO: 1262376 - DNA, 17 bp, Homo sapiens
cctggagaggcctgggg

SEQ ID NO: 1262377 - DNA, 16 bp, Homo sapiens
cctggagatagctggg

SEQ ID NO: 1262378 - DNA, 18 bp, Homo sapiens
cctggagatagctggggc

SEQ ID NO: 1262379 - DNA, 19 bp, Homo sapiens
cctggagatagctggggct

SEQ ID NO: 1262380 - DNA, 20 bp, Homo sapiens
cctggagatagctggggctt

SEQ ID NO: 1262381 - DNA, 15 bp, Homo sapiens
cctggagatcctcct

SEQ ID NO: 1262382 - DNA, 21 bp, Homo sapiens
cctggagatcctcctgcagac

SEQ ID NO: 1262383 - DNA, 22 bp, Homo sapiens
cctggagccagactctggtctt

SEQ ID NO: 1262384 - DNA, 12 bp, Homo sapiens
cctggagccagg

SEQ ID NO: 1262385 - DNA, 13 bp, Homo sapiens
cctggagccaggg

SEQ ID NO: 1262386 - DNA, 15 bp, Homo sapiens
cctggagccagggca

SEQ ID NO: 1262387 - DNA, 21 bp, Homo sapiens
cctggagccagggcagaggaa

SEQ ID NO: 1262388 - DNA, 22 bp, Homo sapiens
cctggagccccatcggccaaga

SEQ ID NO: 1262389 - DNA, 13 bp, Homo sapiens
cctggagcccctg

SEQ ID NO: 1262390 - DNA, 11 bp, Homo sapiens
cctggagccct

SEQ ID NO: 1262391 - DNA, 13 bp, Homo sapiens
cctggagccctgg

SEQ ID NO: 1262392 - DNA, 15 bp, Homo sapiens
cctggagccctgggc

SEQ ID NO: 1262393 - DNA, 22 bp, Homo sapiens
cctggagccctgttggcagctc

SEQ ID NO: 1262394 - DNA, 18 bp, Homo sapiens
cctggagcgtttgctgtg

SEQ ID NO: 1262395 - DNA, 18 bp, Homo sapiens
cctggaggaattcagctc

SEQ ID NO: 1262396 - DNA, 22 bp, Homo sapiens
cctggaggaattcagctcagct

SEQ ID NO: 1262397 - DNA, 14 bp, Homo sapiens
cctggaggacagag

SEQ ID NO: 1262398 - DNA, 23 bp, Homo sapiens
cctggaggacagagggagacagg

SEQ ID NO: 1262399 - DNA, 15 bp, Homo sapiens
cctggaggcaagagg

SEQ ID NO: 1262400 - DNA, 18 bp, Homo sapiens
cctggaggcaagagggag

SEQ ID NO: 1262401 - DNA, 14 bp, Homo sapiens
cctggaggcagggg

SEQ ID NO: 1262402 - DNA, 15 bp, Homo sapiens
cctggaggcaggggc

SEQ ID NO: 1262403 - DNA, 23 bp, Homo sapiens
cctggaggccccaaccctgtcct

SEQ ID NO: 1262404 - DNA, 18 bp, Homo sapiens
cctggaggctgacacaga

SEQ ID NO: 1262405 - DNA, 14 bp, Homo sapiens
cctggagggaagag

SEQ ID NO: 1262406 - DNA, 22 bp, Homo sapiens
cctggagggacttttaatcagt

SEQ ID NO: 1262407 - DNA, 13 bp, Homo sapiens
cctggagggaggc

SEQ ID NO: 1262408 - DNA, 14 bp, Homo sapiens
cctggagggaggct

SEQ ID NO: 1262409 - DNA, 14 bp, Homo sapiens
cctggagggatgcc

SEQ ID NO: 1262410 - DNA, 17 bp, Homo sapiens
cctggagggatgccccc

SEQ ID NO: 1262411 - DNA, 18 bp, Homo sapiens
cctggagggatgccccca

SEQ ID NO: 1262412 - DNA, 22 bp, Homo sapiens
cctggagggatgcccccaggca

SEQ ID NO: 1262413 - DNA, 12 bp, Homo sapiens
cctggagggcac

SEQ ID NO: 1262414 - DNA, 22 bp, Homo sapiens
cctggagggcacttcctccaca

SEQ ID NO: 1262415 - DNA, 19 bp, Homo sapiens
cctggagggtaactggggg

SEQ ID NO: 1262416 - DNA, 23 bp, Homo sapiens
cctggagggtaactggggggcca

SEQ ID NO: 1262417 - DNA, 21 bp, Homo sapiens
cctggaggtggctgagcccct

SEQ ID NO: 1262418 - DNA, 22 bp, Homo sapiens
cctggaggtggctgagcccctg

SEQ ID NO: 1262419 - DNA, 20 bp, Homo sapiens
cctggagtcactgcagaggg

SEQ ID NO: 1262420 - DNA, 21 bp, Homo sapiens
cctggagtcactgcagaggga

SEQ ID NO: 1262421 - DNA, 14 bp, Homo sapiens
cctggagtgccctg

SEQ ID NO: 1262422 - DNA, 17 bp, Homo sapiens
cctggagtgccctgcag

SEQ ID NO: 1262423 - DNA, 21 bp, Homo sapiens
cctggagtgccctgcaggcac

SEQ ID NO: 1262424 - DNA, 17 bp, Homo sapiens
cctggagtgtgtcagag

SEQ ID NO: 1262425 - DNA, 22 bp, Homo sapiens
cctggagttgactgactgagca

SEQ ID NO: 1262426 - DNA, 20 bp, Homo sapiens
cctggagtttaatacagtga

SEQ ID NO: 1262427 - DNA, 22 bp, Homo sapiens
cctggatattattcttgtagtt

SEQ ID NO: 1262428 - DNA, 19 bp, Homo sapiens
cctggatcacgacgctgca

SEQ ID NO: 1262429 - DNA, 18 bp, Homo sapiens
cctggatccagcactggt

SEQ ID NO: 1262430 - DNA, 20 bp, Homo sapiens
cctggatcctcacactacag

SEQ ID NO: 1262431 - DNA, 16 bp, Homo sapiens
cctggatctaccagca

SEQ ID NO: 1262432 - DNA, 17 bp, Homo sapiens
cctggatctatccctgc

SEQ ID NO: 1262433 - DNA, 20 bp, Homo sapiens
cctggatgaggcacttctgt

SEQ ID NO: 1262434 - DNA, 15 bp, Homo sapiens
cctggatggcccctc

SEQ ID NO: 1262435 - DNA, 16 bp, Homo sapiens
cctggatggcccctcc

SEQ ID NO: 1262436 - DNA, 17 bp, Homo sapiens
cctggatgggcattggg

SEQ ID NO: 1262437 - DNA, 15 bp, Homo sapiens
cctggatgtcccctg

SEQ ID NO: 1262438 - DNA, 21 bp, Homo sapiens
cctggatgtcccctgtcccac

SEQ ID NO: 1262439 - DNA, 23 bp, Homo sapiens
cctggatgtcccctgtcccacca

SEQ ID NO: 1262440 - DNA, 18 bp, Homo sapiens
cctggatgtgaagctcac

SEQ ID NO: 1262441 - DNA, 20 bp, Homo sapiens
cctggatgtgaagctcacac

SEQ ID NO: 1262442 - DNA, 12 bp, Homo sapiens
cctggatgtttg

SEQ ID NO: 1262443 - DNA, 19 bp, Homo sapiens
cctggattcatttcctgcc

SEQ ID NO: 1262444 - DNA, 15 bp, Homo sapiens
cctggattccagcag

SEQ ID NO: 1262445 - DNA, 21 bp, Homo sapiens
cctggatttatagtatgtgac

SEQ ID NO: 1262446 - DNA, 23 bp, Homo sapiens
cctggattttttatgtacaaccc

SEQ ID NO: 1262447 - DNA, 23 bp, Homo sapiens
cctggcaagaaagcttgagtctc

SEQ ID NO: 1262448 - DNA, 19 bp, Homo sapiens
cctggcaatagtgtgttct

SEQ ID NO: 1262449 - DNA, 21 bp, Homo sapiens
cctggcaatagtgtgttctga

SEQ ID NO: 1262450 - DNA, 17 bp, Homo sapiens
cctggcacagaccaggc

SEQ ID NO: 1262451 - DNA, 19 bp, Homo sapiens
cctggcacagaccaggcct

SEQ ID NO: 1262452 - DNA, 17 bp, Homo sapiens
cctggcacagggcagtg

SEQ ID NO: 1262453 - DNA, 18 bp, Homo sapiens
cctggcacagggcagtgg

SEQ ID NO: 1262454 - DNA, 13 bp, Homo sapiens
cctggcacccacc

SEQ ID NO: 1262455 - DNA, 22 bp, Homo sapiens
cctggcactgggaggcagggct

SEQ ID NO: 1262456 - DNA, 12 bp, Homo sapiens
cctggcagacac

SEQ ID NO: 1262457 - DNA, 13 bp, Homo sapiens
cctggcagacaca

SEQ ID NO: 1262458 - DNA, 14 bp, Homo sapiens
cctggcagcacagc

SEQ ID NO: 1262459 - DNA, 16 bp, Homo sapiens
cctggcagcacagccc

SEQ ID NO: 1262460 - DNA, 17 bp, Homo sapiens
cctggcagcacagccca

SEQ ID NO: 1262461 - DNA, 14 bp, Homo sapiens
cctggcagcagcag

SEQ ID NO: 1262462 - DNA, 11 bp, Homo sapiens
cctggcagccc

SEQ ID NO: 1262463 - DNA, 13 bp, Homo sapiens
cctggcagctgcc

SEQ ID NO: 1262464 - DNA, 18 bp, Homo sapiens
cctggcagctgcccctcc

SEQ ID NO: 1262465 - DNA, 14 bp, Homo sapiens
cctggcagctgctg

SEQ ID NO: 1262466 - DNA, 23 bp, Homo sapiens
cctggcagctggaccatctctgt

SEQ ID NO: 1262467 - DNA, 17 bp, Homo sapiens
cctggcaggatgaccct

SEQ ID NO: 1262468 - DNA, 17 bp, Homo sapiens
cctggcagggctcacac

SEQ ID NO: 1262469 - DNA, 19 bp, Homo sapiens
cctggcagggctcacactc

SEQ ID NO: 1262470 - DNA, 13 bp, Homo sapiens
cctgggctgatgg

SEQ ID NO: 1262471 - DNA, 12 bp, Homo sapiens
cctgggctgcca

SEQ ID NO: 1262472 - DNA, 15 bp, Homo sapiens
cctgggctgggcagc

SEQ ID NO: 1262473 - DNA, 21 bp, Homo sapiens
cctgggctgggcagccttggg

SEQ ID NO: 1262474 - DNA, 14 bp, Homo sapiens
cctgggctgggcgc

SEQ ID NO: 1262475 - DNA, 14 bp, Homo sapiens
cctgggctggggag

SEQ ID NO: 1262476 - DNA, 17 bp, Homo sapiens
cctgggctggggaggag

SEQ ID NO: 1262477 - DNA, 20 bp, Homo sapiens
cctgggctggggaggaggag

SEQ ID NO: 1262478 - DNA, 14 bp, Homo sapiens
cctgggctgggtgg

SEQ ID NO: 1262479 - DNA, 13 bp, Homo sapiens
cctgggctgtcca

SEQ ID NO: 1262480 - DNA, 14 bp, Homo sapiens
cctgggctgtccag

SEQ ID NO: 1262481 - DNA, 17 bp, Homo sapiens
cctgggctgtctgtcac

SEQ ID NO: 1262482 - DNA, 13 bp, Homo sapiens
cctgggctgtgct

SEQ ID NO: 1262483 - DNA, 14 bp, Homo sapiens
cctgggctgttggc

SEQ ID NO: 1262484 - DNA, 22 bp, Homo sapiens
cctgggctgttggcactcacag

SEQ ID NO: 1262485 - DNA, 12 bp, Homo sapiens
cctgggcttggc

SEQ ID NO: 1262486 - DNA, 13 bp, Homo sapiens
cctgggcttggcc

SEQ ID NO: 1262487 - DNA, 15 bp, Homo sapiens
cctgggcttggcctg

SEQ ID NO: 1262488 - DNA, 17 bp, Homo sapiens
cctgggcttggcctgct

SEQ ID NO: 1262489 - DNA, 18 bp, Homo sapiens
cctgggcttggctcttgg

SEQ ID NO: 1262490 - DNA, 19 bp, Homo sapiens
cctgggcttggctcttggc

SEQ ID NO: 1262491 - DNA, 20 bp, Homo sapiens
cctgggcttggctcttggct

SEQ ID NO: 1262492 - DNA, 12 bp, Homo sapiens
cctgggctttca

SEQ ID NO: 1262493 - DNA, 13 bp, Homo sapiens
cctggggaaggag

SEQ ID NO: 1262494 - DNA, 12 bp, Homo sapiens
cctggggacaga

SEQ ID NO: 1262495 - DNA, 20 bp, Homo sapiens
cctggggacagagccacccc

SEQ ID NO: 1262496 - DNA, 19 bp, Homo sapiens
cctggggagaaagaggggc

SEQ ID NO: 1262497 - DNA, 19 bp, Homo sapiens
cctggggagccctcaggct

SEQ ID NO: 1262498 - DNA, 23 bp, Homo sapiens
cctggggagccctcaggctcccc

SEQ ID NO: 1262499 - DNA, 19 bp, Homo sapiens
cctggggagtgggacagag

SEQ ID NO: 1262500 - DNA, 21 bp, Homo sapiens
cctggggatcttcccacagga

SEQ ID NO: 1262501 - DNA, 19 bp, Homo sapiens
cctggggatgtaaccaagc

SEQ ID NO: 1262502 - DNA, 14 bp, Homo sapiens
cctggggcacagtc

SEQ ID NO: 1262503 - DNA, 15 bp, Homo sapiens
cctggggcagcactc

SEQ ID NO: 1262504 - DNA, 16 bp, Homo sapiens
cctggggcagcactcc

SEQ ID NO: 1262505 - DNA, 23 bp, Homo sapiens
cctggggcccaagttgcagtgag

SEQ ID NO: 1262506 - DNA, 19 bp, Homo sapiens
cctggggcccagcccctgt

SEQ ID NO: 1262507 - DNA, 19 bp, Homo sapiens
cctggggccgcctgccctg

SEQ ID NO: 1262508 - DNA, 23 bp, Homo sapiens
cctggggccgcctgccctgcctt

SEQ ID NO: 1262509 - DNA, 12 bp, Homo sapiens
cctggggcctcg

SEQ ID NO: 1262510 - DNA, 13 bp, Homo sapiens
cctggggcctctt

SEQ ID NO: 1262511 - DNA, 17 bp, Homo sapiens
cctggggcggtgtgtgt

SEQ ID NO: 1262512 - DNA, 13 bp, Homo sapiens
cctggggctccct

SEQ ID NO: 1262513 - DNA, 15 bp, Homo sapiens
cctggggctccctct

SEQ ID NO: 1262514 - DNA, 20 bp, Homo sapiens
cctggggctccctctctggt

SEQ ID NO: 1262515 - DNA, 20 bp, Homo sapiens
cctggggctcctttctccag

SEQ ID NO: 1262516 - DNA, 21 bp, Homo sapiens
cctggggctcctttctccagc

SEQ ID NO: 1262517 - DNA, 14 bp, Homo sapiens
cctggggctctctg

SEQ ID NO: 1262518 - DNA, 15 bp, Homo sapiens
cctggggctctctga

SEQ ID NO: 1262519 - DNA, 14 bp, Homo sapiens
cctggggctgctta

SEQ ID NO: 1262520 - DNA, 18 bp, Homo sapiens
cctggggcttctcctgac

SEQ ID NO: 1262521 - DNA, 21 bp, Homo sapiens
cctggggcttctcctgaccca

SEQ ID NO: 1262522 - DNA, 20 bp, Homo sapiens
cctgggggacccctggctct

SEQ ID NO: 1262523 - DNA, 13 bp, Homo sapiens
cctgggggagaga

SEQ ID NO: 1262524 - DNA, 19 bp, Homo sapiens
cctgggggagttttcctct

SEQ ID NO: 1262525 - DNA, 23 bp, Homo sapiens
cctgggggattcctgagctggcc

SEQ ID NO: 1262526 - DNA, 14 bp, Homo sapiens
cctgggggcagtga

SEQ ID NO: 1262527 - DNA, 18 bp, Homo sapiens
cctgggggcagtgactgg

SEQ ID NO: 1262528 - DNA, 23 bp, Homo sapiens
cctgggggcagtgactggcaggt

SEQ ID NO: 1262529 - DNA, 12 bp, Homo sapiens
cctgggggctct

SEQ ID NO: 1262530 - DNA, 13 bp, Homo sapiens
cctgggggctctc

SEQ ID NO: 1262531 - DNA, 16 bp, Homo sapiens
cctgggggctggctcc

SEQ ID NO: 1262532 - DNA, 22 bp, Homo sapiens
cctgggggctggctcccagggt

SEQ ID NO: 1262533 - DNA, 23 bp, Homo sapiens
cctgggggctggctcccagggtg

SEQ ID NO: 1262534 - DNA, 17 bp, Homo sapiens
cctggggggagggacag

SEQ ID NO: 1262535 - DNA, 22 bp, Homo sapiens
cctggggggagggacagggcag

SEQ ID NO: 1262536 - DNA, 14 bp, Homo sapiens
cctgggggtgccag

SEQ ID NO: 1262537 - DNA, 15 bp, Homo sapiens
cctgggggtgccagg

SEQ ID NO: 1262538 - DNA, 17 bp, Homo sapiens
cctgggggtggcaggca

SEQ ID NO: 1262539 - DNA, 12 bp, Homo sapiens
cctgggggtggg

SEQ ID NO: 1262540 - DNA, 22 bp, Homo sapiens
cctgggggttctttcttcctct

SEQ ID NO: 1262541 - DNA, 21 bp, Homo sapiens
cctgggggtttcacctgggcc

SEQ ID NO: 1262542 - DNA, 21 bp, Homo sapiens
cctggggtataaaactttcct

SEQ ID NO: 1262543 - DNA, 22 bp, Homo sapiens
cctggggtataaaactttcctc

SEQ ID NO: 1262544 - DNA, 18 bp, Homo sapiens
cctggggtccctctgaag

SEQ ID NO: 1262545 - DNA, 17 bp, Homo sapiens
cctggggtctctctccc

SEQ ID NO: 1262546 - DNA, 22 bp, Homo sapiens
cctggggtgcatcctcctcagc

SEQ ID NO: 1262547 - DNA, 20 bp, Homo sapiens
cctggggtggccagggcttc

SEQ ID NO: 1262548 - DNA, 15 bp, Homo sapiens
cctggggtgggacag

SEQ ID NO: 1262549 - DNA, 22 bp, Homo sapiens
cctggggtgggacagggagggc

SEQ ID NO: 1262550 - DNA, 21 bp, Homo sapiens
cctggggtggggatagggagc

SEQ ID NO: 1262551 - DNA, 22 bp, Homo sapiens
cctggggtgtcctacagtgact

SEQ ID NO: 1262552 - DNA, 23 bp, Homo sapiens
cctggggtgtcctacagtgactc

SEQ ID NO: 1262553 - DNA, 18 bp, Homo sapiens
cctggggttgtccccgct

SEQ ID NO: 1262554 - DNA, 23 bp, Homo sapiens
cctggggttgtccccgctggctc

SEQ ID NO: 1262555 - DNA, 16 bp, Homo sapiens
cctgggtatcccctgc

SEQ ID NO: 1262556 - DNA, 21 bp, Homo sapiens
cctgggtatcccctgcctcct

SEQ ID NO: 1262557 - DNA, 18 bp, Homo sapiens
cctgggtctaaggggttg

SEQ ID NO: 1262558 - DNA, 20 bp, Homo sapiens
cctgggtctggatgggagga

SEQ ID NO: 1262559 - DNA, 17 bp, Homo sapiens
cctgggtctgtgtctct

SEQ ID NO: 1262560 - DNA, 15 bp, Homo sapiens
cctgggtgacatttg

SEQ ID NO: 1262561 - DNA, 21 bp, Homo sapiens
cctgggtgagaatcctgcctc

SEQ ID NO: 1262562 - DNA, 22 bp, Homo sapiens
cctgggtgccattcccagcgtt

SEQ ID NO: 1262563 - DNA, 15 bp, Homo sapiens
cctgggtgggctctg

SEQ ID NO: 1262564 - DNA, 17 bp, Homo sapiens
cctgggtggggctgctc

SEQ ID NO: 1262565 - DNA, 17 bp, Homo sapiens
cctgggtgggtggtggg

SEQ ID NO: 1262566 - DNA, 22 bp, Homo sapiens
cctgggttagggtgtgtgttca

SEQ ID NO: 1262567 - DNA, 14 bp, Homo sapiens
cctgggttggaggg

SEQ ID NO: 1262568 - DNA, 20 bp, Homo sapiens
cctgggttggagggaaccac

SEQ ID NO: 1262569 - DNA, 18 bp, Homo sapiens
cctgggttgtttccagga

SEQ ID NO: 1262570 - DNA, 19 bp, Homo sapiens
cctgggttgtttccaggag

SEQ ID NO: 1262571 - DNA, 20 bp, Homo sapiens
cctgggttgtttccaggaga

SEQ ID NO: 1262572 - DNA, 14 bp, Homo sapiens
cctgggtttccagg

SEQ ID NO: 1262573 - DNA, 13 bp, Homo sapiens
cctggtaaaccaa

SEQ ID NO: 1262574 - DNA, 20 bp, Homo sapiens
cctggtaaccaaatattaaa

SEQ ID NO: 1262575 - DNA, 18 bp, Homo sapiens
cctggtacccagccatct

SEQ ID NO: 1262576 - DNA, 14 bp, Homo sapiens
cctggtaccctcct

SEQ ID NO: 1262577 - DNA, 17 bp, Homo sapiens
cctggtaccctcctggc

SEQ ID NO: 1262578 - DNA, 20 bp, Homo sapiens
cctggtagcacatgtctgtc

SEQ ID NO: 1262579 - DNA, 22 bp, Homo sapiens
cctggtcacaggactctgcctc

SEQ ID NO: 1262580 - DNA, 21 bp, Homo sapiens
cctggtcaccaaggcagtgca

SEQ ID NO: 1262581 - DNA, 23 bp, Homo sapiens
cctggtcaccaaggcagtgcatg

SEQ ID NO: 1262582 - DNA, 13 bp, Homo sapiens
cctggtccccact

SEQ ID NO: 1262583 - DNA, 14 bp, Homo sapiens
cctggtccccactg

SEQ ID NO: 1262584 - DNA, 20 bp, Homo sapiens
cctggtccccactgctgagc

SEQ ID NO: 1262585 - DNA, 21 bp, Homo sapiens
cctggtccctcgtccacaggg

SEQ ID NO: 1262586 - DNA, 23 bp, Homo sapiens
cctggtcctgagggtccccacct

SEQ ID NO: 1262587 - DNA, 13 bp, Homo sapiens
cctggtcctggac

SEQ ID NO: 1262588 - DNA, 14 bp, Homo sapiens
cctggtcctggaca

SEQ ID NO: 1262589 - DNA, 23 bp, Homo sapiens
cctggtcctggacacctcccagg

SEQ ID NO: 1262590 - DNA, 23 bp, Homo sapiens
cctggtcctggcctccttccccg

SEQ ID NO: 1262591 - DNA, 13 bp, Homo sapiens
cctggtcctggct

SEQ ID NO: 1262592 - DNA, 18 bp, Homo sapiens
cctggtcctggctgcact

SEQ ID NO: 1262593 - DNA, 15 bp, Homo sapiens
cctggtccttccact

SEQ ID NO: 1262594 - DNA, 18 bp, Homo sapiens
cctggtccttccaggccc

SEQ ID NO: 1262595 - DNA, 14 bp, Homo sapiens
cctggtctgtctgg

SEQ ID NO: 1262596 - DNA, 18 bp, Homo sapiens
cctggtctgtctggatcc

SEQ ID NO: 1262597 - DNA, 23 bp, Homo sapiens
cctggtctgtggagatggactca

SEQ ID NO: 1262598 - DNA, 12 bp, Homo sapiens
cctggtctttgt

SEQ ID NO: 1262599 - DNA, 17 bp, Homo sapiens
cctggtgacctcctgtc

SEQ ID NO: 1262600 - DNA, 17 bp, Homo sapiens
cctggtgaggcccagcc

SEQ ID NO: 1262601 - DNA, 19 bp, Homo sapiens
cctggtgaggcccagcctg

SEQ ID NO: 1262602 - DNA, 17 bp, Homo sapiens
cctggtgcccacagcag

SEQ ID NO: 1262603 - DNA, 19 bp, Homo sapiens
cctggtgccctgagacaga

SEQ ID NO: 1262604 - DNA, 16 bp, Homo sapiens
cctggtgcctctgtgc

SEQ ID NO: 1262605 - DNA, 17 bp, Homo sapiens
cctggtgcctctgtgca

SEQ ID NO: 1262606 - DNA, 19 bp, Homo sapiens
cctggtgctcctgcccagc

SEQ ID NO: 1262607 - DNA, 21 bp, Homo sapiens
cctggtgctcctgcccagcca

SEQ ID NO: 1262608 - DNA, 12 bp, Homo sapiens
cctggtgctctc

SEQ ID NO: 1262609 - DNA, 15 bp, Homo sapiens
cctggtgctctctgc

SEQ ID NO: 1262610 - DNA, 16 bp, Homo sapiens
cctggtgctctctgcc

SEQ ID NO: 1262611 - DNA, 17 bp, Homo sapiens
cctggtgctctctgcca

SEQ ID NO: 1262612 - DNA, 18 bp, Homo sapiens
cctggtgctgccacactt

SEQ ID NO: 1262613 - DNA, 15 bp, Homo sapiens
cctggtgctgcctct

SEQ ID NO: 1262614 - DNA, 17 bp, Homo sapiens
cctggtggacagtcctg

SEQ ID NO: 1262615 - DNA, 19 bp, Homo sapiens
cctggtggacagtcctggg

SEQ ID NO: 1262616 - DNA, 18 bp, Homo sapiens
cctggtggcaccagatgc

SEQ ID NO: 1262617 - DNA, 21 bp, Homo sapiens
cctggtgggggaaggggagga

SEQ ID NO: 1262618 - DNA, 22 bp, Homo sapiens
cctggtgggggaaggggaggag

SEQ ID NO: 1262619 - DNA, 13 bp, Homo sapiens
cctggtgggtcag

SEQ ID NO: 1262620 - DNA, 18 bp, Homo sapiens
cctggtgggtcaggggga

SEQ ID NO: 1262621 - DNA, 23 bp, Homo sapiens
cctggtgtgggtaaagggacagt

SEQ ID NO: 1262622 - DNA, 14 bp, Homo sapiens
cctggtgttctgaa

SEQ ID NO: 1262623 - DNA, 16 bp, Homo sapiens
cctggttcagacacag

SEQ ID NO: 1262624 - DNA, 18 bp, Homo sapiens
cctggttcagacacagct

SEQ ID NO: 1262625 - DNA, 12 bp, Homo sapiens
cctggttcattg

SEQ ID NO: 1262626 - DNA, 20 bp, Homo sapiens
cctggttccttcctatgccc

SEQ ID NO: 1262627 - DNA, 15 bp, Homo sapiens
cctggttgcctctct

SEQ ID NO: 1262628 - DNA, 16 bp, Homo sapiens
cctggttgcctctctt

SEQ ID NO: 1262629 - DNA, 15 bp, Homo sapiens
cctggtttagcctgg

SEQ ID NO: 1262630 - DNA, 13 bp, Homo sapiens
cctggttttattt

SEQ ID NO: 1262631 - DNA, 22 bp, Homo sapiens
cctggtttttaaatagagtttg

SEQ ID NO: 1262632 - DNA, 13 bp, Homo sapiens
cctgtaaaacttt

SEQ ID NO: 1262633 - DNA, 18 bp, Homo sapiens
cctgtaaaactttatttt

SEQ ID NO: 1262634 - DNA, 13 bp, Homo sapiens
cctgtaaacctga

SEQ ID NO: 1262635 - DNA, 19 bp, Homo sapiens
cctgtaaacggtgctattt

SEQ ID NO: 1262636 - DNA, 19 bp, Homo sapiens
cctgtaaatggtgtacata

SEQ ID NO: 1262637 - DNA, 18 bp, Homo sapiens
cctgtaacacaagccaca

SEQ ID NO: 1262638 - DNA, 21 bp, Homo sapiens
cctgtaacacaagccacagaa

SEQ ID NO: 1262639 - DNA, 23 bp, Homo sapiens
cctgtaacaggtgtggggacaca

SEQ ID NO: 1262640 - DNA, 23 bp, Homo sapiens
cctgtaacatactggcctggact

SEQ ID NO: 1262641 - DNA, 16 bp, Homo sapiens
cctgtaacctcttcag

SEQ ID NO: 1262642 - DNA, 21 bp, Homo sapiens
cctgtaacctcttcagaggcc

SEQ ID NO: 1262643 - DNA, 21 bp, Homo sapiens
cctgtaactacaatgatggta

SEQ ID NO: 1262644 - DNA, 18 bp, Homo sapiens
cctgtaacttgagagtag

SEQ ID NO: 1262645 - DNA, 20 bp, Homo sapiens
cctgtaatcatataataaat

SEQ ID NO: 1262646 - DNA, 18 bp, Homo sapiens
cctgtaatcccagcactt

SEQ ID NO: 1262647 - DNA, 21 bp, Homo sapiens
cctgtaatcccagcactttgg

SEQ ID NO: 1262648 - DNA, 23 bp, Homo sapiens
cctgtaatcccagcactttggga

SEQ ID NO: 1262649 - DNA, 16 bp, Homo sapiens
cctgtaatcccagcta

SEQ ID NO: 1262650 - DNA, 23 bp, Homo sapiens
cctgtaatcccagctactcagga

SEQ ID NO: 1262651 - DNA, 18 bp, Homo sapiens
cctgtaatctttttctcc

SEQ ID NO: 1262652 - DNA, 14 bp, Homo sapiens
cctgtacagtagat

SEQ ID NO: 1262653 - DNA, 17 bp, Homo sapiens
cctgtacatacattgta

SEQ ID NO: 1262654 - DNA, 24 bp, Homo sapiens
cctgtacatacattgtataggcca

SEQ ID NO: 1262655 - DNA, 14 bp, Homo sapiens
cctgtacccacccc

SEQ ID NO: 1262656 - DNA, 13 bp, Homo sapiens
cctgtacccagct

SEQ ID NO: 1262657 - DNA, 15 bp, Homo sapiens
cctgtacccagctcc

SEQ ID NO: 1262658 - DNA, 16 bp, Homo sapiens
cctgtacccagctcct

SEQ ID NO: 1262659 - DNA, 12 bp, Homo sapiens
cctgtacctctt

SEQ ID NO: 1262660 - DNA, 21 bp, Homo sapiens
cctgtactatgatgggcttct

SEQ ID NO: 1262661 - DNA, 23 bp, Homo sapiens
cctgtactcaggaggctgagggg

SEQ ID NO: 1262662 - DNA, 15 bp, Homo sapiens
cctgtactcttccga

SEQ ID NO: 1262663 - DNA, 20 bp, Homo sapiens
cctgtactgttctgtgtctt

SEQ ID NO: 1262664 - DNA, 23 bp, Homo sapiens
cctgtagacctagggaggacctt

SEQ ID NO: 1262665 - DNA, 15 bp, Homo sapiens
cctgtagagtgggag

SEQ ID NO: 1262666 - DNA, 16 bp, Homo sapiens
cctgtagagtgggagc

SEQ ID NO: 1262667 - DNA, 23 bp, Homo sapiens
cctgtagagtgggagctgagtgg

SEQ ID NO: 1262668 - DNA, 13 bp, Homo sapiens
cctgtagagttgc

SEQ ID NO: 1262669 - DNA, 14 bp, Homo sapiens
cctgtagagttgct

SEQ ID NO: 1262670 - DNA, 17 bp, Homo sapiens
cctgtagcaatggccag

SEQ ID NO: 1262671 - DNA, 18 bp, Homo sapiens
cctgtagcaatggccaga

SEQ ID NO: 1262672 - DNA, 21 bp, Homo sapiens
cctgtagcaatggccagagcc

SEQ ID NO: 1262673 - DNA, 16 bp, Homo sapiens
cctgtagccttctgta

SEQ ID NO: 1262674 - DNA, 19 bp, Homo sapiens
cctgtagccttctgtagga

SEQ ID NO: 1262675 - DNA, 14 bp, Homo sapiens
cctgtagctctgcc

SEQ ID NO: 1262676 - DNA, 20 bp, Homo sapiens
cctgtagggaaaccttggag

SEQ ID NO: 1262677 - DNA, 15 bp, Homo sapiens
cctgtaggtcaggac

SEQ ID NO: 1262678 - DNA, 13 bp, Homo sapiens
cctgtagtcccag

SEQ ID NO: 1262679 - DNA, 14 bp, Homo sapiens
cctgtagtcccagc

SEQ ID NO: 1262680 - DNA, 17 bp, Homo sapiens
cctgtagttaggaaata

SEQ ID NO: 1262681 - DNA, 19 bp, Homo sapiens
cctgtagttaggaaataaa

SEQ ID NO: 1262682 - DNA, 23 bp, Homo sapiens
cctgtagttaggaaataaaacct

SEQ ID NO: 1262683 - DNA, 14 bp, Homo sapiens
cctgtatacagtgc

SEQ ID NO: 1262684 - DNA, 15 bp, Homo sapiens
cctgtatacagtgca

SEQ ID NO: 1262685 - DNA, 18 bp, Homo sapiens
cctgtatacagtgcagag

SEQ ID NO: 1262686 - DNA, 14 bp, Homo sapiens
cctgtatacctcct

SEQ ID NO: 1262687 - DNA, 22 bp, Homo sapiens
cctgtatagttaggatagcatt

SEQ ID NO: 1262688 - DNA, 23 bp, Homo sapiens
cctgtatatagcccagccaggcc

SEQ ID NO: 1262689 - DNA, 21 bp, Homo sapiens
cctgtatcctccctggcagac

SEQ ID NO: 1262690 - DNA, 22 bp, Homo sapiens
cctgtatcctccctggcagaca

SEQ ID NO: 1262691 - DNA, 15 bp, Homo sapiens
cctgtatgtggtgtg

SEQ ID NO: 1262692 - DNA, 18 bp, Homo sapiens
cctgtatgtggtgtgggg

SEQ ID NO: 1262693 - DNA, 20 bp, Homo sapiens
cctgtattactgaataatat

SEQ ID NO: 1262694 - DNA, 22 bp, Homo sapiens
cctgtattctcaaacacagtta

SEQ ID NO: 1262695 - DNA, 16 bp, Homo sapiens
cctgtattcttgtttg

SEQ ID NO: 1262696 - DNA, 18 bp, Homo sapiens
cctgtcaagttaacaagg

SEQ ID NO: 1262697 - DNA, 23 bp, Homo sapiens
cctgtcaagttaacaaggaatgc

SEQ ID NO: 1262698 - DNA, 19 bp, Homo sapiens
cctgtcacacactggaccc

SEQ ID NO: 1262699 - DNA, 17 bp, Homo sapiens
cctgtcaccctgcagga

SEQ ID NO: 1262700 - DNA, 18 bp, Homo sapiens
cctgtcactcactgaggc

SEQ ID NO: 1262701 - DNA, 22 bp, Homo sapiens
cctgtcactcactgaggccatc

SEQ ID NO: 1262702 - DNA, 19 bp, Homo sapiens
cctgtcactgagcacagtc

SEQ ID NO: 1262703 - DNA, 21 bp, Homo sapiens
cctgtcactgagcacagtcag

SEQ ID NO: 1262704 - DNA, 15 bp, Homo sapiens
cctgtcactgatgga

SEQ ID NO: 1262705 - DNA, 16 bp, Homo sapiens
cctgtcagtgcagccc

SEQ ID NO: 1262706 - DNA, 19 bp, Homo sapiens
cctgtcagtgcagcccgtg

SEQ ID NO: 1262707 - DNA, 14 bp, Homo sapiens
cctgtcatgccccc

SEQ ID NO: 1262708 - DNA, 19 bp, Homo sapiens
cctgtcatgcccccctcaa

SEQ ID NO: 1262709 - DNA, 23 bp, Homo sapiens
cctgtccaacctaacccctttcc

SEQ ID NO: 1262710 - DNA, 16 bp, Homo sapiens
cctgtccaccctgcca

SEQ ID NO: 1262711 - DNA, 13 bp, Homo sapiens
cctgtccagagag

SEQ ID NO: 1262712 - DNA, 12 bp, Homo sapiens
cctgttctgaaa

SEQ ID NO: 1262713 - DNA, 13 bp, Homo sapiens
cctgttctgcttc

SEQ ID NO: 1262714 - DNA, 20 bp, Homo sapiens
cctgttctgtagctttctgg

SEQ ID NO: 1262715 - DNA, 21 bp, Homo sapiens
cctgttctgtagctttctgga

SEQ ID NO: 1262716 - DNA, 12 bp, Homo sapiens
cctgttcttcct

SEQ ID NO: 1262717 - DNA, 16 bp, Homo sapiens
cctgttcttcctccag

SEQ ID NO: 1262718 - DNA, 20 bp, Homo sapiens
cctgttcttccttcctagaa

SEQ ID NO: 1262719 - DNA, 20 bp, Homo sapiens
cctgttgaagacttcctctc

SEQ ID NO: 1262720 - DNA, 21 bp, Homo sapiens
cctgttgaagacttcctctct

SEQ ID NO: 1262721 - DNA, 17 bp, Homo sapiens
cctgttgacacaggtct

SEQ ID NO: 1262722 - DNA, 22 bp, Homo sapiens
cctgttgacacaggtctttcct

SEQ ID NO: 1262723 - DNA, 21 bp, Homo sapiens
cctgttgaggtgggtgggcct

SEQ ID NO: 1262724 - DNA, 13 bp, Homo sapiens
cctgttgatggga

SEQ ID NO: 1262725 - DNA, 16 bp, Homo sapiens
cctgttgattatcttc

SEQ ID NO: 1262726 - DNA, 18 bp, Homo sapiens
cctgttgctttcttcctg

SEQ ID NO: 1262727 - DNA, 18 bp, Homo sapiens
cctgttggcagctctagc

SEQ ID NO: 1262728 - DNA, 18 bp, Homo sapiens
cctgttgtatttatggat

SEQ ID NO: 1262729 - DNA, 18 bp, Homo sapiens
cctgtttcagaggctcag

SEQ ID NO: 1262730 - DNA, 15 bp, Homo sapiens
cctgtttcccaggcc

SEQ ID NO: 1262731 - DNA, 17 bp, Homo sapiens
cctgtttcccaggccca

SEQ ID NO: 1262732 - DNA, 13 bp, Homo sapiens
cctgtttctctgc

SEQ ID NO: 1262733 - DNA, 22 bp, Homo sapiens
cctgtttctctttgtctgcctt

SEQ ID NO: 1262734 - DNA, 14 bp, Homo sapiens
cctgtttctggcac

SEQ ID NO: 1262735 - DNA, 16 bp, Homo sapiens
cctgtttgatgtatgt

SEQ ID NO: 1262736 - DNA, 17 bp, Homo sapiens
cctgtttgatgtatgtg

SEQ ID NO: 1262737 - DNA, 23 bp, Homo sapiens
cctgtttgatgtatgtgtgaaac

SEQ ID NO: 1262738 - DNA, 15 bp, Homo sapiens
cctgtttggcctctc

SEQ ID NO: 1262739 - DNA, 21 bp, Homo sapiens
cctgtttgggcccctctccca

SEQ ID NO: 1262740 - DNA, 16 bp, Homo sapiens
cctgtttgtctgatgt

SEQ ID NO: 1262741 - DNA, 13 bp, Homo sapiens
cctgttttcactc

SEQ ID NO: 1262742 - DNA, 17 bp, Homo sapiens
cctgtttttaagctgtt

SEQ ID NO: 1262743 - DNA, 23 bp, Homo sapiens
cctgtttttagagcttccaaatg

SEQ ID NO: 1262744 - DNA, 20 bp, Homo sapiens
cctgtttttcacattttcct

SEQ ID NO: 1262745 - DNA, 15 bp, Homo sapiens
cctgtttttctgggt

SEQ ID NO: 1262746 - DNA, 14 bp, Homo sapiens
ccttaaaaatgcac

SEQ ID NO: 1262747 - DNA, 15 bp, Homo sapiens
ccttaaaaccaaaga

SEQ ID NO: 1262748 - DNA, 19 bp, Homo sapiens
ccttaaacctgaagatgtc

SEQ ID NO: 1262749 - DNA, 18 bp, Homo sapiens
ccttaaactctggacact

SEQ ID NO: 1262750 - DNA, 20 bp, Homo sapiens
ccttaaagaaaattgcatga

SEQ ID NO: 1262751 - DNA, 21 bp, Homo sapiens
ccttaaattaaacaatttatt

SEQ ID NO: 1262752 - DNA, 22 bp, Homo sapiens
ccttaaccaccgcatatgcatg

SEQ ID NO: 1262753 - DNA, 14 bp, Homo sapiens
ccttaactaagact

SEQ ID NO: 1262754 - DNA, 18 bp, Homo sapiens
ccttaactaagactcccg

SEQ ID NO: 1262755 - DNA, 22 bp, Homo sapiens
ccttaactaagactcccgcccc

SEQ ID NO: 1262756 - DNA, 18 bp, Homo sapiens
ccttaactctaaccctgt

SEQ ID NO: 1262757 - DNA, 13 bp, Homo sapiens
ccttaactgacat

SEQ ID NO: 1262758 - DNA, 16 bp, Homo sapiens
ccttaactgcatccag

SEQ ID NO: 1262759 - DNA, 13 bp, Homo sapiens
ccttaagcagaac

SEQ ID NO: 1262760 - DNA, 20 bp, Homo sapiens
ccttaagcagaacaaatgtg

SEQ ID NO: 1262761 - DNA, 21 bp, Homo sapiens
ccttaagcagaacaaatgtgt

SEQ ID NO: 1262762 - DNA, 19 bp, Homo sapiens
ccttaagggttgaaggcag

SEQ ID NO: 1262763 - DNA, 20 bp, Homo sapiens
ccttaagtgatttgcctgta

SEQ ID NO: 1262764 - DNA, 15 bp, Homo sapiens
ccttaataaatatgt

SEQ ID NO: 1262765 - DNA, 21 bp, Homo sapiens
ccttaatattgaggctgcagc

SEQ ID NO: 1262766 - DNA, 23 bp, Homo sapiens
ccttaatcaggtcctcagagaat

SEQ ID NO: 1262767 - DNA, 17 bp, Homo sapiens
ccttaattcactcccac

SEQ ID NO: 1262768 - DNA, 16 bp, Homo sapiens
ccttaatttattatta

SEQ ID NO: 1262769 - DNA, 18 bp, Homo sapiens
ccttaatttcctttttga

SEQ ID NO: 1262770 - DNA, 23 bp, Homo sapiens
ccttaatttcctttttgacactg

SEQ ID NO: 1262771 - DNA, 19 bp, Homo sapiens
ccttaatttttttttcata

SEQ ID NO: 1262772 - DNA, 18 bp, Homo sapiens
ccttacagcctctgactt

SEQ ID NO: 1262773 - DNA, 17 bp, Homo sapiens
ccttacagtaggagccc

SEQ ID NO: 1262774 - DNA, 18 bp, Homo sapiens
ccttacatcttttctaat

SEQ ID NO: 1262775 - DNA, 15 bp, Homo sapiens
ccttaccaactttct

SEQ ID NO: 1262776 - DNA, 19 bp, Homo sapiens
ccttaccataccactttga

SEQ ID NO: 1262777 - DNA, 15 bp, Homo sapiens
ccttaccctcctctg

SEQ ID NO: 1262778 - DNA, 21 bp, Homo sapiens
ccttaccctgccccagctggg

SEQ ID NO: 1262779 - DNA, 16 bp, Homo sapiens
ccttacctatttcctc

SEQ ID NO: 1262780 - DNA, 17 bp, Homo sapiens
ccttacctcctgcccag

SEQ ID NO: 1262781 - DNA, 12 bp, Homo sapiens
ccttacctctgg

SEQ ID NO: 1262782 - DNA, 15 bp, Homo sapiens
ccttacctctggaac

SEQ ID NO: 1262783 - DNA, 16 bp, Homo sapiens
ccttacgctttgtcac

SEQ ID NO: 1262784 - DNA, 13 bp, Homo sapiens
ccttacgtgagaa

SEQ ID NO: 1262785 - DNA, 22 bp, Homo sapiens
ccttactcccccaccactcagg

SEQ ID NO: 1262786 - DNA, 20 bp, Homo sapiens
ccttactctgagcccaggcc

SEQ ID NO: 1262787 - DNA, 22 bp, Homo sapiens
ccttactctgagcccaggccgt

SEQ ID NO: 1262788 - DNA, 13 bp, Homo sapiens
ccttacttcctgg

SEQ ID NO: 1262789 - DNA, 19 bp, Homo sapiens
ccttacttcctggcctctt

SEQ ID NO: 1262790 - DNA, 16 bp, Homo sapiens
ccttacttgcactgtt

SEQ ID NO: 1262791 - DNA, 20 bp, Homo sapiens
ccttacttgcttctctagct

SEQ ID NO: 1262792 - DNA, 23 bp, Homo sapiens
ccttagaaatgtaaactgccata

SEQ ID NO: 1262793 - DNA, 15 bp, Homo sapiens
ccttagaacctttct

SEQ ID NO: 1262794 - DNA, 16 bp, Homo sapiens
ccttagaagagagcca

SEQ ID NO: 1262795 - DNA, 16 bp, Homo sapiens
ccttagactcttttcc

SEQ ID NO: 1262796 - DNA, 14 bp, Homo sapiens
ccttagagaagcta

SEQ ID NO: 1262797 - DNA, 20 bp, Homo sapiens
ccttagagattgccccagag

SEQ ID NO: 1262798 - DNA, 13 bp, Homo sapiens
ccttagaggacct

SEQ ID NO: 1262799 - DNA, 18 bp, Homo sapiens
ccttagaggtcctctgga

SEQ ID NO: 1262800 - DNA, 18 bp, Homo sapiens
ccttagattagctctgga

SEQ ID NO: 1262801 - DNA, 21 bp, Homo sapiens
ccttagattagctctggacca

SEQ ID NO: 1262802 - DNA, 16 bp, Homo sapiens
ccttagcacagagagg

SEQ ID NO: 1262803 - DNA, 15 bp, Homo sapiens
ccttagcaccttcag

SEQ ID NO: 1262804 - DNA, 16 bp, Homo sapiens
ccttagcctccctgaa

SEQ ID NO: 1262805 - DNA, 16 bp, Homo sapiens
ccttagcctcttggaa

SEQ ID NO: 1262806 - DNA, 15 bp, Homo sapiens
ccttagcgttctgga

SEQ ID NO: 1262807 - DNA, 17 bp, Homo sapiens
ccttagcttagacctca

SEQ ID NO: 1262808 - DNA, 19 bp, Homo sapiens
ccttagcttagacctcagc

SEQ ID NO: 1262809 - DNA, 18 bp, Homo sapiens
ccttaggatggggctccc

SEQ ID NO: 1262810 - DNA, 22 bp, Homo sapiens
ccttaggatggggctcccagct

SEQ ID NO: 1262811 - DNA, 23 bp, Homo sapiens
ccttaggcattatttaatgtttg

SEQ ID NO: 1262812 - DNA, 14 bp, Homo sapiens
ccttaggcctctga

SEQ ID NO: 1262813 - DNA, 23 bp, Homo sapiens
ccttaggccttcctctctccaga

SEQ ID NO: 1262814 - DNA, 13 bp, Homo sapiens
ccttaggctttgt

SEQ ID NO: 1262815 - DNA, 22 bp, Homo sapiens
ccttaggctttgtatgacagtg

SEQ ID NO: 1262816 - DNA, 20 bp, Homo sapiens
ccttagggaagctggcctga

SEQ ID NO: 1262817 - DNA, 21 bp, Homo sapiens
ccttagggaagctggcctgag

SEQ ID NO: 1262818 - DNA, 14 bp, Homo sapiens
ccttagggaagttg

SEQ ID NO: 1262819 - DNA, 22 bp, Homo sapiens
ccttagggaagttgtctccttc

SEQ ID NO: 1262820 - DNA, 22 bp, Homo sapiens
ccttagggagccccaaaaccta

SEQ ID NO: 1262821 - DNA, 15 bp, Homo sapiens
ccttagtgggccagg

SEQ ID NO: 1262822 - DNA, 22 bp, Homo sapiens
ccttagtgggccagggctgccc

SEQ ID NO: 1262823 - DNA, 17 bp, Homo sapiens
ccttatatttctgtgta

SEQ ID NO: 1262824 - DNA, 13 bp, Homo sapiens
ccttatcaagtgt

SEQ ID NO: 1262825 - DNA, 14 bp, Homo sapiens
ccttatcaagtgtc

SEQ ID NO: 1262826 - DNA, 16 bp, Homo sapiens
ccttatcaagtgtctt

SEQ ID NO: 1262827 - DNA, 15 bp, Homo sapiens
ccttatcattcattc

SEQ ID NO: 1262828 - DNA, 16 bp, Homo sapiens
ccttatcattcattct

SEQ ID NO: 1262829 - DNA, 17 bp, Homo sapiens
ccttatcattcattctt

SEQ ID NO: 1262830 - DNA, 13 bp, Homo sapiens
ccttatccaggac

SEQ ID NO: 1262831 - DNA, 17 bp, Homo sapiens
ccttatccaggactctg

SEQ ID NO: 1262832 - DNA, 19 bp, Homo sapiens
ccttatcctacagtacaat

SEQ ID NO: 1262833 - DNA, 20 bp, Homo sapiens
ccttctaacatgttatcaaa

SEQ ID NO: 1262834 - DNA, 23 bp, Homo sapiens
ccttctaagataaaaataataat

SEQ ID NO: 1262835 - DNA, 15 bp, Homo sapiens
ccttctacaaggact

SEQ ID NO: 1262836 - DNA, 20 bp, Homo sapiens
ccttctacagaacctgaggg

SEQ ID NO: 1262837 - DNA, 19 bp, Homo sapiens
ccttctaccccaaggccag

SEQ ID NO: 1262838 - DNA, 21 bp, Homo sapiens
ccttctaccccaaggccagta

SEQ ID NO: 1262839 - DNA, 15 bp, Homo sapiens
ccttctactgagcct

SEQ ID NO: 1262840 - DNA, 19 bp, Homo sapiens
ccttctagaacacctgcct

SEQ ID NO: 1262841 - DNA, 18 bp, Homo sapiens
ccttctagattcactgtc

SEQ ID NO: 1262842 - DNA, 15 bp, Homo sapiens
ccttctagtgagcct

SEQ ID NO: 1262843 - DNA, 23 bp, Homo sapiens
ccttctagtgagcctgggccagg

SEQ ID NO: 1262844 - DNA, 13 bp, Homo sapiens
ccttctattttcc

SEQ ID NO: 1262845 - DNA, 14 bp, Homo sapiens
ccttctcagaatct

SEQ ID NO: 1262846 - DNA, 18 bp, Homo sapiens
ccttctccaaaggctctg

SEQ ID NO: 1262847 - DNA, 16 bp, Homo sapiens
ccttctccatccacat

SEQ ID NO: 1262848 - DNA, 14 bp, Homo sapiens
ccttctccatggag

SEQ ID NO: 1262849 - DNA, 18 bp, Homo sapiens
ccttctccatggagtgtt

SEQ ID NO: 1262850 - DNA, 14 bp, Homo sapiens
ccttctcccagcac

SEQ ID NO: 1262851 - DNA, 15 bp, Homo sapiens
ccttctcccagcaca

SEQ ID NO: 1262852 - DNA, 12 bp, Homo sapiens
ccttctccccct

SEQ ID NO: 1262853 - DNA, 16 bp, Homo sapiens
ccttctcccccttgtc

SEQ ID NO: 1262854 - DNA, 18 bp, Homo sapiens
ccttctcccctctcccag

SEQ ID NO: 1262855 - DNA, 21 bp, Homo sapiens
ccttctcccctctcccaggga

SEQ ID NO: 1262856 - DNA, 22 bp, Homo sapiens
ccttctcccctctcccagggat

SEQ ID NO: 1262857 - DNA, 12 bp, Homo sapiens
ccttctcccctt

SEQ ID NO: 1262858 - DNA, 15 bp, Homo sapiens
ccttctccccttcct

SEQ ID NO: 1262859 - DNA, 16 bp, Homo sapiens
ccttctcccggccctc

SEQ ID NO: 1262860 - DNA, 12 bp, Homo sapiens
ccttctccctgg

SEQ ID NO: 1262861 - DNA, 13 bp, Homo sapiens
ccttctccctgga

SEQ ID NO: 1262862 - DNA, 12 bp, Homo sapiens
ccttctcctctc

SEQ ID NO: 1262863 - DNA, 14 bp, Homo sapiens
ccttctccttccca

SEQ ID NO: 1262864 - DNA, 19 bp, Homo sapiens
ccttctcgtgtttgcttaa

SEQ ID NO: 1262865 - DNA, 22 bp, Homo sapiens
ccttctctattgggcacagcct

SEQ ID NO: 1262866 - DNA, 16 bp, Homo sapiens
ccttctctcactgtgt

SEQ ID NO: 1262867 - DNA, 12 bp, Homo sapiens
ccttctctctcc

SEQ ID NO: 1262868 - DNA, 14 bp, Homo sapiens
ccttctctctccag

SEQ ID NO: 1262869 - DNA, 20 bp, Homo sapiens
ccttctctgctccaccacat

SEQ ID NO: 1262870 - DNA, 13 bp, Homo sapiens
ccttctctgggtc

SEQ ID NO: 1262871 - DNA, 21 bp, Homo sapiens
ccttctctgtagggaactctg

SEQ ID NO: 1262872 - DNA, 14 bp, Homo sapiens
ccttctcttaattt

SEQ ID NO: 1262873 - DNA, 20 bp, Homo sapiens
ccttctgaaaaagtatcctg

SEQ ID NO: 1262874 - DNA, 15 bp, Homo sapiens
ccttctgaactccat

SEQ ID NO: 1262875 - DNA, 23 bp, Homo sapiens
ccttctgaagtgtgtccatcctg

SEQ ID NO: 1262876 - DNA, 24 bp, Homo sapiens
ccttctgacagcccaacttccaga

SEQ ID NO: 1262877 - DNA, 22 bp, Homo sapiens
ccttctgagctccacctctggt

SEQ ID NO: 1262878 - DNA, 15 bp, Homo sapiens
ccttctgatgaaatg

SEQ ID NO: 1262879 - DNA, 21 bp, Homo sapiens
ccttctgatgaaatgttaaca

SEQ ID NO: 1262880 - DNA, 13 bp, Homo sapiens
ccttctgctactg

SEQ ID NO: 1262881 - DNA, 16 bp, Homo sapiens
ccttctgctcccaccc

SEQ ID NO: 1262882 - DNA, 21 bp, Homo sapiens
ccttctgctggataaaatgag

SEQ ID NO: 1262883 - DNA, 11 bp, Homo sapiens
ccttctgctgt

SEQ ID NO: 1262884 - DNA, 18 bp, Homo sapiens
ccttctggagctgggaga

SEQ ID NO: 1262885 - DNA, 22 bp, Homo sapiens
ccttctggagctgggagacaaa

SEQ ID NO: 1262886 - DNA, 17 bp, Homo sapiens
ccttctggcctcccaca

SEQ ID NO: 1262887 - DNA, 12 bp, Homo sapiens
ccttctgggaaa

SEQ ID NO: 1262888 - DNA, 20 bp, Homo sapiens
ccttctgggcaagggctcct

SEQ ID NO: 1262889 - DNA, 16 bp, Homo sapiens
ccttctgggctttttc

SEQ ID NO: 1262890 - DNA, 16 bp, Homo sapiens
ccttctggtatcttgt

SEQ ID NO: 1262891 - DNA, 15 bp, Homo sapiens
ccttctgtccaccag

SEQ ID NO: 1262892 - DNA, 16 bp, Homo sapiens
ccttctgtccccagcc

SEQ ID NO: 1262893 - DNA, 22 bp, Homo sapiens
ccttctgtggggctgggcaccg

SEQ ID NO: 1262894 - DNA, 23 bp, Homo sapiens
ccttcttacaaaaagaaatgtca

SEQ ID NO: 1262895 - DNA, 17 bp, Homo sapiens
ccttcttattctcactc

SEQ ID NO: 1262896 - DNA, 19 bp, Homo sapiens
ccttcttcagcaggaaggg

SEQ ID NO: 1262897 - DNA, 20 bp, Homo sapiens
ccttcttcagcaggaagggt

SEQ ID NO: 1262898 - DNA, 18 bp, Homo sapiens
ccttcttccacttctcca

SEQ ID NO: 1262899 - DNA, 14 bp, Homo sapiens
ccttcttcctcccc

SEQ ID NO: 1262900 - DNA, 17 bp, Homo sapiens
ccttcttcctcccctca

SEQ ID NO: 1262901 - DNA, 14 bp, Homo sapiens
ccttcttcgctgct

SEQ ID NO: 1262902 - DNA, 13 bp, Homo sapiens
ccttcttctgcca

SEQ ID NO: 1262903 - DNA, 16 bp, Homo sapiens
ccttcttgctgccctg

SEQ ID NO: 1262904 - DNA, 15 bp, Homo sapiens
ccttcttggcttctg

SEQ ID NO: 1262905 - DNA, 17 bp, Homo sapiens
ccttcttggcttctggg

SEQ ID NO: 1262906 - DNA, 13 bp, Homo sapiens
ccttcttgggccc

SEQ ID NO: 1262907 - DNA, 20 bp, Homo sapiens
ccttcttgggtagggcagac

SEQ ID NO: 1262908 - DNA, 21 bp, Homo sapiens
ccttcttgggtctgccctgcc

SEQ ID NO: 1262909 - DNA, 18 bp, Homo sapiens
ccttcttggtttcagcca

SEQ ID NO: 1262910 - DNA, 15 bp, Homo sapiens
ccttcttgtcaccag

SEQ ID NO: 1262911 - DNA, 14 bp, Homo sapiens
ccttctttctggac

SEQ ID NO: 1262912 - DNA, 15 bp, Homo sapiens
ccttctttgcagggc

SEQ ID NO: 1262913 - DNA, 15 bp, Homo sapiens
ccttctttttctgga

SEQ ID NO: 1262914 - DNA, 21 bp, Homo sapiens
ccttctttttctggactctgg

SEQ ID NO: 1262915 - DNA, 23 bp, Homo sapiens
ccttctttttctggactctggac

SEQ ID NO: 1262916 - DNA, 15 bp, Homo sapiens
ccttgaaccacttcc

SEQ ID NO: 1262917 - DNA, 14 bp, Homo sapiens
ccttgaactgaggc

SEQ ID NO: 1262918 - DNA, 19 bp, Homo sapiens
ccttgaactttgacctctg

SEQ ID NO: 1262919 - DNA, 18 bp, Homo sapiens
ccttgaagaaaatgactt

SEQ ID NO: 1262920 - DNA, 19 bp, Homo sapiens
ccttgaagaaaatgacttt

SEQ ID NO: 1262921 - DNA, 20 bp, Homo sapiens
ccttgaagaaaatgacttta

SEQ ID NO: 1262922 - DNA, 23 bp, Homo sapiens
ccttgaagaactgcaggccctgg

SEQ ID NO: 1262923 - DNA, 15 bp, Homo sapiens
ccttgaagacagagc

SEQ ID NO: 1262924 - DNA, 15 bp, Homo sapiens
ccttgaagcaaatgt

SEQ ID NO: 1262925 - DNA, 13 bp, Homo sapiens
ccttgaagcaata

SEQ ID NO: 1262926 - DNA, 14 bp, Homo sapiens
ccttgaagccactg

SEQ ID NO: 1262927 - DNA, 22 bp, Homo sapiens
ccttgaagccactgaagctggg

SEQ ID NO: 1262928 - DNA, 18 bp, Homo sapiens
ccttgaaggactaataga

SEQ ID NO: 1262929 - DNA, 22 bp, Homo sapiens
ccttgaatctttttatcccatt

SEQ ID NO: 1262930 - DNA, 12 bp, Homo sapiens
ccttgaatgctg

SEQ ID NO: 1262931 - DNA, 14 bp, Homo sapiens
ccttgaatgctgcc

SEQ ID NO: 1262932 - DNA, 15 bp, Homo sapiens
ccttgaatgctgcca

SEQ ID NO: 1262933 - DNA, 17 bp, Homo sapiens
ccttgaatgctgccagt

SEQ ID NO: 1262934 - DNA, 20 bp, Homo sapiens
ccttgaatgctgccagtgtg

SEQ ID NO: 1262935 - DNA, 22 bp, Homo sapiens
ccttgaatgctgccagtgtgga

SEQ ID NO: 1262936 - DNA, 17 bp, Homo sapiens
ccttgacaacagactga

SEQ ID NO: 1262937 - DNA, 13 bp, Homo sapiens
ccttgacagagca

SEQ ID NO: 1262938 - DNA, 14 bp, Homo sapiens
ccttgacagagcag

SEQ ID NO: 1262939 - DNA, 17 bp, Homo sapiens
ccttgacagagcagcta

SEQ ID NO: 1262940 - DNA, 22 bp, Homo sapiens
ccttgacagagcagctaactcc

SEQ ID NO: 1262941 - DNA, 15 bp, Homo sapiens
ccttgacatcagttc

SEQ ID NO: 1262942 - DNA, 20 bp, Homo sapiens
ccttgacgtcaagtctcctt

SEQ ID NO: 1262943 - DNA, 17 bp, Homo sapiens
ccttgactgtacagaga

SEQ ID NO: 1262944 - DNA, 22 bp, Homo sapiens
ccttgactgtacagagactcta

SEQ ID NO: 1262945 - DNA, 23 bp, Homo sapiens
ccttgactgtacagagactctat

SEQ ID NO: 1262946 - DNA, 23 bp, Homo sapiens
ccttgactgtctagccactccct

SEQ ID NO: 1262947 - DNA, 13 bp, Homo sapiens
ccttgactttgct

SEQ ID NO: 1262948 - DNA, 14 bp, Homo sapiens
ccttgagaaacctt

SEQ ID NO: 1262949 - DNA, 19 bp, Homo sapiens
ccttgagaaaccttattgt

SEQ ID NO: 1262950 - DNA, 11 bp, Homo sapiens
ccttgagacca

SEQ ID NO: 1262951 - DNA, 21 bp, Homo sapiens
ccttgagagacccagctgcag

SEQ ID NO: 1262952 - DNA, 20 bp, Homo sapiens
ccttgagatgagtttctggg

SEQ ID NO: 1262953 - DNA, 15 bp, Homo sapiens
ccttgagccctggct

SEQ ID NO: 1262954 - DNA, 22 bp, Homo sapiens
ccttgagccctggctgttctgt

SEQ ID NO: 1262955 - DNA, 18 bp, Homo sapiens
ccttgttggagcctgcag

SEQ ID NO: 1262956 - DNA, 19 bp, Homo sapiens
ccttgttggagcctgcagg

SEQ ID NO: 1262957 - DNA, 22 bp, Homo sapiens
ccttgtttgagtttttcctccc

SEQ ID NO: 1262958 - DNA, 22 bp, Homo sapiens
ccttgtttgattttagctgcag

SEQ ID NO: 1262959 - DNA, 21 bp, Homo sapiens
ccttgtttttaatctcctgtt

SEQ ID NO: 1262960 - DNA, 21 bp, Homo sapiens
cctttaaaaccagtaacgtgc

SEQ ID NO: 1262961 - DNA, 16 bp, Homo sapiens
cctttaaaggttttta

SEQ ID NO: 1262962 - DNA, 21 bp, Homo sapiens
cctttaaaggtttttaaattg

SEQ ID NO: 1262963 - DNA, 18 bp, Homo sapiens
cctttaaagtaaaggcct

SEQ ID NO: 1262964 - DNA, 18 bp, Homo sapiens
cctttaaagtatgaatct

SEQ ID NO: 1262965 - DNA, 22 bp, Homo sapiens
cctttaaagtatgaatctatgc

SEQ ID NO: 1262966 - DNA, 16 bp, Homo sapiens
cctttaacagaaactt

SEQ ID NO: 1262967 - DNA, 12 bp, Homo sapiens
cctttaactctg

SEQ ID NO: 1262968 - DNA, 16 bp, Homo sapiens
cctttaagaaccttaa

SEQ ID NO: 1262969 - DNA, 21 bp, Homo sapiens
cctttaagaaccttaatgaca

SEQ ID NO: 1262970 - DNA, 20 bp, Homo sapiens
cctttaagatatccatcttt

SEQ ID NO: 1262971 - DNA, 23 bp, Homo sapiens
cctttaagccaaagaaacaagct

SEQ ID NO: 1262972 - DNA, 13 bp, Homo sapiens
cctttaatatttt

SEQ ID NO: 1262973 - DNA, 13 bp, Homo sapiens
cctttaatgagaa

SEQ ID NO: 1262974 - DNA, 16 bp, Homo sapiens
cctttaatgagaaaaa

SEQ ID NO: 1262975 - DNA, 15 bp, Homo sapiens
cctttaattttcttg

SEQ ID NO: 1262976 - DNA, 15 bp, Homo sapiens
cctttacaactaaat

SEQ ID NO: 1262977 - DNA, 15 bp, Homo sapiens
cctttaccttttcta

SEQ ID NO: 1262978 - DNA, 16 bp, Homo sapiens
cctttaccttttctat

SEQ ID NO: 1262979 - DNA, 17 bp, Homo sapiens
cctttaccttttctata

SEQ ID NO: 1262980 - DNA, 19 bp, Homo sapiens
cctttacggacaccccctc

SEQ ID NO: 1262981 - DNA, 14 bp, Homo sapiens
cctttactgaatgt

SEQ ID NO: 1262982 - DNA, 14 bp, Homo sapiens
cctttactgatact

SEQ ID NO: 1262983 - DNA, 14 bp, Homo sapiens
cctttactgtgctt

SEQ ID NO: 1262984 - DNA, 13 bp, Homo sapiens
cctttactttccc

SEQ ID NO: 1262985 - DNA, 16 bp, Homo sapiens
cctttagaacaggaga

SEQ ID NO: 1262986 - DNA, 21 bp, Homo sapiens
cctttaggatgttttcctcct

SEQ ID NO: 1262987 - DNA, 19 bp, Homo sapiens
cctttaggcagcctgccgc

SEQ ID NO: 1262988 - DNA, 13 bp, Homo sapiens
cctttagggcagc

SEQ ID NO: 1262989 - DNA, 22 bp, Homo sapiens
cctttagggcagcttgccccgg

SEQ ID NO: 1262990 - DNA, 15 bp, Homo sapiens
cctttaggtctggtt

SEQ ID NO: 1262991 - DNA, 22 bp, Homo sapiens
cctttatcacctcattctgaac

SEQ ID NO: 1262992 - DNA, 19 bp, Homo sapiens
cctttatgtggaaaacaga

SEQ ID NO: 1262993 - DNA, 23 bp, Homo sapiens
cctttattaccccctccttcaga

SEQ ID NO: 1262994 - DNA, 14 bp, Homo sapiens
cctttattgcagtt

SEQ ID NO: 1262995 - DNA, 15 bp, Homo sapiens
cctttattttattga

SEQ ID NO: 1262996 - DNA, 21 bp, Homo sapiens
cctttattttattgaaatgta

SEQ ID NO: 1262997 - DNA, 22 bp, Homo sapiens
cctttattttattgaaatgtat

SEQ ID NO: 1262998 - DNA, 18 bp, Homo sapiens
cctttatttttctatctg

SEQ ID NO: 1262999 - DNA, 15 bp, Homo sapiens
cctttcaaatttcac

SEQ ID NO: 1263000 - DNA, 16 bp, Homo sapiens
cctttcaaatttcaca

SEQ ID NO: 1263001 - DNA, 18 bp, Homo sapiens
cctttcaagcggtgccta

SEQ ID NO: 1263002 - DNA, 17 bp, Homo sapiens
cctttcaaggaaagtga

SEQ ID NO: 1263003 - DNA, 21 bp, Homo sapiens
cctttcacaaaattttattcc

SEQ ID NO: 1263004 - DNA, 23 bp, Homo sapiens
cctttcacacatctgggtgccct

SEQ ID NO: 1263005 - DNA, 19 bp, Homo sapiens
cctttcaggtccaggccag

SEQ ID NO: 1263006 - DNA, 15 bp, Homo sapiens
cctttcagtcccaaa

SEQ ID NO: 1263007 - DNA, 18 bp, Homo sapiens
cctttcattaggcaaagt

SEQ ID NO: 1263008 - DNA, 23 bp, Homo sapiens
cctttccaccacagccagcacct

SEQ ID NO: 1263009 - DNA, 22 bp, Homo sapiens
cctttccagagaactgcagacc

SEQ ID NO: 1263010 - DNA, 19 bp, Homo sapiens
cctttcccaggtgctacac

SEQ ID NO: 1263011 - DNA, 18 bp, Homo sapiens
cctttcccccttctctta

SEQ ID NO: 1263012 - DNA, 14 bp, Homo sapiens
cctttccctggagc

SEQ ID NO: 1263013 - DNA, 13 bp, Homo sapiens
cctttcccttcct

SEQ ID NO: 1263014 - DNA, 14 bp, Homo sapiens
cctttcccttcctc

SEQ ID NO: 1263015 - DNA, 19 bp, Homo sapiens
cctttcctacatgccccct

SEQ ID NO: 1263016 - DNA, 16 bp, Homo sapiens
cctttcctccccacct

SEQ ID NO: 1263017 - DNA, 14 bp, Homo sapiens
cctttcctccccca

SEQ ID NO: 1263018 - DNA, 18 bp, Homo sapiens
cctttcctcggtctccct

SEQ ID NO: 1263019 - DNA, 21 bp, Homo sapiens
cctttcctctaactcactgcc

SEQ ID NO: 1263020 - DNA, 15 bp, Homo sapiens
cctttcctctccctc

SEQ ID NO: 1263021 - DNA, 19 bp, Homo sapiens
cctttcctctgcagcactt

SEQ ID NO: 1263022 - DNA, 15 bp, Homo sapiens
cctttcctggtttcc

SEQ ID NO: 1263023 - DNA, 13 bp, Homo sapiens
cctttcctgtagc

SEQ ID NO: 1263024 - DNA, 16 bp, Homo sapiens
cctttccttcactgcc

SEQ ID NO: 1263025 - DNA, 12 bp, Homo sapiens
cctttccttcct

SEQ ID NO: 1263026 - DNA, 15 bp, Homo sapiens
cctttctagcctggc

SEQ ID NO: 1263027 - DNA, 18 bp, Homo sapiens
cctttctatcgttctctc

SEQ ID NO: 1263028 - DNA, 14 bp, Homo sapiens
cctttctcatttct

SEQ ID NO: 1263029 - DNA, 17 bp, Homo sapiens
cctttctcatttctttc

SEQ ID NO: 1263030 - DNA, 13 bp, Homo sapiens
cctttctccagcc

SEQ ID NO: 1263031 - DNA, 22 bp, Homo sapiens
cctttctccagccagcaatgat

SEQ ID NO: 1263032 - DNA, 15 bp, Homo sapiens
cctttctcccagtga

SEQ ID NO: 1263033 - DNA, 14 bp, Homo sapiens
cctttctcctcccc

SEQ ID NO: 1263034 - DNA, 18 bp, Homo sapiens
cctttctcctccccacct

SEQ ID NO: 1263035 - DNA, 19 bp, Homo sapiens
cctttctcctccccacctg

SEQ ID NO: 1263036 - DNA, 15 bp, Homo sapiens
cctttctcctgtgaa

SEQ ID NO: 1263037 - DNA, 23 bp, Homo sapiens
cctttctcctgtgaatggaggca

SEQ ID NO: 1263038 - DNA, 13 bp, Homo sapiens
cctttctctcctg

SEQ ID NO: 1263039 - DNA, 15 bp, Homo sapiens
cctttctctctcctc

SEQ ID NO: 1263040 - DNA, 17 bp, Homo sapiens
cctttctctctcctctc

SEQ ID NO: 1263041 - DNA, 21 bp, Homo sapiens
cctttctctctcctctctgct

SEQ ID NO: 1263042 - DNA, 16 bp, Homo sapiens
cctttctctttctctc

SEQ ID NO: 1263043 - DNA, 17 bp, Homo sapiens
cctttctctttctctct

SEQ ID NO: 1263044 - DNA, 13 bp, Homo sapiens
cctttctgactgt

SEQ ID NO: 1263045 - DNA, 18 bp, Homo sapiens
cctttctgcccacttccc

SEQ ID NO: 1263046 - DNA, 18 bp, Homo sapiens
cctttctgccccccaggg

SEQ ID NO: 1263047 - DNA, 13 bp, Homo sapiens
cctttctggcccc

SEQ ID NO: 1263048 - DNA, 13 bp, Homo sapiens
cctttctggcctg

SEQ ID NO: 1263049 - DNA, 13 bp, Homo sapiens
cctttctgggagg

SEQ ID NO: 1263050 - DNA, 15 bp, Homo sapiens
cctttctgggctttc

SEQ ID NO: 1263051 - DNA, 16 bp, Homo sapiens
cctttctgggctttct

SEQ ID NO: 1263052 - DNA, 19 bp, Homo sapiens
cctttctgggctttctcct

SEQ ID NO: 1263053 - DNA, 18 bp, Homo sapiens
cctttctgtgaagctaat

SEQ ID NO: 1263054 - DNA, 14 bp, Homo sapiens
cctttctgtgccct

SEQ ID NO: 1263055 - DNA, 20 bp, Homo sapiens
cctttctgttgccagtcagc

SEQ ID NO: 1263056 - DNA, 10 bp, Homo sapiens
cctttcttct

SEQ ID NO: 1263057 - DNA, 16 bp, Homo sapiens
cctttcttctgtgtta

SEQ ID NO: 1263058 - DNA, 14 bp, Homo sapiens
cctttcttgacaaa

SEQ ID NO: 1263059 - DNA, 13 bp, Homo sapiens
cctttcttggcca

SEQ ID NO: 1263060 - DNA, 13 bp, Homo sapiens
cctttcttggttc

SEQ ID NO: 1263061 - DNA, 20 bp, Homo sapiens
cctttcttgtgccctgggcc

SEQ ID NO: 1263062 - DNA, 12 bp, Homo sapiens
cctttcttttcc

SEQ ID NO: 1263063 - DNA, 15 bp, Homo sapiens
cctttctttttcttc

SEQ ID NO: 1263064 - DNA, 22 bp, Homo sapiens
cctttgaaatattaaaatcact

SEQ ID NO: 1263065 - DNA, 22 bp, Homo sapiens
cctttgaacttgattgcctatg

SEQ ID NO: 1263066 - DNA, 20 bp, Homo sapiens
cctttgaagcctcagctacc

SEQ ID NO: 1263067 - DNA, 14 bp, Homo sapiens
cctttgacttcagc

SEQ ID NO: 1263068 - DNA, 18 bp, Homo sapiens
cctttgagaatgtgattc

SEQ ID NO: 1263069 - DNA, 22 bp, Homo sapiens
cctttgagatctggggaggcag

SEQ ID NO: 1263070 - DNA, 22 bp, Homo sapiens
cctttgagtgcagtcctgatca

SEQ ID NO: 1263071 - DNA, 16 bp, Homo sapiens
cctttgatcacaggag

SEQ ID NO: 1263072 - DNA, 16 bp, Homo sapiens
cctttgatcccagaaa

SEQ ID NO: 1263073 - DNA, 17 bp, Homo sapiens
cctttgcactgagggcc

SEQ ID NO: 1263074 - DNA, 19 bp, Homo sapiens
cctttgcactgagggccac

SEQ ID NO: 1263075 - DNA, 19 bp, Homo sapiens
cctttgcagtgtgcagggt

SEQ ID NO: 1263076 - DNA, 22 bp, Homo sapiens
cctttgcatggcagggcctcat

SEQ ID NO: 1263077 - DNA, 22 bp, Homo sapiens
cgagaccgggccctgggttcct

SEQ ID NO: 1263078 - DNA, 14 bp, Homo sapiens
cgagactttccatt

SEQ ID NO: 1263079 - DNA, 21 bp, Homo sapiens
cgagagagcacccctctctgc

SEQ ID NO: 1263080 - DNA, 17 bp, Homo sapiens
cgagagcagtgggcagg

SEQ ID NO: 1263081 - DNA, 14 bp, Homo sapiens
cgagagcctgctcc

SEQ ID NO: 1263082 - DNA, 15 bp, Homo sapiens
cgagagcctgctccc

SEQ ID NO: 1263083 - DNA, 19 bp, Homo sapiens
cgagaggccaaaggctggt

SEQ ID NO: 1263084 - DNA, 14 bp, Homo sapiens
cgagagggagagag

SEQ ID NO: 1263085 - DNA, 19 bp, Homo sapiens
cgagaggtgggccagtctg

SEQ ID NO: 1263086 - DNA, 20 bp, Homo sapiens
cgagaggtgggccagtctgt

SEQ ID NO: 1263087 - DNA, 22 bp, Homo sapiens
cgagaggtgggccagtctgtgg

SEQ ID NO: 1263088 - DNA, 14 bp, Homo sapiens
cgagagtgtgctct

SEQ ID NO: 1263089 - DNA, 21 bp, Homo sapiens
cgagataccatctcacaccag

SEQ ID NO: 1263090 - DNA, 13 bp, Homo sapiens
cgagatttctttt

SEQ ID NO: 1263091 - DNA, 22 bp, Homo sapiens
cgagatttcttttttatgtgat

SEQ ID NO: 1263092 - DNA, 23 bp, Homo sapiens
cgagatttgccaggggcatccaa

SEQ ID NO: 1263093 - DNA, 20 bp, Homo sapiens
cgagcaaacccagaggtgga

SEQ ID NO: 1263094 - DNA, 23 bp, Homo sapiens
cgagcaaacccagaggtggatgt

SEQ ID NO: 1263095 - DNA, 20 bp, Homo sapiens
cgagcaaagatcaaaataaa

SEQ ID NO: 1263096 - DNA, 13 bp, Homo sapiens
cgagcacctccac

SEQ ID NO: 1263097 - DNA, 22 bp, Homo sapiens
cgagcactctaattagagaact

SEQ ID NO: 1263098 - DNA, 15 bp, Homo sapiens
cgagcactggccaga

SEQ ID NO: 1263099 - DNA, 18 bp, Homo sapiens
cgagcactggccagagag

SEQ ID NO: 1263100 - DNA, 21 bp, Homo sapiens
cgagcagtcctgcctcagcct

SEQ ID NO: 1263101 - DNA, 21 bp, Homo sapiens
cgagcatccccctcctctccc

SEQ ID NO: 1263102 - DNA, 15 bp, Homo sapiens
cgagcatcctggcca

SEQ ID NO: 1263103 - DNA, 20 bp, Homo sapiens
cgagcatgcggagccagcag

SEQ ID NO: 1263104 - DNA, 18 bp, Homo sapiens
cgagcattccagtaactt

SEQ ID NO: 1263105 - DNA, 21 bp, Homo sapiens
cgagcattccagtaacttttt

SEQ ID NO: 1263106 - DNA, 14 bp, Homo sapiens
cgagccacaagctg

SEQ ID NO: 1263107 - DNA, 18 bp, Homo sapiens
cgagccacaagctgcact

SEQ ID NO: 1263108 - DNA, 20 bp, Homo sapiens
cgagccacaggaacggccct

SEQ ID NO: 1263109 - DNA, 17 bp, Homo sapiens
cgagccacgcagtgcct

SEQ ID NO: 1263110 - DNA, 22 bp, Homo sapiens
cgagccacgcagtgcctggagt

SEQ ID NO: 1263111 - DNA, 16 bp, Homo sapiens
cgagcccaggcagcta

SEQ ID NO: 1263112 - DNA, 14 bp, Homo sapiens
cgagcccctcggct

SEQ ID NO: 1263113 - DNA, 16 bp, Homo sapiens
cgagcccctcggctct

SEQ ID NO: 1263114 - DNA, 18 bp, Homo sapiens
cgagcccctcggctctgg

SEQ ID NO: 1263115 - DNA, 14 bp, Homo sapiens
cgagccctccccca

SEQ ID NO: 1263116 - DNA, 13 bp, Homo sapiens
cgagccctgactc

SEQ ID NO: 1263117 - DNA, 16 bp, Homo sapiens
cgagccctgactcctg

SEQ ID NO: 1263118 - DNA, 17 bp, Homo sapiens
cgagccctgactcctgg

SEQ ID NO: 1263119 - DNA, 18 bp, Homo sapiens
cgagccctgactcctgga

SEQ ID NO: 1263120 - DNA, 15 bp, Homo sapiens
cgagcctaatgaaag

SEQ ID NO: 1263121 - DNA, 16 bp, Homo sapiens
cgagcctcctcagggg

SEQ ID NO: 1263122 - DNA, 17 bp, Homo sapiens
cgagcctgtgccttcct

SEQ ID NO: 1263123 - DNA, 22 bp, Homo sapiens
cgagcgacggctcctccccgat

SEQ ID NO: 1263124 - DNA, 14 bp, Homo sapiens
cgagctcctgggga

SEQ ID NO: 1263125 - DNA, 18 bp, Homo sapiens
cgagctcgtgtatcctgg

SEQ ID NO: 1263126 - DNA, 22 bp, Homo sapiens
cgagctctcaaatccctctcca

SEQ ID NO: 1263127 - DNA, 15 bp, Homo sapiens
cgagctgctctgcta

SEQ ID NO: 1263128 - DNA, 13 bp, Homo sapiens
cgagctgggggcc

SEQ ID NO: 1263129 - DNA, 14 bp, Homo sapiens
cgagctggtgcatt

SEQ ID NO: 1263130 - DNA, 15 bp, Homo sapiens
cgagctggtgcatta

SEQ ID NO: 1263131 - DNA, 20 bp, Homo sapiens
cgaggaaaaggtccttgcct

SEQ ID NO: 1263132 - DNA, 15 bp, Homo sapiens
cgaggaaaggatttt

SEQ ID NO: 1263133 - DNA, 16 bp, Homo sapiens
cgaggaactccaggac

SEQ ID NO: 1263134 - DNA, 13 bp, Homo sapiens
cgaggagcagcag

SEQ ID NO: 1263135 - DNA, 15 bp, Homo sapiens
cgaggagcagcagcg

SEQ ID NO: 1263136 - DNA, 13 bp, Homo sapiens
cgaggagctgggc

SEQ ID NO: 1263137 - DNA, 15 bp, Homo sapiens
cgaggaggaggagta

SEQ ID NO: 1263138 - DNA, 13 bp, Homo sapiens
cgaggagtaacaa

SEQ ID NO: 1263139 - DNA, 15 bp, Homo sapiens
cgaggcaccggcgct

SEQ ID NO: 1263140 - DNA, 20 bp, Homo sapiens
cgaggcaccggcgctgcagg

SEQ ID NO: 1263141 - DNA, 22 bp, Homo sapiens
cgaggcaccggcgctgcaggta

SEQ ID NO: 1263142 - DNA, 14 bp, Homo sapiens
cgaggccactcaga

SEQ ID NO: 1263143 - DNA, 11 bp, Homo sapiens
cgaggccagta

SEQ ID NO: 1263144 - DNA, 19 bp, Homo sapiens
cgaggcccagatccaaggc

SEQ ID NO: 1263145 - DNA, 20 bp, Homo sapiens
cgaggcccagatccaaggcc

SEQ ID NO: 1263146 - DNA, 15 bp, Homo sapiens
cgaggcccccgacca

SEQ ID NO: 1263147 - DNA, 19 bp, Homo sapiens
cgaggcctacagaggaggc

SEQ ID NO: 1263148 - DNA, 17 bp, Homo sapiens
cgaggcctaccccgcag

SEQ ID NO: 1263149 - DNA, 22 bp, Homo sapiens
cgaggcctctctcaggagcagg

SEQ ID NO: 1263150 - DNA, 10 bp, Homo sapiens
cgaggcctga

SEQ ID NO: 1263151 - DNA, 11 bp, Homo sapiens
cgaggcctgaa

SEQ ID NO: 1263152 - DNA, 14 bp, Homo sapiens
cgaggctccccgcc

SEQ ID NO: 1263153 - DNA, 13 bp, Homo sapiens
cgaggctgagaat

SEQ ID NO: 1263154 - DNA, 20 bp, Homo sapiens
cgaggctgagaatcagactg

SEQ ID NO: 1263155 - DNA, 17 bp, Homo sapiens
cgaggctgccccaggcc

SEQ ID NO: 1263156 - DNA, 11 bp, Homo sapiens
cgaggctgcta

SEQ ID NO: 1263157 - DNA, 12 bp, Homo sapiens
cgaggctgctag

SEQ ID NO: 1263158 - DNA, 16 bp, Homo sapiens
cgaggctggagctggc

SEQ ID NO: 1263159 - DNA, 13 bp, Homo sapiens
cgaggctggtggt

SEQ ID NO: 1263160 - DNA, 19 bp, Homo sapiens
cgaggctggtggttttcag

SEQ ID NO: 1263161 - DNA, 17 bp, Homo sapiens
cgagggcaacagggagc

SEQ ID NO: 1263162 - DNA, 16 bp, Homo sapiens
cgagggcagctgctat

SEQ ID NO: 1263163 - DNA, 15 bp, Homo sapiens
cgagggccaggcaga

SEQ ID NO: 1263164 - DNA, 18 bp, Homo sapiens
cgagggccgcctgcctta

SEQ ID NO: 1263165 - DNA, 21 bp, Homo sapiens
cgagggcgaaggccattgggt

SEQ ID NO: 1263166 - DNA, 17 bp, Homo sapiens
cgagggcggccagggac

SEQ ID NO: 1263167 - DNA, 11 bp, Homo sapiens
cgagggctcag

SEQ ID NO: 1263168 - DNA, 23 bp, Homo sapiens
cgagggctcagaagagcagcttc

SEQ ID NO: 1263169 - DNA, 13 bp, Homo sapiens
cgagggctgagga

SEQ ID NO: 1263170 - DNA, 21 bp, Homo sapiens
cgagggctgaggagcagccag

SEQ ID NO: 1263171 - DNA, 11 bp, Homo sapiens
cgagggctggc

SEQ ID NO: 1263172 - DNA, 20 bp, Homo sapiens
cgaggggacccatgggggct

SEQ ID NO: 1263173 - DNA, 12 bp, Homo sapiens
cgaggggagggc

SEQ ID NO: 1263174 - DNA, 19 bp, Homo sapiens
cgaggggccagcagagggc

SEQ ID NO: 1263175 - DNA, 15 bp, Homo sapiens
cgagggggccggggg

SEQ ID NO: 1263176 - DNA, 19 bp, Homo sapiens
cgagggggccggggggagg

SEQ ID NO: 1263177 - DNA, 20 bp, Homo sapiens
cgagggggccggggggaggg

SEQ ID NO: 1263178 - DNA, 18 bp, Homo sapiens
cgaggggtgtcttgggca

SEQ ID NO: 1263179 - DNA, 15 bp, Homo sapiens
cgagggtcctggctc

SEQ ID NO: 1263180 - DNA, 20 bp, Homo sapiens
cgagggtctcccctcctgca

SEQ ID NO: 1263181 - DNA, 17 bp, Homo sapiens
cgaggtcaacagagaag

SEQ ID NO: 1263182 - DNA, 21 bp, Homo sapiens
cgaggttcccagggctggaga

SEQ ID NO: 1263183 - DNA, 14 bp, Homo sapiens
cgaggttgtgggga

SEQ ID NO: 1263184 - DNA, 18 bp, Homo sapiens
cgaggttgtggggaggct

SEQ ID NO: 1263185 - DNA, 19 bp, Homo sapiens
cgaggttgtggggaggctg

SEQ ID NO: 1263186 - DNA, 16 bp, Homo sapiens
cgagtaaacttgaaaa

SEQ ID NO: 1263187 - DNA, 20 bp, Homo sapiens
cgagtagatgaacctgcagc

SEQ ID NO: 1263188 - DNA, 19 bp, Homo sapiens
cgagtagctgggattacag

SEQ ID NO: 1263189 - DNA, 20 bp, Homo sapiens
cgagtcaatcccctcattca

SEQ ID NO: 1263190 - DNA, 21 bp, Homo sapiens
cgagtcaattaaacagctggt

SEQ ID NO: 1263191 - DNA, 13 bp, Homo sapiens
cgagtccaagctg

SEQ ID NO: 1263192 - DNA, 18 bp, Homo sapiens
cgagtctcttctccactg

SEQ ID NO: 1263193 - DNA, 16 bp, Homo sapiens
cgagtctgggacacaa

SEQ ID NO: 1263194 - DNA, 21 bp, Homo sapiens
cgagtctggggacctggcact

SEQ ID NO: 1263195 - DNA, 22 bp, Homo sapiens
cgagtctttgtgtgttatattc

SEQ ID NO: 1263196 - DNA, 22 bp, Homo sapiens
cgagtgaatttctaaatgttgg

SEQ ID NO: 1263197 - DNA, 23 bp, Homo sapiens
cgagtgcccctgtcccacctggc

SEQ ID NO: 1263198 - DNA, 13 bp, Homo sapiens
cgagtgggaagga

SEQ ID NO: 1263199 - DNA, 16 bp, Homo sapiens
cgccattggttggaag

SEQ ID NO: 1263200 - DNA, 21 bp, Homo sapiens
cgccattggttggaagctacc

SEQ ID NO: 1263201 - DNA, 22 bp, Homo sapiens
cgcccacaggaagcctgcagtc

SEQ ID NO: 1263202 - DNA, 16 bp, Homo sapiens
cgcccacccgagtacc

SEQ ID NO: 1263203 - DNA, 23 bp, Homo sapiens
cgcccaccgtgggcagtgccacc

SEQ ID NO: 1263204 - DNA, 22 bp, Homo sapiens
cgcccacctcgctcccctctgg

SEQ ID NO: 1263205 - DNA, 23 bp, Homo sapiens
cgcccacctcgctcccctctgga

SEQ ID NO: 1263206 - DNA, 12 bp, Homo sapiens
cgcccactgtcc

SEQ ID NO: 1263207 - DNA, 14 bp, Homo sapiens
cgcccaggacagct

SEQ ID NO: 1263208 - DNA, 11 bp, Homo sapiens
cgcccaggaga

SEQ ID NO: 1263209 - DNA, 20 bp, Homo sapiens
cgcccaggcctgggatgcag

SEQ ID NO: 1263210 - DNA, 21 bp, Homo sapiens
cgcccaggcctgggatgcagt

SEQ ID NO: 1263211 - DNA, 14 bp, Homo sapiens
cgcccagtccttcc

SEQ ID NO: 1263212 - DNA, 19 bp, Homo sapiens
cgcccattcgtctgtccca

SEQ ID NO: 1263213 - DNA, 13 bp, Homo sapiens
cgccccacagggc

SEQ ID NO: 1263214 - DNA, 12 bp, Homo sapiens
cgccccagcccg

SEQ ID NO: 1263215 - DNA, 16 bp, Homo sapiens
cgccccagccctcagt

SEQ ID NO: 1263216 - DNA, 14 bp, Homo sapiens
cgccccaggccctc

SEQ ID NO: 1263217 - DNA, 18 bp, Homo sapiens
cgccccatccctgcttgc

SEQ ID NO: 1263218 - DNA, 11 bp, Homo sapiens
cgcccccaccg

SEQ ID NO: 1263219 - DNA, 16 bp, Homo sapiens
cgcccccaccgggctg

SEQ ID NO: 1263220 - DNA, 13 bp, Homo sapiens
cgcccccagccta

SEQ ID NO: 1263221 - DNA, 22 bp, Homo sapiens
cgcccccagtccccacccctgc

SEQ ID NO: 1263222 - DNA, 18 bp, Homo sapiens
cgccccccacacttccct

SEQ ID NO: 1263223 - DNA, 20 bp, Homo sapiens
cgccccccacacttccctgg

SEQ ID NO: 1263224 - DNA, 13 bp, Homo sapiens
cgccccccacctt

SEQ ID NO: 1263225 - DNA, 13 bp, Homo sapiens
cgccccccagagc

SEQ ID NO: 1263226 - DNA, 14 bp, Homo sapiens
cgccccccagagcc

SEQ ID NO: 1263227 - DNA, 16 bp, Homo sapiens
cgccccccagagccag

SEQ ID NO: 1263228 - DNA, 20 bp, Homo sapiens
cgccccccagagccagggct

SEQ ID NO: 1263229 - DNA, 21 bp, Homo sapiens
cgccccccagagccagggctg

SEQ ID NO: 1263230 - DNA, 17 bp, Homo sapiens
cgcccccccctccccat

SEQ ID NO: 1263231 - DNA, 10 bp, Homo sapiens
cgcccccgcc

SEQ ID NO: 1263232 - DNA, 11 bp, Homo sapiens
cgcccccgccc

SEQ ID NO: 1263233 - DNA, 12 bp, Homo sapiens
cgccccctgccc

SEQ ID NO: 1263234 - DNA, 14 bp, Homo sapiens
cgccccctgccctc

SEQ ID NO: 1263235 - DNA, 16 bp, Homo sapiens
cgccccgcacccccgc

SEQ ID NO: 1263236 - DNA, 21 bp, Homo sapiens
cgccccgcacccccgccaggc

SEQ ID NO: 1263237 - DNA, 16 bp, Homo sapiens
cgccccgcctgacctg

SEQ ID NO: 1263238 - DNA, 19 bp, Homo sapiens
cgccccgctgtgtcctccc

SEQ ID NO: 1263239 - DNA, 20 bp, Homo sapiens
cgccccgctgtgtcctccct

SEQ ID NO: 1263240 - DNA, 15 bp, Homo sapiens
cgccccgggctggcc

SEQ ID NO: 1263241 - DNA, 17 bp, Homo sapiens
cgccccgggctggccct

SEQ ID NO: 1263242 - DNA, 19 bp, Homo sapiens
cgccccgggctggccctgt

SEQ ID NO: 1263243 - DNA, 23 bp, Homo sapiens
cgccccgggctggccctgtgcag

SEQ ID NO: 1263244 - DNA, 15 bp, Homo sapiens
cgcccctccaaacct

SEQ ID NO: 1263245 - DNA, 20 bp, Homo sapiens
cgcccctccaaacctccagc

SEQ ID NO: 1263246 - DNA, 18 bp, Homo sapiens
cgcccctcgctgctgcta

SEQ ID NO: 1263247 - DNA, 12 bp, Homo sapiens
cgcccctgaggc

SEQ ID NO: 1263248 - DNA, 13 bp, Homo sapiens
cgcccctgcctgc

SEQ ID NO: 1263249 - DNA, 18 bp, Homo sapiens
cgcccctgcctgccatgt

SEQ ID NO: 1263250 - DNA, 18 bp, Homo sapiens
cgcccctgtggccctggc

SEQ ID NO: 1263251 - DNA, 21 bp, Homo sapiens
cgcccgactagcaggcatgcc

SEQ ID NO: 1263252 - DNA, 21 bp, Homo sapiens
cgcccgagggatggtgcccct

SEQ ID NO: 1263253 - DNA, 14 bp, Homo sapiens
cgcccgcccctcag

SEQ ID NO: 1263254 - DNA, 12 bp, Homo sapiens
cgcccgcgccct

SEQ ID NO: 1263255 - DNA, 14 bp, Homo sapiens
cgcccgctgagctg

SEQ ID NO: 1263256 - DNA, 14 bp, Homo sapiens
cgcccgctgggctg

SEQ ID NO: 1263257 - DNA, 16 bp, Homo sapiens
cgcccgctgggctgag

SEQ ID NO: 1263258 - DNA, 19 bp, Homo sapiens
cgcccggctaatgtttgta

SEQ ID NO: 1263259 - DNA, 16 bp, Homo sapiens
cgcccgtggggtctgc

SEQ ID NO: 1263260 - DNA, 15 bp, Homo sapiens
cgccctactccactg

SEQ ID NO: 1263261 - DNA, 16 bp, Homo sapiens
cgccctactccactgc

SEQ ID NO: 1263262 - DNA, 13 bp, Homo sapiens
cgccctcacctct

SEQ ID NO: 1263263 - DNA, 15 bp, Homo sapiens
cgccctcactattct

SEQ ID NO: 1263264 - DNA, 16 bp, Homo sapiens
cgccctccctccgcct

SEQ ID NO: 1263265 - DNA, 14 bp, Homo sapiens
cgccctccgacctc

SEQ ID NO: 1263266 - DNA, 12 bp, Homo sapiens
cgccctcctcca

SEQ ID NO: 1263267 - DNA, 17 bp, Homo sapiens
cgccctcctccacttgg

SEQ ID NO: 1263268 - DNA, 12 bp, Homo sapiens
cgccctctctgc

SEQ ID NO: 1263269 - DNA, 17 bp, Homo sapiens
cgccctctgaaattaaa

SEQ ID NO: 1263270 - DNA, 13 bp, Homo sapiens
cgccctcttcctg

SEQ ID NO: 1263271 - DNA, 12 bp, Homo sapiens
cgccctgagaga

SEQ ID NO: 1263272 - DNA, 23 bp, Homo sapiens
cgccctgagagagaatagagctg

SEQ ID NO: 1263273 - DNA, 14 bp, Homo sapiens
cgccctgccactca

SEQ ID NO: 1263274 - DNA, 14 bp, Homo sapiens
cgccctgcctcctg

SEQ ID NO: 1263275 - DNA, 15 bp, Homo sapiens
cgccctgcctcctgg

SEQ ID NO: 1263276 - DNA, 17 bp, Homo sapiens
cgccctgcctcctggag

SEQ ID NO: 1263277 - DNA, 18 bp, Homo sapiens
cgccctgcgttggagcca

SEQ ID NO: 1263278 - DNA, 21 bp, Homo sapiens
cgccctgctcctccctggctg

SEQ ID NO: 1263279 - DNA, 15 bp, Homo sapiens
cgccctgggctggac

SEQ ID NO: 1263280 - DNA, 17 bp, Homo sapiens
cgccctgggctggactg

SEQ ID NO: 1263281 - DNA, 15 bp, Homo sapiens
cgccctgggctgtct

SEQ ID NO: 1263282 - DNA, 19 bp, Homo sapiens
cgccctgtgtgtgtcccct

SEQ ID NO: 1263283 - DNA, 21 bp, Homo sapiens
cgcccttctcccggccctcac

SEQ ID NO: 1263284 - DNA, 16 bp, Homo sapiens
cgcccttgaggggccc

SEQ ID NO: 1263285 - DNA, 18 bp, Homo sapiens
cgcccttgaggggcccca

SEQ ID NO: 1263286 - DNA, 16 bp, Homo sapiens
cgccctttcctcctca

SEQ ID NO: 1263287 - DNA, 20 bp, Homo sapiens
cgccgactccctgagtctgg

SEQ ID NO: 1263288 - DNA, 23 bp, Homo sapiens
cgccgagttaaagaggagaagga

SEQ ID NO: 1263289 - DNA, 17 bp, Homo sapiens
cgccgatcccaggtgcg

SEQ ID NO: 1263290 - DNA, 19 bp, Homo sapiens
cgccgcaaaccacactgga

SEQ ID NO: 1263291 - DNA, 21 bp, Homo sapiens
cgccgcaaaccacactggact

SEQ ID NO: 1263292 - DNA, 19 bp, Homo sapiens
cgccgcagaagcagcccct

SEQ ID NO: 1263293 - DNA, 22 bp, Homo sapiens
cgccgcagaagcagcccctcga

SEQ ID NO: 1263294 - DNA, 12 bp, Homo sapiens
cgccgcctcttt

SEQ ID NO: 1263295 - DNA, 15 bp, Homo sapiens
cgccggcctctgctg

SEQ ID NO: 1263296 - DNA, 18 bp, Homo sapiens
cgccggcctctgctgccc

SEQ ID NO: 1263297 - DNA, 18 bp, Homo sapiens
cgccgggcaccaactcca

SEQ ID NO: 1263298 - DNA, 13 bp, Homo sapiens
cgccgggcaggcc

SEQ ID NO: 1263299 - DNA, 14 bp, Homo sapiens
cgccgggcaggcct

SEQ ID NO: 1263300 - DNA, 15 bp, Homo sapiens
cgccgtctccagggg

SEQ ID NO: 1263301 - DNA, 16 bp, Homo sapiens
cgccgtctgcaggggc

SEQ ID NO: 1263302 - DNA, 21 bp, Homo sapiens
cgccgtgccggcggcagcccc

SEQ ID NO: 1263303 - DNA, 22 bp, Homo sapiens
cgccgtgccggcggcagcccca

SEQ ID NO: 1263304 - DNA, 15 bp, Homo sapiens
cgccgtgctgggcag

SEQ ID NO: 1263305 - DNA, 16 bp, Homo sapiens
cgcctatgatcccagc

SEQ ID NO: 1263306 - DNA, 14 bp, Homo sapiens
cgcctatgccctgc

SEQ ID NO: 1263307 - DNA, 15 bp, Homo sapiens
cgcctatgccctgcc

SEQ ID NO: 1263308 - DNA, 17 bp, Homo sapiens
cgcctcagccctcagtt

SEQ ID NO: 1263309 - DNA, 19 bp, Homo sapiens
cgcctcagttacacaggaa

SEQ ID NO: 1263310 - DNA, 22 bp, Homo sapiens
cgcctcagttacacaggaaccc

SEQ ID NO: 1263311 - DNA, 17 bp, Homo sapiens
cgcctccaaccctagca

SEQ ID NO: 1263312 - DNA, 15 bp, Homo sapiens
cgcctccactctagt

SEQ ID NO: 1263313 - DNA, 18 bp, Homo sapiens
cgcctccatccaaggcca

SEQ ID NO: 1263314 - DNA, 13 bp, Homo sapiens
cgcctcccatccc

SEQ ID NO: 1263315 - DNA, 18 bp, Homo sapiens
cgcctccctccaccccag

SEQ ID NO: 1263316 - DNA, 22 bp, Homo sapiens
cgcctccctctcagaggcctgc

SEQ ID NO: 1263317 - DNA, 12 bp, Homo sapiens
cgcctcctccca

SEQ ID NO: 1263318 - DNA, 14 bp, Homo sapiens
cgcctcctggccag

SEQ ID NO: 1263319 - DNA, 16 bp, Homo sapiens
cgcctcgtgccagcag

SEQ ID NO: 1263320 - DNA, 17 bp, Homo sapiens
cgcctctccctgcactc

SEQ ID NO: 1263321 - DNA, 15 bp, Homo sapiens
cgcctcttgaccagg

SEQ ID NO: 1263322 - DNA, 22 bp, Homo sapiens
cggcaggcgtgtggcagccaca

SEQ ID NO: 1263323 - DNA, 20 bp, Homo sapiens
cggcagggcgggcagagggc

SEQ ID NO: 1263324 - DNA, 23 bp, Homo sapiens
cggcagggcgggcagagggctgg

SEQ ID NO: 1263325 - DNA, 19 bp, Homo sapiens
cggcaggggcctggagatc

SEQ ID NO: 1263326 - DNA, 17 bp, Homo sapiens
cggcagtgggcctgctg

SEQ ID NO: 1263327 - DNA, 22 bp, Homo sapiens
cggcagtgggcctgctgaggcc

SEQ ID NO: 1263328 - DNA, 23 bp, Homo sapiens
cggcatccttgcctgtctaaagc

SEQ ID NO: 1263329 - DNA, 19 bp, Homo sapiens
cggcatgaaccctcttgcc

SEQ ID NO: 1263330 - DNA, 22 bp, Homo sapiens
cggcatgggaaagccacctctc

SEQ ID NO: 1263331 - DNA, 23 bp, Homo sapiens
cggccaagtaaaatgttttttaa

SEQ ID NO: 1263332 - DNA, 14 bp, Homo sapiens
cggccacacccagc

SEQ ID NO: 1263333 - DNA, 18 bp, Homo sapiens
cggccacacccagcggcc

SEQ ID NO: 1263334 - DNA, 16 bp, Homo sapiens
cggccacagctgctgg

SEQ ID NO: 1263335 - DNA, 14 bp, Homo sapiens
cggccacatcattc

SEQ ID NO: 1263336 - DNA, 19 bp, Homo sapiens
cggccacatcattctgtgt

SEQ ID NO: 1263337 - DNA, 11 bp, Homo sapiens
cggccaccctc

SEQ ID NO: 1263338 - DNA, 19 bp, Homo sapiens
cggccactgtgtctctgtt

SEQ ID NO: 1263339 - DNA, 21 bp, Homo sapiens
cggccactgtgtctctgtttc

SEQ ID NO: 1263340 - DNA, 16 bp, Homo sapiens
cggccaggctggagtg

SEQ ID NO: 1263341 - DNA, 18 bp, Homo sapiens
cggccagggacccaaagc

SEQ ID NO: 1263342 - DNA, 13 bp, Homo sapiens
cggccagggcggc

SEQ ID NO: 1263343 - DNA, 18 bp, Homo sapiens
cggccagggcggccaggg

SEQ ID NO: 1263344 - DNA, 20 bp, Homo sapiens
cggccagggcggccagggac

SEQ ID NO: 1263345 - DNA, 22 bp, Homo sapiens
cggccagtggccttccccagca

SEQ ID NO: 1263346 - DNA, 15 bp, Homo sapiens
cggcccaagcccgac

SEQ ID NO: 1263347 - DNA, 22 bp, Homo sapiens
cggcccaagcccgacttgctgt

SEQ ID NO: 1263348 - DNA, 15 bp, Homo sapiens
cggcccacacccagg

SEQ ID NO: 1263349 - DNA, 15 bp, Homo sapiens
cggcccagacccagc

SEQ ID NO: 1263350 - DNA, 20 bp, Homo sapiens
cggcccagagaccccttcct

SEQ ID NO: 1263351 - DNA, 21 bp, Homo sapiens
cggcccagagaccccttcctt

SEQ ID NO: 1263352 - DNA, 17 bp, Homo sapiens
cggcccagtgccactgc

SEQ ID NO: 1263353 - DNA, 18 bp, Homo sapiens
cggcccagtgccagctcc

SEQ ID NO: 1263354 - DNA, 19 bp, Homo sapiens
cggcccagtgccagctcca

SEQ ID NO: 1263355 - DNA, 21 bp, Homo sapiens
cggccccacccaccctctggt

SEQ ID NO: 1263356 - DNA, 14 bp, Homo sapiens
cggccccaccccct

SEQ ID NO: 1263357 - DNA, 17 bp, Homo sapiens
cggccccccgcacagcc

SEQ ID NO: 1263358 - DNA, 20 bp, Homo sapiens
cggccccccgcacagccacc

SEQ ID NO: 1263359 - DNA, 21 bp, Homo sapiens
cggccccccgcgctcgcccag

SEQ ID NO: 1263360 - DNA, 20 bp, Homo sapiens
cggcccccgcgcgcgtcccc

SEQ ID NO: 1263361 - DNA, 17 bp, Homo sapiens
cggccccctcaccccag

SEQ ID NO: 1263362 - DNA, 17 bp, Homo sapiens
cggccccctccatcggg

SEQ ID NO: 1263363 - DNA, 22 bp, Homo sapiens
cggccccctccccccagactct

SEQ ID NO: 1263364 - DNA, 19 bp, Homo sapiens
cggccccggccccagccag

SEQ ID NO: 1263365 - DNA, 14 bp, Homo sapiens
cggcccctcaccct

SEQ ID NO: 1263366 - DNA, 23 bp, Homo sapiens
cggcccctcaccctctgtcccca

SEQ ID NO: 1263367 - DNA, 13 bp, Homo sapiens
cggcccctggcag

SEQ ID NO: 1263368 - DNA, 16 bp, Homo sapiens
cggcccgcagcctggc

SEQ ID NO: 1263369 - DNA, 15 bp, Homo sapiens
cggcccgcctgccca

SEQ ID NO: 1263370 - DNA, 21 bp, Homo sapiens
cggcccgcctgcccagactga

SEQ ID NO: 1263371 - DNA, 12 bp, Homo sapiens
cggcccggcccc

SEQ ID NO: 1263372 - DNA, 18 bp, Homo sapiens
cggcccggcccctcaccc

SEQ ID NO: 1263373 - DNA, 19 bp, Homo sapiens
cggcccgtggacaccccag

SEQ ID NO: 1263374 - DNA, 13 bp, Homo sapiens
cggccctccccca

SEQ ID NO: 1263375 - DNA, 18 bp, Homo sapiens
cggccctcccccagctcc

SEQ ID NO: 1263376 - DNA, 22 bp, Homo sapiens
cggccctcctaccctgcgccca

SEQ ID NO: 1263377 - DNA, 14 bp, Homo sapiens
cggccctgaaccac

SEQ ID NO: 1263378 - DNA, 18 bp, Homo sapiens
cggccctgaaccacgagg

SEQ ID NO: 1263379 - DNA, 18 bp, Homo sapiens
cggccctgcaggagcagg

SEQ ID NO: 1263380 - DNA, 18 bp, Homo sapiens
cggcccttacctttcctg

SEQ ID NO: 1263381 - DNA, 21 bp, Homo sapiens
cggcccttacctttcctgatg

SEQ ID NO: 1263382 - DNA, 20 bp, Homo sapiens
cggccgatgggagtctccct

SEQ ID NO: 1263383 - DNA, 22 bp, Homo sapiens
cggccgatgggagtctccctcc

SEQ ID NO: 1263384 - DNA, 18 bp, Homo sapiens
cggccgcattccctgagt

SEQ ID NO: 1263385 - DNA, 19 bp, Homo sapiens
cggccgccccccgcccctc

SEQ ID NO: 1263386 - DNA, 23 bp, Homo sapiens
cggccgccttctcccctctccca

SEQ ID NO: 1263387 - DNA, 22 bp, Homo sapiens
cggccgcgccacccgggcaagg

SEQ ID NO: 1263388 - DNA, 18 bp, Homo sapiens
cggccggacctctgagca

SEQ ID NO: 1263389 - DNA, 19 bp, Homo sapiens
cggccgtcttcactcgccc

SEQ ID NO: 1263390 - DNA, 18 bp, Homo sapiens
cggcctcagggtctaagg

SEQ ID NO: 1263391 - DNA, 19 bp, Homo sapiens
cggcctccaggaggggcct

SEQ ID NO: 1263392 - DNA, 20 bp, Homo sapiens
cggcctccaggaggggcctg

SEQ ID NO: 1263393 - DNA, 13 bp, Homo sapiens
cggcctcccagag

SEQ ID NO: 1263394 - DNA, 21 bp, Homo sapiens
cggcctcccagagtgctggga

SEQ ID NO: 1263395 - DNA, 15 bp, Homo sapiens
cggcctccggcgtct

SEQ ID NO: 1263396 - DNA, 13 bp, Homo sapiens
cggcctctctggc

SEQ ID NO: 1263397 - DNA, 18 bp, Homo sapiens
cggcctctctggcctccc

SEQ ID NO: 1263398 - DNA, 15 bp, Homo sapiens
cggcctgatgctccc

SEQ ID NO: 1263399 - DNA, 23 bp, Homo sapiens
cggcctgatgctccctcccctgc

SEQ ID NO: 1263400 - DNA, 13 bp, Homo sapiens
cggcctgctccca

SEQ ID NO: 1263401 - DNA, 12 bp, Homo sapiens
cggcctgggcac

SEQ ID NO: 1263402 - DNA, 21 bp, Homo sapiens
cggcctgtgggtttgggtgcc

SEQ ID NO: 1263403 - DNA, 20 bp, Homo sapiens
cggccttccgggtctcgcag

SEQ ID NO: 1263404 - DNA, 11 bp, Homo sapiens
cggccttgctt

SEQ ID NO: 1263405 - DNA, 13 bp, Homo sapiens
cggccttgtctgg

SEQ ID NO: 1263406 - DNA, 17 bp, Homo sapiens
cggccttgtctgggtgc

SEQ ID NO: 1263407 - DNA, 20 bp, Homo sapiens
cggcctttatgttttttgta

SEQ ID NO: 1263408 - DNA, 19 bp, Homo sapiens
cggcgaggccggagagctg

SEQ ID NO: 1263409 - DNA, 15 bp, Homo sapiens
cggcgccaccatcct

SEQ ID NO: 1263410 - DNA, 17 bp, Homo sapiens
cggcgccaccatcctgc

SEQ ID NO: 1263411 - DNA, 22 bp, Homo sapiens
cggcgccccgcacccccgccag

SEQ ID NO: 1263412 - DNA, 18 bp, Homo sapiens
cggcgcccctgccacctc

SEQ ID NO: 1263413 - DNA, 18 bp, Homo sapiens
cggcgcctgccctgccca

SEQ ID NO: 1263414 - DNA, 19 bp, Homo sapiens
cggcgcctgccctgcccaa

SEQ ID NO: 1263415 - DNA, 16 bp, Homo sapiens
cggcgcttcccagcac

SEQ ID NO: 1263416 - DNA, 15 bp, Homo sapiens
cggcggaaagcctgt

SEQ ID NO: 1263417 - DNA, 13 bp, Homo sapiens
cggcggagctggc

SEQ ID NO: 1263418 - DNA, 19 bp, Homo sapiens
cggcggagctggccccgcc

SEQ ID NO: 1263419 - DNA, 21 bp, Homo sapiens
cggcggagctggccccgccgc

SEQ ID NO: 1263420 - DNA, 16 bp, Homo sapiens
cggcggctctgagcag

SEQ ID NO: 1263421 - DNA, 17 bp, Homo sapiens
cggcgggatcctccaca

SEQ ID NO: 1263422 - DNA, 15 bp, Homo sapiens
cggcggtagcagctg

SEQ ID NO: 1263423 - DNA, 19 bp, Homo sapiens
cggcggtcccagctccctg

SEQ ID NO: 1263424 - DNA, 21 bp, Homo sapiens
cggcggtggactgcgctggac

SEQ ID NO: 1263425 - DNA, 17 bp, Homo sapiens
cggcgtcttgcccagca

SEQ ID NO: 1263426 - DNA, 19 bp, Homo sapiens
cggcgtcttgcccagcagc

SEQ ID NO: 1263427 - DNA, 12 bp, Homo sapiens
cggctaacttat

SEQ ID NO: 1263428 - DNA, 19 bp, Homo sapiens
cggctaatgtttgtatttt

SEQ ID NO: 1263429 - DNA, 20 bp, Homo sapiens
cggctaatgtttgtattttt

SEQ ID NO: 1263430 - DNA, 17 bp, Homo sapiens
cggctacccctcgactc

SEQ ID NO: 1263431 - DNA, 12 bp, Homo sapiens
cggctactcagc

SEQ ID NO: 1263432 - DNA, 18 bp, Homo sapiens
cggctactcagcagccct

SEQ ID NO: 1263433 - DNA, 14 bp, Homo sapiens
cggctcagccttgc

SEQ ID NO: 1263434 - DNA, 16 bp, Homo sapiens
cggctcagccttgcac

SEQ ID NO: 1263435 - DNA, 15 bp, Homo sapiens
cggctccccatgtgt

SEQ ID NO: 1263436 - DNA, 14 bp, Homo sapiens
cggctcccctctgc

SEQ ID NO: 1263437 - DNA, 15 bp, Homo sapiens
cggctcccctctgct

SEQ ID NO: 1263438 - DNA, 14 bp, Homo sapiens
cggctccctggagc

SEQ ID NO: 1263439 - DNA, 19 bp, Homo sapiens
cggctccgagggcggccag

SEQ ID NO: 1263440 - DNA, 15 bp, Homo sapiens
cggctcctcagagcg

SEQ ID NO: 1263441 - DNA, 24 bp, Homo sapiens
cggctcctcctcacccacctctgg

SEQ ID NO: 1263442 - DNA, 13 bp, Homo sapiens
cggctcctcgccc

SEQ ID NO: 1263443 - DNA, 18 bp, Homo sapiens
cggtattaaaatggagcg

SEQ ID NO: 1263444 - DNA, 19 bp, Homo sapiens
cggtcagatttgctgttca

SEQ ID NO: 1263445 - DNA, 14 bp, Homo sapiens
cggtcagcgactgg

SEQ ID NO: 1263446 - DNA, 18 bp, Homo sapiens
cggtcaggtttaacattt

SEQ ID NO: 1263447 - DNA, 14 bp, Homo sapiens
cggtcatgtgtgca

SEQ ID NO: 1263448 - DNA, 13 bp, Homo sapiens
cggtccagctggc

SEQ ID NO: 1263449 - DNA, 14 bp, Homo sapiens
cggtccccatcccc

SEQ ID NO: 1263450 - DNA, 15 bp, Homo sapiens
cggtccccatcccca

SEQ ID NO: 1263451 - DNA, 20 bp, Homo sapiens
cggtccccatccccaccagc

SEQ ID NO: 1263452 - DNA, 15 bp, Homo sapiens
cggtcccttccatgc

SEQ ID NO: 1263453 - DNA, 18 bp, Homo sapiens
cggtcccttccatgccct

SEQ ID NO: 1263454 - DNA, 19 bp, Homo sapiens
cggtcccttgagacctcag

SEQ ID NO: 1263455 - DNA, 13 bp, Homo sapiens
cggtcctggtgcc

SEQ ID NO: 1263456 - DNA, 18 bp, Homo sapiens
cggtcctttaggcagcct

SEQ ID NO: 1263457 - DNA, 19 bp, Homo sapiens
cggtctcccttccgtccat

SEQ ID NO: 1263458 - DNA, 12 bp, Homo sapiens
cggtctgagcta

SEQ ID NO: 1263459 - DNA, 22 bp, Homo sapiens
cggtcttgcaaagcgacagatt

SEQ ID NO: 1263460 - DNA, 13 bp, Homo sapiens
cggtcttgggcac

SEQ ID NO: 1263461 - DNA, 21 bp, Homo sapiens
cggtgacacaggtcagggctc

SEQ ID NO: 1263462 - DNA, 23 bp, Homo sapiens
cggtgacacaggtcagggctcag

SEQ ID NO: 1263463 - DNA, 14 bp, Homo sapiens
cggtgaccccatca

SEQ ID NO: 1263464 - DNA, 20 bp, Homo sapiens
cggtgaggggaggggcctcc

SEQ ID NO: 1263465 - DNA, 21 bp, Homo sapiens
cggtgaggggaggggcctccc

SEQ ID NO: 1263466 - DNA, 14 bp, Homo sapiens
cggtgccaagggcc

SEQ ID NO: 1263467 - DNA, 18 bp, Homo sapiens
cggtgccaagggccccag

SEQ ID NO: 1263468 - DNA, 17 bp, Homo sapiens
cggtgccatgaagggac

SEQ ID NO: 1263469 - DNA, 23 bp, Homo sapiens
cggtgcccaaacaccagtcacct

SEQ ID NO: 1263470 - DNA, 14 bp, Homo sapiens
cggtgcccaagcca

SEQ ID NO: 1263471 - DNA, 20 bp, Homo sapiens
cggtgcccaagccagaggct

SEQ ID NO: 1263472 - DNA, 23 bp, Homo sapiens
cggtgcccaagccagaggctggg

SEQ ID NO: 1263473 - DNA, 15 bp, Homo sapiens
cggtgccgcgctccg

SEQ ID NO: 1263474 - DNA, 23 bp, Homo sapiens
cggtgccgcgctccgaaccccgg

SEQ ID NO: 1263475 - DNA, 16 bp, Homo sapiens
cggtgcctaagaagtt

SEQ ID NO: 1263476 - DNA, 10 bp, Homo sapiens
cggtgcctgg

SEQ ID NO: 1263477 - DNA, 11 bp, Homo sapiens
cggtgcctggc

SEQ ID NO: 1263478 - DNA, 17 bp, Homo sapiens
cggtgcctgggtggcca

SEQ ID NO: 1263479 - DNA, 22 bp, Homo sapiens
cggtgccttttttcacggaagt

SEQ ID NO: 1263480 - DNA, 18 bp, Homo sapiens
cggtgctaaaaatgaaaa

SEQ ID NO: 1263481 - DNA, 21 bp, Homo sapiens
cggtgctatttctattcctta

SEQ ID NO: 1263482 - DNA, 17 bp, Homo sapiens
cggtgctgggggcacag

SEQ ID NO: 1263483 - DNA, 22 bp, Homo sapiens
cggtgctgtcctcaggtggcca

SEQ ID NO: 1263484 - DNA, 14 bp, Homo sapiens
cggtgcttgcagta

SEQ ID NO: 1263485 - DNA, 18 bp, Homo sapiens
cggtggataactagccag

SEQ ID NO: 1263486 - DNA, 20 bp, Homo sapiens
cggtggctagtcaagctcct

SEQ ID NO: 1263487 - DNA, 17 bp, Homo sapiens
cggtggctgccccggcc

SEQ ID NO: 1263488 - DNA, 16 bp, Homo sapiens
cggtgggaaggaaagg

SEQ ID NO: 1263489 - DNA, 19 bp, Homo sapiens
cggtgggaccctgtccggc

SEQ ID NO: 1263490 - DNA, 17 bp, Homo sapiens
cggtgggccagagctga

SEQ ID NO: 1263491 - DNA, 22 bp, Homo sapiens
cggtggtgcccgtgcccgcagg

SEQ ID NO: 1263492 - DNA, 10 bp, Homo sapiens
cggtgtcagg

SEQ ID NO: 1263493 - DNA, 17 bp, Homo sapiens
cggtgtccaccatcccc

SEQ ID NO: 1263494 - DNA, 18 bp, Homo sapiens
cggtgtggtgcagtgtga

SEQ ID NO: 1263495 - DNA, 21 bp, Homo sapiens
cggtgtgtcctctgtgcccac

SEQ ID NO: 1263496 - DNA, 21 bp, Homo sapiens
cggtgtttggcaatgctaatt

SEQ ID NO: 1263497 - DNA, 16 bp, Homo sapiens
cggttaacttgtatat

SEQ ID NO: 1263498 - DNA, 21 bp, Homo sapiens
cggttaagtacccgaggcctc

SEQ ID NO: 1263499 - DNA, 18 bp, Homo sapiens
cggttattcgcccacccg

SEQ ID NO: 1263500 - DNA, 16 bp, Homo sapiens
cggttcagacccctgc

SEQ ID NO: 1263501 - DNA, 19 bp, Homo sapiens
cggttccacgtccccctgg

SEQ ID NO: 1263502 - DNA, 19 bp, Homo sapiens
cggttctccagaatgtaag

SEQ ID NO: 1263503 - DNA, 14 bp, Homo sapiens
cggttgttctttcc

SEQ ID NO: 1263504 - DNA, 16 bp, Homo sapiens
cggttgttgatattgt

SEQ ID NO: 1263505 - DNA, 21 bp, Homo sapiens
cggttgttgatattgtttgct

SEQ ID NO: 1263506 - DNA, 22 bp, Homo sapiens
cggttgttgatattgtttgctg

SEQ ID NO: 1263507 - DNA, 23 bp, Homo sapiens
cggttgttgatattgtttgctgt

SEQ ID NO: 1263508 - DNA, 19 bp, Homo sapiens
cggtttcaaaccaggattt

SEQ ID NO: 1263509 - DNA, 16 bp, Homo sapiens
cggtttgggctgtctt

SEQ ID NO: 1263510 - DNA, 13 bp, Homo sapiens
cggtttgtgagag

SEQ ID NO: 1263511 - DNA, 17 bp, Homo sapiens
cggttttggcagctgac

SEQ ID NO: 1263512 - DNA, 16 bp, Homo sapiens
cgtaaaaatgatttca

SEQ ID NO: 1263513 - DNA, 22 bp, Homo sapiens
cgtaaaagagataataagatta

SEQ ID NO: 1263514 - DNA, 16 bp, Homo sapiens
cgtaaagctagaaatg

SEQ ID NO: 1263515 - DNA, 17 bp, Homo sapiens
cgtaaagctagaaatga

SEQ ID NO: 1263516 - DNA, 23 bp, Homo sapiens
cgtaaaggtttatttttctgtta

SEQ ID NO: 1263517 - DNA, 15 bp, Homo sapiens
cgtaaccacggaaaa

SEQ ID NO: 1263518 - DNA, 15 bp, Homo sapiens
cgtaacccaccccca

SEQ ID NO: 1263519 - DNA, 16 bp, Homo sapiens
cgtaagtttaaaggat

SEQ ID NO: 1263520 - DNA, 17 bp, Homo sapiens
cgtaataattattatta

SEQ ID NO: 1263521 - DNA, 14 bp, Homo sapiens
cgtaatgggcctgc

SEQ ID NO: 1263522 - DNA, 16 bp, Homo sapiens
cgtaattttgccaaat

SEQ ID NO: 1263523 - DNA, 16 bp, Homo sapiens
cgtacaaccccctcca

SEQ ID NO: 1263524 - DNA, 19 bp, Homo sapiens
cgtacaaccccctccaccc

SEQ ID NO: 1263525 - DNA, 13 bp, Homo sapiens
cgtacacatttta

SEQ ID NO: 1263526 - DNA, 22 bp, Homo sapiens
cgtacacattttattttattat

SEQ ID NO: 1263527 - DNA, 14 bp, Homo sapiens
cgtacatctgcaat

SEQ ID NO: 1263528 - DNA, 17 bp, Homo sapiens
cgtacccagccatgtgt

SEQ ID NO: 1263529 - DNA, 14 bp, Homo sapiens
cgtaccccaccctc

SEQ ID NO: 1263530 - DNA, 14 bp, Homo sapiens
cgtaccccactggg

SEQ ID NO: 1263531 - DNA, 21 bp, Homo sapiens
cgtacctcttcccatgactgc

SEQ ID NO: 1263532 - DNA, 14 bp, Homo sapiens
cgtacctgtcatga

SEQ ID NO: 1263533 - DNA, 14 bp, Homo sapiens
cgtactctcacatg

SEQ ID NO: 1263534 - DNA, 13 bp, Homo sapiens
cgtactgtaactg

SEQ ID NO: 1263535 - DNA, 14 bp, Homo sapiens
cgtactgtaactgc

SEQ ID NO: 1263536 - DNA, 15 bp, Homo sapiens
cgtactgtaactgct

SEQ ID NO: 1263537 - DNA, 20 bp, Homo sapiens
cgtagccaaggtgggctgag

SEQ ID NO: 1263538 - DNA, 11 bp, Homo sapiens
cgtagcctggg

SEQ ID NO: 1263539 - DNA, 22 bp, Homo sapiens
cgtagcctgggctcactgtgct

SEQ ID NO: 1263540 - DNA, 20 bp, Homo sapiens
cgtagcgtgcccgtgtgcat

SEQ ID NO: 1263541 - DNA, 17 bp, Homo sapiens
cgtagggagtacctgct

SEQ ID NO: 1263542 - DNA, 15 bp, Homo sapiens
cgtagtctcctgggt

SEQ ID NO: 1263543 - DNA, 21 bp, Homo sapiens
cgtataaatatcagtattctg

SEQ ID NO: 1263544 - DNA, 13 bp, Homo sapiens
cgtataatgcttt

SEQ ID NO: 1263545 - DNA, 22 bp, Homo sapiens
cgtataccttattaacaaaata

SEQ ID NO: 1263546 - DNA, 18 bp, Homo sapiens
cgtatacttaaaatgaca

SEQ ID NO: 1263547 - DNA, 16 bp, Homo sapiens
cgtatctccctggaga

SEQ ID NO: 1263548 - DNA, 20 bp, Homo sapiens
cgtatgcagtgtagatttta

SEQ ID NO: 1263549 - DNA, 20 bp, Homo sapiens
cgtatgtctgttaccatgtc

SEQ ID NO: 1263550 - DNA, 15 bp, Homo sapiens
cgtatgtgtgcagga

SEQ ID NO: 1263551 - DNA, 17 bp, Homo sapiens
cgtatgtgtgcaggagc

SEQ ID NO: 1263552 - DNA, 21 bp, Homo sapiens
cgtatgtgtgcaggagcctcc

SEQ ID NO: 1263553 - DNA, 17 bp, Homo sapiens
cgtatgttcgttgcagc

SEQ ID NO: 1263554 - DNA, 15 bp, Homo sapiens
cgtatttaatagcaa

SEQ ID NO: 1263555 - DNA, 18 bp, Homo sapiens
cgtatttatatttggaaa

SEQ ID NO: 1263556 - DNA, 21 bp, Homo sapiens
cgtatttatatttggaaagag

SEQ ID NO: 1263557 - DNA, 20 bp, Homo sapiens
cgtatttctccagacccaga

SEQ ID NO: 1263558 - DNA, 17 bp, Homo sapiens
cgtcaacgtgcatttta

SEQ ID NO: 1263559 - DNA, 13 bp, Homo sapiens
cgtcaagacattt

SEQ ID NO: 1263560 - DNA, 15 bp, Homo sapiens
cgtcaagacatttgc

SEQ ID NO: 1263561 - DNA, 16 bp, Homo sapiens
cgtcaagacatttgct

SEQ ID NO: 1263562 - DNA, 20 bp, Homo sapiens
cgtcaccatctcaggccacc

SEQ ID NO: 1263563 - DNA, 21 bp, Homo sapiens
cgtcaccatctcaggccacct

SEQ ID NO: 1263564 - DNA, 21 bp, Homo sapiens
cgtcacccctgtttctggcac

SEQ ID NO: 1263565 - DNA, 17 bp, Homo sapiens
cgtggcacctcttccga

SEQ ID NO: 1263566 - DNA, 20 bp, Homo sapiens
cgtggcagataatcagcctc

SEQ ID NO: 1263567 - DNA, 21 bp, Homo sapiens
cgtggcagataatcagcctct

SEQ ID NO: 1263568 - DNA, 21 bp, Homo sapiens
cgtggcagcacggcccggccc

SEQ ID NO: 1263569 - DNA, 22 bp, Homo sapiens
cgtggcatttcaattcctggcc

SEQ ID NO: 1263570 - DNA, 15 bp, Homo sapiens
cgtggccacaaaaac

SEQ ID NO: 1263571 - DNA, 14 bp, Homo sapiens
cgtggcccgtggcc

SEQ ID NO: 1263572 - DNA, 21 bp, Homo sapiens
cgtggcctcccaaagtgctgg

SEQ ID NO: 1263573 - DNA, 22 bp, Homo sapiens
cgtggcctccccatgggcacag

SEQ ID NO: 1263574 - DNA, 15 bp, Homo sapiens
cgtggcctggcatct

SEQ ID NO: 1263575 - DNA, 11 bp, Homo sapiens
cgtggccttgg

SEQ ID NO: 1263576 - DNA, 14 bp, Homo sapiens
cgtggctctgctgg

SEQ ID NO: 1263577 - DNA, 12 bp, Homo sapiens
cgtggctctggg

SEQ ID NO: 1263578 - DNA, 17 bp, Homo sapiens
cgtggctctgggtgagg

SEQ ID NO: 1263579 - DNA, 15 bp, Homo sapiens
cgtggctgtggcaca

SEQ ID NO: 1263580 - DNA, 16 bp, Homo sapiens
cgtggctgtggcacag

SEQ ID NO: 1263581 - DNA, 18 bp, Homo sapiens
cgtggcttcccgctcagc

SEQ ID NO: 1263582 - DNA, 20 bp, Homo sapiens
cgtggcttggcatctgtgtg

SEQ ID NO: 1263583 - DNA, 17 bp, Homo sapiens
cgtggcttgggctggtc

SEQ ID NO: 1263584 - DNA, 18 bp, Homo sapiens
cgtggcttgggctggtca

SEQ ID NO: 1263585 - DNA, 15 bp, Homo sapiens
cgtggcttgtagaat

SEQ ID NO: 1263586 - DNA, 20 bp, Homo sapiens
cgtgggacggtgcccaagcc

SEQ ID NO: 1263587 - DNA, 18 bp, Homo sapiens
cgtgggaggcagaaacct

SEQ ID NO: 1263588 - DNA, 18 bp, Homo sapiens
cgtgggatggcatttggt

SEQ ID NO: 1263589 - DNA, 15 bp, Homo sapiens
cgtgggccctgcagg

SEQ ID NO: 1263590 - DNA, 18 bp, Homo sapiens
cgtgggcgcaaaggtgcc

SEQ ID NO: 1263591 - DNA, 16 bp, Homo sapiens
cgtgggctcccctctt

SEQ ID NO: 1263592 - DNA, 20 bp, Homo sapiens
cgtgggctcccctcttcctc

SEQ ID NO: 1263593 - DNA, 17 bp, Homo sapiens
cgtgggctccctgactg

SEQ ID NO: 1263594 - DNA, 16 bp, Homo sapiens
cgtgggctctgccaat

SEQ ID NO: 1263595 - DNA, 12 bp, Homo sapiens
cgtggggaaggg

SEQ ID NO: 1263596 - DNA, 18 bp, Homo sapiens
cgtgggggcactgaccag

SEQ ID NO: 1263597 - DNA, 15 bp, Homo sapiens
cgtggggtgctgccc

SEQ ID NO: 1263598 - DNA, 23 bp, Homo sapiens
cgtgggtgtgtgtagccaaggtc

SEQ ID NO: 1263599 - DNA, 16 bp, Homo sapiens
cgtggtatgtctgcca

SEQ ID NO: 1263600 - DNA, 21 bp, Homo sapiens
cgtggtcaccttcgagtagag

SEQ ID NO: 1263601 - DNA, 21 bp, Homo sapiens
cgtggtgatcaattaaatgta

SEQ ID NO: 1263602 - DNA, 19 bp, Homo sapiens
cgtggtgccgacgtcccca

SEQ ID NO: 1263603 - DNA, 14 bp, Homo sapiens
cgtggtggcaggca

SEQ ID NO: 1263604 - DNA, 21 bp, Homo sapiens
cgtggtggcggtggctgcccc

SEQ ID NO: 1263605 - DNA, 22 bp, Homo sapiens
cgtggtgggactccagctcgtg

SEQ ID NO: 1263606 - DNA, 21 bp, Homo sapiens
cgtggtgggggaggagcctct

SEQ ID NO: 1263607 - DNA, 18 bp, Homo sapiens
cgtggtgttatttaaaga

SEQ ID NO: 1263608 - DNA, 13 bp, Homo sapiens
cgtggttccaaga

SEQ ID NO: 1263609 - DNA, 21 bp, Homo sapiens
cgtggtttgcctgaggctgta

SEQ ID NO: 1263610 - DNA, 18 bp, Homo sapiens
cgtgtaaataatttatta

SEQ ID NO: 1263611 - DNA, 20 bp, Homo sapiens
cgtgtaaccatggacccaat

SEQ ID NO: 1263612 - DNA, 17 bp, Homo sapiens
cgtgtacagcacagaat

SEQ ID NO: 1263613 - DNA, 22 bp, Homo sapiens
cgtgtagctatggaagttgcat

SEQ ID NO: 1263614 - DNA, 21 bp, Homo sapiens
cgtgtagtggaagagcagcct

SEQ ID NO: 1263615 - DNA, 22 bp, Homo sapiens
cgtgtagtggaagagcagcctg

SEQ ID NO: 1263616 - DNA, 17 bp, Homo sapiens
cgtgtatagtatctgta

SEQ ID NO: 1263617 - DNA, 18 bp, Homo sapiens
cgtgtatagtatctgtat

SEQ ID NO: 1263618 - DNA, 15 bp, Homo sapiens
cgtgtatcctggggc

SEQ ID NO: 1263619 - DNA, 18 bp, Homo sapiens
cgtgtatgtacctaggat

SEQ ID NO: 1263620 - DNA, 16 bp, Homo sapiens
cgtgtatgtttcttct

SEQ ID NO: 1263621 - DNA, 18 bp, Homo sapiens
cgtgtatttggctgggct

SEQ ID NO: 1263622 - DNA, 16 bp, Homo sapiens
cgtgtcacctgtgctt

SEQ ID NO: 1263623 - DNA, 18 bp, Homo sapiens
cgtgtcccaaggagctga

SEQ ID NO: 1263624 - DNA, 22 bp, Homo sapiens
cgtgtcccctatcctacttccc

SEQ ID NO: 1263625 - DNA, 16 bp, Homo sapiens
cgtgtcccctgacagg

SEQ ID NO: 1263626 - DNA, 18 bp, Homo sapiens
cgtgtcctcctctgagga

SEQ ID NO: 1263627 - DNA, 14 bp, Homo sapiens
cgtgtctctcccac

SEQ ID NO: 1263628 - DNA, 14 bp, Homo sapiens
cgtgtctgtattta

SEQ ID NO: 1263629 - DNA, 13 bp, Homo sapiens
cgtgtcttccact

SEQ ID NO: 1263630 - DNA, 23 bp, Homo sapiens
cgtgtgaagatgaaggggctctt

SEQ ID NO: 1263631 - DNA, 23 bp, Homo sapiens
cgtgtgaatgtagcttccacctc

SEQ ID NO: 1263632 - DNA, 17 bp, Homo sapiens
cgtgtgacactctcgtg

SEQ ID NO: 1263633 - DNA, 21 bp, Homo sapiens
cgtgtgagaagtgaatgctgg

SEQ ID NO: 1263634 - DNA, 22 bp, Homo sapiens
cgtgtgagaagtgaatgctggg

SEQ ID NO: 1263635 - DNA, 15 bp, Homo sapiens
cgtgtgagtgtgaca

SEQ ID NO: 1263636 - DNA, 21 bp, Homo sapiens
cgtgtgagtgtgacagggcca

SEQ ID NO: 1263637 - DNA, 23 bp, Homo sapiens
cgtgtgcatagcgtcctgccctg

SEQ ID NO: 1263638 - DNA, 14 bp, Homo sapiens
cgtgtgccaggcag

SEQ ID NO: 1263639 - DNA, 16 bp, Homo sapiens
cgtgtgctgctgctgc

SEQ ID NO: 1263640 - DNA, 14 bp, Homo sapiens
cgtgtggacacaga

SEQ ID NO: 1263641 - DNA, 16 bp, Homo sapiens
cgtgtggactgtgcct

SEQ ID NO: 1263642 - DNA, 13 bp, Homo sapiens
cgtgtggagcaga

SEQ ID NO: 1263643 - DNA, 13 bp, Homo sapiens
cgtgtggcctccg

SEQ ID NO: 1263644 - DNA, 14 bp, Homo sapiens
cgtgtggcgtggcc

SEQ ID NO: 1263645 - DNA, 22 bp, Homo sapiens
cgtgtgggctttaaaagaaaaa

SEQ ID NO: 1263646 - DNA, 22 bp, Homo sapiens
cgtgtggtaccttcagccctgg

SEQ ID NO: 1263647 - DNA, 23 bp, Homo sapiens
cgtgtgtatgtgtatgtgtgtga

SEQ ID NO: 1263648 - DNA, 15 bp, Homo sapiens
cgtgtgtcagggatg

SEQ ID NO: 1263649 - DNA, 16 bp, Homo sapiens
cgtgtgtcagggatga

SEQ ID NO: 1263650 - DNA, 17 bp, Homo sapiens
cgtgtgtccatgtgttc

SEQ ID NO: 1263651 - DNA, 23 bp, Homo sapiens
cgtgtgttcttttgagtccttgt

SEQ ID NO: 1263652 - DNA, 19 bp, Homo sapiens
cgtgttaggaggctgcatg

SEQ ID NO: 1263653 - DNA, 21 bp, Homo sapiens
cgtgttaggaggctgcatgct

SEQ ID NO: 1263654 - DNA, 18 bp, Homo sapiens
cgtgttagtgtgtgtgca

SEQ ID NO: 1263655 - DNA, 15 bp, Homo sapiens
cgtgttcagcagaac

SEQ ID NO: 1263656 - DNA, 16 bp, Homo sapiens
cgtgttcagcagaacc

SEQ ID NO: 1263657 - DNA, 14 bp, Homo sapiens
cgtgtttctgactc

SEQ ID NO: 1263658 - DNA, 21 bp, Homo sapiens
cgtgttttattcctgtatgtt

SEQ ID NO: 1263659 - DNA, 14 bp, Homo sapiens
cgttaaaaacagat

SEQ ID NO: 1263660 - DNA, 21 bp, Homo sapiens
cgttaaaaacagatttggaaa

SEQ ID NO: 1263661 - DNA, 22 bp, Homo sapiens
cgttaacattgaccaagaactg

SEQ ID NO: 1263662 - DNA, 19 bp, Homo sapiens
cgttaactgtgtatgtaca

SEQ ID NO: 1263663 - DNA, 21 bp, Homo sapiens
cgttactcagggctcctccca

SEQ ID NO: 1263664 - DNA, 19 bp, Homo sapiens
cgttaggcatttcctgctg

SEQ ID NO: 1263665 - DNA, 14 bp, Homo sapiens
cgttatgtgcagta

SEQ ID NO: 1263666 - DNA, 15 bp, Homo sapiens
cgttattgttgactt

SEQ ID NO: 1263667 - DNA, 23 bp, Homo sapiens
cgttcaagacttgagcggagccc

SEQ ID NO: 1263668 - DNA, 15 bp, Homo sapiens
cgttcacctccctgc

SEQ ID NO: 1263669 - DNA, 21 bp, Homo sapiens
cgttcagcccctgatctctga

SEQ ID NO: 1263670 - DNA, 19 bp, Homo sapiens
cgttcagtgtcccaggcag

SEQ ID NO: 1263671 - DNA, 15 bp, Homo sapiens
cgttcatcacctgct

SEQ ID NO: 1263672 - DNA, 16 bp, Homo sapiens
cgttccacagttgcca

SEQ ID NO: 1263673 - DNA, 22 bp, Homo sapiens
cgttccacagttgccaccacct

SEQ ID NO: 1263674 - DNA, 13 bp, Homo sapiens
cgttccagttccc

SEQ ID NO: 1263675 - DNA, 14 bp, Homo sapiens
cgttccccacccct

SEQ ID NO: 1263676 - DNA, 14 bp, Homo sapiens
cgttccctgcgctt

SEQ ID NO: 1263677 - DNA, 15 bp, Homo sapiens
cgttcccttctcccc

SEQ ID NO: 1263678 - DNA, 19 bp, Homo sapiens
cgttccggtccccacagac

SEQ ID NO: 1263679 - DNA, 11 bp, Homo sapiens
cgttcctggca

SEQ ID NO: 1263680 - DNA, 13 bp, Homo sapiens
cgttcctggcctt

SEQ ID NO: 1263681 - DNA, 14 bp, Homo sapiens
cgttcgcctctggc

SEQ ID NO: 1263682 - DNA, 17 bp, Homo sapiens
cgttcgcctctggccct

SEQ ID NO: 1263683 - DNA, 22 bp, Homo sapiens
cgttcgtacgcccaggacagct

SEQ ID NO: 1263684 - DNA, 14 bp, Homo sapiens
cgttctattgtgtg

SEQ ID NO: 1263685 - DNA, 15 bp, Homo sapiens
cgttctcaagaatct

SEQ ID NO: 1263686 - DNA, 18 bp, Homo sapiens
ctaaccttgaatgctgcc

SEQ ID NO: 1263687 - DNA, 21 bp, Homo sapiens
ctaaccttgcctggtacagta

SEQ ID NO: 1263688 - DNA, 13 bp, Homo sapiens
ctaacctttacat

SEQ ID NO: 1263689 - DNA, 14 bp, Homo sapiens
ctaacgccagcaca

SEQ ID NO: 1263690 - DNA, 15 bp, Homo sapiens
ctaacgtaaatacac

SEQ ID NO: 1263691 - DNA, 18 bp, Homo sapiens
ctaacgtccactagctta

SEQ ID NO: 1263692 - DNA, 13 bp, Homo sapiens
ctaactaaactct

SEQ ID NO: 1263693 - DNA, 16 bp, Homo sapiens
ctaactagaattagta

SEQ ID NO: 1263694 - DNA, 16 bp, Homo sapiens
ctaactcactgcctag

SEQ ID NO: 1263695 - DNA, 17 bp, Homo sapiens
ctaactcagaattattt

SEQ ID NO: 1263696 - DNA, 16 bp, Homo sapiens
ctaactccgagagcag

SEQ ID NO: 1263697 - DNA, 16 bp, Homo sapiens
ctaactctgcccaccc

SEQ ID NO: 1263698 - DNA, 16 bp, Homo sapiens
ctaactgcaatgtgga

SEQ ID NO: 1263699 - DNA, 20 bp, Homo sapiens
ctaactgcttcatctccttt

SEQ ID NO: 1263700 - DNA, 13 bp, Homo sapiens
ctaactggaagca

SEQ ID NO: 1263701 - DNA, 13 bp, Homo sapiens
ctaactgtaaatc

SEQ ID NO: 1263702 - DNA, 14 bp, Homo sapiens
ctaactgtaaatca

SEQ ID NO: 1263703 - DNA, 15 bp, Homo sapiens
ctaactgtatatttg

SEQ ID NO: 1263704 - DNA, 12 bp, Homo sapiens
ctaactgtgatt

SEQ ID NO: 1263705 - DNA, 13 bp, Homo sapiens
ctaactgtgattt

SEQ ID NO: 1263706 - DNA, 18 bp, Homo sapiens
ctaactgtggaatataaa

SEQ ID NO: 1263707 - DNA, 23 bp, Homo sapiens
ctaacttcagtaggatttatgta

SEQ ID NO: 1263708 - DNA, 21 bp, Homo sapiens
ctaacttcctgtgcctttcct

SEQ ID NO: 1263709 - DNA, 13 bp, Homo sapiens
ctaacttccttta

SEQ ID NO: 1263710 - DNA, 14 bp, Homo sapiens
ctaacttgtaaaaa

SEQ ID NO: 1263711 - DNA, 18 bp, Homo sapiens
ctaagaaaaaaagcacaa

SEQ ID NO: 1263712 - DNA, 15 bp, Homo sapiens
ctaagaaaagatttt

SEQ ID NO: 1263713 - DNA, 15 bp, Homo sapiens
ctaagaaaatagcaa

SEQ ID NO: 1263714 - DNA, 16 bp, Homo sapiens
ctaagaaagaggagtg

SEQ ID NO: 1263715 - DNA, 21 bp, Homo sapiens
ctaagaaatatctgtgaaata

SEQ ID NO: 1263716 - DNA, 15 bp, Homo sapiens
ctaagaaatattcca

SEQ ID NO: 1263717 - DNA, 13 bp, Homo sapiens
ctaagaaccaaaa

SEQ ID NO: 1263718 - DNA, 12 bp, Homo sapiens
ctaagaagacat

SEQ ID NO: 1263719 - DNA, 13 bp, Homo sapiens
ctaagaagacatt

SEQ ID NO: 1263720 - DNA, 14 bp, Homo sapiens
ctaagaagacattt

SEQ ID NO: 1263721 - DNA, 20 bp, Homo sapiens
ctaagaagacattttgttac

SEQ ID NO: 1263722 - DNA, 22 bp, Homo sapiens
ctaagaagtacattgttacctc

SEQ ID NO: 1263723 - DNA, 13 bp, Homo sapiens
ctaagaagttact

SEQ ID NO: 1263724 - DNA, 17 bp, Homo sapiens
ctaagaagttgtttgag

SEQ ID NO: 1263725 - DNA, 23 bp, Homo sapiens
ctaagaataacaagaagcccagt

SEQ ID NO: 1263726 - DNA, 18 bp, Homo sapiens
ctaagaataataaaatca

SEQ ID NO: 1263727 - DNA, 18 bp, Homo sapiens
ctaagaatgcattattga

SEQ ID NO: 1263728 - DNA, 17 bp, Homo sapiens
ctaagaattttgtttta

SEQ ID NO: 1263729 - DNA, 17 bp, Homo sapiens
ctaagacagtttttata

SEQ ID NO: 1263730 - DNA, 13 bp, Homo sapiens
ctaagacatgtga

SEQ ID NO: 1263731 - DNA, 12 bp, Homo sapiens
ctaagactcccg

SEQ ID NO: 1263732 - DNA, 17 bp, Homo sapiens
ctaagactgccttcagt

SEQ ID NO: 1263733 - DNA, 17 bp, Homo sapiens
ctaagagaagtagaaat

SEQ ID NO: 1263734 - DNA, 16 bp, Homo sapiens
ctaagagaagttattt

SEQ ID NO: 1263735 - DNA, 19 bp, Homo sapiens
ctaagagaagttattttct

SEQ ID NO: 1263736 - DNA, 19 bp, Homo sapiens
ctaagagacagttctctgt

SEQ ID NO: 1263737 - DNA, 11 bp, Homo sapiens
ctaagagattt

SEQ ID NO: 1263738 - DNA, 20 bp, Homo sapiens
ctaagagccatttaggggcc

SEQ ID NO: 1263739 - DNA, 20 bp, Homo sapiens
ctaagagctagcgctgccgc

SEQ ID NO: 1263740 - DNA, 22 bp, Homo sapiens
ctaagagtgctgggcattttta

SEQ ID NO: 1263741 - DNA, 18 bp, Homo sapiens
ctaagagtggaggaggag

SEQ ID NO: 1263742 - DNA, 19 bp, Homo sapiens
ctaagatacactgcacttt

SEQ ID NO: 1263743 - DNA, 23 bp, Homo sapiens
ctaagatctgttaaaaaagaaat

SEQ ID NO: 1263744 - DNA, 15 bp, Homo sapiens
ctaagatgaaattgc

SEQ ID NO: 1263745 - DNA, 22 bp, Homo sapiens
ctaagatgagatttgccagcac

SEQ ID NO: 1263746 - DNA, 17 bp, Homo sapiens
ctaagatgttcactgtg

SEQ ID NO: 1263747 - DNA, 12 bp, Homo sapiens
ctaagattcttt

SEQ ID NO: 1263748 - DNA, 23 bp, Homo sapiens
ctaagatttggtttgggatcaat

SEQ ID NO: 1263749 - DNA, 21 bp, Homo sapiens
ctaagatttttatattaaaaa

SEQ ID NO: 1263750 - DNA, 12 bp, Homo sapiens
ctaagcagagga

SEQ ID NO: 1263751 - DNA, 23 bp, Homo sapiens
ctaagcagaggaggggccgctgc

SEQ ID NO: 1263752 - DNA, 16 bp, Homo sapiens
ctaagcagccaggagg

SEQ ID NO: 1263753 - DNA, 22 bp, Homo sapiens
ctaagcagccaggagggacctg

SEQ ID NO: 1263754 - DNA, 17 bp, Homo sapiens
ctaagcagctggtcttt

SEQ ID NO: 1263755 - DNA, 21 bp, Homo sapiens
ctaagcatagcaaacagagga

SEQ ID NO: 1263756 - DNA, 15 bp, Homo sapiens
ctaagcatgtagcca

SEQ ID NO: 1263757 - DNA, 19 bp, Homo sapiens
ctaagcatgtgtcccagga

SEQ ID NO: 1263758 - DNA, 19 bp, Homo sapiens
ctaagccacagcttcttca

SEQ ID NO: 1263759 - DNA, 14 bp, Homo sapiens
ctaagccagcctgg

SEQ ID NO: 1263760 - DNA, 15 bp, Homo sapiens
ctaagccaggaggct

SEQ ID NO: 1263761 - DNA, 18 bp, Homo sapiens
ctaagccaggcctggctg

SEQ ID NO: 1263762 - DNA, 23 bp, Homo sapiens
ctaagccaggcctggctggagga

SEQ ID NO: 1263763 - DNA, 18 bp, Homo sapiens
ctaagcccccagggcctc

SEQ ID NO: 1263764 - DNA, 19 bp, Homo sapiens
ctaagcccccagggcctcc

SEQ ID NO: 1263765 - DNA, 20 bp, Homo sapiens
ctaagcccccagggcctcca

SEQ ID NO: 1263766 - DNA, 22 bp, Homo sapiens
ctaagcccccagggcctccagg

SEQ ID NO: 1263767 - DNA, 20 bp, Homo sapiens
ctaagccctgtcgagacact

SEQ ID NO: 1263768 - DNA, 21 bp, Homo sapiens
ctaagccctgtcgagacactt

SEQ ID NO: 1263769 - DNA, 11 bp, Homo sapiens
ctaagcccttt

SEQ ID NO: 1263770 - DNA, 16 bp, Homo sapiens
ctaagccctttgccat

SEQ ID NO: 1263771 - DNA, 17 bp, Homo sapiens
ctaagcctgaaggggcg

SEQ ID NO: 1263772 - DNA, 20 bp, Homo sapiens
ctaagcctgaaggggcgtct

SEQ ID NO: 1263773 - DNA, 20 bp, Homo sapiens
ctaagcctggaagccatcct

SEQ ID NO: 1263774 - DNA, 13 bp, Homo sapiens
ctaagcctgtccc

SEQ ID NO: 1263775 - DNA, 17 bp, Homo sapiens
ctaagcctgtccccaga

SEQ ID NO: 1263776 - DNA, 16 bp, Homo sapiens
ctaagcctttccataa

SEQ ID NO: 1263777 - DNA, 20 bp, Homo sapiens
ctaagcgcctattgtttgta

SEQ ID NO: 1263778 - DNA, 18 bp, Homo sapiens
ctaagcggctgtttactg

SEQ ID NO: 1263779 - DNA, 20 bp, Homo sapiens
ctaagcggctgtttactgct

SEQ ID NO: 1263780 - DNA, 21 bp, Homo sapiens
ctaagcggctgtttactgctt

SEQ ID NO: 1263781 - DNA, 14 bp, Homo sapiens
ctaagcggtggagg

SEQ ID NO: 1263782 - DNA, 19 bp, Homo sapiens
ctaagcgtgctgacatcag

SEQ ID NO: 1263783 - DNA, 14 bp, Homo sapiens
ctaagctaggaatg

SEQ ID NO: 1263784 - DNA, 21 bp, Homo sapiens
ctaagctattcagtaataact

SEQ ID NO: 1263785 - DNA, 16 bp, Homo sapiens
ctaagctcacgtcctg

SEQ ID NO: 1263786 - DNA, 21 bp, Homo sapiens
ctaagctgatattatttcttc

SEQ ID NO: 1263787 - DNA, 15 bp, Homo sapiens
ctaagctggagctct

SEQ ID NO: 1263788 - DNA, 17 bp, Homo sapiens
ctaagctggagctcttg

SEQ ID NO: 1263789 - DNA, 23 bp, Homo sapiens
ctaagctggagctcttggaagag

SEQ ID NO: 1263790 - DNA, 18 bp, Homo sapiens
ctaagctggctctgtttg

SEQ ID NO: 1263791 - DNA, 19 bp, Homo sapiens
ctaagctttgccagctgct

SEQ ID NO: 1263792 - DNA, 12 bp, Homo sapiens
ctaaggaaaatt

SEQ ID NO: 1263793 - DNA, 15 bp, Homo sapiens
ctaaggaatctgaaa

SEQ ID NO: 1263794 - DNA, 12 bp, Homo sapiens
ctaaggacacac

SEQ ID NO: 1263795 - DNA, 23 bp, Homo sapiens
ctaaggaggggaaaaaaatgttg

SEQ ID NO: 1263796 - DNA, 18 bp, Homo sapiens
ctaaggatctctcaggag

SEQ ID NO: 1263797 - DNA, 23 bp, Homo sapiens
ctaaggccatggcatcccttttt

SEQ ID NO: 1263798 - DNA, 22 bp, Homo sapiens
ctaaggccgtgtctctgaggac

SEQ ID NO: 1263799 - DNA, 15 bp, Homo sapiens
ctaaggctccccacc

SEQ ID NO: 1263800 - DNA, 13 bp, Homo sapiens
ctaaggctgctgg

SEQ ID NO: 1263801 - DNA, 15 bp, Homo sapiens
ctaaggctgctggct

SEQ ID NO: 1263802 - DNA, 17 bp, Homo sapiens
ctaaggctgctggcttc

SEQ ID NO: 1263803 - DNA, 15 bp, Homo sapiens
ctaaggcttttattt

SEQ ID NO: 1263804 - DNA, 22 bp, Homo sapiens
ctaagggaacaatccatgtgat

SEQ ID NO: 1263805 - DNA, 20 bp, Homo sapiens
ctaagggaagatcactgtag

SEQ ID NO: 1263806 - DNA, 17 bp, Homo sapiens
ctaagggagagtggtat

SEQ ID NO: 1263807 - DNA, 15 bp, Homo sapiens
ctaagggtctctcat

SEQ ID NO: 1263808 - DNA, 21 bp, Homo sapiens
ctacattccctctcctgccca

SEQ ID NO: 1263809 - DNA, 23 bp, Homo sapiens
ctacattccctctcctgcccaga

SEQ ID NO: 1263810 - DNA, 10 bp, Homo sapiens
ctacattcct

SEQ ID NO: 1263811 - DNA, 11 bp, Homo sapiens
ctacattcctc

SEQ ID NO: 1263812 - DNA, 17 bp, Homo sapiens
ctacattcctcagctgc

SEQ ID NO: 1263813 - DNA, 23 bp, Homo sapiens
ctacattcgtgtgtgtctgcttt

SEQ ID NO: 1263814 - DNA, 19 bp, Homo sapiens
ctacattcttggttgttaa

SEQ ID NO: 1263815 - DNA, 21 bp, Homo sapiens
ctacattcttggttgttaatt

SEQ ID NO: 1263816 - DNA, 17 bp, Homo sapiens
ctacattctttattctg

SEQ ID NO: 1263817 - DNA, 18 bp, Homo sapiens
ctacattctttattctgc

SEQ ID NO: 1263818 - DNA, 16 bp, Homo sapiens
ctacattcttttttct

SEQ ID NO: 1263819 - DNA, 18 bp, Homo sapiens
ctacatttgagggcccag

SEQ ID NO: 1263820 - DNA, 23 bp, Homo sapiens
ctaccaaaaattgccaagtgcct

SEQ ID NO: 1263821 - DNA, 16 bp, Homo sapiens
ctaccacaaggaaaat

SEQ ID NO: 1263822 - DNA, 13 bp, Homo sapiens
ctaccacagtgtc

SEQ ID NO: 1263823 - DNA, 14 bp, Homo sapiens
ctaccaccacggcc

SEQ ID NO: 1263824 - DNA, 14 bp, Homo sapiens
ctaccaccccttcc

SEQ ID NO: 1263825 - DNA, 16 bp, Homo sapiens
ctaccaccccttcctg

SEQ ID NO: 1263826 - DNA, 15 bp, Homo sapiens
ctaccagagctctat

SEQ ID NO: 1263827 - DNA, 17 bp, Homo sapiens
ctaccagccagcctcag

SEQ ID NO: 1263828 - DNA, 18 bp, Homo sapiens
ctaccagccagcctcaga

SEQ ID NO: 1263829 - DNA, 20 bp, Homo sapiens
ctaccagcgcccgctgggct

SEQ ID NO: 1263830 - DNA, 22 bp, Homo sapiens
ctaccagcgcccgctgggctga

SEQ ID NO: 1263831 - DNA, 16 bp, Homo sapiens
ctaccagctcctccag

SEQ ID NO: 1263832 - DNA, 20 bp, Homo sapiens
ctaccagctcctccagccct

SEQ ID NO: 1263833 - DNA, 12 bp, Homo sapiens
ctaccaggaaag

SEQ ID NO: 1263834 - DNA, 15 bp, Homo sapiens
ctaccaggacagaac

SEQ ID NO: 1263835 - DNA, 17 bp, Homo sapiens
ctaccaggatgctaaag

SEQ ID NO: 1263836 - DNA, 20 bp, Homo sapiens
ctaccaggtgtgcctggaag

SEQ ID NO: 1263837 - DNA, 15 bp, Homo sapiens
ctaccaggtgttcta

SEQ ID NO: 1263838 - DNA, 14 bp, Homo sapiens
ctaccatcagggac

SEQ ID NO: 1263839 - DNA, 16 bp, Homo sapiens
ctaccatcagggacag

SEQ ID NO: 1263840 - DNA, 14 bp, Homo sapiens
ctacccaaccactc

SEQ ID NO: 1263841 - DNA, 16 bp, Homo sapiens
ctacccaaccactcaa

SEQ ID NO: 1263842 - DNA, 20 bp, Homo sapiens
ctacccaatgtctcccacac

SEQ ID NO: 1263843 - DNA, 20 bp, Homo sapiens
ctacccactatccttcgtga

SEQ ID NO: 1263844 - DNA, 14 bp, Homo sapiens
ctacccacttctaa

SEQ ID NO: 1263845 - DNA, 16 bp, Homo sapiens
ctacccacttctaaat

SEQ ID NO: 1263846 - DNA, 18 bp, Homo sapiens
ctacccagcgtggcccag

SEQ ID NO: 1263847 - DNA, 20 bp, Homo sapiens
ctacccaggaggctgaggtg

SEQ ID NO: 1263848 - DNA, 15 bp, Homo sapiens
ctacccatatccctc

SEQ ID NO: 1263849 - DNA, 15 bp, Homo sapiens
ctacccatccccgca

SEQ ID NO: 1263850 - DNA, 23 bp, Homo sapiens
ctacccatcggtgtccatttata

SEQ ID NO: 1263851 - DNA, 20 bp, Homo sapiens
ctacccattgttcccttcct

SEQ ID NO: 1263852 - DNA, 15 bp, Homo sapiens
ctaccccaaggccag

SEQ ID NO: 1263853 - DNA, 13 bp, Homo sapiens
ctaccccatgctg

SEQ ID NO: 1263854 - DNA, 14 bp, Homo sapiens
ctaccccctcatcc

SEQ ID NO: 1263855 - DNA, 15 bp, Homo sapiens
ctaccccctcatccc

SEQ ID NO: 1263856 - DNA, 21 bp, Homo sapiens
ctaccccctcttcaaagcaga

SEQ ID NO: 1263857 - DNA, 18 bp, Homo sapiens
ctacccctcaaactgcac

SEQ ID NO: 1263858 - DNA, 19 bp, Homo sapiens
ctacccctcgactcagcac

SEQ ID NO: 1263859 - DNA, 13 bp, Homo sapiens
ctacccctgccct

SEQ ID NO: 1263860 - DNA, 14 bp, Homo sapiens
ctacccctgccctg

SEQ ID NO: 1263861 - DNA, 15 bp, Homo sapiens
ctacccctgccctgc

SEQ ID NO: 1263862 - DNA, 13 bp, Homo sapiens
ctacccctggctg

SEQ ID NO: 1263863 - DNA, 19 bp, Homo sapiens
ctacccctggctgtactgc

SEQ ID NO: 1263864 - DNA, 16 bp, Homo sapiens
ctaccccttcctgtcc

SEQ ID NO: 1263865 - DNA, 17 bp, Homo sapiens
ctaccccttcctgtcct

SEQ ID NO: 1263866 - DNA, 23 bp, Homo sapiens
ctaccccttcctgtcctgcctcc

SEQ ID NO: 1263867 - DNA, 15 bp, Homo sapiens
ctaccccttgtgggc

SEQ ID NO: 1263868 - DNA, 19 bp, Homo sapiens
ctacccgagcccagctaca

SEQ ID NO: 1263869 - DNA, 14 bp, Homo sapiens
ctacccggcccaga

SEQ ID NO: 1263870 - DNA, 16 bp, Homo sapiens
ctacccggcccagaga

SEQ ID NO: 1263871 - DNA, 14 bp, Homo sapiens
ctacccgtgcctgg

SEQ ID NO: 1263872 - DNA, 19 bp, Homo sapiens
ctaccctagccattcctgg

SEQ ID NO: 1263873 - DNA, 21 bp, Homo sapiens
ctaccctatggggaggccctg

SEQ ID NO: 1263874 - DNA, 14 bp, Homo sapiens
ctaccctcaccctt

SEQ ID NO: 1263875 - DNA, 12 bp, Homo sapiens
ctaccctcccac

SEQ ID NO: 1263876 - DNA, 13 bp, Homo sapiens
ctaccctcccacc

SEQ ID NO: 1263877 - DNA, 20 bp, Homo sapiens
ctaccctcgggcccacctgg

SEQ ID NO: 1263878 - DNA, 18 bp, Homo sapiens
ctaccctgcaacttctat

SEQ ID NO: 1263879 - DNA, 12 bp, Homo sapiens
ctaccctggtga

SEQ ID NO: 1263880 - DNA, 17 bp, Homo sapiens
ctaccgaatgtgtcttt

SEQ ID NO: 1263881 - DNA, 18 bp, Homo sapiens
ctaccgaatgtgtcttta

SEQ ID NO: 1263882 - DNA, 21 bp, Homo sapiens
ctaccgagtctcttctccact

SEQ ID NO: 1263883 - DNA, 23 bp, Homo sapiens
ctaccgagtctcttctccactgg

SEQ ID NO: 1263884 - DNA, 17 bp, Homo sapiens
ctaccgatggtcccagg

SEQ ID NO: 1263885 - DNA, 14 bp, Homo sapiens
ctaccgcaggcccg

SEQ ID NO: 1263886 - DNA, 18 bp, Homo sapiens
ctaccgcaggcccggact

SEQ ID NO: 1263887 - DNA, 15 bp, Homo sapiens
ctaccgccctgggct

SEQ ID NO: 1263888 - DNA, 20 bp, Homo sapiens
ctaccgtactccctgcaccg

SEQ ID NO: 1263889 - DNA, 16 bp, Homo sapiens
ctaccgtcttttcctg

SEQ ID NO: 1263890 - DNA, 21 bp, Homo sapiens
ctacctacgtttgcaccgcct

SEQ ID NO: 1263891 - DNA, 23 bp, Homo sapiens
ctacctacgtttgcaccgcctgc

SEQ ID NO: 1263892 - DNA, 16 bp, Homo sapiens
ctacctagtctccact

SEQ ID NO: 1263893 - DNA, 20 bp, Homo sapiens
ctacctcaaagggcagtttt

SEQ ID NO: 1263894 - DNA, 20 bp, Homo sapiens
ctacctcaagttcttggacc

SEQ ID NO: 1263895 - DNA, 19 bp, Homo sapiens
ctacctcagcctcctgggt

SEQ ID NO: 1263896 - DNA, 17 bp, Homo sapiens
ctacctcaggcagctca

SEQ ID NO: 1263897 - DNA, 18 bp, Homo sapiens
ctacctcaggcagctcaa

SEQ ID NO: 1263898 - DNA, 14 bp, Homo sapiens
ctacctcaggcagg

SEQ ID NO: 1263899 - DNA, 23 bp, Homo sapiens
ctacctcaggcaggaagggcagg

SEQ ID NO: 1263900 - DNA, 22 bp, Homo sapiens
ctacctccaaagcttcccacgg

SEQ ID NO: 1263901 - DNA, 16 bp, Homo sapiens
ctacctccctcctcag

SEQ ID NO: 1263902 - DNA, 12 bp, Homo sapiens
ctacctctctcc

SEQ ID NO: 1263903 - DNA, 13 bp, Homo sapiens
ctacctctctgtc

SEQ ID NO: 1263904 - DNA, 20 bp, Homo sapiens
ctacctctctgtcccttgct

SEQ ID NO: 1263905 - DNA, 12 bp, Homo sapiens
ctacctctcttt

SEQ ID NO: 1263906 - DNA, 15 bp, Homo sapiens
ctacctctctttctc

SEQ ID NO: 1263907 - DNA, 19 bp, Homo sapiens
ctacctgacactcccttgg

SEQ ID NO: 1263908 - DNA, 15 bp, Homo sapiens
ctacctgaggccagg

SEQ ID NO: 1263909 - DNA, 16 bp, Homo sapiens
ctacctgccctcaagg

SEQ ID NO: 1263910 - DNA, 16 bp, Homo sapiens
ctacctggaaacagct

SEQ ID NO: 1263911 - DNA, 13 bp, Homo sapiens
ctacctgtgcctg

SEQ ID NO: 1263912 - DNA, 18 bp, Homo sapiens
ctacctgtgtttttttct

SEQ ID NO: 1263913 - DNA, 15 bp, Homo sapiens
ctacctgttctgtag

SEQ ID NO: 1263914 - DNA, 18 bp, Homo sapiens
ctaccttcatttcaggag

SEQ ID NO: 1263915 - DNA, 14 bp, Homo sapiens
ctaccttcctgtcc

SEQ ID NO: 1263916 - DNA, 16 bp, Homo sapiens
ctaccttcctgtccct

SEQ ID NO: 1263917 - DNA, 19 bp, Homo sapiens
ctaccttgcttttgcttct

SEQ ID NO: 1263918 - DNA, 23 bp, Homo sapiens
ctacctttatatttggggtcctt

SEQ ID NO: 1263919 - DNA, 19 bp, Homo sapiens
ctacctttttatatttaaa

SEQ ID NO: 1263920 - DNA, 21 bp, Homo sapiens
ctaccttttttttttgagttt

SEQ ID NO: 1263921 - DNA, 13 bp, Homo sapiens
ctacgccaaagtg

SEQ ID NO: 1263922 - DNA, 20 bp, Homo sapiens
ctacggggaaaatgcatttt

SEQ ID NO: 1263923 - DNA, 23 bp, Homo sapiens
ctacgtatttttctgacttttac

SEQ ID NO: 1263924 - DNA, 12 bp, Homo sapiens
ctacgtgcctcc

SEQ ID NO: 1263925 - DNA, 20 bp, Homo sapiens
ctactaaaaatgcaaaaaaa

SEQ ID NO: 1263926 - DNA, 13 bp, Homo sapiens
ctactaaatccct

SEQ ID NO: 1263927 - DNA, 17 bp, Homo sapiens
ctactaatagaataaag

SEQ ID NO: 1263928 - DNA, 19 bp, Homo sapiens
ctactacccattgttccct

SEQ ID NO: 1263929 - DNA, 22 bp, Homo sapiens
ctactacccattgttcccttcc

SEQ ID NO: 1263930 - DNA, 20 bp, Homo sapiens
ctagcacaaggagtgcccgc

SEQ ID NO: 1263931 - DNA, 14 bp, Homo sapiens
ctagcaccatggca

SEQ ID NO: 1263932 - DNA, 21 bp, Homo sapiens
ctagcactttgggaggccaag

SEQ ID NO: 1263933 - DNA, 17 bp, Homo sapiens
ctagcagacagaaactg

SEQ ID NO: 1263934 - DNA, 23 bp, Homo sapiens
ctagcagagcaggggcagggtga

SEQ ID NO: 1263935 - DNA, 19 bp, Homo sapiens
ctagcagcaccgttctgtg

SEQ ID NO: 1263936 - DNA, 23 bp, Homo sapiens
ctagcagcccttgtgtgtgccct

SEQ ID NO: 1263937 - DNA, 24 bp, Homo sapiens
ctagcagcccttgtgtgtgccctg

SEQ ID NO: 1263938 - DNA, 12 bp, Homo sapiens
ctagcagctggc

SEQ ID NO: 1263939 - DNA, 13 bp, Homo sapiens
ctagcagctggcc

SEQ ID NO: 1263940 - DNA, 15 bp, Homo sapiens
ctagcagctggccta

SEQ ID NO: 1263941 - DNA, 12 bp, Homo sapiens
ctagcaggcccc

SEQ ID NO: 1263942 - DNA, 15 bp, Homo sapiens
ctagcagtaaaagat

SEQ ID NO: 1263943 - DNA, 17 bp, Homo sapiens
ctagcagtaaaagataa

SEQ ID NO: 1263944 - DNA, 18 bp, Homo sapiens
ctagcatacgtacacatt

SEQ ID NO: 1263945 - DNA, 21 bp, Homo sapiens
ctagcatacgtacacatttta

SEQ ID NO: 1263946 - DNA, 22 bp, Homo sapiens
ctagcattgtaaaattatttca

SEQ ID NO: 1263947 - DNA, 19 bp, Homo sapiens
ctagcatttatttctctgg

SEQ ID NO: 1263948 - DNA, 20 bp, Homo sapiens
ctagcatttatttctctggc

SEQ ID NO: 1263949 - DNA, 18 bp, Homo sapiens
ctagcattttcttgaacc

SEQ ID NO: 1263950 - DNA, 23 bp, Homo sapiens
ctagccaaggctagttcctttca

SEQ ID NO: 1263951 - DNA, 15 bp, Homo sapiens
ctagccactcctgcc

SEQ ID NO: 1263952 - DNA, 15 bp, Homo sapiens
ctagccagacactct

SEQ ID NO: 1263953 - DNA, 23 bp, Homo sapiens
ctagccagacactctgctctgcc

SEQ ID NO: 1263954 - DNA, 17 bp, Homo sapiens
ctagccagagcccttca

SEQ ID NO: 1263955 - DNA, 19 bp, Homo sapiens
ctagccagagcccttcact

SEQ ID NO: 1263956 - DNA, 13 bp, Homo sapiens
ctagccaggagtc

SEQ ID NO: 1263957 - DNA, 21 bp, Homo sapiens
ctagccaggagtctgtgctct

SEQ ID NO: 1263958 - DNA, 13 bp, Homo sapiens
ctagccataataa

SEQ ID NO: 1263959 - DNA, 17 bp, Homo sapiens
ctagccatcccttgggg

SEQ ID NO: 1263960 - DNA, 21 bp, Homo sapiens
ctagccatcccttggggaagg

SEQ ID NO: 1263961 - DNA, 15 bp, Homo sapiens
ctagccattcctggt

SEQ ID NO: 1263962 - DNA, 13 bp, Homo sapiens
ctagcccagactc

SEQ ID NO: 1263963 - DNA, 17 bp, Homo sapiens
ctagcccagtgcttctc

SEQ ID NO: 1263964 - DNA, 19 bp, Homo sapiens
ctagcccatggacttcaca

SEQ ID NO: 1263965 - DNA, 19 bp, Homo sapiens
ctagccccaggtcttttct

SEQ ID NO: 1263966 - DNA, 15 bp, Homo sapiens
ctagcccctctctca

SEQ ID NO: 1263967 - DNA, 16 bp, Homo sapiens
ctagcccctctctcac

SEQ ID NO: 1263968 - DNA, 14 bp, Homo sapiens
ctagcccctctgga

SEQ ID NO: 1263969 - DNA, 15 bp, Homo sapiens
ctagcccctctggat

SEQ ID NO: 1263970 - DNA, 15 bp, Homo sapiens
ctagcccctggggtg

SEQ ID NO: 1263971 - DNA, 21 bp, Homo sapiens
ctagccctccccccagctccc

SEQ ID NO: 1263972 - DNA, 22 bp, Homo sapiens
ctagccctccccccagctccct

SEQ ID NO: 1263973 - DNA, 19 bp, Homo sapiens
ctagccctctcacatttat

SEQ ID NO: 1263974 - DNA, 13 bp, Homo sapiens
ctagccctgagcc

SEQ ID NO: 1263975 - DNA, 14 bp, Homo sapiens
ctagccctgagccc

SEQ ID NO: 1263976 - DNA, 18 bp, Homo sapiens
ctagccctgagcccggcc

SEQ ID NO: 1263977 - DNA, 13 bp, Homo sapiens
ctagcccttccag

SEQ ID NO: 1263978 - DNA, 15 bp, Homo sapiens
ctagcccttccagcc

SEQ ID NO: 1263979 - DNA, 16 bp, Homo sapiens
ctagcccttccagcct

SEQ ID NO: 1263980 - DNA, 13 bp, Homo sapiens
ctagcccttccct

SEQ ID NO: 1263981 - DNA, 16 bp, Homo sapiens
ctagcccttccctgag

SEQ ID NO: 1263982 - DNA, 19 bp, Homo sapiens
ctagcccttccctgagtgc

SEQ ID NO: 1263983 - DNA, 14 bp, Homo sapiens
ctagccgacctcag

SEQ ID NO: 1263984 - DNA, 16 bp, Homo sapiens
ctagccgacctcagcc

SEQ ID NO: 1263985 - DNA, 17 bp, Homo sapiens
ctagccgacctcagcct

SEQ ID NO: 1263986 - DNA, 23 bp, Homo sapiens
ctagcctaaagtatacaactgcc

SEQ ID NO: 1263987 - DNA, 12 bp, Homo sapiens
ctagcctaattt

SEQ ID NO: 1263988 - DNA, 15 bp, Homo sapiens
ctagcctccagcttt

SEQ ID NO: 1263989 - DNA, 16 bp, Homo sapiens
ctagcctccagctttg

SEQ ID NO: 1263990 - DNA, 13 bp, Homo sapiens
ctagcctctgaga

SEQ ID NO: 1263991 - DNA, 18 bp, Homo sapiens
ctagcctctgagatgcta

SEQ ID NO: 1263992 - DNA, 19 bp, Homo sapiens
ctagcctgcattgagcttg

SEQ ID NO: 1263993 - DNA, 17 bp, Homo sapiens
ctagcctggatggcccc

SEQ ID NO: 1263994 - DNA, 21 bp, Homo sapiens
ctagcctggatggcccctcct

SEQ ID NO: 1263995 - DNA, 15 bp, Homo sapiens
ctagcctgggccaga

SEQ ID NO: 1263996 - DNA, 17 bp, Homo sapiens
ctagcctgggccagaga

SEQ ID NO: 1263997 - DNA, 21 bp, Homo sapiens
ctagcctgtgattaacttgct

SEQ ID NO: 1263998 - DNA, 17 bp, Homo sapiens
ctagccttatcctctga

SEQ ID NO: 1263999 - DNA, 13 bp, Homo sapiens
ctagccttgcttg

SEQ ID NO: 1264000 - DNA, 14 bp, Homo sapiens
ctagccttgcttgt

SEQ ID NO: 1264001 - DNA, 17 bp, Homo sapiens
ctagcgaacgtatttct

SEQ ID NO: 1264002 - DNA, 22 bp, Homo sapiens
ctagcgaacgtatttctccaga

SEQ ID NO: 1264003 - DNA, 19 bp, Homo sapiens
ctagcgatctctcctggcc

SEQ ID NO: 1264004 - DNA, 21 bp, Homo sapiens
ctagcgcagttttttttttct

SEQ ID NO: 1264005 - DNA, 22 bp, Homo sapiens
ctagcggagcccagcctgggag

SEQ ID NO: 1264006 - DNA, 15 bp, Homo sapiens
ctagcgtgtgccagg

SEQ ID NO: 1264007 - DNA, 17 bp, Homo sapiens
ctagcgtgtgccaggca

SEQ ID NO: 1264008 - DNA, 14 bp, Homo sapiens
ctagctaattattt

SEQ ID NO: 1264009 - DNA, 16 bp, Homo sapiens
ctagctaattatttaa

SEQ ID NO: 1264010 - DNA, 23 bp, Homo sapiens
ctagctagaagtgggccaggaca

SEQ ID NO: 1264011 - DNA, 15 bp, Homo sapiens
ctagctagccagcca

SEQ ID NO: 1264012 - DNA, 17 bp, Homo sapiens
ctagctagccagccaag

SEQ ID NO: 1264013 - DNA, 13 bp, Homo sapiens
ctagctagcgcac

SEQ ID NO: 1264014 - DNA, 16 bp, Homo sapiens
ctagctctctaggcct

SEQ ID NO: 1264015 - DNA, 14 bp, Homo sapiens
ctagctctttgggc

SEQ ID NO: 1264016 - DNA, 23 bp, Homo sapiens
ctagctgagaagcaatgggtcac

SEQ ID NO: 1264017 - DNA, 16 bp, Homo sapiens
ctagctgccactttca

SEQ ID NO: 1264018 - DNA, 15 bp, Homo sapiens
ctagctggcaggaca

SEQ ID NO: 1264019 - DNA, 13 bp, Homo sapiens
ctagctggctctg

SEQ ID NO: 1264020 - DNA, 12 bp, Homo sapiens
ctagctgggggt

SEQ ID NO: 1264021 - DNA, 19 bp, Homo sapiens
ctagctgggggtgggccag

SEQ ID NO: 1264022 - DNA, 17 bp, Homo sapiens
ctagctggtagcataaa

SEQ ID NO: 1264023 - DNA, 13 bp, Homo sapiens
ctagctgtctgtg

SEQ ID NO: 1264024 - DNA, 16 bp, Homo sapiens
ctagctgtctgtgaat

SEQ ID NO: 1264025 - DNA, 17 bp, Homo sapiens
ctagctgtctgtgaata

SEQ ID NO: 1264026 - DNA, 13 bp, Homo sapiens
ctagctgtgcccc

SEQ ID NO: 1264027 - DNA, 23 bp, Homo sapiens
ctagctgtgtgaatacctgctca

SEQ ID NO: 1264028 - DNA, 17 bp, Homo sapiens
ctagctgttctggacta

SEQ ID NO: 1264029 - DNA, 18 bp, Homo sapiens
ctagctttacgctcatca

SEQ ID NO: 1264030 - DNA, 23 bp, Homo sapiens
ctagctttatatatggacatggc

SEQ ID NO: 1264031 - DNA, 14 bp, Homo sapiens
ctagcttttaggaa

SEQ ID NO: 1264032 - DNA, 13 bp, Homo sapiens
ctagcttttctat

SEQ ID NO: 1264033 - DNA, 14 bp, Homo sapiens
ctagctttttaatt

SEQ ID NO: 1264034 - DNA, 15 bp, Homo sapiens
ctaggaaaattattc

SEQ ID NO: 1264035 - DNA, 19 bp, Homo sapiens
ctaggaaaccagctcgtgg

SEQ ID NO: 1264036 - DNA, 14 bp, Homo sapiens
ctaggaaactcaca

SEQ ID NO: 1264037 - DNA, 15 bp, Homo sapiens
ctaggaactcagtgc

SEQ ID NO: 1264038 - DNA, 16 bp, Homo sapiens
ctaggaagaggagtgg

SEQ ID NO: 1264039 - DNA, 17 bp, Homo sapiens
ctaggaatcccagaggt

SEQ ID NO: 1264040 - DNA, 16 bp, Homo sapiens
ctaggaatgaaatcct

SEQ ID NO: 1264041 - DNA, 19 bp, Homo sapiens
ctaggaattctttgcattc

SEQ ID NO: 1264042 - DNA, 16 bp, Homo sapiens
ctaggaccactcagcc

SEQ ID NO: 1264043 - DNA, 17 bp, Homo sapiens
ctaggaccactcagccc

SEQ ID NO: 1264044 - DNA, 18 bp, Homo sapiens
ctaggaccactcagcccc

SEQ ID NO: 1264045 - DNA, 21 bp, Homo sapiens
ctaggaccactcagcccctag

SEQ ID NO: 1264046 - DNA, 22 bp, Homo sapiens
ctaggaccactcagcccctagg

SEQ ID NO: 1264047 - DNA, 15 bp, Homo sapiens
ctaggacgccaactt

SEQ ID NO: 1264048 - DNA, 22 bp, Homo sapiens
ctaggacgccaacttctcccac

SEQ ID NO: 1264049 - DNA, 23 bp, Homo sapiens
ctaggacgccaacttctcccacc

SEQ ID NO: 1264050 - DNA, 18 bp, Homo sapiens
ctaggactgaggagtggg

SEQ ID NO: 1264051 - DNA, 15 bp, Homo sapiens
ctaggactgcagtgt

SEQ ID NO: 1264052 - DNA, 15 bp, Homo sapiens
ctatgcattttcttc

SEQ ID NO: 1264053 - DNA, 18 bp, Homo sapiens
ctatgccatttcttctct

SEQ ID NO: 1264054 - DNA, 22 bp, Homo sapiens
ctatgccatttcttctctctgt

SEQ ID NO: 1264055 - DNA, 22 bp, Homo sapiens
ctatgcccaggtaccacccttc

SEQ ID NO: 1264056 - DNA, 23 bp, Homo sapiens
ctatgccctgcagagcaataaca

SEQ ID NO: 1264057 - DNA, 18 bp, Homo sapiens
ctatgccctgcccttcct

SEQ ID NO: 1264058 - DNA, 14 bp, Homo sapiens
ctatgcctgcactg

SEQ ID NO: 1264059 - DNA, 18 bp, Homo sapiens
ctatgcctgcactgggaa

SEQ ID NO: 1264060 - DNA, 23 bp, Homo sapiens
ctatgctggggtacacagtgaga

SEQ ID NO: 1264061 - DNA, 21 bp, Homo sapiens
ctatgctggtaggctcctgcc

SEQ ID NO: 1264062 - DNA, 14 bp, Homo sapiens
ctatgctgtatctg

SEQ ID NO: 1264063 - DNA, 15 bp, Homo sapiens
ctatgctgtatctgt

SEQ ID NO: 1264064 - DNA, 18 bp, Homo sapiens
ctatgctgtttgtagtga

SEQ ID NO: 1264065 - DNA, 21 bp, Homo sapiens
ctatgcttaataaaagaacat

SEQ ID NO: 1264066 - DNA, 13 bp, Homo sapiens
ctatggaaatgtg

SEQ ID NO: 1264067 - DNA, 18 bp, Homo sapiens
ctatggaaatgtgagaaa

SEQ ID NO: 1264068 - DNA, 19 bp, Homo sapiens
ctatggaaatgtgagaaat

SEQ ID NO: 1264069 - DNA, 20 bp, Homo sapiens
ctatggaaatgtgagaaatg

SEQ ID NO: 1264070 - DNA, 12 bp, Homo sapiens
ctatggacacag

SEQ ID NO: 1264071 - DNA, 14 bp, Homo sapiens
ctatggacacaggg

SEQ ID NO: 1264072 - DNA, 16 bp, Homo sapiens
ctatggcctcgcctcc

SEQ ID NO: 1264073 - DNA, 13 bp, Homo sapiens
ctatgggagcccc

SEQ ID NO: 1264074 - DNA, 15 bp, Homo sapiens
ctatgggagccccag

SEQ ID NO: 1264075 - DNA, 16 bp, Homo sapiens
ctatgggagccccagg

SEQ ID NO: 1264076 - DNA, 19 bp, Homo sapiens
ctatgggagccccagggtc

SEQ ID NO: 1264077 - DNA, 19 bp, Homo sapiens
ctatgggcctgccgggctg

SEQ ID NO: 1264078 - DNA, 23 bp, Homo sapiens
ctatgggcctgccgggctgaggg

SEQ ID NO: 1264079 - DNA, 19 bp, Homo sapiens
ctatggggaggccctgcct

SEQ ID NO: 1264080 - DNA, 20 bp, Homo sapiens
ctatggggaggccctgcctc

SEQ ID NO: 1264081 - DNA, 20 bp, Homo sapiens
ctatgggttatttttattaa

SEQ ID NO: 1264082 - DNA, 20 bp, Homo sapiens
ctatggtgagatgcagctgg

SEQ ID NO: 1264083 - DNA, 20 bp, Homo sapiens
ctatggttcccaataaaagt

SEQ ID NO: 1264084 - DNA, 19 bp, Homo sapiens
ctatggtttgccattattt

SEQ ID NO: 1264085 - DNA, 23 bp, Homo sapiens
ctatggtttgccattatttaata

SEQ ID NO: 1264086 - DNA, 17 bp, Homo sapiens
ctatgtaaattattgta

SEQ ID NO: 1264087 - DNA, 18 bp, Homo sapiens
ctatgtaaattattgtaa

SEQ ID NO: 1264088 - DNA, 19 bp, Homo sapiens
ctatgtaaattattgtaaa

SEQ ID NO: 1264089 - DNA, 22 bp, Homo sapiens
ctatgtaacatgtaggaagtag

SEQ ID NO: 1264090 - DNA, 21 bp, Homo sapiens
ctatgtaagaattcagaagac

SEQ ID NO: 1264091 - DNA, 16 bp, Homo sapiens
ctatgtacagagcttt

SEQ ID NO: 1264092 - DNA, 23 bp, Homo sapiens
ctatgtacagagctttcttttgt

SEQ ID NO: 1264093 - DNA, 19 bp, Homo sapiens
ctatgtagtgtctttattt

SEQ ID NO: 1264094 - DNA, 19 bp, Homo sapiens
ctatgtatcaatgagtaac

SEQ ID NO: 1264095 - DNA, 14 bp, Homo sapiens
ctatgtatggaata

SEQ ID NO: 1264096 - DNA, 17 bp, Homo sapiens
ctatgtcaatttgtata

SEQ ID NO: 1264097 - DNA, 19 bp, Homo sapiens
ctatgtcaatttgtatatc

SEQ ID NO: 1264098 - DNA, 17 bp, Homo sapiens
ctatgtcatttttaatg

SEQ ID NO: 1264099 - DNA, 21 bp, Homo sapiens
ctatgtcctaaggacacacta

SEQ ID NO: 1264100 - DNA, 17 bp, Homo sapiens
ctatgtcgatgcacagt

SEQ ID NO: 1264101 - DNA, 19 bp, Homo sapiens
ctatgtcgtgttttcaagg

SEQ ID NO: 1264102 - DNA, 11 bp, Homo sapiens
ctatgtctgaa

SEQ ID NO: 1264103 - DNA, 13 bp, Homo sapiens
ctatgtctgcctt

SEQ ID NO: 1264104 - DNA, 12 bp, Homo sapiens
ctatgtgacaat

SEQ ID NO: 1264105 - DNA, 19 bp, Homo sapiens
ctatgtgccttatgttgaa

SEQ ID NO: 1264106 - DNA, 22 bp, Homo sapiens
ctatgtgccttatgttgaaaaa

SEQ ID NO: 1264107 - DNA, 16 bp, Homo sapiens
ctatgtgctgggtgcc

SEQ ID NO: 1264108 - DNA, 17 bp, Homo sapiens
ctatgtggctgtatctt

SEQ ID NO: 1264109 - DNA, 14 bp, Homo sapiens
ctatgtgtttctgt

SEQ ID NO: 1264110 - DNA, 15 bp, Homo sapiens
ctatgtgtttctgta

SEQ ID NO: 1264111 - DNA, 20 bp, Homo sapiens
ctatgtgtttctgtaacaaa

SEQ ID NO: 1264112 - DNA, 14 bp, Homo sapiens
ctatgttaaatact

SEQ ID NO: 1264113 - DNA, 18 bp, Homo sapiens
ctatgttaaatactgtgc

SEQ ID NO: 1264114 - DNA, 15 bp, Homo sapiens
ctatgttactatttt

SEQ ID NO: 1264115 - DNA, 22 bp, Homo sapiens
ctatgttactattttctacaat

SEQ ID NO: 1264116 - DNA, 20 bp, Homo sapiens
ctatgttcaaagactgtgaa

SEQ ID NO: 1264117 - DNA, 12 bp, Homo sapiens
ctatgttcccca

SEQ ID NO: 1264118 - DNA, 14 bp, Homo sapiens
ctatgttccctcca

SEQ ID NO: 1264119 - DNA, 18 bp, Homo sapiens
ctatgttctgtcttccca

SEQ ID NO: 1264120 - DNA, 21 bp, Homo sapiens
ctatgttgcccaagctggtct

SEQ ID NO: 1264121 - DNA, 14 bp, Homo sapiens
ctatgtttgcactt

SEQ ID NO: 1264122 - DNA, 12 bp, Homo sapiens
ctatgtttgtat

SEQ ID NO: 1264123 - DNA, 17 bp, Homo sapiens
ctatgtttgtatttgga

SEQ ID NO: 1264124 - DNA, 14 bp, Homo sapiens
ctatgtttttaatg

SEQ ID NO: 1264125 - DNA, 15 bp, Homo sapiens
ctatgtttttaatgt

SEQ ID NO: 1264126 - DNA, 20 bp, Homo sapiens
ctatgtttttgttcaaagcc

SEQ ID NO: 1264127 - DNA, 22 bp, Homo sapiens
ctatgtttttgttcaaagccag

SEQ ID NO: 1264128 - DNA, 21 bp, Homo sapiens
ctattaacaattaattgtctt

SEQ ID NO: 1264129 - DNA, 19 bp, Homo sapiens
ctattaagaaaatcacatt

SEQ ID NO: 1264130 - DNA, 17 bp, Homo sapiens
ctattaagattggaaat

SEQ ID NO: 1264131 - DNA, 22 bp, Homo sapiens
ctattaagcagtaaaaactgtt

SEQ ID NO: 1264132 - DNA, 23 bp, Homo sapiens
ctattaaggtgatatatttaaaa

SEQ ID NO: 1264133 - DNA, 20 bp, Homo sapiens
ctattaatatcaactctgaa

SEQ ID NO: 1264134 - DNA, 17 bp, Homo sapiens
ctattacattttcagtg

SEQ ID NO: 1264135 - DNA, 17 bp, Homo sapiens
ctattacttttctgttt

SEQ ID NO: 1264136 - DNA, 12 bp, Homo sapiens
ctattagacttt

SEQ ID NO: 1264137 - DNA, 16 bp, Homo sapiens
ctattagagtatttcc

SEQ ID NO: 1264138 - DNA, 20 bp, Homo sapiens
ctattagagtatttcccttc

SEQ ID NO: 1264139 - DNA, 16 bp, Homo sapiens
ctattagcaagaatca

SEQ ID NO: 1264140 - DNA, 14 bp, Homo sapiens
ctattatagccaca

SEQ ID NO: 1264141 - DNA, 19 bp, Homo sapiens
ctattatctgtcagctgca

SEQ ID NO: 1264142 - DNA, 22 bp, Homo sapiens
ctattatttggagcctgccaag

SEQ ID NO: 1264143 - DNA, 22 bp, Homo sapiens
ctattattttcactgtagaatg

SEQ ID NO: 1264144 - DNA, 23 bp, Homo sapiens
ctattcaagaggaaatgtcacag

SEQ ID NO: 1264145 - DNA, 20 bp, Homo sapiens
ctattcaccctccacttccc

SEQ ID NO: 1264146 - DNA, 23 bp, Homo sapiens
ctattcagcttcgtttattttca

SEQ ID NO: 1264147 - DNA, 23 bp, Homo sapiens
ctattcattaagtaatcttttta

SEQ ID NO: 1264148 - DNA, 17 bp, Homo sapiens
ctattccccagcagggt

SEQ ID NO: 1264149 - DNA, 17 bp, Homo sapiens
ctattccctttgacttc

SEQ ID NO: 1264150 - DNA, 21 bp, Homo sapiens
ctattccctttgacttcagct

SEQ ID NO: 1264151 - DNA, 11 bp, Homo sapiens
ctattccttat

SEQ ID NO: 1264152 - DNA, 18 bp, Homo sapiens
ctattcctttcccttcct

SEQ ID NO: 1264153 - DNA, 19 bp, Homo sapiens
ctattcctttcccttcctc

SEQ ID NO: 1264154 - DNA, 20 bp, Homo sapiens
ctattcctttcccttcctct

SEQ ID NO: 1264155 - DNA, 17 bp, Homo sapiens
ctattctagcctgcatt

SEQ ID NO: 1264156 - DNA, 14 bp, Homo sapiens
ctattctattgcag

SEQ ID NO: 1264157 - DNA, 15 bp, Homo sapiens
ctattctcaccagga

SEQ ID NO: 1264158 - DNA, 16 bp, Homo sapiens
ctattctcctgccatg

SEQ ID NO: 1264159 - DNA, 22 bp, Homo sapiens
ctattctctgcaatttgtttaa

SEQ ID NO: 1264160 - DNA, 16 bp, Homo sapiens
ctattctgggggcccg

SEQ ID NO: 1264161 - DNA, 22 bp, Homo sapiens
ctattctgtcagtgttaaagat

SEQ ID NO: 1264162 - DNA, 16 bp, Homo sapiens
ctattcttaagcactt

SEQ ID NO: 1264163 - DNA, 16 bp, Homo sapiens
ctattcttggttctta

SEQ ID NO: 1264164 - DNA, 17 bp, Homo sapiens
ctattcttggttcttat

SEQ ID NO: 1264165 - DNA, 22 bp, Homo sapiens
ctattctttaactcccattacc

SEQ ID NO: 1264166 - DNA, 16 bp, Homo sapiens
ctattgacaataaaat

SEQ ID NO: 1264167 - DNA, 16 bp, Homo sapiens
ctattgacttcaatga

SEQ ID NO: 1264168 - DNA, 16 bp, Homo sapiens
ctattgagccttgcat

SEQ ID NO: 1264169 - DNA, 23 bp, Homo sapiens
ctattgatgtacagtctgtcatg

SEQ ID NO: 1264170 - DNA, 21 bp, Homo sapiens
ctattgcaaaggttccaactg

SEQ ID NO: 1264171 - DNA, 14 bp, Homo sapiens
ctattgcaaatgag

SEQ ID NO: 1264172 - DNA, 12 bp, Homo sapiens
ctattgcacatc

SEQ ID NO: 1264173 - DNA, 18 bp, Homo sapiens
ctcaccagccccactgcc

SEQ ID NO: 1264174 - DNA, 19 bp, Homo sapiens
ctcaccagccccactgcca

SEQ ID NO: 1264175 - DNA, 20 bp, Homo sapiens
ctcaccagccccactgccag

SEQ ID NO: 1264176 - DNA, 12 bp, Homo sapiens
ctcaccagccct

SEQ ID NO: 1264177 - DNA, 18 bp, Homo sapiens
ctcaccagccctagctgt

SEQ ID NO: 1264178 - DNA, 19 bp, Homo sapiens
ctcaccagccctagctgtc

SEQ ID NO: 1264179 - DNA, 12 bp, Homo sapiens
ctcaccagggtc

SEQ ID NO: 1264180 - DNA, 13 bp, Homo sapiens
ctcaccagggtcc

SEQ ID NO: 1264181 - DNA, 23 bp, Homo sapiens
ctcaccagggtccgcaccagctg

SEQ ID NO: 1264182 - DNA, 12 bp, Homo sapiens
ctcaccagtggc

SEQ ID NO: 1264183 - DNA, 14 bp, Homo sapiens
ctcaccagtggcct

SEQ ID NO: 1264184 - DNA, 19 bp, Homo sapiens
ctcaccatgatgtgaagag

SEQ ID NO: 1264185 - DNA, 14 bp, Homo sapiens
ctcaccatgtaaaa

SEQ ID NO: 1264186 - DNA, 17 bp, Homo sapiens
ctcaccattgtgaagca

SEQ ID NO: 1264187 - DNA, 13 bp, Homo sapiens
ctcacccacaccc

SEQ ID NO: 1264188 - DNA, 17 bp, Homo sapiens
ctcacccaccagctcca

SEQ ID NO: 1264189 - DNA, 19 bp, Homo sapiens
ctcacccaccagctccaca

SEQ ID NO: 1264190 - DNA, 16 bp, Homo sapiens
ctcacccacctctggg

SEQ ID NO: 1264191 - DNA, 18 bp, Homo sapiens
ctcacccactctggtggc

SEQ ID NO: 1264192 - DNA, 19 bp, Homo sapiens
ctcacccactctggtggcc

SEQ ID NO: 1264193 - DNA, 20 bp, Homo sapiens
ctcacccactctggtggcca

SEQ ID NO: 1264194 - DNA, 22 bp, Homo sapiens
ctcacccactctggtggccact

SEQ ID NO: 1264195 - DNA, 13 bp, Homo sapiens
ctcacccagatca

SEQ ID NO: 1264196 - DNA, 12 bp, Homo sapiens
ctcaccccaagg

SEQ ID NO: 1264197 - DNA, 14 bp, Homo sapiens
ctcaccccaatccc

SEQ ID NO: 1264198 - DNA, 21 bp, Homo sapiens
ctcaccccaatccctgccact

SEQ ID NO: 1264199 - DNA, 20 bp, Homo sapiens
ctcaccccagctccgacctc

SEQ ID NO: 1264200 - DNA, 12 bp, Homo sapiens
ctcaccccatcc

SEQ ID NO: 1264201 - DNA, 14 bp, Homo sapiens
ctcacccccagctt

SEQ ID NO: 1264202 - DNA, 14 bp, Homo sapiens
ctcacccccatccc

SEQ ID NO: 1264203 - DNA, 18 bp, Homo sapiens
ctcaccccctcccacccc

SEQ ID NO: 1264204 - DNA, 23 bp, Homo sapiens
ctcaccccctcccacccccagcc

SEQ ID NO: 1264205 - DNA, 15 bp, Homo sapiens
ctcaccccctcctgg

SEQ ID NO: 1264206 - DNA, 17 bp, Homo sapiens
ctcaccccctcctggca

SEQ ID NO: 1264207 - DNA, 19 bp, Homo sapiens
ctcacccccttctccatcc

SEQ ID NO: 1264208 - DNA, 21 bp, Homo sapiens
ctcacccccttctccatccac

SEQ ID NO: 1264209 - DNA, 15 bp, Homo sapiens
ctcaccccgtctggg

SEQ ID NO: 1264210 - DNA, 16 bp, Homo sapiens
ctcacccctgggcagg

SEQ ID NO: 1264211 - DNA, 15 bp, Homo sapiens
ctcacccctgtaggg

SEQ ID NO: 1264212 - DNA, 18 bp, Homo sapiens
ctcacccctgtagggaaa

SEQ ID NO: 1264213 - DNA, 17 bp, Homo sapiens
ctcaccctactctggat

SEQ ID NO: 1264214 - DNA, 15 bp, Homo sapiens
ctcaccctctgtccc

SEQ ID NO: 1264215 - DNA, 17 bp, Homo sapiens
ctcaccctgcccgctcc

SEQ ID NO: 1264216 - DNA, 23 bp, Homo sapiens
ctcaccctgcccgctcccaaccc

SEQ ID NO: 1264217 - DNA, 21 bp, Homo sapiens
ctcaccctgccttatcttgca

SEQ ID NO: 1264218 - DNA, 15 bp, Homo sapiens
ctcaccctgtgggac

SEQ ID NO: 1264219 - DNA, 17 bp, Homo sapiens
ctcacccttcctggccc

SEQ ID NO: 1264220 - DNA, 18 bp, Homo sapiens
ctcacccttcctggccca

SEQ ID NO: 1264221 - DNA, 14 bp, Homo sapiens
ctcacccttgcacc

SEQ ID NO: 1264222 - DNA, 14 bp, Homo sapiens
ctcaccgcccatca

SEQ ID NO: 1264223 - DNA, 21 bp, Homo sapiens
ctcaccgctggcccttagaga

SEQ ID NO: 1264224 - DNA, 13 bp, Homo sapiens
ctcaccggctctc

SEQ ID NO: 1264225 - DNA, 23 bp, Homo sapiens
ctcacctaatgtttatgagccag

SEQ ID NO: 1264226 - DNA, 12 bp, Homo sapiens
ctcacctagagc

SEQ ID NO: 1264227 - DNA, 19 bp, Homo sapiens
ctcacctagagccagacca

SEQ ID NO: 1264228 - DNA, 14 bp, Homo sapiens
ctcacctcatgccc

SEQ ID NO: 1264229 - DNA, 17 bp, Homo sapiens
ctcacctcatgcccacc

SEQ ID NO: 1264230 - DNA, 16 bp, Homo sapiens
ctcacctcccccatct

SEQ ID NO: 1264231 - DNA, 14 bp, Homo sapiens
ctcacctctccctc

SEQ ID NO: 1264232 - DNA, 15 bp, Homo sapiens
ctcacctctgaggac

SEQ ID NO: 1264233 - DNA, 12 bp, Homo sapiens
ctcacctctgcc

SEQ ID NO: 1264234 - DNA, 15 bp, Homo sapiens
ctcacctctgcctca

SEQ ID NO: 1264235 - DNA, 22 bp, Homo sapiens
ctcacctctggactggctagag

SEQ ID NO: 1264236 - DNA, 19 bp, Homo sapiens
ctcacctgcccctctgttc

SEQ ID NO: 1264237 - DNA, 16 bp, Homo sapiens
ctcacctgctccagga

SEQ ID NO: 1264238 - DNA, 15 bp, Homo sapiens
ctcacctgctggccc

SEQ ID NO: 1264239 - DNA, 18 bp, Homo sapiens
ctcacctgctggcccctc

SEQ ID NO: 1264240 - DNA, 21 bp, Homo sapiens
ctcacctgctggcccctcacc

SEQ ID NO: 1264241 - DNA, 22 bp, Homo sapiens
ctcacctggaggcaagagggag

SEQ ID NO: 1264242 - DNA, 19 bp, Homo sapiens
ctcacctgggcacctgggg

SEQ ID NO: 1264243 - DNA, 21 bp, Homo sapiens
ctcacctgggcacctggggag

SEQ ID NO: 1264244 - DNA, 20 bp, Homo sapiens
ctcacctgggcagggatgat

SEQ ID NO: 1264245 - DNA, 15 bp, Homo sapiens
ctcacctgggccttt

SEQ ID NO: 1264246 - DNA, 16 bp, Homo sapiens
ctcacctgggcctttc

SEQ ID NO: 1264247 - DNA, 17 bp, Homo sapiens
ctcacctgggcctttcc

SEQ ID NO: 1264248 - DNA, 21 bp, Homo sapiens
ctcacctgggcctttcctgtg

SEQ ID NO: 1264249 - DNA, 24 bp, Homo sapiens
ctcacctgggcctttcctgtgcca

SEQ ID NO: 1264250 - DNA, 17 bp, Homo sapiens
ctcacctggttgaccca

SEQ ID NO: 1264251 - DNA, 17 bp, Homo sapiens
ctcaccttcctgtgggt

SEQ ID NO: 1264252 - DNA, 20 bp, Homo sapiens
ctcaccttgcaacacacaga

SEQ ID NO: 1264253 - DNA, 13 bp, Homo sapiens
ctcacgcaggctg

SEQ ID NO: 1264254 - DNA, 14 bp, Homo sapiens
ctcacgccaccccc

SEQ ID NO: 1264255 - DNA, 16 bp, Homo sapiens
ctcacgcccccaggaa

SEQ ID NO: 1264256 - DNA, 20 bp, Homo sapiens
ctcacgcctatgatcccagc

SEQ ID NO: 1264257 - DNA, 18 bp, Homo sapiens
ctcacgcctgtaatccca

SEQ ID NO: 1264258 - DNA, 22 bp, Homo sapiens
ctcacgcctgtaatcccagcag

SEQ ID NO: 1264259 - DNA, 23 bp, Homo sapiens
ctcacggaccactcgaggcctgc

SEQ ID NO: 1264260 - DNA, 17 bp, Homo sapiens
ctcacgggcatgggcac

SEQ ID NO: 1264261 - DNA, 17 bp, Homo sapiens
ctcacggggcctccaac

SEQ ID NO: 1264262 - DNA, 15 bp, Homo sapiens
ctcacgtcctgagaa

SEQ ID NO: 1264263 - DNA, 23 bp, Homo sapiens
ctcacgtgcaggacagctcttga

SEQ ID NO: 1264264 - DNA, 17 bp, Homo sapiens
ctcacgtttcttcccca

SEQ ID NO: 1264265 - DNA, 15 bp, Homo sapiens
ctcactaacaaagaa

SEQ ID NO: 1264266 - DNA, 14 bp, Homo sapiens
ctcactaagccccg

SEQ ID NO: 1264267 - DNA, 18 bp, Homo sapiens
ctcactaagccccggcac

SEQ ID NO: 1264268 - DNA, 13 bp, Homo sapiens
ctcactaattttt

SEQ ID NO: 1264269 - DNA, 15 bp, Homo sapiens
ctcactaatttttgt

SEQ ID NO: 1264270 - DNA, 13 bp, Homo sapiens
ctcactactgaac

SEQ ID NO: 1264271 - DNA, 21 bp, Homo sapiens
ctcactactgaacacatgtgt

SEQ ID NO: 1264272 - DNA, 15 bp, Homo sapiens
ctcactagtgccaat

SEQ ID NO: 1264273 - DNA, 17 bp, Homo sapiens
ctcactataccagtata

SEQ ID NO: 1264274 - DNA, 20 bp, Homo sapiens
ctcactatggtatgctggcc

SEQ ID NO: 1264275 - DNA, 22 bp, Homo sapiens
ctcactatggtatgctggccag

SEQ ID NO: 1264276 - DNA, 17 bp, Homo sapiens
ctcactcactccaagac

SEQ ID NO: 1264277 - DNA, 17 bp, Homo sapiens
ctcactcactccccact

SEQ ID NO: 1264278 - DNA, 21 bp, Homo sapiens
ctcactcagccaccctgagtt

SEQ ID NO: 1264279 - DNA, 21 bp, Homo sapiens
ctcactccacagagtgagcca

SEQ ID NO: 1264280 - DNA, 20 bp, Homo sapiens
ctcactccaccacccaaaag

SEQ ID NO: 1264281 - DNA, 12 bp, Homo sapiens
ctcactccaccc

SEQ ID NO: 1264282 - DNA, 14 bp, Homo sapiens
ctcactccagccaa

SEQ ID NO: 1264283 - DNA, 17 bp, Homo sapiens
ctcactccagccaaaga

SEQ ID NO: 1264284 - DNA, 13 bp, Homo sapiens
ctcactccagccc

SEQ ID NO: 1264285 - DNA, 18 bp, Homo sapiens
ctcactcccaagggacag

SEQ ID NO: 1264286 - DNA, 13 bp, Homo sapiens
ctcactccccagg

SEQ ID NO: 1264287 - DNA, 17 bp, Homo sapiens
ctcactccctctgcaga

SEQ ID NO: 1264288 - DNA, 16 bp, Homo sapiens
ctcactcctacctggt

SEQ ID NO: 1264289 - DNA, 17 bp, Homo sapiens
ctcactcctacctggta

SEQ ID NO: 1264290 - DNA, 18 bp, Homo sapiens
ctcactcctaggagagcc

SEQ ID NO: 1264291 - DNA, 23 bp, Homo sapiens
ctcactcctaggagagccaacct

SEQ ID NO: 1264292 - DNA, 12 bp, Homo sapiens
ctcactcctgag

SEQ ID NO: 1264293 - DNA, 13 bp, Homo sapiens
ctcactcctgagt

SEQ ID NO: 1264294 - DNA, 11 bp, Homo sapiens
ctcactcctgt

SEQ ID NO: 1264295 - DNA, 22 bp, Homo sapiens
ctcaggtcagctgggagccagt

SEQ ID NO: 1264296 - DNA, 17 bp, Homo sapiens
ctcaggtccctgcaggg

SEQ ID NO: 1264297 - DNA, 20 bp, Homo sapiens
ctcaggtccctggggctagg

SEQ ID NO: 1264298 - DNA, 15 bp, Homo sapiens
ctcaggtctgtaact

SEQ ID NO: 1264299 - DNA, 16 bp, Homo sapiens
ctcaggtgagaagcag

SEQ ID NO: 1264300 - DNA, 21 bp, Homo sapiens
ctcaggtgatccgcccacctc

SEQ ID NO: 1264301 - DNA, 16 bp, Homo sapiens
ctcaggtgatctgccc

SEQ ID NO: 1264302 - DNA, 14 bp, Homo sapiens
ctcaggtgccactc

SEQ ID NO: 1264303 - DNA, 18 bp, Homo sapiens
ctcaggtgccactccctg

SEQ ID NO: 1264304 - DNA, 12 bp, Homo sapiens
ctcaggtgcctc

SEQ ID NO: 1264305 - DNA, 17 bp, Homo sapiens
ctcaggtgctatgtccc

SEQ ID NO: 1264306 - DNA, 14 bp, Homo sapiens
ctcaggtgctgtcc

SEQ ID NO: 1264307 - DNA, 15 bp, Homo sapiens
ctcaggtggccatgc

SEQ ID NO: 1264308 - DNA, 18 bp, Homo sapiens
ctcaggtggccatgcctc

SEQ ID NO: 1264309 - DNA, 19 bp, Homo sapiens
ctcaggtggccatgcctca

SEQ ID NO: 1264310 - DNA, 20 bp, Homo sapiens
ctcaggtggccatgcctcag

SEQ ID NO: 1264311 - DNA, 19 bp, Homo sapiens
ctcaggtgtagctgagctg

SEQ ID NO: 1264312 - DNA, 20 bp, Homo sapiens
ctcaggtgtagctgagctgt

SEQ ID NO: 1264313 - DNA, 14 bp, Homo sapiens
ctcaggtgtgcctg

SEQ ID NO: 1264314 - DNA, 20 bp, Homo sapiens
ctcaggttagggctctgccc

SEQ ID NO: 1264315 - DNA, 14 bp, Homo sapiens
ctcaggttccagaa

SEQ ID NO: 1264316 - DNA, 16 bp, Homo sapiens
ctcaggttctttccat

SEQ ID NO: 1264317 - DNA, 21 bp, Homo sapiens
ctcaggttggcggcagacaca

SEQ ID NO: 1264318 - DNA, 22 bp, Homo sapiens
ctcaggttgtctgaagtcactg

SEQ ID NO: 1264319 - DNA, 18 bp, Homo sapiens
ctcaggtttgtcctggtc

SEQ ID NO: 1264320 - DNA, 21 bp, Homo sapiens
ctcagtaacataactgcttct

SEQ ID NO: 1264321 - DNA, 18 bp, Homo sapiens
ctcagtaatttagaaatc

SEQ ID NO: 1264322 - DNA, 17 bp, Homo sapiens
ctcagtacccagaacag

SEQ ID NO: 1264323 - DNA, 18 bp, Homo sapiens
ctcagtactttggaggcc

SEQ ID NO: 1264324 - DNA, 19 bp, Homo sapiens
ctcagtactttggaggccc

SEQ ID NO: 1264325 - DNA, 23 bp, Homo sapiens
ctcagtactttggaggcccctat

SEQ ID NO: 1264326 - DNA, 18 bp, Homo sapiens
ctcagtatgctgcccctg

SEQ ID NO: 1264327 - DNA, 22 bp, Homo sapiens
ctcagtattactttctgccgct

SEQ ID NO: 1264328 - DNA, 17 bp, Homo sapiens
ctcagtatttatgtaat

SEQ ID NO: 1264329 - DNA, 19 bp, Homo sapiens
ctcagtatttatgtaattt

SEQ ID NO: 1264330 - DNA, 20 bp, Homo sapiens
ctcagtcagttcccggagca

SEQ ID NO: 1264331 - DNA, 15 bp, Homo sapiens
ctcagtcatcaaagc

SEQ ID NO: 1264332 - DNA, 15 bp, Homo sapiens
ctcagtctaaggtct

SEQ ID NO: 1264333 - DNA, 18 bp, Homo sapiens
ctcagtctaaggtctcat

SEQ ID NO: 1264334 - DNA, 14 bp, Homo sapiens
ctcagtctcaggag

SEQ ID NO: 1264335 - DNA, 23 bp, Homo sapiens
ctcagtctcccagctaattgaga

SEQ ID NO: 1264336 - DNA, 14 bp, Homo sapiens
ctcagtctcccttt

SEQ ID NO: 1264337 - DNA, 13 bp, Homo sapiens
ctcagtctctgag

SEQ ID NO: 1264338 - DNA, 14 bp, Homo sapiens
ctcagtctctgagc

SEQ ID NO: 1264339 - DNA, 24 bp, Homo sapiens
ctcagtctggtgctccagttccag

SEQ ID NO: 1264340 - DNA, 12 bp, Homo sapiens
ctcagtctgttc

SEQ ID NO: 1264341 - DNA, 11 bp, Homo sapiens
ctcagtcttct

SEQ ID NO: 1264342 - DNA, 14 bp, Homo sapiens
ctcagtgaaggtgg

SEQ ID NO: 1264343 - DNA, 22 bp, Homo sapiens
ctcagtgaagtacacctgtgtg

SEQ ID NO: 1264344 - DNA, 13 bp, Homo sapiens
ctcagtgacccat

SEQ ID NO: 1264345 - DNA, 18 bp, Homo sapiens
ctcagtgagcctcctgtg

SEQ ID NO: 1264346 - DNA, 20 bp, Homo sapiens
ctcagtgagcctcctgtgcc

SEQ ID NO: 1264347 - DNA, 21 bp, Homo sapiens
ctcagtgagcctcctgtgcct

SEQ ID NO: 1264348 - DNA, 20 bp, Homo sapiens
ctcagtgccacctatgcctg

SEQ ID NO: 1264349 - DNA, 21 bp, Homo sapiens
ctcagtgccacctatgcctgt

SEQ ID NO: 1264350 - DNA, 21 bp, Homo sapiens
ctcagtgccggaggccttggg

SEQ ID NO: 1264351 - DNA, 12 bp, Homo sapiens
ctcagtgcctcc

SEQ ID NO: 1264352 - DNA, 14 bp, Homo sapiens
ctcagtgcctccac

SEQ ID NO: 1264353 - DNA, 19 bp, Homo sapiens
ctcagtgcctccacatgct

SEQ ID NO: 1264354 - DNA, 15 bp, Homo sapiens
ctcagtgcctcctgg

SEQ ID NO: 1264355 - DNA, 17 bp, Homo sapiens
ctcagtgcttgggctcc

SEQ ID NO: 1264356 - DNA, 20 bp, Homo sapiens
ctcagtggactttccacccc

SEQ ID NO: 1264357 - DNA, 18 bp, Homo sapiens
ctcagtgggaagaaaaat

SEQ ID NO: 1264358 - DNA, 22 bp, Homo sapiens
ctcagtgggacaaaccagagca

SEQ ID NO: 1264359 - DNA, 21 bp, Homo sapiens
ctcagtggtagctctggctta

SEQ ID NO: 1264360 - DNA, 14 bp, Homo sapiens
ctcagtgtcattta

SEQ ID NO: 1264361 - DNA, 18 bp, Homo sapiens
ctcagtgtcatttatgaa

SEQ ID NO: 1264362 - DNA, 21 bp, Homo sapiens
ctcagtgtccagcttccaaag

SEQ ID NO: 1264363 - DNA, 14 bp, Homo sapiens
ctcagtgttagaga

SEQ ID NO: 1264364 - DNA, 17 bp, Homo sapiens
ctcagtgttagagaaat

SEQ ID NO: 1264365 - DNA, 22 bp, Homo sapiens
ctcagtgttttggactccatct

SEQ ID NO: 1264366 - DNA, 13 bp, Homo sapiens
ctcagttaaaatg

SEQ ID NO: 1264367 - DNA, 14 bp, Homo sapiens
ctcagttaaaatgt

SEQ ID NO: 1264368 - DNA, 22 bp, Homo sapiens
ctcagttaaatctttgaagaat

SEQ ID NO: 1264369 - DNA, 16 bp, Homo sapiens
ctcagttacacaggaa

SEQ ID NO: 1264370 - DNA, 14 bp, Homo sapiens
ctcagttccaggcc

SEQ ID NO: 1264371 - DNA, 18 bp, Homo sapiens
ctcagttcccagacagct

SEQ ID NO: 1264372 - DNA, 14 bp, Homo sapiens
ctcagttcccttgg

SEQ ID NO: 1264373 - DNA, 16 bp, Homo sapiens
ctcagttcccttggcc

SEQ ID NO: 1264374 - DNA, 20 bp, Homo sapiens
ctcagttctctcccttcctc

SEQ ID NO: 1264375 - DNA, 22 bp, Homo sapiens
ctcagttgtttgcttcttgcca

SEQ ID NO: 1264376 - DNA, 18 bp, Homo sapiens
ctcagtttctccatcagc

SEQ ID NO: 1264377 - DNA, 14 bp, Homo sapiens
ctcagttttccttc

SEQ ID NO: 1264378 - DNA, 22 bp, Homo sapiens
ctcataaaactgtgactaggca

SEQ ID NO: 1264379 - DNA, 18 bp, Homo sapiens
ctcataaagatgttaaat

SEQ ID NO: 1264380 - DNA, 21 bp, Homo sapiens
ctcataaagatgttaaatgga

SEQ ID NO: 1264381 - DNA, 23 bp, Homo sapiens
ctcataaagatgttaaatggaat

SEQ ID NO: 1264382 - DNA, 14 bp, Homo sapiens
ctcataacttgaga

SEQ ID NO: 1264383 - DNA, 21 bp, Homo sapiens
ctcataattcctacagcacta

SEQ ID NO: 1264384 - DNA, 18 bp, Homo sapiens
ctcatacacagttaaata

SEQ ID NO: 1264385 - DNA, 18 bp, Homo sapiens
ctcataccacatggcttt

SEQ ID NO: 1264386 - DNA, 14 bp, Homo sapiens
ctcatactcctggg

SEQ ID NO: 1264387 - DNA, 14 bp, Homo sapiens
ctcatactgtctgg

SEQ ID NO: 1264388 - DNA, 17 bp, Homo sapiens
ctcatactgtctgggat

SEQ ID NO: 1264389 - DNA, 18 bp, Homo sapiens
ctcatagacactgatctg

SEQ ID NO: 1264390 - DNA, 12 bp, Homo sapiens
ctcatagaggtg

SEQ ID NO: 1264391 - DNA, 19 bp, Homo sapiens
ctcatagaggtgagaaaac

SEQ ID NO: 1264392 - DNA, 12 bp, Homo sapiens
ctcatagcatta

SEQ ID NO: 1264393 - DNA, 15 bp, Homo sapiens
ctcataggagactgc

SEQ ID NO: 1264394 - DNA, 17 bp, Homo sapiens
ctcataggagactgcgt

SEQ ID NO: 1264395 - DNA, 15 bp, Homo sapiens
ctcataggttaaaaa

SEQ ID NO: 1264396 - DNA, 21 bp, Homo sapiens
ctcatagtaataagatggctg

SEQ ID NO: 1264397 - DNA, 14 bp, Homo sapiens
ctcatatatttaag

SEQ ID NO: 1264398 - DNA, 12 bp, Homo sapiens
ctcatatttaaa

SEQ ID NO: 1264399 - DNA, 12 bp, Homo sapiens
ctcatattttgt

SEQ ID NO: 1264400 - DNA, 17 bp, Homo sapiens
ctcatcaatcaaataag

SEQ ID NO: 1264401 - DNA, 18 bp, Homo sapiens
ctcatcaatggggccagt

SEQ ID NO: 1264402 - DNA, 20 bp, Homo sapiens
ctcatcaccatcgtgtttgc

SEQ ID NO: 1264403 - DNA, 15 bp, Homo sapiens
ctcatcactggactg

SEQ ID NO: 1264404 - DNA, 22 bp, Homo sapiens
ctcatcagagcagctagctctt

SEQ ID NO: 1264405 - DNA, 18 bp, Homo sapiens
ctcatcagtgtgtaaata

SEQ ID NO: 1264406 - DNA, 14 bp, Homo sapiens
ctcatcataaaata

SEQ ID NO: 1264407 - DNA, 16 bp, Homo sapiens
ctcatcataaaataaa

SEQ ID NO: 1264408 - DNA, 23 bp, Homo sapiens
ctcatcatattccaacccagcca

SEQ ID NO: 1264409 - DNA, 22 bp, Homo sapiens
ctcatcatattgtatgtaagta

SEQ ID NO: 1264410 - DNA, 15 bp, Homo sapiens
ctcatcatttgcatt

SEQ ID NO: 1264411 - DNA, 23 bp, Homo sapiens
ctcatcatttgcattgggcatta

SEQ ID NO: 1264412 - DNA, 15 bp, Homo sapiens
ctcatcatttttata

SEQ ID NO: 1264413 - DNA, 13 bp, Homo sapiens
ctcatccacccca

SEQ ID NO: 1264414 - DNA, 15 bp, Homo sapiens
ctcatccaccccatc

SEQ ID NO: 1264415 - DNA, 22 bp, Homo sapiens
ctcatccactctactaatgcct

SEQ ID NO: 1264416 - DNA, 22 bp, Homo sapiens
ctcatcccaacctctttttcct

SEQ ID NO: 1264417 - DNA, 24 bp, Homo sapiens
ctccagcctctcccggctgcctgc

SEQ ID NO: 1264418 - DNA, 20 bp, Homo sapiens
ctccagcctgaacagaagct

SEQ ID NO: 1264419 - DNA, 13 bp, Homo sapiens
ctccagcctgagc

SEQ ID NO: 1264420 - DNA, 17 bp, Homo sapiens
ctccagcctgcctggca

SEQ ID NO: 1264421 - DNA, 13 bp, Homo sapiens
ctccagcctgggc

SEQ ID NO: 1264422 - DNA, 16 bp, Homo sapiens
ctccagcctgggggac

SEQ ID NO: 1264423 - DNA, 18 bp, Homo sapiens
ctccagcctttgctccct

SEQ ID NO: 1264424 - DNA, 13 bp, Homo sapiens
ctccagcgctgag

SEQ ID NO: 1264425 - DNA, 13 bp, Homo sapiens
ctccagcggccct

SEQ ID NO: 1264426 - DNA, 21 bp, Homo sapiens
ctccagctcagaacccagggc

SEQ ID NO: 1264427 - DNA, 22 bp, Homo sapiens
ctccagctcagaacccagggct

SEQ ID NO: 1264428 - DNA, 13 bp, Homo sapiens
ctccagctgcctg

SEQ ID NO: 1264429 - DNA, 14 bp, Homo sapiens
ctccagctgcctgg

SEQ ID NO: 1264430 - DNA, 19 bp, Homo sapiens
ctccagctgcctgggcccg

SEQ ID NO: 1264431 - DNA, 20 bp, Homo sapiens
ctccagctgggctctgcaat

SEQ ID NO: 1264432 - DNA, 16 bp, Homo sapiens
ctccagctgttcttag

SEQ ID NO: 1264433 - DNA, 13 bp, Homo sapiens
ctccagcttcagc

SEQ ID NO: 1264434 - DNA, 11 bp, Homo sapiens
ctccagcttct

SEQ ID NO: 1264435 - DNA, 13 bp, Homo sapiens
ctccagcttctgg

SEQ ID NO: 1264436 - DNA, 20 bp, Homo sapiens
ctccagcttctggtactctc

SEQ ID NO: 1264437 - DNA, 22 bp, Homo sapiens
ctccagcttctggtactctcct

SEQ ID NO: 1264438 - DNA, 16 bp, Homo sapiens
ctccaggaaagagcag

SEQ ID NO: 1264439 - DNA, 20 bp, Homo sapiens
ctccaggaatgcctcctccc

SEQ ID NO: 1264440 - DNA, 15 bp, Homo sapiens
ctccaggaccagggg

SEQ ID NO: 1264441 - DNA, 16 bp, Homo sapiens
ctccaggagagagcca

SEQ ID NO: 1264442 - DNA, 11 bp, Homo sapiens
ctccaggagct

SEQ ID NO: 1264443 - DNA, 12 bp, Homo sapiens
ctccaggagggg

SEQ ID NO: 1264444 - DNA, 19 bp, Homo sapiens
ctccaggattgaagagcat

SEQ ID NO: 1264445 - DNA, 21 bp, Homo sapiens
ctccaggcacccttctttcct

SEQ ID NO: 1264446 - DNA, 17 bp, Homo sapiens
ctccaggcaggccaggc

SEQ ID NO: 1264447 - DNA, 12 bp, Homo sapiens
ctccaggccagg

SEQ ID NO: 1264448 - DNA, 21 bp, Homo sapiens
ctccaggccccaccaagaggg

SEQ ID NO: 1264449 - DNA, 16 bp, Homo sapiens
ctccaggcctgcctcc

SEQ ID NO: 1264450 - DNA, 13 bp, Homo sapiens
ctccaggcctgtt

SEQ ID NO: 1264451 - DNA, 16 bp, Homo sapiens
ctccaggctttctgga

SEQ ID NO: 1264452 - DNA, 17 bp, Homo sapiens
ctccaggctttctggag

SEQ ID NO: 1264453 - DNA, 19 bp, Homo sapiens
ctccagggaatccaagcct

SEQ ID NO: 1264454 - DNA, 20 bp, Homo sapiens
ctccagggaatccaagcctc

SEQ ID NO: 1264455 - DNA, 21 bp, Homo sapiens
ctccagggaatccaagcctcc

SEQ ID NO: 1264456 - DNA, 14 bp, Homo sapiens
ctccagggacacac

SEQ ID NO: 1264457 - DNA, 18 bp, Homo sapiens
ctccagggacacacagcc

SEQ ID NO: 1264458 - DNA, 19 bp, Homo sapiens
ctccagggacacacagcct

SEQ ID NO: 1264459 - DNA, 20 bp, Homo sapiens
ctccagggacacacagccta

SEQ ID NO: 1264460 - DNA, 22 bp, Homo sapiens
ctccagggacacacagcctagc

SEQ ID NO: 1264461 - DNA, 23 bp, Homo sapiens
ctccagggacccttgcctgcctc

SEQ ID NO: 1264462 - DNA, 20 bp, Homo sapiens
ctccagggagtcccctcccc

SEQ ID NO: 1264463 - DNA, 17 bp, Homo sapiens
ctccagggatggcccct

SEQ ID NO: 1264464 - DNA, 16 bp, Homo sapiens
ctccagggccacgtgc

SEQ ID NO: 1264465 - DNA, 13 bp, Homo sapiens
ctccagggccccc

SEQ ID NO: 1264466 - DNA, 15 bp, Homo sapiens
ctccagggcccccac

SEQ ID NO: 1264467 - DNA, 15 bp, Homo sapiens
ctccagggcccccca

SEQ ID NO: 1264468 - DNA, 13 bp, Homo sapiens
ctccagggctcca

SEQ ID NO: 1264469 - DNA, 21 bp, Homo sapiens
ctccaggggcagggccttgtc

SEQ ID NO: 1264470 - DNA, 19 bp, Homo sapiens
ctccaggggctcctgggtt

SEQ ID NO: 1264471 - DNA, 21 bp, Homo sapiens
ctccaggggctcctgggttgg

SEQ ID NO: 1264472 - DNA, 14 bp, Homo sapiens
ctccaggggctgct

SEQ ID NO: 1264473 - DNA, 18 bp, Homo sapiens
ctccaggggctgcttcct

SEQ ID NO: 1264474 - DNA, 17 bp, Homo sapiens
ctccaggggtttacagt

SEQ ID NO: 1264475 - DNA, 14 bp, Homo sapiens
ctccagggtcccct

SEQ ID NO: 1264476 - DNA, 20 bp, Homo sapiens
ctccagggtcttgggctact

SEQ ID NO: 1264477 - DNA, 15 bp, Homo sapiens
ctccagggtgatttt

SEQ ID NO: 1264478 - DNA, 17 bp, Homo sapiens
ctccaggtctcacgggc

SEQ ID NO: 1264479 - DNA, 14 bp, Homo sapiens
ctccaggtgtgcac

SEQ ID NO: 1264480 - DNA, 15 bp, Homo sapiens
ctccaggttcaagtg

SEQ ID NO: 1264481 - DNA, 17 bp, Homo sapiens
ctccagtagctcctgga

SEQ ID NO: 1264482 - DNA, 14 bp, Homo sapiens
ctccagtattcttg

SEQ ID NO: 1264483 - DNA, 15 bp, Homo sapiens
ctccagtcaggaggc

SEQ ID NO: 1264484 - DNA, 16 bp, Homo sapiens
ctccagtcatggtact

SEQ ID NO: 1264485 - DNA, 19 bp, Homo sapiens
ctccagtcgttatttctgt

SEQ ID NO: 1264486 - DNA, 20 bp, Homo sapiens
ctccagtctgctgccctcca

SEQ ID NO: 1264487 - DNA, 21 bp, Homo sapiens
ctccagtctgctgccctccat

SEQ ID NO: 1264488 - DNA, 22 bp, Homo sapiens
ctccagtgccgctcctgcttcc

SEQ ID NO: 1264489 - DNA, 18 bp, Homo sapiens
ctccagtgggctgatgct

SEQ ID NO: 1264490 - DNA, 14 bp, Homo sapiens
ctccagtggtgacc

SEQ ID NO: 1264491 - DNA, 14 bp, Homo sapiens
ctccagtgtcaggg

SEQ ID NO: 1264492 - DNA, 16 bp, Homo sapiens
ctccagtgtcagggtc

SEQ ID NO: 1264493 - DNA, 23 bp, Homo sapiens
ctccagtgttgcctcctcccatc

SEQ ID NO: 1264494 - DNA, 21 bp, Homo sapiens
ctccagttagaatgcaccatg

SEQ ID NO: 1264495 - DNA, 22 bp, Homo sapiens
ctccagttgaacactagtctgt

SEQ ID NO: 1264496 - DNA, 20 bp, Homo sapiens
ctccagttgggactcaggat

SEQ ID NO: 1264497 - DNA, 17 bp, Homo sapiens
ctccagttttcagttga

SEQ ID NO: 1264498 - DNA, 16 bp, Homo sapiens
ctccagtttttgagga

SEQ ID NO: 1264499 - DNA, 16 bp, Homo sapiens
ctccataagtaagaaa

SEQ ID NO: 1264500 - DNA, 22 bp, Homo sapiens
ctccataagtttaactttaaaa

SEQ ID NO: 1264501 - DNA, 20 bp, Homo sapiens
ctccatatttgatttctaat

SEQ ID NO: 1264502 - DNA, 21 bp, Homo sapiens
ctccatcacctgaaacactgg

SEQ ID NO: 1264503 - DNA, 23 bp, Homo sapiens
ctccatcacctgaaacactggac

SEQ ID NO: 1264504 - DNA, 14 bp, Homo sapiens
ctccatccaaggcc

SEQ ID NO: 1264505 - DNA, 18 bp, Homo sapiens
ctccatccaaggccaggt

SEQ ID NO: 1264506 - DNA, 20 bp, Homo sapiens
ctccatccacatgggagccg

SEQ ID NO: 1264507 - DNA, 16 bp, Homo sapiens
ctccatccatctgtcc

SEQ ID NO: 1264508 - DNA, 13 bp, Homo sapiens
ctccatcccctcc

SEQ ID NO: 1264509 - DNA, 14 bp, Homo sapiens
ctccatcccctccc

SEQ ID NO: 1264510 - DNA, 16 bp, Homo sapiens
ctccatcccctccctg

SEQ ID NO: 1264511 - DNA, 18 bp, Homo sapiens
ctccatcccctccctgcc

SEQ ID NO: 1264512 - DNA, 20 bp, Homo sapiens
ctccatcccctccctgcctg

SEQ ID NO: 1264513 - DNA, 22 bp, Homo sapiens
ctccatccctctaatgagactg

SEQ ID NO: 1264514 - DNA, 16 bp, Homo sapiens
ctccatccctgaaatt

SEQ ID NO: 1264515 - DNA, 14 bp, Homo sapiens
ctccatccctgctc

SEQ ID NO: 1264516 - DNA, 13 bp, Homo sapiens
ctccatccgtgct

SEQ ID NO: 1264517 - DNA, 20 bp, Homo sapiens
ctccatcgtctcatcctcct

SEQ ID NO: 1264518 - DNA, 13 bp, Homo sapiens
ctccatctccact

SEQ ID NO: 1264519 - DNA, 14 bp, Homo sapiens
ctccatctccactc

SEQ ID NO: 1264520 - DNA, 19 bp, Homo sapiens
ctccatctctcatcctcca

SEQ ID NO: 1264521 - DNA, 16 bp, Homo sapiens
ctccatctggcagggt

SEQ ID NO: 1264522 - DNA, 13 bp, Homo sapiens
ctccatctttata

SEQ ID NO: 1264523 - DNA, 16 bp, Homo sapiens
ctccatctttatagaa

SEQ ID NO: 1264524 - DNA, 18 bp, Homo sapiens
ctccatgactggctgtct

SEQ ID NO: 1264525 - DNA, 21 bp, Homo sapiens
ctccatgagacacatctcctc

SEQ ID NO: 1264526 - DNA, 20 bp, Homo sapiens
ctccatgaggtactggtccc

SEQ ID NO: 1264527 - DNA, 16 bp, Homo sapiens
ctccatgccccagctc

SEQ ID NO: 1264528 - DNA, 18 bp, Homo sapiens
ctccatgccccagctctg

SEQ ID NO: 1264529 - DNA, 14 bp, Homo sapiens
ctccatgcctctgg

SEQ ID NO: 1264530 - DNA, 14 bp, Homo sapiens
ctccatgctcctca

SEQ ID NO: 1264531 - DNA, 21 bp, Homo sapiens
ctccatgctcctcacctgtct

SEQ ID NO: 1264532 - DNA, 21 bp, Homo sapiens
ctccatgctgaaggctcccat

SEQ ID NO: 1264533 - DNA, 13 bp, Homo sapiens
ctccatgctgcaa

SEQ ID NO: 1264534 - DNA, 15 bp, Homo sapiens
ctccatgctgcctcc

SEQ ID NO: 1264535 - DNA, 13 bp, Homo sapiens
ctccatggccacc

SEQ ID NO: 1264536 - DNA, 15 bp, Homo sapiens
ctccatggccctgtc

SEQ ID NO: 1264537 - DNA, 21 bp, Homo sapiens
ctccatggccctgtcccaggc

SEQ ID NO: 1264538 - DNA, 18 bp, Homo sapiens
ctccatggcttcctcctc

SEQ ID NO: 1264539 - DNA, 16 bp, Homo sapiens
ctccccccactgcagg

SEQ ID NO: 1264540 - DNA, 16 bp, Homo sapiens
ctccccccagactctt

SEQ ID NO: 1264541 - DNA, 15 bp, Homo sapiens
ctccccccagctccc

SEQ ID NO: 1264542 - DNA, 19 bp, Homo sapiens
ctccccccagctccctgca

SEQ ID NO: 1264543 - DNA, 14 bp, Homo sapiens
ctccccccatccca

SEQ ID NO: 1264544 - DNA, 20 bp, Homo sapiens
ctccccccatcccagggtcc

SEQ ID NO: 1264545 - DNA, 18 bp, Homo sapiens
ctccccccgcccacccac

SEQ ID NO: 1264546 - DNA, 21 bp, Homo sapiens
ctccccccgcccacccacgca

SEQ ID NO: 1264547 - DNA, 17 bp, Homo sapiens
ctcccccgacactgctg

SEQ ID NO: 1264548 - DNA, 21 bp, Homo sapiens
ctcccccgcagtccccagccc

SEQ ID NO: 1264549 - DNA, 14 bp, Homo sapiens
ctcccccgccactc

SEQ ID NO: 1264550 - DNA, 15 bp, Homo sapiens
ctcccccgccactcc

SEQ ID NO: 1264551 - DNA, 16 bp, Homo sapiens
ctcccccggctgggcc

SEQ ID NO: 1264552 - DNA, 17 bp, Homo sapiens
ctccccctacccatatc

SEQ ID NO: 1264553 - DNA, 12 bp, Homo sapiens
ctccccctcaac

SEQ ID NO: 1264554 - DNA, 14 bp, Homo sapiens
ctccccctcagatg

SEQ ID NO: 1264555 - DNA, 13 bp, Homo sapiens
ctccccctcccca

SEQ ID NO: 1264556 - DNA, 17 bp, Homo sapiens
ctccccctcccccttct

SEQ ID NO: 1264557 - DNA, 11 bp, Homo sapiens
ctccccctcct

SEQ ID NO: 1264558 - DNA, 13 bp, Homo sapiens
ctccccctcctag

SEQ ID NO: 1264559 - DNA, 13 bp, Homo sapiens
ctccccctcctga

SEQ ID NO: 1264560 - DNA, 13 bp, Homo sapiens
ctccccctctgct

SEQ ID NO: 1264561 - DNA, 14 bp, Homo sapiens
ctccccctctgctt

SEQ ID NO: 1264562 - DNA, 16 bp, Homo sapiens
ctccccctctgcttct

SEQ ID NO: 1264563 - DNA, 14 bp, Homo sapiens
ctccccctctgtct

SEQ ID NO: 1264564 - DNA, 12 bp, Homo sapiens
ctccccctgcaa

SEQ ID NO: 1264565 - DNA, 23 bp, Homo sapiens
ctccccctgcaacttccgctgag

SEQ ID NO: 1264566 - DNA, 13 bp, Homo sapiens
ctccccctgctgc

SEQ ID NO: 1264567 - DNA, 12 bp, Homo sapiens
ctccccctgttc

SEQ ID NO: 1264568 - DNA, 21 bp, Homo sapiens
ctcccccttcagctcctgagt

SEQ ID NO: 1264569 - DNA, 23 bp, Homo sapiens
ctcccccttccccttctgtgtca

SEQ ID NO: 1264570 - DNA, 18 bp, Homo sapiens
ctcccccttcccttggag

SEQ ID NO: 1264571 - DNA, 13 bp, Homo sapiens
ctcccccttctcc

SEQ ID NO: 1264572 - DNA, 18 bp, Homo sapiens
ctcccccttgtcttcccc

SEQ ID NO: 1264573 - DNA, 20 bp, Homo sapiens
ctccccctttcacactggat

SEQ ID NO: 1264574 - DNA, 22 bp, Homo sapiens
ctccccctttcacactggatcc

SEQ ID NO: 1264575 - DNA, 13 bp, Homo sapiens
ctccccctttggg

SEQ ID NO: 1264576 - DNA, 19 bp, Homo sapiens
ctccccgaggctgccccag

SEQ ID NO: 1264577 - DNA, 22 bp, Homo sapiens
ctccccgaggctgccccaggcc

SEQ ID NO: 1264578 - DNA, 20 bp, Homo sapiens
ctccccgagggctcagaaga

SEQ ID NO: 1264579 - DNA, 23 bp, Homo sapiens
ctccccgatccccgacagtggct

SEQ ID NO: 1264580 - DNA, 22 bp, Homo sapiens
ctccccgcagcccgcctgccgt

SEQ ID NO: 1264581 - DNA, 17 bp, Homo sapiens
ctccccgcccctgtggc

SEQ ID NO: 1264582 - DNA, 22 bp, Homo sapiens
ctccccgcccctgtggccctgg

SEQ ID NO: 1264583 - DNA, 15 bp, Homo sapiens
ctccccgcctccact

SEQ ID NO: 1264584 - DNA, 22 bp, Homo sapiens
ctccccgcctcctcccactggg

SEQ ID NO: 1264585 - DNA, 18 bp, Homo sapiens
ctccccgctccgtctctg

SEQ ID NO: 1264586 - DNA, 22 bp, Homo sapiens
ctccccgctccgtctctgtcct

SEQ ID NO: 1264587 - DNA, 17 bp, Homo sapiens
ctccccggcaggcctga

SEQ ID NO: 1264588 - DNA, 14 bp, Homo sapiens
ctccccggccctac

SEQ ID NO: 1264589 - DNA, 21 bp, Homo sapiens
ctccccggcggtgccgcgctc

SEQ ID NO: 1264590 - DNA, 22 bp, Homo sapiens
ctccccggtaatgtcactgttt

SEQ ID NO: 1264591 - DNA, 21 bp, Homo sapiens
ctcccctatccacccagccca

SEQ ID NO: 1264592 - DNA, 16 bp, Homo sapiens
ctcccctcacatcctc

SEQ ID NO: 1264593 - DNA, 13 bp, Homo sapiens
ctcccctcagagc

SEQ ID NO: 1264594 - DNA, 19 bp, Homo sapiens
ctcccctcagcctgcccac

SEQ ID NO: 1264595 - DNA, 21 bp, Homo sapiens
ctcccctcagcctgcccacct

SEQ ID NO: 1264596 - DNA, 23 bp, Homo sapiens
ctcccctcagcctgcccacctct

SEQ ID NO: 1264597 - DNA, 13 bp, Homo sapiens
ctcccctcagcgc

SEQ ID NO: 1264598 - DNA, 20 bp, Homo sapiens
ctcccctcagcgcaggctgc

SEQ ID NO: 1264599 - DNA, 10 bp, Homo sapiens
ctcccctcca

SEQ ID NO: 1264600 - DNA, 14 bp, Homo sapiens
ctcccctccacagc

SEQ ID NO: 1264601 - DNA, 22 bp, Homo sapiens
ctcccctcccagtcctccagac

SEQ ID NO: 1264602 - DNA, 13 bp, Homo sapiens
ctcccctccccag

SEQ ID NO: 1264603 - DNA, 13 bp, Homo sapiens
ctcccctcccctg

SEQ ID NO: 1264604 - DNA, 15 bp, Homo sapiens
ctcccctcccctggg

SEQ ID NO: 1264605 - DNA, 15 bp, Homo sapiens
ctcccctccttgcct

SEQ ID NO: 1264606 - DNA, 22 bp, Homo sapiens
ctcccctccttgcctcctgtgt

SEQ ID NO: 1264607 - DNA, 10 bp, Homo sapiens
ctcccctcta

SEQ ID NO: 1264608 - DNA, 18 bp, Homo sapiens
ctcccctctcatccccct

SEQ ID NO: 1264609 - DNA, 21 bp, Homo sapiens
ctcccctctcatccccctgtg

SEQ ID NO: 1264610 - DNA, 16 bp, Homo sapiens
ctcccctctccttcct

SEQ ID NO: 1264611 - DNA, 15 bp, Homo sapiens
ctcccctctcttgca

SEQ ID NO: 1264612 - DNA, 19 bp, Homo sapiens
ctcccctctgcttctcatc

SEQ ID NO: 1264613 - DNA, 15 bp, Homo sapiens
ctcccctctggaatc

SEQ ID NO: 1264614 - DNA, 17 bp, Homo sapiens
ctcccctcttcctcttg

SEQ ID NO: 1264615 - DNA, 13 bp, Homo sapiens
ctcccctcttgag

SEQ ID NO: 1264616 - DNA, 14 bp, Homo sapiens
ctcccctgagaggt

SEQ ID NO: 1264617 - DNA, 22 bp, Homo sapiens
ctcccctgaggctcagggaaag

SEQ ID NO: 1264618 - DNA, 16 bp, Homo sapiens
ctcccctgccacactg

SEQ ID NO: 1264619 - DNA, 18 bp, Homo sapiens
ctcccctgccaccaggcc

SEQ ID NO: 1264620 - DNA, 16 bp, Homo sapiens
ctcccctgccagggca

SEQ ID NO: 1264621 - DNA, 21 bp, Homo sapiens
ctcccctgcccttcctcctga

SEQ ID NO: 1264622 - DNA, 12 bp, Homo sapiens
ctcccctgcctt

SEQ ID NO: 1264623 - DNA, 13 bp, Homo sapiens
ctcccctgccttg

SEQ ID NO: 1264624 - DNA, 13 bp, Homo sapiens
ctcccctgggcag

SEQ ID NO: 1264625 - DNA, 20 bp, Homo sapiens
ctcccctgggcagggttctc

SEQ ID NO: 1264626 - DNA, 23 bp, Homo sapiens
ctcccctgggcatcttctggctt

SEQ ID NO: 1264627 - DNA, 13 bp, Homo sapiens
ctcccctgggggt

SEQ ID NO: 1264628 - DNA, 15 bp, Homo sapiens
ctccccttccctgca

SEQ ID NO: 1264629 - DNA, 16 bp, Homo sapiens
ctccccttccctgcaa

SEQ ID NO: 1264630 - DNA, 16 bp, Homo sapiens
ctccccttccctgggg

SEQ ID NO: 1264631 - DNA, 15 bp, Homo sapiens
ctccccttcctggac

SEQ ID NO: 1264632 - DNA, 14 bp, Homo sapiens
ctccccttcttccc

SEQ ID NO: 1264633 - DNA, 23 bp, Homo sapiens
ctccccttcttcccgccccacct

SEQ ID NO: 1264634 - DNA, 14 bp, Homo sapiens
ctccccttgagctg

SEQ ID NO: 1264635 - DNA, 23 bp, Homo sapiens
ctccccttggacctccaggggct

SEQ ID NO: 1264636 - DNA, 21 bp, Homo sapiens
ctccccttttaccactcccag

SEQ ID NO: 1264637 - DNA, 20 bp, Homo sapiens
ctccccttttatgcacttca

SEQ ID NO: 1264638 - DNA, 14 bp, Homo sapiens
ctccccttttctat

SEQ ID NO: 1264639 - DNA, 20 bp, Homo sapiens
ctccccttttttttctgatt

SEQ ID NO: 1264640 - DNA, 18 bp, Homo sapiens
ctcccgaaaaatgtgtgg

SEQ ID NO: 1264641 - DNA, 17 bp, Homo sapiens
ctcccgaaagcctttcc

SEQ ID NO: 1264642 - DNA, 18 bp, Homo sapiens
ctcccgaaagcctttcct

SEQ ID NO: 1264643 - DNA, 19 bp, Homo sapiens
ctcccgccccgggctggcc

SEQ ID NO: 1264644 - DNA, 21 bp, Homo sapiens
ctcccgccccgggctggccct

SEQ ID NO: 1264645 - DNA, 13 bp, Homo sapiens
ctcccgctgcaca

SEQ ID NO: 1264646 - DNA, 16 bp, Homo sapiens
ctcccgctgcacacag

SEQ ID NO: 1264647 - DNA, 17 bp, Homo sapiens
ctcccgctgcacacaga

SEQ ID NO: 1264648 - DNA, 22 bp, Homo sapiens
ctcccggaattccgtcaccacg

SEQ ID NO: 1264649 - DNA, 22 bp, Homo sapiens
ctcccggcctggcttcactctc

SEQ ID NO: 1264650 - DNA, 20 bp, Homo sapiens
ctcccggctatgggggcact

SEQ ID NO: 1264651 - DNA, 13 bp, Homo sapiens
ctcccggctgcct

SEQ ID NO: 1264652 - DNA, 21 bp, Homo sapiens
ctcccgggccaagacagatgg

SEQ ID NO: 1264653 - DNA, 21 bp, Homo sapiens
ctcccgggccacgccccagcc

SEQ ID NO: 1264654 - DNA, 19 bp, Homo sapiens
ctcccgggccctcccttgg

SEQ ID NO: 1264655 - DNA, 14 bp, Homo sapiens
ctcccggggcccag

SEQ ID NO: 1264656 - DNA, 20 bp, Homo sapiens
ctcccgggggcagggtgggg

SEQ ID NO: 1264657 - DNA, 14 bp, Homo sapiens
ctcccgggggcccc

SEQ ID NO: 1264658 - DNA, 21 bp, Homo sapiens
ctcccgggggccccacctcgg

SEQ ID NO: 1264659 - DNA, 16 bp, Homo sapiens
ctcccgggtccttggc

SEQ ID NO: 1264660 - DNA, 21 bp, Homo sapiens
ctcccggtgcccaagaataga

SEQ ID NO: 1264661 - DNA, 14 bp, Homo sapiens
ctcctccactccac

SEQ ID NO: 1264662 - DNA, 16 bp, Homo sapiens
ctcctccagcccctgt

SEQ ID NO: 1264663 - DNA, 17 bp, Homo sapiens
ctcctccagcccctgtc

SEQ ID NO: 1264664 - DNA, 18 bp, Homo sapiens
ctcctccagcccctgtcc

SEQ ID NO: 1264665 - DNA, 22 bp, Homo sapiens
ctcctccagccgccatgctcct

SEQ ID NO: 1264666 - DNA, 13 bp, Homo sapiens
ctcctccaggcct

SEQ ID NO: 1264667 - DNA, 14 bp, Homo sapiens
ctcctccaggcctg

SEQ ID NO: 1264668 - DNA, 17 bp, Homo sapiens
ctcctccaggcctgcct

SEQ ID NO: 1264669 - DNA, 18 bp, Homo sapiens
ctcctccaggcctgcctc

SEQ ID NO: 1264670 - DNA, 21 bp, Homo sapiens
ctcctccaggcctgcctccca

SEQ ID NO: 1264671 - DNA, 14 bp, Homo sapiens
ctcctccagggaag

SEQ ID NO: 1264672 - DNA, 13 bp, Homo sapiens
ctcctccagggcc

SEQ ID NO: 1264673 - DNA, 20 bp, Homo sapiens
ctcctccagggccacgtgcc

SEQ ID NO: 1264674 - DNA, 23 bp, Homo sapiens
ctcctccagtacgtcccgctgct

SEQ ID NO: 1264675 - DNA, 15 bp, Homo sapiens
ctcctccatcacctg

SEQ ID NO: 1264676 - DNA, 19 bp, Homo sapiens
ctcctccatcacctgaaac

SEQ ID NO: 1264677 - DNA, 18 bp, Homo sapiens
ctcctccatgggagaaaa

SEQ ID NO: 1264678 - DNA, 13 bp, Homo sapiens
ctcctcccacaat

SEQ ID NO: 1264679 - DNA, 12 bp, Homo sapiens
ctcctcccactg

SEQ ID NO: 1264680 - DNA, 13 bp, Homo sapiens
ctcctcccactgg

SEQ ID NO: 1264681 - DNA, 21 bp, Homo sapiens
ctcctcccactgggactccca

SEQ ID NO: 1264682 - DNA, 17 bp, Homo sapiens
ctcctcccacttctcaa

SEQ ID NO: 1264683 - DNA, 13 bp, Homo sapiens
ctcctcccagatg

SEQ ID NO: 1264684 - DNA, 16 bp, Homo sapiens
ctcctcccagatggct

SEQ ID NO: 1264685 - DNA, 14 bp, Homo sapiens
ctcctcccagccca

SEQ ID NO: 1264686 - DNA, 14 bp, Homo sapiens
ctcctcccagcggc

SEQ ID NO: 1264687 - DNA, 16 bp, Homo sapiens
ctcctcccagctgctt

SEQ ID NO: 1264688 - DNA, 22 bp, Homo sapiens
ctcctcccaggcgccccttccc

SEQ ID NO: 1264689 - DNA, 21 bp, Homo sapiens
ctcctcccagggcctcctggg

SEQ ID NO: 1264690 - DNA, 15 bp, Homo sapiens
ctcctcccatccagc

SEQ ID NO: 1264691 - DNA, 17 bp, Homo sapiens
ctcctccccaaatcaat

SEQ ID NO: 1264692 - DNA, 18 bp, Homo sapiens
ctcctccccacctgtagc

SEQ ID NO: 1264693 - DNA, 11 bp, Homo sapiens
ctcctccccca

SEQ ID NO: 1264694 - DNA, 16 bp, Homo sapiens
ctcctcccccggctgg

SEQ ID NO: 1264695 - DNA, 19 bp, Homo sapiens
ctcctcccccggctgggcc

SEQ ID NO: 1264696 - DNA, 12 bp, Homo sapiens
ctcctccccctt

SEQ ID NO: 1264697 - DNA, 13 bp, Homo sapiens
ctcctcccccttt

SEQ ID NO: 1264698 - DNA, 21 bp, Homo sapiens
ctcctccccgctccgtctctg

SEQ ID NO: 1264699 - DNA, 22 bp, Homo sapiens
ctcctccccgctccgtctctgt

SEQ ID NO: 1264700 - DNA, 23 bp, Homo sapiens
ctcctccccgctccgtctctgtc

SEQ ID NO: 1264701 - DNA, 13 bp, Homo sapiens
ctcctcccctcct

SEQ ID NO: 1264702 - DNA, 17 bp, Homo sapiens
ctcctcccggtgcccaa

SEQ ID NO: 1264703 - DNA, 10 bp, Homo sapiens
ctcctccctg

SEQ ID NO: 1264704 - DNA, 15 bp, Homo sapiens
ctcctccctgcatct

SEQ ID NO: 1264705 - DNA, 12 bp, Homo sapiens
ctcctccctgct

SEQ ID NO: 1264706 - DNA, 15 bp, Homo sapiens
ctcctccctgctcct

SEQ ID NO: 1264707 - DNA, 22 bp, Homo sapiens
ctcctccctgctcctcatggga

SEQ ID NO: 1264708 - DNA, 14 bp, Homo sapiens
ctcctccctggctg

SEQ ID NO: 1264709 - DNA, 17 bp, Homo sapiens
ctcctccctggctgccc

SEQ ID NO: 1264710 - DNA, 18 bp, Homo sapiens
ctcctccctggctgccct

SEQ ID NO: 1264711 - DNA, 22 bp, Homo sapiens
ctcctccctgtgcccccagcct

SEQ ID NO: 1264712 - DNA, 14 bp, Homo sapiens
ctcctcccttcctt

SEQ ID NO: 1264713 - DNA, 14 bp, Homo sapiens
ctcctccgccaccc

SEQ ID NO: 1264714 - DNA, 18 bp, Homo sapiens
ctcctccgcctgtgtcca

SEQ ID NO: 1264715 - DNA, 13 bp, Homo sapiens
ctcctcctccctg

SEQ ID NO: 1264716 - DNA, 15 bp, Homo sapiens
ctcctcctctttctc

SEQ ID NO: 1264717 - DNA, 17 bp, Homo sapiens
ctcctcctctttctctc

SEQ ID NO: 1264718 - DNA, 19 bp, Homo sapiens
ctcctcctctttctctccc

SEQ ID NO: 1264719 - DNA, 14 bp, Homo sapiens
ctcctcctgccctg

SEQ ID NO: 1264720 - DNA, 14 bp, Homo sapiens
ctcctcctgggggc

SEQ ID NO: 1264721 - DNA, 15 bp, Homo sapiens
ctcctccttcccagg

SEQ ID NO: 1264722 - DNA, 20 bp, Homo sapiens
ctcctccttcccagggacca

SEQ ID NO: 1264723 - DNA, 12 bp, Homo sapiens
ctcctcctttta

SEQ ID NO: 1264724 - DNA, 14 bp, Homo sapiens
ctcctcgcccccac

SEQ ID NO: 1264725 - DNA, 22 bp, Homo sapiens
ctcctcgcccccaccagtgtag

SEQ ID NO: 1264726 - DNA, 15 bp, Homo sapiens
ctcctctacctctct

SEQ ID NO: 1264727 - DNA, 17 bp, Homo sapiens
ctcctctacctctctcc

SEQ ID NO: 1264728 - DNA, 18 bp, Homo sapiens
ctcctctagccatccctt

SEQ ID NO: 1264729 - DNA, 23 bp, Homo sapiens
ctcctctagccatcccttgggga

SEQ ID NO: 1264730 - DNA, 20 bp, Homo sapiens
ctcctctaggggcagcctcc

SEQ ID NO: 1264731 - DNA, 20 bp, Homo sapiens
ctcctctcacctctccctcg

SEQ ID NO: 1264732 - DNA, 18 bp, Homo sapiens
ctcctctcactccccagc

SEQ ID NO: 1264733 - DNA, 22 bp, Homo sapiens
ctcctctcactccccagcctgg

SEQ ID NO: 1264734 - DNA, 13 bp, Homo sapiens
ctcctctcagtac

SEQ ID NO: 1264735 - DNA, 14 bp, Homo sapiens
ctcctctcagtgtt

SEQ ID NO: 1264736 - DNA, 11 bp, Homo sapiens
ctcctctccag

SEQ ID NO: 1264737 - DNA, 13 bp, Homo sapiens
ctcctctccaggc

SEQ ID NO: 1264738 - DNA, 12 bp, Homo sapiens
ctcctctcccat

SEQ ID NO: 1264739 - DNA, 12 bp, Homo sapiens
ctcctctccctg

SEQ ID NO: 1264740 - DNA, 13 bp, Homo sapiens
ctcctctccctgt

SEQ ID NO: 1264741 - DNA, 19 bp, Homo sapiens
ctcctctcctcctcagctg

SEQ ID NO: 1264742 - DNA, 9 bp, Homo sapiens
ctcctctct

SEQ ID NO: 1264743 - DNA, 11 bp, Homo sapiens
ctcctctctgc

SEQ ID NO: 1264744 - DNA, 12 bp, Homo sapiens
ctcctctctggg

SEQ ID NO: 1264745 - DNA, 14 bp, Homo sapiens
ctcctctctgggcc

SEQ ID NO: 1264746 - DNA, 20 bp, Homo sapiens
ctcctctgactcagggctcc

SEQ ID NO: 1264747 - DNA, 16 bp, Homo sapiens
ctcctctgagccatac

SEQ ID NO: 1264748 - DNA, 12 bp, Homo sapiens
ctcctctgccac

SEQ ID NO: 1264749 - DNA, 14 bp, Homo sapiens
ctcctctgccacct

SEQ ID NO: 1264750 - DNA, 17 bp, Homo sapiens
ctcctctgccacctccc

SEQ ID NO: 1264751 - DNA, 12 bp, Homo sapiens
ctcctctgccta

SEQ ID NO: 1264752 - DNA, 18 bp, Homo sapiens
ctcctctgcctacagcca

SEQ ID NO: 1264753 - DNA, 22 bp, Homo sapiens
ctcctctgcctacagccaggtt

SEQ ID NO: 1264754 - DNA, 15 bp, Homo sapiens
ctcctctgccttgga

SEQ ID NO: 1264755 - DNA, 18 bp, Homo sapiens
ctcctctgccttggacac

SEQ ID NO: 1264756 - DNA, 21 bp, Homo sapiens
ctcctctgctatgcattttct

SEQ ID NO: 1264757 - DNA, 12 bp, Homo sapiens
ctcctctgctgg

SEQ ID NO: 1264758 - DNA, 13 bp, Homo sapiens
ctcctctgctggg

SEQ ID NO: 1264759 - DNA, 13 bp, Homo sapiens
ctcctctggcagg

SEQ ID NO: 1264760 - DNA, 12 bp, Homo sapiens
ctcctctggctt

SEQ ID NO: 1264761 - DNA, 14 bp, Homo sapiens
ctcctctggctttc

SEQ ID NO: 1264762 - DNA, 20 bp, Homo sapiens
ctcctctgggcctggggtgc

SEQ ID NO: 1264763 - DNA, 13 bp, Homo sapiens
ctcctctgtgacc

SEQ ID NO: 1264764 - DNA, 23 bp, Homo sapiens
ctcctctgtgaccaatgtcttga

SEQ ID NO: 1264765 - DNA, 18 bp, Homo sapiens
ctcctcttcaactgacca

SEQ ID NO: 1264766 - DNA, 23 bp, Homo sapiens
ctcctcttcaactgaccagcctc

SEQ ID NO: 1264767 - DNA, 11 bp, Homo sapiens
ctcctcttcca

SEQ ID NO: 1264768 - DNA, 23 bp, Homo sapiens
ctcctcttcttttttttcattat

SEQ ID NO: 1264769 - DNA, 17 bp, Homo sapiens
ctcctcttgattcctgg

SEQ ID NO: 1264770 - DNA, 18 bp, Homo sapiens
ctcctcttgccactgcct

SEQ ID NO: 1264771 - DNA, 13 bp, Homo sapiens
ctcctcttggaat

SEQ ID NO: 1264772 - DNA, 13 bp, Homo sapiens
ctcctcttgtaaa

SEQ ID NO: 1264773 - DNA, 14 bp, Homo sapiens
ctcctctttcccct

SEQ ID NO: 1264774 - DNA, 20 bp, Homo sapiens
ctcctctttcccctcctttg

SEQ ID NO: 1264775 - DNA, 22 bp, Homo sapiens
ctcctgaaaaggtttatgaaaa

SEQ ID NO: 1264776 - DNA, 22 bp, Homo sapiens
ctcctgaaacccaaagccctgg

SEQ ID NO: 1264777 - DNA, 21 bp, Homo sapiens
ctcctgaaatgccaagtgcct

SEQ ID NO: 1264778 - DNA, 13 bp, Homo sapiens
ctcctgaaattca

SEQ ID NO: 1264779 - DNA, 20 bp, Homo sapiens
ctcctgaaccgcacagctca

SEQ ID NO: 1264780 - DNA, 19 bp, Homo sapiens
ctcctgaagcctctgccct

SEQ ID NO: 1264781 - DNA, 17 bp, Homo sapiens
ctcctgacaacgtctct

SEQ ID NO: 1264782 - DNA, 19 bp, Homo sapiens
ctcctgacaacgtctcttc

SEQ ID NO: 1264783 - DNA, 20 bp, Homo sapiens
ctcctgacaacgtctcttca

SEQ ID NO: 1264784 - DNA, 14 bp, Homo sapiens
ctcctgacagaagg

SEQ ID NO: 1264785 - DNA, 21 bp, Homo sapiens
ctcctgtgcccacatcccagg

SEQ ID NO: 1264786 - DNA, 22 bp, Homo sapiens
ctcctgtgcccacatcccaggc

SEQ ID NO: 1264787 - DNA, 19 bp, Homo sapiens
ctcctgtgccccagctgcc

SEQ ID NO: 1264788 - DNA, 21 bp, Homo sapiens
ctcctgtgccccagctgccag

SEQ ID NO: 1264789 - DNA, 11 bp, Homo sapiens
ctcctgtgcct

SEQ ID NO: 1264790 - DNA, 17 bp, Homo sapiens
ctcctgtgcctcccttt

SEQ ID NO: 1264791 - DNA, 14 bp, Homo sapiens
ctcctgtgcctggc

SEQ ID NO: 1264792 - DNA, 18 bp, Homo sapiens
ctcctgtgcctggcccca

SEQ ID NO: 1264793 - DNA, 19 bp, Homo sapiens
ctcctgtgcctggccccag

SEQ ID NO: 1264794 - DNA, 13 bp, Homo sapiens
ctcctgtggcccc

SEQ ID NO: 1264795 - DNA, 19 bp, Homo sapiens
ctcctgtggccccaccctg

SEQ ID NO: 1264796 - DNA, 9 bp, Homo sapiens
ctcctgtgt

SEQ ID NO: 1264797 - DNA, 17 bp, Homo sapiens
ctcctgtgtgcttgtca

SEQ ID NO: 1264798 - DNA, 16 bp, Homo sapiens
ctcctgttctgcccac

SEQ ID NO: 1264799 - DNA, 18 bp, Homo sapiens
ctcctgtttattcccatc

SEQ ID NO: 1264800 - DNA, 14 bp, Homo sapiens
ctcctgtttctcct

SEQ ID NO: 1264801 - DNA, 23 bp, Homo sapiens
ctcctgtttgttgagtgcactga

SEQ ID NO: 1264802 - DNA, 14 bp, Homo sapiens
ctcctgttttctcc

SEQ ID NO: 1264803 - DNA, 17 bp, Homo sapiens
ctcctgttttctccctc

SEQ ID NO: 1264804 - DNA, 21 bp, Homo sapiens
ctccttaatttaattgctttg

SEQ ID NO: 1264805 - DNA, 17 bp, Homo sapiens
ctccttacctctggaac

SEQ ID NO: 1264806 - DNA, 22 bp, Homo sapiens
ctccttactctgagcccaggcc

SEQ ID NO: 1264807 - DNA, 14 bp, Homo sapiens
ctccttagacacct

SEQ ID NO: 1264808 - DNA, 20 bp, Homo sapiens
ctccttagagacatcaaaat

SEQ ID NO: 1264809 - DNA, 19 bp, Homo sapiens
ctccttatagacacttgct

SEQ ID NO: 1264810 - DNA, 20 bp, Homo sapiens
ctccttatagacacttgctc

SEQ ID NO: 1264811 - DNA, 21 bp, Homo sapiens
ctccttatagacacttgctcc

SEQ ID NO: 1264812 - DNA, 17 bp, Homo sapiens
ctccttatcaaaggaca

SEQ ID NO: 1264813 - DNA, 19 bp, Homo sapiens
ctccttattggaaggtatt

SEQ ID NO: 1264814 - DNA, 12 bp, Homo sapiens
ctccttcagaca

SEQ ID NO: 1264815 - DNA, 14 bp, Homo sapiens
ctccttcagacacc

SEQ ID NO: 1264816 - DNA, 19 bp, Homo sapiens
ctccttccacatgtacata

SEQ ID NO: 1264817 - DNA, 15 bp, Homo sapiens
ctccttccacctccc

SEQ ID NO: 1264818 - DNA, 16 bp, Homo sapiens
ctccttccacctccct

SEQ ID NO: 1264819 - DNA, 16 bp, Homo sapiens
ctccttcccatcgctg

SEQ ID NO: 1264820 - DNA, 13 bp, Homo sapiens
ctccttcccatgc

SEQ ID NO: 1264821 - DNA, 15 bp, Homo sapiens
ctccttcccatgcct

SEQ ID NO: 1264822 - DNA, 16 bp, Homo sapiens
ctccttcccatgcctg

SEQ ID NO: 1264823 - DNA, 10 bp, Homo sapiens
ctccttcccc

SEQ ID NO: 1264824 - DNA, 15 bp, Homo sapiens
ctccttccccacttc

SEQ ID NO: 1264825 - DNA, 17 bp, Homo sapiens
ctccttccccatttcca

SEQ ID NO: 1264826 - DNA, 23 bp, Homo sapiens
ctccttccccccatctctgagtg

SEQ ID NO: 1264827 - DNA, 23 bp, Homo sapiens
ctccttcccctacacctccctcc

SEQ ID NO: 1264828 - DNA, 15 bp, Homo sapiens
ctccttcccctgcac

SEQ ID NO: 1264829 - DNA, 17 bp, Homo sapiens
ctccttcccctgcacct

SEQ ID NO: 1264830 - DNA, 15 bp, Homo sapiens
ctccttccctcctgt

SEQ ID NO: 1264831 - DNA, 16 bp, Homo sapiens
ctccttccctcctgtg

SEQ ID NO: 1264832 - DNA, 17 bp, Homo sapiens
ctccttcctcagcctcc

SEQ ID NO: 1264833 - DNA, 14 bp, Homo sapiens
ctccttcctggaga

SEQ ID NO: 1264834 - DNA, 17 bp, Homo sapiens
ctccttcctggcctgag

SEQ ID NO: 1264835 - DNA, 23 bp, Homo sapiens
ctccttcctggcgggggtgggcc

SEQ ID NO: 1264836 - DNA, 14 bp, Homo sapiens
ctccttcctgggac

SEQ ID NO: 1264837 - DNA, 19 bp, Homo sapiens
ctccttcgtatcccgagtc

SEQ ID NO: 1264838 - DNA, 19 bp, Homo sapiens
ctccttcgtgtctctccca

SEQ ID NO: 1264839 - DNA, 21 bp, Homo sapiens
ctccttcgtgtctctcccacc

SEQ ID NO: 1264840 - DNA, 15 bp, Homo sapiens
ctccttctccttccc

SEQ ID NO: 1264841 - DNA, 22 bp, Homo sapiens
ctccttctgctgtgtatcatgg

SEQ ID NO: 1264842 - DNA, 15 bp, Homo sapiens
ctccttgaatatctt

SEQ ID NO: 1264843 - DNA, 20 bp, Homo sapiens
ctccttgaatatctttcgat

SEQ ID NO: 1264844 - DNA, 23 bp, Homo sapiens
ctccttgaccctgaaaggaacac

SEQ ID NO: 1264845 - DNA, 17 bp, Homo sapiens
ctccttgcagcagggct

SEQ ID NO: 1264846 - DNA, 19 bp, Homo sapiens
ctccttgcagcagggctgg

SEQ ID NO: 1264847 - DNA, 20 bp, Homo sapiens
ctccttgccccccgccctca

SEQ ID NO: 1264848 - DNA, 21 bp, Homo sapiens
ctccttgccccccgccctcat

SEQ ID NO: 1264849 - DNA, 18 bp, Homo sapiens
ctccttgccttgcttctc

SEQ ID NO: 1264850 - DNA, 20 bp, Homo sapiens
ctccttgctgaccccaggtc

SEQ ID NO: 1264851 - DNA, 20 bp, Homo sapiens
ctccttggcacccccatgct

SEQ ID NO: 1264852 - DNA, 15 bp, Homo sapiens
ctccttggccacaga

SEQ ID NO: 1264853 - DNA, 15 bp, Homo sapiens
ctccttggctgcagc

SEQ ID NO: 1264854 - DNA, 16 bp, Homo sapiens
ctccttggctgcagcc

SEQ ID NO: 1264855 - DNA, 18 bp, Homo sapiens
ctccttggctgcagccat

SEQ ID NO: 1264856 - DNA, 21 bp, Homo sapiens
ctccttggctgcagccatccc

SEQ ID NO: 1264857 - DNA, 21 bp, Homo sapiens
ctccttgggcactttttaatt

SEQ ID NO: 1264858 - DNA, 16 bp, Homo sapiens
ctccttgggccctttg

SEQ ID NO: 1264859 - DNA, 17 bp, Homo sapiens
ctccttgggccctttga

SEQ ID NO: 1264860 - DNA, 16 bp, Homo sapiens
ctccttgggctgggac

SEQ ID NO: 1264861 - DNA, 15 bp, Homo sapiens
ctccttggtttgcta

SEQ ID NO: 1264862 - DNA, 20 bp, Homo sapiens
ctccttgtcaatactgagcc

SEQ ID NO: 1264863 - DNA, 16 bp, Homo sapiens
ctccttgtggactggc

SEQ ID NO: 1264864 - DNA, 23 bp, Homo sapiens
ctccttgtggccttttttataac

SEQ ID NO: 1264865 - DNA, 22 bp, Homo sapiens
ctccttgtgttgcactgaacag

SEQ ID NO: 1264866 - DNA, 12 bp, Homo sapiens
ctcctttaccag

SEQ ID NO: 1264867 - DNA, 14 bp, Homo sapiens
ctcctttagcaggt

SEQ ID NO: 1264868 - DNA, 15 bp, Homo sapiens
ctcctttattgcagt

SEQ ID NO: 1264869 - DNA, 12 bp, Homo sapiens
ctcctttccctt

SEQ ID NO: 1264870 - DNA, 20 bp, Homo sapiens
ctcctttcccttattgcctc

SEQ ID NO: 1264871 - DNA, 18 bp, Homo sapiens
ctcctttctccagccagc

SEQ ID NO: 1264872 - DNA, 21 bp, Homo sapiens
ctcctttctccagccagcaat

SEQ ID NO: 1264873 - DNA, 16 bp, Homo sapiens
ctcctttctccctgca

SEQ ID NO: 1264874 - DNA, 12 bp, Homo sapiens
ctcctttctgtg

SEQ ID NO: 1264875 - DNA, 13 bp, Homo sapiens
ctcctttctgtgc

SEQ ID NO: 1264876 - DNA, 14 bp, Homo sapiens
ctcctttctgtgcc

SEQ ID NO: 1264877 - DNA, 15 bp, Homo sapiens
ctcctttgcactgag

SEQ ID NO: 1264878 - DNA, 16 bp, Homo sapiens
ctcctttgcactgagg

SEQ ID NO: 1264879 - DNA, 21 bp, Homo sapiens
ctcctttgcactgagggccac

SEQ ID NO: 1264880 - DNA, 22 bp, Homo sapiens
ctcctttgcactgagggccaca

SEQ ID NO: 1264881 - DNA, 22 bp, Homo sapiens
ctcctttgcatggcagggcctc

SEQ ID NO: 1264882 - DNA, 20 bp, Homo sapiens
ctcctttgtgtgtattcaga

SEQ ID NO: 1264883 - DNA, 15 bp, Homo sapiens
ctcctttgtgtgtgt

SEQ ID NO: 1264884 - DNA, 13 bp, Homo sapiens
ctccttttaaaga

SEQ ID NO: 1264885 - DNA, 23 bp, Homo sapiens
ctccttttaaagaaaaaaattga

SEQ ID NO: 1264886 - DNA, 22 bp, Homo sapiens
ctccttttatctggtgcctcct

SEQ ID NO: 1264887 - DNA, 15 bp, Homo sapiens
ctccttttcacttta

SEQ ID NO: 1264888 - DNA, 13 bp, Homo sapiens
ctccttttgaact

SEQ ID NO: 1264889 - DNA, 24 bp, Homo sapiens
ctccttttgaccttcatttcatgt

SEQ ID NO: 1264890 - DNA, 13 bp, Homo sapiens
ctccttttgctgt

SEQ ID NO: 1264891 - DNA, 16 bp, Homo sapiens
ctccttttggctgggg

SEQ ID NO: 1264892 - DNA, 17 bp, Homo sapiens
ctccttttgtatcttcc

SEQ ID NO: 1264893 - DNA, 17 bp, Homo sapiens
ctccttttgtccccagg

SEQ ID NO: 1264894 - DNA, 21 bp, Homo sapiens
ctcctttttatttttttgtac

SEQ ID NO: 1264895 - DNA, 13 bp, Homo sapiens
ctcgaaactgaca

SEQ ID NO: 1264896 - DNA, 18 bp, Homo sapiens
ctcgaaactgacagtatt

SEQ ID NO: 1264897 - DNA, 15 bp, Homo sapiens
ctcgaaccaaggcag

SEQ ID NO: 1264898 - DNA, 17 bp, Homo sapiens
ctcgaaccaaggcagcc

SEQ ID NO: 1264899 - DNA, 18 bp, Homo sapiens
ctcgaaccaaggcagcct

SEQ ID NO: 1264900 - DNA, 20 bp, Homo sapiens
ctcgaaccaaggcagcctcc

SEQ ID NO: 1264901 - DNA, 18 bp, Homo sapiens
ctcgaactcctgacctca

SEQ ID NO: 1264902 - DNA, 14 bp, Homo sapiens
ctcgaatctctgtg

SEQ ID NO: 1264903 - DNA, 18 bp, Homo sapiens
ctcgaatctctgtgcctt

SEQ ID NO: 1264904 - DNA, 13 bp, Homo sapiens
ctcgaatgtaatt

SEQ ID NO: 1264905 - DNA, 18 bp, Homo sapiens
ctcgaattttatctgtgg

SEQ ID NO: 1264906 - DNA, 18 bp, Homo sapiens
ctcgacaaaggccacagg

SEQ ID NO: 1264907 - DNA, 23 bp, Homo sapiens
ctctactgtctcctccctgggct

SEQ ID NO: 1264908 - DNA, 17 bp, Homo sapiens
ctctacttagcatgtcc

SEQ ID NO: 1264909 - DNA, 14 bp, Homo sapiens
ctctacttcccctt

SEQ ID NO: 1264910 - DNA, 13 bp, Homo sapiens
ctctactttgagg

SEQ ID NO: 1264911 - DNA, 15 bp, Homo sapiens
ctctactttgattct

SEQ ID NO: 1264912 - DNA, 18 bp, Homo sapiens
ctctactttgattctgat

SEQ ID NO: 1264913 - DNA, 21 bp, Homo sapiens
ctctagaaataggttaaactg

SEQ ID NO: 1264914 - DNA, 18 bp, Homo sapiens
ctctagaacatgcacatt

SEQ ID NO: 1264915 - DNA, 23 bp, Homo sapiens
ctctagaacatgcacatttatat

SEQ ID NO: 1264916 - DNA, 23 bp, Homo sapiens
ctctagaattttaagtgctttgt

SEQ ID NO: 1264917 - DNA, 17 bp, Homo sapiens
ctctagacaaccctgca

SEQ ID NO: 1264918 - DNA, 12 bp, Homo sapiens
ctctagagagag

SEQ ID NO: 1264919 - DNA, 19 bp, Homo sapiens
ctctagagtctcactgctg

SEQ ID NO: 1264920 - DNA, 15 bp, Homo sapiens
ctctagccaggagtc

SEQ ID NO: 1264921 - DNA, 18 bp, Homo sapiens
ctctagccatcccttggg

SEQ ID NO: 1264922 - DNA, 23 bp, Homo sapiens
ctctagcctggcaacagagcgag

SEQ ID NO: 1264923 - DNA, 13 bp, Homo sapiens
ctctagcctgggc

SEQ ID NO: 1264924 - DNA, 14 bp, Homo sapiens
ctctagcctgggca

SEQ ID NO: 1264925 - DNA, 17 bp, Homo sapiens
ctctagctctctaggcc

SEQ ID NO: 1264926 - DNA, 12 bp, Homo sapiens
ctctagctggca

SEQ ID NO: 1264927 - DNA, 17 bp, Homo sapiens
ctctagctggcaggaca

SEQ ID NO: 1264928 - DNA, 18 bp, Homo sapiens
ctctagctggcaggacac

SEQ ID NO: 1264929 - DNA, 23 bp, Homo sapiens
ctctagctgggggtgggccaggc

SEQ ID NO: 1264930 - DNA, 16 bp, Homo sapiens
ctctagctgtgggggt

SEQ ID NO: 1264931 - DNA, 12 bp, Homo sapiens
ctctagcttttc

SEQ ID NO: 1264932 - DNA, 21 bp, Homo sapiens
ctctaggagggagccttgtga

SEQ ID NO: 1264933 - DNA, 23 bp, Homo sapiens
ctctagggatataaaaacagatt

SEQ ID NO: 1264934 - DNA, 12 bp, Homo sapiens
ctctagggcagg

SEQ ID NO: 1264935 - DNA, 16 bp, Homo sapiens
ctctagggcagggtgg

SEQ ID NO: 1264936 - DNA, 13 bp, Homo sapiens
ctctaggggcagc

SEQ ID NO: 1264937 - DNA, 15 bp, Homo sapiens
ctctaggttatacaa

SEQ ID NO: 1264938 - DNA, 19 bp, Homo sapiens
ctctagtaagatgcactga

SEQ ID NO: 1264939 - DNA, 17 bp, Homo sapiens
ctctagtagtgtggcct

SEQ ID NO: 1264940 - DNA, 18 bp, Homo sapiens
ctctagtgccctccacag

SEQ ID NO: 1264941 - DNA, 15 bp, Homo sapiens
ctctagtgctgtgaa

SEQ ID NO: 1264942 - DNA, 20 bp, Homo sapiens
ctctagtgctgtgaaaaaaa

SEQ ID NO: 1264943 - DNA, 18 bp, Homo sapiens
ctctagtgggacagccca

SEQ ID NO: 1264944 - DNA, 19 bp, Homo sapiens
ctctagtgggacagcccag

SEQ ID NO: 1264945 - DNA, 13 bp, Homo sapiens
ctctagttctaga

SEQ ID NO: 1264946 - DNA, 14 bp, Homo sapiens
ctctagttctagat

SEQ ID NO: 1264947 - DNA, 16 bp, Homo sapiens
ctctagttctagatga

SEQ ID NO: 1264948 - DNA, 20 bp, Homo sapiens
ctctagttttcagccttggg

SEQ ID NO: 1264949 - DNA, 21 bp, Homo sapiens
ctctagttttcagccttggga

SEQ ID NO: 1264950 - DNA, 22 bp, Homo sapiens
ctctataacagatcctttcaaa

SEQ ID NO: 1264951 - DNA, 22 bp, Homo sapiens
ctctataagcaaattgcttttt

SEQ ID NO: 1264952 - DNA, 18 bp, Homo sapiens
ctctatacatctctcccc

SEQ ID NO: 1264953 - DNA, 22 bp, Homo sapiens
ctctatattatgtcttcttttg

SEQ ID NO: 1264954 - DNA, 15 bp, Homo sapiens
ctctatcaccaagga

SEQ ID NO: 1264955 - DNA, 20 bp, Homo sapiens
ctctatcagcattgtttcaa

SEQ ID NO: 1264956 - DNA, 13 bp, Homo sapiens
ctctatcctctct

SEQ ID NO: 1264957 - DNA, 18 bp, Homo sapiens
ctctatcctctcttcctc

SEQ ID NO: 1264958 - DNA, 17 bp, Homo sapiens
ctctatgccagctcagt

SEQ ID NO: 1264959 - DNA, 21 bp, Homo sapiens
ctctatgccagctcagtccca

SEQ ID NO: 1264960 - DNA, 14 bp, Homo sapiens
ctctatgccctgca

SEQ ID NO: 1264961 - DNA, 16 bp, Homo sapiens
ctctatgccctgcaga

SEQ ID NO: 1264962 - DNA, 16 bp, Homo sapiens
ctctatgctggctttt

SEQ ID NO: 1264963 - DNA, 23 bp, Homo sapiens
ctctattagactttagaaataaa

SEQ ID NO: 1264964 - DNA, 20 bp, Homo sapiens
ctctattatgttatcatcct

SEQ ID NO: 1264965 - DNA, 22 bp, Homo sapiens
ctctattgggcacagcctaggg

SEQ ID NO: 1264966 - DNA, 21 bp, Homo sapiens
ctctattgtagcatttcttga

SEQ ID NO: 1264967 - DNA, 14 bp, Homo sapiens
ctctatttaagata

SEQ ID NO: 1264968 - DNA, 13 bp, Homo sapiens
ctctatttaatat

SEQ ID NO: 1264969 - DNA, 15 bp, Homo sapiens
ctctatttaatattt

SEQ ID NO: 1264970 - DNA, 17 bp, Homo sapiens
ctctatttatgtttgca

SEQ ID NO: 1264971 - DNA, 13 bp, Homo sapiens
ctctatttctcta

SEQ ID NO: 1264972 - DNA, 14 bp, Homo sapiens
ctctattttaatgt

SEQ ID NO: 1264973 - DNA, 22 bp, Homo sapiens
ctctattttaatgtatatttgc

SEQ ID NO: 1264974 - DNA, 11 bp, Homo sapiens
ctctattttgt

SEQ ID NO: 1264975 - DNA, 18 bp, Homo sapiens
ctctattttgtgatgatg

SEQ ID NO: 1264976 - DNA, 18 bp, Homo sapiens
ctctcaagctagtgtttc

SEQ ID NO: 1264977 - DNA, 15 bp, Homo sapiens
ctctcaatatgctta

SEQ ID NO: 1264978 - DNA, 13 bp, Homo sapiens
ctctcaattaaag

SEQ ID NO: 1264979 - DNA, 14 bp, Homo sapiens
ctctcaatttttgg

SEQ ID NO: 1264980 - DNA, 14 bp, Homo sapiens
ctctcacacatcac

SEQ ID NO: 1264981 - DNA, 21 bp, Homo sapiens
ctctcacacatcacattccca

SEQ ID NO: 1264982 - DNA, 13 bp, Homo sapiens
ctctcacatgtgg

SEQ ID NO: 1264983 - DNA, 18 bp, Homo sapiens
ctctcacccaccagctcc

SEQ ID NO: 1264984 - DNA, 21 bp, Homo sapiens
ctctcacccaccagctccaca

SEQ ID NO: 1264985 - DNA, 19 bp, Homo sapiens
ctctcaccccacttcccat

SEQ ID NO: 1264986 - DNA, 23 bp, Homo sapiens
ctctcaccccacttcccatctcc

SEQ ID NO: 1264987 - DNA, 17 bp, Homo sapiens
ctctcacgccacccccg

SEQ ID NO: 1264988 - DNA, 16 bp, Homo sapiens
ctctcacgggccctgc

SEQ ID NO: 1264989 - DNA, 15 bp, Homo sapiens
ctctcactaaacttt

SEQ ID NO: 1264990 - DNA, 21 bp, Homo sapiens
ctctcactaaactttacccaa

SEQ ID NO: 1264991 - DNA, 13 bp, Homo sapiens
ctctcactccagc

SEQ ID NO: 1264992 - DNA, 14 bp, Homo sapiens
ctctcactccagcc

SEQ ID NO: 1264993 - DNA, 22 bp, Homo sapiens
ctctcactccccagcctgggcc

SEQ ID NO: 1264994 - DNA, 23 bp, Homo sapiens
ctctcactccccagcctgggccc

SEQ ID NO: 1264995 - DNA, 20 bp, Homo sapiens
ctctcactcctgaattcagt

SEQ ID NO: 1264996 - DNA, 12 bp, Homo sapiens
ctctcactttgg

SEQ ID NO: 1264997 - DNA, 22 bp, Homo sapiens
ctctcactttggttggaacttt

SEQ ID NO: 1264998 - DNA, 17 bp, Homo sapiens
ctctcagaattcttcag

SEQ ID NO: 1264999 - DNA, 12 bp, Homo sapiens
ctctcagagtga

SEQ ID NO: 1265000 - DNA, 18 bp, Homo sapiens
ctctcagccccatcgccc

SEQ ID NO: 1265001 - DNA, 19 bp, Homo sapiens
ctctcagccccatcgcccc

SEQ ID NO: 1265002 - DNA, 14 bp, Homo sapiens
ctctcagcctccca

SEQ ID NO: 1265003 - DNA, 16 bp, Homo sapiens
ctctcagcctcccaca

SEQ ID NO: 1265004 - DNA, 17 bp, Homo sapiens
ctctcagctcagcgcca

SEQ ID NO: 1265005 - DNA, 14 bp, Homo sapiens
ctctcagctggcag

SEQ ID NO: 1265006 - DNA, 14 bp, Homo sapiens
ctctcagctttccc

SEQ ID NO: 1265007 - DNA, 19 bp, Homo sapiens
ctctcaggagcacaggcag

SEQ ID NO: 1265008 - DNA, 20 bp, Homo sapiens
ctctcaggagcacaggcagc

SEQ ID NO: 1265009 - DNA, 18 bp, Homo sapiens
ctctcagtactttggagg

SEQ ID NO: 1265010 - DNA, 19 bp, Homo sapiens
ctctcagtactttggaggc

SEQ ID NO: 1265011 - DNA, 13 bp, Homo sapiens
ctctcagtctctg

SEQ ID NO: 1265012 - DNA, 14 bp, Homo sapiens
ctctcagtctctga

SEQ ID NO: 1265013 - DNA, 17 bp, Homo sapiens
ctctcagtgccctccag

SEQ ID NO: 1265014 - DNA, 16 bp, Homo sapiens
ctctcagttctctccc

SEQ ID NO: 1265015 - DNA, 12 bp, Homo sapiens
ctctcagttttt

SEQ ID NO: 1265016 - DNA, 21 bp, Homo sapiens
ctctcatatgccaccccatgt

SEQ ID NO: 1265017 - DNA, 22 bp, Homo sapiens
ctctcatcaccccagaggcctt

SEQ ID NO: 1265018 - DNA, 19 bp, Homo sapiens
ctctcatgtccccttcctg

SEQ ID NO: 1265019 - DNA, 16 bp, Homo sapiens
ctctcatgtccctcca

SEQ ID NO: 1265020 - DNA, 20 bp, Homo sapiens
ctctcatgtccctccaggga

SEQ ID NO: 1265021 - DNA, 11 bp, Homo sapiens
ctctcattccc

SEQ ID NO: 1265022 - DNA, 14 bp, Homo sapiens
ctctcattccccag

SEQ ID NO: 1265023 - DNA, 16 bp, Homo sapiens
ctctcattccccaggt

SEQ ID NO: 1265024 - DNA, 19 bp, Homo sapiens
ctctcattctttgaacatg

SEQ ID NO: 1265025 - DNA, 13 bp, Homo sapiens
ctctcattgtctt

SEQ ID NO: 1265026 - DNA, 21 bp, Homo sapiens
ctctccaaaggggctgctggg

SEQ ID NO: 1265027 - DNA, 13 bp, Homo sapiens
ctctccaaccact

SEQ ID NO: 1265028 - DNA, 22 bp, Homo sapiens
ctctccaaccactgtgccactg

SEQ ID NO: 1265029 - DNA, 19 bp, Homo sapiens
ctctctttttggaggtgct

SEQ ID NO: 1265030 - DNA, 13 bp, Homo sapiens
ctctgaaaacaag

SEQ ID NO: 1265031 - DNA, 22 bp, Homo sapiens
ctctgaaaagcaattgccctgt

SEQ ID NO: 1265032 - DNA, 15 bp, Homo sapiens
ctctgaaaattctgg

SEQ ID NO: 1265033 - DNA, 12 bp, Homo sapiens
ctctgaaaccag

SEQ ID NO: 1265034 - DNA, 13 bp, Homo sapiens
ctctgaaagagaa

SEQ ID NO: 1265035 - DNA, 14 bp, Homo sapiens
ctctgaaagagaaa

SEQ ID NO: 1265036 - DNA, 20 bp, Homo sapiens
ctctgaaattaaagaaatga

SEQ ID NO: 1265037 - DNA, 17 bp, Homo sapiens
ctctgaacaaacactga

SEQ ID NO: 1265038 - DNA, 21 bp, Homo sapiens
ctctgaacaaacactgaatca

SEQ ID NO: 1265039 - DNA, 19 bp, Homo sapiens
ctctgaacacacacgccag

SEQ ID NO: 1265040 - DNA, 21 bp, Homo sapiens
ctctgaacacacacgccagct

SEQ ID NO: 1265041 - DNA, 19 bp, Homo sapiens
ctctgaagaactctctgga

SEQ ID NO: 1265042 - DNA, 23 bp, Homo sapiens
ctctgaagagaccttggctgctc

SEQ ID NO: 1265043 - DNA, 20 bp, Homo sapiens
ctctgaagcgactctcctgt

SEQ ID NO: 1265044 - DNA, 19 bp, Homo sapiens
ctctgaagctaattgtact

SEQ ID NO: 1265045 - DNA, 18 bp, Homo sapiens
ctctgaagttggacagca

SEQ ID NO: 1265046 - DNA, 18 bp, Homo sapiens
ctctgaatattttgtaat

SEQ ID NO: 1265047 - DNA, 12 bp, Homo sapiens
ctctgaatcaga

SEQ ID NO: 1265048 - DNA, 16 bp, Homo sapiens
ctctgaatgggagcca

SEQ ID NO: 1265049 - DNA, 18 bp, Homo sapiens
ctctgaatggtccagggt

SEQ ID NO: 1265050 - DNA, 16 bp, Homo sapiens
ctctgacagcagcctg

SEQ ID NO: 1265051 - DNA, 17 bp, Homo sapiens
ctctgacagcagcctgt

SEQ ID NO: 1265052 - DNA, 21 bp, Homo sapiens
ctctgacagcagcctgtgagg

SEQ ID NO: 1265053 - DNA, 16 bp, Homo sapiens
ctctgacagtccacag

SEQ ID NO: 1265054 - DNA, 14 bp, Homo sapiens
ctctgacatccctt

SEQ ID NO: 1265055 - DNA, 16 bp, Homo sapiens
ctctgacatcccttcc

SEQ ID NO: 1265056 - DNA, 16 bp, Homo sapiens
ctctgacccagtgaga

SEQ ID NO: 1265057 - DNA, 17 bp, Homo sapiens
ctctgacccggttgcag

SEQ ID NO: 1265058 - DNA, 14 bp, Homo sapiens
ctctgaccctgggc

SEQ ID NO: 1265059 - DNA, 18 bp, Homo sapiens
ctctgaccgattccttta

SEQ ID NO: 1265060 - DNA, 17 bp, Homo sapiens
ctctgacctctgctgag

SEQ ID NO: 1265061 - DNA, 18 bp, Homo sapiens
ctctgaccttccagagcc

SEQ ID NO: 1265062 - DNA, 23 bp, Homo sapiens
ctctgaccttccagagcccaagg

SEQ ID NO: 1265063 - DNA, 14 bp, Homo sapiens
ctctgacctttcat

SEQ ID NO: 1265064 - DNA, 19 bp, Homo sapiens
ctctgacgcaccactgcca

SEQ ID NO: 1265065 - DNA, 14 bp, Homo sapiens
ctctgacgcttgtg

SEQ ID NO: 1265066 - DNA, 17 bp, Homo sapiens
ctctgacgcttgtgaca

SEQ ID NO: 1265067 - DNA, 20 bp, Homo sapiens
ctctgacgcttgtgacagtg

SEQ ID NO: 1265068 - DNA, 21 bp, Homo sapiens
ctctgacgtagaaagatcctt

SEQ ID NO: 1265069 - DNA, 19 bp, Homo sapiens
ctctgactagtagatttct

SEQ ID NO: 1265070 - DNA, 16 bp, Homo sapiens
ctctgactcagggctc

SEQ ID NO: 1265071 - DNA, 15 bp, Homo sapiens
ctctgactctgagtc

SEQ ID NO: 1265072 - DNA, 20 bp, Homo sapiens
ctctgacttaagcaaaagaa

SEQ ID NO: 1265073 - DNA, 23 bp, Homo sapiens
ctctgacttccccaaacccagaa

SEQ ID NO: 1265074 - DNA, 16 bp, Homo sapiens
ctctgacttctgcctg

SEQ ID NO: 1265075 - DNA, 19 bp, Homo sapiens
ctctgacttctgcctggag

SEQ ID NO: 1265076 - DNA, 22 bp, Homo sapiens
ctctgagaaaatgcgagactct

SEQ ID NO: 1265077 - DNA, 16 bp, Homo sapiens
ctctgagaagctctga

SEQ ID NO: 1265078 - DNA, 19 bp, Homo sapiens
ctctgagaattccaaggag

SEQ ID NO: 1265079 - DNA, 23 bp, Homo sapiens
ctctgagaattgttgagatactt

SEQ ID NO: 1265080 - DNA, 14 bp, Homo sapiens
ctctgagatgatgc

SEQ ID NO: 1265081 - DNA, 17 bp, Homo sapiens
ctctgagatgctaattt

SEQ ID NO: 1265082 - DNA, 18 bp, Homo sapiens
ctctgagatgctaattta

SEQ ID NO: 1265083 - DNA, 19 bp, Homo sapiens
ctctgagcacaggtgacag

SEQ ID NO: 1265084 - DNA, 14 bp, Homo sapiens
ctctgagcaggggc

SEQ ID NO: 1265085 - DNA, 18 bp, Homo sapiens
ctctgagcaggggcaggc

SEQ ID NO: 1265086 - DNA, 20 bp, Homo sapiens
ctctgagcaggggcaggcgc

SEQ ID NO: 1265087 - DNA, 21 bp, Homo sapiens
ctctgagcaggggcaggcgca

SEQ ID NO: 1265088 - DNA, 13 bp, Homo sapiens
ctctgagccaagg

SEQ ID NO: 1265089 - DNA, 16 bp, Homo sapiens
ctctgagccaagggag

SEQ ID NO: 1265090 - DNA, 16 bp, Homo sapiens
ctctgagccacagtgg

SEQ ID NO: 1265091 - DNA, 12 bp, Homo sapiens
ctctgagcccat

SEQ ID NO: 1265092 - DNA, 19 bp, Homo sapiens
ctctgagcccatacttttg

SEQ ID NO: 1265093 - DNA, 21 bp, Homo sapiens
ctctgagcccatgttctgccc

SEQ ID NO: 1265094 - DNA, 15 bp, Homo sapiens
ctctgagccttggga

SEQ ID NO: 1265095 - DNA, 17 bp, Homo sapiens
ctctgagcgggaggcag

SEQ ID NO: 1265096 - DNA, 14 bp, Homo sapiens
ctctgagctgctca

SEQ ID NO: 1265097 - DNA, 16 bp, Homo sapiens
ctctgagctgctcacc

SEQ ID NO: 1265098 - DNA, 16 bp, Homo sapiens
ctctgagctggggagg

SEQ ID NO: 1265099 - DNA, 15 bp, Homo sapiens
ctctgagctgtgcag

SEQ ID NO: 1265100 - DNA, 16 bp, Homo sapiens
ctctgagctgtgcagg

SEQ ID NO: 1265101 - DNA, 17 bp, Homo sapiens
ctctgaggaagcagttg

SEQ ID NO: 1265102 - DNA, 22 bp, Homo sapiens
ctctgaggcccgatctccactg

SEQ ID NO: 1265103 - DNA, 15 bp, Homo sapiens
ctctgaggcttccag

SEQ ID NO: 1265104 - DNA, 20 bp, Homo sapiens
ctctgaggggaggcacctcc

SEQ ID NO: 1265105 - DNA, 13 bp, Homo sapiens
ctctgaggggcac

SEQ ID NO: 1265106 - DNA, 20 bp, Homo sapiens
ctctgaggggctaccaggaa

SEQ ID NO: 1265107 - DNA, 20 bp, Homo sapiens
ctctgaggtcaataaagcag

SEQ ID NO: 1265108 - DNA, 23 bp, Homo sapiens
ctctgaggtcaataaagcagagc

SEQ ID NO: 1265109 - DNA, 15 bp, Homo sapiens
ctctgaggtcccttc

SEQ ID NO: 1265110 - DNA, 15 bp, Homo sapiens
ctctgagtcctttgc

SEQ ID NO: 1265111 - DNA, 14 bp, Homo sapiens
ctctgatacacagt

SEQ ID NO: 1265112 - DNA, 21 bp, Homo sapiens
ctctgatagctgtttcaaatg

SEQ ID NO: 1265113 - DNA, 20 bp, Homo sapiens
ctctgatattccatgaatgt

SEQ ID NO: 1265114 - DNA, 17 bp, Homo sapiens
ctctgatcccatattct

SEQ ID NO: 1265115 - DNA, 22 bp, Homo sapiens
ctctgatccctctacagagctt

SEQ ID NO: 1265116 - DNA, 22 bp, Homo sapiens
ctctgatctccatggcttcctc

SEQ ID NO: 1265117 - DNA, 13 bp, Homo sapiens
ctctgatcttgtg

SEQ ID NO: 1265118 - DNA, 16 bp, Homo sapiens
ctctgatcttgtgctc

SEQ ID NO: 1265119 - DNA, 17 bp, Homo sapiens
ctctgatcttgtgctca

SEQ ID NO: 1265120 - DNA, 12 bp, Homo sapiens
ctctgatgcaga

SEQ ID NO: 1265121 - DNA, 15 bp, Homo sapiens
ctctgatgcagaaat

SEQ ID NO: 1265122 - DNA, 14 bp, Homo sapiens
ctctgatgcagctt

SEQ ID NO: 1265123 - DNA, 21 bp, Homo sapiens
ctctgatggaatgtgccacct

SEQ ID NO: 1265124 - DNA, 13 bp, Homo sapiens
ctctgatgtccca

SEQ ID NO: 1265125 - DNA, 18 bp, Homo sapiens
ctctgattcacctcttcc

SEQ ID NO: 1265126 - DNA, 21 bp, Homo sapiens
ctctgattcacctcttcctct

SEQ ID NO: 1265127 - DNA, 22 bp, Homo sapiens
ctctgattcacctcttcctctg

SEQ ID NO: 1265128 - DNA, 15 bp, Homo sapiens
ctctgattggctgga

SEQ ID NO: 1265129 - DNA, 20 bp, Homo sapiens
ctctgattttcaaagctttt

SEQ ID NO: 1265130 - DNA, 16 bp, Homo sapiens
ctctgcaaaggaaata

SEQ ID NO: 1265131 - DNA, 18 bp, Homo sapiens
ctctgcaatgggcactgg

SEQ ID NO: 1265132 - DNA, 15 bp, Homo sapiens
ctctgcaattcccct

SEQ ID NO: 1265133 - DNA, 17 bp, Homo sapiens
ctctgcaattcccctct

SEQ ID NO: 1265134 - DNA, 18 bp, Homo sapiens
ctctgcaattcccctctg

SEQ ID NO: 1265135 - DNA, 23 bp, Homo sapiens
ctctgcaattcccctctgctgct

SEQ ID NO: 1265136 - DNA, 15 bp, Homo sapiens
ctctgcacaagctgc

SEQ ID NO: 1265137 - DNA, 16 bp, Homo sapiens
ctctgcacaagctgca

SEQ ID NO: 1265138 - DNA, 10 bp, Homo sapiens
ctctgcacag

SEQ ID NO: 1265139 - DNA, 23 bp, Homo sapiens
ctctgcacagaaacttgaactcc

SEQ ID NO: 1265140 - DNA, 14 bp, Homo sapiens
ctctgcacagatgg

SEQ ID NO: 1265141 - DNA, 15 bp, Homo sapiens
ctctgcacagatgga

SEQ ID NO: 1265142 - DNA, 15 bp, Homo sapiens
ctctgcacccagaac

SEQ ID NO: 1265143 - DNA, 17 bp, Homo sapiens
ctctgcacccagaacag

SEQ ID NO: 1265144 - DNA, 16 bp, Homo sapiens
ctctgcacccccatat

SEQ ID NO: 1265145 - DNA, 18 bp, Homo sapiens
ctctgcaccgtactgtgg

SEQ ID NO: 1265146 - DNA, 20 bp, Homo sapiens
ctctgcactactcctctgca

SEQ ID NO: 1265147 - DNA, 22 bp, Homo sapiens
ctctgcactactgacatgtggg

SEQ ID NO: 1265148 - DNA, 16 bp, Homo sapiens
ctctgcactccatggc

SEQ ID NO: 1265149 - DNA, 20 bp, Homo sapiens
ctctgcactccatggccacc

SEQ ID NO: 1265150 - DNA, 21 bp, Homo sapiens
ctctgcactccatggccaccc

SEQ ID NO: 1265151 - DNA, 24 bp, Homo sapiens
ctctggggcttgtcctgtgcttgc

SEQ ID NO: 1265152 - DNA, 18 bp, Homo sapiens
ctctgggggaggcagggc

SEQ ID NO: 1265153 - DNA, 20 bp, Homo sapiens
ctctggggtcccccatcccc

SEQ ID NO: 1265154 - DNA, 17 bp, Homo sapiens
ctctgggtccctcggag

SEQ ID NO: 1265155 - DNA, 14 bp, Homo sapiens
ctctggtcctcgga

SEQ ID NO: 1265156 - DNA, 22 bp, Homo sapiens
ctctggtgagtcttggcggcag

SEQ ID NO: 1265157 - DNA, 21 bp, Homo sapiens
ctctggtgataaaaataaagc

SEQ ID NO: 1265158 - DNA, 22 bp, Homo sapiens
ctctggtgcacgcctgagcgtc

SEQ ID NO: 1265159 - DNA, 18 bp, Homo sapiens
ctctggtggccacttcat

SEQ ID NO: 1265160 - DNA, 16 bp, Homo sapiens
ctctggtggctcctcc

SEQ ID NO: 1265161 - DNA, 21 bp, Homo sapiens
ctctggtggctcctcctagga

SEQ ID NO: 1265162 - DNA, 21 bp, Homo sapiens
ctctggtggcttaagtgagca

SEQ ID NO: 1265163 - DNA, 17 bp, Homo sapiens
ctctggtggtcttcctt

SEQ ID NO: 1265164 - DNA, 16 bp, Homo sapiens
ctctggtgtgtggtga

SEQ ID NO: 1265165 - DNA, 15 bp, Homo sapiens
ctctggttatttttc

SEQ ID NO: 1265166 - DNA, 21 bp, Homo sapiens
ctctggttcctttcatctctc

SEQ ID NO: 1265167 - DNA, 21 bp, Homo sapiens
ctctggttgtctagtcattgt

SEQ ID NO: 1265168 - DNA, 17 bp, Homo sapiens
ctctggttgtttctgtt

SEQ ID NO: 1265169 - DNA, 16 bp, Homo sapiens
ctctggtttaattaca

SEQ ID NO: 1265170 - DNA, 19 bp, Homo sapiens
ctctggttttcttgccacc

SEQ ID NO: 1265171 - DNA, 21 bp, Homo sapiens
ctctgtaaagctaaaataaag

SEQ ID NO: 1265172 - DNA, 20 bp, Homo sapiens
ctctgtaacttacacctgga

SEQ ID NO: 1265173 - DNA, 16 bp, Homo sapiens
ctctgtaagtgtagct

SEQ ID NO: 1265174 - DNA, 19 bp, Homo sapiens
ctctgtaattgaatattat

SEQ ID NO: 1265175 - DNA, 14 bp, Homo sapiens
ctctgtaattgcaa

SEQ ID NO: 1265176 - DNA, 12 bp, Homo sapiens
ctctgtactttt

SEQ ID NO: 1265177 - DNA, 20 bp, Homo sapiens
ctctgtacttttcattctct

SEQ ID NO: 1265178 - DNA, 21 bp, Homo sapiens
ctctgtaggatcgtaaaaaaa

SEQ ID NO: 1265179 - DNA, 13 bp, Homo sapiens
ctctgtaggcagc

SEQ ID NO: 1265180 - DNA, 19 bp, Homo sapiens
ctctgtaggcagcagagag

SEQ ID NO: 1265181 - DNA, 16 bp, Homo sapiens
ctctgtagtctcagtt

SEQ ID NO: 1265182 - DNA, 16 bp, Homo sapiens
ctctgtcactccaggc

SEQ ID NO: 1265183 - DNA, 15 bp, Homo sapiens
ctctgtcactgagca

SEQ ID NO: 1265184 - DNA, 13 bp, Homo sapiens
ctctgtcagatgg

SEQ ID NO: 1265185 - DNA, 20 bp, Homo sapiens
ctctgtcagccagccgccct

SEQ ID NO: 1265186 - DNA, 16 bp, Homo sapiens
ctctgtcagtcacagc

SEQ ID NO: 1265187 - DNA, 17 bp, Homo sapiens
ctctgtcagtcacagcc

SEQ ID NO: 1265188 - DNA, 17 bp, Homo sapiens
ctctgtcatcactccct

SEQ ID NO: 1265189 - DNA, 19 bp, Homo sapiens
ctctgtccagctcccgctg

SEQ ID NO: 1265190 - DNA, 12 bp, Homo sapiens
ctctgtccaggc

SEQ ID NO: 1265191 - DNA, 15 bp, Homo sapiens
ctctgtccaggccac

SEQ ID NO: 1265192 - DNA, 22 bp, Homo sapiens
ctctgtccaggccactgtggcc

SEQ ID NO: 1265193 - DNA, 23 bp, Homo sapiens
ctctgtccaggccactgtggcca

SEQ ID NO: 1265194 - DNA, 20 bp, Homo sapiens
ctctgtccagggccctgagc

SEQ ID NO: 1265195 - DNA, 22 bp, Homo sapiens
ctctgtccagggccctgagctc

SEQ ID NO: 1265196 - DNA, 17 bp, Homo sapiens
ctctgtccatttatcca

SEQ ID NO: 1265197 - DNA, 18 bp, Homo sapiens
ctctgtcccattccctgg

SEQ ID NO: 1265198 - DNA, 22 bp, Homo sapiens
ctctgtccccaggcctggctcc

SEQ ID NO: 1265199 - DNA, 16 bp, Homo sapiens
ctctgtccccaggtcc

SEQ ID NO: 1265200 - DNA, 17 bp, Homo sapiens
ctctgtccccaggtcct

SEQ ID NO: 1265201 - DNA, 18 bp, Homo sapiens
ctctgtccccaggtcctg

SEQ ID NO: 1265202 - DNA, 19 bp, Homo sapiens
ctctgtccccaggtcctgt

SEQ ID NO: 1265203 - DNA, 18 bp, Homo sapiens
ctctgtcccccaggctgg

SEQ ID NO: 1265204 - DNA, 20 bp, Homo sapiens
ctctgtcctcccatcccctc

SEQ ID NO: 1265205 - DNA, 19 bp, Homo sapiens
ctctgtcggctttttgcca

SEQ ID NO: 1265206 - DNA, 17 bp, Homo sapiens
ctctgtctacccagtgc

SEQ ID NO: 1265207 - DNA, 22 bp, Homo sapiens
ctctgtctaggactgcagtgtg

SEQ ID NO: 1265208 - DNA, 15 bp, Homo sapiens
ctctgtctcatccat

SEQ ID NO: 1265209 - DNA, 19 bp, Homo sapiens
ctctgtctcatcctcctgg

SEQ ID NO: 1265210 - DNA, 13 bp, Homo sapiens
ctctgtctcccag

SEQ ID NO: 1265211 - DNA, 16 bp, Homo sapiens
ctctgtctcccaggct

SEQ ID NO: 1265212 - DNA, 17 bp, Homo sapiens
ctctgtctcccaggctg

SEQ ID NO: 1265213 - DNA, 22 bp, Homo sapiens
ctctgtctcccaggctgctgga

SEQ ID NO: 1265214 - DNA, 12 bp, Homo sapiens
ctctgtctcctc

SEQ ID NO: 1265215 - DNA, 13 bp, Homo sapiens
ctctgtctctcct

SEQ ID NO: 1265216 - DNA, 13 bp, Homo sapiens
ctctgtctctgtg

SEQ ID NO: 1265217 - DNA, 15 bp, Homo sapiens
ctctgtctctgtgga

SEQ ID NO: 1265218 - DNA, 22 bp, Homo sapiens
ctctgtctgagtaagaaacaga

SEQ ID NO: 1265219 - DNA, 14 bp, Homo sapiens
ctctgtctggggct

SEQ ID NO: 1265220 - DNA, 17 bp, Homo sapiens
ctctgtctgtctctccc

SEQ ID NO: 1265221 - DNA, 14 bp, Homo sapiens
ctctgtcttctctc

SEQ ID NO: 1265222 - DNA, 15 bp, Homo sapiens
ctctgtcttgtgttt

SEQ ID NO: 1265223 - DNA, 16 bp, Homo sapiens
ctctgtcttgtgtttc

SEQ ID NO: 1265224 - DNA, 16 bp, Homo sapiens
ctctgtcttttctcct

SEQ ID NO: 1265225 - DNA, 23 bp, Homo sapiens
ctctgtcttttctcctccgcctg

SEQ ID NO: 1265226 - DNA, 21 bp, Homo sapiens
ctctgtcttttggagaaccag

SEQ ID NO: 1265227 - DNA, 18 bp, Homo sapiens
ctctgtgaacgatttaga

SEQ ID NO: 1265228 - DNA, 17 bp, Homo sapiens
ctctgtgaatacaatta

SEQ ID NO: 1265229 - DNA, 20 bp, Homo sapiens
ctctgtgaatacaattaaag

SEQ ID NO: 1265230 - DNA, 21 bp, Homo sapiens
ctctgtgaatacaattaaagg

SEQ ID NO: 1265231 - DNA, 13 bp, Homo sapiens
ctctgtgacaagg

SEQ ID NO: 1265232 - DNA, 16 bp, Homo sapiens
ctctgtgacaaggcta

SEQ ID NO: 1265233 - DNA, 15 bp, Homo sapiens
ctctgtgaccaatgt

SEQ ID NO: 1265234 - DNA, 19 bp, Homo sapiens
ctctgtgaccaatgtcttg

SEQ ID NO: 1265235 - DNA, 15 bp, Homo sapiens
ctctgtgacctgccc

SEQ ID NO: 1265236 - DNA, 20 bp, Homo sapiens
ctctgtgcagtcactggagg

SEQ ID NO: 1265237 - DNA, 15 bp, Homo sapiens
ctctgtgccttcttt

SEQ ID NO: 1265238 - DNA, 13 bp, Homo sapiens
ctctgtgctctga

SEQ ID NO: 1265239 - DNA, 11 bp, Homo sapiens
ctctgtgcttc

SEQ ID NO: 1265240 - DNA, 18 bp, Homo sapiens
ctctgtgctttgactcac

SEQ ID NO: 1265241 - DNA, 21 bp, Homo sapiens
ctctgtgctttgactcacctg

SEQ ID NO: 1265242 - DNA, 19 bp, Homo sapiens
ctctgtggcattgaaatga

SEQ ID NO: 1265243 - DNA, 22 bp, Homo sapiens
ctctgtggcctgtgtccagcag

SEQ ID NO: 1265244 - DNA, 13 bp, Homo sapiens
ctctgtggggctg

SEQ ID NO: 1265245 - DNA, 20 bp, Homo sapiens
ctctgtgggtctctggaaga

SEQ ID NO: 1265246 - DNA, 18 bp, Homo sapiens
ctctgtggtcacagaggg

SEQ ID NO: 1265247 - DNA, 15 bp, Homo sapiens
ctctgtgtaaagact

SEQ ID NO: 1265248 - DNA, 21 bp, Homo sapiens
ctctgtgtagccgccctgaga

SEQ ID NO: 1265249 - DNA, 17 bp, Homo sapiens
ctctgtgtatttatata

SEQ ID NO: 1265250 - DNA, 19 bp, Homo sapiens
ctctgtgtatttatataaa

SEQ ID NO: 1265251 - DNA, 14 bp, Homo sapiens
ctctgtgtccttcc

SEQ ID NO: 1265252 - DNA, 22 bp, Homo sapiens
ctctgtgttcccagaggcaggc

SEQ ID NO: 1265253 - DNA, 19 bp, Homo sapiens
ctctgtgtttgttcctaca

SEQ ID NO: 1265254 - DNA, 15 bp, Homo sapiens
ctctgttaacatcta

SEQ ID NO: 1265255 - DNA, 22 bp, Homo sapiens
ctctgttacactttttggaagt

SEQ ID NO: 1265256 - DNA, 17 bp, Homo sapiens
ctctgttaggtccattt

SEQ ID NO: 1265257 - DNA, 22 bp, Homo sapiens
ctctgttatcagctgggcagtg

SEQ ID NO: 1265258 - DNA, 15 bp, Homo sapiens
ctctgttcaaagctg

SEQ ID NO: 1265259 - DNA, 11 bp, Homo sapiens
ctctgttcaca

SEQ ID NO: 1265260 - DNA, 20 bp, Homo sapiens
ctctgttcacaaactacctc

SEQ ID NO: 1265261 - DNA, 21 bp, Homo sapiens
ctctgttcatttcacacagtg

SEQ ID NO: 1265262 - DNA, 22 bp, Homo sapiens
ctctgttctgctcccagatgcc

SEQ ID NO: 1265263 - DNA, 23 bp, Homo sapiens
ctctgttctgtttggcacttgta

SEQ ID NO: 1265264 - DNA, 14 bp, Homo sapiens
ctctgttgcccagg

SEQ ID NO: 1265265 - DNA, 20 bp, Homo sapiens
ctctgttgcccaggctggag

SEQ ID NO: 1265266 - DNA, 17 bp, Homo sapiens
ctctgttggtccactgt

SEQ ID NO: 1265267 - DNA, 18 bp, Homo sapiens
ctctgttggtccactgtg

SEQ ID NO: 1265268 - DNA, 12 bp, Homo sapiens
ctctgttgtcct

SEQ ID NO: 1265269 - DNA, 21 bp, Homo sapiens
ctctgttgtttggttcaggga

SEQ ID NO: 1265270 - DNA, 16 bp, Homo sapiens
ctcttaaaaaataaaa

SEQ ID NO: 1265271 - DNA, 18 bp, Homo sapiens
ctcttaaaaaataaaaac

SEQ ID NO: 1265272 - DNA, 15 bp, Homo sapiens
ctctttaattttaac

SEQ ID NO: 1265273 - DNA, 16 bp, Homo sapiens
ctctttaattttaact

SEQ ID NO: 1265274 - DNA, 16 bp, Homo sapiens
ctctttaccttctaaa

SEQ ID NO: 1265275 - DNA, 22 bp, Homo sapiens
ctctttactcccttcctggcct

SEQ ID NO: 1265276 - DNA, 23 bp, Homo sapiens
ctctttagaaataatggtcattc

SEQ ID NO: 1265277 - DNA, 17 bp, Homo sapiens
ctctttagtgttctgtt

SEQ ID NO: 1265278 - DNA, 14 bp, Homo sapiens
ctctttatacagct

SEQ ID NO: 1265279 - DNA, 17 bp, Homo sapiens
ctctttatgatctggcc

SEQ ID NO: 1265280 - DNA, 19 bp, Homo sapiens
ctctttatttctagcagag

SEQ ID NO: 1265281 - DNA, 20 bp, Homo sapiens
ctctttatttttctctttct

SEQ ID NO: 1265282 - DNA, 18 bp, Homo sapiens
ctctttcaaagaaatcca

SEQ ID NO: 1265283 - DNA, 14 bp, Homo sapiens
ctctttcaaattat

SEQ ID NO: 1265284 - DNA, 22 bp, Homo sapiens
ctctttcaagcagtcgtgcctg

SEQ ID NO: 1265285 - DNA, 13 bp, Homo sapiens
ctctttcatccac

SEQ ID NO: 1265286 - DNA, 13 bp, Homo sapiens
ctctttccaaatt

SEQ ID NO: 1265287 - DNA, 16 bp, Homo sapiens
ctctttccaaattaaa

SEQ ID NO: 1265288 - DNA, 22 bp, Homo sapiens
ctctttccagtggatcataaga

SEQ ID NO: 1265289 - DNA, 20 bp, Homo sapiens
ctctttcccaccctccacct

SEQ ID NO: 1265290 - DNA, 23 bp, Homo sapiens
ctctttcccaccctccacctctc

SEQ ID NO: 1265291 - DNA, 15 bp, Homo sapiens
ctctttccctgcgag

SEQ ID NO: 1265292 - DNA, 20 bp, Homo sapiens
ctctttccctgcgagacgca

SEQ ID NO: 1265293 - DNA, 14 bp, Homo sapiens
ctctttcctaaagc

SEQ ID NO: 1265294 - DNA, 19 bp, Homo sapiens
ctctttcctatttcagtgt

SEQ ID NO: 1265295 - DNA, 13 bp, Homo sapiens
ctctttccttgct

SEQ ID NO: 1265296 - DNA, 11 bp, Homo sapiens
ctctttctccc

SEQ ID NO: 1265297 - DNA, 19 bp, Homo sapiens
ctctttctctattatgtta

SEQ ID NO: 1265298 - DNA, 12 bp, Homo sapiens
ctctttctctcc

SEQ ID NO: 1265299 - DNA, 14 bp, Homo sapiens
ctctttctctcccc

SEQ ID NO: 1265300 - DNA, 18 bp, Homo sapiens
ctctttctctgccagtga

SEQ ID NO: 1265301 - DNA, 12 bp, Homo sapiens
ctctttctctgg

SEQ ID NO: 1265302 - DNA, 23 bp, Homo sapiens
ctctttctctggtggtcttcctt

SEQ ID NO: 1265303 - DNA, 20 bp, Homo sapiens
ctctttctgaaggaagagaa

SEQ ID NO: 1265304 - DNA, 15 bp, Homo sapiens
ctctttctgctctgc

SEQ ID NO: 1265305 - DNA, 17 bp, Homo sapiens
ctctttctgctctgcca

SEQ ID NO: 1265306 - DNA, 13 bp, Homo sapiens
ctctttctgtata

SEQ ID NO: 1265307 - DNA, 15 bp, Homo sapiens
ctctttctgtatata

SEQ ID NO: 1265308 - DNA, 15 bp, Homo sapiens
ctctttctgtcttct

SEQ ID NO: 1265309 - DNA, 17 bp, Homo sapiens
ctctttcttcctttact

SEQ ID NO: 1265310 - DNA, 15 bp, Homo sapiens
ctctttcttcctttc

SEQ ID NO: 1265311 - DNA, 16 bp, Homo sapiens
ctctttcttcctttct

SEQ ID NO: 1265312 - DNA, 23 bp, Homo sapiens
ctctttgaaatgacatgttcctt

SEQ ID NO: 1265313 - DNA, 16 bp, Homo sapiens
ctctttgaagaaaaga

SEQ ID NO: 1265314 - DNA, 20 bp, Homo sapiens
ctctttgaattttctgtgtt

SEQ ID NO: 1265315 - DNA, 23 bp, Homo sapiens
ctctttgagatagaagaactgca

SEQ ID NO: 1265316 - DNA, 16 bp, Homo sapiens
ctctttgattatttgc

SEQ ID NO: 1265317 - DNA, 20 bp, Homo sapiens
ctctttgattatttgcatgt

SEQ ID NO: 1265318 - DNA, 16 bp, Homo sapiens
ctctttgctttgcttt

SEQ ID NO: 1265319 - DNA, 18 bp, Homo sapiens
ctctttgctttgctttct

SEQ ID NO: 1265320 - DNA, 18 bp, Homo sapiens
ctctttggaaatagcatg

SEQ ID NO: 1265321 - DNA, 15 bp, Homo sapiens
ctctttggacactca

SEQ ID NO: 1265322 - DNA, 18 bp, Homo sapiens
ctctttggacactcacac

SEQ ID NO: 1265323 - DNA, 18 bp, Homo sapiens
ctctttggctcccctgta

SEQ ID NO: 1265324 - DNA, 20 bp, Homo sapiens
ctctttgggaatgtttgtct

SEQ ID NO: 1265325 - DNA, 17 bp, Homo sapiens
ctctttggggtcagcca

SEQ ID NO: 1265326 - DNA, 21 bp, Homo sapiens
ctctttgggtccattcagatg

SEQ ID NO: 1265327 - DNA, 16 bp, Homo sapiens
ctctttggtaggagtt

SEQ ID NO: 1265328 - DNA, 23 bp, Homo sapiens
ctctttgtgggttggccaggagg

SEQ ID NO: 1265329 - DNA, 22 bp, Homo sapiens
ctctttgtttatctctgagaca

SEQ ID NO: 1265330 - DNA, 21 bp, Homo sapiens
ctcttttaaaatatcctgtaa

SEQ ID NO: 1265331 - DNA, 19 bp, Homo sapiens
ctcttttaccaacttcctc

SEQ ID NO: 1265332 - DNA, 13 bp, Homo sapiens
ctcttttattctg

SEQ ID NO: 1265333 - DNA, 23 bp, Homo sapiens
ctcttttccactccattgtcgta

SEQ ID NO: 1265334 - DNA, 19 bp, Homo sapiens
ctcttttcccctttcctgt

SEQ ID NO: 1265335 - DNA, 21 bp, Homo sapiens
ctcttttcccctttcctgtcc

SEQ ID NO: 1265336 - DNA, 13 bp, Homo sapiens
ctcttttcctctc

SEQ ID NO: 1265337 - DNA, 16 bp, Homo sapiens
ctcttttcctggcagc

SEQ ID NO: 1265338 - DNA, 23 bp, Homo sapiens
ctcttttctaagtggcgtgtgca

SEQ ID NO: 1265339 - DNA, 14 bp, Homo sapiens
ctcttttctctgtg

SEQ ID NO: 1265340 - DNA, 13 bp, Homo sapiens
ctcttttgaaagt

SEQ ID NO: 1265341 - DNA, 14 bp, Homo sapiens
ctcttttgctgtgc

SEQ ID NO: 1265342 - DNA, 21 bp, Homo sapiens
ctcttttgctttattccagaa

SEQ ID NO: 1265343 - DNA, 19 bp, Homo sapiens
ctcttttgtgatgaacata

SEQ ID NO: 1265344 - DNA, 18 bp, Homo sapiens
ctcttttgttaaataata

SEQ ID NO: 1265345 - DNA, 11 bp, Homo sapiens
ctctttttaag

SEQ ID NO: 1265346 - DNA, 14 bp, Homo sapiens
ctctttttccttct

SEQ ID NO: 1265347 - DNA, 18 bp, Homo sapiens
ctctttttgccctttagg

SEQ ID NO: 1265348 - DNA, 16 bp, Homo sapiens
ctctttttggaggtgc

SEQ ID NO: 1265349 - DNA, 17 bp, Homo sapiens
ctctttttgggctcctt

SEQ ID NO: 1265350 - DNA, 23 bp, Homo sapiens
ctctttttgttgttgttgttctt

SEQ ID NO: 1265351 - DNA, 20 bp, Homo sapiens
ctcttttttgtttgtttctt

SEQ ID NO: 1265352 - DNA, 13 bp, Homo sapiens
ctctttttttgag

SEQ ID NO: 1265353 - DNA, 22 bp, Homo sapiens
ctgaaaaaacacctagctttat

SEQ ID NO: 1265354 - DNA, 13 bp, Homo sapiens
ctgaaaaaatata

SEQ ID NO: 1265355 - DNA, 21 bp, Homo sapiens
ctgaaaaatggtaattgttgc

SEQ ID NO: 1265356 - DNA, 14 bp, Homo sapiens
ctgaaaaatgtcag

SEQ ID NO: 1265357 - DNA, 21 bp, Homo sapiens
ctgaaaacacttgatgatgtg

SEQ ID NO: 1265358 - DNA, 15 bp, Homo sapiens
ctgaaaacccagaga

SEQ ID NO: 1265359 - DNA, 17 bp, Homo sapiens
ctgaaaacccagagagg

SEQ ID NO: 1265360 - DNA, 17 bp, Homo sapiens
ctgaaaacctctcctca

SEQ ID NO: 1265361 - DNA, 22 bp, Homo sapiens
ctgaaaactaatgtactgtaca

SEQ ID NO: 1265362 - DNA, 23 bp, Homo sapiens
ctgaaaactaatgtactgtacat

SEQ ID NO: 1265363 - DNA, 17 bp, Homo sapiens
ctgaaaacttagccaga

SEQ ID NO: 1265364 - DNA, 18 bp, Homo sapiens
ctgaaaagactcagtgtt

SEQ ID NO: 1265365 - DNA, 19 bp, Homo sapiens
ctgaaaagactcagtgttc

SEQ ID NO: 1265366 - DNA, 13 bp, Homo sapiens
ctgaaaatccaat

SEQ ID NO: 1265367 - DNA, 20 bp, Homo sapiens
ctgaaaatccaataatcaga

SEQ ID NO: 1265368 - DNA, 20 bp, Homo sapiens
ctgaaaatcgagtttttcct

SEQ ID NO: 1265369 - DNA, 14 bp, Homo sapiens
ctgaaaatgtatgt

SEQ ID NO: 1265370 - DNA, 16 bp, Homo sapiens
ctgaaaatgtatgtgt

SEQ ID NO: 1265371 - DNA, 13 bp, Homo sapiens
ctgaaaatttaac

SEQ ID NO: 1265372 - DNA, 13 bp, Homo sapiens
ctgaaacacacga

SEQ ID NO: 1265373 - DNA, 18 bp, Homo sapiens
ctgaaacacgaaacttgt

SEQ ID NO: 1265374 - DNA, 12 bp, Homo sapiens
ctgaaacactgg

SEQ ID NO: 1265375 - DNA, 17 bp, Homo sapiens
ctgaaacactggacctg

SEQ ID NO: 1265376 - DNA, 12 bp, Homo sapiens
ctgaaacatgaa

SEQ ID NO: 1265377 - DNA, 15 bp, Homo sapiens
ctgaaaccaaaacat

SEQ ID NO: 1265378 - DNA, 22 bp, Homo sapiens
ctgaaaccattttcccatcatc

SEQ ID NO: 1265379 - DNA, 18 bp, Homo sapiens
ctgaaacccgccctcagg

SEQ ID NO: 1265380 - DNA, 21 bp, Homo sapiens
ctgaaacccgccctcaggggc

SEQ ID NO: 1265381 - DNA, 15 bp, Homo sapiens
ctgaaacgccttgca

SEQ ID NO: 1265382 - DNA, 22 bp, Homo sapiens
ctgaaacgccttgcacggctgc

SEQ ID NO: 1265383 - DNA, 22 bp, Homo sapiens
ctgaaacgtggatacagagcca

SEQ ID NO: 1265384 - DNA, 16 bp, Homo sapiens
ctgaaacttttctaaa

SEQ ID NO: 1265385 - DNA, 19 bp, Homo sapiens
ctgaaagaagaaaacagta

SEQ ID NO: 1265386 - DNA, 23 bp, Homo sapiens
ctgaaagaggaggacccctgcct

SEQ ID NO: 1265387 - DNA, 22 bp, Homo sapiens
ctgaaagaggctgaggcctgga

SEQ ID NO: 1265388 - DNA, 15 bp, Homo sapiens
ctgaaagatctctgt

SEQ ID NO: 1265389 - DNA, 16 bp, Homo sapiens
ctgaaagatctctgtc

SEQ ID NO: 1265390 - DNA, 14 bp, Homo sapiens
ctgaaagcagcagc

SEQ ID NO: 1265391 - DNA, 22 bp, Homo sapiens
ctgaaagcagcagctaggactg

SEQ ID NO: 1265392 - DNA, 13 bp, Homo sapiens
ctgaaagccaagg

SEQ ID NO: 1265393 - DNA, 15 bp, Homo sapiens
ctgaaagccaaggca

SEQ ID NO: 1265394 - DNA, 22 bp, Homo sapiens
ctgacaaccaccgctccccagc

SEQ ID NO: 1265395 - DNA, 20 bp, Homo sapiens
ctgacaaccactggtctgta

SEQ ID NO: 1265396 - DNA, 13 bp, Homo sapiens
ctgacaagttatt

SEQ ID NO: 1265397 - DNA, 21 bp, Homo sapiens
ctgacaatcaactctaatagt

SEQ ID NO: 1265398 - DNA, 21 bp, Homo sapiens
ctgacaatcagttaaacacac

SEQ ID NO: 1265399 - DNA, 15 bp, Homo sapiens
ctgacaatggcagct

SEQ ID NO: 1265400 - DNA, 22 bp, Homo sapiens
ctgacaatggcagctagactgg

SEQ ID NO: 1265401 - DNA, 18 bp, Homo sapiens
ctgacacaaaaagtagat

SEQ ID NO: 1265402 - DNA, 14 bp, Homo sapiens
ctgacacaccaggc

SEQ ID NO: 1265403 - DNA, 16 bp, Homo sapiens
ctgacacactaaccaa

SEQ ID NO: 1265404 - DNA, 14 bp, Homo sapiens
ctgacaccccctcc

SEQ ID NO: 1265405 - DNA, 21 bp, Homo sapiens
ctgacaccgtcgaccaggaaa

SEQ ID NO: 1265406 - DNA, 18 bp, Homo sapiens
ctgacacctaccatgctg

SEQ ID NO: 1265407 - DNA, 20 bp, Homo sapiens
ctgacacgaagccagcagag

SEQ ID NO: 1265408 - DNA, 13 bp, Homo sapiens
ctgacacttcctg

SEQ ID NO: 1265409 - DNA, 17 bp, Homo sapiens
ctgacactttctgctgg

SEQ ID NO: 1265410 - DNA, 18 bp, Homo sapiens
ctgacactttctgctgga

SEQ ID NO: 1265411 - DNA, 14 bp, Homo sapiens
ctgacagaaggact

SEQ ID NO: 1265412 - DNA, 15 bp, Homo sapiens
ctgacagcagcctgt

SEQ ID NO: 1265413 - DNA, 18 bp, Homo sapiens
ctgacagcagcctgtgag

SEQ ID NO: 1265414 - DNA, 20 bp, Homo sapiens
ctgacagcatgtgccctcct

SEQ ID NO: 1265415 - DNA, 14 bp, Homo sapiens
ctgacagcctccca

SEQ ID NO: 1265416 - DNA, 15 bp, Homo sapiens
ctgacagccttgccc

SEQ ID NO: 1265417 - DNA, 16 bp, Homo sapiens
ctgacagctgctccta

SEQ ID NO: 1265418 - DNA, 17 bp, Homo sapiens
ctgacagctgctcctag

SEQ ID NO: 1265419 - DNA, 22 bp, Homo sapiens
ctgacagctgctcctagaggga

SEQ ID NO: 1265420 - DNA, 20 bp, Homo sapiens
ctgacaggcagcctggacat

SEQ ID NO: 1265421 - DNA, 23 bp, Homo sapiens
ctgacaggcagcctggacataga

SEQ ID NO: 1265422 - DNA, 17 bp, Homo sapiens
ctgacagggagcagccc

SEQ ID NO: 1265423 - DNA, 17 bp, Homo sapiens
ctgacagggccagtgca

SEQ ID NO: 1265424 - DNA, 17 bp, Homo sapiens
ctgacagtccacagggg

SEQ ID NO: 1265425 - DNA, 15 bp, Homo sapiens
ctgacagtcttgtgc

SEQ ID NO: 1265426 - DNA, 15 bp, Homo sapiens
ctgacagtttttctg

SEQ ID NO: 1265427 - DNA, 14 bp, Homo sapiens
ctgacatagagaaa

SEQ ID NO: 1265428 - DNA, 19 bp, Homo sapiens
ctgacatagagaaaaggct

SEQ ID NO: 1265429 - DNA, 16 bp, Homo sapiens
ctgacatccactgttt

SEQ ID NO: 1265430 - DNA, 13 bp, Homo sapiens
ctgacatcccttc

SEQ ID NO: 1265431 - DNA, 18 bp, Homo sapiens
ctgacatcccttcctgga

SEQ ID NO: 1265432 - DNA, 17 bp, Homo sapiens
ctgacatctgtgtttca

SEQ ID NO: 1265433 - DNA, 21 bp, Homo sapiens
ctgacatctgtgtttcaagtg

SEQ ID NO: 1265434 - DNA, 23 bp, Homo sapiens
ctgacatgaagctgttgtgtgag

SEQ ID NO: 1265435 - DNA, 23 bp, Homo sapiens
ctgacatgcatattgattctgaa

SEQ ID NO: 1265436 - DNA, 21 bp, Homo sapiens
ctgacatgctaacctctctga

SEQ ID NO: 1265437 - DNA, 15 bp, Homo sapiens
ctgacatgtaagaaa

SEQ ID NO: 1265438 - DNA, 21 bp, Homo sapiens
ctgacatgtaccccctttccc

SEQ ID NO: 1265439 - DNA, 22 bp, Homo sapiens
ctgacatgtaccccctttccct

SEQ ID NO: 1265440 - DNA, 18 bp, Homo sapiens
ctgacatgtttgtgctct

SEQ ID NO: 1265441 - DNA, 14 bp, Homo sapiens
ctgacattaacagt

SEQ ID NO: 1265442 - DNA, 18 bp, Homo sapiens
ctgacattaacagttttc

SEQ ID NO: 1265443 - DNA, 23 bp, Homo sapiens
ctgacattcacctgccccaactc

SEQ ID NO: 1265444 - DNA, 19 bp, Homo sapiens
ctgacattgctccaagatg

SEQ ID NO: 1265445 - DNA, 17 bp, Homo sapiens
ctgaccaaatggccagt

SEQ ID NO: 1265446 - DNA, 16 bp, Homo sapiens
ctgaccaacatggaga

SEQ ID NO: 1265447 - DNA, 14 bp, Homo sapiens
ctgaccaagtttct

SEQ ID NO: 1265448 - DNA, 20 bp, Homo sapiens
ctgaccaatattgtacagtt

SEQ ID NO: 1265449 - DNA, 18 bp, Homo sapiens
ctgaccaattgtgctgcc

SEQ ID NO: 1265450 - DNA, 20 bp, Homo sapiens
ctgaccaattgtgctgccat

SEQ ID NO: 1265451 - DNA, 21 bp, Homo sapiens
ctgaccaattgtgctgccatt

SEQ ID NO: 1265452 - DNA, 12 bp, Homo sapiens
ctgaccacactt

SEQ ID NO: 1265453 - DNA, 19 bp, Homo sapiens
ctgaccacacttcctgtcc

SEQ ID NO: 1265454 - DNA, 21 bp, Homo sapiens
ctgaccacacttcctgtccag

SEQ ID NO: 1265455 - DNA, 13 bp, Homo sapiens
ctgaccagcagcg

SEQ ID NO: 1265456 - DNA, 15 bp, Homo sapiens
ctgaccagcagcgcc

SEQ ID NO: 1265457 - DNA, 16 bp, Homo sapiens
ctgaccagctgctccg

SEQ ID NO: 1265458 - DNA, 19 bp, Homo sapiens
ctgaccagctgctccgagg

SEQ ID NO: 1265459 - DNA, 18 bp, Homo sapiens
ctgaccagctggagtgag

SEQ ID NO: 1265460 - DNA, 15 bp, Homo sapiens
ctgaccatgcatttt

SEQ ID NO: 1265461 - DNA, 19 bp, Homo sapiens
ctgaccatgcgtcaggggc

SEQ ID NO: 1265462 - DNA, 22 bp, Homo sapiens
ctgaccatggttttggctctcc

SEQ ID NO: 1265463 - DNA, 15 bp, Homo sapiens
ctgacccaaagcaaa

SEQ ID NO: 1265464 - DNA, 16 bp, Homo sapiens
ctgacccacctgcgct

SEQ ID NO: 1265465 - DNA, 21 bp, Homo sapiens
ctgacccacctgcgcttctgc

SEQ ID NO: 1265466 - DNA, 22 bp, Homo sapiens
ctgacccagagtggagtctgag

SEQ ID NO: 1265467 - DNA, 21 bp, Homo sapiens
ctgacccagcatctcccagca

SEQ ID NO: 1265468 - DNA, 12 bp, Homo sapiens
ctgacccaggcc

SEQ ID NO: 1265469 - DNA, 19 bp, Homo sapiens
ctgacccaggccgcagctc

SEQ ID NO: 1265470 - DNA, 21 bp, Homo sapiens
ctgacccaggccgcagctctt

SEQ ID NO: 1265471 - DNA, 12 bp, Homo sapiens
ctgacccagtcc

SEQ ID NO: 1265472 - DNA, 18 bp, Homo sapiens
ctgacccagtccctgggg

SEQ ID NO: 1265473 - DNA, 14 bp, Homo sapiens
ctgacccatccctt

SEQ ID NO: 1265474 - DNA, 20 bp, Homo sapiens
ctgaccccaaacaccttcca

SEQ ID NO: 1265475 - DNA, 23 bp, Homo sapiens
ctgaccccaaagagcctggagaa

SEQ ID NO: 1265476 - DNA, 12 bp, Homo sapiens
ctgaccccactt

SEQ ID NO: 1265477 - DNA, 17 bp, Homo sapiens
ctgaccccaggtcagcc

SEQ ID NO: 1265478 - DNA, 19 bp, Homo sapiens
ctgaccccaggtcagccct

SEQ ID NO: 1265479 - DNA, 19 bp, Homo sapiens
ctgacccccatctgagctg

SEQ ID NO: 1265480 - DNA, 20 bp, Homo sapiens
ctgacccccatctgagctgg

SEQ ID NO: 1265481 - DNA, 21 bp, Homo sapiens
ctgacccccatctgagctggg

SEQ ID NO: 1265482 - DNA, 20 bp, Homo sapiens
ctgaccccccccattagaat

SEQ ID NO: 1265483 - DNA, 23 bp, Homo sapiens
ctgaccccccccattagaatgtg

SEQ ID NO: 1265484 - DNA, 19 bp, Homo sapiens
ctgaccccgagaagtgctc

SEQ ID NO: 1265485 - DNA, 22 bp, Homo sapiens
ctgaccccggggggctgggaca

SEQ ID NO: 1265486 - DNA, 18 bp, Homo sapiens
ctgacccctccctgcagg

SEQ ID NO: 1265487 - DNA, 21 bp, Homo sapiens
ctgacccctccctgcaggggc

SEQ ID NO: 1265488 - DNA, 13 bp, Homo sapiens
ctgacccctctgg

SEQ ID NO: 1265489 - DNA, 13 bp, Homo sapiens
ctgacccctgcct

SEQ ID NO: 1265490 - DNA, 19 bp, Homo sapiens
ctgacccctgcctgttggc

SEQ ID NO: 1265491 - DNA, 23 bp, Homo sapiens
ctgacccctgcctgttggcaggc

SEQ ID NO: 1265492 - DNA, 13 bp, Homo sapiens
ctgaccccttgct

SEQ ID NO: 1265493 - DNA, 17 bp, Homo sapiens
ctgaccccttgctccct

SEQ ID NO: 1265494 - DNA, 17 bp, Homo sapiens
ctgacccggaggaaagg

SEQ ID NO: 1265495 - DNA, 13 bp, Homo sapiens
ctgaccctcccac

SEQ ID NO: 1265496 - DNA, 21 bp, Homo sapiens
ctgaccctctgcggccactgc

SEQ ID NO: 1265497 - DNA, 19 bp, Homo sapiens
ctgaccctgcttcaaatat

SEQ ID NO: 1265498 - DNA, 23 bp, Homo sapiens
ctgaccctgcttcaaatatttcc

SEQ ID NO: 1265499 - DNA, 22 bp, Homo sapiens
ctgaccctgtatatagcccagc

SEQ ID NO: 1265500 - DNA, 17 bp, Homo sapiens
ctgacccttctctcact

SEQ ID NO: 1265501 - DNA, 14 bp, Homo sapiens
ctgacccttttctg

SEQ ID NO: 1265502 - DNA, 15 bp, Homo sapiens
ctgaccgttttcact

SEQ ID NO: 1265503 - DNA, 20 bp, Homo sapiens
ctgacctacctcaaagggca

SEQ ID NO: 1265504 - DNA, 11 bp, Homo sapiens
ctgacctccca

SEQ ID NO: 1265505 - DNA, 13 bp, Homo sapiens
ctgacctcccagc

SEQ ID NO: 1265506 - DNA, 16 bp, Homo sapiens
ctgacctcccagccct

SEQ ID NO: 1265507 - DNA, 18 bp, Homo sapiens
ctgacctcccagccctat

SEQ ID NO: 1265508 - DNA, 12 bp, Homo sapiens
ctgacctctgct

SEQ ID NO: 1265509 - DNA, 14 bp, Homo sapiens
ctgacctctgctga

SEQ ID NO: 1265510 - DNA, 14 bp, Homo sapiens
ctgacctcttgctg

SEQ ID NO: 1265511 - DNA, 21 bp, Homo sapiens
ctgacctcttgctgtctctgc

SEQ ID NO: 1265512 - DNA, 16 bp, Homo sapiens
ctgacctgctgaattg

SEQ ID NO: 1265513 - DNA, 20 bp, Homo sapiens
ctgacctgctgacctgtgca

SEQ ID NO: 1265514 - DNA, 15 bp, Homo sapiens
ctgacctgggcccac

SEQ ID NO: 1265515 - DNA, 18 bp, Homo sapiens
ctgagcctacagatgaac

SEQ ID NO: 1265516 - DNA, 19 bp, Homo sapiens
ctgagcctcacagcagtga

SEQ ID NO: 1265517 - DNA, 21 bp, Homo sapiens
ctgagcctcagtctccctccc

SEQ ID NO: 1265518 - DNA, 15 bp, Homo sapiens
ctgagcctctgctcc

SEQ ID NO: 1265519 - DNA, 16 bp, Homo sapiens
ctgagcctctgctccc

SEQ ID NO: 1265520 - DNA, 16 bp, Homo sapiens
ctgagcctgcattctg

SEQ ID NO: 1265521 - DNA, 20 bp, Homo sapiens
ctgagcctgccaaagtgcct

SEQ ID NO: 1265522 - DNA, 12 bp, Homo sapiens
ctgagcctgctt

SEQ ID NO: 1265523 - DNA, 16 bp, Homo sapiens
ctgagcctggctggca

SEQ ID NO: 1265524 - DNA, 14 bp, Homo sapiens
ctgagcctgtgggt

SEQ ID NO: 1265525 - DNA, 16 bp, Homo sapiens
ctgagcctgtgggtcc

SEQ ID NO: 1265526 - DNA, 17 bp, Homo sapiens
ctgagccttcagtcttg

SEQ ID NO: 1265527 - DNA, 20 bp, Homo sapiens
ctgagcgaggagatgctcct

SEQ ID NO: 1265528 - DNA, 19 bp, Homo sapiens
ctgagcgcccccgagccct

SEQ ID NO: 1265529 - DNA, 22 bp, Homo sapiens
ctgagcgcccccgagccctgac

SEQ ID NO: 1265530 - DNA, 15 bp, Homo sapiens
ctgagcgcctccatc

SEQ ID NO: 1265531 - DNA, 20 bp, Homo sapiens
ctgagcgctgtggactgtcc

SEQ ID NO: 1265532 - DNA, 19 bp, Homo sapiens
ctgagcggatgcatctggg

SEQ ID NO: 1265533 - DNA, 21 bp, Homo sapiens
ctgagcggcaccctggtctgt

SEQ ID NO: 1265534 - DNA, 22 bp, Homo sapiens
ctgagcggtgggggaggagggt

SEQ ID NO: 1265535 - DNA, 14 bp, Homo sapiens
ctgagcgtggaagg

SEQ ID NO: 1265536 - DNA, 16 bp, Homo sapiens
ctgagctatttcatct

SEQ ID NO: 1265537 - DNA, 21 bp, Homo sapiens
ctgagctatttcatctatttt

SEQ ID NO: 1265538 - DNA, 17 bp, Homo sapiens
ctgagctattttcctct

SEQ ID NO: 1265539 - DNA, 18 bp, Homo sapiens
ctgagctattttcctctg

SEQ ID NO: 1265540 - DNA, 22 bp, Homo sapiens
ctgagctcacatgggactggga

SEQ ID NO: 1265541 - DNA, 13 bp, Homo sapiens
ctgagctcactcg

SEQ ID NO: 1265542 - DNA, 17 bp, Homo sapiens
ctgagctcccacctccc

SEQ ID NO: 1265543 - DNA, 21 bp, Homo sapiens
ctgagctcccacctcccttcc

SEQ ID NO: 1265544 - DNA, 23 bp, Homo sapiens
ctgagctcctctgggcaggacct

SEQ ID NO: 1265545 - DNA, 18 bp, Homo sapiens
ctgagctcgcagcccccg

SEQ ID NO: 1265546 - DNA, 17 bp, Homo sapiens
ctgagctcggtggaccc

SEQ ID NO: 1265547 - DNA, 14 bp, Homo sapiens
ctgagctctccagg

SEQ ID NO: 1265548 - DNA, 15 bp, Homo sapiens
ctgagctctccaggc

SEQ ID NO: 1265549 - DNA, 16 bp, Homo sapiens
ctgagctctccaggcc

SEQ ID NO: 1265550 - DNA, 17 bp, Homo sapiens
ctgagctctccaggcca

SEQ ID NO: 1265551 - DNA, 17 bp, Homo sapiens
ctgagctgaatgtttgt

SEQ ID NO: 1265552 - DNA, 13 bp, Homo sapiens
ctgagctgagtgg

SEQ ID NO: 1265553 - DNA, 15 bp, Homo sapiens
ctgagctgagtggcc

SEQ ID NO: 1265554 - DNA, 19 bp, Homo sapiens
ctgagctgagtggccagcc

SEQ ID NO: 1265555 - DNA, 17 bp, Homo sapiens
ctgagctggaaggggcc

SEQ ID NO: 1265556 - DNA, 13 bp, Homo sapiens
ctgagctggccct

SEQ ID NO: 1265557 - DNA, 18 bp, Homo sapiens
ctgagctggcctgtctgc

SEQ ID NO: 1265558 - DNA, 14 bp, Homo sapiens
ctgagctgggccca

SEQ ID NO: 1265559 - DNA, 17 bp, Homo sapiens
ctgagctgggcccagcc

SEQ ID NO: 1265560 - DNA, 20 bp, Homo sapiens
ctgagctgggcccagcccct

SEQ ID NO: 1265561 - DNA, 12 bp, Homo sapiens
ctgagctgggct

SEQ ID NO: 1265562 - DNA, 21 bp, Homo sapiens
ctgagctggggaggtgggagg

SEQ ID NO: 1265563 - DNA, 13 bp, Homo sapiens
ctgagctggggcc

SEQ ID NO: 1265564 - DNA, 13 bp, Homo sapiens
ctgagctgggggg

SEQ ID NO: 1265565 - DNA, 12 bp, Homo sapiens
ctgagctgtaat

SEQ ID NO: 1265566 - DNA, 21 bp, Homo sapiens
ctgagctgtaatttcgcctta

SEQ ID NO: 1265567 - DNA, 12 bp, Homo sapiens
ctgagctgtgat

SEQ ID NO: 1265568 - DNA, 15 bp, Homo sapiens
ctgagctgtgcaggt

SEQ ID NO: 1265569 - DNA, 22 bp, Homo sapiens
ctgagcttagccttgtgccctg

SEQ ID NO: 1265570 - DNA, 23 bp, Homo sapiens
ctgagcttagccttgtgccctgc

SEQ ID NO: 1265571 - DNA, 24 bp, Homo sapiens
ctgagcttagccttgtgccctgcc

SEQ ID NO: 1265572 - DNA, 21 bp, Homo sapiens
ctgagcttcggttctccagaa

SEQ ID NO: 1265573 - DNA, 16 bp, Homo sapiens
ctgagcttctctgtga

SEQ ID NO: 1265574 - DNA, 21 bp, Homo sapiens
ctgagctttaaatcattagag

SEQ ID NO: 1265575 - DNA, 17 bp, Homo sapiens
ctgagctttggggacag

SEQ ID NO: 1265576 - DNA, 21 bp, Homo sapiens
ctgagctttggggacagttgg

SEQ ID NO: 1265577 - DNA, 16 bp, Homo sapiens
ctgaggaactgtctcg

SEQ ID NO: 1265578 - DNA, 20 bp, Homo sapiens
ctgaggaagcacagcagcat

SEQ ID NO: 1265579 - DNA, 15 bp, Homo sapiens
ctgaggaagcagttg

SEQ ID NO: 1265580 - DNA, 23 bp, Homo sapiens
ctgaggaagcagttggggccctc

SEQ ID NO: 1265581 - DNA, 16 bp, Homo sapiens
ctgaggaatttcacct

SEQ ID NO: 1265582 - DNA, 15 bp, Homo sapiens
ctgaggacaaagtgg

SEQ ID NO: 1265583 - DNA, 20 bp, Homo sapiens
ctgaggacaaagtggaggag

SEQ ID NO: 1265584 - DNA, 11 bp, Homo sapiens
ctgaggacaga

SEQ ID NO: 1265585 - DNA, 19 bp, Homo sapiens
ctgaggacaggctctagag

SEQ ID NO: 1265586 - DNA, 14 bp, Homo sapiens
ctgaggaccagcca

SEQ ID NO: 1265587 - DNA, 19 bp, Homo sapiens
ctgaggaccgctgataagc

SEQ ID NO: 1265588 - DNA, 16 bp, Homo sapiens
ctgaggacctctcagc

SEQ ID NO: 1265589 - DNA, 22 bp, Homo sapiens
ctgaggacctctcagcatagcc

SEQ ID NO: 1265590 - DNA, 14 bp, Homo sapiens
ctgaggactggaga

SEQ ID NO: 1265591 - DNA, 22 bp, Homo sapiens
ctgaggacttaaaatattcctg

SEQ ID NO: 1265592 - DNA, 21 bp, Homo sapiens
ctgaggagatgaccagggatg

SEQ ID NO: 1265593 - DNA, 16 bp, Homo sapiens
ctgaggagcagccagg

SEQ ID NO: 1265594 - DNA, 19 bp, Homo sapiens
ctgaggagcagccaggacc

SEQ ID NO: 1265595 - DNA, 22 bp, Homo sapiens
ctgaggagcagccaggacccgc

SEQ ID NO: 1265596 - DNA, 20 bp, Homo sapiens
ctgaggagccctgaggacct

SEQ ID NO: 1265597 - DNA, 20 bp, Homo sapiens
ctgaggaggaggacacagca

SEQ ID NO: 1265598 - DNA, 13 bp, Homo sapiens
ctgaggaggccgc

SEQ ID NO: 1265599 - DNA, 18 bp, Homo sapiens
ctgaggagtaagtgtaca

SEQ ID NO: 1265600 - DNA, 20 bp, Homo sapiens
ctgaggagtaagtgtacaat

SEQ ID NO: 1265601 - DNA, 21 bp, Homo sapiens
ctgaggagtaagtgtacaatt

SEQ ID NO: 1265602 - DNA, 12 bp, Homo sapiens
ctgaggagtctg

SEQ ID NO: 1265603 - DNA, 15 bp, Homo sapiens
ctgaggagtctgagg

SEQ ID NO: 1265604 - DNA, 20 bp, Homo sapiens
ctgaggagtctgaggactgt

SEQ ID NO: 1265605 - DNA, 21 bp, Homo sapiens
ctgaggagtctgaggactgtc

SEQ ID NO: 1265606 - DNA, 16 bp, Homo sapiens
ctgaggatgagctgga

SEQ ID NO: 1265607 - DNA, 18 bp, Homo sapiens
ctgaggatgggtcagagc

SEQ ID NO: 1265608 - DNA, 19 bp, Homo sapiens
ctgaggatgggtcagagct

SEQ ID NO: 1265609 - DNA, 22 bp, Homo sapiens
ctgaggatttaagggatggaaa

SEQ ID NO: 1265610 - DNA, 15 bp, Homo sapiens
ctgaggatttcctgg

SEQ ID NO: 1265611 - DNA, 23 bp, Homo sapiens
ctgaggatttcctggagtgccct

SEQ ID NO: 1265612 - DNA, 14 bp, Homo sapiens
ctgaggcaaccccc

SEQ ID NO: 1265613 - DNA, 17 bp, Homo sapiens
ctgaggcaaccccctcg

SEQ ID NO: 1265614 - DNA, 16 bp, Homo sapiens
ctgaggcaagagaatt

SEQ ID NO: 1265615 - DNA, 22 bp, Homo sapiens
ctgaggcagacagcagctcagg

SEQ ID NO: 1265616 - DNA, 15 bp, Homo sapiens
ctgaggcagcagtgt

SEQ ID NO: 1265617 - DNA, 17 bp, Homo sapiens
ctgaggcagcagtgtga

SEQ ID NO: 1265618 - DNA, 13 bp, Homo sapiens
ctgaggcaggaga

SEQ ID NO: 1265619 - DNA, 20 bp, Homo sapiens
ctgaggccacactcagcaca

SEQ ID NO: 1265620 - DNA, 17 bp, Homo sapiens
ctgaggccacccagagg

SEQ ID NO: 1265621 - DNA, 14 bp, Homo sapiens
ctgaggccagagtc

SEQ ID NO: 1265622 - DNA, 18 bp, Homo sapiens
ctgaggccagagtcacct

SEQ ID NO: 1265623 - DNA, 21 bp, Homo sapiens
ctgaggccaggacgtctgggg

SEQ ID NO: 1265624 - DNA, 14 bp, Homo sapiens
ctgaggccagtggc

SEQ ID NO: 1265625 - DNA, 16 bp, Homo sapiens
ctgaggccagtggccc

SEQ ID NO: 1265626 - DNA, 18 bp, Homo sapiens
ctgaggccatcagggccc

SEQ ID NO: 1265627 - DNA, 20 bp, Homo sapiens
ctgaggccatcagggccctg

SEQ ID NO: 1265628 - DNA, 14 bp, Homo sapiens
ctgaggcccagtgc

SEQ ID NO: 1265629 - DNA, 15 bp, Homo sapiens
ctgaggcccagtgca

SEQ ID NO: 1265630 - DNA, 16 bp, Homo sapiens
ctgaggcccagtgcat

SEQ ID NO: 1265631 - DNA, 17 bp, Homo sapiens
ctgaggcccagtgcata

SEQ ID NO: 1265632 - DNA, 15 bp, Homo sapiens
ctgaggccctcactg

SEQ ID NO: 1265633 - DNA, 21 bp, Homo sapiens
ctgaggccctgggctgggtgc

SEQ ID NO: 1265634 - DNA, 17 bp, Homo sapiens
ctgaggcctagactctg

SEQ ID NO: 1265635 - DNA, 11 bp, Homo sapiens
ctgaggcctca

SEQ ID NO: 1265636 - DNA, 14 bp, Homo sapiens
ctgaggcctcatcc

SEQ ID NO: 1265637 - DNA, 15 bp, Homo sapiens
ctgatgcgctgggat

SEQ ID NO: 1265638 - DNA, 15 bp, Homo sapiens
ctgatgctccctccc

SEQ ID NO: 1265639 - DNA, 17 bp, Homo sapiens
ctgatgctccctcccct

SEQ ID NO: 1265640 - DNA, 18 bp, Homo sapiens
ctgatgctccctcccctg

SEQ ID NO: 1265641 - DNA, 23 bp, Homo sapiens
ctgatgctccctcccctgccctg

SEQ ID NO: 1265642 - DNA, 15 bp, Homo sapiens
ctgatgctcctccgg

SEQ ID NO: 1265643 - DNA, 22 bp, Homo sapiens
ctgatgctttgcttcaaatcca

SEQ ID NO: 1265644 - DNA, 21 bp, Homo sapiens
ctgatggaactgtgtatttat

SEQ ID NO: 1265645 - DNA, 19 bp, Homo sapiens
ctgatggaatgtgccacct

SEQ ID NO: 1265646 - DNA, 13 bp, Homo sapiens
ctgatggaccctc

SEQ ID NO: 1265647 - DNA, 15 bp, Homo sapiens
ctgatggagtgtgca

SEQ ID NO: 1265648 - DNA, 16 bp, Homo sapiens
ctgatggccaagagca

SEQ ID NO: 1265649 - DNA, 15 bp, Homo sapiens
ctgatggccaagggg

SEQ ID NO: 1265650 - DNA, 16 bp, Homo sapiens
ctgatggcctttggac

SEQ ID NO: 1265651 - DNA, 13 bp, Homo sapiens
ctgatggctcaag

SEQ ID NO: 1265652 - DNA, 14 bp, Homo sapiens
ctgatggcttgaca

SEQ ID NO: 1265653 - DNA, 17 bp, Homo sapiens
ctgatggcttgacatgt

SEQ ID NO: 1265654 - DNA, 21 bp, Homo sapiens
ctgatggcttgacatgtgcaa

SEQ ID NO: 1265655 - DNA, 22 bp, Homo sapiens
ctgatggcttgacatgtgcaat

SEQ ID NO: 1265656 - DNA, 14 bp, Homo sapiens
ctgatgggaaggag

SEQ ID NO: 1265657 - DNA, 16 bp, Homo sapiens
ctgatgggacatcaaa

SEQ ID NO: 1265658 - DNA, 20 bp, Homo sapiens
ctgatgggctggggcagggg

SEQ ID NO: 1265659 - DNA, 24 bp, Homo sapiens
ctgatggtataaacaggagacagg

SEQ ID NO: 1265660 - DNA, 15 bp, Homo sapiens
ctgatggtcagctcc

SEQ ID NO: 1265661 - DNA, 23 bp, Homo sapiens
ctgatggtcttaaatgctcattt

SEQ ID NO: 1265662 - DNA, 14 bp, Homo sapiens
ctgatggtgagctg

SEQ ID NO: 1265663 - DNA, 18 bp, Homo sapiens
ctgatggtgagctgggaa

SEQ ID NO: 1265664 - DNA, 23 bp, Homo sapiens
ctgatggtgctcacgactcttcc

SEQ ID NO: 1265665 - DNA, 18 bp, Homo sapiens
ctgatggtgctgctcagg

SEQ ID NO: 1265666 - DNA, 20 bp, Homo sapiens
ctgatggtgtcattctgcct

SEQ ID NO: 1265667 - DNA, 20 bp, Homo sapiens
ctgatgtacaattaaaaacc

SEQ ID NO: 1265668 - DNA, 19 bp, Homo sapiens
ctgatgtcaatttctgtgt

SEQ ID NO: 1265669 - DNA, 12 bp, Homo sapiens
ctgatgtcccag

SEQ ID NO: 1265670 - DNA, 22 bp, Homo sapiens
ctgatgtgacattccatgacga

SEQ ID NO: 1265671 - DNA, 15 bp, Homo sapiens
ctgatgtgatattct

SEQ ID NO: 1265672 - DNA, 20 bp, Homo sapiens
ctgatgtgtcctcagggagc

SEQ ID NO: 1265673 - DNA, 21 bp, Homo sapiens
ctgatgtttataaactgagag

SEQ ID NO: 1265674 - DNA, 18 bp, Homo sapiens
ctgattaaatatttgaag

SEQ ID NO: 1265675 - DNA, 19 bp, Homo sapiens
ctgattaaatatttgaaga

SEQ ID NO: 1265676 - DNA, 20 bp, Homo sapiens
ctgattaaatatttgaagag

SEQ ID NO: 1265677 - DNA, 16 bp, Homo sapiens
ctgattaagcattctt

SEQ ID NO: 1265678 - DNA, 16 bp, Homo sapiens
ctgattaatatattta

SEQ ID NO: 1265679 - DNA, 16 bp, Homo sapiens
ctgattactgtcaata

SEQ ID NO: 1265680 - DNA, 17 bp, Homo sapiens
ctgattactgtcaataa

SEQ ID NO: 1265681 - DNA, 11 bp, Homo sapiens
ctgattagaaa

SEQ ID NO: 1265682 - DNA, 13 bp, Homo sapiens
ctgattagaaatg

SEQ ID NO: 1265683 - DNA, 18 bp, Homo sapiens
ctgattagtattcaggca

SEQ ID NO: 1265684 - DNA, 19 bp, Homo sapiens
ctgattataccatgtgtgc

SEQ ID NO: 1265685 - DNA, 20 bp, Homo sapiens
ctgattataccatgtgtgct

SEQ ID NO: 1265686 - DNA, 19 bp, Homo sapiens
ctgattcaaaccaaagctg

SEQ ID NO: 1265687 - DNA, 20 bp, Homo sapiens
ctgattcaaaccaaagctgc

SEQ ID NO: 1265688 - DNA, 23 bp, Homo sapiens
ctgattcaaaccaaagctgcctg

SEQ ID NO: 1265689 - DNA, 17 bp, Homo sapiens
ctgattcacatctcatt

SEQ ID NO: 1265690 - DNA, 21 bp, Homo sapiens
ctgattcacatctcatttttc

SEQ ID NO: 1265691 - DNA, 17 bp, Homo sapiens
ctgattcacctcttcct

SEQ ID NO: 1265692 - DNA, 18 bp, Homo sapiens
ctgattcactgcatggct

SEQ ID NO: 1265693 - DNA, 23 bp, Homo sapiens
ctgattcctttaaaatatatgtc

SEQ ID NO: 1265694 - DNA, 19 bp, Homo sapiens
ctgattcgaatgacactgt

SEQ ID NO: 1265695 - DNA, 21 bp, Homo sapiens
ctgattcttgattcctggctc

SEQ ID NO: 1265696 - DNA, 13 bp, Homo sapiens
ctgattcttgtaa

SEQ ID NO: 1265697 - DNA, 15 bp, Homo sapiens
ctgattgacctgctc

SEQ ID NO: 1265698 - DNA, 15 bp, Homo sapiens
ctgattggaatttct

SEQ ID NO: 1265699 - DNA, 18 bp, Homo sapiens
ctgattggaatttctggc

SEQ ID NO: 1265700 - DNA, 16 bp, Homo sapiens
ctgattggctcaccca

SEQ ID NO: 1265701 - DNA, 18 bp, Homo sapiens
ctgattgtgttgaagaag

SEQ ID NO: 1265702 - DNA, 23 bp, Homo sapiens
ctgatttagaagcaaagatttca

SEQ ID NO: 1265703 - DNA, 14 bp, Homo sapiens
ctgatttatttcta

SEQ ID NO: 1265704 - DNA, 18 bp, Homo sapiens
ctgatttattttgtatga

SEQ ID NO: 1265705 - DNA, 12 bp, Homo sapiens
ctgatttcagga

SEQ ID NO: 1265706 - DNA, 19 bp, Homo sapiens
ctgatttcaggcagcaggg

SEQ ID NO: 1265707 - DNA, 19 bp, Homo sapiens
ctgatttcagtttttcatt

SEQ ID NO: 1265708 - DNA, 24 bp, Homo sapiens
ctgatttcagtttttcatttgttt

SEQ ID NO: 1265709 - DNA, 13 bp, Homo sapiens
ctgatttcataat

SEQ ID NO: 1265710 - DNA, 19 bp, Homo sapiens
ctgatttcataattcagaa

SEQ ID NO: 1265711 - DNA, 17 bp, Homo sapiens
ctgatttccaggcccct

SEQ ID NO: 1265712 - DNA, 19 bp, Homo sapiens
ctgatttccaggcccctga

SEQ ID NO: 1265713 - DNA, 20 bp, Homo sapiens
ctgatttctacaactggagt

SEQ ID NO: 1265714 - DNA, 12 bp, Homo sapiens
ctgatttctagg

SEQ ID NO: 1265715 - DNA, 17 bp, Homo sapiens
ctgatttctagtgtata

SEQ ID NO: 1265716 - DNA, 14 bp, Homo sapiens
ctgatttctctgaa

SEQ ID NO: 1265717 - DNA, 14 bp, Homo sapiens
ctgatttggaaaaa

SEQ ID NO: 1265718 - DNA, 19 bp, Homo sapiens
ctgatttggagtgagccag

SEQ ID NO: 1265719 - DNA, 14 bp, Homo sapiens
ctgatttgtcctgc

SEQ ID NO: 1265720 - DNA, 19 bp, Homo sapiens
ctgattttaaaggcagaga

SEQ ID NO: 1265721 - DNA, 13 bp, Homo sapiens
ctgattttaacaa

SEQ ID NO: 1265722 - DNA, 18 bp, Homo sapiens
ctgattttcaaagctttt

SEQ ID NO: 1265723 - DNA, 21 bp, Homo sapiens
ctgattttcaaagctttttcc

SEQ ID NO: 1265724 - DNA, 15 bp, Homo sapiens
ctgattttctcactg

SEQ ID NO: 1265725 - DNA, 14 bp, Homo sapiens
ctgatttttccttt

SEQ ID NO: 1265726 - DNA, 15 bp, Homo sapiens
ctgattttttttcct

SEQ ID NO: 1265727 - DNA, 20 bp, Homo sapiens
ctgattttttttccttttaa

SEQ ID NO: 1265728 - DNA, 14 bp, Homo sapiens
ctgattttttttgt

SEQ ID NO: 1265729 - DNA, 21 bp, Homo sapiens
ctgattttttttgtagctgct

SEQ ID NO: 1265730 - DNA, 18 bp, Homo sapiens
ctgcaaaaaaagcctcca

SEQ ID NO: 1265731 - DNA, 19 bp, Homo sapiens
ctgcaaaaaaagcctccaa

SEQ ID NO: 1265732 - DNA, 14 bp, Homo sapiens
ctgcaaaaagaaaa

SEQ ID NO: 1265733 - DNA, 20 bp, Homo sapiens
ctgcaaaaagaaaaaaagaa

SEQ ID NO: 1265734 - DNA, 20 bp, Homo sapiens
ctgcaaaaatatttataaaa

SEQ ID NO: 1265735 - DNA, 13 bp, Homo sapiens
ctgcaaaaatgga

SEQ ID NO: 1265736 - DNA, 15 bp, Homo sapiens
ctgcaaaactggaag

SEQ ID NO: 1265737 - DNA, 17 bp, Homo sapiens
ctgcaaaaggactctca

SEQ ID NO: 1265738 - DNA, 13 bp, Homo sapiens
ctgcaaaatctgt

SEQ ID NO: 1265739 - DNA, 12 bp, Homo sapiens
ctgcaaaatgag

SEQ ID NO: 1265740 - DNA, 21 bp, Homo sapiens
ctgcaaaatgaggaatgtata

SEQ ID NO: 1265741 - DNA, 22 bp, Homo sapiens
ctgcaaaatgaggaatgtatat

SEQ ID NO: 1265742 - DNA, 13 bp, Homo sapiens
ctgcaaaattaaa

SEQ ID NO: 1265743 - DNA, 22 bp, Homo sapiens
ctgcaaacaccaacatgttggg

SEQ ID NO: 1265744 - DNA, 16 bp, Homo sapiens
ctgcaaacagaaatca

SEQ ID NO: 1265745 - DNA, 14 bp, Homo sapiens
ctgcaaacagaaca

SEQ ID NO: 1265746 - DNA, 15 bp, Homo sapiens
ctgcaaaccttcctg

SEQ ID NO: 1265747 - DNA, 18 bp, Homo sapiens
ctgcaaaccttcctggga

SEQ ID NO: 1265748 - DNA, 19 bp, Homo sapiens
ctgcaaaccttcctgggag

SEQ ID NO: 1265749 - DNA, 12 bp, Homo sapiens
ctgcaaagaaag

SEQ ID NO: 1265750 - DNA, 23 bp, Homo sapiens
ctgcaaagagaaaccgcttttgg

SEQ ID NO: 1265751 - DNA, 17 bp, Homo sapiens
ctgcaaagcccagcttg

SEQ ID NO: 1265752 - DNA, 20 bp, Homo sapiens
ctgcaaagctttggctgaga

SEQ ID NO: 1265753 - DNA, 15 bp, Homo sapiens
ctgcaaaggagaagc

SEQ ID NO: 1265754 - DNA, 21 bp, Homo sapiens
ctgcaaaggagaagcacagct

SEQ ID NO: 1265755 - DNA, 23 bp, Homo sapiens
ctgcaaaggtaataatacagcca

SEQ ID NO: 1265756 - DNA, 23 bp, Homo sapiens
ctgcaaaggtggcaatgcttaaa

SEQ ID NO: 1265757 - DNA, 14 bp, Homo sapiens
ctgcaaataaagcc

SEQ ID NO: 1265758 - DNA, 18 bp, Homo sapiens
ctgcaaataaagcctttt

SEQ ID NO: 1265759 - DNA, 22 bp, Homo sapiens
ctgcattttcctcttgtcctgg

SEQ ID NO: 1265760 - DNA, 23 bp, Homo sapiens
ctgcattttgtacaaatccacga

SEQ ID NO: 1265761 - DNA, 15 bp, Homo sapiens
ctgcatttttcactt

SEQ ID NO: 1265762 - DNA, 14 bp, Homo sapiens
ctgccaaaaccaca

SEQ ID NO: 1265763 - DNA, 18 bp, Homo sapiens
ctgccaaaaccacatggg

SEQ ID NO: 1265764 - DNA, 20 bp, Homo sapiens
ctgccaaaaccacatgggct

SEQ ID NO: 1265765 - DNA, 23 bp, Homo sapiens
ctgccaaaaccacatgggctggg

SEQ ID NO: 1265766 - DNA, 15 bp, Homo sapiens
ctgccaaaatgctct

SEQ ID NO: 1265767 - DNA, 14 bp, Homo sapiens
ctgccaaaggatgt

SEQ ID NO: 1265768 - DNA, 22 bp, Homo sapiens
ctgccaaaggatgtgatatata

SEQ ID NO: 1265769 - DNA, 20 bp, Homo sapiens
ctgccaaagtagtcctggca

SEQ ID NO: 1265770 - DNA, 16 bp, Homo sapiens
ctgccaaagtgcctgg

SEQ ID NO: 1265771 - DNA, 20 bp, Homo sapiens
ctgccaaattttggccaaag

SEQ ID NO: 1265772 - DNA, 19 bp, Homo sapiens
ctgccaagactcctcaggc

SEQ ID NO: 1265773 - DNA, 24 bp, Homo sapiens
ctgccaagcactcgagaccatcct

SEQ ID NO: 1265774 - DNA, 18 bp, Homo sapiens
ctgccaagcttcctgtgc

SEQ ID NO: 1265775 - DNA, 19 bp, Homo sapiens
ctgccaagcttcctgtgcc

SEQ ID NO: 1265776 - DNA, 21 bp, Homo sapiens
ctgccaaggccagagtggcct

SEQ ID NO: 1265777 - DNA, 22 bp, Homo sapiens
ctgccaaggccagagtggcctg

SEQ ID NO: 1265778 - DNA, 23 bp, Homo sapiens
ctgccaaggccagagtggcctgg

SEQ ID NO: 1265779 - DNA, 16 bp, Homo sapiens
ctgccaagggtgctgg

SEQ ID NO: 1265780 - DNA, 18 bp, Homo sapiens
ctgccaatcggctacccc

SEQ ID NO: 1265781 - DNA, 16 bp, Homo sapiens
ctgccaatgctccagc

SEQ ID NO: 1265782 - DNA, 21 bp, Homo sapiens
ctgccaatgtgggctgcccct

SEQ ID NO: 1265783 - DNA, 13 bp, Homo sapiens
ctgccacacccag

SEQ ID NO: 1265784 - DNA, 15 bp, Homo sapiens
ctgccacacccaggg

SEQ ID NO: 1265785 - DNA, 21 bp, Homo sapiens
ctgccacactctccatcaccc

SEQ ID NO: 1265786 - DNA, 23 bp, Homo sapiens
ctgccacagagaagtttgtagcc

SEQ ID NO: 1265787 - DNA, 16 bp, Homo sapiens
ctgccacagcaaggaa

SEQ ID NO: 1265788 - DNA, 15 bp, Homo sapiens
ctgccacagccagag

SEQ ID NO: 1265789 - DNA, 17 bp, Homo sapiens
ctgccacagccagagga

SEQ ID NO: 1265790 - DNA, 22 bp, Homo sapiens
ctgccacagcctcccctgccag

SEQ ID NO: 1265791 - DNA, 16 bp, Homo sapiens
ctgccacatccagctt

SEQ ID NO: 1265792 - DNA, 23 bp, Homo sapiens
ctgccacatggagccccctctgc

SEQ ID NO: 1265793 - DNA, 12 bp, Homo sapiens
ctgccacattga

SEQ ID NO: 1265794 - DNA, 14 bp, Homo sapiens
ctgccaccacgtct

SEQ ID NO: 1265795 - DNA, 18 bp, Homo sapiens
ctgccaccacgtctgcca

SEQ ID NO: 1265796 - DNA, 19 bp, Homo sapiens
ctgccaccacgtctgccag

SEQ ID NO: 1265797 - DNA, 12 bp, Homo sapiens
ctgccaccagca

SEQ ID NO: 1265798 - DNA, 16 bp, Homo sapiens
ctgccaccagcatcca

SEQ ID NO: 1265799 - DNA, 13 bp, Homo sapiens
ctgccaccaggcc

SEQ ID NO: 1265800 - DNA, 23 bp, Homo sapiens
ctgccaccaggccacctccccag

SEQ ID NO: 1265801 - DNA, 17 bp, Homo sapiens
ctgccaccagtcactgt

SEQ ID NO: 1265802 - DNA, 20 bp, Homo sapiens
ctgccacccacctccctgcc

SEQ ID NO: 1265803 - DNA, 22 bp, Homo sapiens
ctgccacccacctccctgcctc

SEQ ID NO: 1265804 - DNA, 18 bp, Homo sapiens
ctgccacccactcaggat

SEQ ID NO: 1265805 - DNA, 13 bp, Homo sapiens
ctgccaccccttc

SEQ ID NO: 1265806 - DNA, 14 bp, Homo sapiens
ctgccaccccttcc

SEQ ID NO: 1265807 - DNA, 15 bp, Homo sapiens
ctgccaccccttcct

SEQ ID NO: 1265808 - DNA, 23 bp, Homo sapiens
ctgccacccgcttcctgtttctt

SEQ ID NO: 1265809 - DNA, 15 bp, Homo sapiens
ctgccaccctacctg

SEQ ID NO: 1265810 - DNA, 21 bp, Homo sapiens
ctgccaccctgccccttgcca

SEQ ID NO: 1265811 - DNA, 22 bp, Homo sapiens
ctgccaccgactgcccagccac

SEQ ID NO: 1265812 - DNA, 21 bp, Homo sapiens
ctgccaccgtgggggaactga

SEQ ID NO: 1265813 - DNA, 13 bp, Homo sapiens
ctgccacctccct

SEQ ID NO: 1265814 - DNA, 16 bp, Homo sapiens
ctgccacctccctgac

SEQ ID NO: 1265815 - DNA, 21 bp, Homo sapiens
ctgccacgtcccgctgcctcc

SEQ ID NO: 1265816 - DNA, 16 bp, Homo sapiens
ctgccactcacccttc

SEQ ID NO: 1265817 - DNA, 19 bp, Homo sapiens
ctgccactcacccttcctg

SEQ ID NO: 1265818 - DNA, 20 bp, Homo sapiens
ctgccactcacccttcctgg

SEQ ID NO: 1265819 - DNA, 16 bp, Homo sapiens
ctgccactcactaggc

SEQ ID NO: 1265820 - DNA, 20 bp, Homo sapiens
ctgccactctctgggactct

SEQ ID NO: 1265821 - DNA, 19 bp, Homo sapiens
ctgccactgcacaccagcc

SEQ ID NO: 1265822 - DNA, 12 bp, Homo sapiens
ctgccactgggc

SEQ ID NO: 1265823 - DNA, 13 bp, Homo sapiens
ctgccactgggca

SEQ ID NO: 1265824 - DNA, 17 bp, Homo sapiens
ctgccactgggctctgg

SEQ ID NO: 1265825 - DNA, 20 bp, Homo sapiens
ctgccactgggctctggacc

SEQ ID NO: 1265826 - DNA, 21 bp, Homo sapiens
ctgccactgggctctggacct

SEQ ID NO: 1265827 - DNA, 19 bp, Homo sapiens
ctgccactttggtacatgg

SEQ ID NO: 1265828 - DNA, 17 bp, Homo sapiens
ctgccagacactgcgcc

SEQ ID NO: 1265829 - DNA, 22 bp, Homo sapiens
ctgccagacactgcgccccgcc

SEQ ID NO: 1265830 - DNA, 20 bp, Homo sapiens
ctgccagagaagcatcggag

SEQ ID NO: 1265831 - DNA, 13 bp, Homo sapiens
ctgccagcagggg

SEQ ID NO: 1265832 - DNA, 12 bp, Homo sapiens
ctgccagccagc

SEQ ID NO: 1265833 - DNA, 13 bp, Homo sapiens
ctgccagccagca

SEQ ID NO: 1265834 - DNA, 15 bp, Homo sapiens
ctgccagccagcagc

SEQ ID NO: 1265835 - DNA, 16 bp, Homo sapiens
ctgccagccagcagcc

SEQ ID NO: 1265836 - DNA, 14 bp, Homo sapiens
ctgccagcccactg

SEQ ID NO: 1265837 - DNA, 18 bp, Homo sapiens
ctgccagccgaccctcct

SEQ ID NO: 1265838 - DNA, 19 bp, Homo sapiens
ctgccagccgaccctcctg

SEQ ID NO: 1265839 - DNA, 20 bp, Homo sapiens
ctgccagccgaccctcctgg

SEQ ID NO: 1265840 - DNA, 13 bp, Homo sapiens
ctgccagcctgag

SEQ ID NO: 1265841 - DNA, 15 bp, Homo sapiens
ctgccagcctgagcg

SEQ ID NO: 1265842 - DNA, 20 bp, Homo sapiens
ctgccagcctgagcggaggc

SEQ ID NO: 1265843 - DNA, 15 bp, Homo sapiens
ctgccagcctggctt

SEQ ID NO: 1265844 - DNA, 16 bp, Homo sapiens
ctgccagcctggcttc

SEQ ID NO: 1265845 - DNA, 13 bp, Homo sapiens
ctgccagccttga

SEQ ID NO: 1265846 - DNA, 17 bp, Homo sapiens
ctgccagccttgagccc

SEQ ID NO: 1265847 - DNA, 21 bp, Homo sapiens
ctgccagccttgagccctggc

SEQ ID NO: 1265848 - DNA, 19 bp, Homo sapiens
ctgccaggcaacttttaaa

SEQ ID NO: 1265849 - DNA, 22 bp, Homo sapiens
ctgccaggcacacacagcccct

SEQ ID NO: 1265850 - DNA, 21 bp, Homo sapiens
ctgccaggcacctggcctgct

SEQ ID NO: 1265851 - DNA, 15 bp, Homo sapiens
ctgccaggcactctc

SEQ ID NO: 1265852 - DNA, 17 bp, Homo sapiens
ctgccaggcactctcat

SEQ ID NO: 1265853 - DNA, 13 bp, Homo sapiens
ctgccaggcaggg

SEQ ID NO: 1265854 - DNA, 20 bp, Homo sapiens
ctgccaggcaggggtggggg

SEQ ID NO: 1265855 - DNA, 13 bp, Homo sapiens
ctgccaggccagc

SEQ ID NO: 1265856 - DNA, 18 bp, Homo sapiens
ctgccaggccagcctccg

SEQ ID NO: 1265857 - DNA, 23 bp, Homo sapiens
ctgccaggccagcctccgagagg

SEQ ID NO: 1265858 - DNA, 12 bp, Homo sapiens
ctgccaggccca

SEQ ID NO: 1265859 - DNA, 13 bp, Homo sapiens
ctgccaggcccat

SEQ ID NO: 1265860 - DNA, 16 bp, Homo sapiens
ctgccaggcccatctc

SEQ ID NO: 1265861 - DNA, 19 bp, Homo sapiens
ctgccaggcggccctgggg

SEQ ID NO: 1265862 - DNA, 23 bp, Homo sapiens
ctgccaggcgttggtgccacttc

SEQ ID NO: 1265863 - DNA, 14 bp, Homo sapiens
ctgccaggctgttt

SEQ ID NO: 1265864 - DNA, 14 bp, Homo sapiens
ctgccagggcttcc

SEQ ID NO: 1265865 - DNA, 19 bp, Homo sapiens
ctgccaggggttcttgagc

SEQ ID NO: 1265866 - DNA, 16 bp, Homo sapiens
ctgccagggtgagcag

SEQ ID NO: 1265867 - DNA, 17 bp, Homo sapiens
ctgccagtccccctgcc

SEQ ID NO: 1265868 - DNA, 22 bp, Homo sapiens
ctgccagtcgggagagccaggc

SEQ ID NO: 1265869 - DNA, 18 bp, Homo sapiens
ctgccagtctcactgtgg

SEQ ID NO: 1265870 - DNA, 17 bp, Homo sapiens
ctgccagtgaagtcctt

SEQ ID NO: 1265871 - DNA, 12 bp, Homo sapiens
ctgccagtgaca

SEQ ID NO: 1265872 - DNA, 23 bp, Homo sapiens
ctgccagtgacagacaggctctt

SEQ ID NO: 1265873 - DNA, 17 bp, Homo sapiens
ctgccagtgcagccact

SEQ ID NO: 1265874 - DNA, 12 bp, Homo sapiens
ctgccagtgcca

SEQ ID NO: 1265875 - DNA, 23 bp, Homo sapiens
ctgccagtgccagggtgggctgg

SEQ ID NO: 1265876 - DNA, 13 bp, Homo sapiens
ctgccagtgcctt

SEQ ID NO: 1265877 - DNA, 22 bp, Homo sapiens
ctgccagtgccttacctcctgc

SEQ ID NO: 1265878 - DNA, 15 bp, Homo sapiens
ctgccagtgtggaac

SEQ ID NO: 1265879 - DNA, 12 bp, Homo sapiens
ctgccagttttg

SEQ ID NO: 1265880 - DNA, 12 bp, Homo sapiens
ctgccctctaga

SEQ ID NO: 1265881 - DNA, 23 bp, Homo sapiens
ctgccctctccctgtgttctggg

SEQ ID NO: 1265882 - DNA, 20 bp, Homo sapiens
ctgccctctgctctgcctgg

SEQ ID NO: 1265883 - DNA, 19 bp, Homo sapiens
ctgccctcttaagatctga

SEQ ID NO: 1265884 - DNA, 12 bp, Homo sapiens
ctgccctgagaa

SEQ ID NO: 1265885 - DNA, 19 bp, Homo sapiens
ctgccctgagaagctgctc

SEQ ID NO: 1265886 - DNA, 21 bp, Homo sapiens
ctgccctgagaagctgctcca

SEQ ID NO: 1265887 - DNA, 18 bp, Homo sapiens
ctgccctgaggggctggg

SEQ ID NO: 1265888 - DNA, 14 bp, Homo sapiens
ctgccctgcaccct

SEQ ID NO: 1265889 - DNA, 13 bp, Homo sapiens
ctgccctgcagca

SEQ ID NO: 1265890 - DNA, 15 bp, Homo sapiens
ctgccctgcagcacg

SEQ ID NO: 1265891 - DNA, 15 bp, Homo sapiens
ctgccctgcccaagt

SEQ ID NO: 1265892 - DNA, 16 bp, Homo sapiens
ctgccctgcccaagtg

SEQ ID NO: 1265893 - DNA, 13 bp, Homo sapiens
ctgccctgcccag

SEQ ID NO: 1265894 - DNA, 21 bp, Homo sapiens
ctgccctgcccatactgagcc

SEQ ID NO: 1265895 - DNA, 13 bp, Homo sapiens
ctgccctgccccc

SEQ ID NO: 1265896 - DNA, 17 bp, Homo sapiens
ctgccctgcctcagcca

SEQ ID NO: 1265897 - DNA, 16 bp, Homo sapiens
ctgccctgcctgagga

SEQ ID NO: 1265898 - DNA, 22 bp, Homo sapiens
ctgccctgctgccgcctcccag

SEQ ID NO: 1265899 - DNA, 14 bp, Homo sapiens
ctgccctggaggga

SEQ ID NO: 1265900 - DNA, 16 bp, Homo sapiens
ctgccctggagggagg

SEQ ID NO: 1265901 - DNA, 15 bp, Homo sapiens
ctgccctggcagcag

SEQ ID NO: 1265902 - DNA, 18 bp, Homo sapiens
ctgccctggcagcagcag

SEQ ID NO: 1265903 - DNA, 15 bp, Homo sapiens
ctgccctggctccag

SEQ ID NO: 1265904 - DNA, 12 bp, Homo sapiens
ctgccctggctg

SEQ ID NO: 1265905 - DNA, 18 bp, Homo sapiens
ctgccctggctgctgccc

SEQ ID NO: 1265906 - DNA, 15 bp, Homo sapiens
ctgccctggtccagg

SEQ ID NO: 1265907 - DNA, 20 bp, Homo sapiens
ctgccctggtccagggaagc

SEQ ID NO: 1265908 - DNA, 14 bp, Homo sapiens
ctgccctggtgctg

SEQ ID NO: 1265909 - DNA, 16 bp, Homo sapiens
ctgccctggtgctgcc

SEQ ID NO: 1265910 - DNA, 17 bp, Homo sapiens
ctgccctggtgctgcca

SEQ ID NO: 1265911 - DNA, 23 bp, Homo sapiens
ctgccctggtgctgccacacttc

SEQ ID NO: 1265912 - DNA, 13 bp, Homo sapiens
ctgccctgtaccc

SEQ ID NO: 1265913 - DNA, 16 bp, Homo sapiens
ctgccctgtccctgtc

SEQ ID NO: 1265914 - DNA, 13 bp, Homo sapiens
ctgccctgtgtac

SEQ ID NO: 1265915 - DNA, 11 bp, Homo sapiens
ctgcccttccc

SEQ ID NO: 1265916 - DNA, 12 bp, Homo sapiens
ctgcccttccct

SEQ ID NO: 1265917 - DNA, 13 bp, Homo sapiens
ctgcccttccctc

SEQ ID NO: 1265918 - DNA, 15 bp, Homo sapiens
ctgcccttccctctg

SEQ ID NO: 1265919 - DNA, 15 bp, Homo sapiens
ctgcccttccgcagt

SEQ ID NO: 1265920 - DNA, 12 bp, Homo sapiens
ctgcccttcctc

SEQ ID NO: 1265921 - DNA, 13 bp, Homo sapiens
ctgcccttcctca

SEQ ID NO: 1265922 - DNA, 18 bp, Homo sapiens
ctgcccttcctcctgatg

SEQ ID NO: 1265923 - DNA, 15 bp, Homo sapiens
ctgcccttcctgcag

SEQ ID NO: 1265924 - DNA, 16 bp, Homo sapiens
ctgcccttctcaagac

SEQ ID NO: 1265925 - DNA, 20 bp, Homo sapiens
ctgccctttgcagtgtgcag

SEQ ID NO: 1265926 - DNA, 18 bp, Homo sapiens
ctgccctttggccaacag

SEQ ID NO: 1265927 - DNA, 20 bp, Homo sapiens
ctgccgaagaattgtcttgc

SEQ ID NO: 1265928 - DNA, 15 bp, Homo sapiens
ctgccgacatcagca

SEQ ID NO: 1265929 - DNA, 15 bp, Homo sapiens
ctgccgaccagagcc

SEQ ID NO: 1265930 - DNA, 15 bp, Homo sapiens
ctgccgacctcgtcc

SEQ ID NO: 1265931 - DNA, 16 bp, Homo sapiens
ctgccgagacagaccc

SEQ ID NO: 1265932 - DNA, 17 bp, Homo sapiens
ctgccgcaatacaggaa

SEQ ID NO: 1265933 - DNA, 14 bp, Homo sapiens
ctgccgcaccccag

SEQ ID NO: 1265934 - DNA, 15 bp, Homo sapiens
ctgccgcatgctccc

SEQ ID NO: 1265935 - DNA, 15 bp, Homo sapiens
ctgccgcccaaagag

SEQ ID NO: 1265936 - DNA, 19 bp, Homo sapiens
ctgccgccccctcctgaac

SEQ ID NO: 1265937 - DNA, 14 bp, Homo sapiens
ctgccgcctcccag

SEQ ID NO: 1265938 - DNA, 18 bp, Homo sapiens
ctgccgcctcccagcctg

SEQ ID NO: 1265939 - DNA, 19 bp, Homo sapiens
ctgccgcctcccagcctgg

SEQ ID NO: 1265940 - DNA, 14 bp, Homo sapiens
ctgccgctgcacct

SEQ ID NO: 1265941 - DNA, 13 bp, Homo sapiens
ctgccgctgcagg

SEQ ID NO: 1265942 - DNA, 21 bp, Homo sapiens
ctgccgggctgagggcctgct

SEQ ID NO: 1265943 - DNA, 21 bp, Homo sapiens
ctgccgggttctagtctcctt

SEQ ID NO: 1265944 - DNA, 16 bp, Homo sapiens
ctgccggtcatttgaa

SEQ ID NO: 1265945 - DNA, 16 bp, Homo sapiens
ctgccggtcgggcagc

SEQ ID NO: 1265946 - DNA, 21 bp, Homo sapiens
ctgccggtcgggcagccagca

SEQ ID NO: 1265947 - DNA, 23 bp, Homo sapiens
ctgccggtcgggcagccagcaga

SEQ ID NO: 1265948 - DNA, 14 bp, Homo sapiens
ctgccggtgggacc

SEQ ID NO: 1265949 - DNA, 22 bp, Homo sapiens
ctgccggtgggaccctgtccgg

SEQ ID NO: 1265950 - DNA, 20 bp, Homo sapiens
ctgccgtcaccaccacccct

SEQ ID NO: 1265951 - DNA, 15 bp, Homo sapiens
ctgccgtgcatggct

SEQ ID NO: 1265952 - DNA, 21 bp, Homo sapiens
ctgccgtgcatggctcctgtc

SEQ ID NO: 1265953 - DNA, 23 bp, Homo sapiens
ctgccgtgggcctgtcgtgccag

SEQ ID NO: 1265954 - DNA, 13 bp, Homo sapiens
ctgccgtggggcc

SEQ ID NO: 1265955 - DNA, 21 bp, Homo sapiens
ctgccgtggggccgccgcctc

SEQ ID NO: 1265956 - DNA, 24 bp, Homo sapiens
ctgcctagatccacgtgtggcctc

SEQ ID NO: 1265957 - DNA, 20 bp, Homo sapiens
ctgcctaggaggctggccaa

SEQ ID NO: 1265958 - DNA, 17 bp, Homo sapiens
ctgcctaggttctgtta

SEQ ID NO: 1265959 - DNA, 22 bp, Homo sapiens
ctgcctataatcttatacaaca

SEQ ID NO: 1265960 - DNA, 23 bp, Homo sapiens
ctgcctattatctgtcagctgca

SEQ ID NO: 1265961 - DNA, 24 bp, Homo sapiens
ctgcctcaatgtgaatcagaccct

SEQ ID NO: 1265962 - DNA, 14 bp, Homo sapiens
ctgcctcacccaca

SEQ ID NO: 1265963 - DNA, 18 bp, Homo sapiens
ctgcctcagacgttgcct

SEQ ID NO: 1265964 - DNA, 19 bp, Homo sapiens
ctgcctcagacgttgcctg

SEQ ID NO: 1265965 - DNA, 15 bp, Homo sapiens
ctgcctcagccagtg

SEQ ID NO: 1265966 - DNA, 23 bp, Homo sapiens
ctgcctcagcctccccagtagct

SEQ ID NO: 1265967 - DNA, 15 bp, Homo sapiens
ctgcctcagccttcc

SEQ ID NO: 1265968 - DNA, 11 bp, Homo sapiens
ctgcctcagga

SEQ ID NO: 1265969 - DNA, 23 bp, Homo sapiens
ctgcctcaggaggcaggaccttc

SEQ ID NO: 1265970 - DNA, 17 bp, Homo sapiens
ctgcctccacccgtcct

SEQ ID NO: 1265971 - DNA, 23 bp, Homo sapiens
ctgcctccacccgtcctccctca

SEQ ID NO: 1265972 - DNA, 24 bp, Homo sapiens
ctgcctccacccgtcctccctcag

SEQ ID NO: 1265973 - DNA, 23 bp, Homo sapiens
ctgcctcccaaggtcctctcagt

SEQ ID NO: 1265974 - DNA, 14 bp, Homo sapiens
ctgcctcccacttc

SEQ ID NO: 1265975 - DNA, 18 bp, Homo sapiens
ctgcctcccacttcactg

SEQ ID NO: 1265976 - DNA, 11 bp, Homo sapiens
ctgcctcccat

SEQ ID NO: 1265977 - DNA, 17 bp, Homo sapiens
ctgcctcccatgcctgg

SEQ ID NO: 1265978 - DNA, 20 bp, Homo sapiens
ctgcctcccattctgcacca

SEQ ID NO: 1265979 - DNA, 12 bp, Homo sapiens
ctgcctccccaa

SEQ ID NO: 1265980 - DNA, 14 bp, Homo sapiens
ctgcctccccaacc

SEQ ID NO: 1265981 - DNA, 22 bp, Homo sapiens
ctgcctccccaaccctgcccct

SEQ ID NO: 1265982 - DNA, 21 bp, Homo sapiens
ctgcctccctcaccctgagcc

SEQ ID NO: 1265983 - DNA, 22 bp, Homo sapiens
ctgcctccctcaccctgagccc

SEQ ID NO: 1265984 - DNA, 13 bp, Homo sapiens
ctgcctccctctc

SEQ ID NO: 1265985 - DNA, 15 bp, Homo sapiens
ctgcctccctctctt

SEQ ID NO: 1265986 - DNA, 14 bp, Homo sapiens
ctgcctcccttgac

SEQ ID NO: 1265987 - DNA, 16 bp, Homo sapiens
ctgcctccctttctgg

SEQ ID NO: 1265988 - DNA, 23 bp, Homo sapiens
ctgcctccgcgtgatcaaagcca

SEQ ID NO: 1265989 - DNA, 17 bp, Homo sapiens
ctgcctccgggaggtca

SEQ ID NO: 1265990 - DNA, 23 bp, Homo sapiens
ctgcctccgggaggtcatttttt

SEQ ID NO: 1265991 - DNA, 11 bp, Homo sapiens
ctgcctcctca

SEQ ID NO: 1265992 - DNA, 17 bp, Homo sapiens
ctgcctcctcgttcctt

SEQ ID NO: 1265993 - DNA, 13 bp, Homo sapiens
ctgcctcctgcca

SEQ ID NO: 1265994 - DNA, 14 bp, Homo sapiens
ctgcctcctgccac

SEQ ID NO: 1265995 - DNA, 20 bp, Homo sapiens
ctgcctcctggaggaccaga

SEQ ID NO: 1265996 - DNA, 21 bp, Homo sapiens
ctgcctcctgttttctccctc

SEQ ID NO: 1265997 - DNA, 18 bp, Homo sapiens
ctgcctcctttgcacctg

SEQ ID NO: 1265998 - DNA, 18 bp, Homo sapiens
ctgcctcgagggccgcct

SEQ ID NO: 1265999 - DNA, 17 bp, Homo sapiens
ctgcctcgctcaccgct

SEQ ID NO: 1266000 - DNA, 18 bp, Homo sapiens
ctgcctcgctcaccgctg

SEQ ID NO: 1266001 - DNA, 18 bp, Homo sapiens
ctgcctcggactccatgg

SEQ ID NO: 1266002 - DNA, 17 bp, Homo sapiens
ctgctaggccagagcca

SEQ ID NO: 1266003 - DNA, 18 bp, Homo sapiens
ctgctaggcgagtgccag

SEQ ID NO: 1266004 - DNA, 22 bp, Homo sapiens
ctgctaggcgagtgccaggact

SEQ ID NO: 1266005 - DNA, 22 bp, Homo sapiens
ctgctaggtgggccagcccctc

SEQ ID NO: 1266006 - DNA, 18 bp, Homo sapiens
ctgctatatataaaacgg

SEQ ID NO: 1266007 - DNA, 20 bp, Homo sapiens
ctgctatattaacatcatct

SEQ ID NO: 1266008 - DNA, 16 bp, Homo sapiens
ctgctatccccatctc

SEQ ID NO: 1266009 - DNA, 16 bp, Homo sapiens
ctgctatcctgccaaa

SEQ ID NO: 1266010 - DNA, 22 bp, Homo sapiens
ctgctatgaaaatgagcatcag

SEQ ID NO: 1266011 - DNA, 14 bp, Homo sapiens
ctgctatgccattt

SEQ ID NO: 1266012 - DNA, 15 bp, Homo sapiens
ctgctatgccatttc

SEQ ID NO: 1266013 - DNA, 16 bp, Homo sapiens
ctgctatgccatttct

SEQ ID NO: 1266014 - DNA, 18 bp, Homo sapiens
ctgctatgccatttcttc

SEQ ID NO: 1266015 - DNA, 19 bp, Homo sapiens
ctgctattgctgtctggtg

SEQ ID NO: 1266016 - DNA, 19 bp, Homo sapiens
ctgctatttattttcctaa

SEQ ID NO: 1266017 - DNA, 20 bp, Homo sapiens
ctgctcaagaagacatggag

SEQ ID NO: 1266018 - DNA, 21 bp, Homo sapiens
ctgctcaaggaccaagagcaa

SEQ ID NO: 1266019 - DNA, 15 bp, Homo sapiens
ctgctcacaagttct

SEQ ID NO: 1266020 - DNA, 14 bp, Homo sapiens
ctgctcacaggcag

SEQ ID NO: 1266021 - DNA, 18 bp, Homo sapiens
ctgctcacagggatgctg

SEQ ID NO: 1266022 - DNA, 23 bp, Homo sapiens
ctgctcacagggatgctggtggc

SEQ ID NO: 1266023 - DNA, 16 bp, Homo sapiens
ctgctcacccacctct

SEQ ID NO: 1266024 - DNA, 18 bp, Homo sapiens
ctgctcacccacctcttg

SEQ ID NO: 1266025 - DNA, 19 bp, Homo sapiens
ctgctcacccacctcttgt

SEQ ID NO: 1266026 - DNA, 19 bp, Homo sapiens
ctgctcaccgcccatcagg

SEQ ID NO: 1266027 - DNA, 16 bp, Homo sapiens
ctgctcaccggagtca

SEQ ID NO: 1266028 - DNA, 18 bp, Homo sapiens
ctgctcacgtcaaatgca

SEQ ID NO: 1266029 - DNA, 22 bp, Homo sapiens
ctgctcagaacttgctgctgtc

SEQ ID NO: 1266030 - DNA, 22 bp, Homo sapiens
ctgctcagcaattcagacccct

SEQ ID NO: 1266031 - DNA, 18 bp, Homo sapiens
ctgctcagcagccagtct

SEQ ID NO: 1266032 - DNA, 21 bp, Homo sapiens
ctgctcagcagccagtctcag

SEQ ID NO: 1266033 - DNA, 14 bp, Homo sapiens
ctgctcagctctgg

SEQ ID NO: 1266034 - DNA, 16 bp, Homo sapiens
ctgctcagctctgggc

SEQ ID NO: 1266035 - DNA, 22 bp, Homo sapiens
ctgctcagctctgggccattct

SEQ ID NO: 1266036 - DNA, 13 bp, Homo sapiens
ctgctcagcttct

SEQ ID NO: 1266037 - DNA, 17 bp, Homo sapiens
ctgctcaggcccatgct

SEQ ID NO: 1266038 - DNA, 19 bp, Homo sapiens
ctgctcaggcctccctagc

SEQ ID NO: 1266039 - DNA, 20 bp, Homo sapiens
ctgctcaggcctccctagca

SEQ ID NO: 1266040 - DNA, 20 bp, Homo sapiens
ctgctcaggctgcagctgga

SEQ ID NO: 1266041 - DNA, 19 bp, Homo sapiens
ctgctcagtaaagcacttg

SEQ ID NO: 1266042 - DNA, 22 bp, Homo sapiens
ctgctcagtgcttgggctccac

SEQ ID NO: 1266043 - DNA, 23 bp, Homo sapiens
ctgctcagtgcttgggctccacg

SEQ ID NO: 1266044 - DNA, 21 bp, Homo sapiens
ctgctcatcatattccaaccc

SEQ ID NO: 1266045 - DNA, 16 bp, Homo sapiens
ctgctcatcattctct

SEQ ID NO: 1266046 - DNA, 22 bp, Homo sapiens
ctgctcatcattctctgtctca

SEQ ID NO: 1266047 - DNA, 15 bp, Homo sapiens
ctgctcatccaaagt

SEQ ID NO: 1266048 - DNA, 18 bp, Homo sapiens
ctgctcattacagttctt

SEQ ID NO: 1266049 - DNA, 17 bp, Homo sapiens
ctgctcattttgacaaa

SEQ ID NO: 1266050 - DNA, 21 bp, Homo sapiens
ctgctccaccaaggggctctt

SEQ ID NO: 1266051 - DNA, 14 bp, Homo sapiens
ctgctccaccagca

SEQ ID NO: 1266052 - DNA, 16 bp, Homo sapiens
ctgctccaccagcagc

SEQ ID NO: 1266053 - DNA, 17 bp, Homo sapiens
ctgctccaccagcagca

SEQ ID NO: 1266054 - DNA, 18 bp, Homo sapiens
ctgctccaccagcagcat

SEQ ID NO: 1266055 - DNA, 20 bp, Homo sapiens
ctgctccaccagcagcatgg

SEQ ID NO: 1266056 - DNA, 16 bp, Homo sapiens
ctgctccacccttggc

SEQ ID NO: 1266057 - DNA, 22 bp, Homo sapiens
ctgctccagaatttggaaatcc

SEQ ID NO: 1266058 - DNA, 23 bp, Homo sapiens
ctgctccagaatttggaaatcct

SEQ ID NO: 1266059 - DNA, 21 bp, Homo sapiens
ctgctccagcaactgcccttc

SEQ ID NO: 1266060 - DNA, 22 bp, Homo sapiens
ctgctccagcaactgcccttcc

SEQ ID NO: 1266061 - DNA, 14 bp, Homo sapiens
ctgctccagcccct

SEQ ID NO: 1266062 - DNA, 13 bp, Homo sapiens
ctgctccagtgta

SEQ ID NO: 1266063 - DNA, 21 bp, Homo sapiens
ctgctccatccccctgcctcc

SEQ ID NO: 1266064 - DNA, 14 bp, Homo sapiens
ctgctcccacactt

SEQ ID NO: 1266065 - DNA, 20 bp, Homo sapiens
ctgctcccacacttgtgcca

SEQ ID NO: 1266066 - DNA, 21 bp, Homo sapiens
ctgctcccacacttgtgccag

SEQ ID NO: 1266067 - DNA, 14 bp, Homo sapiens
ctgctcccacccca

SEQ ID NO: 1266068 - DNA, 16 bp, Homo sapiens
ctgctcccaccccaga

SEQ ID NO: 1266069 - DNA, 17 bp, Homo sapiens
ctgctcccagatgcctt

SEQ ID NO: 1266070 - DNA, 19 bp, Homo sapiens
ctgctcccagatgccttct

SEQ ID NO: 1266071 - DNA, 14 bp, Homo sapiens
ctgctcccagcagc

SEQ ID NO: 1266072 - DNA, 16 bp, Homo sapiens
ctgctcccagcagccc

SEQ ID NO: 1266073 - DNA, 22 bp, Homo sapiens
ctgctcccagcagccctaagga

SEQ ID NO: 1266074 - DNA, 14 bp, Homo sapiens
ctgctcccagcctg

SEQ ID NO: 1266075 - DNA, 16 bp, Homo sapiens
ctgctcccagcctgct

SEQ ID NO: 1266076 - DNA, 15 bp, Homo sapiens
ctgctcccattcctc

SEQ ID NO: 1266077 - DNA, 17 bp, Homo sapiens
ctgctccccaacacctg

SEQ ID NO: 1266078 - DNA, 17 bp, Homo sapiens
ctgctccccagccctgg

SEQ ID NO: 1266079 - DNA, 13 bp, Homo sapiens
ctgctcccccacc

SEQ ID NO: 1266080 - DNA, 17 bp, Homo sapiens
ctgctcccccaccccct

SEQ ID NO: 1266081 - DNA, 21 bp, Homo sapiens
ctgctcccccaccccctcccc

SEQ ID NO: 1266082 - DNA, 13 bp, Homo sapiens
ctgctcccctaac

SEQ ID NO: 1266083 - DNA, 14 bp, Homo sapiens
ctgctcccctaacc

SEQ ID NO: 1266084 - DNA, 15 bp, Homo sapiens
ctgctcccctgccac

SEQ ID NO: 1266085 - DNA, 21 bp, Homo sapiens
ctgctcccggcccgcctgccc

SEQ ID NO: 1266086 - DNA, 19 bp, Homo sapiens
ctgctccctaagccagcct

SEQ ID NO: 1266087 - DNA, 13 bp, Homo sapiens
ctgctccctggca

SEQ ID NO: 1266088 - DNA, 16 bp, Homo sapiens
ctgctccgccaggaaa

SEQ ID NO: 1266089 - DNA, 14 bp, Homo sapiens
ctgctccgctgctc

SEQ ID NO: 1266090 - DNA, 15 bp, Homo sapiens
ctgctccgtggagga

SEQ ID NO: 1266091 - DNA, 18 bp, Homo sapiens
ctgctcctacatccagct

SEQ ID NO: 1266092 - DNA, 15 bp, Homo sapiens
ctgctcctagaggga

SEQ ID NO: 1266093 - DNA, 21 bp, Homo sapiens
ctgctcctagagggaggggcc

SEQ ID NO: 1266094 - DNA, 11 bp, Homo sapiens
ctgctcctcat

SEQ ID NO: 1266095 - DNA, 12 bp, Homo sapiens
ctgctcctccag

SEQ ID NO: 1266096 - DNA, 13 bp, Homo sapiens
ctgctcctccagg

SEQ ID NO: 1266097 - DNA, 22 bp, Homo sapiens
ctgctcctccagggccacgtgc

SEQ ID NO: 1266098 - DNA, 18 bp, Homo sapiens
ctgctcctccctgccccc

SEQ ID NO: 1266099 - DNA, 14 bp, Homo sapiens
ctgctcctccctgg

SEQ ID NO: 1266100 - DNA, 13 bp, Homo sapiens
ctgctcctgcttt

SEQ ID NO: 1266101 - DNA, 16 bp, Homo sapiens
ctgctcctgcttttct

SEQ ID NO: 1266102 - DNA, 17 bp, Homo sapiens
ctgctcctgcttttctg

SEQ ID NO: 1266103 - DNA, 14 bp, Homo sapiens
ctgctcctgtggca

SEQ ID NO: 1266104 - DNA, 16 bp, Homo sapiens
ctgctcctgtggcagg

SEQ ID NO: 1266105 - DNA, 12 bp, Homo sapiens
ctgctccttggc

SEQ ID NO: 1266106 - DNA, 18 bp, Homo sapiens
ctgctcctttaccctctt

SEQ ID NO: 1266107 - DNA, 20 bp, Homo sapiens
ctgctcctttaccctcttgg

SEQ ID NO: 1266108 - DNA, 15 bp, Homo sapiens
ctgctcgccctcctt

SEQ ID NO: 1266109 - DNA, 19 bp, Homo sapiens
ctgctcgccctcctttctg

SEQ ID NO: 1266110 - DNA, 22 bp, Homo sapiens
ctgctcgccctcctttctgtgc

SEQ ID NO: 1266111 - DNA, 23 bp, Homo sapiens
ctgctcgccctcctttctgtgcc

SEQ ID NO: 1266112 - DNA, 21 bp, Homo sapiens
ctgctcggcttcttggacctt

SEQ ID NO: 1266113 - DNA, 17 bp, Homo sapiens
ctgctcgtggactgtgc

SEQ ID NO: 1266114 - DNA, 19 bp, Homo sapiens
ctgctctacccatgagcct

SEQ ID NO: 1266115 - DNA, 20 bp, Homo sapiens
ctgctctacccatgagcctg

SEQ ID NO: 1266116 - DNA, 15 bp, Homo sapiens
ctgctctagccagga

SEQ ID NO: 1266117 - DNA, 14 bp, Homo sapiens
ctgctctagctggc

SEQ ID NO: 1266118 - DNA, 18 bp, Homo sapiens
ctgctctagctggcagga

SEQ ID NO: 1266119 - DNA, 20 bp, Homo sapiens
ctgctctagctggcaggaca

SEQ ID NO: 1266120 - DNA, 21 bp, Homo sapiens
ctgctctagtgggacagccca

SEQ ID NO: 1266121 - DNA, 23 bp, Homo sapiens
ctgctctattgtagcatttcttg

SEQ ID NO: 1266122 - DNA, 16 bp, Homo sapiens
ctgctctcagcctccc

SEQ ID NO: 1266123 - DNA, 18 bp, Homo sapiens
ctggaatctacaagccaa

SEQ ID NO: 1266124 - DNA, 19 bp, Homo sapiens
ctggaatctggagaccagg

SEQ ID NO: 1266125 - DNA, 24 bp, Homo sapiens
ctggaatctggagaccagggagcc

SEQ ID NO: 1266126 - DNA, 17 bp, Homo sapiens
ctggaatcttccccaag

SEQ ID NO: 1266127 - DNA, 19 bp, Homo sapiens
ctggaatcttccccaaggg

SEQ ID NO: 1266128 - DNA, 22 bp, Homo sapiens
ctggaatgccagtttgaccttt

SEQ ID NO: 1266129 - DNA, 14 bp, Homo sapiens
ctggaatgctgggt

SEQ ID NO: 1266130 - DNA, 20 bp, Homo sapiens
ctggaatggaagggttctgg

SEQ ID NO: 1266131 - DNA, 14 bp, Homo sapiens
ctggaatgggagac

SEQ ID NO: 1266132 - DNA, 18 bp, Homo sapiens
ctggaatgggagacctgt

SEQ ID NO: 1266133 - DNA, 15 bp, Homo sapiens
ctggaatgtaatcaa

SEQ ID NO: 1266134 - DNA, 16 bp, Homo sapiens
ctggaatgtttttccc

SEQ ID NO: 1266135 - DNA, 16 bp, Homo sapiens
ctggaattaaaacaaa

SEQ ID NO: 1266136 - DNA, 19 bp, Homo sapiens
ctggaattaaaacaaaaca

SEQ ID NO: 1266137 - DNA, 18 bp, Homo sapiens
ctggaattcagcaccctg

SEQ ID NO: 1266138 - DNA, 23 bp, Homo sapiens
ctggaattcctaacttttcaatg

SEQ ID NO: 1266139 - DNA, 14 bp, Homo sapiens
ctggaatttctgct

SEQ ID NO: 1266140 - DNA, 14 bp, Homo sapiens
ctggacaacactga

SEQ ID NO: 1266141 - DNA, 15 bp, Homo sapiens
ctggacaacactgat

SEQ ID NO: 1266142 - DNA, 15 bp, Homo sapiens
ctggacaagcagagg

SEQ ID NO: 1266143 - DNA, 19 bp, Homo sapiens
ctggacacaataggtcttt

SEQ ID NO: 1266144 - DNA, 23 bp, Homo sapiens
ctggacacactaaactctggggc

SEQ ID NO: 1266145 - DNA, 23 bp, Homo sapiens
ctggacacattggaatgccttgg

SEQ ID NO: 1266146 - DNA, 17 bp, Homo sapiens
ctggacacccctgctct

SEQ ID NO: 1266147 - DNA, 17 bp, Homo sapiens
ctggacaccgggccagt

SEQ ID NO: 1266148 - DNA, 13 bp, Homo sapiens
ctggacacctccc

SEQ ID NO: 1266149 - DNA, 17 bp, Homo sapiens
ctggacacctcccaggg

SEQ ID NO: 1266150 - DNA, 19 bp, Homo sapiens
ctggacactctatatgtag

SEQ ID NO: 1266151 - DNA, 17 bp, Homo sapiens
ctggacacttgctcatg

SEQ ID NO: 1266152 - DNA, 13 bp, Homo sapiens
ctggacagacaga

SEQ ID NO: 1266153 - DNA, 14 bp, Homo sapiens
ctggacagagggga

SEQ ID NO: 1266154 - DNA, 21 bp, Homo sapiens
ctggacagaggggactctggg

SEQ ID NO: 1266155 - DNA, 22 bp, Homo sapiens
ctggacagaggggactctgggc

SEQ ID NO: 1266156 - DNA, 23 bp, Homo sapiens
ctggacagatggacgcaggccct

SEQ ID NO: 1266157 - DNA, 16 bp, Homo sapiens
ctggacagcagaagcc

SEQ ID NO: 1266158 - DNA, 13 bp, Homo sapiens
ctggacagccagt

SEQ ID NO: 1266159 - DNA, 12 bp, Homo sapiens
ctggacagcttg

SEQ ID NO: 1266160 - DNA, 13 bp, Homo sapiens
ctggacaggcagc

SEQ ID NO: 1266161 - DNA, 15 bp, Homo sapiens
ctggacaggcagcct

SEQ ID NO: 1266162 - DNA, 13 bp, Homo sapiens
ctggacaggctct

SEQ ID NO: 1266163 - DNA, 23 bp, Homo sapiens
ctggacatagagagggagaagaa

SEQ ID NO: 1266164 - DNA, 16 bp, Homo sapiens
ctggacatgagatgga

SEQ ID NO: 1266165 - DNA, 17 bp, Homo sapiens
ctggacatgagatggag

SEQ ID NO: 1266166 - DNA, 20 bp, Homo sapiens
ctggacatgagatggagagg

SEQ ID NO: 1266167 - DNA, 23 bp, Homo sapiens
ctggaccaaagggaagtgaggcc

SEQ ID NO: 1266168 - DNA, 14 bp, Homo sapiens
ctggaccactgggc

SEQ ID NO: 1266169 - DNA, 15 bp, Homo sapiens
ctggaccatctctgt

SEQ ID NO: 1266170 - DNA, 16 bp, Homo sapiens
ctggaccattcctgtc

SEQ ID NO: 1266171 - DNA, 20 bp, Homo sapiens
ctggaccattcctgtccctt

SEQ ID NO: 1266172 - DNA, 20 bp, Homo sapiens
ctggaccccactggctgaga

SEQ ID NO: 1266173 - DNA, 17 bp, Homo sapiens
ctggaccccatctgtga

SEQ ID NO: 1266174 - DNA, 22 bp, Homo sapiens
ctggacccccagcccccagggc

SEQ ID NO: 1266175 - DNA, 14 bp, Homo sapiens
ctggaccccctgcc

SEQ ID NO: 1266176 - DNA, 19 bp, Homo sapiens
ctggaccccgtttcatttt

SEQ ID NO: 1266177 - DNA, 13 bp, Homo sapiens
ctggacccctgga

SEQ ID NO: 1266178 - DNA, 17 bp, Homo sapiens
ctggaccctgcttcacc

SEQ ID NO: 1266179 - DNA, 15 bp, Homo sapiens
ctggaccgagatgtg

SEQ ID NO: 1266180 - DNA, 17 bp, Homo sapiens
ctggaccgctgactgca

SEQ ID NO: 1266181 - DNA, 14 bp, Homo sapiens
ctggacctatgcag

SEQ ID NO: 1266182 - DNA, 19 bp, Homo sapiens
ctggacctatgcagggagg

SEQ ID NO: 1266183 - DNA, 22 bp, Homo sapiens
ctggacctcaggagggcaggct

SEQ ID NO: 1266184 - DNA, 19 bp, Homo sapiens
ctggacctcatgttgttga

SEQ ID NO: 1266185 - DNA, 18 bp, Homo sapiens
ctggacctccatccctgc

SEQ ID NO: 1266186 - DNA, 21 bp, Homo sapiens
ctggacctccatccctgctct

SEQ ID NO: 1266187 - DNA, 12 bp, Homo sapiens
ctggacctgagt

SEQ ID NO: 1266188 - DNA, 12 bp, Homo sapiens
ctggacctgcct

SEQ ID NO: 1266189 - DNA, 15 bp, Homo sapiens
ctggacctgcctcct

SEQ ID NO: 1266190 - DNA, 13 bp, Homo sapiens
ctggacctgggaa

SEQ ID NO: 1266191 - DNA, 22 bp, Homo sapiens
ctggacctgggggtagccccgc

SEQ ID NO: 1266192 - DNA, 20 bp, Homo sapiens
ctggaccttgacagagcagc

SEQ ID NO: 1266193 - DNA, 21 bp, Homo sapiens
ctggacgatagcttggaggga

SEQ ID NO: 1266194 - DNA, 20 bp, Homo sapiens
ctggacggcaggctcactgc

SEQ ID NO: 1266195 - DNA, 22 bp, Homo sapiens
ctggacggcaggctcactgcca

SEQ ID NO: 1266196 - DNA, 20 bp, Homo sapiens
ctggacgggccctccttccc

SEQ ID NO: 1266197 - DNA, 18 bp, Homo sapiens
ctggactaaaggcatcct

SEQ ID NO: 1266198 - DNA, 20 bp, Homo sapiens
ctggactaaaggcatccttg

SEQ ID NO: 1266199 - DNA, 22 bp, Homo sapiens
ctggactaaaggcatccttgtc

SEQ ID NO: 1266200 - DNA, 19 bp, Homo sapiens
ctggactaaccctgtggtt

SEQ ID NO: 1266201 - DNA, 16 bp, Homo sapiens
ctggactagcaaagga

SEQ ID NO: 1266202 - DNA, 16 bp, Homo sapiens
ctggactcaggaactt

SEQ ID NO: 1266203 - DNA, 15 bp, Homo sapiens
ctggactccggagga

SEQ ID NO: 1266204 - DNA, 19 bp, Homo sapiens
ctggactccggaggactga

SEQ ID NO: 1266205 - DNA, 20 bp, Homo sapiens
ctggactccggaggactgag

SEQ ID NO: 1266206 - DNA, 23 bp, Homo sapiens
ctggactccggaggactgagccc

SEQ ID NO: 1266207 - DNA, 18 bp, Homo sapiens
ctggactcctctgtccag

SEQ ID NO: 1266208 - DNA, 20 bp, Homo sapiens
ctggactcctgccaccagca

SEQ ID NO: 1266209 - DNA, 20 bp, Homo sapiens
ctggactctaagctggagct

SEQ ID NO: 1266210 - DNA, 23 bp, Homo sapiens
ctggactctcagtctctgagcag

SEQ ID NO: 1266211 - DNA, 22 bp, Homo sapiens
ctggactgaagcctgcaggagt

SEQ ID NO: 1266212 - DNA, 12 bp, Homo sapiens
ctggactgacag

SEQ ID NO: 1266213 - DNA, 13 bp, Homo sapiens
ctggactgacagc

SEQ ID NO: 1266214 - DNA, 19 bp, Homo sapiens
ctggactgaccctgcaggt

SEQ ID NO: 1266215 - DNA, 18 bp, Homo sapiens
ctggactgagccaaggag

SEQ ID NO: 1266216 - DNA, 20 bp, Homo sapiens
ctggactgagccaaggaggc

SEQ ID NO: 1266217 - DNA, 13 bp, Homo sapiens
ctggactgcatgg

SEQ ID NO: 1266218 - DNA, 14 bp, Homo sapiens
ctggactgcatggg

SEQ ID NO: 1266219 - DNA, 21 bp, Homo sapiens
ctggactgcatggggaggcag

SEQ ID NO: 1266220 - DNA, 15 bp, Homo sapiens
ctggactggaggtgg

SEQ ID NO: 1266221 - DNA, 16 bp, Homo sapiens
ctggactggaggtggg

SEQ ID NO: 1266222 - DNA, 17 bp, Homo sapiens
ctggactggaggtgggc

SEQ ID NO: 1266223 - DNA, 18 bp, Homo sapiens
ctggactggaggtgggca

SEQ ID NO: 1266224 - DNA, 24 bp, Homo sapiens
ctggactggaggtgggcatgccac

SEQ ID NO: 1266225 - DNA, 12 bp, Homo sapiens
ctggactggcca

SEQ ID NO: 1266226 - DNA, 14 bp, Homo sapiens
ctggactggcctgt

SEQ ID NO: 1266227 - DNA, 17 bp, Homo sapiens
ctggactgggaggtaga

SEQ ID NO: 1266228 - DNA, 18 bp, Homo sapiens
ctggactgtcatagaaat

SEQ ID NO: 1266229 - DNA, 20 bp, Homo sapiens
ctggacttacaaaatgccaa

SEQ ID NO: 1266230 - DNA, 15 bp, Homo sapiens
ctggacttgagcttg

SEQ ID NO: 1266231 - DNA, 15 bp, Homo sapiens
ctggacttgcctctg

SEQ ID NO: 1266232 - DNA, 18 bp, Homo sapiens
ctggactttaaaaaaaca

SEQ ID NO: 1266233 - DNA, 14 bp, Homo sapiens
ctggactttcctgc

SEQ ID NO: 1266234 - DNA, 16 bp, Homo sapiens
ctggactttcctgcaa

SEQ ID NO: 1266235 - DNA, 22 bp, Homo sapiens
ctggactttctctaataataaa

SEQ ID NO: 1266236 - DNA, 20 bp, Homo sapiens
ctggagaacaagaaagggcc

SEQ ID NO: 1266237 - DNA, 14 bp, Homo sapiens
ctggagaagcacca

SEQ ID NO: 1266238 - DNA, 20 bp, Homo sapiens
ctggagacccccccccaact

SEQ ID NO: 1266239 - DNA, 23 bp, Homo sapiens
ctggagaccgcttcacccctgca

SEQ ID NO: 1266240 - DNA, 15 bp, Homo sapiens
ctggagacttagggc

SEQ ID NO: 1266241 - DNA, 12 bp, Homo sapiens
ctggagagaagt

SEQ ID NO: 1266242 - DNA, 13 bp, Homo sapiens
ctggagagctgct

SEQ ID NO: 1266243 - DNA, 20 bp, Homo sapiens
ctggagagctgtgtctattt

SEQ ID NO: 1266244 - DNA, 14 bp, Homo sapiens
ctggctccagctgg

SEQ ID NO: 1266245 - DNA, 17 bp, Homo sapiens
ctggctccagtgaaact

SEQ ID NO: 1266246 - DNA, 18 bp, Homo sapiens
ctggctcccacaggccct

SEQ ID NO: 1266247 - DNA, 22 bp, Homo sapiens
ctggctcccacaggcccttcct

SEQ ID NO: 1266248 - DNA, 13 bp, Homo sapiens
ctggctcccacct

SEQ ID NO: 1266249 - DNA, 15 bp, Homo sapiens
ctggctcccagggtg

SEQ ID NO: 1266250 - DNA, 17 bp, Homo sapiens
ctggctcccagggtgga

SEQ ID NO: 1266251 - DNA, 23 bp, Homo sapiens
ctggctccccacgagtcacctgc

SEQ ID NO: 1266252 - DNA, 18 bp, Homo sapiens
ctggctccccctccccag

SEQ ID NO: 1266253 - DNA, 23 bp, Homo sapiens
ctggctccccctccccaggctgg

SEQ ID NO: 1266254 - DNA, 24 bp, Homo sapiens
ctggctccccctccccaggctgga

SEQ ID NO: 1266255 - DNA, 13 bp, Homo sapiens
ctggctccccgag

SEQ ID NO: 1266256 - DNA, 17 bp, Homo sapiens
ctggctccctcctccag

SEQ ID NO: 1266257 - DNA, 23 bp, Homo sapiens
ctggctccctcctccaggcctgc

SEQ ID NO: 1266258 - DNA, 20 bp, Homo sapiens
ctggctccgtccaggagcct

SEQ ID NO: 1266259 - DNA, 16 bp, Homo sapiens
ctggctcctgaggggc

SEQ ID NO: 1266260 - DNA, 13 bp, Homo sapiens
ctggctccttgca

SEQ ID NO: 1266261 - DNA, 17 bp, Homo sapiens
ctggctccttgcagcag

SEQ ID NO: 1266262 - DNA, 17 bp, Homo sapiens
ctggctcggacccaccc

SEQ ID NO: 1266263 - DNA, 18 bp, Homo sapiens
ctggctcggacccacccc

SEQ ID NO: 1266264 - DNA, 23 bp, Homo sapiens
ctggctcggacccaccccaactc

SEQ ID NO: 1266265 - DNA, 22 bp, Homo sapiens
ctggctcggggtaaaaagtggc

SEQ ID NO: 1266266 - DNA, 22 bp, Homo sapiens
ctggctctaattcacagtgctc

SEQ ID NO: 1266267 - DNA, 23 bp, Homo sapiens
ctggctctaattcacagtgctct

SEQ ID NO: 1266268 - DNA, 15 bp, Homo sapiens
ctggctctaccctgt

SEQ ID NO: 1266269 - DNA, 19 bp, Homo sapiens
ctggctctaccctgtctgt

SEQ ID NO: 1266270 - DNA, 17 bp, Homo sapiens
ctggctctaccttcctg

SEQ ID NO: 1266271 - DNA, 12 bp, Homo sapiens
ctggctctccaa

SEQ ID NO: 1266272 - DNA, 20 bp, Homo sapiens
ctggctctccaagtgccaga

SEQ ID NO: 1266273 - DNA, 13 bp, Homo sapiens
ctggctctcctgg

SEQ ID NO: 1266274 - DNA, 16 bp, Homo sapiens
ctggctctgagaatca

SEQ ID NO: 1266275 - DNA, 12 bp, Homo sapiens
ctggctctgagc

SEQ ID NO: 1266276 - DNA, 13 bp, Homo sapiens
ctggctctgcccc

SEQ ID NO: 1266277 - DNA, 14 bp, Homo sapiens
ctggctctgccccc

SEQ ID NO: 1266278 - DNA, 15 bp, Homo sapiens
ctggctctgcccctc

SEQ ID NO: 1266279 - DNA, 22 bp, Homo sapiens
ctggctctgcccctcagggggc

SEQ ID NO: 1266280 - DNA, 14 bp, Homo sapiens
ctggctctggggga

SEQ ID NO: 1266281 - DNA, 19 bp, Homo sapiens
ctggctctgggggacccag

SEQ ID NO: 1266282 - DNA, 12 bp, Homo sapiens
ctggctctgtga

SEQ ID NO: 1266283 - DNA, 23 bp, Homo sapiens
ctggctctgttcggcctttgggt

SEQ ID NO: 1266284 - DNA, 22 bp, Homo sapiens
ctggctcttgatacccccctct

SEQ ID NO: 1266285 - DNA, 18 bp, Homo sapiens
ctggctgaaccctgtgct

SEQ ID NO: 1266286 - DNA, 19 bp, Homo sapiens
ctggctgaaccctgtgctg

SEQ ID NO: 1266287 - DNA, 20 bp, Homo sapiens
ctggctgaaccctgtgctgg

SEQ ID NO: 1266288 - DNA, 20 bp, Homo sapiens
ctggctgaacttggagaggg

SEQ ID NO: 1266289 - DNA, 17 bp, Homo sapiens
ctggctgacctgggccc

SEQ ID NO: 1266290 - DNA, 23 bp, Homo sapiens
ctggctgacctgggcccacagag

SEQ ID NO: 1266291 - DNA, 19 bp, Homo sapiens
ctggctgagaatctggggg

SEQ ID NO: 1266292 - DNA, 20 bp, Homo sapiens
ctggctgagaatctgggggt

SEQ ID NO: 1266293 - DNA, 16 bp, Homo sapiens
ctggctgagcctggct

SEQ ID NO: 1266294 - DNA, 21 bp, Homo sapiens
ctggctgaggatttcaagcct

SEQ ID NO: 1266295 - DNA, 13 bp, Homo sapiens
ctggctgagggga

SEQ ID NO: 1266296 - DNA, 21 bp, Homo sapiens
ctggctgaggttcctctgcct

SEQ ID NO: 1266297 - DNA, 22 bp, Homo sapiens
ctggctgaggttcctctgcctg

SEQ ID NO: 1266298 - DNA, 18 bp, Homo sapiens
ctggctgccaggcgttgg

SEQ ID NO: 1266299 - DNA, 18 bp, Homo sapiens
ctggctgcccagacccct

SEQ ID NO: 1266300 - DNA, 19 bp, Homo sapiens
ctggctgccccaacctgct

SEQ ID NO: 1266301 - DNA, 13 bp, Homo sapiens
ctggctgccctgg

SEQ ID NO: 1266302 - DNA, 15 bp, Homo sapiens
ctggctgccctggcc

SEQ ID NO: 1266303 - DNA, 16 bp, Homo sapiens
ctggctgccctggccc

SEQ ID NO: 1266304 - DNA, 19 bp, Homo sapiens
ctggctgccttagaacctt

SEQ ID NO: 1266305 - DNA, 15 bp, Homo sapiens
ctggctgctaggcca

SEQ ID NO: 1266306 - DNA, 16 bp, Homo sapiens
ctggctgctaggccag

SEQ ID NO: 1266307 - DNA, 17 bp, Homo sapiens
ctggctgctaggccaga

SEQ ID NO: 1266308 - DNA, 12 bp, Homo sapiens
ctggctgctgcc

SEQ ID NO: 1266309 - DNA, 20 bp, Homo sapiens
ctggctgcttgcagccagga

SEQ ID NO: 1266310 - DNA, 21 bp, Homo sapiens
ctggctgcttgcagccaggag

SEQ ID NO: 1266311 - DNA, 14 bp, Homo sapiens
ctggctggaaagca

SEQ ID NO: 1266312 - DNA, 23 bp, Homo sapiens
ctggctggaaagcagagcctcct

SEQ ID NO: 1266313 - DNA, 12 bp, Homo sapiens
ctggctggagcc

SEQ ID NO: 1266314 - DNA, 15 bp, Homo sapiens
ctggctggagcctag

SEQ ID NO: 1266315 - DNA, 15 bp, Homo sapiens
ctggctggcacagaa

SEQ ID NO: 1266316 - DNA, 17 bp, Homo sapiens
ctggctggcctcaccca

SEQ ID NO: 1266317 - DNA, 16 bp, Homo sapiens
ctggctggcctgagca

SEQ ID NO: 1266318 - DNA, 23 bp, Homo sapiens
ctggctgggacgtggctcagcca

SEQ ID NO: 1266319 - DNA, 17 bp, Homo sapiens
ctggctgggcatggacg

SEQ ID NO: 1266320 - DNA, 16 bp, Homo sapiens
ctggctgggcccctgg

SEQ ID NO: 1266321 - DNA, 15 bp, Homo sapiens
ctggctggggcagag

SEQ ID NO: 1266322 - DNA, 17 bp, Homo sapiens
ctggctggggcagaggg

SEQ ID NO: 1266323 - DNA, 21 bp, Homo sapiens
ctggctgggtggcaccagcag

SEQ ID NO: 1266324 - DNA, 16 bp, Homo sapiens
ctggctgtaaatccta

SEQ ID NO: 1266325 - DNA, 19 bp, Homo sapiens
ctggctgtcagtatgacat

SEQ ID NO: 1266326 - DNA, 20 bp, Homo sapiens
ctggctgtccaaccagactt

SEQ ID NO: 1266327 - DNA, 21 bp, Homo sapiens
ctggctgtccaaccagacttt

SEQ ID NO: 1266328 - DNA, 14 bp, Homo sapiens
ctggctgtgcccag

SEQ ID NO: 1266329 - DNA, 16 bp, Homo sapiens
ctggctgtgcccagca

SEQ ID NO: 1266330 - DNA, 15 bp, Homo sapiens
ctggctgtgcccctg

SEQ ID NO: 1266331 - DNA, 15 bp, Homo sapiens
ctggctgtgcctgct

SEQ ID NO: 1266332 - DNA, 20 bp, Homo sapiens
ctggctgtgcctgcttctgt

SEQ ID NO: 1266333 - DNA, 17 bp, Homo sapiens
ctggctgtggaggcctg

SEQ ID NO: 1266334 - DNA, 19 bp, Homo sapiens
ctggctgtggaggcctgat

SEQ ID NO: 1266335 - DNA, 12 bp, Homo sapiens
ctggctgtgtgg

SEQ ID NO: 1266336 - DNA, 20 bp, Homo sapiens
ctggcttacctatctgtgga

SEQ ID NO: 1266337 - DNA, 20 bp, Homo sapiens
ctggcttcagcccccaccag

SEQ ID NO: 1266338 - DNA, 12 bp, Homo sapiens
ctggcttccagg

SEQ ID NO: 1266339 - DNA, 15 bp, Homo sapiens
ctggcttccaggtat

SEQ ID NO: 1266340 - DNA, 22 bp, Homo sapiens
ctggcttctctcctcagacttc

SEQ ID NO: 1266341 - DNA, 14 bp, Homo sapiens
ctggcttctgaaga

SEQ ID NO: 1266342 - DNA, 14 bp, Homo sapiens
ctggcttgccccag

SEQ ID NO: 1266343 - DNA, 22 bp, Homo sapiens
ctggcttgccccaggactctgg

SEQ ID NO: 1266344 - DNA, 17 bp, Homo sapiens
ctggcttgctccagggt

SEQ ID NO: 1266345 - DNA, 22 bp, Homo sapiens
ctggcttgctccagggtcttgg

SEQ ID NO: 1266346 - DNA, 20 bp, Homo sapiens
ctggcttgcttgccgagcct

SEQ ID NO: 1266347 - DNA, 20 bp, Homo sapiens
ctggcttggggtcaagaaac

SEQ ID NO: 1266348 - DNA, 17 bp, Homo sapiens
ctggcttgtaactccac

SEQ ID NO: 1266349 - DNA, 19 bp, Homo sapiens
ctggcttgtaactccacca

SEQ ID NO: 1266350 - DNA, 16 bp, Homo sapiens
ctggctttcccaggag

SEQ ID NO: 1266351 - DNA, 15 bp, Homo sapiens
ctggctttctccgac

SEQ ID NO: 1266352 - DNA, 22 bp, Homo sapiens
ctggctttctccgactgctagg

SEQ ID NO: 1266353 - DNA, 15 bp, Homo sapiens
ctggcttttacttta

SEQ ID NO: 1266354 - DNA, 22 bp, Homo sapiens
ctggcttttattaatgcacttt

SEQ ID NO: 1266355 - DNA, 15 bp, Homo sapiens
ctggcttttcacccc

SEQ ID NO: 1266356 - DNA, 17 bp, Homo sapiens
ctggcttttcactgctg

SEQ ID NO: 1266357 - DNA, 19 bp, Homo sapiens
ctggcttttcactgctggc

SEQ ID NO: 1266358 - DNA, 15 bp, Homo sapiens
ctggctttttaaaat

SEQ ID NO: 1266359 - DNA, 19 bp, Homo sapiens
ctgggaaaatccactatga

SEQ ID NO: 1266360 - DNA, 16 bp, Homo sapiens
ctgggaaatattccct

SEQ ID NO: 1266361 - DNA, 15 bp, Homo sapiens
ctgggaaatgcagaa

SEQ ID NO: 1266362 - DNA, 17 bp, Homo sapiens
ctgggaaatgcagaaat

SEQ ID NO: 1266363 - DNA, 23 bp, Homo sapiens
ctgggaaatggcttgaagccaag

SEQ ID NO: 1266364 - DNA, 19 bp, Homo sapiens
ctgggaacacatctggctg

SEQ ID NO: 1266365 - DNA, 22 bp, Homo sapiens
ctgggccgtggcacagctggga

SEQ ID NO: 1266366 - DNA, 21 bp, Homo sapiens
ctgggcctcaacaaggatcag

SEQ ID NO: 1266367 - DNA, 20 bp, Homo sapiens
ctgggcctcagtgtgcccat

SEQ ID NO: 1266368 - DNA, 20 bp, Homo sapiens
ctgggcctcagttcaacctg

SEQ ID NO: 1266369 - DNA, 15 bp, Homo sapiens
ctgggcctcccctgg

SEQ ID NO: 1266370 - DNA, 17 bp, Homo sapiens
ctgggcctcccctgggc

SEQ ID NO: 1266371 - DNA, 20 bp, Homo sapiens
ctgggcctcgtgcgcccgtg

SEQ ID NO: 1266372 - DNA, 13 bp, Homo sapiens
ctgggcctctgac

SEQ ID NO: 1266373 - DNA, 21 bp, Homo sapiens
ctgggcctgcttttccaggat

SEQ ID NO: 1266374 - DNA, 14 bp, Homo sapiens
ctgggcctggggtg

SEQ ID NO: 1266375 - DNA, 13 bp, Homo sapiens
ctgggcctgtccc

SEQ ID NO: 1266376 - DNA, 17 bp, Homo sapiens
ctgggcctgtgcactgg

SEQ ID NO: 1266377 - DNA, 20 bp, Homo sapiens
ctgggcctgtgcactgggca

SEQ ID NO: 1266378 - DNA, 13 bp, Homo sapiens
ctgggcctgtgtg

SEQ ID NO: 1266379 - DNA, 16 bp, Homo sapiens
ctgggcctttcctgtg

SEQ ID NO: 1266380 - DNA, 17 bp, Homo sapiens
ctgggcctttcctgtgc

SEQ ID NO: 1266381 - DNA, 18 bp, Homo sapiens
ctgggcctttcctgtgcc

SEQ ID NO: 1266382 - DNA, 22 bp, Homo sapiens
ctgggcctttcctgtgccaacc

SEQ ID NO: 1266383 - DNA, 23 bp, Homo sapiens
ctgggcctttcctgtgccaacct

SEQ ID NO: 1266384 - DNA, 17 bp, Homo sapiens
ctgggcctttgcaagat

SEQ ID NO: 1266385 - DNA, 13 bp, Homo sapiens
ctgggcgacagag

SEQ ID NO: 1266386 - DNA, 15 bp, Homo sapiens
ctgggcgccctggaa

SEQ ID NO: 1266387 - DNA, 16 bp, Homo sapiens
ctgggcgtccagctca

SEQ ID NO: 1266388 - DNA, 17 bp, Homo sapiens
ctgggcgtctgactccc

SEQ ID NO: 1266389 - DNA, 19 bp, Homo sapiens
ctgggcgtctgactccctc

SEQ ID NO: 1266390 - DNA, 16 bp, Homo sapiens
ctgggcgtctgttctt

SEQ ID NO: 1266391 - DNA, 17 bp, Homo sapiens
ctgggcgtgtgtgacac

SEQ ID NO: 1266392 - DNA, 21 bp, Homo sapiens
ctgggcgtgtgtgacactgat

SEQ ID NO: 1266393 - DNA, 16 bp, Homo sapiens
ctgggctacaatttgt

SEQ ID NO: 1266394 - DNA, 13 bp, Homo sapiens
ctgggctagggag

SEQ ID NO: 1266395 - DNA, 20 bp, Homo sapiens
ctgggctatggacacagggt

SEQ ID NO: 1266396 - DNA, 21 bp, Homo sapiens
ctgggctcaagcaatcctcct

SEQ ID NO: 1266397 - DNA, 22 bp, Homo sapiens
ctgggctcaagcaatcctcctg

SEQ ID NO: 1266398 - DNA, 15 bp, Homo sapiens
ctgggctccctcttg

SEQ ID NO: 1266399 - DNA, 16 bp, Homo sapiens
ctgggctccctcttgt

SEQ ID NO: 1266400 - DNA, 14 bp, Homo sapiens
ctgggctcctccag

SEQ ID NO: 1266401 - DNA, 15 bp, Homo sapiens
ctgggctcctccagg

SEQ ID NO: 1266402 - DNA, 17 bp, Homo sapiens
ctgggctcctccagggt

SEQ ID NO: 1266403 - DNA, 20 bp, Homo sapiens
ctgggctcctggaaccaatc

SEQ ID NO: 1266404 - DNA, 13 bp, Homo sapiens
ctgggctctccac

SEQ ID NO: 1266405 - DNA, 17 bp, Homo sapiens
ctgggctctccacctca

SEQ ID NO: 1266406 - DNA, 19 bp, Homo sapiens
ctgggctctccacctcagc

SEQ ID NO: 1266407 - DNA, 20 bp, Homo sapiens
ctgggctctgaacacacacg

SEQ ID NO: 1266408 - DNA, 14 bp, Homo sapiens
ctgggctctgccac

SEQ ID NO: 1266409 - DNA, 15 bp, Homo sapiens
ctgggctctgccacc

SEQ ID NO: 1266410 - DNA, 18 bp, Homo sapiens
ctgggctctgccccagct

SEQ ID NO: 1266411 - DNA, 15 bp, Homo sapiens
ctgggctctggacct

SEQ ID NO: 1266412 - DNA, 15 bp, Homo sapiens
ctgggctctggctct

SEQ ID NO: 1266413 - DNA, 18 bp, Homo sapiens
ctgggctgagcccctacc

SEQ ID NO: 1266414 - DNA, 19 bp, Homo sapiens
ctgggctgagcccctaccc

SEQ ID NO: 1266415 - DNA, 12 bp, Homo sapiens
ctgggctgaggg

SEQ ID NO: 1266416 - DNA, 13 bp, Homo sapiens
ctgggctgaggga

SEQ ID NO: 1266417 - DNA, 16 bp, Homo sapiens
ctgggctgagggagcc

SEQ ID NO: 1266418 - DNA, 18 bp, Homo sapiens
ctgggctgagggagcctg

SEQ ID NO: 1266419 - DNA, 19 bp, Homo sapiens
ctgggctgagggagcctgg

SEQ ID NO: 1266420 - DNA, 13 bp, Homo sapiens
ctgggctgagtga

SEQ ID NO: 1266421 - DNA, 17 bp, Homo sapiens
ctgggctgcagagtctg

SEQ ID NO: 1266422 - DNA, 15 bp, Homo sapiens
ctgggctgccaccag

SEQ ID NO: 1266423 - DNA, 20 bp, Homo sapiens
ctgggctgccaccagccccc

SEQ ID NO: 1266424 - DNA, 17 bp, Homo sapiens
ctgggctgccatgtgaa

SEQ ID NO: 1266425 - DNA, 14 bp, Homo sapiens
ctgggctggactgg

SEQ ID NO: 1266426 - DNA, 17 bp, Homo sapiens
ctgggctggactggagg

SEQ ID NO: 1266427 - DNA, 14 bp, Homo sapiens
ctgggctggcgctt

SEQ ID NO: 1266428 - DNA, 20 bp, Homo sapiens
ctgggctggcgcttggatct

SEQ ID NO: 1266429 - DNA, 11 bp, Homo sapiens
ctgggctgggc

SEQ ID NO: 1266430 - DNA, 13 bp, Homo sapiens
ctgggctgggcac

SEQ ID NO: 1266431 - DNA, 16 bp, Homo sapiens
ctgggctgggcagcct

SEQ ID NO: 1266432 - DNA, 21 bp, Homo sapiens
ctgggctgggccctctttccc

SEQ ID NO: 1266433 - DNA, 18 bp, Homo sapiens
ctgggctgggctgggctg

SEQ ID NO: 1266434 - DNA, 13 bp, Homo sapiens
ctgggctggggag

SEQ ID NO: 1266435 - DNA, 17 bp, Homo sapiens
ctgggctggggccacct

SEQ ID NO: 1266436 - DNA, 18 bp, Homo sapiens
ctgggctggggccacctt

SEQ ID NO: 1266437 - DNA, 23 bp, Homo sapiens
ctgggctggggccacctttgtgc

SEQ ID NO: 1266438 - DNA, 17 bp, Homo sapiens
ctgggctggggcctcag

SEQ ID NO: 1266439 - DNA, 23 bp, Homo sapiens
ctgggctgtaacgtggcactggt

SEQ ID NO: 1266440 - DNA, 11 bp, Homo sapiens
ctgggctgtcc

SEQ ID NO: 1266441 - DNA, 16 bp, Homo sapiens
ctgggctgtccagcct

SEQ ID NO: 1266442 - DNA, 14 bp, Homo sapiens
ctgggctgtctctc

SEQ ID NO: 1266443 - DNA, 13 bp, Homo sapiens
ctgggctgtctgt

SEQ ID NO: 1266444 - DNA, 17 bp, Homo sapiens
ctgggctgtctgtcacc

SEQ ID NO: 1266445 - DNA, 18 bp, Homo sapiens
ctgggctgtctgtcacca

SEQ ID NO: 1266446 - DNA, 21 bp, Homo sapiens
ctgggctgtctgtcaccagct

SEQ ID NO: 1266447 - DNA, 12 bp, Homo sapiens
ctgggctgtgct

SEQ ID NO: 1266448 - DNA, 13 bp, Homo sapiens
ctgggctgtgggg

SEQ ID NO: 1266449 - DNA, 13 bp, Homo sapiens
ctgggctgttggc

SEQ ID NO: 1266450 - DNA, 14 bp, Homo sapiens
ctgggctgttgttc

SEQ ID NO: 1266451 - DNA, 22 bp, Homo sapiens
ctgggcttcagggtatcccaga

SEQ ID NO: 1266452 - DNA, 15 bp, Homo sapiens
ctgggcttcatctgg

SEQ ID NO: 1266453 - DNA, 19 bp, Homo sapiens
ctgggcttcatctggcaac

SEQ ID NO: 1266454 - DNA, 15 bp, Homo sapiens
ctgggcttcattctg

SEQ ID NO: 1266455 - DNA, 17 bp, Homo sapiens
ctgggcttcattctgga

SEQ ID NO: 1266456 - DNA, 18 bp, Homo sapiens
ctgggcttggcctgctgt

SEQ ID NO: 1266457 - DNA, 12 bp, Homo sapiens
ctgggcttggct

SEQ ID NO: 1266458 - DNA, 17 bp, Homo sapiens
ctgggcttggggtgtgg

SEQ ID NO: 1266459 - DNA, 18 bp, Homo sapiens
ctgggcttgtctgtagat

SEQ ID NO: 1266460 - DNA, 12 bp, Homo sapiens
ctgggctttctc

SEQ ID NO: 1266461 - DNA, 16 bp, Homo sapiens
ctgggctttctcctgg

SEQ ID NO: 1266462 - DNA, 20 bp, Homo sapiens
ctgggctttctcctggagat

SEQ ID NO: 1266463 - DNA, 16 bp, Homo sapiens
ctggggaagaggatga

SEQ ID NO: 1266464 - DNA, 20 bp, Homo sapiens
ctggggaagaggatgagcag

SEQ ID NO: 1266465 - DNA, 22 bp, Homo sapiens
ctggggaagaggatgagcagag

SEQ ID NO: 1266466 - DNA, 15 bp, Homo sapiens
ctggggaaggagcca

SEQ ID NO: 1266467 - DNA, 18 bp, Homo sapiens
ctggggaaggagccagtt

SEQ ID NO: 1266468 - DNA, 22 bp, Homo sapiens
ctggggaagtacgtcccagcgg

SEQ ID NO: 1266469 - DNA, 18 bp, Homo sapiens
ctggggaatgctcccagc

SEQ ID NO: 1266470 - DNA, 13 bp, Homo sapiens
ctggggacagagc

SEQ ID NO: 1266471 - DNA, 16 bp, Homo sapiens
ctggggacagagccac

SEQ ID NO: 1266472 - DNA, 15 bp, Homo sapiens
ctggggacagcttcc

SEQ ID NO: 1266473 - DNA, 19 bp, Homo sapiens
ctggggacagcttcctcac

SEQ ID NO: 1266474 - DNA, 20 bp, Homo sapiens
ctggggacccacccagcccc

SEQ ID NO: 1266475 - DNA, 20 bp, Homo sapiens
ctggggaccctccagaggtg

SEQ ID NO: 1266476 - DNA, 14 bp, Homo sapiens
ctggggactcaggg

SEQ ID NO: 1266477 - DNA, 17 bp, Homo sapiens
ctggggactcagggacc

SEQ ID NO: 1266478 - DNA, 20 bp, Homo sapiens
ctggggactcctcaaaccac

SEQ ID NO: 1266479 - DNA, 21 bp, Homo sapiens
ctggggactcctcaaaccact

SEQ ID NO: 1266480 - DNA, 15 bp, Homo sapiens
ctggggactctggca

SEQ ID NO: 1266481 - DNA, 17 bp, Homo sapiens
ctggggactctggcaca

SEQ ID NO: 1266482 - DNA, 18 bp, Homo sapiens
ctggggactctggcacag

SEQ ID NO: 1266483 - DNA, 19 bp, Homo sapiens
ctggggagaaagaggggcc

SEQ ID NO: 1266484 - DNA, 22 bp, Homo sapiens
ctggggagaaagaggggcctga

SEQ ID NO: 1266485 - DNA, 15 bp, Homo sapiens
ctggggagaaagtag

SEQ ID NO: 1266486 - DNA, 20 bp, Homo sapiens
ctggggagaaataattgttg

SEQ ID NO: 1266487 - DNA, 23 bp, Homo sapiens
ctggggagcacaggtgtctgcct

SEQ ID NO: 1266488 - DNA, 22 bp, Homo sapiens
ctggtgtcctgaccaccctccc

SEQ ID NO: 1266489 - DNA, 17 bp, Homo sapiens
ctggtgtctgctttctc

SEQ ID NO: 1266490 - DNA, 14 bp, Homo sapiens
ctggtgtctttgat

SEQ ID NO: 1266491 - DNA, 17 bp, Homo sapiens
ctggtgtgaactcaccc

SEQ ID NO: 1266492 - DNA, 21 bp, Homo sapiens
ctggtgtgtggtgaggggctt

SEQ ID NO: 1266493 - DNA, 20 bp, Homo sapiens
ctggtgttcaccaaaaccaa

SEQ ID NO: 1266494 - DNA, 20 bp, Homo sapiens
ctggttaacagcagtccttt

SEQ ID NO: 1266495 - DNA, 21 bp, Homo sapiens
ctggttaagcaggcattgctt

SEQ ID NO: 1266496 - DNA, 14 bp, Homo sapiens
ctggttaatttata

SEQ ID NO: 1266497 - DNA, 19 bp, Homo sapiens
ctggttacctgttccattg

SEQ ID NO: 1266498 - DNA, 13 bp, Homo sapiens
ctggttagtgatg

SEQ ID NO: 1266499 - DNA, 17 bp, Homo sapiens
ctggttagtgatgcagt

SEQ ID NO: 1266500 - DNA, 22 bp, Homo sapiens
ctggttataacagcaaatgaaa

SEQ ID NO: 1266501 - DNA, 13 bp, Homo sapiens
ctggttatttatt

SEQ ID NO: 1266502 - DNA, 14 bp, Homo sapiens
ctggttatttattt

SEQ ID NO: 1266503 - DNA, 16 bp, Homo sapiens
ctggttatttttctct

SEQ ID NO: 1266504 - DNA, 13 bp, Homo sapiens
ctggttcacctga

SEQ ID NO: 1266505 - DNA, 16 bp, Homo sapiens
ctggttcagacacagc

SEQ ID NO: 1266506 - DNA, 17 bp, Homo sapiens
ctggttcagacacagct

SEQ ID NO: 1266507 - DNA, 12 bp, Homo sapiens
ctggttccaaac

SEQ ID NO: 1266508 - DNA, 21 bp, Homo sapiens
ctggttccatttttcctctgt

SEQ ID NO: 1266509 - DNA, 16 bp, Homo sapiens
ctggttctcaatgaaa

SEQ ID NO: 1266510 - DNA, 18 bp, Homo sapiens
ctggttctcaatgaaaaa

SEQ ID NO: 1266511 - DNA, 17 bp, Homo sapiens
ctggttctggctgtggt

SEQ ID NO: 1266512 - DNA, 15 bp, Homo sapiens
ctggttgcctctctt

SEQ ID NO: 1266513 - DNA, 17 bp, Homo sapiens
ctggttgcctctcttgc

SEQ ID NO: 1266514 - DNA, 18 bp, Homo sapiens
ctggttgcctctcttgcc

SEQ ID NO: 1266515 - DNA, 22 bp, Homo sapiens
ctggttgcctctcttgcccctt

SEQ ID NO: 1266516 - DNA, 15 bp, Homo sapiens
ctggttgtatttcta

SEQ ID NO: 1266517 - DNA, 16 bp, Homo sapiens
ctggttgttatgtgat

SEQ ID NO: 1266518 - DNA, 16 bp, Homo sapiens
ctggttgtttctgttc

SEQ ID NO: 1266519 - DNA, 19 bp, Homo sapiens
ctggttgtttctgttccaa

SEQ ID NO: 1266520 - DNA, 20 bp, Homo sapiens
ctggttgtttttgttctttg

SEQ ID NO: 1266521 - DNA, 15 bp, Homo sapiens
ctggtttacacttta

SEQ ID NO: 1266522 - DNA, 17 bp, Homo sapiens
ctggtttacaggccctg

SEQ ID NO: 1266523 - DNA, 18 bp, Homo sapiens
ctggtttacaggccctgc

SEQ ID NO: 1266524 - DNA, 23 bp, Homo sapiens
ctggtttcctatttgcagttact

SEQ ID NO: 1266525 - DNA, 13 bp, Homo sapiens
ctggtttcctttc

SEQ ID NO: 1266526 - DNA, 16 bp, Homo sapiens
ctggtttctgtccccg

SEQ ID NO: 1266527 - DNA, 14 bp, Homo sapiens
ctggtttgactcag

SEQ ID NO: 1266528 - DNA, 16 bp, Homo sapiens
ctggtttgcagctgtt

SEQ ID NO: 1266529 - DNA, 16 bp, Homo sapiens
ctggtttgtttgctta

SEQ ID NO: 1266530 - DNA, 21 bp, Homo sapiens
ctggtttgtttgcttaatttc

SEQ ID NO: 1266531 - DNA, 13 bp, Homo sapiens
ctggttttaacaa

SEQ ID NO: 1266532 - DNA, 14 bp, Homo sapiens
ctggttttacacag

SEQ ID NO: 1266533 - DNA, 15 bp, Homo sapiens
ctggttttcttgcca

SEQ ID NO: 1266534 - DNA, 20 bp, Homo sapiens
ctggttttcttgccaccctc

SEQ ID NO: 1266535 - DNA, 14 bp, Homo sapiens
ctggttttggcatc

SEQ ID NO: 1266536 - DNA, 20 bp, Homo sapiens
ctggttttgtaagatgctgg

SEQ ID NO: 1266537 - DNA, 21 bp, Homo sapiens
ctggttttgtaagatgctggg

SEQ ID NO: 1266538 - DNA, 14 bp, Homo sapiens
ctggtttttctcaa

SEQ ID NO: 1266539 - DNA, 15 bp, Homo sapiens
ctgtaaaacaggtta

SEQ ID NO: 1266540 - DNA, 18 bp, Homo sapiens
ctgtaaaagttataataa

SEQ ID NO: 1266541 - DNA, 20 bp, Homo sapiens
ctgtaaaagttataataact

SEQ ID NO: 1266542 - DNA, 21 bp, Homo sapiens
ctgtaaaagttataataactg

SEQ ID NO: 1266543 - DNA, 22 bp, Homo sapiens
ctgtaaaagttataataactga

SEQ ID NO: 1266544 - DNA, 13 bp, Homo sapiens
ctgtaaaatacat

SEQ ID NO: 1266545 - DNA, 16 bp, Homo sapiens
ctgtaaaatgaaatta

SEQ ID NO: 1266546 - DNA, 17 bp, Homo sapiens
ctgtaaaatttgtgtaa

SEQ ID NO: 1266547 - DNA, 21 bp, Homo sapiens
ctgtaaaatttgtgtaaattt

SEQ ID NO: 1266548 - DNA, 22 bp, Homo sapiens
ctgtaaaatttgtgtaaatttg

SEQ ID NO: 1266549 - DNA, 16 bp, Homo sapiens
ctgtaaacagaataaa

SEQ ID NO: 1266550 - DNA, 21 bp, Homo sapiens
ctgtaaacggtgctatttcta

SEQ ID NO: 1266551 - DNA, 14 bp, Homo sapiens
ctgtaaagagttgc

SEQ ID NO: 1266552 - DNA, 17 bp, Homo sapiens
ctgtaaataaaatgtgt

SEQ ID NO: 1266553 - DNA, 18 bp, Homo sapiens
ctgtaaataaaatgtgta

SEQ ID NO: 1266554 - DNA, 11 bp, Homo sapiens
ctgtaaataac

SEQ ID NO: 1266555 - DNA, 12 bp, Homo sapiens
ctgtaaataaga

SEQ ID NO: 1266556 - DNA, 21 bp, Homo sapiens
ctgtaaatatcccagagaaca

SEQ ID NO: 1266557 - DNA, 23 bp, Homo sapiens
ctgtaaatatcccagagaacaat

SEQ ID NO: 1266558 - DNA, 22 bp, Homo sapiens
ctgtaaatatgtttgtgcctta

SEQ ID NO: 1266559 - DNA, 21 bp, Homo sapiens
ctgtaaatcctagacttgaaa

SEQ ID NO: 1266560 - DNA, 13 bp, Homo sapiens
ctgtaacaaattg

SEQ ID NO: 1266561 - DNA, 17 bp, Homo sapiens
ctgtaacacaagccaca

SEQ ID NO: 1266562 - DNA, 19 bp, Homo sapiens
ctgtaacacaagccacaga

SEQ ID NO: 1266563 - DNA, 19 bp, Homo sapiens
ctgtaacatactggcctgg

SEQ ID NO: 1266564 - DNA, 16 bp, Homo sapiens
ctgtaacccccaagga

SEQ ID NO: 1266565 - DNA, 14 bp, Homo sapiens
ctgtaacccttgaa

SEQ ID NO: 1266566 - DNA, 19 bp, Homo sapiens
ctgtaacccttgaatttct

SEQ ID NO: 1266567 - DNA, 15 bp, Homo sapiens
ctgtaacctcttcag

SEQ ID NO: 1266568 - DNA, 20 bp, Homo sapiens
ctgtaacctcttcagaggcc

SEQ ID NO: 1266569 - DNA, 14 bp, Homo sapiens
ctgtaacctgctgg

SEQ ID NO: 1266570 - DNA, 23 bp, Homo sapiens
ctgtaacctgctggatgggactc

SEQ ID NO: 1266571 - DNA, 23 bp, Homo sapiens
ctgtaactacaatgatggtaaag

SEQ ID NO: 1266572 - DNA, 17 bp, Homo sapiens
ctgtaactactttataa

SEQ ID NO: 1266573 - DNA, 16 bp, Homo sapiens
ctgtaactattgggtg

SEQ ID NO: 1266574 - DNA, 15 bp, Homo sapiens
ctgtaactcagacat

SEQ ID NO: 1266575 - DNA, 19 bp, Homo sapiens
ctgtaactctaaaagatcc

SEQ ID NO: 1266576 - DNA, 16 bp, Homo sapiens
ctgtaactgcccagcc

SEQ ID NO: 1266577 - DNA, 21 bp, Homo sapiens
ctgtaactgcccagccccttt

SEQ ID NO: 1266578 - DNA, 20 bp, Homo sapiens
ctgtaactgctcagagcttt

SEQ ID NO: 1266579 - DNA, 22 bp, Homo sapiens
ctgtaactgctcagagctttaa

SEQ ID NO: 1266580 - DNA, 14 bp, Homo sapiens
ctgtaactgctgag

SEQ ID NO: 1266581 - DNA, 17 bp, Homo sapiens
ctgtaactgctgagcca

SEQ ID NO: 1266582 - DNA, 15 bp, Homo sapiens
ctgtaactgtcagtg

SEQ ID NO: 1266583 - DNA, 17 bp, Homo sapiens
ctgtaactgttacagta

SEQ ID NO: 1266584 - DNA, 18 bp, Homo sapiens
ctgtaactttttttcagt

SEQ ID NO: 1266585 - DNA, 23 bp, Homo sapiens
ctgtaagaagagactgggaagat

SEQ ID NO: 1266586 - DNA, 20 bp, Homo sapiens
ctgtaagagcttgctccaga

SEQ ID NO: 1266587 - DNA, 20 bp, Homo sapiens
ctgtaagcttttaagaaaaa

SEQ ID NO: 1266588 - DNA, 17 bp, Homo sapiens
ctgtaaggcatgaagga

SEQ ID NO: 1266589 - DNA, 13 bp, Homo sapiens
ctgtaagggcagt

SEQ ID NO: 1266590 - DNA, 17 bp, Homo sapiens
ctgtaagggcagtgccc

SEQ ID NO: 1266591 - DNA, 17 bp, Homo sapiens
ctgtaaggtttcaatgc

SEQ ID NO: 1266592 - DNA, 20 bp, Homo sapiens
ctgtaataaagatgattgtg

SEQ ID NO: 1266593 - DNA, 23 bp, Homo sapiens
ctgtaataaataaatatactcaa

SEQ ID NO: 1266594 - DNA, 22 bp, Homo sapiens
ctgtaatagttcagtagaatta

SEQ ID NO: 1266595 - DNA, 23 bp, Homo sapiens
ctgtaatagttcagtagaattac

SEQ ID NO: 1266596 - DNA, 17 bp, Homo sapiens
ctgtaatattgtaaata

SEQ ID NO: 1266597 - DNA, 22 bp, Homo sapiens
ctgtaatattgtaaatactgga

SEQ ID NO: 1266598 - DNA, 17 bp, Homo sapiens
ctgtaatcagcaataaa

SEQ ID NO: 1266599 - DNA, 19 bp, Homo sapiens
ctgtaatcagctctcctgg

SEQ ID NO: 1266600 - DNA, 22 bp, Homo sapiens
ctgtaatcagctctcctggctc

SEQ ID NO: 1266601 - DNA, 14 bp, Homo sapiens
ctgtaatcccagct

SEQ ID NO: 1266602 - DNA, 20 bp, Homo sapiens
ctgtaatcgccctactattc

SEQ ID NO: 1266603 - DNA, 15 bp, Homo sapiens
ctgtaatctttttct

SEQ ID NO: 1266604 - DNA, 21 bp, Homo sapiens
ctgtaatgaaacaccttctct

SEQ ID NO: 1266605 - DNA, 22 bp, Homo sapiens
ctgtaatggaactgaccccctc

SEQ ID NO: 1266606 - DNA, 19 bp, Homo sapiens
ctgtaatgttaaactcttt

SEQ ID NO: 1266607 - DNA, 12 bp, Homo sapiens
ctgtaattacat

SEQ ID NO: 1266608 - DNA, 24 bp, Homo sapiens
ctgtaattcattgagcagttagct

SEQ ID NO: 1266609 - DNA, 22 bp, Homo sapiens
ctgtcctcccctattgcgctct

SEQ ID NO: 1266610 - DNA, 21 bp, Homo sapiens
ctgtcctcccgagctcctctt

SEQ ID NO: 1266611 - DNA, 15 bp, Homo sapiens
ctgtcctcctggaag

SEQ ID NO: 1266612 - DNA, 12 bp, Homo sapiens
ctgtcctccttc

SEQ ID NO: 1266613 - DNA, 18 bp, Homo sapiens
ctgtcctccttggcggca

SEQ ID NO: 1266614 - DNA, 14 bp, Homo sapiens
ctgtcctctccccc

SEQ ID NO: 1266615 - DNA, 12 bp, Homo sapiens
ctgtcctgatct

SEQ ID NO: 1266616 - DNA, 13 bp, Homo sapiens
ctgtcctgcagca

SEQ ID NO: 1266617 - DNA, 15 bp, Homo sapiens
ctgtcctgcagcaaa

SEQ ID NO: 1266618 - DNA, 16 bp, Homo sapiens
ctgtcctgcagcaaac

SEQ ID NO: 1266619 - DNA, 17 bp, Homo sapiens
ctgtcctgcagtcccac

SEQ ID NO: 1266620 - DNA, 11 bp, Homo sapiens
ctgtcctgcct

SEQ ID NO: 1266621 - DNA, 15 bp, Homo sapiens
ctgtcctgcctcctc

SEQ ID NO: 1266622 - DNA, 11 bp, Homo sapiens
ctgtcctgggc

SEQ ID NO: 1266623 - DNA, 14 bp, Homo sapiens
ctgtcctgggcatg

SEQ ID NO: 1266624 - DNA, 23 bp, Homo sapiens
ctgtcctgggcatgggtccaggg

SEQ ID NO: 1266625 - DNA, 14 bp, Homo sapiens
ctgtcctggtggta

SEQ ID NO: 1266626 - DNA, 17 bp, Homo sapiens
ctgtcctggtggtattt

SEQ ID NO: 1266627 - DNA, 12 bp, Homo sapiens
ctgtcctgtcct

SEQ ID NO: 1266628 - DNA, 16 bp, Homo sapiens
ctgtcctgtcctgctc

SEQ ID NO: 1266629 - DNA, 19 bp, Homo sapiens
ctgtcctgttttcttaggc

SEQ ID NO: 1266630 - DNA, 12 bp, Homo sapiens
ctgtccttcccc

SEQ ID NO: 1266631 - DNA, 20 bp, Homo sapiens
ctgtccttccccttccccgt

SEQ ID NO: 1266632 - DNA, 22 bp, Homo sapiens
ctgtccttccccttccccgtcc

SEQ ID NO: 1266633 - DNA, 14 bp, Homo sapiens
ctgtccttccctgt

SEQ ID NO: 1266634 - DNA, 21 bp, Homo sapiens
ctgtccttctgaagtgtgtcc

SEQ ID NO: 1266635 - DNA, 18 bp, Homo sapiens
ctgtccttgaaaaacaaa

SEQ ID NO: 1266636 - DNA, 18 bp, Homo sapiens
ctgtccttgaacccaaca

SEQ ID NO: 1266637 - DNA, 20 bp, Homo sapiens
ctgtccttgaacccaacagt

SEQ ID NO: 1266638 - DNA, 21 bp, Homo sapiens
ctgtccttgaacccaacagtc

SEQ ID NO: 1266639 - DNA, 13 bp, Homo sapiens
ctgtccttgccct

SEQ ID NO: 1266640 - DNA, 17 bp, Homo sapiens
ctgtccttgttcatgga

SEQ ID NO: 1266641 - DNA, 19 bp, Homo sapiens
ctgtccttgttcatggaga

SEQ ID NO: 1266642 - DNA, 13 bp, Homo sapiens
ctgtcgagacact

SEQ ID NO: 1266643 - DNA, 20 bp, Homo sapiens
ctgtcgattagactggacag

SEQ ID NO: 1266644 - DNA, 13 bp, Homo sapiens
ctgtcgccccagg

SEQ ID NO: 1266645 - DNA, 17 bp, Homo sapiens
ctgtcgccccaggccct

SEQ ID NO: 1266646 - DNA, 20 bp, Homo sapiens
ctgtcgccccaggccctccc

SEQ ID NO: 1266647 - DNA, 15 bp, Homo sapiens
ctgtcgcccttctcc

SEQ ID NO: 1266648 - DNA, 16 bp, Homo sapiens
ctgtcgctcaggctgg

SEQ ID NO: 1266649 - DNA, 15 bp, Homo sapiens
ctgtcgctctcagtt

SEQ ID NO: 1266650 - DNA, 15 bp, Homo sapiens
ctgtcggagaggctg

SEQ ID NO: 1266651 - DNA, 18 bp, Homo sapiens
ctgtcgggggctgtggat

SEQ ID NO: 1266652 - DNA, 15 bp, Homo sapiens
ctgtcggtggctgcc

SEQ ID NO: 1266653 - DNA, 15 bp, Homo sapiens
ctgtcgtgatggggc

SEQ ID NO: 1266654 - DNA, 15 bp, Homo sapiens
ctgtctaaagtgtat

SEQ ID NO: 1266655 - DNA, 15 bp, Homo sapiens
ctgtctaacctgtga

SEQ ID NO: 1266656 - DNA, 14 bp, Homo sapiens
ctgtctacctggtc

SEQ ID NO: 1266657 - DNA, 16 bp, Homo sapiens
ctgtctactgtggtga

SEQ ID NO: 1266658 - DNA, 13 bp, Homo sapiens
ctgtctagaatgt

SEQ ID NO: 1266659 - DNA, 14 bp, Homo sapiens
ctgtctagagaggg

SEQ ID NO: 1266660 - DNA, 16 bp, Homo sapiens
ctgtctagagagggag

SEQ ID NO: 1266661 - DNA, 18 bp, Homo sapiens
ctgtctagccactccctc

SEQ ID NO: 1266662 - DNA, 18 bp, Homo sapiens
ctgtctaggaaggtgtga

SEQ ID NO: 1266663 - DNA, 20 bp, Homo sapiens
ctgtctaggactgcagtgtg

SEQ ID NO: 1266664 - DNA, 17 bp, Homo sapiens
ctgtctaggtctcctca

SEQ ID NO: 1266665 - DNA, 19 bp, Homo sapiens
ctgtctaggttaaagctaa

SEQ ID NO: 1266666 - DNA, 14 bp, Homo sapiens
ctgtctatttaagt

SEQ ID NO: 1266667 - DNA, 18 bp, Homo sapiens
ctgtctcaaaaaaagaaa

SEQ ID NO: 1266668 - DNA, 18 bp, Homo sapiens
ctgtctcaagagggcact

SEQ ID NO: 1266669 - DNA, 19 bp, Homo sapiens
ctgtctcaagagggcactg

SEQ ID NO: 1266670 - DNA, 12 bp, Homo sapiens
ctgtctcagcct

SEQ ID NO: 1266671 - DNA, 14 bp, Homo sapiens
ctgtctcagcctcc

SEQ ID NO: 1266672 - DNA, 15 bp, Homo sapiens
ctgtctcagcctccc

SEQ ID NO: 1266673 - DNA, 17 bp, Homo sapiens
ctgtctcagcctcccag

SEQ ID NO: 1266674 - DNA, 17 bp, Homo sapiens
ctgtctcagtttcactt

SEQ ID NO: 1266675 - DNA, 12 bp, Homo sapiens
ctgtctcatcca

SEQ ID NO: 1266676 - DNA, 17 bp, Homo sapiens
ctgtctcatccatcatc

SEQ ID NO: 1266677 - DNA, 15 bp, Homo sapiens
ctgtctcatccccag

SEQ ID NO: 1266678 - DNA, 20 bp, Homo sapiens
ctgtctcatccccaggggtc

SEQ ID NO: 1266679 - DNA, 18 bp, Homo sapiens
ctgtctcatcctcctgga

SEQ ID NO: 1266680 - DNA, 14 bp, Homo sapiens
ctgtctccactgtg

SEQ ID NO: 1266681 - DNA, 15 bp, Homo sapiens
ctgtctccactgtgc

SEQ ID NO: 1266682 - DNA, 18 bp, Homo sapiens
ctgtctccagacccccac

SEQ ID NO: 1266683 - DNA, 19 bp, Homo sapiens
ctgtctccagacccccacc

SEQ ID NO: 1266684 - DNA, 12 bp, Homo sapiens
ctgtctccagct

SEQ ID NO: 1266685 - DNA, 14 bp, Homo sapiens
ctgtctccagctgc

SEQ ID NO: 1266686 - DNA, 18 bp, Homo sapiens
ctgtctccagctgcctgg

SEQ ID NO: 1266687 - DNA, 21 bp, Homo sapiens
ctgtctccctagggaattcct

SEQ ID NO: 1266688 - DNA, 23 bp, Homo sapiens
ctgtctccctccccaaatggctg

SEQ ID NO: 1266689 - DNA, 20 bp, Homo sapiens
ctgtctccctcccctctcag

SEQ ID NO: 1266690 - DNA, 22 bp, Homo sapiens
ctgtctccctcccctctcagaa

SEQ ID NO: 1266691 - DNA, 23 bp, Homo sapiens
ctgtctccctcccctctcagaac

SEQ ID NO: 1266692 - DNA, 14 bp, Homo sapiens
ctgtctcgggctga

SEQ ID NO: 1266693 - DNA, 19 bp, Homo sapiens
ctgtctcgggctgaccctt

SEQ ID NO: 1266694 - DNA, 18 bp, Homo sapiens
ctgtctctaaccattcaa

SEQ ID NO: 1266695 - DNA, 22 bp, Homo sapiens
ctgtctctaaccattcaaatga

SEQ ID NO: 1266696 - DNA, 19 bp, Homo sapiens
ctgtctctattagctgggt

SEQ ID NO: 1266697 - DNA, 13 bp, Homo sapiens
ctgtctctccatc

SEQ ID NO: 1266698 - DNA, 20 bp, Homo sapiens
ctgtctctcctagcccctct

SEQ ID NO: 1266699 - DNA, 22 bp, Homo sapiens
ctgtctctcctagcccctctct

SEQ ID NO: 1266700 - DNA, 24 bp, Homo sapiens
ctgtctctcctagcccctctctca

SEQ ID NO: 1266701 - DNA, 15 bp, Homo sapiens
ctgtctctctccatg

SEQ ID NO: 1266702 - DNA, 12 bp, Homo sapiens
ctgtctctctgg

SEQ ID NO: 1266703 - DNA, 15 bp, Homo sapiens
ctgtctctctgggct

SEQ ID NO: 1266704 - DNA, 13 bp, Homo sapiens
ctgtctctgcaca

SEQ ID NO: 1266705 - DNA, 13 bp, Homo sapiens
ctgtctctgcctc

SEQ ID NO: 1266706 - DNA, 17 bp, Homo sapiens
ctgtctctgctcgccct

SEQ ID NO: 1266707 - DNA, 13 bp, Homo sapiens
ctgtctctggagt

SEQ ID NO: 1266708 - DNA, 17 bp, Homo sapiens
ctgtctctggcatttgt

SEQ ID NO: 1266709 - DNA, 23 bp, Homo sapiens
ctgtctctgtggaaaagccatct

SEQ ID NO: 1266710 - DNA, 21 bp, Homo sapiens
ctgtctcttaaaaaaataaaa

SEQ ID NO: 1266711 - DNA, 20 bp, Homo sapiens
ctgtctcttcggcagggagg

SEQ ID NO: 1266712 - DNA, 16 bp, Homo sapiens
ctgtctcttggctttg

SEQ ID NO: 1266713 - DNA, 15 bp, Homo sapiens
ctgtctctttccact

SEQ ID NO: 1266714 - DNA, 22 bp, Homo sapiens
ctgtctgaaggacacttcctgc

SEQ ID NO: 1266715 - DNA, 15 bp, Homo sapiens
ctgtctgagactcac

SEQ ID NO: 1266716 - DNA, 22 bp, Homo sapiens
ctgtctgagactcacaggaagg

SEQ ID NO: 1266717 - DNA, 23 bp, Homo sapiens
ctgtctgaggagtaagtgtacaa

SEQ ID NO: 1266718 - DNA, 15 bp, Homo sapiens
ctgtctgcacagagg

SEQ ID NO: 1266719 - DNA, 17 bp, Homo sapiens
ctgtctgcacagagggt

SEQ ID NO: 1266720 - DNA, 17 bp, Homo sapiens
ctgtctgccaacctaaa

SEQ ID NO: 1266721 - DNA, 20 bp, Homo sapiens
ctgtctgccaacctaaaact

SEQ ID NO: 1266722 - DNA, 16 bp, Homo sapiens
ctgtctgccagccagc

SEQ ID NO: 1266723 - DNA, 17 bp, Homo sapiens
ctgtctgccagccagca

SEQ ID NO: 1266724 - DNA, 12 bp, Homo sapiens
ctgtctgccctc

SEQ ID NO: 1266725 - DNA, 16 bp, Homo sapiens
ctgtctgccctctggg

SEQ ID NO: 1266726 - DNA, 17 bp, Homo sapiens
ctgtctgccctctgggt

SEQ ID NO: 1266727 - DNA, 18 bp, Homo sapiens
ctgtctgcgtctgctctt

SEQ ID NO: 1266728 - DNA, 15 bp, Homo sapiens
ctgtctgctcagaca

SEQ ID NO: 1266729 - DNA, 12 bp, Homo sapiens
ctgtctggaaga

SEQ ID NO: 1266730 - DNA, 15 bp, Homo sapiens
ctgtctggccctggg

SEQ ID NO: 1266731 - DNA, 21 bp, Homo sapiens
ctgtctggctcggacccaccc

SEQ ID NO: 1266732 - DNA, 22 bp, Homo sapiens
ctgtgcttgaaggccctgctga

SEQ ID NO: 1266733 - DNA, 23 bp, Homo sapiens
ctgtgcttgcttagagtgcccag

SEQ ID NO: 1266734 - DNA, 22 bp, Homo sapiens
ctgtgcttggatttgcatattt

SEQ ID NO: 1266735 - DNA, 18 bp, Homo sapiens
ctgtgctttctgcatgct

SEQ ID NO: 1266736 - DNA, 21 bp, Homo sapiens
ctgtgctttgactcacctgtt

SEQ ID NO: 1266737 - DNA, 19 bp, Homo sapiens
ctgtggaaaagaaacacgc

SEQ ID NO: 1266738 - DNA, 22 bp, Homo sapiens
ctgtggaaaagaaacacgcact

SEQ ID NO: 1266739 - DNA, 19 bp, Homo sapiens
ctgtggaaaagccatctca

SEQ ID NO: 1266740 - DNA, 18 bp, Homo sapiens
ctgtggaactaataaata

SEQ ID NO: 1266741 - DNA, 22 bp, Homo sapiens
ctgtggaactaataaatacata

SEQ ID NO: 1266742 - DNA, 19 bp, Homo sapiens
ctgtggaagcatggctgtc

SEQ ID NO: 1266743 - DNA, 23 bp, Homo sapiens
ctgtggaagcatggctgtctgca

SEQ ID NO: 1266744 - DNA, 18 bp, Homo sapiens
ctgtggaaggcagagaaa

SEQ ID NO: 1266745 - DNA, 13 bp, Homo sapiens
ctgtggaagggac

SEQ ID NO: 1266746 - DNA, 11 bp, Homo sapiens
ctgtggaatat

SEQ ID NO: 1266747 - DNA, 14 bp, Homo sapiens
ctgtggaatataaa

SEQ ID NO: 1266748 - DNA, 23 bp, Homo sapiens
ctgtggaatataaatagctgaaa

SEQ ID NO: 1266749 - DNA, 15 bp, Homo sapiens
ctgtggacggggagg

SEQ ID NO: 1266750 - DNA, 15 bp, Homo sapiens
ctgtggagactttct

SEQ ID NO: 1266751 - DNA, 18 bp, Homo sapiens
ctgtggagactttctgtt

SEQ ID NO: 1266752 - DNA, 12 bp, Homo sapiens
ctgtggagagaa

SEQ ID NO: 1266753 - DNA, 21 bp, Homo sapiens
ctgtggagcaaaaggcagctc

SEQ ID NO: 1266754 - DNA, 23 bp, Homo sapiens
ctgtggagcaaaaggcagctcac

SEQ ID NO: 1266755 - DNA, 15 bp, Homo sapiens
ctgtggagctcagcc

SEQ ID NO: 1266756 - DNA, 11 bp, Homo sapiens
ctgtggagctg

SEQ ID NO: 1266757 - DNA, 16 bp, Homo sapiens
ctgtggagctgccaca

SEQ ID NO: 1266758 - DNA, 17 bp, Homo sapiens
ctgtggaggattgctat

SEQ ID NO: 1266759 - DNA, 12 bp, Homo sapiens
ctgtggaggcct

SEQ ID NO: 1266760 - DNA, 18 bp, Homo sapiens
ctgtggaggcctgatgct

SEQ ID NO: 1266761 - DNA, 19 bp, Homo sapiens
ctgtggagggagggcagct

SEQ ID NO: 1266762 - DNA, 20 bp, Homo sapiens
ctgtggagggagggcagctg

SEQ ID NO: 1266763 - DNA, 23 bp, Homo sapiens
ctgtggagggagggcagctggcc

SEQ ID NO: 1266764 - DNA, 20 bp, Homo sapiens
ctgtggagtccagctctact

SEQ ID NO: 1266765 - DNA, 17 bp, Homo sapiens
ctgtggagttcctgctc

SEQ ID NO: 1266766 - DNA, 19 bp, Homo sapiens
ctgtggagttcctgctccg

SEQ ID NO: 1266767 - DNA, 20 bp, Homo sapiens
ctgtggagttcctgctccgt

SEQ ID NO: 1266768 - DNA, 21 bp, Homo sapiens
ctgtggagttcctgctccgtg

SEQ ID NO: 1266769 - DNA, 14 bp, Homo sapiens
ctgtggagttgcat

SEQ ID NO: 1266770 - DNA, 19 bp, Homo sapiens
ctgtggatacagtgcccac

SEQ ID NO: 1266771 - DNA, 20 bp, Homo sapiens
ctgtggatacagtgcccacc

SEQ ID NO: 1266772 - DNA, 12 bp, Homo sapiens
ctgtggcacaga

SEQ ID NO: 1266773 - DNA, 15 bp, Homo sapiens
ctgtggcacagactt

SEQ ID NO: 1266774 - DNA, 21 bp, Homo sapiens
ctgtggcagaaaagaggagac

SEQ ID NO: 1266775 - DNA, 18 bp, Homo sapiens
ctgtggcagagttacagt

SEQ ID NO: 1266776 - DNA, 22 bp, Homo sapiens
ctgtggcagagttacagttctg

SEQ ID NO: 1266777 - DNA, 19 bp, Homo sapiens
ctgtggcagccgtcccagg

SEQ ID NO: 1266778 - DNA, 12 bp, Homo sapiens
ctgtggcaggag

SEQ ID NO: 1266779 - DNA, 17 bp, Homo sapiens
ctgtggcaggaggagct

SEQ ID NO: 1266780 - DNA, 16 bp, Homo sapiens
ctgtggcaggaggctt

SEQ ID NO: 1266781 - DNA, 18 bp, Homo sapiens
ctgtggcatgggtgaaga

SEQ ID NO: 1266782 - DNA, 14 bp, Homo sapiens
ctgtggcatttcca

SEQ ID NO: 1266783 - DNA, 17 bp, Homo sapiens
ctgtggcatttccaaac

SEQ ID NO: 1266784 - DNA, 14 bp, Homo sapiens
ctgtggccacagcc

SEQ ID NO: 1266785 - DNA, 16 bp, Homo sapiens
ctgtggccacagcccc

SEQ ID NO: 1266786 - DNA, 14 bp, Homo sapiens
ctgtggccaggcct

SEQ ID NO: 1266787 - DNA, 19 bp, Homo sapiens
ctgtggccaggcctgcaga

SEQ ID NO: 1266788 - DNA, 15 bp, Homo sapiens
ctgtggccccaagag

SEQ ID NO: 1266789 - DNA, 18 bp, Homo sapiens
ctgtggccccaccctggg

SEQ ID NO: 1266790 - DNA, 14 bp, Homo sapiens
ctgtggccccctgt

SEQ ID NO: 1266791 - DNA, 16 bp, Homo sapiens
ctgtggccctggccac

SEQ ID NO: 1266792 - DNA, 18 bp, Homo sapiens
ctgtggccgcacgcctct

SEQ ID NO: 1266793 - DNA, 15 bp, Homo sapiens
ctgtggccgtctcct

SEQ ID NO: 1266794 - DNA, 19 bp, Homo sapiens
ctgtggccgtctcctccct

SEQ ID NO: 1266795 - DNA, 17 bp, Homo sapiens
ctgtggcctgtgtccag

SEQ ID NO: 1266796 - DNA, 17 bp, Homo sapiens
ctgtggcctgtgtccca

SEQ ID NO: 1266797 - DNA, 14 bp, Homo sapiens
ctgtggccttgccc

SEQ ID NO: 1266798 - DNA, 17 bp, Homo sapiens
ctgtggccttgcccgcc

SEQ ID NO: 1266799 - DNA, 18 bp, Homo sapiens
ctgtggcgactctgcaga

SEQ ID NO: 1266800 - DNA, 22 bp, Homo sapiens
ctgtggcgactctgcagagtca

SEQ ID NO: 1266801 - DNA, 21 bp, Homo sapiens
ctgtggcgccgtctccagggg

SEQ ID NO: 1266802 - DNA, 24 bp, Homo sapiens
ctgtggcgccgtctccaggggctg

SEQ ID NO: 1266803 - DNA, 21 bp, Homo sapiens
ctgtggcgggtaggcaggaag

SEQ ID NO: 1266804 - DNA, 17 bp, Homo sapiens
ctgtggctgctagcact

SEQ ID NO: 1266805 - DNA, 13 bp, Homo sapiens
ctgtggctggctc

SEQ ID NO: 1266806 - DNA, 18 bp, Homo sapiens
ctgtggctttttgttcag

SEQ ID NO: 1266807 - DNA, 24 bp, Homo sapiens
ctgtgggaagatgaactttgtcat

SEQ ID NO: 1266808 - DNA, 15 bp, Homo sapiens
ctgtgggaaggccag

SEQ ID NO: 1266809 - DNA, 17 bp, Homo sapiens
ctgtgggaccgcctggc

SEQ ID NO: 1266810 - DNA, 14 bp, Homo sapiens
ctgtgggatgggat

SEQ ID NO: 1266811 - DNA, 16 bp, Homo sapiens
ctgtgggcactggtgg

SEQ ID NO: 1266812 - DNA, 16 bp, Homo sapiens
ctgtgggcagcaccct

SEQ ID NO: 1266813 - DNA, 21 bp, Homo sapiens
ctgtgggcagcaccctccccc

SEQ ID NO: 1266814 - DNA, 20 bp, Homo sapiens
ctgtgggcagcatgcccaga

SEQ ID NO: 1266815 - DNA, 13 bp, Homo sapiens
ctgtgggcatggc

SEQ ID NO: 1266816 - DNA, 15 bp, Homo sapiens
ctgtgggccagattg

SEQ ID NO: 1266817 - DNA, 15 bp, Homo sapiens
ctgtgggcctcacct

SEQ ID NO: 1266818 - DNA, 16 bp, Homo sapiens
ctgtgggcctcacctg

SEQ ID NO: 1266819 - DNA, 15 bp, Homo sapiens
ctgtgggcctcaggc

SEQ ID NO: 1266820 - DNA, 15 bp, Homo sapiens
ctgtgggctggcagt

SEQ ID NO: 1266821 - DNA, 14 bp, Homo sapiens
ctgtgggcttcagc

SEQ ID NO: 1266822 - DNA, 17 bp, Homo sapiens
ctgtgggcttggccttg

SEQ ID NO: 1266823 - DNA, 21 bp, Homo sapiens
ctgtgggcttggccttgtgtc

SEQ ID NO: 1266824 - DNA, 16 bp, Homo sapiens
ctgtggggatctcagg

SEQ ID NO: 1266825 - DNA, 21 bp, Homo sapiens
ctgtggggatctcaggggctg

SEQ ID NO: 1266826 - DNA, 17 bp, Homo sapiens
ctgtggggcaggagtgc

SEQ ID NO: 1266827 - DNA, 23 bp, Homo sapiens
ctgtggggcaggagtgccaggac

SEQ ID NO: 1266828 - DNA, 23 bp, Homo sapiens
ctgtggggcccttgggccacgct

SEQ ID NO: 1266829 - DNA, 13 bp, Homo sapiens
ctgtggggcctga

SEQ ID NO: 1266830 - DNA, 19 bp, Homo sapiens
ctgtggggccttggttccc

SEQ ID NO: 1266831 - DNA, 14 bp, Homo sapiens
ctgtggggctacag

SEQ ID NO: 1266832 - DNA, 12 bp, Homo sapiens
ctgtggggctga

SEQ ID NO: 1266833 - DNA, 16 bp, Homo sapiens
ctgtggggctgggcac

SEQ ID NO: 1266834 - DNA, 21 bp, Homo sapiens
ctgtggggggtaatccctgct

SEQ ID NO: 1266835 - DNA, 24 bp, Homo sapiens
ctgtgggggtgagggtcccatgtg

SEQ ID NO: 1266836 - DNA, 14 bp, Homo sapiens
ctgtgggggtggcc

SEQ ID NO: 1266837 - DNA, 17 bp, Homo sapiens
ctgtgggggtggccatc

SEQ ID NO: 1266838 - DNA, 20 bp, Homo sapiens
ctgtgggggtggccatccct

SEQ ID NO: 1266839 - DNA, 23 bp, Homo sapiens
ctgtgggggtggccatccctggg

SEQ ID NO: 1266840 - DNA, 14 bp, Homo sapiens
ctgtggggtctggc

SEQ ID NO: 1266841 - DNA, 17 bp, Homo sapiens
ctgtggggtctggctgt

SEQ ID NO: 1266842 - DNA, 10 bp, Homo sapiens
ctgtggggtg

SEQ ID NO: 1266843 - DNA, 13 bp, Homo sapiens
ctgtggggtggag

SEQ ID NO: 1266844 - DNA, 13 bp, Homo sapiens
ctgtggggtgggc

SEQ ID NO: 1266845 - DNA, 17 bp, Homo sapiens
ctgtggggtgggctgga

SEQ ID NO: 1266846 - DNA, 18 bp, Homo sapiens
ctgtgggtctctgaaggg

SEQ ID NO: 1266847 - DNA, 15 bp, Homo sapiens
ctgtgggtctctgga

SEQ ID NO: 1266848 - DNA, 16 bp, Homo sapiens
ctgtgggtctgggagt

SEQ ID NO: 1266849 - DNA, 14 bp, Homo sapiens
ctgtgggtgaagcg

SEQ ID NO: 1266850 - DNA, 18 bp, Homo sapiens
ctgtgggtgctacacaga

SEQ ID NO: 1266851 - DNA, 23 bp, Homo sapiens
ctgtgggtggggaggccctgcct

SEQ ID NO: 1266852 - DNA, 17 bp, Homo sapiens
ctgtgggtgtctccctc

SEQ ID NO: 1266853 - DNA, 22 bp, Homo sapiens
ctgtgggtgttctttcctgccc

SEQ ID NO: 1266854 - DNA, 23 bp, Homo sapiens
ctgttctgtttggcacttgtatt

SEQ ID NO: 1266855 - DNA, 18 bp, Homo sapiens
ctgttcttaagacgtgat

SEQ ID NO: 1266856 - DNA, 14 bp, Homo sapiens
ctgttcttacaaat

SEQ ID NO: 1266857 - DNA, 15 bp, Homo sapiens
ctgttcttacaaatg

SEQ ID NO: 1266858 - DNA, 19 bp, Homo sapiens
ctgttcttagagtgtagct

SEQ ID NO: 1266859 - DNA, 17 bp, Homo sapiens
ctgttcttcacttctgg

SEQ ID NO: 1266860 - DNA, 12 bp, Homo sapiens
ctgttcttcctc

SEQ ID NO: 1266861 - DNA, 13 bp, Homo sapiens
ctgttcttcctcc

SEQ ID NO: 1266862 - DNA, 15 bp, Homo sapiens
ctgttcttcctccag

SEQ ID NO: 1266863 - DNA, 21 bp, Homo sapiens
ctgttcttcctccagctgcac

SEQ ID NO: 1266864 - DNA, 22 bp, Homo sapiens
ctgttcttcctccagctgcacc

SEQ ID NO: 1266865 - DNA, 16 bp, Homo sapiens
ctgttcttgcataggc

SEQ ID NO: 1266866 - DNA, 23 bp, Homo sapiens
ctgttctttctggctatgcattt

SEQ ID NO: 1266867 - DNA, 14 bp, Homo sapiens
ctgttcttttgcat

SEQ ID NO: 1266868 - DNA, 20 bp, Homo sapiens
ctgttgaaaagcacacacaa

SEQ ID NO: 1266869 - DNA, 17 bp, Homo sapiens
ctgttgaagcattttct

SEQ ID NO: 1266870 - DNA, 15 bp, Homo sapiens
ctgttgaaggtgcca

SEQ ID NO: 1266871 - DNA, 18 bp, Homo sapiens
ctgttgaatcaaagtgat

SEQ ID NO: 1266872 - DNA, 19 bp, Homo sapiens
ctgttgaatcaaagtgatt

SEQ ID NO: 1266873 - DNA, 21 bp, Homo sapiens
ctgttgaattatgttttgaca

SEQ ID NO: 1266874 - DNA, 17 bp, Homo sapiens
ctgttgaatttcccaca

SEQ ID NO: 1266875 - DNA, 15 bp, Homo sapiens
ctgttgacatattta

SEQ ID NO: 1266876 - DNA, 19 bp, Homo sapiens
ctgttgacatatttaatgt

SEQ ID NO: 1266877 - DNA, 22 bp, Homo sapiens
ctgttgacatatttaatgtttt

SEQ ID NO: 1266878 - DNA, 23 bp, Homo sapiens
ctgttgacatatttaatgtttta

SEQ ID NO: 1266879 - DNA, 15 bp, Homo sapiens
ctgttgacatcagcc

SEQ ID NO: 1266880 - DNA, 13 bp, Homo sapiens
ctgttgagatgcc

SEQ ID NO: 1266881 - DNA, 16 bp, Homo sapiens
ctgttgagatgcctgt

SEQ ID NO: 1266882 - DNA, 15 bp, Homo sapiens
ctgttgagccccagt

SEQ ID NO: 1266883 - DNA, 15 bp, Homo sapiens
ctgttgataaaaact

SEQ ID NO: 1266884 - DNA, 16 bp, Homo sapiens
ctgttgatacaaacca

SEQ ID NO: 1266885 - DNA, 20 bp, Homo sapiens
ctgttgatacaaaccactgt

SEQ ID NO: 1266886 - DNA, 19 bp, Homo sapiens
ctgttgatcccacttcact

SEQ ID NO: 1266887 - DNA, 22 bp, Homo sapiens
ctgttgatcccacttcactgtg

SEQ ID NO: 1266888 - DNA, 19 bp, Homo sapiens
ctgttgatgaagtatactt

SEQ ID NO: 1266889 - DNA, 20 bp, Homo sapiens
ctgttgatgaggcctcttgg

SEQ ID NO: 1266890 - DNA, 14 bp, Homo sapiens
ctgttgatgtatct

SEQ ID NO: 1266891 - DNA, 13 bp, Homo sapiens
ctgttgattaatt

SEQ ID NO: 1266892 - DNA, 16 bp, Homo sapiens
ctgttgcaagcccctc

SEQ ID NO: 1266893 - DNA, 15 bp, Homo sapiens
ctgttgcatttactt

SEQ ID NO: 1266894 - DNA, 17 bp, Homo sapiens
ctgttgcatttactttt

SEQ ID NO: 1266895 - DNA, 18 bp, Homo sapiens
ctgttgccagtcagcaac

SEQ ID NO: 1266896 - DNA, 18 bp, Homo sapiens
ctgttgccatagccccat

SEQ ID NO: 1266897 - DNA, 18 bp, Homo sapiens
ctgttgccatggtgatgg

SEQ ID NO: 1266898 - DNA, 12 bp, Homo sapiens
ctgttgcctcat

SEQ ID NO: 1266899 - DNA, 16 bp, Homo sapiens
ctgttgctagggagag

SEQ ID NO: 1266900 - DNA, 19 bp, Homo sapiens
ctgttgctagggagaggga

SEQ ID NO: 1266901 - DNA, 23 bp, Homo sapiens
ctgttgctatagagcctacctgt

SEQ ID NO: 1266902 - DNA, 15 bp, Homo sapiens
ctgttgctatttgta

SEQ ID NO: 1266903 - DNA, 23 bp, Homo sapiens
ctgttgctatttgtatttctctt

SEQ ID NO: 1266904 - DNA, 14 bp, Homo sapiens
ctgttgctggaggg

SEQ ID NO: 1266905 - DNA, 21 bp, Homo sapiens
ctgttgctttcttcctgcata

SEQ ID NO: 1266906 - DNA, 11 bp, Homo sapiens
ctgttggaagc

SEQ ID NO: 1266907 - DNA, 16 bp, Homo sapiens
ctgttggacagctgct

SEQ ID NO: 1266908 - DNA, 19 bp, Homo sapiens
ctgttggacccgctctgga

SEQ ID NO: 1266909 - DNA, 17 bp, Homo sapiens
ctgttggagcaaaccat

SEQ ID NO: 1266910 - DNA, 21 bp, Homo sapiens
ctgttggcactcacagacctg

SEQ ID NO: 1266911 - DNA, 22 bp, Homo sapiens
ctgttggcactcacagacctgg

SEQ ID NO: 1266912 - DNA, 23 bp, Homo sapiens
ctgttggcactcacagacctgga

SEQ ID NO: 1266913 - DNA, 13 bp, Homo sapiens
ctgttggcactta

SEQ ID NO: 1266914 - DNA, 16 bp, Homo sapiens
ctgttggcagctctag

SEQ ID NO: 1266915 - DNA, 16 bp, Homo sapiens
ctgttggcaggcccac

SEQ ID NO: 1266916 - DNA, 15 bp, Homo sapiens
ctgttggcaggctgg

SEQ ID NO: 1266917 - DNA, 13 bp, Homo sapiens
ctgttggcctgtg

SEQ ID NO: 1266918 - DNA, 18 bp, Homo sapiens
ctgttgggaacagcatgg

SEQ ID NO: 1266919 - DNA, 12 bp, Homo sapiens
ctgttgggtggg

SEQ ID NO: 1266920 - DNA, 20 bp, Homo sapiens
ctgttgggtgggtgggccct

SEQ ID NO: 1266921 - DNA, 21 bp, Homo sapiens
ctgttggtccactgtgtttag

SEQ ID NO: 1266922 - DNA, 22 bp, Homo sapiens
ctgttggtccactgtgtttagt

SEQ ID NO: 1266923 - DNA, 15 bp, Homo sapiens
ctgttgtactatgga

SEQ ID NO: 1266924 - DNA, 19 bp, Homo sapiens
ctgttgtagcattttcctg

SEQ ID NO: 1266925 - DNA, 18 bp, Homo sapiens
ctgttgtatttatggatt

SEQ ID NO: 1266926 - DNA, 17 bp, Homo sapiens
ctgttgtcattgctgtt

SEQ ID NO: 1266927 - DNA, 16 bp, Homo sapiens
ctgttgtgaagctaat

SEQ ID NO: 1266928 - DNA, 20 bp, Homo sapiens
ctgttgtgagctttgaagta

SEQ ID NO: 1266929 - DNA, 20 bp, Homo sapiens
ctgttgtgggcgctgcttcc

SEQ ID NO: 1266930 - DNA, 17 bp, Homo sapiens
ctgttgttgttaatgaa

SEQ ID NO: 1266931 - DNA, 19 bp, Homo sapiens
ctgttgtttggttcaggga

SEQ ID NO: 1266932 - DNA, 16 bp, Homo sapiens
ctgttgttttgtttta

SEQ ID NO: 1266933 - DNA, 21 bp, Homo sapiens
ctgtttaaagtcacatccctg

SEQ ID NO: 1266934 - DNA, 23 bp, Homo sapiens
ctgtttaaagtcacatccctgta

SEQ ID NO: 1266935 - DNA, 19 bp, Homo sapiens
ctgtttaagctactaacga

SEQ ID NO: 1266936 - DNA, 16 bp, Homo sapiens
ctgtttaatatttaaa

SEQ ID NO: 1266937 - DNA, 14 bp, Homo sapiens
ctgtttaatttaca

SEQ ID NO: 1266938 - DNA, 14 bp, Homo sapiens
ctgtttacaagaaa

SEQ ID NO: 1266939 - DNA, 17 bp, Homo sapiens
ctgtttacaagaaaaaa

SEQ ID NO: 1266940 - DNA, 18 bp, Homo sapiens
ctgtttactcccttctgt

SEQ ID NO: 1266941 - DNA, 22 bp, Homo sapiens
ctgtttactcccttctgtagtt

SEQ ID NO: 1266942 - DNA, 14 bp, Homo sapiens
ctgtttactgcttt

SEQ ID NO: 1266943 - DNA, 22 bp, Homo sapiens
ctgtttactgcttttcattagc

SEQ ID NO: 1266944 - DNA, 19 bp, Homo sapiens
ctgtttacttgaatagtat

SEQ ID NO: 1266945 - DNA, 23 bp, Homo sapiens
ctgtttagcttcctccagaggag

SEQ ID NO: 1266946 - DNA, 21 bp, Homo sapiens
ctgtttaggttcccctgtcaa

SEQ ID NO: 1266947 - DNA, 20 bp, Homo sapiens
ctgtttagtagcagtgattg

SEQ ID NO: 1266948 - DNA, 15 bp, Homo sapiens
ctgtttataatctga

SEQ ID NO: 1266949 - DNA, 20 bp, Homo sapiens
ctgtttataatctgaagata

SEQ ID NO: 1266950 - DNA, 14 bp, Homo sapiens
ctgtttatggcctc

SEQ ID NO: 1266951 - DNA, 16 bp, Homo sapiens
ctgtttatggcctcag

SEQ ID NO: 1266952 - DNA, 21 bp, Homo sapiens
ctgtttatggcctcagctgcc

SEQ ID NO: 1266953 - DNA, 18 bp, Homo sapiens
ctgtttattaatcttagt

SEQ ID NO: 1266954 - DNA, 15 bp, Homo sapiens
ctgtttatttattca

SEQ ID NO: 1266955 - DNA, 15 bp, Homo sapiens
ctgtttcaaacttta

SEQ ID NO: 1266956 - DNA, 17 bp, Homo sapiens
ctgtttcaacacagacc

SEQ ID NO: 1266957 - DNA, 19 bp, Homo sapiens
ctgtttcaatgacctgtat

SEQ ID NO: 1266958 - DNA, 11 bp, Homo sapiens
ctgtttcacaa

SEQ ID NO: 1266959 - DNA, 18 bp, Homo sapiens
ctgtttcagaccccccca

SEQ ID NO: 1266960 - DNA, 14 bp, Homo sapiens
ctgtttcagtgtga

SEQ ID NO: 1266961 - DNA, 13 bp, Homo sapiens
ctgtttcattcac

SEQ ID NO: 1266962 - DNA, 14 bp, Homo sapiens
ctgtttcattcact

SEQ ID NO: 1266963 - DNA, 14 bp, Homo sapiens
ctgtttctaagaaa

SEQ ID NO: 1266964 - DNA, 18 bp, Homo sapiens
ctgtttctaagaaaatgt

SEQ ID NO: 1266965 - DNA, 15 bp, Homo sapiens
ctgtttctcaagtgt

SEQ ID NO: 1266966 - DNA, 21 bp, Homo sapiens
ctgtttctcaagtgttttgga

SEQ ID NO: 1266967 - DNA, 11 bp, Homo sapiens
ctgtttctcat

SEQ ID NO: 1266968 - DNA, 12 bp, Homo sapiens
ctgtttctcatg

SEQ ID NO: 1266969 - DNA, 22 bp, Homo sapiens
ctgtttctccacaacagcctgg

SEQ ID NO: 1266970 - DNA, 14 bp, Homo sapiens
ctgtttctctgctg

SEQ ID NO: 1266971 - DNA, 17 bp, Homo sapiens
ctgtttctctgctgtca

SEQ ID NO: 1266972 - DNA, 20 bp, Homo sapiens
ctgtttctcttgagctggcc

SEQ ID NO: 1266973 - DNA, 22 bp, Homo sapiens
ctgtttctctttgtctgccttc

SEQ ID NO: 1266974 - DNA, 23 bp, Homo sapiens
ctgtttctggaagactgctcccg

SEQ ID NO: 1266975 - DNA, 18 bp, Homo sapiens
ctgtttcttgcactgaat

SEQ ID NO: 1266976 - DNA, 14 bp, Homo sapiens
cttaatttcctttt

SEQ ID NO: 1266977 - DNA, 20 bp, Homo sapiens
cttaatttcctttttgacac

SEQ ID NO: 1266978 - DNA, 14 bp, Homo sapiens
cttaatttctgcct

SEQ ID NO: 1266979 - DNA, 17 bp, Homo sapiens
cttaatttctgcctttc

SEQ ID NO: 1266980 - DNA, 19 bp, Homo sapiens
cttaatttctgcctttccc

SEQ ID NO: 1266981 - DNA, 20 bp, Homo sapiens
cttaatttctgcctttcccc

SEQ ID NO: 1266982 - DNA, 22 bp, Homo sapiens
cttaatttctgcctttcccccc

SEQ ID NO: 1266983 - DNA, 13 bp, Homo sapiens
cttaatttgcaca

SEQ ID NO: 1266984 - DNA, 18 bp, Homo sapiens
cttaatttggataataaa

SEQ ID NO: 1266985 - DNA, 18 bp, Homo sapiens
cttaatttgtaaacttct

SEQ ID NO: 1266986 - DNA, 23 bp, Homo sapiens
cttaatttgtaaacttctgaaga

SEQ ID NO: 1266987 - DNA, 17 bp, Homo sapiens
cttacaagatattgatg

SEQ ID NO: 1266988 - DNA, 17 bp, Homo sapiens
cttacaagccagctgga

SEQ ID NO: 1266989 - DNA, 18 bp, Homo sapiens
cttacaagcctaagaatc

SEQ ID NO: 1266990 - DNA, 19 bp, Homo sapiens
cttacaagcttaaagcttg

SEQ ID NO: 1266991 - DNA, 22 bp, Homo sapiens
cttacaaggccctttcctttgg

SEQ ID NO: 1266992 - DNA, 19 bp, Homo sapiens
cttacaagtggtgaccaaa

SEQ ID NO: 1266993 - DNA, 18 bp, Homo sapiens
cttacaattgcactgctg

SEQ ID NO: 1266994 - DNA, 16 bp, Homo sapiens
cttacacaagaagtga

SEQ ID NO: 1266995 - DNA, 16 bp, Homo sapiens
cttacacacccccaga

SEQ ID NO: 1266996 - DNA, 15 bp, Homo sapiens
cttacagaaatgact

SEQ ID NO: 1266997 - DNA, 20 bp, Homo sapiens
cttacagcacatcacctctt

SEQ ID NO: 1266998 - DNA, 17 bp, Homo sapiens
cttacagtaactaattt

SEQ ID NO: 1266999 - DNA, 20 bp, Homo sapiens
cttacataaaccatttttgt

SEQ ID NO: 1267000 - DNA, 22 bp, Homo sapiens
cttacataattttttattcaag

SEQ ID NO: 1267001 - DNA, 15 bp, Homo sapiens
cttacatctggctgg

SEQ ID NO: 1267002 - DNA, 15 bp, Homo sapiens
cttacatgtgtaaag

SEQ ID NO: 1267003 - DNA, 16 bp, Homo sapiens
cttacatttcagacat

SEQ ID NO: 1267004 - DNA, 14 bp, Homo sapiens
cttacattttaata

SEQ ID NO: 1267005 - DNA, 19 bp, Homo sapiens
cttacattttcgtcctgta

SEQ ID NO: 1267006 - DNA, 22 bp, Homo sapiens
cttacatttttacaataaataa

SEQ ID NO: 1267007 - DNA, 15 bp, Homo sapiens
cttaccaaaggatag

SEQ ID NO: 1267008 - DNA, 16 bp, Homo sapiens
cttaccaactttctgt

SEQ ID NO: 1267009 - DNA, 19 bp, Homo sapiens
cttaccaactttctgtaaa

SEQ ID NO: 1267010 - DNA, 17 bp, Homo sapiens
cttaccaagttgtgctt

SEQ ID NO: 1267011 - DNA, 21 bp, Homo sapiens
cttaccagataatgctacttt

SEQ ID NO: 1267012 - DNA, 13 bp, Homo sapiens
cttaccaggaagc

SEQ ID NO: 1267013 - DNA, 20 bp, Homo sapiens
cttaccaggcaccaaaagaa

SEQ ID NO: 1267014 - DNA, 16 bp, Homo sapiens
cttaccatctctacca

SEQ ID NO: 1267015 - DNA, 12 bp, Homo sapiens
cttacccaaagc

SEQ ID NO: 1267016 - DNA, 16 bp, Homo sapiens
cttacccaatttccca

SEQ ID NO: 1267017 - DNA, 23 bp, Homo sapiens
cttacccgaaagcatcactgcct

SEQ ID NO: 1267018 - DNA, 19 bp, Homo sapiens
cttaccctcctctgctggg

SEQ ID NO: 1267019 - DNA, 21 bp, Homo sapiens
cttacctaaacagatataaat

SEQ ID NO: 1267020 - DNA, 22 bp, Homo sapiens
cttacctaaacagatataaatg

SEQ ID NO: 1267021 - DNA, 16 bp, Homo sapiens
cttacctactttcttc

SEQ ID NO: 1267022 - DNA, 14 bp, Homo sapiens
cttacctagtgaaa

SEQ ID NO: 1267023 - DNA, 21 bp, Homo sapiens
cttacctagtgaaacttttct

SEQ ID NO: 1267024 - DNA, 22 bp, Homo sapiens
cttacctagtgaaacttttcta

SEQ ID NO: 1267025 - DNA, 14 bp, Homo sapiens
cttacctatttcct

SEQ ID NO: 1267026 - DNA, 15 bp, Homo sapiens
cttacctatttcctc

SEQ ID NO: 1267027 - DNA, 18 bp, Homo sapiens
cttacctcctgcccagga

SEQ ID NO: 1267028 - DNA, 19 bp, Homo sapiens
cttacctcctgcccaggag

SEQ ID NO: 1267029 - DNA, 19 bp, Homo sapiens
cttacctcggtgccttcct

SEQ ID NO: 1267030 - DNA, 13 bp, Homo sapiens
cttacctctggaa

SEQ ID NO: 1267031 - DNA, 15 bp, Homo sapiens
cttacctcttccgga

SEQ ID NO: 1267032 - DNA, 15 bp, Homo sapiens
cttacctgtacactg

SEQ ID NO: 1267033 - DNA, 17 bp, Homo sapiens
cttacctgtacactgac

SEQ ID NO: 1267034 - DNA, 14 bp, Homo sapiens
cttaccttctgctg

SEQ ID NO: 1267035 - DNA, 18 bp, Homo sapiens
cttaccttggggctgggg

SEQ ID NO: 1267036 - DNA, 22 bp, Homo sapiens
cttacctttcctgatgcccctg

SEQ ID NO: 1267037 - DNA, 17 bp, Homo sapiens
cttactaaaaagtataa

SEQ ID NO: 1267038 - DNA, 18 bp, Homo sapiens
cttactaaaaagtataaa

SEQ ID NO: 1267039 - DNA, 21 bp, Homo sapiens
cttactaaacattttgttatt

SEQ ID NO: 1267040 - DNA, 22 bp, Homo sapiens
cttactaaacattttgttattg

SEQ ID NO: 1267041 - DNA, 24 bp, Homo sapiens
cttactaagctttgccagctgctg

SEQ ID NO: 1267042 - DNA, 19 bp, Homo sapiens
cttactattaagcagtaaa

SEQ ID NO: 1267043 - DNA, 11 bp, Homo sapiens
cttactatttc

SEQ ID NO: 1267044 - DNA, 21 bp, Homo sapiens
cttactcccccaccactcagg

SEQ ID NO: 1267045 - DNA, 23 bp, Homo sapiens
cttactcccccaccactcaggcc

SEQ ID NO: 1267046 - DNA, 12 bp, Homo sapiens
cttactcctcct

SEQ ID NO: 1267047 - DNA, 16 bp, Homo sapiens
cttactcctcctcttt

SEQ ID NO: 1267048 - DNA, 18 bp, Homo sapiens
cttactcctcctctttct

SEQ ID NO: 1267049 - DNA, 15 bp, Homo sapiens
cttactctgagccca

SEQ ID NO: 1267050 - DNA, 13 bp, Homo sapiens
cttactctgtctc

SEQ ID NO: 1267051 - DNA, 19 bp, Homo sapiens
cttactcttcttgaaattt

SEQ ID NO: 1267052 - DNA, 16 bp, Homo sapiens
cttactgatgatgtgt

SEQ ID NO: 1267053 - DNA, 23 bp, Homo sapiens
cttactggtttccccagggaagg

SEQ ID NO: 1267054 - DNA, 13 bp, Homo sapiens
cttactgtacatg

SEQ ID NO: 1267055 - DNA, 16 bp, Homo sapiens
cttactgtacatgaaa

SEQ ID NO: 1267056 - DNA, 18 bp, Homo sapiens
cttactgtacctgttcct

SEQ ID NO: 1267057 - DNA, 12 bp, Homo sapiens
cttactgtatat

SEQ ID NO: 1267058 - DNA, 16 bp, Homo sapiens
cttactgtatatgtat

SEQ ID NO: 1267059 - DNA, 16 bp, Homo sapiens
cttacttcctggcctc

SEQ ID NO: 1267060 - DNA, 17 bp, Homo sapiens
cttacttcctggcctct

SEQ ID NO: 1267061 - DNA, 14 bp, Homo sapiens
cttacttctcacta

SEQ ID NO: 1267062 - DNA, 23 bp, Homo sapiens
cttacttctcttgccttaaatat

SEQ ID NO: 1267063 - DNA, 20 bp, Homo sapiens
cttactttacctctctgtca

SEQ ID NO: 1267064 - DNA, 17 bp, Homo sapiens
cttacttttattatttt

SEQ ID NO: 1267065 - DNA, 20 bp, Homo sapiens
cttacttttattattttaat

SEQ ID NO: 1267066 - DNA, 21 bp, Homo sapiens
cttacttttcctggacttaaa

SEQ ID NO: 1267067 - DNA, 20 bp, Homo sapiens
cttagaaaaaccaccaccat

SEQ ID NO: 1267068 - DNA, 13 bp, Homo sapiens
cttagaaaatgtg

SEQ ID NO: 1267069 - DNA, 17 bp, Homo sapiens
cttagaaaattaaaata

SEQ ID NO: 1267070 - DNA, 23 bp, Homo sapiens
cttagaaataacagaagaaaata

SEQ ID NO: 1267071 - DNA, 19 bp, Homo sapiens
cttagaaatcattgtagaa

SEQ ID NO: 1267072 - DNA, 22 bp, Homo sapiens
cttagaaatgtaaactgccata

SEQ ID NO: 1267073 - DNA, 17 bp, Homo sapiens
cttagaaattgcatttc

SEQ ID NO: 1267074 - DNA, 15 bp, Homo sapiens
cttagaacattttaa

SEQ ID NO: 1267075 - DNA, 16 bp, Homo sapiens
cttagaacattttaat

SEQ ID NO: 1267076 - DNA, 21 bp, Homo sapiens
cttagaagaatattgtattgt

SEQ ID NO: 1267077 - DNA, 19 bp, Homo sapiens
cttagaagccatgggacct

SEQ ID NO: 1267078 - DNA, 20 bp, Homo sapiens
cttagaagtggaccaggaca

SEQ ID NO: 1267079 - DNA, 18 bp, Homo sapiens
cttagaatgcatctcatc

SEQ ID NO: 1267080 - DNA, 18 bp, Homo sapiens
cttagacaaatgatcacc

SEQ ID NO: 1267081 - DNA, 16 bp, Homo sapiens
cttagaccttccataa

SEQ ID NO: 1267082 - DNA, 14 bp, Homo sapiens
cttagactccttct

SEQ ID NO: 1267083 - DNA, 19 bp, Homo sapiens
cttagactccttctcccca

SEQ ID NO: 1267084 - DNA, 15 bp, Homo sapiens
cttagactcttttcc

SEQ ID NO: 1267085 - DNA, 18 bp, Homo sapiens
cttagagagaggaggcag

SEQ ID NO: 1267086 - DNA, 20 bp, Homo sapiens
cttagagattgccccagagc

SEQ ID NO: 1267087 - DNA, 22 bp, Homo sapiens
cttagagattgccccagagccc

SEQ ID NO: 1267088 - DNA, 13 bp, Homo sapiens
cttagaggaaaat

SEQ ID NO: 1267089 - DNA, 18 bp, Homo sapiens
cttagagtgcccagcaga

SEQ ID NO: 1267090 - DNA, 14 bp, Homo sapiens
cttagagtgtagct

SEQ ID NO: 1267091 - DNA, 15 bp, Homo sapiens
cttagagtgtagctg

SEQ ID NO: 1267092 - DNA, 19 bp, Homo sapiens
cttagagtgtagctgtaag

SEQ ID NO: 1267093 - DNA, 14 bp, Homo sapiens
cttagagttcttct

SEQ ID NO: 1267094 - DNA, 16 bp, Homo sapiens
cttagagtttacagtt

SEQ ID NO: 1267095 - DNA, 22 bp, Homo sapiens
cttagagtttacagtttgtgtt

SEQ ID NO: 1267096 - DNA, 17 bp, Homo sapiens
cttagagtttctgtttg

SEQ ID NO: 1267097 - DNA, 13 bp, Homo sapiens
cttcagccctggc

SEQ ID NO: 1267098 - DNA, 21 bp, Homo sapiens
cttcagcctagccgacctcag

SEQ ID NO: 1267099 - DNA, 22 bp, Homo sapiens
cttcagcctagccgacctcagc

SEQ ID NO: 1267100 - DNA, 14 bp, Homo sapiens
cttcagcctccctc

SEQ ID NO: 1267101 - DNA, 15 bp, Homo sapiens
cttcagcctccctca

SEQ ID NO: 1267102 - DNA, 14 bp, Homo sapiens
cttcagcctgaggc

SEQ ID NO: 1267103 - DNA, 15 bp, Homo sapiens
cttcagcctgaggct

SEQ ID NO: 1267104 - DNA, 16 bp, Homo sapiens
cttcagcctgaggctg

SEQ ID NO: 1267105 - DNA, 22 bp, Homo sapiens
cttcagcctgaggctgagactg

SEQ ID NO: 1267106 - DNA, 11 bp, Homo sapiens
cttcagctcct

SEQ ID NO: 1267107 - DNA, 13 bp, Homo sapiens
cttcagctcctga

SEQ ID NO: 1267108 - DNA, 14 bp, Homo sapiens
cttcagctcctgag

SEQ ID NO: 1267109 - DNA, 21 bp, Homo sapiens
cttcagctcctgagtagctgg

SEQ ID NO: 1267110 - DNA, 19 bp, Homo sapiens
cttcagctgacttttctgt

SEQ ID NO: 1267111 - DNA, 15 bp, Homo sapiens
cttcagctgcctgaa

SEQ ID NO: 1267112 - DNA, 13 bp, Homo sapiens
cttcaggactctg

SEQ ID NO: 1267113 - DNA, 14 bp, Homo sapiens
cttcaggactctgc

SEQ ID NO: 1267114 - DNA, 15 bp, Homo sapiens
cttcaggactctgcg

SEQ ID NO: 1267115 - DNA, 18 bp, Homo sapiens
cttcaggactctgcggga

SEQ ID NO: 1267116 - DNA, 20 bp, Homo sapiens
cttcaggatattggttcttc

SEQ ID NO: 1267117 - DNA, 21 bp, Homo sapiens
cttcaggatattggttcttcc

SEQ ID NO: 1267118 - DNA, 12 bp, Homo sapiens
cttcaggcctcc

SEQ ID NO: 1267119 - DNA, 16 bp, Homo sapiens
cttcaggctcttctcc

SEQ ID NO: 1267120 - DNA, 17 bp, Homo sapiens
cttcaggctcttctcct

SEQ ID NO: 1267121 - DNA, 22 bp, Homo sapiens
cttcaggctcttctcctttcac

SEQ ID NO: 1267122 - DNA, 23 bp, Homo sapiens
cttcagggactcaagggtccaga

SEQ ID NO: 1267123 - DNA, 17 bp, Homo sapiens
cttcagggattccctgt

SEQ ID NO: 1267124 - DNA, 19 bp, Homo sapiens
cttcagggattccctgtcc

SEQ ID NO: 1267125 - DNA, 11 bp, Homo sapiens
cttcagggcca

SEQ ID NO: 1267126 - DNA, 23 bp, Homo sapiens
cttcagggccagaaggagggcag

SEQ ID NO: 1267127 - DNA, 21 bp, Homo sapiens
cttcaggggagtcccgtcagg

SEQ ID NO: 1267128 - DNA, 15 bp, Homo sapiens
cttcaggtaacacta

SEQ ID NO: 1267129 - DNA, 15 bp, Homo sapiens
cttcaggtccgtggg

SEQ ID NO: 1267130 - DNA, 18 bp, Homo sapiens
cttcaggtcgtagcattt

SEQ ID NO: 1267131 - DNA, 16 bp, Homo sapiens
cttcaggtgaacactt

SEQ ID NO: 1267132 - DNA, 21 bp, Homo sapiens
cttcaggtgcttttgatgtga

SEQ ID NO: 1267133 - DNA, 21 bp, Homo sapiens
cttcaggtggagagcactaga

SEQ ID NO: 1267134 - DNA, 18 bp, Homo sapiens
cttcaggttggtttaatc

SEQ ID NO: 1267135 - DNA, 14 bp, Homo sapiens
cttcagtaagccgt

SEQ ID NO: 1267136 - DNA, 23 bp, Homo sapiens
cttcagtaagccgtgattttcat

SEQ ID NO: 1267137 - DNA, 20 bp, Homo sapiens
cttcagtaggaacaagctgg

SEQ ID NO: 1267138 - DNA, 23 bp, Homo sapiens
cttcagtatgttgtcaaagagag

SEQ ID NO: 1267139 - DNA, 18 bp, Homo sapiens
cttcagtcatcagccagc

SEQ ID NO: 1267140 - DNA, 15 bp, Homo sapiens
cttcagtcattaaat

SEQ ID NO: 1267141 - DNA, 16 bp, Homo sapiens
cttcagtcattaaatt

SEQ ID NO: 1267142 - DNA, 17 bp, Homo sapiens
cttcagtcctgctccag

SEQ ID NO: 1267143 - DNA, 18 bp, Homo sapiens
cttcagtcctgctccaga

SEQ ID NO: 1267144 - DNA, 15 bp, Homo sapiens
cttcagtgagcccct

SEQ ID NO: 1267145 - DNA, 17 bp, Homo sapiens
cttcagtgagcccctcc

SEQ ID NO: 1267146 - DNA, 22 bp, Homo sapiens
cttcagtgcaaattgtatctta

SEQ ID NO: 1267147 - DNA, 13 bp, Homo sapiens
cttcagtgcccac

SEQ ID NO: 1267148 - DNA, 15 bp, Homo sapiens
cttcagtgcccacca

SEQ ID NO: 1267149 - DNA, 17 bp, Homo sapiens
cttcagtgcccaccaac

SEQ ID NO: 1267150 - DNA, 23 bp, Homo sapiens
cttcagtggaacacaaatgaaaa

SEQ ID NO: 1267151 - DNA, 18 bp, Homo sapiens
cttcagtgggagaaaaca

SEQ ID NO: 1267152 - DNA, 17 bp, Homo sapiens
cttcagtgtctctgttt

SEQ ID NO: 1267153 - DNA, 11 bp, Homo sapiens
cttcagttgtt

SEQ ID NO: 1267154 - DNA, 22 bp, Homo sapiens
cttcagtttatttccactattt

SEQ ID NO: 1267155 - DNA, 15 bp, Homo sapiens
cttcagtttcacaga

SEQ ID NO: 1267156 - DNA, 17 bp, Homo sapiens
cttcagtttcacagaaa

SEQ ID NO: 1267157 - DNA, 20 bp, Homo sapiens
cttcagtttcacagaaaata

SEQ ID NO: 1267158 - DNA, 15 bp, Homo sapiens
cttcagtttgtaaag

SEQ ID NO: 1267159 - DNA, 14 bp, Homo sapiens
cttcataaatgaag

SEQ ID NO: 1267160 - DNA, 15 bp, Homo sapiens
cttcataacaatttt

SEQ ID NO: 1267161 - DNA, 19 bp, Homo sapiens
cttcataacaattttagga

SEQ ID NO: 1267162 - DNA, 20 bp, Homo sapiens
cttcataataaactacacaa

SEQ ID NO: 1267163 - DNA, 23 bp, Homo sapiens
cttcataccgcctcgtgccagca

SEQ ID NO: 1267164 - DNA, 16 bp, Homo sapiens
cttcatactggcagga

SEQ ID NO: 1267165 - DNA, 15 bp, Homo sapiens
cttcatagaaacctc

SEQ ID NO: 1267166 - DNA, 22 bp, Homo sapiens
cttcatagatgcaggaggctca

SEQ ID NO: 1267167 - DNA, 20 bp, Homo sapiens
cttcataggcggtcatgtgt

SEQ ID NO: 1267168 - DNA, 15 bp, Homo sapiens
cttcatatatttctc

SEQ ID NO: 1267169 - DNA, 15 bp, Homo sapiens
cttcatattgctgag

SEQ ID NO: 1267170 - DNA, 19 bp, Homo sapiens
cttcatcattccctctcat

SEQ ID NO: 1267171 - DNA, 15 bp, Homo sapiens
cttcatcgaatctac

SEQ ID NO: 1267172 - DNA, 13 bp, Homo sapiens
cttcatctcccac

SEQ ID NO: 1267173 - DNA, 14 bp, Homo sapiens
cttcatctccctgc

SEQ ID NO: 1267174 - DNA, 20 bp, Homo sapiens
cttcatctccctgccatccc

SEQ ID NO: 1267175 - DNA, 15 bp, Homo sapiens
cttcatctgcaaagg

SEQ ID NO: 1267176 - DNA, 13 bp, Homo sapiens
cttcatctggcaa

SEQ ID NO: 1267177 - DNA, 14 bp, Homo sapiens
cttcatctggcaac

SEQ ID NO: 1267178 - DNA, 22 bp, Homo sapiens
cttcatcttcctgtgtcctgaa

SEQ ID NO: 1267179 - DNA, 16 bp, Homo sapiens
cttcatgacagcctcc

SEQ ID NO: 1267180 - DNA, 12 bp, Homo sapiens
cttcatgcaatg

SEQ ID NO: 1267181 - DNA, 18 bp, Homo sapiens
cttcatgcacttaaagaa

SEQ ID NO: 1267182 - DNA, 16 bp, Homo sapiens
cttcatgccagctact

SEQ ID NO: 1267183 - DNA, 16 bp, Homo sapiens
cttcatgcctttgtaa

SEQ ID NO: 1267184 - DNA, 15 bp, Homo sapiens
cttcatgctcagccc

SEQ ID NO: 1267185 - DNA, 17 bp, Homo sapiens
cttcatgcttgacatac

SEQ ID NO: 1267186 - DNA, 15 bp, Homo sapiens
cttcatggcagaagg

SEQ ID NO: 1267187 - DNA, 23 bp, Homo sapiens
cttcatggcatcttcaatatgaa

SEQ ID NO: 1267188 - DNA, 16 bp, Homo sapiens
cttcatgtaattttat

SEQ ID NO: 1267189 - DNA, 20 bp, Homo sapiens
cttcatgtcaacttctggct

SEQ ID NO: 1267190 - DNA, 16 bp, Homo sapiens
cttcatgtgatgtcat

SEQ ID NO: 1267191 - DNA, 23 bp, Homo sapiens
cttcatgtgatgtcatgaaactg

SEQ ID NO: 1267192 - DNA, 13 bp, Homo sapiens
cttcattaaagtc

SEQ ID NO: 1267193 - DNA, 15 bp, Homo sapiens
cttcattattctctg

SEQ ID NO: 1267194 - DNA, 18 bp, Homo sapiens
cttcattattttaaaaat

SEQ ID NO: 1267195 - DNA, 20 bp, Homo sapiens
cttcattcaatattgacatt

SEQ ID NO: 1267196 - DNA, 18 bp, Homo sapiens
cttcattccagcagctgc

SEQ ID NO: 1267197 - DNA, 20 bp, Homo sapiens
cttcattctaaaccaaaaca

SEQ ID NO: 1267198 - DNA, 13 bp, Homo sapiens
cttcattctcctt

SEQ ID NO: 1267199 - DNA, 22 bp, Homo sapiens
cttcattctccttgttgttggt

SEQ ID NO: 1267200 - DNA, 18 bp, Homo sapiens
cttcattctgagaccaaa

SEQ ID NO: 1267201 - DNA, 21 bp, Homo sapiens
cttcattcttgaaagctgtgg

SEQ ID NO: 1267202 - DNA, 15 bp, Homo sapiens
cttcattctttgcag

SEQ ID NO: 1267203 - DNA, 22 bp, Homo sapiens
cttcattgtactacctgtgtat

SEQ ID NO: 1267204 - DNA, 23 bp, Homo sapiens
cttcattgtactacctgtgtata

SEQ ID NO: 1267205 - DNA, 14 bp, Homo sapiens
cttcatttaaacta

SEQ ID NO: 1267206 - DNA, 13 bp, Homo sapiens
cttcatttcaatc

SEQ ID NO: 1267207 - DNA, 18 bp, Homo sapiens
cttcatttcaatcattga

SEQ ID NO: 1267208 - DNA, 16 bp, Homo sapiens
cttcatttcattgtat

SEQ ID NO: 1267209 - DNA, 17 bp, Homo sapiens
cttcatttcattgtatg

SEQ ID NO: 1267210 - DNA, 18 bp, Homo sapiens
cttcatttcattgtatga

SEQ ID NO: 1267211 - DNA, 20 bp, Homo sapiens
cttcatttccaccaggccgt

SEQ ID NO: 1267212 - DNA, 13 bp, Homo sapiens
cttcatttctctg

SEQ ID NO: 1267213 - DNA, 14 bp, Homo sapiens
cttcatttctctgc

SEQ ID NO: 1267214 - DNA, 20 bp, Homo sapiens
cttcatttgacacaaagctt

SEQ ID NO: 1267215 - DNA, 14 bp, Homo sapiens
cttcatttgcaatt

SEQ ID NO: 1267216 - DNA, 13 bp, Homo sapiens
cttcatttgtgcc

SEQ ID NO: 1267217 - DNA, 14 bp, Homo sapiens
cttcatttgtgcca

SEQ ID NO: 1267218 - DNA, 17 bp, Homo sapiens
cttcatttttaagactg

SEQ ID NO: 1267219 - DNA, 17 bp, Homo sapiens
cttcctaggtccaagcc

SEQ ID NO: 1267220 - DNA, 13 bp, Homo sapiens
cttcctattaaga

SEQ ID NO: 1267221 - DNA, 23 bp, Homo sapiens
cttcctcacactgctgtcctctc

SEQ ID NO: 1267222 - DNA, 13 bp, Homo sapiens
cttcctcactgcc

SEQ ID NO: 1267223 - DNA, 13 bp, Homo sapiens
cttcctcacttcc

SEQ ID NO: 1267224 - DNA, 14 bp, Homo sapiens
cttcctcacttcca

SEQ ID NO: 1267225 - DNA, 18 bp, Homo sapiens
cttcctcagcctcccaag

SEQ ID NO: 1267226 - DNA, 23 bp, Homo sapiens
cttcctcagtaacatttctgttc

SEQ ID NO: 1267227 - DNA, 17 bp, Homo sapiens
cttcctccacagtcccc

SEQ ID NO: 1267228 - DNA, 23 bp, Homo sapiens
cttcctccactgcgcttactcct

SEQ ID NO: 1267229 - DNA, 13 bp, Homo sapiens
cttcctccagctg

SEQ ID NO: 1267230 - DNA, 20 bp, Homo sapiens
cttcctccagctgcaccaga

SEQ ID NO: 1267231 - DNA, 11 bp, Homo sapiens
cttcctcccct

SEQ ID NO: 1267232 - DNA, 14 bp, Homo sapiens
cttcctcccctcaa

SEQ ID NO: 1267233 - DNA, 21 bp, Homo sapiens
cttcctccgtccacccaggct

SEQ ID NO: 1267234 - DNA, 22 bp, Homo sapiens
cttcctccgtccacccaggctg

SEQ ID NO: 1267235 - DNA, 23 bp, Homo sapiens
cttcctccgtccacccaggctgc

SEQ ID NO: 1267236 - DNA, 13 bp, Homo sapiens
cttcctcctacct

SEQ ID NO: 1267237 - DNA, 15 bp, Homo sapiens
cttcctcctacctgg

SEQ ID NO: 1267238 - DNA, 19 bp, Homo sapiens
cttcctcctacctggggac

SEQ ID NO: 1267239 - DNA, 15 bp, Homo sapiens
cttcctcctccacag

SEQ ID NO: 1267240 - DNA, 21 bp, Homo sapiens
cttcctcctccacagtgctgc

SEQ ID NO: 1267241 - DNA, 15 bp, Homo sapiens
cttcctcctccatca

SEQ ID NO: 1267242 - DNA, 22 bp, Homo sapiens
cttcctcctccatcacctgaaa

SEQ ID NO: 1267243 - DNA, 19 bp, Homo sapiens
cttcctcctccccgctccg

SEQ ID NO: 1267244 - DNA, 14 bp, Homo sapiens
cttcctcctccctc

SEQ ID NO: 1267245 - DNA, 16 bp, Homo sapiens
cttcctcctccctcct

SEQ ID NO: 1267246 - DNA, 12 bp, Homo sapiens
cttcctcctctg

SEQ ID NO: 1267247 - DNA, 19 bp, Homo sapiens
cttcctcctgaagcctctg

SEQ ID NO: 1267248 - DNA, 22 bp, Homo sapiens
cttcctcctgatggccaagagc

SEQ ID NO: 1267249 - DNA, 13 bp, Homo sapiens
cttcctcctgcag

SEQ ID NO: 1267250 - DNA, 15 bp, Homo sapiens
cttcctcctgcagac

SEQ ID NO: 1267251 - DNA, 12 bp, Homo sapiens
cttcctcctggg

SEQ ID NO: 1267252 - DNA, 17 bp, Homo sapiens
cttcctcggtggctctg

SEQ ID NO: 1267253 - DNA, 21 bp, Homo sapiens
cttcctcggtggctctggggt

SEQ ID NO: 1267254 - DNA, 15 bp, Homo sapiens
cttcctcgtgcagag

SEQ ID NO: 1267255 - DNA, 16 bp, Homo sapiens
cttcctcgtgcagagc

SEQ ID NO: 1267256 - DNA, 15 bp, Homo sapiens
cttcctctaacattt

SEQ ID NO: 1267257 - DNA, 18 bp, Homo sapiens
cttcctctagaagccaag

SEQ ID NO: 1267258 - DNA, 20 bp, Homo sapiens
cttcctctagagtctcactg

SEQ ID NO: 1267259 - DNA, 21 bp, Homo sapiens
cttcctctccactgccttcga

SEQ ID NO: 1267260 - DNA, 16 bp, Homo sapiens
cttcctctccatacct

SEQ ID NO: 1267261 - DNA, 15 bp, Homo sapiens
cttcctctccttccc

SEQ ID NO: 1267262 - DNA, 20 bp, Homo sapiens
cttcctctcgcggccctcag

SEQ ID NO: 1267263 - DNA, 23 bp, Homo sapiens
cttcctctcggctggaagaacat

SEQ ID NO: 1267264 - DNA, 15 bp, Homo sapiens
cttcctctctccaga

SEQ ID NO: 1267265 - DNA, 23 bp, Homo sapiens
cttcctctctcggagccctcaga

SEQ ID NO: 1267266 - DNA, 16 bp, Homo sapiens
cttcctctctctacca

SEQ ID NO: 1267267 - DNA, 14 bp, Homo sapiens
cttcctctgagcct

SEQ ID NO: 1267268 - DNA, 14 bp, Homo sapiens
cttcctctgaggac

SEQ ID NO: 1267269 - DNA, 14 bp, Homo sapiens
cttcctctgcagct

SEQ ID NO: 1267270 - DNA, 12 bp, Homo sapiens
cttcctctgctg

SEQ ID NO: 1267271 - DNA, 13 bp, Homo sapiens
cttcctctgctga

SEQ ID NO: 1267272 - DNA, 16 bp, Homo sapiens
cttcctctgggcagcg

SEQ ID NO: 1267273 - DNA, 16 bp, Homo sapiens
cttcctcttcctgccc

SEQ ID NO: 1267274 - DNA, 15 bp, Homo sapiens
cttcctcttcggccc

SEQ ID NO: 1267275 - DNA, 14 bp, Homo sapiens
cttcctcttgaccc

SEQ ID NO: 1267276 - DNA, 18 bp, Homo sapiens
cttcctcttgaccctgca

SEQ ID NO: 1267277 - DNA, 19 bp, Homo sapiens
cttcctcttgaccctgcac

SEQ ID NO: 1267278 - DNA, 20 bp, Homo sapiens
cttcctcttgaccctgcacc

SEQ ID NO: 1267279 - DNA, 21 bp, Homo sapiens
cttcctcttgaccctgcaccc

SEQ ID NO: 1267280 - DNA, 22 bp, Homo sapiens
cttcctgaagggggacactcca

SEQ ID NO: 1267281 - DNA, 18 bp, Homo sapiens
cttcctgacactttaatt

SEQ ID NO: 1267282 - DNA, 22 bp, Homo sapiens
cttcctgagaaagcccacctgg

SEQ ID NO: 1267283 - DNA, 20 bp, Homo sapiens
cttcctgcaggcaggaacaa

SEQ ID NO: 1267284 - DNA, 18 bp, Homo sapiens
cttcctgccaccagtcac

SEQ ID NO: 1267285 - DNA, 21 bp, Homo sapiens
cttcctgccaccagtcactgt

SEQ ID NO: 1267286 - DNA, 12 bp, Homo sapiens
cttcctgccact

SEQ ID NO: 1267287 - DNA, 13 bp, Homo sapiens
cttcctgccactg

SEQ ID NO: 1267288 - DNA, 10 bp, Homo sapiens
cttcctgccc

SEQ ID NO: 1267289 - DNA, 15 bp, Homo sapiens
cttcctgcccctctt

SEQ ID NO: 1267290 - DNA, 17 bp, Homo sapiens
cttcctgccctacagag

SEQ ID NO: 1267291 - DNA, 12 bp, Homo sapiens
cttcctgccctt

SEQ ID NO: 1267292 - DNA, 15 bp, Homo sapiens
cttcctgcccttccc

SEQ ID NO: 1267293 - DNA, 13 bp, Homo sapiens
cttcctgcccttg

SEQ ID NO: 1267294 - DNA, 16 bp, Homo sapiens
cttcctgcccttgaac

SEQ ID NO: 1267295 - DNA, 15 bp, Homo sapiens
cttcctgcgtcctcc

SEQ ID NO: 1267296 - DNA, 16 bp, Homo sapiens
cttcctgcgtcctcct

SEQ ID NO: 1267297 - DNA, 20 bp, Homo sapiens
cttcctgcgtcctcctcacc

SEQ ID NO: 1267298 - DNA, 21 bp, Homo sapiens
cttcctgcgtcctcctcacct

SEQ ID NO: 1267299 - DNA, 14 bp, Homo sapiens
cttcctgctccttt

SEQ ID NO: 1267300 - DNA, 17 bp, Homo sapiens
cttcctgctgcaccctg

SEQ ID NO: 1267301 - DNA, 13 bp, Homo sapiens
cttcctgctgctg

SEQ ID NO: 1267302 - DNA, 14 bp, Homo sapiens
cttcctgctgctgt

SEQ ID NO: 1267303 - DNA, 15 bp, Homo sapiens
cttcctgctgctgta

SEQ ID NO: 1267304 - DNA, 22 bp, Homo sapiens
cttcctgctgctgtaactgctg

SEQ ID NO: 1267305 - DNA, 15 bp, Homo sapiens
cttcctgctgggact

SEQ ID NO: 1267306 - DNA, 14 bp, Homo sapiens
cttcctggaaacag

SEQ ID NO: 1267307 - DNA, 17 bp, Homo sapiens
cttcctggaaacagcat

SEQ ID NO: 1267308 - DNA, 13 bp, Homo sapiens
cttcctggacaca

SEQ ID NO: 1267309 - DNA, 12 bp, Homo sapiens
cttcctggacct

SEQ ID NO: 1267310 - DNA, 13 bp, Homo sapiens
cttcctggacctg

SEQ ID NO: 1267311 - DNA, 18 bp, Homo sapiens
cttcctggacctgagtcg

SEQ ID NO: 1267312 - DNA, 22 bp, Homo sapiens
cttcctggagactgcccagcta

SEQ ID NO: 1267313 - DNA, 12 bp, Homo sapiens
cttcctggccca

SEQ ID NO: 1267314 - DNA, 11 bp, Homo sapiens
cttcctggcct

SEQ ID NO: 1267315 - DNA, 12 bp, Homo sapiens
cttcctggcctc

SEQ ID NO: 1267316 - DNA, 13 bp, Homo sapiens
cttcctggcctca

SEQ ID NO: 1267317 - DNA, 14 bp, Homo sapiens
cttcctggcctcac

SEQ ID NO: 1267318 - DNA, 14 bp, Homo sapiens
cttcctggcctgag

SEQ ID NO: 1267319 - DNA, 15 bp, Homo sapiens
cttcctggcctgaga

SEQ ID NO: 1267320 - DNA, 18 bp, Homo sapiens
cttcctggctctggggga

SEQ ID NO: 1267321 - DNA, 23 bp, Homo sapiens
cttcctgggaccccctcgccagc

SEQ ID NO: 1267322 - DNA, 17 bp, Homo sapiens
cttcctgggaggacagg

SEQ ID NO: 1267323 - DNA, 23 bp, Homo sapiens
cttcctggggcatctggcgaatc

SEQ ID NO: 1267324 - DNA, 10 bp, Homo sapiens
cttcctgggt

SEQ ID NO: 1267325 - DNA, 20 bp, Homo sapiens
cttcctggtgaggcccagcc

SEQ ID NO: 1267326 - DNA, 22 bp, Homo sapiens
cttcctggtgaggcccagcctg

SEQ ID NO: 1267327 - DNA, 24 bp, Homo sapiens
cttcctggtgaggcccagcctgtc

SEQ ID NO: 1267328 - DNA, 22 bp, Homo sapiens
cttcctgtaacacaagccacag

SEQ ID NO: 1267329 - DNA, 16 bp, Homo sapiens
cttcctgtccactctc

SEQ ID NO: 1267330 - DNA, 17 bp, Homo sapiens
cttcctgtccagagaga

SEQ ID NO: 1267331 - DNA, 14 bp, Homo sapiens
cttcctgtcctgcc

SEQ ID NO: 1267332 - DNA, 18 bp, Homo sapiens
cttcctgtgatccaccca

SEQ ID NO: 1267333 - DNA, 19 bp, Homo sapiens
cttcctgtgccctcacccc

SEQ ID NO: 1267334 - DNA, 23 bp, Homo sapiens
cttcctgtgccctcaccccaatc

SEQ ID NO: 1267335 - DNA, 15 bp, Homo sapiens
cttcctgtgctaagt

SEQ ID NO: 1267336 - DNA, 21 bp, Homo sapiens
cttcctgtgctaagtctttcc

SEQ ID NO: 1267337 - DNA, 12 bp, Homo sapiens
cttcctgtgtcc

SEQ ID NO: 1267338 - DNA, 17 bp, Homo sapiens
cttcctgttcttccttc

SEQ ID NO: 1267339 - DNA, 21 bp, Homo sapiens
cttcctgttcttccttcctag

SEQ ID NO: 1267340 - DNA, 16 bp, Homo sapiens
cttcctgtttgggccc

SEQ ID NO: 1267341 - DNA, 13 bp, Homo sapiens
cttcctgtttgtt

SEQ ID NO: 1267342 - DNA, 17 bp, Homo sapiens
cttcttcccgccccacc

SEQ ID NO: 1267343 - DNA, 12 bp, Homo sapiens
cttcttccctta

SEQ ID NO: 1267344 - DNA, 16 bp, Homo sapiens
cttcttcctcacactg

SEQ ID NO: 1267345 - DNA, 23 bp, Homo sapiens
cttcttcgttaatagattatttc

SEQ ID NO: 1267346 - DNA, 16 bp, Homo sapiens
cttcttctaagaagac

SEQ ID NO: 1267347 - DNA, 17 bp, Homo sapiens
cttcttctaagaagaca

SEQ ID NO: 1267348 - DNA, 11 bp, Homo sapiens
cttcttctgcc

SEQ ID NO: 1267349 - DNA, 12 bp, Homo sapiens
cttcttctgcca

SEQ ID NO: 1267350 - DNA, 14 bp, Homo sapiens
cttcttctgccact

SEQ ID NO: 1267351 - DNA, 13 bp, Homo sapiens
cttcttctgcccc

SEQ ID NO: 1267352 - DNA, 13 bp, Homo sapiens
cttcttctgtaat

SEQ ID NO: 1267353 - DNA, 22 bp, Homo sapiens
cttcttctgtaatatttacaat

SEQ ID NO: 1267354 - DNA, 14 bp, Homo sapiens
cttcttcttcagaa

SEQ ID NO: 1267355 - DNA, 15 bp, Homo sapiens
cttcttcttccaaat

SEQ ID NO: 1267356 - DNA, 20 bp, Homo sapiens
cttcttgaaacagcctgggt

SEQ ID NO: 1267357 - DNA, 22 bp, Homo sapiens
cttcttgaaattttaacctatg

SEQ ID NO: 1267358 - DNA, 15 bp, Homo sapiens
cttcttgagcagacc

SEQ ID NO: 1267359 - DNA, 16 bp, Homo sapiens
cttcttgcactccttc

SEQ ID NO: 1267360 - DNA, 20 bp, Homo sapiens
cttcttgcactccttcccta

SEQ ID NO: 1267361 - DNA, 12 bp, Homo sapiens
cttcttgcatct

SEQ ID NO: 1267362 - DNA, 13 bp, Homo sapiens
cttcttgctgccc

SEQ ID NO: 1267363 - DNA, 14 bp, Homo sapiens
cttcttgctgccct

SEQ ID NO: 1267364 - DNA, 21 bp, Homo sapiens
cttcttgcttctttctagaaa

SEQ ID NO: 1267365 - DNA, 16 bp, Homo sapiens
cttcttggaccttggc

SEQ ID NO: 1267366 - DNA, 17 bp, Homo sapiens
cttcttggaccttggcg

SEQ ID NO: 1267367 - DNA, 15 bp, Homo sapiens
cttcttggcgctgga

SEQ ID NO: 1267368 - DNA, 12 bp, Homo sapiens
cttcttggcttc

SEQ ID NO: 1267369 - DNA, 20 bp, Homo sapiens
cttcttgggagtatgttgtc

SEQ ID NO: 1267370 - DNA, 17 bp, Homo sapiens
cttcttgggccccagac

SEQ ID NO: 1267371 - DNA, 18 bp, Homo sapiens
cttcttgggccccagacc

SEQ ID NO: 1267372 - DNA, 22 bp, Homo sapiens
cttcttgggtctgccctgccca

SEQ ID NO: 1267373 - DNA, 23 bp, Homo sapiens
cttcttgggtctgccctgcccat

SEQ ID NO: 1267374 - DNA, 16 bp, Homo sapiens
cttcttggtcttattt

SEQ ID NO: 1267375 - DNA, 15 bp, Homo sapiens
cttcttggttcctgg

SEQ ID NO: 1267376 - DNA, 17 bp, Homo sapiens
cttcttggttcctggga

SEQ ID NO: 1267377 - DNA, 18 bp, Homo sapiens
cttcttggttcctgggat

SEQ ID NO: 1267378 - DNA, 16 bp, Homo sapiens
cttcttggtttcagcc

SEQ ID NO: 1267379 - DNA, 15 bp, Homo sapiens
cttcttgtgtcctga

SEQ ID NO: 1267380 - DNA, 21 bp, Homo sapiens
cttcttgttctgagattcaat

SEQ ID NO: 1267381 - DNA, 15 bp, Homo sapiens
cttcttgtttccttg

SEQ ID NO: 1267382 - DNA, 17 bp, Homo sapiens
cttcttgtttccttgtt

SEQ ID NO: 1267383 - DNA, 15 bp, Homo sapiens
cttctttaagccata

SEQ ID NO: 1267384 - DNA, 15 bp, Homo sapiens
cttctttccctggac

SEQ ID NO: 1267385 - DNA, 14 bp, Homo sapiens
cttctttcctcttc

SEQ ID NO: 1267386 - DNA, 22 bp, Homo sapiens
cttctttcctttactcctggct

SEQ ID NO: 1267387 - DNA, 16 bp, Homo sapiens
cttctttctagaaaga

SEQ ID NO: 1267388 - DNA, 17 bp, Homo sapiens
cttctttctagagcagt

SEQ ID NO: 1267389 - DNA, 16 bp, Homo sapiens
cttcttttcctgcagg

SEQ ID NO: 1267390 - DNA, 23 bp, Homo sapiens
cttcttttgaactgttagatgct

SEQ ID NO: 1267391 - DNA, 15 bp, Homo sapiens
cttcttttgccaact

SEQ ID NO: 1267392 - DNA, 13 bp, Homo sapiens
cttcttttgctct

SEQ ID NO: 1267393 - DNA, 15 bp, Homo sapiens
cttcttttggcttcc

SEQ ID NO: 1267394 - DNA, 20 bp, Homo sapiens
cttctttttattttcttttg

SEQ ID NO: 1267395 - DNA, 17 bp, Homo sapiens
cttgaaaaagatggctt

SEQ ID NO: 1267396 - DNA, 23 bp, Homo sapiens
cttgaaaacagaatcagtgttaa

SEQ ID NO: 1267397 - DNA, 13 bp, Homo sapiens
cttgaaaactgtg

SEQ ID NO: 1267398 - DNA, 22 bp, Homo sapiens
cttgaaaataagaatagaaata

SEQ ID NO: 1267399 - DNA, 16 bp, Homo sapiens
cttgaaacagcctggg

SEQ ID NO: 1267400 - DNA, 22 bp, Homo sapiens
cttgaaagcagttaaactgatt

SEQ ID NO: 1267401 - DNA, 18 bp, Homo sapiens
cttgaaagcatccatgtg

SEQ ID NO: 1267402 - DNA, 16 bp, Homo sapiens
cttgaaaggcaggaag

SEQ ID NO: 1267403 - DNA, 16 bp, Homo sapiens
cttgaaatatataata

SEQ ID NO: 1267404 - DNA, 15 bp, Homo sapiens
cttgaaatattcaga

SEQ ID NO: 1267405 - DNA, 19 bp, Homo sapiens
cttgaaatattcagaaatt

SEQ ID NO: 1267406 - DNA, 21 bp, Homo sapiens
cttgaaatctaatatttctag

SEQ ID NO: 1267407 - DNA, 22 bp, Homo sapiens
cttgaaatgaaagtataactga

SEQ ID NO: 1267408 - DNA, 20 bp, Homo sapiens
cttgaaatgagtaaaaacta

SEQ ID NO: 1267409 - DNA, 20 bp, Homo sapiens
cttgaaattactgtgtaaat

SEQ ID NO: 1267410 - DNA, 15 bp, Homo sapiens
cttgaaattttaacc

SEQ ID NO: 1267411 - DNA, 17 bp, Homo sapiens
cttgaaattttaaccta

SEQ ID NO: 1267412 - DNA, 13 bp, Homo sapiens
cttgaacactggg

SEQ ID NO: 1267413 - DNA, 16 bp, Homo sapiens
cttgaacactggggga

SEQ ID NO: 1267414 - DNA, 23 bp, Homo sapiens
cttgaacattaatccacatgttt

SEQ ID NO: 1267415 - DNA, 24 bp, Homo sapiens
cttgaaccccctccctgtcccagg

SEQ ID NO: 1267416 - DNA, 18 bp, Homo sapiens
cttgaacctgggaagtgg

SEQ ID NO: 1267417 - DNA, 18 bp, Homo sapiens
cttgaactcctggactca

SEQ ID NO: 1267418 - DNA, 17 bp, Homo sapiens
cttgaactgaggccctg

SEQ ID NO: 1267419 - DNA, 18 bp, Homo sapiens
cttgaagaactgcaggcc

SEQ ID NO: 1267420 - DNA, 21 bp, Homo sapiens
cttgaagaaggggctgttctt

SEQ ID NO: 1267421 - DNA, 22 bp, Homo sapiens
cttgaagacagagcaaagcgcc

SEQ ID NO: 1267422 - DNA, 13 bp, Homo sapiens
cttgaagatcgtt

SEQ ID NO: 1267423 - DNA, 13 bp, Homo sapiens
cttgaagcaaatg

SEQ ID NO: 1267424 - DNA, 17 bp, Homo sapiens
cttgaagcaagaaagag

SEQ ID NO: 1267425 - DNA, 23 bp, Homo sapiens
cttgaagcatttcaaagccctgc

SEQ ID NO: 1267426 - DNA, 14 bp, Homo sapiens
cttgaagccaaaga

SEQ ID NO: 1267427 - DNA, 16 bp, Homo sapiens
cttgaagccaaagaaa

SEQ ID NO: 1267428 - DNA, 13 bp, Homo sapiens
cttgaagccaagt

SEQ ID NO: 1267429 - DNA, 16 bp, Homo sapiens
cttgaagccactgaag

SEQ ID NO: 1267430 - DNA, 21 bp, Homo sapiens
cttgaagccactgaagctggg

SEQ ID NO: 1267431 - DNA, 16 bp, Homo sapiens
cttgaaggactaatag

SEQ ID NO: 1267432 - DNA, 20 bp, Homo sapiens
cttgaaggattgcatcctgc

SEQ ID NO: 1267433 - DNA, 23 bp, Homo sapiens
cttgaaggattgcatcctgctgg

SEQ ID NO: 1267434 - DNA, 15 bp, Homo sapiens
cttgaaggccctgct

SEQ ID NO: 1267435 - DNA, 18 bp, Homo sapiens
cttgaaggccctgctgag

SEQ ID NO: 1267436 - DNA, 14 bp, Homo sapiens
cttgaagggttact

SEQ ID NO: 1267437 - DNA, 20 bp, Homo sapiens
cttgaagtggtttctaagat

SEQ ID NO: 1267438 - DNA, 10 bp, Homo sapiens
cttgaagttg

SEQ ID NO: 1267439 - DNA, 14 bp, Homo sapiens
cttgaataataagc

SEQ ID NO: 1267440 - DNA, 19 bp, Homo sapiens
cttgaatagattttctctg

SEQ ID NO: 1267441 - DNA, 22 bp, Homo sapiens
cttgaatagattttctctggaa

SEQ ID NO: 1267442 - DNA, 13 bp, Homo sapiens
cttgaatagtatt

SEQ ID NO: 1267443 - DNA, 15 bp, Homo sapiens
cttgaatataaaaaa

SEQ ID NO: 1267444 - DNA, 13 bp, Homo sapiens
cttgaatgctgcc

SEQ ID NO: 1267445 - DNA, 21 bp, Homo sapiens
cttgaatggttaataaaactg

SEQ ID NO: 1267446 - DNA, 23 bp, Homo sapiens
cttgaatggttaataaaactgca

SEQ ID NO: 1267447 - DNA, 19 bp, Homo sapiens
cttgaatgtggcttgagaa

SEQ ID NO: 1267448 - DNA, 17 bp, Homo sapiens
cttgaatgtggtctcag

SEQ ID NO: 1267449 - DNA, 13 bp, Homo sapiens
cttgaatgtttgt

SEQ ID NO: 1267450 - DNA, 20 bp, Homo sapiens
cttgaattgtaactgttctt

SEQ ID NO: 1267451 - DNA, 21 bp, Homo sapiens
cttgaattgtaactgttcttg

SEQ ID NO: 1267452 - DNA, 22 bp, Homo sapiens
cttgaattgtgtattgatgcaa

SEQ ID NO: 1267453 - DNA, 12 bp, Homo sapiens
cttgaattgtta

SEQ ID NO: 1267454 - DNA, 19 bp, Homo sapiens
cttgaattgttatgaaaat

SEQ ID NO: 1267455 - DNA, 20 bp, Homo sapiens
cttgaattgttatgaaaatc

SEQ ID NO: 1267456 - DNA, 20 bp, Homo sapiens
cttgaatttctaaaaaacag

SEQ ID NO: 1267457 - DNA, 14 bp, Homo sapiens
cttgacaacagact

SEQ ID NO: 1267458 - DNA, 22 bp, Homo sapiens
cttgacaagctgacttggcact

SEQ ID NO: 1267459 - DNA, 23 bp, Homo sapiens
cttgacacatagtttttcagtct

SEQ ID NO: 1267460 - DNA, 22 bp, Homo sapiens
cttgacacctgctgagaaaaca

SEQ ID NO: 1267461 - DNA, 15 bp, Homo sapiens
cttgacagagcagct

SEQ ID NO: 1267462 - DNA, 13 bp, Homo sapiens
cttgacagtctga

SEQ ID NO: 1267463 - DNA, 19 bp, Homo sapiens
cttgacatacctaccagta

SEQ ID NO: 1267464 - DNA, 19 bp, Homo sapiens
cttgccttcttcacccagc

SEQ ID NO: 1267465 - DNA, 17 bp, Homo sapiens
cttgcctttcgaggcct

SEQ ID NO: 1267466 - DNA, 14 bp, Homo sapiens
cttgcctttttcta

SEQ ID NO: 1267467 - DNA, 14 bp, Homo sapiens
cttgcgaatccaag

SEQ ID NO: 1267468 - DNA, 13 bp, Homo sapiens
cttgcgagtccaa

SEQ ID NO: 1267469 - DNA, 23 bp, Homo sapiens
cttgcgccgagaccgcagaggga

SEQ ID NO: 1267470 - DNA, 20 bp, Homo sapiens
cttgcgcctcagccctcagt

SEQ ID NO: 1267471 - DNA, 13 bp, Homo sapiens
cttgcgctgtccc

SEQ ID NO: 1267472 - DNA, 15 bp, Homo sapiens
cttgcgctgtcccag

SEQ ID NO: 1267473 - DNA, 16 bp, Homo sapiens
cttgcgctgtcccagg

SEQ ID NO: 1267474 - DNA, 14 bp, Homo sapiens
cttgcggaagccat

SEQ ID NO: 1267475 - DNA, 15 bp, Homo sapiens
cttgcggaagccata

SEQ ID NO: 1267476 - DNA, 14 bp, Homo sapiens
cttgcgtcctgcag

SEQ ID NO: 1267477 - DNA, 19 bp, Homo sapiens
cttgcgtcctgcagaggac

SEQ ID NO: 1267478 - DNA, 24 bp, Homo sapiens
cttgcgtcctgcagaggaccacag

SEQ ID NO: 1267479 - DNA, 13 bp, Homo sapiens
cttgctaaagcac

SEQ ID NO: 1267480 - DNA, 16 bp, Homo sapiens
cttgctaaagcacttt

SEQ ID NO: 1267481 - DNA, 13 bp, Homo sapiens
cttgctaccagta

SEQ ID NO: 1267482 - DNA, 16 bp, Homo sapiens
cttgctacctcaaggg

SEQ ID NO: 1267483 - DNA, 21 bp, Homo sapiens
cttgctacttatcatttttgt

SEQ ID NO: 1267484 - DNA, 13 bp, Homo sapiens
cttgctatgatga

SEQ ID NO: 1267485 - DNA, 16 bp, Homo sapiens
cttgctatttcaataa

SEQ ID NO: 1267486 - DNA, 21 bp, Homo sapiens
cttgctcactcactcactcca

SEQ ID NO: 1267487 - DNA, 14 bp, Homo sapiens
cttgctcagtgcct

SEQ ID NO: 1267488 - DNA, 18 bp, Homo sapiens
cttgctcagtgcctcctg

SEQ ID NO: 1267489 - DNA, 12 bp, Homo sapiens
cttgctccagat

SEQ ID NO: 1267490 - DNA, 21 bp, Homo sapiens
cttgctccagattctgatgca

SEQ ID NO: 1267491 - DNA, 14 bp, Homo sapiens
cttgctccagggtc

SEQ ID NO: 1267492 - DNA, 21 bp, Homo sapiens
cttgctccagggtcttgggct

SEQ ID NO: 1267493 - DNA, 22 bp, Homo sapiens
cttgctccagggtcttgggcta

SEQ ID NO: 1267494 - DNA, 12 bp, Homo sapiens
cttgctcccaac

SEQ ID NO: 1267495 - DNA, 15 bp, Homo sapiens
cttgctccctgtgtc

SEQ ID NO: 1267496 - DNA, 13 bp, Homo sapiens
cttgctcccttca

SEQ ID NO: 1267497 - DNA, 15 bp, Homo sapiens
cttgctcctgccaac

SEQ ID NO: 1267498 - DNA, 20 bp, Homo sapiens
cttgctcctggggagaaaga

SEQ ID NO: 1267499 - DNA, 20 bp, Homo sapiens
cttgctcgctgtaaaatctt

SEQ ID NO: 1267500 - DNA, 14 bp, Homo sapiens
cttgctctccctct

SEQ ID NO: 1267501 - DNA, 16 bp, Homo sapiens
cttgctctctctccct

SEQ ID NO: 1267502 - DNA, 19 bp, Homo sapiens
cttgctctctctccctgcc

SEQ ID NO: 1267503 - DNA, 15 bp, Homo sapiens
cttgctctcttgtga

SEQ ID NO: 1267504 - DNA, 14 bp, Homo sapiens
cttgctctgagcac

SEQ ID NO: 1267505 - DNA, 13 bp, Homo sapiens
cttgctctgtctc

SEQ ID NO: 1267506 - DNA, 12 bp, Homo sapiens
cttgctcttctt

SEQ ID NO: 1267507 - DNA, 15 bp, Homo sapiens
cttgctgaaagccaa

SEQ ID NO: 1267508 - DNA, 20 bp, Homo sapiens
cttgctgaaagccaaggcag

SEQ ID NO: 1267509 - DNA, 16 bp, Homo sapiens
cttgctgaccccaggt

SEQ ID NO: 1267510 - DNA, 23 bp, Homo sapiens
cttgctgaccccaggtcagccct

SEQ ID NO: 1267511 - DNA, 16 bp, Homo sapiens
cttgctgactctctga

SEQ ID NO: 1267512 - DNA, 18 bp, Homo sapiens
cttgctgaggggcaggga

SEQ ID NO: 1267513 - DNA, 19 bp, Homo sapiens
cttgctgaggggcagggag

SEQ ID NO: 1267514 - DNA, 23 bp, Homo sapiens
cttgctgaggggcagggagagcg

SEQ ID NO: 1267515 - DNA, 17 bp, Homo sapiens
cttgctgcactcttgca

SEQ ID NO: 1267516 - DNA, 15 bp, Homo sapiens
cttgctgcaggccct

SEQ ID NO: 1267517 - DNA, 17 bp, Homo sapiens
cttgctgcaggccctcc

SEQ ID NO: 1267518 - DNA, 20 bp, Homo sapiens
cttgctgcaggccctccctc

SEQ ID NO: 1267519 - DNA, 20 bp, Homo sapiens
cttgctgccatgatgtatat

SEQ ID NO: 1267520 - DNA, 22 bp, Homo sapiens
cttgctgctccggtttgggctg

SEQ ID NO: 1267521 - DNA, 15 bp, Homo sapiens
cttgctgctttagtc

SEQ ID NO: 1267522 - DNA, 17 bp, Homo sapiens
cttgctggacggggact

SEQ ID NO: 1267523 - DNA, 13 bp, Homo sapiens
cttgctggcccca

SEQ ID NO: 1267524 - DNA, 21 bp, Homo sapiens
cttgctggccccagccctgct

SEQ ID NO: 1267525 - DNA, 22 bp, Homo sapiens
cttgctggccccagccctgctg

SEQ ID NO: 1267526 - DNA, 22 bp, Homo sapiens
cttgctggctacgcctcttctg

SEQ ID NO: 1267527 - DNA, 12 bp, Homo sapiens
cttgctgggcca

SEQ ID NO: 1267528 - DNA, 22 bp, Homo sapiens
cttgctgggccagggaaacaaa

SEQ ID NO: 1267529 - DNA, 19 bp, Homo sapiens
cttgctggggtccagggct

SEQ ID NO: 1267530 - DNA, 23 bp, Homo sapiens
cttgctgggtacctggtccccac

SEQ ID NO: 1267531 - DNA, 13 bp, Homo sapiens
cttgctgtatgct

SEQ ID NO: 1267532 - DNA, 13 bp, Homo sapiens
cttgctgtccagg

SEQ ID NO: 1267533 - DNA, 16 bp, Homo sapiens
cttgctgtcctgatct

SEQ ID NO: 1267534 - DNA, 17 bp, Homo sapiens
cttgctgtcctgatctg

SEQ ID NO: 1267535 - DNA, 22 bp, Homo sapiens
cttgctgtctacagtagctgct

SEQ ID NO: 1267536 - DNA, 16 bp, Homo sapiens
cttgctgtctctgctc

SEQ ID NO: 1267537 - DNA, 17 bp, Homo sapiens
cttgctgtctctgctcg

SEQ ID NO: 1267538 - DNA, 20 bp, Homo sapiens
cttgctgtgtgacctgaggc

SEQ ID NO: 1267539 - DNA, 19 bp, Homo sapiens
cttgctgttgacatattta

SEQ ID NO: 1267540 - DNA, 16 bp, Homo sapiens
cttgcttaaatttctt

SEQ ID NO: 1267541 - DNA, 19 bp, Homo sapiens
cttgcttagagtgcccagc

SEQ ID NO: 1267542 - DNA, 21 bp, Homo sapiens
cttgcttagagtgcccagcag

SEQ ID NO: 1267543 - DNA, 18 bp, Homo sapiens
cttgcttagcctgtgctg

SEQ ID NO: 1267544 - DNA, 22 bp, Homo sapiens
cttgcttagtatggttctcaga

SEQ ID NO: 1267545 - DNA, 12 bp, Homo sapiens
cttgcttcagtg

SEQ ID NO: 1267546 - DNA, 13 bp, Homo sapiens
cttgcttctccca

SEQ ID NO: 1267547 - DNA, 21 bp, Homo sapiens
cttgcttctcccatttcctga

SEQ ID NO: 1267548 - DNA, 19 bp, Homo sapiens
cttgcttctctagctctct

SEQ ID NO: 1267549 - DNA, 19 bp, Homo sapiens
cttgcttcttactgataat

SEQ ID NO: 1267550 - DNA, 18 bp, Homo sapiens
cttgcttctttctagaaa

SEQ ID NO: 1267551 - DNA, 19 bp, Homo sapiens
cttgcttggaagccaggta

SEQ ID NO: 1267552 - DNA, 22 bp, Homo sapiens
cttgcttgttgggattcctgac

SEQ ID NO: 1267553 - DNA, 19 bp, Homo sapiens
cttgctttaccttttcagg

SEQ ID NO: 1267554 - DNA, 12 bp, Homo sapiens
cttgctttcctg

SEQ ID NO: 1267555 - DNA, 18 bp, Homo sapiens
cttgctttcttttttaaa

SEQ ID NO: 1267556 - DNA, 23 bp, Homo sapiens
cttgctttcttttttaaaatcaa

SEQ ID NO: 1267557 - DNA, 14 bp, Homo sapiens
cttgctttgattta

SEQ ID NO: 1267558 - DNA, 20 bp, Homo sapiens
cttgctttgtctggcctcac

SEQ ID NO: 1267559 - DNA, 18 bp, Homo sapiens
cttgcttttccctctttt

SEQ ID NO: 1267560 - DNA, 21 bp, Homo sapiens
cttgcttttccctcttttctt

SEQ ID NO: 1267561 - DNA, 20 bp, Homo sapiens
cttgcttttgcctctgccca

SEQ ID NO: 1267562 - DNA, 23 bp, Homo sapiens
cttggaaaagtggcaagaccaaa

SEQ ID NO: 1267563 - DNA, 18 bp, Homo sapiens
cttggaaacctgccctgc

SEQ ID NO: 1267564 - DNA, 21 bp, Homo sapiens
cttggaaacctgccctgcctg

SEQ ID NO: 1267565 - DNA, 22 bp, Homo sapiens
cttggaaacctgccctgcctga

SEQ ID NO: 1267566 - DNA, 23 bp, Homo sapiens
cttggaaacctgccctgcctgag

SEQ ID NO: 1267567 - DNA, 20 bp, Homo sapiens
cttggaaagcatcacctcag

SEQ ID NO: 1267568 - DNA, 21 bp, Homo sapiens
cttggaaagcatcacctcagg

SEQ ID NO: 1267569 - DNA, 14 bp, Homo sapiens
cttggaaatcaggt

SEQ ID NO: 1267570 - DNA, 17 bp, Homo sapiens
cttggaaatgtctgctg

SEQ ID NO: 1267571 - DNA, 19 bp, Homo sapiens
cttggaaatgtctgctggt

SEQ ID NO: 1267572 - DNA, 24 bp, Homo sapiens
cttggaaatgtctgctggtatttc

SEQ ID NO: 1267573 - DNA, 11 bp, Homo sapiens
cttggaactgc

SEQ ID NO: 1267574 - DNA, 13 bp, Homo sapiens
cttggaagagctc

SEQ ID NO: 1267575 - DNA, 14 bp, Homo sapiens
cttggaagagctct

SEQ ID NO: 1267576 - DNA, 12 bp, Homo sapiens
cttggaagccag

SEQ ID NO: 1267577 - DNA, 13 bp, Homo sapiens
cttggaagccagg

SEQ ID NO: 1267578 - DNA, 20 bp, Homo sapiens
cttggaattacaagccctgg

SEQ ID NO: 1267579 - DNA, 22 bp, Homo sapiens
cttggacaaacctagaattttc

SEQ ID NO: 1267580 - DNA, 17 bp, Homo sapiens
cttggacaccatcccct

SEQ ID NO: 1267581 - DNA, 14 bp, Homo sapiens
cttggacacttggt

SEQ ID NO: 1267582 - DNA, 15 bp, Homo sapiens
cttggacatcctcct

SEQ ID NO: 1267583 - DNA, 17 bp, Homo sapiens
cttggacatcctcctcc

SEQ ID NO: 1267584 - DNA, 20 bp, Homo sapiens
cttggacatcctcctcccac

SEQ ID NO: 1267585 - DNA, 19 bp, Homo sapiens
cttggacatctctctggct

SEQ ID NO: 1267586 - DNA, 15 bp, Homo sapiens
cttggttgaggaaac

SEQ ID NO: 1267587 - DNA, 13 bp, Homo sapiens
cttggttggctgg

SEQ ID NO: 1267588 - DNA, 15 bp, Homo sapiens
cttggttgtctggca

SEQ ID NO: 1267589 - DNA, 15 bp, Homo sapiens
cttggttgttaattt

SEQ ID NO: 1267590 - DNA, 17 bp, Homo sapiens
cttggtttccaaaggca

SEQ ID NO: 1267591 - DNA, 19 bp, Homo sapiens
cttggtttctctctacagt

SEQ ID NO: 1267592 - DNA, 13 bp, Homo sapiens
cttggtttgctag

SEQ ID NO: 1267593 - DNA, 20 bp, Homo sapiens
cttggtttgtaaattaactt

SEQ ID NO: 1267594 - DNA, 14 bp, Homo sapiens
cttggttttatggt

SEQ ID NO: 1267595 - DNA, 23 bp, Homo sapiens
cttggtttttttttttcttaaat

SEQ ID NO: 1267596 - DNA, 21 bp, Homo sapiens
cttgtaaaaaggggaggagaa

SEQ ID NO: 1267597 - DNA, 11 bp, Homo sapiens
cttgtaaaatg

SEQ ID NO: 1267598 - DNA, 20 bp, Homo sapiens
cttgtaaaatgcttttcact

SEQ ID NO: 1267599 - DNA, 18 bp, Homo sapiens
cttgtaaagactgtagaa

SEQ ID NO: 1267600 - DNA, 12 bp, Homo sapiens
cttgtaaataaa

SEQ ID NO: 1267601 - DNA, 16 bp, Homo sapiens
cttgtaaataaagccc

SEQ ID NO: 1267602 - DNA, 15 bp, Homo sapiens
cttgtaaatacacca

SEQ ID NO: 1267603 - DNA, 14 bp, Homo sapiens
cttgtaaatgtttc

SEQ ID NO: 1267604 - DNA, 15 bp, Homo sapiens
cttgtaaatgtttct

SEQ ID NO: 1267605 - DNA, 14 bp, Homo sapiens
cttgtaactaaaat

SEQ ID NO: 1267606 - DNA, 15 bp, Homo sapiens
cttgtaactccacca

SEQ ID NO: 1267607 - DNA, 12 bp, Homo sapiens
cttgtaatatgt

SEQ ID NO: 1267608 - DNA, 14 bp, Homo sapiens
cttgtaatatgtat

SEQ ID NO: 1267609 - DNA, 15 bp, Homo sapiens
cttgtaattctaaat

SEQ ID NO: 1267610 - DNA, 16 bp, Homo sapiens
cttgtaattctaaatg

SEQ ID NO: 1267611 - DNA, 23 bp, Homo sapiens
cttgtaattctaaatgaatgttt

SEQ ID NO: 1267612 - DNA, 12 bp, Homo sapiens
cttgtaatttaa

SEQ ID NO: 1267613 - DNA, 22 bp, Homo sapiens
cttgtaatttaaacaggcccag

SEQ ID NO: 1267614 - DNA, 22 bp, Homo sapiens
cttgtaattttacacgcttttg

SEQ ID NO: 1267615 - DNA, 16 bp, Homo sapiens
cttgtaatttttattt

SEQ ID NO: 1267616 - DNA, 20 bp, Homo sapiens
cttgtacagtgtctgtgcca

SEQ ID NO: 1267617 - DNA, 22 bp, Homo sapiens
cttgtacataatgcgtgcatac

SEQ ID NO: 1267618 - DNA, 18 bp, Homo sapiens
cttgtactaagccaggag

SEQ ID NO: 1267619 - DNA, 17 bp, Homo sapiens
cttgtactatgttaata

SEQ ID NO: 1267620 - DNA, 13 bp, Homo sapiens
cttgtacttctgt

SEQ ID NO: 1267621 - DNA, 17 bp, Homo sapiens
cttgtagaaacgaagcc

SEQ ID NO: 1267622 - DNA, 17 bp, Homo sapiens
cttgtagaactcactct

SEQ ID NO: 1267623 - DNA, 23 bp, Homo sapiens
cttgtagaactcactctgggctg

SEQ ID NO: 1267624 - DNA, 17 bp, Homo sapiens
cttgtagggatgccttt

SEQ ID NO: 1267625 - DNA, 15 bp, Homo sapiens
cttgtagtgtgtgct

SEQ ID NO: 1267626 - DNA, 21 bp, Homo sapiens
cttgtataaaatccaaaatga

SEQ ID NO: 1267627 - DNA, 20 bp, Homo sapiens
cttgtatatacgcatctata

SEQ ID NO: 1267628 - DNA, 22 bp, Homo sapiens
cttgtatatagagattgtacat

SEQ ID NO: 1267629 - DNA, 23 bp, Homo sapiens
cttgtatatagagattgtacatt

SEQ ID NO: 1267630 - DNA, 16 bp, Homo sapiens
cttgtatattccacca

SEQ ID NO: 1267631 - DNA, 18 bp, Homo sapiens
cttgtatatttgtacaaa

SEQ ID NO: 1267632 - DNA, 17 bp, Homo sapiens
cttgtatattttaagaa

SEQ ID NO: 1267633 - DNA, 16 bp, Homo sapiens
cttgtatcaaatgtta

SEQ ID NO: 1267634 - DNA, 18 bp, Homo sapiens
cttgtatcaaatgttaca

SEQ ID NO: 1267635 - DNA, 21 bp, Homo sapiens
cttgtatgaaagatggctgtg

SEQ ID NO: 1267636 - DNA, 20 bp, Homo sapiens
cttgtatgaataaaaggctg

SEQ ID NO: 1267637 - DNA, 13 bp, Homo sapiens
cttgtattaaact

SEQ ID NO: 1267638 - DNA, 14 bp, Homo sapiens
cttgtattccctta

SEQ ID NO: 1267639 - DNA, 22 bp, Homo sapiens
cttgtattccttttagcagtag

SEQ ID NO: 1267640 - DNA, 20 bp, Homo sapiens
cttgtattctctttaccttc

SEQ ID NO: 1267641 - DNA, 13 bp, Homo sapiens
cttgtatttaatt

SEQ ID NO: 1267642 - DNA, 15 bp, Homo sapiens
cttgtatttaattct

SEQ ID NO: 1267643 - DNA, 16 bp, Homo sapiens
cttgtatttaattctt

SEQ ID NO: 1267644 - DNA, 14 bp, Homo sapiens
cttgtcaaagaagg

SEQ ID NO: 1267645 - DNA, 23 bp, Homo sapiens
cttgtcaaagaaggtgctgatcc

SEQ ID NO: 1267646 - DNA, 19 bp, Homo sapiens
cttgtcaagcctgtgcaaa

SEQ ID NO: 1267647 - DNA, 18 bp, Homo sapiens
cttgtcaatactgagcca

SEQ ID NO: 1267648 - DNA, 22 bp, Homo sapiens
cttgtcaccagttaaaagcatt

SEQ ID NO: 1267649 - DNA, 23 bp, Homo sapiens
cttgtcactggtagaccaaaata

SEQ ID NO: 1267650 - DNA, 18 bp, Homo sapiens
cttgtcaggcatggctca

SEQ ID NO: 1267651 - DNA, 16 bp, Homo sapiens
cttgtcataaaatgca

SEQ ID NO: 1267652 - DNA, 22 bp, Homo sapiens
cttgtcataaaatgcatactgt

SEQ ID NO: 1267653 - DNA, 19 bp, Homo sapiens
cttgtcatatcactaaata

SEQ ID NO: 1267654 - DNA, 20 bp, Homo sapiens
cttgtcatatgtagccttca

SEQ ID NO: 1267655 - DNA, 17 bp, Homo sapiens
cttgtcatgtaccatca

SEQ ID NO: 1267656 - DNA, 14 bp, Homo sapiens
cttgtcatgtgaca

SEQ ID NO: 1267657 - DNA, 16 bp, Homo sapiens
cttgtcattgccttcg

SEQ ID NO: 1267658 - DNA, 22 bp, Homo sapiens
cttgtcccacgtgtcttccact

SEQ ID NO: 1267659 - DNA, 15 bp, Homo sapiens
cttgtcccagccagt

SEQ ID NO: 1267660 - DNA, 18 bp, Homo sapiens
cttgtccctttccctacc

SEQ ID NO: 1267661 - DNA, 18 bp, Homo sapiens
cttgtcctacgtccaagg

SEQ ID NO: 1267662 - DNA, 18 bp, Homo sapiens
cttgtcctgaagcccagc

SEQ ID NO: 1267663 - DNA, 13 bp, Homo sapiens
cttgtcctgccag

SEQ ID NO: 1267664 - DNA, 14 bp, Homo sapiens
cttgtcctgccagc

SEQ ID NO: 1267665 - DNA, 20 bp, Homo sapiens
cttgtcctgccagctgcctt

SEQ ID NO: 1267666 - DNA, 15 bp, Homo sapiens
cttgtcctgctctct

SEQ ID NO: 1267667 - DNA, 21 bp, Homo sapiens
cttgtcctgctctcttcagga

SEQ ID NO: 1267668 - DNA, 14 bp, Homo sapiens
cttgtcctggccct

SEQ ID NO: 1267669 - DNA, 16 bp, Homo sapiens
cttgtcctggcccttc

SEQ ID NO: 1267670 - DNA, 19 bp, Homo sapiens
cttgtcctggcccttcagt

SEQ ID NO: 1267671 - DNA, 16 bp, Homo sapiens
cttgtcgcgcgtctcc

SEQ ID NO: 1267672 - DNA, 15 bp, Homo sapiens
cttgtcgtgggatgg

SEQ ID NO: 1267673 - DNA, 16 bp, Homo sapiens
cttgtctataaagcat

SEQ ID NO: 1267674 - DNA, 17 bp, Homo sapiens
cttgtctataaagcatt

SEQ ID NO: 1267675 - DNA, 20 bp, Homo sapiens
cttgtctataaagcatttaa

SEQ ID NO: 1267676 - DNA, 17 bp, Homo sapiens
cttgtctatttttgtct

SEQ ID NO: 1267677 - DNA, 19 bp, Homo sapiens
cttgtctcagatggtgtgt

SEQ ID NO: 1267678 - DNA, 19 bp, Homo sapiens
cttgtctccctggttgcct

SEQ ID NO: 1267679 - DNA, 14 bp, Homo sapiens
cttgtctgaggcct

SEQ ID NO: 1267680 - DNA, 15 bp, Homo sapiens
cttgtctgaggcctc

SEQ ID NO: 1267681 - DNA, 16 bp, Homo sapiens
cttgtctgaggcctca

SEQ ID NO: 1267682 - DNA, 17 bp, Homo sapiens
cttgtctgaggcctcat

SEQ ID NO: 1267683 - DNA, 22 bp, Homo sapiens
cttgtctgaggcctcatccctc

SEQ ID NO: 1267684 - DNA, 13 bp, Homo sapiens
cttgtctgtagat

SEQ ID NO: 1267685 - DNA, 17 bp, Homo sapiens
cttgtctgtcaaatgtt

SEQ ID NO: 1267686 - DNA, 23 bp, Homo sapiens
cttgtctgtcaaatgtttcctta

SEQ ID NO: 1267687 - DNA, 12 bp, Homo sapiens
cttgtcttcccc

SEQ ID NO: 1267688 - DNA, 15 bp, Homo sapiens
cttgtcttcccccct

SEQ ID NO: 1267689 - DNA, 14 bp, Homo sapiens
cttgtcttgctctt

SEQ ID NO: 1267690 - DNA, 18 bp, Homo sapiens
cttgtcttttcagaagca

SEQ ID NO: 1267691 - DNA, 19 bp, Homo sapiens
cttgtgaattattctgatt

SEQ ID NO: 1267692 - DNA, 13 bp, Homo sapiens
cttgtgacagtgc

SEQ ID NO: 1267693 - DNA, 12 bp, Homo sapiens
cttgtgactgaa

SEQ ID NO: 1267694 - DNA, 14 bp, Homo sapiens
cttgtgactgaagg

SEQ ID NO: 1267695 - DNA, 22 bp, Homo sapiens
cttgtgattcctacccctcttc

SEQ ID NO: 1267696 - DNA, 17 bp, Homo sapiens
cttgtgattgctgccat

SEQ ID NO: 1267697 - DNA, 20 bp, Homo sapiens
cttgtgatttccatttctga

SEQ ID NO: 1267698 - DNA, 22 bp, Homo sapiens
cttgtgatttctttaaaagaat

SEQ ID NO: 1267699 - DNA, 23 bp, Homo sapiens
cttgtgatttctttaaaagaatg

SEQ ID NO: 1267700 - DNA, 21 bp, Homo sapiens
cttgtgatttggttgcacttt

SEQ ID NO: 1267701 - DNA, 21 bp, Homo sapiens
cttgtgcataattcttccaaa

SEQ ID NO: 1267702 - DNA, 13 bp, Homo sapiens
cttgtgccagccc

SEQ ID NO: 1267703 - DNA, 14 bp, Homo sapiens
cttgtgccagcccg

SEQ ID NO: 1267704 - DNA, 14 bp, Homo sapiens
cttgtgccctgccc

SEQ ID NO: 1267705 - DNA, 21 bp, Homo sapiens
cttgtgccctgcccccatctc

SEQ ID NO: 1267706 - DNA, 14 bp, Homo sapiens
cttgtgccctgggc

SEQ ID NO: 1267707 - DNA, 14 bp, Homo sapiens
cttgtgcctccctt

SEQ ID NO: 1267708 - DNA, 16 bp, Homo sapiens
ctttatctcctgctct

SEQ ID NO: 1267709 - DNA, 13 bp, Homo sapiens
ctttatctgtaat

SEQ ID NO: 1267710 - DNA, 13 bp, Homo sapiens
ctttatctgttct

SEQ ID NO: 1267711 - DNA, 13 bp, Homo sapiens
ctttatctttgtg

SEQ ID NO: 1267712 - DNA, 14 bp, Homo sapiens
ctttatctttgtgt

SEQ ID NO: 1267713 - DNA, 19 bp, Homo sapiens
ctttatgccggatgtgctt

SEQ ID NO: 1267714 - DNA, 21 bp, Homo sapiens
ctttatgctgtattttaacac

SEQ ID NO: 1267715 - DNA, 13 bp, Homo sapiens
ctttatggctgct

SEQ ID NO: 1267716 - DNA, 20 bp, Homo sapiens
ctttatgtagtttttatatg

SEQ ID NO: 1267717 - DNA, 13 bp, Homo sapiens
ctttatgtgaatt

SEQ ID NO: 1267718 - DNA, 17 bp, Homo sapiens
ctttattaaaaactgag

SEQ ID NO: 1267719 - DNA, 17 bp, Homo sapiens
ctttattaaaacaaaag

SEQ ID NO: 1267720 - DNA, 23 bp, Homo sapiens
ctttattaaaaccattgtcctaa

SEQ ID NO: 1267721 - DNA, 21 bp, Homo sapiens
ctttattaaccctctgagttt

SEQ ID NO: 1267722 - DNA, 16 bp, Homo sapiens
ctttattagctttctc

SEQ ID NO: 1267723 - DNA, 17 bp, Homo sapiens
ctttattataatcaaag

SEQ ID NO: 1267724 - DNA, 12 bp, Homo sapiens
ctttattattcc

SEQ ID NO: 1267725 - DNA, 13 bp, Homo sapiens
ctttattattcct

SEQ ID NO: 1267726 - DNA, 15 bp, Homo sapiens
ctttattcttgctgg

SEQ ID NO: 1267727 - DNA, 14 bp, Homo sapiens
ctttattgaaattc

SEQ ID NO: 1267728 - DNA, 19 bp, Homo sapiens
ctttattgaattagaaaat

SEQ ID NO: 1267729 - DNA, 16 bp, Homo sapiens
ctttattgagaaagag

SEQ ID NO: 1267730 - DNA, 19 bp, Homo sapiens
ctttattgcactaggaatt

SEQ ID NO: 1267731 - DNA, 16 bp, Homo sapiens
ctttattgcagaatgt

SEQ ID NO: 1267732 - DNA, 13 bp, Homo sapiens
ctttattgcatat

SEQ ID NO: 1267733 - DNA, 19 bp, Homo sapiens
ctttattgcccatgggata

SEQ ID NO: 1267734 - DNA, 21 bp, Homo sapiens
ctttattgcttaatttctgcc

SEQ ID NO: 1267735 - DNA, 15 bp, Homo sapiens
ctttattgtctgtaa

SEQ ID NO: 1267736 - DNA, 18 bp, Homo sapiens
ctttattgtctgtaaatc

SEQ ID NO: 1267737 - DNA, 14 bp, Homo sapiens
ctttattgtgatta

SEQ ID NO: 1267738 - DNA, 16 bp, Homo sapiens
ctttattgtgattacg

SEQ ID NO: 1267739 - DNA, 12 bp, Homo sapiens
ctttatttaaat

SEQ ID NO: 1267740 - DNA, 16 bp, Homo sapiens
ctttatttaaatgcat

SEQ ID NO: 1267741 - DNA, 21 bp, Homo sapiens
ctttatttaggaaacaccatt

SEQ ID NO: 1267742 - DNA, 14 bp, Homo sapiens
ctttatttctagca

SEQ ID NO: 1267743 - DNA, 20 bp, Homo sapiens
ctttatttctagcagagtga

SEQ ID NO: 1267744 - DNA, 16 bp, Homo sapiens
ctttatttgtaaattt

SEQ ID NO: 1267745 - DNA, 23 bp, Homo sapiens
ctttattttatataataaagtat

SEQ ID NO: 1267746 - DNA, 18 bp, Homo sapiens
ctttattttattgaaatg

SEQ ID NO: 1267747 - DNA, 18 bp, Homo sapiens
ctttattttctggtagat

SEQ ID NO: 1267748 - DNA, 18 bp, Homo sapiens
ctttattttcttctccag

SEQ ID NO: 1267749 - DNA, 14 bp, Homo sapiens
ctttatttttctat

SEQ ID NO: 1267750 - DNA, 17 bp, Homo sapiens
ctttatttttctctttc

SEQ ID NO: 1267751 - DNA, 17 bp, Homo sapiens
ctttatttttgttaata

SEQ ID NO: 1267752 - DNA, 18 bp, Homo sapiens
ctttattttttaagtatt

SEQ ID NO: 1267753 - DNA, 21 bp, Homo sapiens
ctttcaaaagaagagttttag

SEQ ID NO: 1267754 - DNA, 14 bp, Homo sapiens
ctttcaaaatatat

SEQ ID NO: 1267755 - DNA, 15 bp, Homo sapiens
ctttcaaaatatatt

SEQ ID NO: 1267756 - DNA, 18 bp, Homo sapiens
ctttcaaaatatattttg

SEQ ID NO: 1267757 - DNA, 15 bp, Homo sapiens
ctttcaaagaaggaa

SEQ ID NO: 1267758 - DNA, 21 bp, Homo sapiens
ctttcaaagaaggaattctag

SEQ ID NO: 1267759 - DNA, 21 bp, Homo sapiens
ctttcaaattgagagaatgga

SEQ ID NO: 1267760 - DNA, 21 bp, Homo sapiens
ctttcaaatttagaaactaat

SEQ ID NO: 1267761 - DNA, 15 bp, Homo sapiens
ctttcaaatttcaca

SEQ ID NO: 1267762 - DNA, 13 bp, Homo sapiens
ctttcaacatgta

SEQ ID NO: 1267763 - DNA, 18 bp, Homo sapiens
ctttcaagaactatatat

SEQ ID NO: 1267764 - DNA, 17 bp, Homo sapiens
ctttcaagatctaaatc

SEQ ID NO: 1267765 - DNA, 22 bp, Homo sapiens
ctttcaagcagtcgtgcctgtg

SEQ ID NO: 1267766 - DNA, 16 bp, Homo sapiens
ctttcaaggctggggc

SEQ ID NO: 1267767 - DNA, 17 bp, Homo sapiens
ctttcaaggctggggca

SEQ ID NO: 1267768 - DNA, 21 bp, Homo sapiens
ctttcaatatttatttccaga

SEQ ID NO: 1267769 - DNA, 22 bp, Homo sapiens
ctttcaatatttatttccagag

SEQ ID NO: 1267770 - DNA, 12 bp, Homo sapiens
ctttcaattgta

SEQ ID NO: 1267771 - DNA, 15 bp, Homo sapiens
ctttcacaaaaaaga

SEQ ID NO: 1267772 - DNA, 20 bp, Homo sapiens
ctttcacaaaattttattcc

SEQ ID NO: 1267773 - DNA, 20 bp, Homo sapiens
ctttcacaacatttgcagat

SEQ ID NO: 1267774 - DNA, 23 bp, Homo sapiens
ctttcacacatctgggtgccctg

SEQ ID NO: 1267775 - DNA, 12 bp, Homo sapiens
ctttcacagtgg

SEQ ID NO: 1267776 - DNA, 22 bp, Homo sapiens
ctttcacattgtttgctgctat

SEQ ID NO: 1267777 - DNA, 20 bp, Homo sapiens
ctttcaccaagatgggtggc

SEQ ID NO: 1267778 - DNA, 17 bp, Homo sapiens
ctttcacgggccccatt

SEQ ID NO: 1267779 - DNA, 20 bp, Homo sapiens
ctttcactaaaacacacagg

SEQ ID NO: 1267780 - DNA, 15 bp, Homo sapiens
ctttcactataatgt

SEQ ID NO: 1267781 - DNA, 15 bp, Homo sapiens
ctttcactatttcct

SEQ ID NO: 1267782 - DNA, 18 bp, Homo sapiens
ctttcactctttagaaat

SEQ ID NO: 1267783 - DNA, 17 bp, Homo sapiens
ctttcactggaatgaag

SEQ ID NO: 1267784 - DNA, 14 bp, Homo sapiens
ctttcacttcttcc

SEQ ID NO: 1267785 - DNA, 20 bp, Homo sapiens
ctttcagagaggtctcaggt

SEQ ID NO: 1267786 - DNA, 18 bp, Homo sapiens
ctttcagagccagcctgg

SEQ ID NO: 1267787 - DNA, 21 bp, Homo sapiens
ctttcagagccagcctggctc

SEQ ID NO: 1267788 - DNA, 20 bp, Homo sapiens
ctttcagagccagtgaagga

SEQ ID NO: 1267789 - DNA, 17 bp, Homo sapiens
ctttcagatgtcttctg

SEQ ID NO: 1267790 - DNA, 23 bp, Homo sapiens
ctttcagatgtcttctgcctgtt

SEQ ID NO: 1267791 - DNA, 21 bp, Homo sapiens
ctttcaggctacctttttctg

SEQ ID NO: 1267792 - DNA, 12 bp, Homo sapiens
ctttcaggtact

SEQ ID NO: 1267793 - DNA, 16 bp, Homo sapiens
ctttcaggtccaggcc

SEQ ID NO: 1267794 - DNA, 17 bp, Homo sapiens
ctttcagtcccaaagcg

SEQ ID NO: 1267795 - DNA, 21 bp, Homo sapiens
ctttcagtgcagtttcttttc

SEQ ID NO: 1267796 - DNA, 23 bp, Homo sapiens
ctttcataatttaaaaatctcca

SEQ ID NO: 1267797 - DNA, 13 bp, Homo sapiens
ctttcatacatat

SEQ ID NO: 1267798 - DNA, 20 bp, Homo sapiens
ctttcatacatatatatatt

SEQ ID NO: 1267799 - DNA, 16 bp, Homo sapiens
ctttcatagagaggcc

SEQ ID NO: 1267800 - DNA, 18 bp, Homo sapiens
ctttcatagagaggcctg

SEQ ID NO: 1267801 - DNA, 23 bp, Homo sapiens
ctttcatattttaaacagaggat

SEQ ID NO: 1267802 - DNA, 16 bp, Homo sapiens
ctttcatcctgtgtcc

SEQ ID NO: 1267803 - DNA, 17 bp, Homo sapiens
ctttcatcggtgcctgg

SEQ ID NO: 1267804 - DNA, 18 bp, Homo sapiens
ctttcatcggtgcctggt

SEQ ID NO: 1267805 - DNA, 18 bp, Homo sapiens
ctttcatcgtaaagtgct

SEQ ID NO: 1267806 - DNA, 18 bp, Homo sapiens
ctttcatctcctgagtat

SEQ ID NO: 1267807 - DNA, 19 bp, Homo sapiens
ctttcatctctctacctcc

SEQ ID NO: 1267808 - DNA, 15 bp, Homo sapiens
ctttcatcttaaact

SEQ ID NO: 1267809 - DNA, 20 bp, Homo sapiens
ctttcatgtaaactgtgcac

SEQ ID NO: 1267810 - DNA, 16 bp, Homo sapiens
ctttcatgtcttgtca

SEQ ID NO: 1267811 - DNA, 22 bp, Homo sapiens
ctttcatgtcttgtcatacaaa

SEQ ID NO: 1267812 - DNA, 16 bp, Homo sapiens
ctttcattaggcaaag

SEQ ID NO: 1267813 - DNA, 18 bp, Homo sapiens
ctttcattccttcagatt

SEQ ID NO: 1267814 - DNA, 17 bp, Homo sapiens
ctttcattgctaagact

SEQ ID NO: 1267815 - DNA, 14 bp, Homo sapiens
ctttcatttgcttt

SEQ ID NO: 1267816 - DNA, 15 bp, Homo sapiens
ctttcatttttgata

SEQ ID NO: 1267817 - DNA, 17 bp, Homo sapiens
ctttccaaaacatttct

SEQ ID NO: 1267818 - DNA, 11 bp, Homo sapiens
ctttccaaaga

SEQ ID NO: 1267819 - DNA, 16 bp, Homo sapiens
ctttccaaagtacact

SEQ ID NO: 1267820 - DNA, 22 bp, Homo sapiens
ctttccaaagtacactgtttca

SEQ ID NO: 1267821 - DNA, 21 bp, Homo sapiens
ctttccaaatacccaaatgtc

SEQ ID NO: 1267822 - DNA, 14 bp, Homo sapiens
ctttccaaattaaa

SEQ ID NO: 1267823 - DNA, 15 bp, Homo sapiens
ctttccaaattaaaa

SEQ ID NO: 1267824 - DNA, 19 bp, Homo sapiens
ctttccaaattaaaacaaa

SEQ ID NO: 1267825 - DNA, 22 bp, Homo sapiens
ctttccaaattaaaacaaatat

SEQ ID NO: 1267826 - DNA, 14 bp, Homo sapiens
ctttccaatagaaa

SEQ ID NO: 1267827 - DNA, 22 bp, Homo sapiens
ctttccaatccagaggaacaag

SEQ ID NO: 1267828 - DNA, 17 bp, Homo sapiens
ctttccaccacagccag

SEQ ID NO: 1267829 - DNA, 16 bp, Homo sapiens
ctttccaccccctccc

SEQ ID NO: 1267830 - DNA, 23 bp, Homo sapiens
ctttgggctttgcaggctctggg

SEQ ID NO: 1267831 - DNA, 20 bp, Homo sapiens
ctttggggaaagggaggaag

SEQ ID NO: 1267832 - DNA, 20 bp, Homo sapiens
ctttggggaagtttatttga

SEQ ID NO: 1267833 - DNA, 24 bp, Homo sapiens
ctttggggaagtttatttgagaaa

SEQ ID NO: 1267834 - DNA, 21 bp, Homo sapiens
ctttggggacagggggtggga

SEQ ID NO: 1267835 - DNA, 24 bp, Homo sapiens
ctttggggacagttggcagagaag

SEQ ID NO: 1267836 - DNA, 23 bp, Homo sapiens
ctttggggacttccgctccctgg

SEQ ID NO: 1267837 - DNA, 13 bp, Homo sapiens
ctttggggagcag

SEQ ID NO: 1267838 - DNA, 23 bp, Homo sapiens
ctttgggggaaacgggctccttc

SEQ ID NO: 1267839 - DNA, 18 bp, Homo sapiens
ctttgggggagtgggcgc

SEQ ID NO: 1267840 - DNA, 19 bp, Homo sapiens
ctttgggggtggaaaagga

SEQ ID NO: 1267841 - DNA, 17 bp, Homo sapiens
ctttggggtcagccagg

SEQ ID NO: 1267842 - DNA, 21 bp, Homo sapiens
ctttggggtcagccagggcca

SEQ ID NO: 1267843 - DNA, 23 bp, Homo sapiens
ctttggggtcctagcccagtgct

SEQ ID NO: 1267844 - DNA, 18 bp, Homo sapiens
ctttgggtcctgggcagg

SEQ ID NO: 1267845 - DNA, 23 bp, Homo sapiens
ctttgggtctacaagtatatgtg

SEQ ID NO: 1267846 - DNA, 10 bp, Homo sapiens
ctttggtaat

SEQ ID NO: 1267847 - DNA, 22 bp, Homo sapiens
ctttggtaattttttttgtttt

SEQ ID NO: 1267848 - DNA, 14 bp, Homo sapiens
ctttggtagaaaag

SEQ ID NO: 1267849 - DNA, 15 bp, Homo sapiens
ctttggtctattttc

SEQ ID NO: 1267850 - DNA, 14 bp, Homo sapiens
ctttggttaaaaat

SEQ ID NO: 1267851 - DNA, 15 bp, Homo sapiens
ctttggttaaaaatg

SEQ ID NO: 1267852 - DNA, 16 bp, Homo sapiens
ctttggttaaaaatgg

SEQ ID NO: 1267853 - DNA, 19 bp, Homo sapiens
ctttggttaagggctccct

SEQ ID NO: 1267854 - DNA, 19 bp, Homo sapiens
ctttggttaatacatcttt

SEQ ID NO: 1267855 - DNA, 20 bp, Homo sapiens
ctttggttccttctctgggt

SEQ ID NO: 1267856 - DNA, 19 bp, Homo sapiens
ctttggttctggccagaat

SEQ ID NO: 1267857 - DNA, 21 bp, Homo sapiens
ctttggttctggccagaatgc

SEQ ID NO: 1267858 - DNA, 17 bp, Homo sapiens
ctttggttttggaggag

SEQ ID NO: 1267859 - DNA, 11 bp, Homo sapiens
ctttggttttt

SEQ ID NO: 1267860 - DNA, 19 bp, Homo sapiens
ctttggtttttttcttctg

SEQ ID NO: 1267861 - DNA, 13 bp, Homo sapiens
ctttgtaaaatct

SEQ ID NO: 1267862 - DNA, 12 bp, Homo sapiens
ctttgtaaatag

SEQ ID NO: 1267863 - DNA, 21 bp, Homo sapiens
ctttgtaaatatcggatgggt

SEQ ID NO: 1267864 - DNA, 16 bp, Homo sapiens
ctttgtaagacatttg

SEQ ID NO: 1267865 - DNA, 13 bp, Homo sapiens
ctttgtaatggga

SEQ ID NO: 1267866 - DNA, 21 bp, Homo sapiens
ctttgtaatgtcaccaccttc

SEQ ID NO: 1267867 - DNA, 17 bp, Homo sapiens
ctttgtacgttccttct

SEQ ID NO: 1267868 - DNA, 21 bp, Homo sapiens
ctttgtactaatacagggagc

SEQ ID NO: 1267869 - DNA, 18 bp, Homo sapiens
ctttgtagaataaatggt

SEQ ID NO: 1267870 - DNA, 17 bp, Homo sapiens
ctttgtagactgtttca

SEQ ID NO: 1267871 - DNA, 13 bp, Homo sapiens
ctttgtagatcct

SEQ ID NO: 1267872 - DNA, 19 bp, Homo sapiens
ctttgtatataggcttctc

SEQ ID NO: 1267873 - DNA, 14 bp, Homo sapiens
ctttgtatattaca

SEQ ID NO: 1267874 - DNA, 16 bp, Homo sapiens
ctttgtatgacagtga

SEQ ID NO: 1267875 - DNA, 14 bp, Homo sapiens
ctttgtatgtggaa

SEQ ID NO: 1267876 - DNA, 22 bp, Homo sapiens
ctttgtatgtggaagtatacct

SEQ ID NO: 1267877 - DNA, 12 bp, Homo sapiens
ctttgtattata

SEQ ID NO: 1267878 - DNA, 17 bp, Homo sapiens
ctttgtattataaaagc

SEQ ID NO: 1267879 - DNA, 17 bp, Homo sapiens
ctttgtattctctcctg

SEQ ID NO: 1267880 - DNA, 22 bp, Homo sapiens
ctttgtattgtatattacaatg

SEQ ID NO: 1267881 - DNA, 22 bp, Homo sapiens
ctttgtcacttttccttttctt

SEQ ID NO: 1267882 - DNA, 15 bp, Homo sapiens
ctttgtcccggggct

SEQ ID NO: 1267883 - DNA, 17 bp, Homo sapiens
ctttgtcgtggttctta

SEQ ID NO: 1267884 - DNA, 20 bp, Homo sapiens
ctttgtctaactcagaatta

SEQ ID NO: 1267885 - DNA, 15 bp, Homo sapiens
ctttgtctgaaaaat

SEQ ID NO: 1267886 - DNA, 18 bp, Homo sapiens
ctttgtctgccttcccaa

SEQ ID NO: 1267887 - DNA, 16 bp, Homo sapiens
ctttgtctggatgcac

SEQ ID NO: 1267888 - DNA, 18 bp, Homo sapiens
ctttgtctggatgcacac

SEQ ID NO: 1267889 - DNA, 22 bp, Homo sapiens
ctttgtctgtacatactggcct

SEQ ID NO: 1267890 - DNA, 13 bp, Homo sapiens
ctttgtcttggac

SEQ ID NO: 1267891 - DNA, 20 bp, Homo sapiens
ctttgtcttgtacttctgtg

SEQ ID NO: 1267892 - DNA, 22 bp, Homo sapiens
ctttgtgacaggaaagccctcc

SEQ ID NO: 1267893 - DNA, 13 bp, Homo sapiens
ctttgtgagtcaa

SEQ ID NO: 1267894 - DNA, 19 bp, Homo sapiens
ctttgtgagtcaatacata

SEQ ID NO: 1267895 - DNA, 18 bp, Homo sapiens
ctttgtgattatttcact

SEQ ID NO: 1267896 - DNA, 14 bp, Homo sapiens
ctttgtgatttttg

SEQ ID NO: 1267897 - DNA, 17 bp, Homo sapiens
ctttgtgatttttgtaa

SEQ ID NO: 1267898 - DNA, 14 bp, Homo sapiens
ctttgtgcattctg

SEQ ID NO: 1267899 - DNA, 14 bp, Homo sapiens
ctttgtgcctttga

SEQ ID NO: 1267900 - DNA, 14 bp, Homo sapiens
ctttgtgcttgggg

SEQ ID NO: 1267901 - DNA, 17 bp, Homo sapiens
ctttgtgcttggggcta

SEQ ID NO: 1267902 - DNA, 22 bp, Homo sapiens
ctttgtgcttgtcattccagag

SEQ ID NO: 1267903 - DNA, 16 bp, Homo sapiens
ctttgtgctttcctga

SEQ ID NO: 1267904 - DNA, 12 bp, Homo sapiens
ctttgtggccaa

SEQ ID NO: 1267905 - DNA, 16 bp, Homo sapiens
ctttgtggccaaggag

SEQ ID NO: 1267906 - DNA, 21 bp, Homo sapiens
ctttgtggccaaggagctgct

SEQ ID NO: 1267907 - DNA, 22 bp, Homo sapiens
ctttgtggccaaggagctgcta

SEQ ID NO: 1267908 - DNA, 20 bp, Homo sapiens
ctttgtgggagggtaagaca

SEQ ID NO: 1267909 - DNA, 19 bp, Homo sapiens
ctttgtggggaagaggggc

SEQ ID NO: 1267910 - DNA, 20 bp, Homo sapiens
ctttgtgggttggccaggag

SEQ ID NO: 1267911 - DNA, 20 bp, Homo sapiens
ctttgtggtgggcgctgggg

SEQ ID NO: 1267912 - DNA, 22 bp, Homo sapiens
ctttgtggtgggcgctggggaa

SEQ ID NO: 1267913 - DNA, 17 bp, Homo sapiens
ctttgtgtaatctaagt

SEQ ID NO: 1267914 - DNA, 17 bp, Homo sapiens
ctttgtgtagctttgct

SEQ ID NO: 1267915 - DNA, 12 bp, Homo sapiens
ctttgtgtatgg

SEQ ID NO: 1267916 - DNA, 18 bp, Homo sapiens
ctttgtgtgtactcactg

SEQ ID NO: 1267917 - DNA, 15 bp, Homo sapiens
ctttgtgtgtattca

SEQ ID NO: 1267918 - DNA, 17 bp, Homo sapiens
ctttgtgtgttatattc

SEQ ID NO: 1267919 - DNA, 17 bp, Homo sapiens
ctttgtgttcatttcat

SEQ ID NO: 1267920 - DNA, 23 bp, Homo sapiens
ctttgtgtttctattgacttcaa

SEQ ID NO: 1267921 - DNA, 22 bp, Homo sapiens
ctttgttaaccttaaatacact

SEQ ID NO: 1267922 - DNA, 22 bp, Homo sapiens
ctttgttatttttgtttcttcc

SEQ ID NO: 1267923 - DNA, 14 bp, Homo sapiens
ctttgttctgagca

SEQ ID NO: 1267924 - DNA, 15 bp, Homo sapiens
ctttgttctgagcat

SEQ ID NO: 1267925 - DNA, 15 bp, Homo sapiens
ctttgttgaagtttg

SEQ ID NO: 1267926 - DNA, 20 bp, Homo sapiens
ctttgttgaagtttgaacca

SEQ ID NO: 1267927 - DNA, 21 bp, Homo sapiens
ctttgttgcaagatgtgaatt

SEQ ID NO: 1267928 - DNA, 16 bp, Homo sapiens
ctttgttgcccaggct

SEQ ID NO: 1267929 - DNA, 17 bp, Homo sapiens
ctttgttggcccttcca

SEQ ID NO: 1267930 - DNA, 19 bp, Homo sapiens
ctttgttggcccttccagt

SEQ ID NO: 1267931 - DNA, 15 bp, Homo sapiens
ctttgttgtacgcag

SEQ ID NO: 1267932 - DNA, 16 bp, Homo sapiens
ctttgttttaataaac

SEQ ID NO: 1267933 - DNA, 17 bp, Homo sapiens
ctttgttttctgactaa

SEQ ID NO: 1267934 - DNA, 24 bp, Homo sapiens
ctttgttttgatgtttgtggcctc

SEQ ID NO: 1267935 - DNA, 23 bp, Homo sapiens
ctttgttttgcacactttgccat

SEQ ID NO: 1267936 - DNA, 21 bp, Homo sapiens
cttttaaaaaacaaaaaaaga

SEQ ID NO: 1267937 - DNA, 22 bp, Homo sapiens
cttttaaaaagaaggggagaag

SEQ ID NO: 1267938 - DNA, 12 bp, Homo sapiens
cttttaaaaata

SEQ ID NO: 1267939 - DNA, 22 bp, Homo sapiens
cttttaaaagacaagacttcag

SEQ ID NO: 1267940 - DNA, 14 bp, Homo sapiens
cttttaaaataagc

SEQ ID NO: 1267941 - DNA, 17 bp, Homo sapiens
cttttaaaattcaaaag

SEQ ID NO: 1267942 - DNA, 14 bp, Homo sapiens
cttttaaactggaa

SEQ ID NO: 1267943 - DNA, 15 bp, Homo sapiens
cttttaaagaaaaaa

SEQ ID NO: 1267944 - DNA, 22 bp, Homo sapiens
cttttaaagaaaaaaattgaaa

SEQ ID NO: 1267945 - DNA, 20 bp, Homo sapiens
cttttaaagaaaaatatgat

SEQ ID NO: 1267946 - DNA, 22 bp, Homo sapiens
cttttaaaggaatgtgaaattt

SEQ ID NO: 1267947 - DNA, 22 bp, Homo sapiens
cttttaaaggggcagaaaaact

SEQ ID NO: 1267948 - DNA, 23 bp, Homo sapiens
cttttaaaggggcagaaaaactc

SEQ ID NO: 1267949 - DNA, 13 bp, Homo sapiens
cttttaaagtgtt

SEQ ID NO: 1267950 - DNA, 20 bp, Homo sapiens
cttttaaagtgttacttttt

SEQ ID NO: 1267951 - DNA, 18 bp, Homo sapiens
ctttttaaaaaactattt

SEQ ID NO: 1267952 - DNA, 16 bp, Homo sapiens
ctttttaaaaaatacc

SEQ ID NO: 1267953 - DNA, 19 bp, Homo sapiens
ctttttaaaaatagacact

SEQ ID NO: 1267954 - DNA, 12 bp, Homo sapiens
ctttttaaaata

SEQ ID NO: 1267955 - DNA, 13 bp, Homo sapiens
ctttttaaaatac

SEQ ID NO: 1267956 - DNA, 23 bp, Homo sapiens
ctttttaaagtgtttctgttatt

SEQ ID NO: 1267957 - DNA, 20 bp, Homo sapiens
ctttttaaatgtaaagatat

SEQ ID NO: 1267958 - DNA, 16 bp, Homo sapiens
ctttttaaatgtgaat

SEQ ID NO: 1267959 - DNA, 21 bp, Homo sapiens
ctttttaaatgtgaattttta

SEQ ID NO: 1267960 - DNA, 21 bp, Homo sapiens
ctttttaaccctaatctttca

SEQ ID NO: 1267961 - DNA, 20 bp, Homo sapiens
ctttttaaggtctttcagta

SEQ ID NO: 1267962 - DNA, 17 bp, Homo sapiens
ctttttaatagcactaa

SEQ ID NO: 1267963 - DNA, 17 bp, Homo sapiens
ctttttaattcaccaaa

SEQ ID NO: 1267964 - DNA, 19 bp, Homo sapiens
ctttttacagcattgtctt

SEQ ID NO: 1267965 - DNA, 21 bp, Homo sapiens
ctttttacagcattgtctttg

SEQ ID NO: 1267966 - DNA, 15 bp, Homo sapiens
ctttttacctttcat

SEQ ID NO: 1267967 - DNA, 17 bp, Homo sapiens
ctttttacctttcatac

SEQ ID NO: 1267968 - DNA, 19 bp, Homo sapiens
ctttttactccccttgagc

SEQ ID NO: 1267969 - DNA, 19 bp, Homo sapiens
ctttttataaaaagataat

SEQ ID NO: 1267970 - DNA, 14 bp, Homo sapiens
ctttttatacacaa

SEQ ID NO: 1267971 - DNA, 18 bp, Homo sapiens
ctttttatactccataca

SEQ ID NO: 1267972 - DNA, 23 bp, Homo sapiens
ctttttatgctatttctgtatat

SEQ ID NO: 1267973 - DNA, 18 bp, Homo sapiens
ctttttattccctgccca

SEQ ID NO: 1267974 - DNA, 18 bp, Homo sapiens
ctttttatttaaatgtga

SEQ ID NO: 1267975 - DNA, 18 bp, Homo sapiens
ctttttattttaggcact

SEQ ID NO: 1267976 - DNA, 19 bp, Homo sapiens
ctttttcagaaacagggca

SEQ ID NO: 1267977 - DNA, 21 bp, Homo sapiens
ctttttcagagttgctttaaa

SEQ ID NO: 1267978 - DNA, 23 bp, Homo sapiens
ctttttcatttatctataattta

SEQ ID NO: 1267979 - DNA, 17 bp, Homo sapiens
ctttttccaacaagaag

SEQ ID NO: 1267980 - DNA, 22 bp, Homo sapiens
ctttttccaactcagaaattca

SEQ ID NO: 1267981 - DNA, 12 bp, Homo sapiens
ctttttccacaa

SEQ ID NO: 1267982 - DNA, 13 bp, Homo sapiens
ctttttccagcaa

SEQ ID NO: 1267983 - DNA, 13 bp, Homo sapiens
ctttttcctactc

SEQ ID NO: 1267984 - DNA, 18 bp, Homo sapiens
ctttttcctactccgttc

SEQ ID NO: 1267985 - DNA, 16 bp, Homo sapiens
ctttttccttatttca

SEQ ID NO: 1267986 - DNA, 15 bp, Homo sapiens
ctttttccttcttca

SEQ ID NO: 1267987 - DNA, 19 bp, Homo sapiens
ctttttccttcttcagcag

SEQ ID NO: 1267988 - DNA, 21 bp, Homo sapiens
ctttttccttcttcagcagga

SEQ ID NO: 1267989 - DNA, 14 bp, Homo sapiens
ctttttctccaccc

SEQ ID NO: 1267990 - DNA, 14 bp, Homo sapiens
ctttttctccctct

SEQ ID NO: 1267991 - DNA, 17 bp, Homo sapiens
ctttttctccctctgga

SEQ ID NO: 1267992 - DNA, 14 bp, Homo sapiens
ctttttctcttctg

SEQ ID NO: 1267993 - DNA, 19 bp, Homo sapiens
ctttttctgaactccattt

SEQ ID NO: 1267994 - DNA, 13 bp, Homo sapiens
ctttttctggaaa

SEQ ID NO: 1267995 - DNA, 22 bp, Homo sapiens
ctttttctggactgaagcctgc

SEQ ID NO: 1267996 - DNA, 13 bp, Homo sapiens
ctttttctgttga

SEQ ID NO: 1267997 - DNA, 13 bp, Homo sapiens
ctttttcttccct

SEQ ID NO: 1267998 - DNA, 18 bp, Homo sapiens
ctttttctttttctttct

SEQ ID NO: 1267999 - DNA, 19 bp, Homo sapiens
ctttttctttttctttctt

SEQ ID NO: 1268000 - DNA, 12 bp, Homo sapiens
ctttttgaagtg

SEQ ID NO: 1268001 - DNA, 20 bp, Homo sapiens
ctttttgagatactattttc

SEQ ID NO: 1268002 - DNA, 22 bp, Homo sapiens
ctttttgattacagtgtagctt

SEQ ID NO: 1268003 - DNA, 20 bp, Homo sapiens
ctttttgcatgatatcttca

SEQ ID NO: 1268004 - DNA, 12 bp, Homo sapiens
ctttttgcttct

SEQ ID NO: 1268005 - DNA, 15 bp, Homo sapiens
ctttttgcttctact

SEQ ID NO: 1268006 - DNA, 18 bp, Homo sapiens
ctttttgcttctactttc

SEQ ID NO: 1268007 - DNA, 18 bp, Homo sapiens
ctttttggaatctttgta

SEQ ID NO: 1268008 - DNA, 23 bp, Homo sapiens
ctttttggtcgaggagtaacaat

SEQ ID NO: 1268009 - DNA, 12 bp, Homo sapiens
ctttttgtaaat

SEQ ID NO: 1268010 - DNA, 16 bp, Homo sapiens
ctttttgtaaatactg

SEQ ID NO: 1268011 - DNA, 15 bp, Homo sapiens
ctttttgtaatactt

SEQ ID NO: 1268012 - DNA, 12 bp, Homo sapiens
ctttttgtagag

SEQ ID NO: 1268013 - DNA, 13 bp, Homo sapiens
ctttttgtataaa

SEQ ID NO: 1268014 - DNA, 22 bp, Homo sapiens
ctttttgtataaatgacaaagt

SEQ ID NO: 1268015 - DNA, 17 bp, Homo sapiens
ctttttgtattttttcc

SEQ ID NO: 1268016 - DNA, 19 bp, Homo sapiens
ctttttgtattttttcctt

SEQ ID NO: 1268017 - DNA, 12 bp, Homo sapiens
ctttttgtgaat

SEQ ID NO: 1268018 - DNA, 15 bp, Homo sapiens
ctttttgttcagaat

SEQ ID NO: 1268019 - DNA, 17 bp, Homo sapiens
cttttttaaaaaagcaa

SEQ ID NO: 1268020 - DNA, 13 bp, Homo sapiens
cttttttaaagta

SEQ ID NO: 1268021 - DNA, 18 bp, Homo sapiens
cttttttaaatattttct

SEQ ID NO: 1268022 - DNA, 21 bp, Homo sapiens
cttttttaaccaaggaggggc

SEQ ID NO: 1268023 - DNA, 22 bp, Homo sapiens
cttttttaaccaaggaggggcc

SEQ ID NO: 1268024 - DNA, 15 bp, Homo sapiens
cttttttacacaaat

SEQ ID NO: 1268025 - DNA, 21 bp, Homo sapiens
cttttttacttagtagattaa

SEQ ID NO: 1268026 - DNA, 16 bp, Homo sapiens
cttttttatacataaa

SEQ ID NO: 1268027 - DNA, 15 bp, Homo sapiens
cttttttatagctta

SEQ ID NO: 1268028 - DNA, 18 bp, Homo sapiens
cttttttatagcttaact

SEQ ID NO: 1268029 - DNA, 18 bp, Homo sapiens
cttttttatgtgccgtgt

SEQ ID NO: 1268030 - DNA, 21 bp, Homo sapiens
cttttttattctgttttcttg

SEQ ID NO: 1268031 - DNA, 16 bp, Homo sapiens
cttttttcaatatgca

SEQ ID NO: 1268032 - DNA, 12 bp, Homo sapiens
cttttttcagtt

SEQ ID NO: 1268033 - DNA, 11 bp, Homo sapiens
cttttttctct

SEQ ID NO: 1268034 - DNA, 15 bp, Homo sapiens
cttttttctcttctg

SEQ ID NO: 1268035 - DNA, 16 bp, Homo sapiens
cttttttcttatttaa

SEQ ID NO: 1268036 - DNA, 14 bp, Homo sapiens
cttttttgtctatg

SEQ ID NO: 1268037 - DNA, 23 bp, Homo sapiens
cttttttgtctatgaagttgctg

SEQ ID NO: 1268038 - DNA, 19 bp, Homo sapiens
cttttttgtggcaattagt

SEQ ID NO: 1268039 - DNA, 13 bp, Homo sapiens
cttttttgtgtat

SEQ ID NO: 1268040 - DNA, 15 bp, Homo sapiens
cttttttgtgtatgt

SEQ ID NO: 1268041 - DNA, 17 bp, Homo sapiens
cttttttgtttgtttct

SEQ ID NO: 1268042 - DNA, 16 bp, Homo sapiens
ctttttttacatttca

SEQ ID NO: 1268043 - DNA, 13 bp, Homo sapiens
ctttttttcagtt

SEQ ID NO: 1268044 - DNA, 11 bp, Homo sapiens
ctttttttcct

SEQ ID NO: 1268045 - DNA, 21 bp, Homo sapiens
ctttttttccttcctttttat

SEQ ID NO: 1268046 - DNA, 14 bp, Homo sapiens
ctttttttctgtac

SEQ ID NO: 1268047 - DNA, 20 bp, Homo sapiens
ctttttttctgtaccagtta

SEQ ID NO: 1268048 - DNA, 15 bp, Homo sapiens
ctttttttcttaaaa

SEQ ID NO: 1268049 - DNA, 16 bp, Homo sapiens
ctttttttgagaagga

SEQ ID NO: 1268050 - DNA, 20 bp, Homo sapiens
ctttttttgagtgacagctt

SEQ ID NO: 1268051 - DNA, 23 bp, Homo sapiens
ctttttttggtataatgtttaaa

SEQ ID NO: 1268052 - DNA, 17 bp, Homo sapiens
ctttttttgtatgtgtg

SEQ ID NO: 1268053 - DNA, 13 bp, Homo sapiens
ctttttttgtgtg

SEQ ID NO: 1268054 - DNA, 21 bp, Homo sapiens
ctttttttgtgtgtatttgct

SEQ ID NO: 1268055 - DNA, 22 bp, Homo sapiens
ctttttttgtgtgtatttgcta

SEQ ID NO: 1268056 - DNA, 14 bp, Homo sapiens
ctttttttgttata

SEQ ID NO: 1268057 - DNA, 19 bp, Homo sapiens
cttttttttatataaatat

SEQ ID NO: 1268058 - DNA, 15 bp, Homo sapiens
cttttttttcatcct

SEQ ID NO: 1268059 - DNA, 15 bp, Homo sapiens
cttttttttccttct

SEQ ID NO: 1268060 - DNA, 14 bp, Homo sapiens
cttttttttcttta

SEQ ID NO: 1268061 - DNA, 15 bp, Homo sapiens
cttttttttgttttg

SEQ ID NO: 1268062 - DNA, 13 bp, Homo sapiens
ctttttttttaag

SEQ ID NO: 1268063 - DNA, 15 bp, Homo sapiens
ctttttttttctctt

SEQ ID NO: 1268064 - DNA, 21 bp, Homo sapiens
cttttttttttccaaattatt

SEQ ID NO: 1268065 - DNA, 23 bp, Homo sapiens
cttttttttttccaaattattaa

SEQ ID NO: 1268066 - DNA, 23 bp, Homo sapiens
ctttttttttttttaaagacaga

SEQ ID NO: 1268067 - DNA, 20 bp, Homo sapiens
cttttttttttttttacagt

SEQ ID NO: 1268068 - DNA, 21 bp, Homo sapiens
ctttttttttttttttgacaa

SEQ ID NO: 1268069 - DNA, 22 bp, Homo sapiens
ctttttttttttttttttggtc

SEQ ID NO: 1268070 - DNA, 17 bp, Homo sapiens
gaaaaaaaaaaaagaaa

SEQ ID NO: 1268071 - DNA, 19 bp, Homo sapiens
gaaaaaaaaaaaagaaaag

SEQ ID NO: 1268072 - DNA, 16 bp, Homo sapiens
gaaaaaaaaaaagaaa

SEQ ID NO: 1268073 - DNA, 20 bp, Homo sapiens
gaaacgtatgtgtgcaggag

SEQ ID NO: 1268074 - DNA, 16 bp, Homo sapiens
gaaacgtcttctaaac

SEQ ID NO: 1268075 - DNA, 19 bp, Homo sapiens
gaaacgtgttgtatctaca

SEQ ID NO: 1268076 - DNA, 18 bp, Homo sapiens
gaaactaaaataaattaa

SEQ ID NO: 1268077 - DNA, 15 bp, Homo sapiens
gaaactaacagataa

SEQ ID NO: 1268078 - DNA, 15 bp, Homo sapiens
gaaactaagcattgt

SEQ ID NO: 1268079 - DNA, 14 bp, Homo sapiens
gaaactaagccagg

SEQ ID NO: 1268080 - DNA, 15 bp, Homo sapiens
gaaactaagccaggc

SEQ ID NO: 1268081 - DNA, 13 bp, Homo sapiens
gaaactacaaata

SEQ ID NO: 1268082 - DNA, 22 bp, Homo sapiens
gaaactactgcctttagaaaat

SEQ ID NO: 1268083 - DNA, 23 bp, Homo sapiens
gaaactactgcctttagaaaata

SEQ ID NO: 1268084 - DNA, 14 bp, Homo sapiens
gaaactagaaatgt

SEQ ID NO: 1268085 - DNA, 13 bp, Homo sapiens
gaaactaggtctg

SEQ ID NO: 1268086 - DNA, 14 bp, Homo sapiens
gaaactatgtgttt

SEQ ID NO: 1268087 - DNA, 19 bp, Homo sapiens
gaaactatgtgtttttctc

SEQ ID NO: 1268088 - DNA, 21 bp, Homo sapiens
gaaactcacactcccctaggg

SEQ ID NO: 1268089 - DNA, 18 bp, Homo sapiens
gaaactcacctgctggcc

SEQ ID NO: 1268090 - DNA, 19 bp, Homo sapiens
gaaactcacctgctggccc

SEQ ID NO: 1268091 - DNA, 17 bp, Homo sapiens
gaaactcagatgtccaa

SEQ ID NO: 1268092 - DNA, 20 bp, Homo sapiens
gaaactccacatctgcctta

SEQ ID NO: 1268093 - DNA, 17 bp, Homo sapiens
gaaactcccctgggggt

SEQ ID NO: 1268094 - DNA, 19 bp, Homo sapiens
gaaactccgaagaaaagaa

SEQ ID NO: 1268095 - DNA, 15 bp, Homo sapiens
gaaactctaccctga

SEQ ID NO: 1268096 - DNA, 19 bp, Homo sapiens
gaaactctggctcagcctg

SEQ ID NO: 1268097 - DNA, 13 bp, Homo sapiens
gaaactctttcat

SEQ ID NO: 1268098 - DNA, 18 bp, Homo sapiens
gaaactctttcattcttc

SEQ ID NO: 1268099 - DNA, 19 bp, Homo sapiens
gaaactctttttgggctcc

SEQ ID NO: 1268100 - DNA, 13 bp, Homo sapiens
gaaactgaatgaa

SEQ ID NO: 1268101 - DNA, 19 bp, Homo sapiens
gaaactgacatgccctccc

SEQ ID NO: 1268102 - DNA, 13 bp, Homo sapiens
gaaactgctaaat

SEQ ID NO: 1268103 - DNA, 14 bp, Homo sapiens
gaaactgctaaatt

SEQ ID NO: 1268104 - DNA, 21 bp, Homo sapiens
gaaactgctaaattctatgtt

SEQ ID NO: 1268105 - DNA, 13 bp, Homo sapiens
gaaactggattaa

SEQ ID NO: 1268106 - DNA, 17 bp, Homo sapiens
gaaactggcaaagcaga

SEQ ID NO: 1268107 - DNA, 15 bp, Homo sapiens
gaaactggccccgga

SEQ ID NO: 1268108 - DNA, 16 bp, Homo sapiens
gaaactggccccggat

SEQ ID NO: 1268109 - DNA, 21 bp, Homo sapiens
gaaactgttcccacctgctgg

SEQ ID NO: 1268110 - DNA, 23 bp, Homo sapiens
gaaacttatagttaatattttgt

SEQ ID NO: 1268111 - DNA, 19 bp, Homo sapiens
gaaacttcagttgatcttc

SEQ ID NO: 1268112 - DNA, 14 bp, Homo sapiens
gaaacttgaactcc

SEQ ID NO: 1268113 - DNA, 18 bp, Homo sapiens
gaaacttggccagtttgt

SEQ ID NO: 1268114 - DNA, 17 bp, Homo sapiens
gaaacttggctggaatt

SEQ ID NO: 1268115 - DNA, 17 bp, Homo sapiens
gaaactttatttaaatg

SEQ ID NO: 1268116 - DNA, 14 bp, Homo sapiens
gaaacttttaactg

SEQ ID NO: 1268117 - DNA, 19 bp, Homo sapiens
gaaacttttaactgagaaa

SEQ ID NO: 1268118 - DNA, 14 bp, Homo sapiens
gaaacttttctaaa

SEQ ID NO: 1268119 - DNA, 15 bp, Homo sapiens
gaaacttttctagaa

SEQ ID NO: 1268120 - DNA, 18 bp, Homo sapiens
gaaacttttttatttaaa

SEQ ID NO: 1268121 - DNA, 10 bp, Homo sapiens
gaaagaaaaa

SEQ ID NO: 1268122 - DNA, 11 bp, Homo sapiens
gaaagaaaact

SEQ ID NO: 1268123 - DNA, 16 bp, Homo sapiens
gaaagaaaaggcaaaa

SEQ ID NO: 1268124 - DNA, 21 bp, Homo sapiens
gaaagaaaaggcaaaagactg

SEQ ID NO: 1268125 - DNA, 22 bp, Homo sapiens
gaaagaaaaggcaaaagactgg

SEQ ID NO: 1268126 - DNA, 22 bp, Homo sapiens
gaaagaaaataatggagaatca

SEQ ID NO: 1268127 - DNA, 20 bp, Homo sapiens
gaaagaacatggacttgtat

SEQ ID NO: 1268128 - DNA, 19 bp, Homo sapiens
gaaagaagacacagaacca

SEQ ID NO: 1268129 - DNA, 11 bp, Homo sapiens
gaaagaagaga

SEQ ID NO: 1268130 - DNA, 15 bp, Homo sapiens
gaaagaagagacagg

SEQ ID NO: 1268131 - DNA, 15 bp, Homo sapiens
gaaagaagcagttct

SEQ ID NO: 1268132 - DNA, 12 bp, Homo sapiens
gaaagaagccat

SEQ ID NO: 1268133 - DNA, 21 bp, Homo sapiens
gaaagaattatttttgtgttt

SEQ ID NO: 1268134 - DNA, 14 bp, Homo sapiens
gaaagacaggaaga

SEQ ID NO: 1268135 - DNA, 18 bp, Homo sapiens
gaaagacaggaagaccaa

SEQ ID NO: 1268136 - DNA, 23 bp, Homo sapiens
gaaagacatccataaagaagcaa

SEQ ID NO: 1268137 - DNA, 22 bp, Homo sapiens
gaaagacctacattccctctcc

SEQ ID NO: 1268138 - DNA, 20 bp, Homo sapiens
gaaagacgtttttgtgctgt

SEQ ID NO: 1268139 - DNA, 17 bp, Homo sapiens
gaaagactgaagaaagt

SEQ ID NO: 1268140 - DNA, 17 bp, Homo sapiens
gaaagactgtacaaagt

SEQ ID NO: 1268141 - DNA, 11 bp, Homo sapiens
gaaagagacca

SEQ ID NO: 1268142 - DNA, 16 bp, Homo sapiens
gaaagagcacttaaga

SEQ ID NO: 1268143 - DNA, 18 bp, Homo sapiens
gaaagagcacttaagaga

SEQ ID NO: 1268144 - DNA, 21 bp, Homo sapiens
gaaagagcacttaagagaata

SEQ ID NO: 1268145 - DNA, 23 bp, Homo sapiens
gaaagagcacttaagagaatatt

SEQ ID NO: 1268146 - DNA, 21 bp, Homo sapiens
gaaagaggaggacccctgcct

SEQ ID NO: 1268147 - DNA, 22 bp, Homo sapiens
gaaagaggaggacccctgcctt

SEQ ID NO: 1268148 - DNA, 23 bp, Homo sapiens
gaaagaggaggacccctgccttc

SEQ ID NO: 1268149 - DNA, 22 bp, Homo sapiens
gaaagaggctgaggcctggact

SEQ ID NO: 1268150 - DNA, 19 bp, Homo sapiens
gaaagagggaaaaagagct

SEQ ID NO: 1268151 - DNA, 11 bp, Homo sapiens
gaaagagggag

SEQ ID NO: 1268152 - DNA, 20 bp, Homo sapiens
gaaagagggtcccagggctg

SEQ ID NO: 1268153 - DNA, 15 bp, Homo sapiens
gaaagagtctgggac

SEQ ID NO: 1268154 - DNA, 17 bp, Homo sapiens
gaaagataataaattga

SEQ ID NO: 1268155 - DNA, 18 bp, Homo sapiens
gaaagatacaggggatca

SEQ ID NO: 1268156 - DNA, 13 bp, Homo sapiens
gaaagatgacaaa

SEQ ID NO: 1268157 - DNA, 14 bp, Homo sapiens
gaaagatggataaa

SEQ ID NO: 1268158 - DNA, 16 bp, Homo sapiens
gaaagatggataaact

SEQ ID NO: 1268159 - DNA, 22 bp, Homo sapiens
gaaagatggctgtgcctctgcc

SEQ ID NO: 1268160 - DNA, 23 bp, Homo sapiens
gaaagatggctgtgcctctgcct

SEQ ID NO: 1268161 - DNA, 19 bp, Homo sapiens
gaaagatggttaaacattt

SEQ ID NO: 1268162 - DNA, 19 bp, Homo sapiens
gaaagatgttaagcattta

SEQ ID NO: 1268163 - DNA, 17 bp, Homo sapiens
gaaagatttgttactgt

SEQ ID NO: 1268164 - DNA, 20 bp, Homo sapiens
gaaagatttgttactgtatt

SEQ ID NO: 1268165 - DNA, 19 bp, Homo sapiens
gaaagattttattgtataa

SEQ ID NO: 1268166 - DNA, 14 bp, Homo sapiens
gaaagcaaagggct

SEQ ID NO: 1268167 - DNA, 17 bp, Homo sapiens
gaaagcaacaaagaaat

SEQ ID NO: 1268168 - DNA, 18 bp, Homo sapiens
gaaagcactacaatcatg

SEQ ID NO: 1268169 - DNA, 22 bp, Homo sapiens
gaaagcagagcctcctgggaac

SEQ ID NO: 1268170 - DNA, 14 bp, Homo sapiens
gaaagcagcagcta

SEQ ID NO: 1268171 - DNA, 14 bp, Homo sapiens
gaaagcatattgac

SEQ ID NO: 1268172 - DNA, 18 bp, Homo sapiens
gaaagcatattgactttt

SEQ ID NO: 1268173 - DNA, 19 bp, Homo sapiens
gaaagcatcacctcaggcc

SEQ ID NO: 1268174 - DNA, 23 bp, Homo sapiens
gaaagcatcactgccttggcccc

SEQ ID NO: 1268175 - DNA, 21 bp, Homo sapiens
gaaagcatgtctctgcttcca

SEQ ID NO: 1268176 - DNA, 22 bp, Homo sapiens
gaaagcatgtctctgcttccat

SEQ ID NO: 1268177 - DNA, 20 bp, Homo sapiens
gaaagccaacaactctgcct

SEQ ID NO: 1268178 - DNA, 13 bp, Homo sapiens
gaaagccacctct

SEQ ID NO: 1268179 - DNA, 19 bp, Homo sapiens
gaaagccacctctccctca

SEQ ID NO: 1268180 - DNA, 20 bp, Homo sapiens
gaaagccacctctccctcaa

SEQ ID NO: 1268181 - DNA, 14 bp, Homo sapiens
gaaagccatattcc

SEQ ID NO: 1268182 - DNA, 14 bp, Homo sapiens
gaaagccatttgtt

SEQ ID NO: 1268183 - DNA, 14 bp, Homo sapiens
gaaagcccacctgg

SEQ ID NO: 1268184 - DNA, 18 bp, Homo sapiens
gaaagccctcccccttcc

SEQ ID NO: 1268185 - DNA, 17 bp, Homo sapiens
gaaagccctgagctttc

SEQ ID NO: 1268186 - DNA, 15 bp, Homo sapiens
gaaagccgggggagg

SEQ ID NO: 1268187 - DNA, 17 bp, Homo sapiens
gaaagccgggggagggg

SEQ ID NO: 1268188 - DNA, 19 bp, Homo sapiens
gaaagcctcctgccccctg

SEQ ID NO: 1268189 - DNA, 14 bp, Homo sapiens
gaaagcctctctct

SEQ ID NO: 1268190 - DNA, 15 bp, Homo sapiens
gaaagcctctgctgc

SEQ ID NO: 1268191 - DNA, 20 bp, Homo sapiens
gaaagcctgttcccctcact

SEQ ID NO: 1268192 - DNA, 17 bp, Homo sapiens
gaaagcgcctccaaccc

SEQ ID NO: 1268193 - DNA, 17 bp, Homo sapiens
gaaagcgggcagccccg

SEQ ID NO: 1268194 - DNA, 18 bp, Homo sapiens
gaaagcgggcagccccgt

SEQ ID NO: 1268195 - DNA, 16 bp, Homo sapiens
gaaattcaaaatgctc

SEQ ID NO: 1268196 - DNA, 21 bp, Homo sapiens
gaaattccagcaataagaaat

SEQ ID NO: 1268197 - DNA, 21 bp, Homo sapiens
gaaattccatacttctctcag

SEQ ID NO: 1268198 - DNA, 17 bp, Homo sapiens
gaaattcctccttcccc

SEQ ID NO: 1268199 - DNA, 12 bp, Homo sapiens
gaaattcctgta

SEQ ID NO: 1268200 - DNA, 14 bp, Homo sapiens
gaaattctcctgga

SEQ ID NO: 1268201 - DNA, 18 bp, Homo sapiens
gaaattcttgttatggta

SEQ ID NO: 1268202 - DNA, 18 bp, Homo sapiens
gaaattctttatacattc

SEQ ID NO: 1268203 - DNA, 16 bp, Homo sapiens
gaaattgaagtgtctt

SEQ ID NO: 1268204 - DNA, 19 bp, Homo sapiens
gaaattgcatttcctgaca

SEQ ID NO: 1268205 - DNA, 17 bp, Homo sapiens
gaaattggaacagaatg

SEQ ID NO: 1268206 - DNA, 16 bp, Homo sapiens
gaaattggaagagcac

SEQ ID NO: 1268207 - DNA, 18 bp, Homo sapiens
gaaattgtacatatttgt

SEQ ID NO: 1268208 - DNA, 19 bp, Homo sapiens
gaaattgtatattgtaatt

SEQ ID NO: 1268209 - DNA, 19 bp, Homo sapiens
gaaatttaaaagacactgt

SEQ ID NO: 1268210 - DNA, 14 bp, Homo sapiens
gaaatttaaactat

SEQ ID NO: 1268211 - DNA, 13 bp, Homo sapiens
gaaatttaaagca

SEQ ID NO: 1268212 - DNA, 14 bp, Homo sapiens
gaaatttaaagcag

SEQ ID NO: 1268213 - DNA, 13 bp, Homo sapiens
gaaatttaaataa

SEQ ID NO: 1268214 - DNA, 19 bp, Homo sapiens
gaaatttaaataatagaca

SEQ ID NO: 1268215 - DNA, 16 bp, Homo sapiens
gaaatttaattcatgt

SEQ ID NO: 1268216 - DNA, 21 bp, Homo sapiens
gaaatttaattcatgtttctt

SEQ ID NO: 1268217 - DNA, 15 bp, Homo sapiens
gaaatttacaaatca

SEQ ID NO: 1268218 - DNA, 16 bp, Homo sapiens
gaaatttactgtgaga

SEQ ID NO: 1268219 - DNA, 18 bp, Homo sapiens
gaaatttagagtcaattt

SEQ ID NO: 1268220 - DNA, 16 bp, Homo sapiens
gaaatttagagttcta

SEQ ID NO: 1268221 - DNA, 21 bp, Homo sapiens
gaaatttatgaagcagattta

SEQ ID NO: 1268222 - DNA, 21 bp, Homo sapiens
gaaatttattagttaatatat

SEQ ID NO: 1268223 - DNA, 18 bp, Homo sapiens
gaaatttcacatagccca

SEQ ID NO: 1268224 - DNA, 18 bp, Homo sapiens
gaaatttcatgattggct

SEQ ID NO: 1268225 - DNA, 11 bp, Homo sapiens
gaaatttgaat

SEQ ID NO: 1268226 - DNA, 13 bp, Homo sapiens
gaaatttggtacc

SEQ ID NO: 1268227 - DNA, 14 bp, Homo sapiens
gaaatttgtttgta

SEQ ID NO: 1268228 - DNA, 15 bp, Homo sapiens
gaaattttacaatag

SEQ ID NO: 1268229 - DNA, 19 bp, Homo sapiens
gaaattttatatgtaaatg

SEQ ID NO: 1268230 - DNA, 21 bp, Homo sapiens
gaaattttatatgtaaatgtg

SEQ ID NO: 1268231 - DNA, 16 bp, Homo sapiens
gaaattttatgaagtt

SEQ ID NO: 1268232 - DNA, 12 bp, Homo sapiens
gaaattttgtaa

SEQ ID NO: 1268233 - DNA, 17 bp, Homo sapiens
gaaatttttcttcttga

SEQ ID NO: 1268234 - DNA, 15 bp, Homo sapiens
gaacaaaacctacac

SEQ ID NO: 1268235 - DNA, 23 bp, Homo sapiens
gaacaaaactgttcttttgcatt

SEQ ID NO: 1268236 - DNA, 14 bp, Homo sapiens
gaacaaagcagcca

SEQ ID NO: 1268237 - DNA, 16 bp, Homo sapiens
gaacaaagcagccacg

SEQ ID NO: 1268238 - DNA, 19 bp, Homo sapiens
gaacaaagcagccacgagg

SEQ ID NO: 1268239 - DNA, 15 bp, Homo sapiens
gaacaaagctgttaa

SEQ ID NO: 1268240 - DNA, 21 bp, Homo sapiens
gaacaaagctgttaaactgtt

SEQ ID NO: 1268241 - DNA, 22 bp, Homo sapiens
gaacaaagctgttaaactgtta

SEQ ID NO: 1268242 - DNA, 19 bp, Homo sapiens
gaacaaatcgtttctcaga

SEQ ID NO: 1268243 - DNA, 20 bp, Homo sapiens
gaacaaatgtgtttttctat

SEQ ID NO: 1268244 - DNA, 21 bp, Homo sapiens
gaacaaatgtgtttttctata

SEQ ID NO: 1268245 - DNA, 21 bp, Homo sapiens
gaacaacagtagtttctcagg

SEQ ID NO: 1268246 - DNA, 13 bp, Homo sapiens
gaacaacttgcta

SEQ ID NO: 1268247 - DNA, 15 bp, Homo sapiens
gaacaacttgtagca

SEQ ID NO: 1268248 - DNA, 16 bp, Homo sapiens
gaacaagacagccttc

SEQ ID NO: 1268249 - DNA, 18 bp, Homo sapiens
gaacaagacagccttcac

SEQ ID NO: 1268250 - DNA, 16 bp, Homo sapiens
gaacaagcatgtctct

SEQ ID NO: 1268251 - DNA, 17 bp, Homo sapiens
gaacaagcatgtctctc

SEQ ID NO: 1268252 - DNA, 14 bp, Homo sapiens
gaacaagctggctt

SEQ ID NO: 1268253 - DNA, 13 bp, Homo sapiens
gaacaagcttcag

SEQ ID NO: 1268254 - DNA, 19 bp, Homo sapiens
gaacaagtcacagctgcag

SEQ ID NO: 1268255 - DNA, 22 bp, Homo sapiens
gaacaagtccctgtaattgttg

SEQ ID NO: 1268256 - DNA, 21 bp, Homo sapiens
gaacaagttgtttcattgact

SEQ ID NO: 1268257 - DNA, 12 bp, Homo sapiens
gaacaagtttta

SEQ ID NO: 1268258 - DNA, 16 bp, Homo sapiens
gaacaatattttatgg

SEQ ID NO: 1268259 - DNA, 14 bp, Homo sapiens
gaacaatcaaagca

SEQ ID NO: 1268260 - DNA, 21 bp, Homo sapiens
gaacaatgtgctatgtgaaga

SEQ ID NO: 1268261 - DNA, 21 bp, Homo sapiens
gaacaattcggtggtaaaagt

SEQ ID NO: 1268262 - DNA, 13 bp, Homo sapiens
gaacaattgaagt

SEQ ID NO: 1268263 - DNA, 17 bp, Homo sapiens
gaacaattgaagtaaac

SEQ ID NO: 1268264 - DNA, 15 bp, Homo sapiens
gaacaatttggcaat

SEQ ID NO: 1268265 - DNA, 14 bp, Homo sapiens
gaacacaaaacatt

SEQ ID NO: 1268266 - DNA, 16 bp, Homo sapiens
gaacacaaaacattta

SEQ ID NO: 1268267 - DNA, 16 bp, Homo sapiens
gaacacacacatatac

SEQ ID NO: 1268268 - DNA, 12 bp, Homo sapiens
gaacacacacgc

SEQ ID NO: 1268269 - DNA, 21 bp, Homo sapiens
gaacacacagactttctgtga

SEQ ID NO: 1268270 - DNA, 12 bp, Homo sapiens
gaacacagtgtc

SEQ ID NO: 1268271 - DNA, 15 bp, Homo sapiens
gaacacatttctctg

SEQ ID NO: 1268272 - DNA, 22 bp, Homo sapiens
gaacacctgccttctaccctct

SEQ ID NO: 1268273 - DNA, 23 bp, Homo sapiens
gaacacctggccgggtcaccctg

SEQ ID NO: 1268274 - DNA, 23 bp, Homo sapiens
gaacaccttggggtccctccacc

SEQ ID NO: 1268275 - DNA, 14 bp, Homo sapiens
gaacacgattttca

SEQ ID NO: 1268276 - DNA, 14 bp, Homo sapiens
gaacacggccacat

SEQ ID NO: 1268277 - DNA, 22 bp, Homo sapiens
gaacacggccacatcaaagagg

SEQ ID NO: 1268278 - DNA, 14 bp, Homo sapiens
gaacactggacaac

SEQ ID NO: 1268279 - DNA, 22 bp, Homo sapiens
gaacactggcttgaaggactgc

SEQ ID NO: 1268280 - DNA, 16 bp, Homo sapiens
gaacactgggggaggg

SEQ ID NO: 1268281 - DNA, 18 bp, Homo sapiens
gaacactgggggagggga

SEQ ID NO: 1268282 - DNA, 18 bp, Homo sapiens
gaacactgtcatcaatgt

SEQ ID NO: 1268283 - DNA, 22 bp, Homo sapiens
gaacactttcagtttcaggagt

SEQ ID NO: 1268284 - DNA, 18 bp, Homo sapiens
gaacagaaaacaacaaaa

SEQ ID NO: 1268285 - DNA, 21 bp, Homo sapiens
gaacagaaaacaacaaaagaa

SEQ ID NO: 1268286 - DNA, 23 bp, Homo sapiens
gaacagaacatagacagaagaaa

SEQ ID NO: 1268287 - DNA, 15 bp, Homo sapiens
gaacagacaggagaa

SEQ ID NO: 1268288 - DNA, 13 bp, Homo sapiens
gaacagacctgag

SEQ ID NO: 1268289 - DNA, 20 bp, Homo sapiens
gaacagagagacccttgtgg

SEQ ID NO: 1268290 - DNA, 17 bp, Homo sapiens
gaacagaggcatttaaa

SEQ ID NO: 1268291 - DNA, 15 bp, Homo sapiens
gaacagagggccaga

SEQ ID NO: 1268292 - DNA, 22 bp, Homo sapiens
gaacagatcttttactttggcc

SEQ ID NO: 1268293 - DNA, 21 bp, Homo sapiens
gaacagatgtttcttttgtat

SEQ ID NO: 1268294 - DNA, 14 bp, Homo sapiens
gaacagcgggagac

SEQ ID NO: 1268295 - DNA, 22 bp, Homo sapiens
gaacagctatcacgttgaacca

SEQ ID NO: 1268296 - DNA, 23 bp, Homo sapiens
gaacagctatgggagccccaggg

SEQ ID NO: 1268297 - DNA, 19 bp, Homo sapiens
gaacagctctgagatcctg

SEQ ID NO: 1268298 - DNA, 21 bp, Homo sapiens
gaacagctctgagatcctgga

SEQ ID NO: 1268299 - DNA, 23 bp, Homo sapiens
gaacagctgtgagccatgcctcc

SEQ ID NO: 1268300 - DNA, 14 bp, Homo sapiens
gaacagctgtgtct

SEQ ID NO: 1268301 - DNA, 15 bp, Homo sapiens
gaacagctgtgtctg

SEQ ID NO: 1268302 - DNA, 17 bp, Homo sapiens
gaacaggccccacgccc

SEQ ID NO: 1268303 - DNA, 15 bp, Homo sapiens
gaacaggctggggcc

SEQ ID NO: 1268304 - DNA, 20 bp, Homo sapiens
gaacagggaaaataggcagg

SEQ ID NO: 1268305 - DNA, 13 bp, Homo sapiens
gaacagggcccag

SEQ ID NO: 1268306 - DNA, 19 bp, Homo sapiens
gaacagggtgcaggagagg

SEQ ID NO: 1268307 - DNA, 13 bp, Homo sapiens
gaacagtaaacat

SEQ ID NO: 1268308 - DNA, 13 bp, Homo sapiens
gaacagtggctgg

SEQ ID NO: 1268309 - DNA, 17 bp, Homo sapiens
gaacagtggctgggtgg

SEQ ID NO: 1268310 - DNA, 18 bp, Homo sapiens
gaacagtggctgggtggg

SEQ ID NO: 1268311 - DNA, 22 bp, Homo sapiens
gaacagtggctgggtgggccca

SEQ ID NO: 1268312 - DNA, 23 bp, Homo sapiens
gaacagtggctgggtgggcccag

SEQ ID NO: 1268313 - DNA, 21 bp, Homo sapiens
gaacagtggtggcaacattca

SEQ ID NO: 1268314 - DNA, 23 bp, Homo sapiens
gaacagtgtggtttgggaaagat

SEQ ID NO: 1268315 - DNA, 16 bp, Homo sapiens
gaacagtgtttcccat

SEQ ID NO: 1268316 - DNA, 14 bp, Homo sapiens
gaacataaaaagga

SEQ ID NO: 1268317 - DNA, 22 bp, Homo sapiens
gaagagcagcctgatggccaag

SEQ ID NO: 1268318 - DNA, 18 bp, Homo sapiens
gaagagcaggactccagg

SEQ ID NO: 1268319 - DNA, 18 bp, Homo sapiens
gaagagcaggcacatgga

SEQ ID NO: 1268320 - DNA, 10 bp, Homo sapiens
gaagagccac

SEQ ID NO: 1268321 - DNA, 14 bp, Homo sapiens
gaagagccacctgc

SEQ ID NO: 1268322 - DNA, 15 bp, Homo sapiens
gaagagccacctgca

SEQ ID NO: 1268323 - DNA, 16 bp, Homo sapiens
gaagagccacctgcaa

SEQ ID NO: 1268324 - DNA, 17 bp, Homo sapiens
gaagagccacctgcaag

SEQ ID NO: 1268325 - DNA, 22 bp, Homo sapiens
gaagagccacctgcaagatgga

SEQ ID NO: 1268326 - DNA, 14 bp, Homo sapiens
gaagagcccagtct

SEQ ID NO: 1268327 - DNA, 23 bp, Homo sapiens
gaagagcccgcagggccatgcag

SEQ ID NO: 1268328 - DNA, 22 bp, Homo sapiens
gaagagcccgccgtctgcaggg

SEQ ID NO: 1268329 - DNA, 13 bp, Homo sapiens
gaagagcctgaag

SEQ ID NO: 1268330 - DNA, 20 bp, Homo sapiens
gaagagcctgaagctggcct

SEQ ID NO: 1268331 - DNA, 12 bp, Homo sapiens
gaagagccttgc

SEQ ID NO: 1268332 - DNA, 17 bp, Homo sapiens
gaagagctattatataa

SEQ ID NO: 1268333 - DNA, 12 bp, Homo sapiens
gaagagctcccc

SEQ ID NO: 1268334 - DNA, 16 bp, Homo sapiens
gaagagctcccctcca

SEQ ID NO: 1268335 - DNA, 14 bp, Homo sapiens
gaagagcttgcaca

SEQ ID NO: 1268336 - DNA, 16 bp, Homo sapiens
gaagagcttgctttga

SEQ ID NO: 1268337 - DNA, 12 bp, Homo sapiens
gaagaggaacca

SEQ ID NO: 1268338 - DNA, 17 bp, Homo sapiens
gaagaggactgtgtgag

SEQ ID NO: 1268339 - DNA, 14 bp, Homo sapiens
gaagaggaggagga

SEQ ID NO: 1268340 - DNA, 20 bp, Homo sapiens
gaagaggaggaggtgggggc

SEQ ID NO: 1268341 - DNA, 20 bp, Homo sapiens
gaagaggatgagcagaggga

SEQ ID NO: 1268342 - DNA, 23 bp, Homo sapiens
gaagaggcctaagtcaaaacttg

SEQ ID NO: 1268343 - DNA, 17 bp, Homo sapiens
gaagaggcgggccagcc

SEQ ID NO: 1268344 - DNA, 19 bp, Homo sapiens
gaagaggcgggccagccag

SEQ ID NO: 1268345 - DNA, 16 bp, Homo sapiens
gaagaggctggtgctg

SEQ ID NO: 1268346 - DNA, 19 bp, Homo sapiens
gaagagggcagtacctggg

SEQ ID NO: 1268347 - DNA, 18 bp, Homo sapiens
gaagagggcccagcccag

SEQ ID NO: 1268348 - DNA, 19 bp, Homo sapiens
gaagagggcccagcccaga

SEQ ID NO: 1268349 - DNA, 17 bp, Homo sapiens
gaagaggggaggggcct

SEQ ID NO: 1268350 - DNA, 20 bp, Homo sapiens
gaagaggggtgcagaggctg

SEQ ID NO: 1268351 - DNA, 21 bp, Homo sapiens
gaagaggtagtgtgaatatta

SEQ ID NO: 1268352 - DNA, 19 bp, Homo sapiens
gaagaggtccttggttggg

SEQ ID NO: 1268353 - DNA, 14 bp, Homo sapiens
gaagagtcctctga

SEQ ID NO: 1268354 - DNA, 20 bp, Homo sapiens
gaagagtttaaagagaaaag

SEQ ID NO: 1268355 - DNA, 20 bp, Homo sapiens
gaagagtttttgtgatgggg

SEQ ID NO: 1268356 - DNA, 23 bp, Homo sapiens
gaagagtttttgtgatgggggag

SEQ ID NO: 1268357 - DNA, 19 bp, Homo sapiens
gaagatacactgagattga

SEQ ID NO: 1268358 - DNA, 15 bp, Homo sapiens
gaagataggctctgc

SEQ ID NO: 1268359 - DNA, 21 bp, Homo sapiens
gaagatagtcttggaagctgt

SEQ ID NO: 1268360 - DNA, 15 bp, Homo sapiens
gaagatatacatgaa

SEQ ID NO: 1268361 - DNA, 13 bp, Homo sapiens
gaagatattattt

SEQ ID NO: 1268362 - DNA, 14 bp, Homo sapiens
gaagatcccccaga

SEQ ID NO: 1268363 - DNA, 14 bp, Homo sapiens
gaagatcctgcggg

SEQ ID NO: 1268364 - DNA, 18 bp, Homo sapiens
gaagatcgttagtatcta

SEQ ID NO: 1268365 - DNA, 21 bp, Homo sapiens
gaagatctaccccagggagaa

SEQ ID NO: 1268366 - DNA, 21 bp, Homo sapiens
gaagatcttgatggtgtttct

SEQ ID NO: 1268367 - DNA, 20 bp, Homo sapiens
gaagatgaaatatatattgt

SEQ ID NO: 1268368 - DNA, 14 bp, Homo sapiens
gaagatgaatcaat

SEQ ID NO: 1268369 - DNA, 13 bp, Homo sapiens
gaagatgatcaga

SEQ ID NO: 1268370 - DNA, 17 bp, Homo sapiens
gaagatgccagcttctc

SEQ ID NO: 1268371 - DNA, 17 bp, Homo sapiens
gaagatgcccctgctcc

SEQ ID NO: 1268372 - DNA, 16 bp, Homo sapiens
gaagatgcctgttaat

SEQ ID NO: 1268373 - DNA, 20 bp, Homo sapiens
gaagatggcatcctgtgaag

SEQ ID NO: 1268374 - DNA, 21 bp, Homo sapiens
gaagatggctcccaaggttcc

SEQ ID NO: 1268375 - DNA, 19 bp, Homo sapiens
gaagatggtccgtgcccag

SEQ ID NO: 1268376 - DNA, 16 bp, Homo sapiens
gaagatggtgaagaca

SEQ ID NO: 1268377 - DNA, 19 bp, Homo sapiens
gaagatggtttcaattcag

SEQ ID NO: 1268378 - DNA, 16 bp, Homo sapiens
gaagatgtctcctcaa

SEQ ID NO: 1268379 - DNA, 17 bp, Homo sapiens
gaagatgtctcctcaag

SEQ ID NO: 1268380 - DNA, 21 bp, Homo sapiens
gaagatgtgtaaacaggtatt

SEQ ID NO: 1268381 - DNA, 15 bp, Homo sapiens
gaagatgtttcaaaa

SEQ ID NO: 1268382 - DNA, 19 bp, Homo sapiens
gaagattaggagaaacaca

SEQ ID NO: 1268383 - DNA, 18 bp, Homo sapiens
gaagattattttttaaaa

SEQ ID NO: 1268384 - DNA, 12 bp, Homo sapiens
gaagatttacct

SEQ ID NO: 1268385 - DNA, 17 bp, Homo sapiens
gaagattttggtaatga

SEQ ID NO: 1268386 - DNA, 18 bp, Homo sapiens
gaagcaaaaattcacaaa

SEQ ID NO: 1268387 - DNA, 13 bp, Homo sapiens
gaagcaaagacaa

SEQ ID NO: 1268388 - DNA, 15 bp, Homo sapiens
gaagcaaagacaaaa

SEQ ID NO: 1268389 - DNA, 22 bp, Homo sapiens
gaagcaaagacaaaagaaactt

SEQ ID NO: 1268390 - DNA, 17 bp, Homo sapiens
gaagcaaagatttcagt

SEQ ID NO: 1268391 - DNA, 16 bp, Homo sapiens
gaagcaaagcaccagc

SEQ ID NO: 1268392 - DNA, 18 bp, Homo sapiens
gaagcaaaggggggaggt

SEQ ID NO: 1268393 - DNA, 17 bp, Homo sapiens
gaagcaaatcgaatgaa

SEQ ID NO: 1268394 - DNA, 20 bp, Homo sapiens
gaagcaacctcagtaattta

SEQ ID NO: 1268395 - DNA, 22 bp, Homo sapiens
gaagcaacctcagtaatttaga

SEQ ID NO: 1268396 - DNA, 15 bp, Homo sapiens
gaagcaagaaagagg

SEQ ID NO: 1268397 - DNA, 23 bp, Homo sapiens
gaagcaagaggcaagctgaaatt

SEQ ID NO: 1268398 - DNA, 16 bp, Homo sapiens
gaagcaagccagacct

SEQ ID NO: 1268399 - DNA, 17 bp, Homo sapiens
gaagcaagccagaccta

SEQ ID NO: 1268400 - DNA, 13 bp, Homo sapiens
gaagcaaggaaga

SEQ ID NO: 1268401 - DNA, 23 bp, Homo sapiens
gaagcaaggaagatatacatgaa

SEQ ID NO: 1268402 - DNA, 15 bp, Homo sapiens
gaagcaagggcaaga

SEQ ID NO: 1268403 - DNA, 17 bp, Homo sapiens
gaagcaataactccaag

SEQ ID NO: 1268404 - DNA, 20 bp, Homo sapiens
gaagcaataactccaagcag

SEQ ID NO: 1268405 - DNA, 17 bp, Homo sapiens
gaagcaatctttgaaat

SEQ ID NO: 1268406 - DNA, 20 bp, Homo sapiens
gaagcaattatttaaagaaa

SEQ ID NO: 1268407 - DNA, 21 bp, Homo sapiens
gaagcaattatttaaagaaag

SEQ ID NO: 1268408 - DNA, 22 bp, Homo sapiens
gaagcaattatttaaagaaagt

SEQ ID NO: 1268409 - DNA, 15 bp, Homo sapiens
gaagcacaactccct

SEQ ID NO: 1268410 - DNA, 20 bp, Homo sapiens
gaagcacagagggctaggga

SEQ ID NO: 1268411 - DNA, 19 bp, Homo sapiens
gaagcacagctcctgccag

SEQ ID NO: 1268412 - DNA, 20 bp, Homo sapiens
gaagcacagctcctgccagg

SEQ ID NO: 1268413 - DNA, 16 bp, Homo sapiens
gaagcaccccatgcca

SEQ ID NO: 1268414 - DNA, 20 bp, Homo sapiens
gaagcacctactatgtgctg

SEQ ID NO: 1268415 - DNA, 22 bp, Homo sapiens
gaagcacttaagtcttccttaa

SEQ ID NO: 1268416 - DNA, 22 bp, Homo sapiens
gaagcagaaatatagtgcaata

SEQ ID NO: 1268417 - DNA, 12 bp, Homo sapiens
gaagcagagaga

SEQ ID NO: 1268418 - DNA, 19 bp, Homo sapiens
gaagcagcaaatgaaagaa

SEQ ID NO: 1268419 - DNA, 22 bp, Homo sapiens
gaagcagcagccaccagggagt

SEQ ID NO: 1268420 - DNA, 22 bp, Homo sapiens
gaagcagcctctccccaggtcc

SEQ ID NO: 1268421 - DNA, 12 bp, Homo sapiens
gaagcaggctgg

SEQ ID NO: 1268422 - DNA, 20 bp, Homo sapiens
gaagcagggaattcctgggg

SEQ ID NO: 1268423 - DNA, 12 bp, Homo sapiens
gaagcaggtgct

SEQ ID NO: 1268424 - DNA, 17 bp, Homo sapiens
gaagcaggttcttgatg

SEQ ID NO: 1268425 - DNA, 19 bp, Homo sapiens
gaagcaggttgaggggctc

SEQ ID NO: 1268426 - DNA, 13 bp, Homo sapiens
gaagcagtatttt

SEQ ID NO: 1268427 - DNA, 23 bp, Homo sapiens
gaagcagtcgtggctttggcagt

SEQ ID NO: 1268428 - DNA, 16 bp, Homo sapiens
gaagcagtgagccgca

SEQ ID NO: 1268429 - DNA, 16 bp, Homo sapiens
gaagcagtgcctcgag

SEQ ID NO: 1268430 - DNA, 18 bp, Homo sapiens
gaagcagtgtgagcaggg

SEQ ID NO: 1268431 - DNA, 17 bp, Homo sapiens
gaagcagttggggccct

SEQ ID NO: 1268432 - DNA, 13 bp, Homo sapiens
gaagcagttgtgt

SEQ ID NO: 1268433 - DNA, 15 bp, Homo sapiens
gaagcataatttgtt

SEQ ID NO: 1268434 - DNA, 20 bp, Homo sapiens
gaagcatagctacaatttgt

SEQ ID NO: 1268435 - DNA, 21 bp, Homo sapiens
gaagcatagctacaatttgtt

SEQ ID NO: 1268436 - DNA, 14 bp, Homo sapiens
gaagcatggctgtc

SEQ ID NO: 1268437 - DNA, 16 bp, Homo sapiens
gaagcatggctgtctg

SEQ ID NO: 1268438 - DNA, 22 bp, Homo sapiens
gaagcatggctgtctgcacaga

SEQ ID NO: 1268439 - DNA, 23 bp, Homo sapiens
gaaggggcacaccactgccctgc

SEQ ID NO: 1268440 - DNA, 14 bp, Homo sapiens
gaaggggccagagg

SEQ ID NO: 1268441 - DNA, 20 bp, Homo sapiens
gaaggggccccggggctggc

SEQ ID NO: 1268442 - DNA, 21 bp, Homo sapiens
gaaggggccccggggctggca

SEQ ID NO: 1268443 - DNA, 16 bp, Homo sapiens
gaaggggcctccctcc

SEQ ID NO: 1268444 - DNA, 22 bp, Homo sapiens
gaagggggccatgaggcctcag

SEQ ID NO: 1268445 - DNA, 15 bp, Homo sapiens
gaagggggctctgcc

SEQ ID NO: 1268446 - DNA, 20 bp, Homo sapiens
gaagggggtgacagtcctcc

SEQ ID NO: 1268447 - DNA, 16 bp, Homo sapiens
gaagggggttgtggca

SEQ ID NO: 1268448 - DNA, 15 bp, Homo sapiens
gaaggggtcctgcag

SEQ ID NO: 1268449 - DNA, 17 bp, Homo sapiens
gaaggggtcctgcaggg

SEQ ID NO: 1268450 - DNA, 18 bp, Homo sapiens
gaaggggtcctgcagggg

SEQ ID NO: 1268451 - DNA, 19 bp, Homo sapiens
gaaggggtcctgcaggggg

SEQ ID NO: 1268452 - DNA, 21 bp, Homo sapiens
gaaggggtcctgcagggggag

SEQ ID NO: 1268453 - DNA, 18 bp, Homo sapiens
gaaggggtgcaggtgggg

SEQ ID NO: 1268454 - DNA, 14 bp, Homo sapiens
gaagggtgcatagc

SEQ ID NO: 1268455 - DNA, 21 bp, Homo sapiens
gaagggtggatgacagggcag

SEQ ID NO: 1268456 - DNA, 21 bp, Homo sapiens
gaagggtgggaagggataatt

SEQ ID NO: 1268457 - DNA, 11 bp, Homo sapiens
gaagggtgggg

SEQ ID NO: 1268458 - DNA, 15 bp, Homo sapiens
gaagggtggggagaa

SEQ ID NO: 1268459 - DNA, 19 bp, Homo sapiens
gaagggtggtctgagcacc

SEQ ID NO: 1268460 - DNA, 13 bp, Homo sapiens
gaagggttctgcc

SEQ ID NO: 1268461 - DNA, 18 bp, Homo sapiens
gaagggttggtgggctgg

SEQ ID NO: 1268462 - DNA, 19 bp, Homo sapiens
gaagggttggtgggctggc

SEQ ID NO: 1268463 - DNA, 22 bp, Homo sapiens
gaaggtaaataaaaagaaaggc

SEQ ID NO: 1268464 - DNA, 19 bp, Homo sapiens
gaaggtagcattctttgga

SEQ ID NO: 1268465 - DNA, 19 bp, Homo sapiens
gaaggtatcagttatatga

SEQ ID NO: 1268466 - DNA, 14 bp, Homo sapiens
gaaggtattggcct

SEQ ID NO: 1268467 - DNA, 21 bp, Homo sapiens
gaaggtcactcttcctgcaag

SEQ ID NO: 1268468 - DNA, 20 bp, Homo sapiens
gaaggtcagcgagaaggagt

SEQ ID NO: 1268469 - DNA, 16 bp, Homo sapiens
gaaggtccttgcctga

SEQ ID NO: 1268470 - DNA, 23 bp, Homo sapiens
gaaggtccttgcctgaactccag

SEQ ID NO: 1268471 - DNA, 21 bp, Homo sapiens
gaaggtctccaagggagggtg

SEQ ID NO: 1268472 - DNA, 19 bp, Homo sapiens
gaaggtctttgttatgaca

SEQ ID NO: 1268473 - DNA, 14 bp, Homo sapiens
gaaggtgacagcag

SEQ ID NO: 1268474 - DNA, 12 bp, Homo sapiens
gaaggtgagagg

SEQ ID NO: 1268475 - DNA, 19 bp, Homo sapiens
gaaggtgataagggaaaag

SEQ ID NO: 1268476 - DNA, 21 bp, Homo sapiens
gaaggtgcatctttccctgcc

SEQ ID NO: 1268477 - DNA, 17 bp, Homo sapiens
gaaggtgccagaaggaa

SEQ ID NO: 1268478 - DNA, 19 bp, Homo sapiens
gaaggtgccagaaggaagg

SEQ ID NO: 1268479 - DNA, 20 bp, Homo sapiens
gaaggtgccagaaggaaggt

SEQ ID NO: 1268480 - DNA, 14 bp, Homo sapiens
gaaggtgcctggcc

SEQ ID NO: 1268481 - DNA, 14 bp, Homo sapiens
gaaggtgctgagct

SEQ ID NO: 1268482 - DNA, 18 bp, Homo sapiens
gaaggtggaagttgcagt

SEQ ID NO: 1268483 - DNA, 20 bp, Homo sapiens
gaaggtggaggttgcggtga

SEQ ID NO: 1268484 - DNA, 14 bp, Homo sapiens
gaaggtggccacag

SEQ ID NO: 1268485 - DNA, 13 bp, Homo sapiens
gaaggtggggccc

SEQ ID NO: 1268486 - DNA, 18 bp, Homo sapiens
gaaggtggggccctgccc

SEQ ID NO: 1268487 - DNA, 19 bp, Homo sapiens
gaaggtggggccctgcccc

SEQ ID NO: 1268488 - DNA, 21 bp, Homo sapiens
gaaggtggtggggctgccgga

SEQ ID NO: 1268489 - DNA, 20 bp, Homo sapiens
gaaggttatcagtgcttccc

SEQ ID NO: 1268490 - DNA, 19 bp, Homo sapiens
gaaggttcatgtagagaaa

SEQ ID NO: 1268491 - DNA, 15 bp, Homo sapiens
gaaggttcccaagga

SEQ ID NO: 1268492 - DNA, 16 bp, Homo sapiens
gaaggttcttcatgat

SEQ ID NO: 1268493 - DNA, 22 bp, Homo sapiens
gaaggttggtgaatttcacaag

SEQ ID NO: 1268494 - DNA, 12 bp, Homo sapiens
gaaggttgtaag

SEQ ID NO: 1268495 - DNA, 23 bp, Homo sapiens
gaaggtttgcggatgagggcatg

SEQ ID NO: 1268496 - DNA, 20 bp, Homo sapiens
gaaggtttggtgtgtggaga

SEQ ID NO: 1268497 - DNA, 16 bp, Homo sapiens
gaaggtttgtatattg

SEQ ID NO: 1268498 - DNA, 19 bp, Homo sapiens
gaagtaaaagcaaaaaaga

SEQ ID NO: 1268499 - DNA, 13 bp, Homo sapiens
gaagtaaaataaa

SEQ ID NO: 1268500 - DNA, 13 bp, Homo sapiens
gaagtaaacagct

SEQ ID NO: 1268501 - DNA, 13 bp, Homo sapiens
gaagtaaactttt

SEQ ID NO: 1268502 - DNA, 22 bp, Homo sapiens
gaagtaaattaaacatttttca

SEQ ID NO: 1268503 - DNA, 22 bp, Homo sapiens
gaagtaacatgcatactttatt

SEQ ID NO: 1268504 - DNA, 19 bp, Homo sapiens
gaagtaaccatttgcactg

SEQ ID NO: 1268505 - DNA, 21 bp, Homo sapiens
gaagtaagagctaagttctaa

SEQ ID NO: 1268506 - DNA, 21 bp, Homo sapiens
gaagtaatatgcacacatttt

SEQ ID NO: 1268507 - DNA, 22 bp, Homo sapiens
gaagtaatatgcacacattttt

SEQ ID NO: 1268508 - DNA, 13 bp, Homo sapiens
gaagtaatgaatt

SEQ ID NO: 1268509 - DNA, 22 bp, Homo sapiens
gaagtaattatcagttggtttg

SEQ ID NO: 1268510 - DNA, 17 bp, Homo sapiens
gaagtacaaacatgaaa

SEQ ID NO: 1268511 - DNA, 17 bp, Homo sapiens
gaagtacacctgtgtgg

SEQ ID NO: 1268512 - DNA, 17 bp, Homo sapiens
gaagtagacctcttttt

SEQ ID NO: 1268513 - DNA, 14 bp, Homo sapiens
gaagtagctagtag

SEQ ID NO: 1268514 - DNA, 18 bp, Homo sapiens
gaagtagcttgctccctg

SEQ ID NO: 1268515 - DNA, 13 bp, Homo sapiens
gaagtaggaagta

SEQ ID NO: 1268516 - DNA, 21 bp, Homo sapiens
gaagtagtatgttattcctgg

SEQ ID NO: 1268517 - DNA, 14 bp, Homo sapiens
gaagtagtccttgg

SEQ ID NO: 1268518 - DNA, 23 bp, Homo sapiens
gaagtagtgtctggatcagtaaa

SEQ ID NO: 1268519 - DNA, 20 bp, Homo sapiens
gaagtagttctgtttggtgt

SEQ ID NO: 1268520 - DNA, 23 bp, Homo sapiens
gaagtatacctggctttttaaaa

SEQ ID NO: 1268521 - DNA, 17 bp, Homo sapiens
gaagtcacctttctggg

SEQ ID NO: 1268522 - DNA, 18 bp, Homo sapiens
gaagtcactgaacaaaac

SEQ ID NO: 1268523 - DNA, 17 bp, Homo sapiens
gaagtcagccacactgg

SEQ ID NO: 1268524 - DNA, 20 bp, Homo sapiens
gaagtcagccacactgggcc

SEQ ID NO: 1268525 - DNA, 22 bp, Homo sapiens
gaagtcagccacactgggcctg

SEQ ID NO: 1268526 - DNA, 23 bp, Homo sapiens
gaagtcagccacactgggcctgg

SEQ ID NO: 1268527 - DNA, 22 bp, Homo sapiens
gaagtcaggggagaagctgaag

SEQ ID NO: 1268528 - DNA, 12 bp, Homo sapiens
gaagtcatatgt

SEQ ID NO: 1268529 - DNA, 16 bp, Homo sapiens
gaagtcattgtcgctc

SEQ ID NO: 1268530 - DNA, 16 bp, Homo sapiens
gaagtcctgggaggat

SEQ ID NO: 1268531 - DNA, 16 bp, Homo sapiens
gaagtcggatgtcaga

SEQ ID NO: 1268532 - DNA, 15 bp, Homo sapiens
gaagtctaattcaca

SEQ ID NO: 1268533 - DNA, 20 bp, Homo sapiens
gaagtctaggagctgggagg

SEQ ID NO: 1268534 - DNA, 13 bp, Homo sapiens
gaagtctcagcta

SEQ ID NO: 1268535 - DNA, 21 bp, Homo sapiens
gaagtctccatgaagagcttg

SEQ ID NO: 1268536 - DNA, 15 bp, Homo sapiens
gaagtctggctttgc

SEQ ID NO: 1268537 - DNA, 15 bp, Homo sapiens
gaagtcttccctcag

SEQ ID NO: 1268538 - DNA, 13 bp, Homo sapiens
gaagtcttgaagt

SEQ ID NO: 1268539 - DNA, 15 bp, Homo sapiens
gaagtgaagaatgca

SEQ ID NO: 1268540 - DNA, 15 bp, Homo sapiens
gaagtgaatgctggg

SEQ ID NO: 1268541 - DNA, 16 bp, Homo sapiens
gaagtgaatgctggga

SEQ ID NO: 1268542 - DNA, 17 bp, Homo sapiens
gaagtgaatgctgggac

SEQ ID NO: 1268543 - DNA, 21 bp, Homo sapiens
gaagtgacaaggccccagaga

SEQ ID NO: 1268544 - DNA, 21 bp, Homo sapiens
gaagtgagagaaaaaggtcct

SEQ ID NO: 1268545 - DNA, 16 bp, Homo sapiens
gaagtgaggaagccag

SEQ ID NO: 1268546 - DNA, 20 bp, Homo sapiens
gaagtgatttagttgtggaa

SEQ ID NO: 1268547 - DNA, 24 bp, Homo sapiens
gaagtgcagtcagcagatgctgtt

SEQ ID NO: 1268548 - DNA, 14 bp, Homo sapiens
gaagtgcatccaaa

SEQ ID NO: 1268549 - DNA, 22 bp, Homo sapiens
gaagtgcccctgctgcctcccc

SEQ ID NO: 1268550 - DNA, 21 bp, Homo sapiens
gaagtgcgtgaatgtatgtaa

SEQ ID NO: 1268551 - DNA, 19 bp, Homo sapiens
gaagtgcgtggtataatct

SEQ ID NO: 1268552 - DNA, 20 bp, Homo sapiens
gaagtgctcttggctgaccc

SEQ ID NO: 1268553 - DNA, 20 bp, Homo sapiens
gaagtgctgtttattaatct

SEQ ID NO: 1268554 - DNA, 14 bp, Homo sapiens
gaagtggccctccc

SEQ ID NO: 1268555 - DNA, 15 bp, Homo sapiens
gaagtggccctccct

SEQ ID NO: 1268556 - DNA, 18 bp, Homo sapiens
gaagtggctggtctggag

SEQ ID NO: 1268557 - DNA, 16 bp, Homo sapiens
gaagtggctgtccctg

SEQ ID NO: 1268558 - DNA, 17 bp, Homo sapiens
gaagtgggaaaaaatag

SEQ ID NO: 1268559 - DNA, 16 bp, Homo sapiens
gaagtgggagcagctt

SEQ ID NO: 1268560 - DNA, 19 bp, Homo sapiens
gaatctcaagatgggggca

SEQ ID NO: 1268561 - DNA, 16 bp, Homo sapiens
gaatctcaagattcta

SEQ ID NO: 1268562 - DNA, 16 bp, Homo sapiens
gaatctcataattgga

SEQ ID NO: 1268563 - DNA, 19 bp, Homo sapiens
gaatctcgcagtgtttctg

SEQ ID NO: 1268564 - DNA, 15 bp, Homo sapiens
gaatctctgtgcctt

SEQ ID NO: 1268565 - DNA, 12 bp, Homo sapiens
gaatctctttcc

SEQ ID NO: 1268566 - DNA, 18 bp, Homo sapiens
gaatctctttttgctttc

SEQ ID NO: 1268567 - DNA, 15 bp, Homo sapiens
gaatctgaatcagcc

SEQ ID NO: 1268568 - DNA, 21 bp, Homo sapiens
gaatctgagtgaattgtacct

SEQ ID NO: 1268569 - DNA, 23 bp, Homo sapiens
gaatctgatctttttatacacaa

SEQ ID NO: 1268570 - DNA, 19 bp, Homo sapiens
gaatctgcagggagcaact

SEQ ID NO: 1268571 - DNA, 19 bp, Homo sapiens
gaatctgcctgtggccttg

SEQ ID NO: 1268572 - DNA, 21 bp, Homo sapiens
gaatctgccttccagcccaga

SEQ ID NO: 1268573 - DNA, 20 bp, Homo sapiens
gaatctgctgcatagctcta

SEQ ID NO: 1268574 - DNA, 23 bp, Homo sapiens
gaatctggaccccatctgtgaat

SEQ ID NO: 1268575 - DNA, 16 bp, Homo sapiens
gaatctggagaccagg

SEQ ID NO: 1268576 - DNA, 22 bp, Homo sapiens
gaatctggagaccagggagcct

SEQ ID NO: 1268577 - DNA, 12 bp, Homo sapiens
gaatctgggggt

SEQ ID NO: 1268578 - DNA, 13 bp, Homo sapiens
gaatctgtgcaaa

SEQ ID NO: 1268579 - DNA, 13 bp, Homo sapiens
gaatctgtgcctg

SEQ ID NO: 1268580 - DNA, 14 bp, Homo sapiens
gaatctgtgtgaaa

SEQ ID NO: 1268581 - DNA, 20 bp, Homo sapiens
gaatcttaaggtctaactgt

SEQ ID NO: 1268582 - DNA, 16 bp, Homo sapiens
gaatcttaatttatta

SEQ ID NO: 1268583 - DNA, 15 bp, Homo sapiens
gaatcttcacctcag

SEQ ID NO: 1268584 - DNA, 16 bp, Homo sapiens
gaatcttctccagtat

SEQ ID NO: 1268585 - DNA, 16 bp, Homo sapiens
gaatcttgactttctg

SEQ ID NO: 1268586 - DNA, 19 bp, Homo sapiens
gaatcttgactttctgatt

SEQ ID NO: 1268587 - DNA, 22 bp, Homo sapiens
gaatctttagagaagtatacat

SEQ ID NO: 1268588 - DNA, 23 bp, Homo sapiens
gaatctttagagaagtatacata

SEQ ID NO: 1268589 - DNA, 19 bp, Homo sapiens
gaatctttattgagaaaga

SEQ ID NO: 1268590 - DNA, 22 bp, Homo sapiens
gaatctttattgagaaagagca

SEQ ID NO: 1268591 - DNA, 11 bp, Homo sapiens
gaatctttctc

SEQ ID NO: 1268592 - DNA, 14 bp, Homo sapiens
gaatctttctcctg

SEQ ID NO: 1268593 - DNA, 16 bp, Homo sapiens
gaatctttctcctggt

SEQ ID NO: 1268594 - DNA, 17 bp, Homo sapiens
gaatctttctcctggtg

SEQ ID NO: 1268595 - DNA, 19 bp, Homo sapiens
gaatctttgtaccaaaatt

SEQ ID NO: 1268596 - DNA, 12 bp, Homo sapiens
gaatcttttaaa

SEQ ID NO: 1268597 - DNA, 23 bp, Homo sapiens
gaatcttttggattttaagcagt

SEQ ID NO: 1268598 - DNA, 19 bp, Homo sapiens
gaatcttttttttatataa

SEQ ID NO: 1268599 - DNA, 12 bp, Homo sapiens
gaatgaaaataa

SEQ ID NO: 1268600 - DNA, 17 bp, Homo sapiens
gaatgaaagagagctct

SEQ ID NO: 1268601 - DNA, 23 bp, Homo sapiens
gaatgaaatcctgcttcagtgta

SEQ ID NO: 1268602 - DNA, 22 bp, Homo sapiens
gaatgaaattcttttataaata

SEQ ID NO: 1268603 - DNA, 20 bp, Homo sapiens
gaatgaacccatagggagct

SEQ ID NO: 1268604 - DNA, 17 bp, Homo sapiens
gaatgaaccctcctcct

SEQ ID NO: 1268605 - DNA, 15 bp, Homo sapiens
gaatgaaccttctgg

SEQ ID NO: 1268606 - DNA, 12 bp, Homo sapiens
gaatgaactgtg

SEQ ID NO: 1268607 - DNA, 17 bp, Homo sapiens
gaatgaagcagtatttt

SEQ ID NO: 1268608 - DNA, 15 bp, Homo sapiens
gaatgaagttctgct

SEQ ID NO: 1268609 - DNA, 15 bp, Homo sapiens
gaatgaatacagcat

SEQ ID NO: 1268610 - DNA, 14 bp, Homo sapiens
gaatgactatgtcc

SEQ ID NO: 1268611 - DNA, 17 bp, Homo sapiens
gaatgactatgtccaga

SEQ ID NO: 1268612 - DNA, 16 bp, Homo sapiens
gaatgactgaaagaag

SEQ ID NO: 1268613 - DNA, 21 bp, Homo sapiens
gaatgactgaaagaagaacag

SEQ ID NO: 1268614 - DNA, 15 bp, Homo sapiens
gaatgacttgggttt

SEQ ID NO: 1268615 - DNA, 12 bp, Homo sapiens
gaatgagaaaca

SEQ ID NO: 1268616 - DNA, 16 bp, Homo sapiens
gaatgagaggttgagg

SEQ ID NO: 1268617 - DNA, 16 bp, Homo sapiens
gaatgagccaaaatga

SEQ ID NO: 1268618 - DNA, 22 bp, Homo sapiens
gaatgaggaagcaaagagtgag

SEQ ID NO: 1268619 - DNA, 23 bp, Homo sapiens
gaatgaggaataataagttaaac

SEQ ID NO: 1268620 - DNA, 12 bp, Homo sapiens
gaatgagggagg

SEQ ID NO: 1268621 - DNA, 13 bp, Homo sapiens
gaatgagggaggc

SEQ ID NO: 1268622 - DNA, 19 bp, Homo sapiens
gaatgaggtcccaggcaga

SEQ ID NO: 1268623 - DNA, 22 bp, Homo sapiens
gaatgaggtgggaggtggaaga

SEQ ID NO: 1268624 - DNA, 20 bp, Homo sapiens
gaatgagtcaatcagccttt

SEQ ID NO: 1268625 - DNA, 22 bp, Homo sapiens
gaatgatgttttaaaaaaattt

SEQ ID NO: 1268626 - DNA, 16 bp, Homo sapiens
gaatgattaatcaaag

SEQ ID NO: 1268627 - DNA, 19 bp, Homo sapiens
gaatgattcatgttatatt

SEQ ID NO: 1268628 - DNA, 21 bp, Homo sapiens
gaatgattggttaaaatgtga

SEQ ID NO: 1268629 - DNA, 23 bp, Homo sapiens
gaatgattggttaaaatgtgatt

SEQ ID NO: 1268630 - DNA, 20 bp, Homo sapiens
gaatgatttccaaagagaaa

SEQ ID NO: 1268631 - DNA, 14 bp, Homo sapiens
gaatgatttttaga

SEQ ID NO: 1268632 - DNA, 12 bp, Homo sapiens
gaatgcaagagt

SEQ ID NO: 1268633 - DNA, 19 bp, Homo sapiens
gaatgcacaagaatggatc

SEQ ID NO: 1268634 - DNA, 20 bp, Homo sapiens
gaatgcacactagcctctcc

SEQ ID NO: 1268635 - DNA, 14 bp, Homo sapiens
gaatgcacctcccc

SEQ ID NO: 1268636 - DNA, 18 bp, Homo sapiens
gaatgcagattcctgggc

SEQ ID NO: 1268637 - DNA, 19 bp, Homo sapiens
gaatgcagattcctgggcc

SEQ ID NO: 1268638 - DNA, 20 bp, Homo sapiens
gaatgcagattcctgggcct

SEQ ID NO: 1268639 - DNA, 21 bp, Homo sapiens
gaatgcagattcctgggcctg

SEQ ID NO: 1268640 - DNA, 15 bp, Homo sapiens
gaatgcagcccacca

SEQ ID NO: 1268641 - DNA, 18 bp, Homo sapiens
gaatgcatccttaacctt

SEQ ID NO: 1268642 - DNA, 19 bp, Homo sapiens
gaatgcattccctgaatct

SEQ ID NO: 1268643 - DNA, 21 bp, Homo sapiens
gaatgccactgccttcgcttc

SEQ ID NO: 1268644 - DNA, 14 bp, Homo sapiens
gaatgccataaaat

SEQ ID NO: 1268645 - DNA, 15 bp, Homo sapiens
gaatgccatttctca

SEQ ID NO: 1268646 - DNA, 17 bp, Homo sapiens
gaatgccatttctcacg

SEQ ID NO: 1268647 - DNA, 14 bp, Homo sapiens
gaatgccctcaggg

SEQ ID NO: 1268648 - DNA, 20 bp, Homo sapiens
gaatgccgcgaactgggttc

SEQ ID NO: 1268649 - DNA, 14 bp, Homo sapiens
gaatgcctcctgtg

SEQ ID NO: 1268650 - DNA, 16 bp, Homo sapiens
gaatgcctcctgtggg

SEQ ID NO: 1268651 - DNA, 11 bp, Homo sapiens
gaatgcctgga

SEQ ID NO: 1268652 - DNA, 13 bp, Homo sapiens
gaatgcctggagg

SEQ ID NO: 1268653 - DNA, 20 bp, Homo sapiens
gaatgcgctttattgcccat

SEQ ID NO: 1268654 - DNA, 23 bp, Homo sapiens
gaatgcggcaagaaggaattgac

SEQ ID NO: 1268655 - DNA, 14 bp, Homo sapiens
gaatgctagacaga

SEQ ID NO: 1268656 - DNA, 22 bp, Homo sapiens
gaatgctagcagggcatggcac

SEQ ID NO: 1268657 - DNA, 11 bp, Homo sapiens
gaatgctcccc

SEQ ID NO: 1268658 - DNA, 16 bp, Homo sapiens
gaatgctctgtgccag

SEQ ID NO: 1268659 - DNA, 17 bp, Homo sapiens
gaatgctctgtgccaga

SEQ ID NO: 1268660 - DNA, 21 bp, Homo sapiens
gaatgctgcaggacttgagaa

SEQ ID NO: 1268661 - DNA, 13 bp, Homo sapiens
gaatgctgggact

SEQ ID NO: 1268662 - DNA, 13 bp, Homo sapiens
gaatgctgggccc

SEQ ID NO: 1268663 - DNA, 22 bp, Homo sapiens
gaatgctgggcccccagcctgg

SEQ ID NO: 1268664 - DNA, 22 bp, Homo sapiens
gaatgctgggtatgctctgtga

SEQ ID NO: 1268665 - DNA, 15 bp, Homo sapiens
gaatgctgtacatct

SEQ ID NO: 1268666 - DNA, 15 bp, Homo sapiens
gaatgctgtatatgt

SEQ ID NO: 1268667 - DNA, 14 bp, Homo sapiens
gaatgcttctaagt

SEQ ID NO: 1268668 - DNA, 22 bp, Homo sapiens
gaatgcttctaagtaaatacaa

SEQ ID NO: 1268669 - DNA, 23 bp, Homo sapiens
gaatgcttctaagtaaatacaat

SEQ ID NO: 1268670 - DNA, 21 bp, Homo sapiens
gaatgcttttagtgtgtgcat

SEQ ID NO: 1268671 - DNA, 16 bp, Homo sapiens
gaatggaactactgta

SEQ ID NO: 1268672 - DNA, 14 bp, Homo sapiens
gaatggaataacta

SEQ ID NO: 1268673 - DNA, 16 bp, Homo sapiens
gaatggaatcttctcc

SEQ ID NO: 1268674 - DNA, 19 bp, Homo sapiens
gaatggactaagatgaaat

SEQ ID NO: 1268675 - DNA, 14 bp, Homo sapiens
gaatggagcctgct

SEQ ID NO: 1268676 - DNA, 17 bp, Homo sapiens
gaatggaggcagagacc

SEQ ID NO: 1268677 - DNA, 21 bp, Homo sapiens
gaatggaggggcagagccagg

SEQ ID NO: 1268678 - DNA, 21 bp, Homo sapiens
gaatggatttttctttaactg

SEQ ID NO: 1268679 - DNA, 22 bp, Homo sapiens
gaatggcaatagggtagaatga

SEQ ID NO: 1268680 - DNA, 18 bp, Homo sapiens
gaatggccctagaactgt

SEQ ID NO: 1268681 - DNA, 24 bp, Homo sapiens
gaatggccctagaactgtgcctag

SEQ ID NO: 1268682 - DNA, 16 bp, Homo sapiens
gacaaaggccacaggc

SEQ ID NO: 1268683 - DNA, 11 bp, Homo sapiens
gacaaagtgcc

SEQ ID NO: 1268684 - DNA, 19 bp, Homo sapiens
gacaaagtggaggagggcc

SEQ ID NO: 1268685 - DNA, 20 bp, Homo sapiens
gacaaagttccaaaatgcca

SEQ ID NO: 1268686 - DNA, 15 bp, Homo sapiens
gacaaataaggaagg

SEQ ID NO: 1268687 - DNA, 16 bp, Homo sapiens
gacaaataggagtgag

SEQ ID NO: 1268688 - DNA, 22 bp, Homo sapiens
gacaaatattcctttgcatatt

SEQ ID NO: 1268689 - DNA, 13 bp, Homo sapiens
gacaaatattctc

SEQ ID NO: 1268690 - DNA, 18 bp, Homo sapiens
gacaaatcaacagaagca

SEQ ID NO: 1268691 - DNA, 21 bp, Homo sapiens
gacaaatcaacagaagcattt

SEQ ID NO: 1268692 - DNA, 18 bp, Homo sapiens
gacaaatcacatatttta

SEQ ID NO: 1268693 - DNA, 16 bp, Homo sapiens
gacaaatctttaagaa

SEQ ID NO: 1268694 - DNA, 14 bp, Homo sapiens
gacaaatgacagat

SEQ ID NO: 1268695 - DNA, 20 bp, Homo sapiens
gacaaatgacagattctgac

SEQ ID NO: 1268696 - DNA, 16 bp, Homo sapiens
gacaaattatatttga

SEQ ID NO: 1268697 - DNA, 14 bp, Homo sapiens
gacaaattctgttt

SEQ ID NO: 1268698 - DNA, 14 bp, Homo sapiens
gacaaattttaatt

SEQ ID NO: 1268699 - DNA, 20 bp, Homo sapiens
gacaacaccttcctcctgca

SEQ ID NO: 1268700 - DNA, 17 bp, Homo sapiens
gacaacactgattcctg

SEQ ID NO: 1268701 - DNA, 19 bp, Homo sapiens
gacaacactgggaaacaga

SEQ ID NO: 1268702 - DNA, 21 bp, Homo sapiens
gacaacacttaatagcaacag

SEQ ID NO: 1268703 - DNA, 13 bp, Homo sapiens
gacaacagaaaaa

SEQ ID NO: 1268704 - DNA, 14 bp, Homo sapiens
gacaacagaaaaac

SEQ ID NO: 1268705 - DNA, 14 bp, Homo sapiens
gacaacagaagtca

SEQ ID NO: 1268706 - DNA, 15 bp, Homo sapiens
gacaacagcccaggc

SEQ ID NO: 1268707 - DNA, 13 bp, Homo sapiens
gacaacagctctc

SEQ ID NO: 1268708 - DNA, 15 bp, Homo sapiens
gacaacagctctcgt

SEQ ID NO: 1268709 - DNA, 20 bp, Homo sapiens
gacaacaggtaaaacagggc

SEQ ID NO: 1268710 - DNA, 23 bp, Homo sapiens
gacaacatcgcaatagtttttta

SEQ ID NO: 1268711 - DNA, 17 bp, Homo sapiens
gacaaccaccgctcccc

SEQ ID NO: 1268712 - DNA, 15 bp, Homo sapiens
gacaaccactggtct

SEQ ID NO: 1268713 - DNA, 17 bp, Homo sapiens
gacaaccactggtctgt

SEQ ID NO: 1268714 - DNA, 13 bp, Homo sapiens
gacaaccctgcaa

SEQ ID NO: 1268715 - DNA, 18 bp, Homo sapiens
gacaaccgatgctccagc

SEQ ID NO: 1268716 - DNA, 16 bp, Homo sapiens
gacaacctagaatgtc

SEQ ID NO: 1268717 - DNA, 23 bp, Homo sapiens
gacaacctgtgtgagagaattta

SEQ ID NO: 1268718 - DNA, 14 bp, Homo sapiens
gacaacctttctgt

SEQ ID NO: 1268719 - DNA, 18 bp, Homo sapiens
gacaacgggcccatggcc

SEQ ID NO: 1268720 - DNA, 15 bp, Homo sapiens
gacaactagatttgt

SEQ ID NO: 1268721 - DNA, 18 bp, Homo sapiens
gacaactagatttgtcct

SEQ ID NO: 1268722 - DNA, 15 bp, Homo sapiens
gacaacttatttaaa

SEQ ID NO: 1268723 - DNA, 17 bp, Homo sapiens
gacaacttatttaaaaa

SEQ ID NO: 1268724 - DNA, 21 bp, Homo sapiens
gacaacttatttaaaaatatt

SEQ ID NO: 1268725 - DNA, 22 bp, Homo sapiens
gacaacttatttaaaaatattt

SEQ ID NO: 1268726 - DNA, 20 bp, Homo sapiens
gacaacttttaaagaaaaat

SEQ ID NO: 1268727 - DNA, 13 bp, Homo sapiens
gacaagaagcaaa

SEQ ID NO: 1268728 - DNA, 14 bp, Homo sapiens
gacaagagatggga

SEQ ID NO: 1268729 - DNA, 22 bp, Homo sapiens
gacaagcactattttatattta

SEQ ID NO: 1268730 - DNA, 14 bp, Homo sapiens
gacaagcagtccct

SEQ ID NO: 1268731 - DNA, 19 bp, Homo sapiens
gacaagccaacttgtaaat

SEQ ID NO: 1268732 - DNA, 22 bp, Homo sapiens
gacaagccaacttgtaaataca

SEQ ID NO: 1268733 - DNA, 17 bp, Homo sapiens
gacaagccccaggcagg

SEQ ID NO: 1268734 - DNA, 12 bp, Homo sapiens
gacaagccctgg

SEQ ID NO: 1268735 - DNA, 13 bp, Homo sapiens
gacaagccctggc

SEQ ID NO: 1268736 - DNA, 15 bp, Homo sapiens
gacaagccctggcaa

SEQ ID NO: 1268737 - DNA, 17 bp, Homo sapiens
gacaagccctggcaaca

SEQ ID NO: 1268738 - DNA, 22 bp, Homo sapiens
gacaagctgacttggcacttaa

SEQ ID NO: 1268739 - DNA, 14 bp, Homo sapiens
gacaaggccccaga

SEQ ID NO: 1268740 - DNA, 16 bp, Homo sapiens
gacaaggccccagaga

SEQ ID NO: 1268741 - DNA, 17 bp, Homo sapiens
gacaaggccccagagac

SEQ ID NO: 1268742 - DNA, 23 bp, Homo sapiens
gacaaggccccagagactcagag

SEQ ID NO: 1268743 - DNA, 19 bp, Homo sapiens
gacaagggaggcagtggct

SEQ ID NO: 1268744 - DNA, 14 bp, Homo sapiens
gacaaggtgctaac

SEQ ID NO: 1268745 - DNA, 12 bp, Homo sapiens
gacaagtagttc

SEQ ID NO: 1268746 - DNA, 23 bp, Homo sapiens
gacaagtatgaatattactctca

SEQ ID NO: 1268747 - DNA, 20 bp, Homo sapiens
gacaagtggactcagggcag

SEQ ID NO: 1268748 - DNA, 18 bp, Homo sapiens
gacaagttgtttatgtat

SEQ ID NO: 1268749 - DNA, 14 bp, Homo sapiens
gacaataaaacatt

SEQ ID NO: 1268750 - DNA, 13 bp, Homo sapiens
gacaataatttca

SEQ ID NO: 1268751 - DNA, 13 bp, Homo sapiens
gacaatacagtaa

SEQ ID NO: 1268752 - DNA, 16 bp, Homo sapiens
gacaatcagtcccctc

SEQ ID NO: 1268753 - DNA, 15 bp, Homo sapiens
gacaatgaagggaaa

SEQ ID NO: 1268754 - DNA, 20 bp, Homo sapiens
gacaatgacttactgtacat

SEQ ID NO: 1268755 - DNA, 21 bp, Homo sapiens
gacaatgacttactgtacatg

SEQ ID NO: 1268756 - DNA, 13 bp, Homo sapiens
gacaatggcagct

SEQ ID NO: 1268757 - DNA, 19 bp, Homo sapiens
gacaatgtgaaaagaaaaa

SEQ ID NO: 1268758 - DNA, 16 bp, Homo sapiens
gacaatgttgagaagt

SEQ ID NO: 1268759 - DNA, 12 bp, Homo sapiens
gacaattctgca

SEQ ID NO: 1268760 - DNA, 14 bp, Homo sapiens
gacaattctgcatg

SEQ ID NO: 1268761 - DNA, 14 bp, Homo sapiens
gacaattctgggtg

SEQ ID NO: 1268762 - DNA, 15 bp, Homo sapiens
gacaattctgggtgc

SEQ ID NO: 1268763 - DNA, 12 bp, Homo sapiens
gacaatttatta

SEQ ID NO: 1268764 - DNA, 17 bp, Homo sapiens
gacaatttgatacataa

SEQ ID NO: 1268765 - DNA, 19 bp, Homo sapiens
gacaattttgcttcacttt

SEQ ID NO: 1268766 - DNA, 18 bp, Homo sapiens
gacacaaagcttctaaag

SEQ ID NO: 1268767 - DNA, 13 bp, Homo sapiens
gacacaaatgcat

SEQ ID NO: 1268768 - DNA, 14 bp, Homo sapiens
gacacaaatgcatg

SEQ ID NO: 1268769 - DNA, 13 bp, Homo sapiens
gacacaaggcacg

SEQ ID NO: 1268770 - DNA, 16 bp, Homo sapiens
gacacaatatgtatgc

SEQ ID NO: 1268771 - DNA, 12 bp, Homo sapiens
gacacacacacg

SEQ ID NO: 1268772 - DNA, 17 bp, Homo sapiens
gacacacacagactatt

SEQ ID NO: 1268773 - DNA, 13 bp, Homo sapiens
gacacacactcac

SEQ ID NO: 1268774 - DNA, 17 bp, Homo sapiens
gacacacactcaccagt

SEQ ID NO: 1268775 - DNA, 20 bp, Homo sapiens
gacacacagcctcacgcccc

SEQ ID NO: 1268776 - DNA, 18 bp, Homo sapiens
gacacaccaggcgctaat

SEQ ID NO: 1268777 - DNA, 21 bp, Homo sapiens
gacacaccccacaccccagcc

SEQ ID NO: 1268778 - DNA, 22 bp, Homo sapiens
gacacaccccacaccccagccc

SEQ ID NO: 1268779 - DNA, 13 bp, Homo sapiens
gacacacggggct

SEQ ID NO: 1268780 - DNA, 19 bp, Homo sapiens
gacacactaaactctgggg

SEQ ID NO: 1268781 - DNA, 21 bp, Homo sapiens
gacacactaaactctggggct

SEQ ID NO: 1268782 - DNA, 18 bp, Homo sapiens
gacacagaaaatgttgag

SEQ ID NO: 1268783 - DNA, 19 bp, Homo sapiens
gacacagaaaatgttgaga

SEQ ID NO: 1268784 - DNA, 18 bp, Homo sapiens
gacacagactggcaataa

SEQ ID NO: 1268785 - DNA, 20 bp, Homo sapiens
gacacagactggcaataaac

SEQ ID NO: 1268786 - DNA, 17 bp, Homo sapiens
gacacagaggctggcac

SEQ ID NO: 1268787 - DNA, 22 bp, Homo sapiens
gacacagcaccgtgccaacccc

SEQ ID NO: 1268788 - DNA, 19 bp, Homo sapiens
gacacagcagcttcaccag

SEQ ID NO: 1268789 - DNA, 21 bp, Homo sapiens
gacacagcagcttcaccagag

SEQ ID NO: 1268790 - DNA, 11 bp, Homo sapiens
gacacagcagt

SEQ ID NO: 1268791 - DNA, 18 bp, Homo sapiens
gacacagggacttgaagt

SEQ ID NO: 1268792 - DNA, 23 bp, Homo sapiens
gacacagggtgacggtgacaaag

SEQ ID NO: 1268793 - DNA, 18 bp, Homo sapiens
gacacaggtcagggctca

SEQ ID NO: 1268794 - DNA, 22 bp, Homo sapiens
gacacaggtctttcctaaggct

SEQ ID NO: 1268795 - DNA, 13 bp, Homo sapiens
gacacagttcctg

SEQ ID NO: 1268796 - DNA, 17 bp, Homo sapiens
gacacatatacatatga

SEQ ID NO: 1268797 - DNA, 16 bp, Homo sapiens
gacacatcccggcctc

SEQ ID NO: 1268798 - DNA, 17 bp, Homo sapiens
gacacatcccggcctct

SEQ ID NO: 1268799 - DNA, 20 bp, Homo sapiens
gacacatgaaggtaaataaa

SEQ ID NO: 1268800 - DNA, 21 bp, Homo sapiens
gacacatgaaggtaaataaaa

SEQ ID NO: 1268801 - DNA, 14 bp, Homo sapiens
gacacatgcaaggt

SEQ ID NO: 1268802 - DNA, 17 bp, Homo sapiens
gacacatgctatgttct

SEQ ID NO: 1268803 - DNA, 18 bp, Homo sapiens
gacacatgctgaggtttt

SEQ ID NO: 1268804 - DNA, 16 bp, Homo sapiens
gacacatttaccaaat

SEQ ID NO: 1268805 - DNA, 23 bp, Homo sapiens
gacagtcctgggagaacctcagg

SEQ ID NO: 1268806 - DNA, 18 bp, Homo sapiens
gacagtcctttcccacca

SEQ ID NO: 1268807 - DNA, 23 bp, Homo sapiens
gacagtcctttcccaccattcct

SEQ ID NO: 1268808 - DNA, 18 bp, Homo sapiens
gacagtcgctcagtctgt

SEQ ID NO: 1268809 - DNA, 22 bp, Homo sapiens
gacagtcgctcagtctgttcac

SEQ ID NO: 1268810 - DNA, 21 bp, Homo sapiens
gacagtcggtgaccccatcac

SEQ ID NO: 1268811 - DNA, 13 bp, Homo sapiens
gacagtctcactc

SEQ ID NO: 1268812 - DNA, 14 bp, Homo sapiens
gacagtctccctga

SEQ ID NO: 1268813 - DNA, 18 bp, Homo sapiens
gacagtctccctgatgga

SEQ ID NO: 1268814 - DNA, 22 bp, Homo sapiens
gacagtctccctgatggaccct

SEQ ID NO: 1268815 - DNA, 20 bp, Homo sapiens
gacagtctgttatgcactgt

SEQ ID NO: 1268816 - DNA, 15 bp, Homo sapiens
gacagtgaagcagca

SEQ ID NO: 1268817 - DNA, 20 bp, Homo sapiens
gacagtgaattgacccatgt

SEQ ID NO: 1268818 - DNA, 18 bp, Homo sapiens
gacagtgagacagtctgg

SEQ ID NO: 1268819 - DNA, 14 bp, Homo sapiens
gacagtgccatccc

SEQ ID NO: 1268820 - DNA, 11 bp, Homo sapiens
gacagtgcccc

SEQ ID NO: 1268821 - DNA, 20 bp, Homo sapiens
gacagtgcctcttccagtga

SEQ ID NO: 1268822 - DNA, 13 bp, Homo sapiens
gacagtgcctggg

SEQ ID NO: 1268823 - DNA, 21 bp, Homo sapiens
gacagtgcctgggaatgtatt

SEQ ID NO: 1268824 - DNA, 15 bp, Homo sapiens
gacagtgctgccctg

SEQ ID NO: 1268825 - DNA, 20 bp, Homo sapiens
gacagtgcttcagcctgagg

SEQ ID NO: 1268826 - DNA, 15 bp, Homo sapiens
gacagtgcttgcatc

SEQ ID NO: 1268827 - DNA, 20 bp, Homo sapiens
gacagtggattgcatttctt

SEQ ID NO: 1268828 - DNA, 14 bp, Homo sapiens
gacagtggctctcc

SEQ ID NO: 1268829 - DNA, 17 bp, Homo sapiens
gacagtggctgacaagg

SEQ ID NO: 1268830 - DNA, 13 bp, Homo sapiens
gacagtgggaaat

SEQ ID NO: 1268831 - DNA, 21 bp, Homo sapiens
gacagtgttccccgataccat

SEQ ID NO: 1268832 - DNA, 17 bp, Homo sapiens
gacagttcatatgtacc

SEQ ID NO: 1268833 - DNA, 13 bp, Homo sapiens
gacagttggcaga

SEQ ID NO: 1268834 - DNA, 19 bp, Homo sapiens
gacagtttaccagttgcct

SEQ ID NO: 1268835 - DNA, 14 bp, Homo sapiens
gacagtttccaaat

SEQ ID NO: 1268836 - DNA, 16 bp, Homo sapiens
gacagttttcaccatc

SEQ ID NO: 1268837 - DNA, 13 bp, Homo sapiens
gacataaaacttt

SEQ ID NO: 1268838 - DNA, 17 bp, Homo sapiens
gacataaaactttaaaa

SEQ ID NO: 1268839 - DNA, 21 bp, Homo sapiens
gacataaaactttaaaaggca

SEQ ID NO: 1268840 - DNA, 20 bp, Homo sapiens
gacataaagttgataaagat

SEQ ID NO: 1268841 - DNA, 22 bp, Homo sapiens
gacataaagttgataaagattt

SEQ ID NO: 1268842 - DNA, 20 bp, Homo sapiens
gacataagcaatcattttat

SEQ ID NO: 1268843 - DNA, 14 bp, Homo sapiens
gacatacagctgcc

SEQ ID NO: 1268844 - DNA, 22 bp, Homo sapiens
gacatacagctgcctacctaat

SEQ ID NO: 1268845 - DNA, 20 bp, Homo sapiens
gacatacatattatctcatt

SEQ ID NO: 1268846 - DNA, 19 bp, Homo sapiens
gacatacatgctacttttt

SEQ ID NO: 1268847 - DNA, 22 bp, Homo sapiens
gacatactccttccatcaaata

SEQ ID NO: 1268848 - DNA, 14 bp, Homo sapiens
gacatagagaaaag

SEQ ID NO: 1268849 - DNA, 20 bp, Homo sapiens
gacatagagagggagaagaa

SEQ ID NO: 1268850 - DNA, 19 bp, Homo sapiens
gacatagccgattctctgc

SEQ ID NO: 1268851 - DNA, 21 bp, Homo sapiens
gacatagccgattctctgccc

SEQ ID NO: 1268852 - DNA, 13 bp, Homo sapiens
gacatagcctcat

SEQ ID NO: 1268853 - DNA, 21 bp, Homo sapiens
gacatagcctcatgttctgtg

SEQ ID NO: 1268854 - DNA, 23 bp, Homo sapiens
gacataggccatgaaaaaaatga

SEQ ID NO: 1268855 - DNA, 14 bp, Homo sapiens
gacatatctacact

SEQ ID NO: 1268856 - DNA, 21 bp, Homo sapiens
gacatatgggatattcccaag

SEQ ID NO: 1268857 - DNA, 13 bp, Homo sapiens
gacatattcaagt

SEQ ID NO: 1268858 - DNA, 11 bp, Homo sapiens
gacatatttaa

SEQ ID NO: 1268859 - DNA, 14 bp, Homo sapiens
gacatatttaactg

SEQ ID NO: 1268860 - DNA, 16 bp, Homo sapiens
gacatatttaatgttt

SEQ ID NO: 1268861 - DNA, 20 bp, Homo sapiens
gacatatttaatgttttaaa

SEQ ID NO: 1268862 - DNA, 19 bp, Homo sapiens
gacatcaaactcaatgctt

SEQ ID NO: 1268863 - DNA, 15 bp, Homo sapiens
gacatcaacatggca

SEQ ID NO: 1268864 - DNA, 15 bp, Homo sapiens
gacatcacttgtaca

SEQ ID NO: 1268865 - DNA, 22 bp, Homo sapiens
gacatcacttgtacaaaataaa

SEQ ID NO: 1268866 - DNA, 14 bp, Homo sapiens
gacatcagcaaaca

SEQ ID NO: 1268867 - DNA, 13 bp, Homo sapiens
gacatcagctggt

SEQ ID NO: 1268868 - DNA, 16 bp, Homo sapiens
gacatcagtattctgc

SEQ ID NO: 1268869 - DNA, 13 bp, Homo sapiens
gacatcagtggca

SEQ ID NO: 1268870 - DNA, 19 bp, Homo sapiens
gacatcattcatgacaaca

SEQ ID NO: 1268871 - DNA, 15 bp, Homo sapiens
gacatccagaaagct

SEQ ID NO: 1268872 - DNA, 18 bp, Homo sapiens
gacatccataaagaagca

SEQ ID NO: 1268873 - DNA, 19 bp, Homo sapiens
gacatccataaagaagcaa

SEQ ID NO: 1268874 - DNA, 20 bp, Homo sapiens
gacatccataaagaagcaat

SEQ ID NO: 1268875 - DNA, 23 bp, Homo sapiens
gacatccatgtttgtaaaactac

SEQ ID NO: 1268876 - DNA, 23 bp, Homo sapiens
gacatccccccgccaaaagctgc

SEQ ID NO: 1268877 - DNA, 18 bp, Homo sapiens
gacatccctcccccagca

SEQ ID NO: 1268878 - DNA, 16 bp, Homo sapiens
gacatcccttcctgga

SEQ ID NO: 1268879 - DNA, 17 bp, Homo sapiens
gacatcccttcctggaa

SEQ ID NO: 1268880 - DNA, 23 bp, Homo sapiens
gacatcccttcctggaaacagca

SEQ ID NO: 1268881 - DNA, 22 bp, Homo sapiens
gacatccgtcattgctgctgct

SEQ ID NO: 1268882 - DNA, 19 bp, Homo sapiens
gacatcctgtataagcact

SEQ ID NO: 1268883 - DNA, 15 bp, Homo sapiens
gacatcggaaaaata

SEQ ID NO: 1268884 - DNA, 19 bp, Homo sapiens
gacatctacctatacttaa

SEQ ID NO: 1268885 - DNA, 19 bp, Homo sapiens
gacatctccagtgtgccag

SEQ ID NO: 1268886 - DNA, 18 bp, Homo sapiens
gacatctctctggcttct

SEQ ID NO: 1268887 - DNA, 15 bp, Homo sapiens
gacatctctgcaccc

SEQ ID NO: 1268888 - DNA, 14 bp, Homo sapiens
gacatctctggagc

SEQ ID NO: 1268889 - DNA, 15 bp, Homo sapiens
gacatctctggagcc

SEQ ID NO: 1268890 - DNA, 16 bp, Homo sapiens
gacatctctggagcca

SEQ ID NO: 1268891 - DNA, 22 bp, Homo sapiens
gacatctctggagccagagaga

SEQ ID NO: 1268892 - DNA, 16 bp, Homo sapiens
gacatctctttgaatt

SEQ ID NO: 1268893 - DNA, 19 bp, Homo sapiens
gacatctgcacccctgagt

SEQ ID NO: 1268894 - DNA, 20 bp, Homo sapiens
gacatctgcctgtaattaaa

SEQ ID NO: 1268895 - DNA, 16 bp, Homo sapiens
gacatctgctgttatc

SEQ ID NO: 1268896 - DNA, 22 bp, Homo sapiens
gacatctggaatctggagacca

SEQ ID NO: 1268897 - DNA, 20 bp, Homo sapiens
gacatcttcaaagcttgaag

SEQ ID NO: 1268898 - DNA, 13 bp, Homo sapiens
gacatcttctcaa

SEQ ID NO: 1268899 - DNA, 23 bp, Homo sapiens
gacatcttgcctacttttcttta

SEQ ID NO: 1268900 - DNA, 14 bp, Homo sapiens
gacatgaatactat

SEQ ID NO: 1268901 - DNA, 14 bp, Homo sapiens
gacatgacaatgca

SEQ ID NO: 1268902 - DNA, 23 bp, Homo sapiens
gacatgaccctctgtccccaggc

SEQ ID NO: 1268903 - DNA, 17 bp, Homo sapiens
gacatgatggggaagga

SEQ ID NO: 1268904 - DNA, 22 bp, Homo sapiens
gacatgatttccttgaatgtgg

SEQ ID NO: 1268905 - DNA, 24 bp, Homo sapiens
gacatgatttccttgaatgtggct

SEQ ID NO: 1268906 - DNA, 14 bp, Homo sapiens
gacatgcactcagc

SEQ ID NO: 1268907 - DNA, 19 bp, Homo sapiens
gacatgccctcccttctcc

SEQ ID NO: 1268908 - DNA, 14 bp, Homo sapiens
gacatgccctgtgt

SEQ ID NO: 1268909 - DNA, 15 bp, Homo sapiens
gacatgcgtgtgtca

SEQ ID NO: 1268910 - DNA, 20 bp, Homo sapiens
gacatgcgtgtgtcagggat

SEQ ID NO: 1268911 - DNA, 21 bp, Homo sapiens
gacatgctaacctctctgaac

SEQ ID NO: 1268912 - DNA, 13 bp, Homo sapiens
gacatgctgccag

SEQ ID NO: 1268913 - DNA, 19 bp, Homo sapiens
gacatgcttactttttaat

SEQ ID NO: 1268914 - DNA, 15 bp, Homo sapiens
gacatggaaatgaag

SEQ ID NO: 1268915 - DNA, 18 bp, Homo sapiens
gacatggaccagcatctg

SEQ ID NO: 1268916 - DNA, 20 bp, Homo sapiens
gacatggaccagcatctggt

SEQ ID NO: 1268917 - DNA, 16 bp, Homo sapiens
gacatggacccggagc

SEQ ID NO: 1268918 - DNA, 19 bp, Homo sapiens
gacatggagactcctgccc

SEQ ID NO: 1268919 - DNA, 20 bp, Homo sapiens
gacatggagactcctgccct

SEQ ID NO: 1268920 - DNA, 17 bp, Homo sapiens
gacatggcacaggcccg

SEQ ID NO: 1268921 - DNA, 16 bp, Homo sapiens
gacatggcccattgga

SEQ ID NO: 1268922 - DNA, 16 bp, Homo sapiens
gacatggggaaggcag

SEQ ID NO: 1268923 - DNA, 19 bp, Homo sapiens
gacatggggaaggcagagg

SEQ ID NO: 1268924 - DNA, 13 bp, Homo sapiens
gacatggggcaag

SEQ ID NO: 1268925 - DNA, 22 bp, Homo sapiens
gacatggggcaagccagggccc

SEQ ID NO: 1268926 - DNA, 20 bp, Homo sapiens
gaccccaggtcagccctgtg

SEQ ID NO: 1268927 - DNA, 20 bp, Homo sapiens
gaccccagtcgtgatgtgga

SEQ ID NO: 1268928 - DNA, 19 bp, Homo sapiens
gaccccatcactcgcagga

SEQ ID NO: 1268929 - DNA, 19 bp, Homo sapiens
gaccccatctgtgaataag

SEQ ID NO: 1268930 - DNA, 21 bp, Homo sapiens
gacccccaccccttccccact

SEQ ID NO: 1268931 - DNA, 19 bp, Homo sapiens
gacccccactctcattccc

SEQ ID NO: 1268932 - DNA, 17 bp, Homo sapiens
gacccccagctccggcc

SEQ ID NO: 1268933 - DNA, 23 bp, Homo sapiens
gacccccagctccggcctgtcct

SEQ ID NO: 1268934 - DNA, 11 bp, Homo sapiens
gacccccaggc

SEQ ID NO: 1268935 - DNA, 17 bp, Homo sapiens
gacccccatctgagctg

SEQ ID NO: 1268936 - DNA, 20 bp, Homo sapiens
gacccccctaccccatgctg

SEQ ID NO: 1268937 - DNA, 21 bp, Homo sapiens
gacccccgaggggagggcagg

SEQ ID NO: 1268938 - DNA, 16 bp, Homo sapiens
gacccccgccccctgc

SEQ ID NO: 1268939 - DNA, 13 bp, Homo sapiens
gaccccctcagcc

SEQ ID NO: 1268940 - DNA, 19 bp, Homo sapiens
gaccccctcgccagcttgg

SEQ ID NO: 1268941 - DNA, 20 bp, Homo sapiens
gaccccctcgccagcttggc

SEQ ID NO: 1268942 - DNA, 15 bp, Homo sapiens
gaccccctgcccgcc

SEQ ID NO: 1268943 - DNA, 13 bp, Homo sapiens
gaccccgagggct

SEQ ID NO: 1268944 - DNA, 19 bp, Homo sapiens
gaccccgagggctgaggag

SEQ ID NO: 1268945 - DNA, 20 bp, Homo sapiens
gaccccgtccacgtcctcca

SEQ ID NO: 1268946 - DNA, 16 bp, Homo sapiens
gaccccgtggctctgg

SEQ ID NO: 1268947 - DNA, 18 bp, Homo sapiens
gaccccgtggctctggga

SEQ ID NO: 1268948 - DNA, 24 bp, Homo sapiens
gacccctaccccctcatcccccag

SEQ ID NO: 1268949 - DNA, 11 bp, Homo sapiens
gacccctcacc

SEQ ID NO: 1268950 - DNA, 18 bp, Homo sapiens
gacccctcaccaccccca

SEQ ID NO: 1268951 - DNA, 22 bp, Homo sapiens
gacccctcaccttgcaacacac

SEQ ID NO: 1268952 - DNA, 15 bp, Homo sapiens
gacccctcagctccc

SEQ ID NO: 1268953 - DNA, 16 bp, Homo sapiens
gacccctcagctcccc

SEQ ID NO: 1268954 - DNA, 19 bp, Homo sapiens
gacccctcgcaaccctgcc

SEQ ID NO: 1268955 - DNA, 20 bp, Homo sapiens
gacccctcgcaaccctgcct

SEQ ID NO: 1268956 - DNA, 15 bp, Homo sapiens
gacccctgccttcct

SEQ ID NO: 1268957 - DNA, 21 bp, Homo sapiens
gacccctggcttttcactgct

SEQ ID NO: 1268958 - DNA, 16 bp, Homo sapiens
gacccctggggtggcc

SEQ ID NO: 1268959 - DNA, 21 bp, Homo sapiens
gacccctggggtggccagggc

SEQ ID NO: 1268960 - DNA, 17 bp, Homo sapiens
gaccccttcctttcctc

SEQ ID NO: 1268961 - DNA, 18 bp, Homo sapiens
gaccccttcctttcctct

SEQ ID NO: 1268962 - DNA, 14 bp, Homo sapiens
gaccccttctctct

SEQ ID NO: 1268963 - DNA, 15 bp, Homo sapiens
gaccccttctctctc

SEQ ID NO: 1268964 - DNA, 11 bp, Homo sapiens
gaccccttgct

SEQ ID NO: 1268965 - DNA, 23 bp, Homo sapiens
gaccccttgttgcactgccccct

SEQ ID NO: 1268966 - DNA, 12 bp, Homo sapiens
gacccctttgag

SEQ ID NO: 1268967 - DNA, 17 bp, Homo sapiens
gacccgccagccccgct

SEQ ID NO: 1268968 - DNA, 23 bp, Homo sapiens
gacccgccagccccgctcccacc

SEQ ID NO: 1268969 - DNA, 21 bp, Homo sapiens
gacccggagctaacactggcc

SEQ ID NO: 1268970 - DNA, 17 bp, Homo sapiens
gacccggggtctcctgg

SEQ ID NO: 1268971 - DNA, 22 bp, Homo sapiens
gacccggttattcgcccacccg

SEQ ID NO: 1268972 - DNA, 14 bp, Homo sapiens
gacccggttgcagt

SEQ ID NO: 1268973 - DNA, 16 bp, Homo sapiens
gaccctaaatcttgac

SEQ ID NO: 1268974 - DNA, 16 bp, Homo sapiens
gaccctattgctgctt

SEQ ID NO: 1268975 - DNA, 19 bp, Homo sapiens
gaccctcactgctggggag

SEQ ID NO: 1268976 - DNA, 14 bp, Homo sapiens
gaccctcagccctg

SEQ ID NO: 1268977 - DNA, 16 bp, Homo sapiens
gaccctcagccctggc

SEQ ID NO: 1268978 - DNA, 17 bp, Homo sapiens
gaccctcagccctggcc

SEQ ID NO: 1268979 - DNA, 12 bp, Homo sapiens
gaccctccactc

SEQ ID NO: 1268980 - DNA, 20 bp, Homo sapiens
gaccctccactcactgctgt

SEQ ID NO: 1268981 - DNA, 11 bp, Homo sapiens
gaccctcccac

SEQ ID NO: 1268982 - DNA, 14 bp, Homo sapiens
gaccctcccactcc

SEQ ID NO: 1268983 - DNA, 15 bp, Homo sapiens
gaccctcccactccc

SEQ ID NO: 1268984 - DNA, 16 bp, Homo sapiens
gaccctcccactccca

SEQ ID NO: 1268985 - DNA, 18 bp, Homo sapiens
gaccctcctccactccac

SEQ ID NO: 1268986 - DNA, 21 bp, Homo sapiens
gaccctcctccactccacctc

SEQ ID NO: 1268987 - DNA, 22 bp, Homo sapiens
gaccctcctcctcccccagagg

SEQ ID NO: 1268988 - DNA, 15 bp, Homo sapiens
gaccctcgcagacct

SEQ ID NO: 1268989 - DNA, 12 bp, Homo sapiens
gaccctctcact

SEQ ID NO: 1268990 - DNA, 14 bp, Homo sapiens
gaccctctcacttt

SEQ ID NO: 1268991 - DNA, 21 bp, Homo sapiens
gaccctctgggaacctcccag

SEQ ID NO: 1268992 - DNA, 22 bp, Homo sapiens
gaccctctgggaacctcccaga

SEQ ID NO: 1268993 - DNA, 13 bp, Homo sapiens
gaccctctgtccc

SEQ ID NO: 1268994 - DNA, 15 bp, Homo sapiens
gaccctctgtcccca

SEQ ID NO: 1268995 - DNA, 21 bp, Homo sapiens
gaccctctgtccccaggcctg

SEQ ID NO: 1268996 - DNA, 22 bp, Homo sapiens
gaccctctgtccccaggcctgg

SEQ ID NO: 1268997 - DNA, 14 bp, Homo sapiens
gaccctcttgccca

SEQ ID NO: 1268998 - DNA, 20 bp, Homo sapiens
gaccctcttgcccatcctga

SEQ ID NO: 1268999 - DNA, 22 bp, Homo sapiens
gaccctcttgcccatcctgact

SEQ ID NO: 1269000 - DNA, 19 bp, Homo sapiens
gaccctgaacccacacctg

SEQ ID NO: 1269001 - DNA, 17 bp, Homo sapiens
gaccctgaggccctggg

SEQ ID NO: 1269002 - DNA, 21 bp, Homo sapiens
gaccctgaggccctgggctgg

SEQ ID NO: 1269003 - DNA, 19 bp, Homo sapiens
gaccctgcaaacagaacag

SEQ ID NO: 1269004 - DNA, 22 bp, Homo sapiens
gaccctgcaaacagaacagggt

SEQ ID NO: 1269005 - DNA, 15 bp, Homo sapiens
gaccctgcaagacca

SEQ ID NO: 1269006 - DNA, 18 bp, Homo sapiens
gaccctgcaagaccacgg

SEQ ID NO: 1269007 - DNA, 19 bp, Homo sapiens
gaccctgccacagccagag

SEQ ID NO: 1269008 - DNA, 18 bp, Homo sapiens
gaccctgccccctgccag

SEQ ID NO: 1269009 - DNA, 15 bp, Homo sapiens
gaccctgcctgagcc

SEQ ID NO: 1269010 - DNA, 17 bp, Homo sapiens
gaccctgctcacaggca

SEQ ID NO: 1269011 - DNA, 21 bp, Homo sapiens
gaccctggaattcagcaccct

SEQ ID NO: 1269012 - DNA, 18 bp, Homo sapiens
gaccctggcctcaagtta

SEQ ID NO: 1269013 - DNA, 15 bp, Homo sapiens
gaccctgggagagaa

SEQ ID NO: 1269014 - DNA, 19 bp, Homo sapiens
gaccctgggtgggctctgt

SEQ ID NO: 1269015 - DNA, 21 bp, Homo sapiens
gaccctgggtgggctctgtgc

SEQ ID NO: 1269016 - DNA, 19 bp, Homo sapiens
gaccctggtgacctcctgt

SEQ ID NO: 1269017 - DNA, 21 bp, Homo sapiens
gaccctggtgacctcctgtca

SEQ ID NO: 1269018 - DNA, 11 bp, Homo sapiens
gaccctgtata

SEQ ID NO: 1269019 - DNA, 17 bp, Homo sapiens
gaccctgtatatagccc

SEQ ID NO: 1269020 - DNA, 16 bp, Homo sapiens
gaccctgtcctgcagt

SEQ ID NO: 1269021 - DNA, 24 bp, Homo sapiens
gaccctgtcctgcagtcccacact

SEQ ID NO: 1269022 - DNA, 17 bp, Homo sapiens
gaccctgtcttctgggc

SEQ ID NO: 1269023 - DNA, 15 bp, Homo sapiens
gaccctgtggccagg

SEQ ID NO: 1269024 - DNA, 17 bp, Homo sapiens
gacccttacagcctctg

SEQ ID NO: 1269025 - DNA, 16 bp, Homo sapiens
gacccttattgctgtc

SEQ ID NO: 1269026 - DNA, 14 bp, Homo sapiens
gacccttcagggcc

SEQ ID NO: 1269027 - DNA, 15 bp, Homo sapiens
gacccttcagggcca

SEQ ID NO: 1269028 - DNA, 17 bp, Homo sapiens
gacccttcagggccaga

SEQ ID NO: 1269029 - DNA, 17 bp, Homo sapiens
gacccttcccagccctc

SEQ ID NO: 1269030 - DNA, 20 bp, Homo sapiens
gacccttcccagccctcatc

SEQ ID NO: 1269031 - DNA, 21 bp, Homo sapiens
gacccttggtgtttcccttcc

SEQ ID NO: 1269032 - DNA, 17 bp, Homo sapiens
gaccctttcctccccca

SEQ ID NO: 1269033 - DNA, 14 bp, Homo sapiens
gaccctttccttcc

SEQ ID NO: 1269034 - DNA, 12 bp, Homo sapiens
gaccctttgggg

SEQ ID NO: 1269035 - DNA, 12 bp, Homo sapiens
gacccttttcat

SEQ ID NO: 1269036 - DNA, 15 bp, Homo sapiens
gacccttttctcagg

SEQ ID NO: 1269037 - DNA, 13 bp, Homo sapiens
gacccttttctga

SEQ ID NO: 1269038 - DNA, 16 bp, Homo sapiens
gaccgaaatctgtatt

SEQ ID NO: 1269039 - DNA, 22 bp, Homo sapiens
gaccgagatgtgagtcctgttg

SEQ ID NO: 1269040 - DNA, 13 bp, Homo sapiens
gaccgccccaggg

SEQ ID NO: 1269041 - DNA, 15 bp, Homo sapiens
gaccgccccctcctc

SEQ ID NO: 1269042 - DNA, 16 bp, Homo sapiens
gaccgcctggccctcc

SEQ ID NO: 1269043 - DNA, 22 bp, Homo sapiens
gaccgcttgtggggacccaggc

SEQ ID NO: 1269044 - DNA, 20 bp, Homo sapiens
gaccggcggaccccagccat

SEQ ID NO: 1269045 - DNA, 15 bp, Homo sapiens
gaccggcggctcgga

SEQ ID NO: 1269046 - DNA, 17 bp, Homo sapiens
gaccgggtgggcctggc

SEQ ID NO: 1269047 - DNA, 19 bp, Homo sapiens
gaccgggtgggcctggcct

SEQ ID NO: 1269048 - DNA, 20 bp, Homo sapiens
gacctgggtatcccctgcct

SEQ ID NO: 1269049 - DNA, 23 bp, Homo sapiens
gacctgggtatcccctgcctcct

SEQ ID NO: 1269050 - DNA, 22 bp, Homo sapiens
gacctggtgctgcctctacctg

SEQ ID NO: 1269051 - DNA, 15 bp, Homo sapiens
gacctggttcccact

SEQ ID NO: 1269052 - DNA, 20 bp, Homo sapiens
gacctgtcatgcccccctca

SEQ ID NO: 1269053 - DNA, 17 bp, Homo sapiens
gacctgtgaccagcact

SEQ ID NO: 1269054 - DNA, 15 bp, Homo sapiens
gacctgtgagcccag

SEQ ID NO: 1269055 - DNA, 19 bp, Homo sapiens
gacctgtgagcccagctgg

SEQ ID NO: 1269056 - DNA, 23 bp, Homo sapiens
gacctgtgagcccagctgggtca

SEQ ID NO: 1269057 - DNA, 14 bp, Homo sapiens
gacctgtgctttga

SEQ ID NO: 1269058 - DNA, 20 bp, Homo sapiens
gacctgtggggatttctccc

SEQ ID NO: 1269059 - DNA, 22 bp, Homo sapiens
gacctgtggggatttctcccag

SEQ ID NO: 1269060 - DNA, 23 bp, Homo sapiens
gacctgtggggatttctcccagc

SEQ ID NO: 1269061 - DNA, 18 bp, Homo sapiens
gacctgtgttcttgctga

SEQ ID NO: 1269062 - DNA, 17 bp, Homo sapiens
gacctgttagcagacag

SEQ ID NO: 1269063 - DNA, 18 bp, Homo sapiens
gacctgttgccagcagat

SEQ ID NO: 1269064 - DNA, 16 bp, Homo sapiens
gacctgttggcctgtg

SEQ ID NO: 1269065 - DNA, 14 bp, Homo sapiens
gaccttaaatgcaa

SEQ ID NO: 1269066 - DNA, 18 bp, Homo sapiens
gaccttaagacactgtga

SEQ ID NO: 1269067 - DNA, 22 bp, Homo sapiens
gaccttaataaaggcccccact

SEQ ID NO: 1269068 - DNA, 23 bp, Homo sapiens
gaccttaataaaggcccccactt

SEQ ID NO: 1269069 - DNA, 19 bp, Homo sapiens
gaccttagaaatcattgta

SEQ ID NO: 1269070 - DNA, 15 bp, Homo sapiens
gaccttagcgttctg

SEQ ID NO: 1269071 - DNA, 15 bp, Homo sapiens
gaccttaggccttcc

SEQ ID NO: 1269072 - DNA, 16 bp, Homo sapiens
gaccttaggccttcct

SEQ ID NO: 1269073 - DNA, 21 bp, Homo sapiens
gaccttaggccttcctctctc

SEQ ID NO: 1269074 - DNA, 16 bp, Homo sapiens
gaccttcatttcatgt

SEQ ID NO: 1269075 - DNA, 10 bp, Homo sapiens
gaccttcccc

SEQ ID NO: 1269076 - DNA, 14 bp, Homo sapiens
gaccttcctcatcc

SEQ ID NO: 1269077 - DNA, 23 bp, Homo sapiens
gaccttcctcatccaccccatcc

SEQ ID NO: 1269078 - DNA, 14 bp, Homo sapiens
gaccttcctgccac

SEQ ID NO: 1269079 - DNA, 19 bp, Homo sapiens
gaccttcctgccaccagtc

SEQ ID NO: 1269080 - DNA, 23 bp, Homo sapiens
gaccttcctgccaccagtcactg

SEQ ID NO: 1269081 - DNA, 19 bp, Homo sapiens
gaccttctagtgagcctgg

SEQ ID NO: 1269082 - DNA, 22 bp, Homo sapiens
gaccttctgcggctccgggctg

SEQ ID NO: 1269083 - DNA, 12 bp, Homo sapiens
gaccttctggga

SEQ ID NO: 1269084 - DNA, 19 bp, Homo sapiens
gaccttgaagggtaaagaa

SEQ ID NO: 1269085 - DNA, 18 bp, Homo sapiens
gaccttgacagagcagct

SEQ ID NO: 1269086 - DNA, 19 bp, Homo sapiens
gaccttgagggtgggccag

SEQ ID NO: 1269087 - DNA, 22 bp, Homo sapiens
gaccttgcaacctcaccttcct

SEQ ID NO: 1269088 - DNA, 15 bp, Homo sapiens
gaccttgctgccaca

SEQ ID NO: 1269089 - DNA, 16 bp, Homo sapiens
gaccttgctgccacaa

SEQ ID NO: 1269090 - DNA, 18 bp, Homo sapiens
gaccttggatcagtggtc

SEQ ID NO: 1269091 - DNA, 21 bp, Homo sapiens
gaccttgggaccaaaggggga

SEQ ID NO: 1269092 - DNA, 22 bp, Homo sapiens
gaccttgggaccaaagggggag

SEQ ID NO: 1269093 - DNA, 18 bp, Homo sapiens
gaccttgggcacatctgc

SEQ ID NO: 1269094 - DNA, 18 bp, Homo sapiens
gaccttgtagtgagccga

SEQ ID NO: 1269095 - DNA, 21 bp, Homo sapiens
gacctttccaccacagccagc

SEQ ID NO: 1269096 - DNA, 22 bp, Homo sapiens
gacctttgatgaattcttcctc

SEQ ID NO: 1269097 - DNA, 21 bp, Homo sapiens
gacctttgtcatctttcttct

SEQ ID NO: 1269098 - DNA, 14 bp, Homo sapiens
gaccttttgctgcc

SEQ ID NO: 1269099 - DNA, 18 bp, Homo sapiens
gacgaggggtgtcttggg

SEQ ID NO: 1269100 - DNA, 23 bp, Homo sapiens
gacgatatttaattcacctcagc

SEQ ID NO: 1269101 - DNA, 14 bp, Homo sapiens
gacgcacgctcgct

SEQ ID NO: 1269102 - DNA, 16 bp, Homo sapiens
gacgcacgctcgctgc

SEQ ID NO: 1269103 - DNA, 19 bp, Homo sapiens
gacgcacgctcgctgccat

SEQ ID NO: 1269104 - DNA, 20 bp, Homo sapiens
gacgcacgctcgctgccatc

SEQ ID NO: 1269105 - DNA, 21 bp, Homo sapiens
gacgcacgctcgctgccatca

SEQ ID NO: 1269106 - DNA, 20 bp, Homo sapiens
gacgcagacagaggggatgg

SEQ ID NO: 1269107 - DNA, 12 bp, Homo sapiens
gacgcagcagct

SEQ ID NO: 1269108 - DNA, 17 bp, Homo sapiens
gacgcaggccctgtcca

SEQ ID NO: 1269109 - DNA, 20 bp, Homo sapiens
gacgcaggccctgtccagcc

SEQ ID NO: 1269110 - DNA, 19 bp, Homo sapiens
gacgccaacttctcccacc

SEQ ID NO: 1269111 - DNA, 22 bp, Homo sapiens
gacgccaacttctcccacccct

SEQ ID NO: 1269112 - DNA, 15 bp, Homo sapiens
gacgccaataataaa

SEQ ID NO: 1269113 - DNA, 14 bp, Homo sapiens
gacgccactcattt

SEQ ID NO: 1269114 - DNA, 17 bp, Homo sapiens
gacgccactcatttcat

SEQ ID NO: 1269115 - DNA, 11 bp, Homo sapiens
gacgcccagct

SEQ ID NO: 1269116 - DNA, 15 bp, Homo sapiens
gacgccctctcccca

SEQ ID NO: 1269117 - DNA, 15 bp, Homo sapiens
gacgccgtcccacca

SEQ ID NO: 1269118 - DNA, 13 bp, Homo sapiens
gacgcctgagctc

SEQ ID NO: 1269119 - DNA, 17 bp, Homo sapiens
gacgcctgagctcactc

SEQ ID NO: 1269120 - DNA, 21 bp, Homo sapiens
gacgcctgggggtgccaggac

SEQ ID NO: 1269121 - DNA, 23 bp, Homo sapiens
gacgcctgtctgtgtgcatcatg

SEQ ID NO: 1269122 - DNA, 24 bp, Homo sapiens
gacgccttcatctgggacaaaact

SEQ ID NO: 1269123 - DNA, 16 bp, Homo sapiens
gacgccttccaggtca

SEQ ID NO: 1269124 - DNA, 19 bp, Homo sapiens
gacgccttccaggtcagga

SEQ ID NO: 1269125 - DNA, 17 bp, Homo sapiens
gacgctgaccgtggagc

SEQ ID NO: 1269126 - DNA, 19 bp, Homo sapiens
gacgctggagatgcaaggt

SEQ ID NO: 1269127 - DNA, 13 bp, Homo sapiens
gacgcttctgaat

SEQ ID NO: 1269128 - DNA, 21 bp, Homo sapiens
gacgcttgtgacagtgcctct

SEQ ID NO: 1269129 - DNA, 20 bp, Homo sapiens
gacggagcccacactgccac

SEQ ID NO: 1269130 - DNA, 12 bp, Homo sapiens
gacggaggggag

SEQ ID NO: 1269131 - DNA, 11 bp, Homo sapiens
gacggcaggct

SEQ ID NO: 1269132 - DNA, 12 bp, Homo sapiens
gacggccctgct

SEQ ID NO: 1269133 - DNA, 18 bp, Homo sapiens
gacggcctccaggagggg

SEQ ID NO: 1269134 - DNA, 20 bp, Homo sapiens
gacggcctccaggaggggcc

SEQ ID NO: 1269135 - DNA, 20 bp, Homo sapiens
gacggcctgatgctccctcc

SEQ ID NO: 1269136 - DNA, 23 bp, Homo sapiens
gacggcctgatgctccctcccct

SEQ ID NO: 1269137 - DNA, 17 bp, Homo sapiens
gacggcgcccccagtgt

SEQ ID NO: 1269138 - DNA, 15 bp, Homo sapiens
gacggctgccattgg

SEQ ID NO: 1269139 - DNA, 18 bp, Homo sapiens
gacggctgggcacacgcc

SEQ ID NO: 1269140 - DNA, 22 bp, Homo sapiens
gacggctgggcacacgcctccc

SEQ ID NO: 1269141 - DNA, 18 bp, Homo sapiens
gacgggaatgcctaggtc

SEQ ID NO: 1269142 - DNA, 23 bp, Homo sapiens
gacgggccctccttccctcctgt

SEQ ID NO: 1269143 - DNA, 21 bp, Homo sapiens
gacgggccgcaggagggaggc

SEQ ID NO: 1269144 - DNA, 13 bp, Homo sapiens
gacggggctcagc

SEQ ID NO: 1269145 - DNA, 12 bp, Homo sapiens
gacgggggtggg

SEQ ID NO: 1269146 - DNA, 20 bp, Homo sapiens
gacggggtcggacggggcag

SEQ ID NO: 1269147 - DNA, 16 bp, Homo sapiens
gacggtcccacactgg

SEQ ID NO: 1269148 - DNA, 15 bp, Homo sapiens
gacggtctgtgtgct

SEQ ID NO: 1269149 - DNA, 16 bp, Homo sapiens
gacggtctgtgtgctg

SEQ ID NO: 1269150 - DNA, 14 bp, Homo sapiens
gacggtgacaaaga

SEQ ID NO: 1269151 - DNA, 20 bp, Homo sapiens
gacggtgccaagggccccag

SEQ ID NO: 1269152 - DNA, 21 bp, Homo sapiens
gacggtgggcatttgtgaggc

SEQ ID NO: 1269153 - DNA, 20 bp, Homo sapiens
gacggttaacttgtatattc

SEQ ID NO: 1269154 - DNA, 18 bp, Homo sapiens
gacggtttctagcctctg

SEQ ID NO: 1269155 - DNA, 14 bp, Homo sapiens
gacggttttgcttt

SEQ ID NO: 1269156 - DNA, 12 bp, Homo sapiens
gacgtaaaattt

SEQ ID NO: 1269157 - DNA, 22 bp, Homo sapiens
gacgtcaacccaagctctgggg

SEQ ID NO: 1269158 - DNA, 14 bp, Homo sapiens
gacgtcaagtctcc

SEQ ID NO: 1269159 - DNA, 18 bp, Homo sapiens
gacgtcaagtctccttcc

SEQ ID NO: 1269160 - DNA, 16 bp, Homo sapiens
gacgtcacgctccctg

SEQ ID NO: 1269161 - DNA, 13 bp, Homo sapiens
gacgtcaggccct

SEQ ID NO: 1269162 - DNA, 19 bp, Homo sapiens
gacgtcaggccctgactcc

SEQ ID NO: 1269163 - DNA, 23 bp, Homo sapiens
gacgtcaggccctgactcctctg

SEQ ID NO: 1269164 - DNA, 19 bp, Homo sapiens
gacgtcatcggaggctggg

SEQ ID NO: 1269165 - DNA, 21 bp, Homo sapiens
gacgtcatcggaggctgggcc

SEQ ID NO: 1269166 - DNA, 22 bp, Homo sapiens
gacgtcatcggaggctgggccc

SEQ ID NO: 1269167 - DNA, 20 bp, Homo sapiens
gacgtcgtacccagccatgt

SEQ ID NO: 1269168 - DNA, 19 bp, Homo sapiens
gacgtctggggtgtgggga

SEQ ID NO: 1269169 - DNA, 18 bp, Homo sapiens
gactgcatttaaatttga

SEQ ID NO: 1269170 - DNA, 21 bp, Homo sapiens
gactgcccagccactccaagc

SEQ ID NO: 1269171 - DNA, 22 bp, Homo sapiens
gactgcccagccactccaagcc

SEQ ID NO: 1269172 - DNA, 22 bp, Homo sapiens
gactgccccacggagacagagg

SEQ ID NO: 1269173 - DNA, 19 bp, Homo sapiens
gactgccccagccaacgag

SEQ ID NO: 1269174 - DNA, 14 bp, Homo sapiens
gactgcccccagaa

SEQ ID NO: 1269175 - DNA, 15 bp, Homo sapiens
gactgcccctgctgt

SEQ ID NO: 1269176 - DNA, 22 bp, Homo sapiens
gactgcccctgctgtgctgctc

SEQ ID NO: 1269177 - DNA, 19 bp, Homo sapiens
gactgccgaccgaggctgg

SEQ ID NO: 1269178 - DNA, 11 bp, Homo sapiens
gactgcctgtc

SEQ ID NO: 1269179 - DNA, 19 bp, Homo sapiens
gactgctccccagccctgg

SEQ ID NO: 1269180 - DNA, 21 bp, Homo sapiens
gactgctccccagccctggct

SEQ ID NO: 1269181 - DNA, 13 bp, Homo sapiens
gactgctgctccc

SEQ ID NO: 1269182 - DNA, 17 bp, Homo sapiens
gactgctgctccccacc

SEQ ID NO: 1269183 - DNA, 19 bp, Homo sapiens
gactgctgctccccacccc

SEQ ID NO: 1269184 - DNA, 16 bp, Homo sapiens
gactgctgctgcctgg

SEQ ID NO: 1269185 - DNA, 12 bp, Homo sapiens
gactgctggctc

SEQ ID NO: 1269186 - DNA, 15 bp, Homo sapiens
gactgctggctcacg

SEQ ID NO: 1269187 - DNA, 13 bp, Homo sapiens
gactgcttcccat

SEQ ID NO: 1269188 - DNA, 17 bp, Homo sapiens
gactgcttcccatccta

SEQ ID NO: 1269189 - DNA, 22 bp, Homo sapiens
gactgcttcccatcctaccctc

SEQ ID NO: 1269190 - DNA, 14 bp, Homo sapiens
gactgcttggccag

SEQ ID NO: 1269191 - DNA, 21 bp, Homo sapiens
gactgctttggacctaaatgg

SEQ ID NO: 1269192 - DNA, 20 bp, Homo sapiens
gactggaagctaatttgcat

SEQ ID NO: 1269193 - DNA, 19 bp, Homo sapiens
gactggaaggtccttgcct

SEQ ID NO: 1269194 - DNA, 14 bp, Homo sapiens
gactggacagcttg

SEQ ID NO: 1269195 - DNA, 15 bp, Homo sapiens
gactggacagcttgt

SEQ ID NO: 1269196 - DNA, 17 bp, Homo sapiens
gactggaccgctgactg

SEQ ID NO: 1269197 - DNA, 18 bp, Homo sapiens
gactggacctggtggcta

SEQ ID NO: 1269198 - DNA, 22 bp, Homo sapiens
gactggagaaaacccctcccac

SEQ ID NO: 1269199 - DNA, 16 bp, Homo sapiens
gactggaggaacacag

SEQ ID NO: 1269200 - DNA, 15 bp, Homo sapiens
gactggaggtgggca

SEQ ID NO: 1269201 - DNA, 18 bp, Homo sapiens
gactggaggtgggcatgc

SEQ ID NO: 1269202 - DNA, 15 bp, Homo sapiens
gactggagtgaggct

SEQ ID NO: 1269203 - DNA, 22 bp, Homo sapiens
gactggagtgaggcttccaggc

SEQ ID NO: 1269204 - DNA, 22 bp, Homo sapiens
gactggatactgcccggggcag

SEQ ID NO: 1269205 - DNA, 12 bp, Homo sapiens
gactggcaataa

SEQ ID NO: 1269206 - DNA, 14 bp, Homo sapiens
gactggcaataaac

SEQ ID NO: 1269207 - DNA, 12 bp, Homo sapiens
gactggccaggg

SEQ ID NO: 1269208 - DNA, 18 bp, Homo sapiens
gactggctagtgtggaag

SEQ ID NO: 1269209 - DNA, 17 bp, Homo sapiens
gactggctggctgcagt

SEQ ID NO: 1269210 - DNA, 15 bp, Homo sapiens
gactggctgtctgcc

SEQ ID NO: 1269211 - DNA, 19 bp, Homo sapiens
gactggctgtctgcctgta

SEQ ID NO: 1269212 - DNA, 23 bp, Homo sapiens
gactggctgtgtaaccttgggtg

SEQ ID NO: 1269213 - DNA, 20 bp, Homo sapiens
gactggcttttattaatgca

SEQ ID NO: 1269214 - DNA, 19 bp, Homo sapiens
gactgggaacccctcctgg

SEQ ID NO: 1269215 - DNA, 23 bp, Homo sapiens
gactgggaagataggctctgcac

SEQ ID NO: 1269216 - DNA, 21 bp, Homo sapiens
gactgggaccgtgcgagctgc

SEQ ID NO: 1269217 - DNA, 18 bp, Homo sapiens
gactgggagccgcagcag

SEQ ID NO: 1269218 - DNA, 13 bp, Homo sapiens
gactgggaggtag

SEQ ID NO: 1269219 - DNA, 15 bp, Homo sapiens
gactgggagtcagag

SEQ ID NO: 1269220 - DNA, 13 bp, Homo sapiens
gactgggcccagg

SEQ ID NO: 1269221 - DNA, 15 bp, Homo sapiens
gactgggcccaggca

SEQ ID NO: 1269222 - DNA, 16 bp, Homo sapiens
gactgggcccaggcag

SEQ ID NO: 1269223 - DNA, 22 bp, Homo sapiens
gactgggcctcccttgggctgg

SEQ ID NO: 1269224 - DNA, 15 bp, Homo sapiens
gactgggctctggct

SEQ ID NO: 1269225 - DNA, 21 bp, Homo sapiens
gactgggctgagggagcctgg

SEQ ID NO: 1269226 - DNA, 20 bp, Homo sapiens
gactggggatgtgggaggga

SEQ ID NO: 1269227 - DNA, 19 bp, Homo sapiens
gactggggccactacattt

SEQ ID NO: 1269228 - DNA, 17 bp, Homo sapiens
gactgggggactgggag

SEQ ID NO: 1269229 - DNA, 16 bp, Homo sapiens
gactggggtgggaggt

SEQ ID NO: 1269230 - DNA, 21 bp, Homo sapiens
gactgggtaggaaagaggaag

SEQ ID NO: 1269231 - DNA, 14 bp, Homo sapiens
gactgggtttctag

SEQ ID NO: 1269232 - DNA, 10 bp, Homo sapiens
gactggtcac

SEQ ID NO: 1269233 - DNA, 20 bp, Homo sapiens
gactggtcaccttgcactcc

SEQ ID NO: 1269234 - DNA, 11 bp, Homo sapiens
gactggtccag

SEQ ID NO: 1269235 - DNA, 12 bp, Homo sapiens
gactggtccagc

SEQ ID NO: 1269236 - DNA, 13 bp, Homo sapiens
gactggtccagct

SEQ ID NO: 1269237 - DNA, 14 bp, Homo sapiens
gactggtccagctc

SEQ ID NO: 1269238 - DNA, 16 bp, Homo sapiens
gactggtccagctctg

SEQ ID NO: 1269239 - DNA, 17 bp, Homo sapiens
gactggtccagctctga

SEQ ID NO: 1269240 - DNA, 18 bp, Homo sapiens
gactggtccagctctgac

SEQ ID NO: 1269241 - DNA, 20 bp, Homo sapiens
gactggtccagctctgacat

SEQ ID NO: 1269242 - DNA, 20 bp, Homo sapiens
gactggtgctataggctgga

SEQ ID NO: 1269243 - DNA, 19 bp, Homo sapiens
gactggtgggggttctggc

SEQ ID NO: 1269244 - DNA, 22 bp, Homo sapiens
gactggtgggggttctggcagg

SEQ ID NO: 1269245 - DNA, 23 bp, Homo sapiens
gactggtgggggttctggcagga

SEQ ID NO: 1269246 - DNA, 18 bp, Homo sapiens
gactggtttacaggccct

SEQ ID NO: 1269247 - DNA, 16 bp, Homo sapiens
gactggttttctgcca

SEQ ID NO: 1269248 - DNA, 13 bp, Homo sapiens
gactgtaactttt

SEQ ID NO: 1269249 - DNA, 15 bp, Homo sapiens
gactgtacagagact

SEQ ID NO: 1269250 - DNA, 16 bp, Homo sapiens
gactgtaccacagaca

SEQ ID NO: 1269251 - DNA, 20 bp, Homo sapiens
gactgtagattgcttctgta

SEQ ID NO: 1269252 - DNA, 14 bp, Homo sapiens
gactgtatattgct

SEQ ID NO: 1269253 - DNA, 15 bp, Homo sapiens
gactgtatattgcta

SEQ ID NO: 1269254 - DNA, 16 bp, Homo sapiens
gactgtatattgctaa

SEQ ID NO: 1269255 - DNA, 16 bp, Homo sapiens
gactgtatctgtgtag

SEQ ID NO: 1269256 - DNA, 19 bp, Homo sapiens
gactgtcacactggtgctg

SEQ ID NO: 1269257 - DNA, 22 bp, Homo sapiens
gactgtcacgcggcagcttcag

SEQ ID NO: 1269258 - DNA, 21 bp, Homo sapiens
gactgtcacggggttccctcc

SEQ ID NO: 1269259 - DNA, 23 bp, Homo sapiens
gactgtcacggggttccctccta

SEQ ID NO: 1269260 - DNA, 14 bp, Homo sapiens
gactgtcagggagg

SEQ ID NO: 1269261 - DNA, 20 bp, Homo sapiens
gactgtcctgaggagccctg

SEQ ID NO: 1269262 - DNA, 19 bp, Homo sapiens
gactgtctcacttaatcct

SEQ ID NO: 1269263 - DNA, 16 bp, Homo sapiens
gactgtgaaatgtttg

SEQ ID NO: 1269264 - DNA, 14 bp, Homo sapiens
gactgtgaatttca

SEQ ID NO: 1269265 - DNA, 23 bp, Homo sapiens
gactgtgacagactttggacagt

SEQ ID NO: 1269266 - DNA, 17 bp, Homo sapiens
gactgtgaccaccttct

SEQ ID NO: 1269267 - DNA, 19 bp, Homo sapiens
gactgtgcccaagtgggtc

SEQ ID NO: 1269268 - DNA, 17 bp, Homo sapiens
gactgtgggtggggagg

SEQ ID NO: 1269269 - DNA, 21 bp, Homo sapiens
gactgtggtaggggcagggag

SEQ ID NO: 1269270 - DNA, 19 bp, Homo sapiens
gactgtgtaactttctctt

SEQ ID NO: 1269271 - DNA, 19 bp, Homo sapiens
gactgttggctctctgacg

SEQ ID NO: 1269272 - DNA, 22 bp, Homo sapiens
gactgtttcattcactgtgcac

SEQ ID NO: 1269273 - DNA, 22 bp, Homo sapiens
gactgttttactgttttaattg

SEQ ID NO: 1269274 - DNA, 14 bp, Homo sapiens
gactgttttcaata

SEQ ID NO: 1269275 - DNA, 19 bp, Homo sapiens
gacttaaaatattcctgca

SEQ ID NO: 1269276 - DNA, 19 bp, Homo sapiens
gacttaaaattagtctttt

SEQ ID NO: 1269277 - DNA, 13 bp, Homo sapiens
gacttaaagcaga

SEQ ID NO: 1269278 - DNA, 14 bp, Homo sapiens
gacttaaaggacag

SEQ ID NO: 1269279 - DNA, 23 bp, Homo sapiens
gacttaaagggcccaatgaatta

SEQ ID NO: 1269280 - DNA, 14 bp, Homo sapiens
gacttaacggctcc

SEQ ID NO: 1269281 - DNA, 16 bp, Homo sapiens
gacttaacggctccag

SEQ ID NO: 1269282 - DNA, 19 bp, Homo sapiens
gacttaacggctccaggat

SEQ ID NO: 1269283 - DNA, 20 bp, Homo sapiens
gacttaactgcatttttaga

SEQ ID NO: 1269284 - DNA, 20 bp, Homo sapiens
gacttaagcatctggctcta

SEQ ID NO: 1269285 - DNA, 22 bp, Homo sapiens
gacttaagcatctggctctaat

SEQ ID NO: 1269286 - DNA, 14 bp, Homo sapiens
gacttacaaaatgc

SEQ ID NO: 1269287 - DNA, 13 bp, Homo sapiens
gacttactgggtg

SEQ ID NO: 1269288 - DNA, 15 bp, Homo sapiens
gacttactgtacatg

SEQ ID NO: 1269289 - DNA, 23 bp, Homo sapiens
gacttactgtacatgaaaacaca

SEQ ID NO: 1269290 - DNA, 19 bp, Homo sapiens
gacttagacctatactgaa

SEQ ID NO: 1269291 - DNA, 15 bp, Homo sapiens
gagacacacctgagg

SEQ ID NO: 1269292 - DNA, 11 bp, Homo sapiens
gagacacagat

SEQ ID NO: 1269293 - DNA, 13 bp, Homo sapiens
gagacacctgcac

SEQ ID NO: 1269294 - DNA, 18 bp, Homo sapiens
gagacacctgcacctccc

SEQ ID NO: 1269295 - DNA, 20 bp, Homo sapiens
gagacacctgcacctccccc

SEQ ID NO: 1269296 - DNA, 21 bp, Homo sapiens
gagacacctgcacctcccccc

SEQ ID NO: 1269297 - DNA, 15 bp, Homo sapiens
gagacagaagcaggc

SEQ ID NO: 1269298 - DNA, 12 bp, Homo sapiens
gagacagacaca

SEQ ID NO: 1269299 - DNA, 21 bp, Homo sapiens
gagacagaccacttgccacgc

SEQ ID NO: 1269300 - DNA, 17 bp, Homo sapiens
gagacagactagaagtt

SEQ ID NO: 1269301 - DNA, 19 bp, Homo sapiens
gagacagaggaaagggctg

SEQ ID NO: 1269302 - DNA, 23 bp, Homo sapiens
gagacagaggaaagggctggctc

SEQ ID NO: 1269303 - DNA, 18 bp, Homo sapiens
gagacagagtcttggtct

SEQ ID NO: 1269304 - DNA, 22 bp, Homo sapiens
gagacagatacctccaaccctg

SEQ ID NO: 1269305 - DNA, 20 bp, Homo sapiens
gagacagatcactcctggag

SEQ ID NO: 1269306 - DNA, 12 bp, Homo sapiens
gagacagcagcc

SEQ ID NO: 1269307 - DNA, 14 bp, Homo sapiens
gagacagcagcctg

SEQ ID NO: 1269308 - DNA, 15 bp, Homo sapiens
gagacagcagcctgt

SEQ ID NO: 1269309 - DNA, 18 bp, Homo sapiens
gagacagcagcctgtatg

SEQ ID NO: 1269310 - DNA, 14 bp, Homo sapiens
gagacagcttctct

SEQ ID NO: 1269311 - DNA, 19 bp, Homo sapiens
gagacaggaaaatcctctg

SEQ ID NO: 1269312 - DNA, 18 bp, Homo sapiens
gagacaggacagaatgtg

SEQ ID NO: 1269313 - DNA, 19 bp, Homo sapiens
gagacaggacagaatgtgt

SEQ ID NO: 1269314 - DNA, 15 bp, Homo sapiens
gagacaggagggcaa

SEQ ID NO: 1269315 - DNA, 19 bp, Homo sapiens
gagacaggcagcccagcag

SEQ ID NO: 1269316 - DNA, 16 bp, Homo sapiens
gagacagggtaggaaa

SEQ ID NO: 1269317 - DNA, 18 bp, Homo sapiens
gagacagggtaggaaagg

SEQ ID NO: 1269318 - DNA, 19 bp, Homo sapiens
gagacagggtaggaaaggg

SEQ ID NO: 1269319 - DNA, 18 bp, Homo sapiens
gagacagggtcttgctct

SEQ ID NO: 1269320 - DNA, 22 bp, Homo sapiens
gagacagggtttggctgtgtct

SEQ ID NO: 1269321 - DNA, 16 bp, Homo sapiens
gagacagtgggaaata

SEQ ID NO: 1269322 - DNA, 16 bp, Homo sapiens
gagacagttcaagaaa

SEQ ID NO: 1269323 - DNA, 18 bp, Homo sapiens
gagacagttcaagaaagc

SEQ ID NO: 1269324 - DNA, 15 bp, Homo sapiens
gagacagttctctgt

SEQ ID NO: 1269325 - DNA, 15 bp, Homo sapiens
gagacatggaccagc

SEQ ID NO: 1269326 - DNA, 22 bp, Homo sapiens
gagacatgggatccaattttaa

SEQ ID NO: 1269327 - DNA, 16 bp, Homo sapiens
gagaccaacctgacca

SEQ ID NO: 1269328 - DNA, 22 bp, Homo sapiens
gagaccaagactctgaaatctc

SEQ ID NO: 1269329 - DNA, 17 bp, Homo sapiens
gagaccaagtcctggct

SEQ ID NO: 1269330 - DNA, 16 bp, Homo sapiens
gagaccagggagcctt

SEQ ID NO: 1269331 - DNA, 20 bp, Homo sapiens
gagaccagttgggagcactg

SEQ ID NO: 1269332 - DNA, 23 bp, Homo sapiens
gagaccatcctggcccctccaga

SEQ ID NO: 1269333 - DNA, 16 bp, Homo sapiens
gagaccatcctggcta

SEQ ID NO: 1269334 - DNA, 22 bp, Homo sapiens
gagacccaaagcggtccctgtc

SEQ ID NO: 1269335 - DNA, 24 bp, Homo sapiens
gagacccaaattataagggccctg

SEQ ID NO: 1269336 - DNA, 14 bp, Homo sapiens
gagacccaaggagg

SEQ ID NO: 1269337 - DNA, 13 bp, Homo sapiens
gagacccccacac

SEQ ID NO: 1269338 - DNA, 14 bp, Homo sapiens
gagacccccacacc

SEQ ID NO: 1269339 - DNA, 15 bp, Homo sapiens
gagacccctgtctcc

SEQ ID NO: 1269340 - DNA, 14 bp, Homo sapiens
gagaccccttcctt

SEQ ID NO: 1269341 - DNA, 15 bp, Homo sapiens
gagaccccttccttt

SEQ ID NO: 1269342 - DNA, 20 bp, Homo sapiens
gagaccccttcctttcctct

SEQ ID NO: 1269343 - DNA, 19 bp, Homo sapiens
gagaccccttgttgcactg

SEQ ID NO: 1269344 - DNA, 12 bp, Homo sapiens
gagaccctcact

SEQ ID NO: 1269345 - DNA, 23 bp, Homo sapiens
gagaccctgccacagccagagga

SEQ ID NO: 1269346 - DNA, 13 bp, Homo sapiens
gagacccttttct

SEQ ID NO: 1269347 - DNA, 16 bp, Homo sapiens
gagacccttttctcag

SEQ ID NO: 1269348 - DNA, 21 bp, Homo sapiens
gagaccgcttcacccctgcac

SEQ ID NO: 1269349 - DNA, 18 bp, Homo sapiens
gagaccgggccctgggtt

SEQ ID NO: 1269350 - DNA, 20 bp, Homo sapiens
gagaccgtcgggggctgagg

SEQ ID NO: 1269351 - DNA, 17 bp, Homo sapiens
gagacctacaggctgac

SEQ ID NO: 1269352 - DNA, 13 bp, Homo sapiens
gagacctcagcca

SEQ ID NO: 1269353 - DNA, 14 bp, Homo sapiens
gagacctcagccat

SEQ ID NO: 1269354 - DNA, 19 bp, Homo sapiens
gagacctcatcaggatgaa

SEQ ID NO: 1269355 - DNA, 15 bp, Homo sapiens
gagacctgaagtgtg

SEQ ID NO: 1269356 - DNA, 18 bp, Homo sapiens
gagacctgacaagcactg

SEQ ID NO: 1269357 - DNA, 19 bp, Homo sapiens
gagacctgacaagcactgc

SEQ ID NO: 1269358 - DNA, 16 bp, Homo sapiens
gagacctgaggcagat

SEQ ID NO: 1269359 - DNA, 17 bp, Homo sapiens
gagacctgttggcctgt

SEQ ID NO: 1269360 - DNA, 19 bp, Homo sapiens
gagacctgttggcctgtgg

SEQ ID NO: 1269361 - DNA, 21 bp, Homo sapiens
gagacctgttggcctgtgggc

SEQ ID NO: 1269362 - DNA, 19 bp, Homo sapiens
gagacgcacacagctgagc

SEQ ID NO: 1269363 - DNA, 21 bp, Homo sapiens
gagacgcacacagctgagcac

SEQ ID NO: 1269364 - DNA, 14 bp, Homo sapiens
gagacggccctgct

SEQ ID NO: 1269365 - DNA, 18 bp, Homo sapiens
gagacggccctgctgggg

SEQ ID NO: 1269366 - DNA, 21 bp, Homo sapiens
gagacggcgattttcgggctg

SEQ ID NO: 1269367 - DNA, 18 bp, Homo sapiens
gagacggtgttttgccat

SEQ ID NO: 1269368 - DNA, 18 bp, Homo sapiens
gagacgtggaacctctgt

SEQ ID NO: 1269369 - DNA, 21 bp, Homo sapiens
gagacgtggaacctctgtctc

SEQ ID NO: 1269370 - DNA, 22 bp, Homo sapiens
gagacgtggaacctctgtctca

SEQ ID NO: 1269371 - DNA, 19 bp, Homo sapiens
gagacgtggtgggactcca

SEQ ID NO: 1269372 - DNA, 18 bp, Homo sapiens
gagactcaaaaaaacaaa

SEQ ID NO: 1269373 - DNA, 17 bp, Homo sapiens
gagactcacactctctg

SEQ ID NO: 1269374 - DNA, 19 bp, Homo sapiens
gagactcacactctctgca

SEQ ID NO: 1269375 - DNA, 15 bp, Homo sapiens
gagactcacctctgc

SEQ ID NO: 1269376 - DNA, 18 bp, Homo sapiens
gagactcacctctgcctc

SEQ ID NO: 1269377 - DNA, 19 bp, Homo sapiens
gagactcacctctgcctca

SEQ ID NO: 1269378 - DNA, 13 bp, Homo sapiens
gagactcagatga

SEQ ID NO: 1269379 - DNA, 13 bp, Homo sapiens
gagactccaagga

SEQ ID NO: 1269380 - DNA, 17 bp, Homo sapiens
gagactccagaatctgc

SEQ ID NO: 1269381 - DNA, 19 bp, Homo sapiens
gagactccagaatctgctg

SEQ ID NO: 1269382 - DNA, 13 bp, Homo sapiens
gagactccatctt

SEQ ID NO: 1269383 - DNA, 20 bp, Homo sapiens
gagactctagggtccagtgg

SEQ ID NO: 1269384 - DNA, 24 bp, Homo sapiens
gagactctttatttttctctttct

SEQ ID NO: 1269385 - DNA, 17 bp, Homo sapiens
gagactgaaagcagcag

SEQ ID NO: 1269386 - DNA, 15 bp, Homo sapiens
gagactgagcagccg

SEQ ID NO: 1269387 - DNA, 16 bp, Homo sapiens
gagactgcaggtgggc

SEQ ID NO: 1269388 - DNA, 18 bp, Homo sapiens
gagactgcaggtgggctg

SEQ ID NO: 1269389 - DNA, 12 bp, Homo sapiens
gagactgccctt

SEQ ID NO: 1269390 - DNA, 21 bp, Homo sapiens
gagactgggaagataggctct

SEQ ID NO: 1269391 - DNA, 14 bp, Homo sapiens
gagactgggctctg

SEQ ID NO: 1269392 - DNA, 17 bp, Homo sapiens
gagactgggctgaggga

SEQ ID NO: 1269393 - DNA, 21 bp, Homo sapiens
gagactgggctgagggagcct

SEQ ID NO: 1269394 - DNA, 13 bp, Homo sapiens
gagactgtcccga

SEQ ID NO: 1269395 - DNA, 22 bp, Homo sapiens
gagactgtccctgaaacctagt

SEQ ID NO: 1269396 - DNA, 16 bp, Homo sapiens
gagactgtcggagagg

SEQ ID NO: 1269397 - DNA, 20 bp, Homo sapiens
gagactgtcggagaggctgt

SEQ ID NO: 1269398 - DNA, 23 bp, Homo sapiens
gagactgtctcaagagggcactg

SEQ ID NO: 1269399 - DNA, 13 bp, Homo sapiens
gagactgtgctgt

SEQ ID NO: 1269400 - DNA, 20 bp, Homo sapiens
gagactgtggtaggggcagg

SEQ ID NO: 1269401 - DNA, 22 bp, Homo sapiens
gagactgtggtaggggcaggga

SEQ ID NO: 1269402 - DNA, 14 bp, Homo sapiens
gagacttactgggt

SEQ ID NO: 1269403 - DNA, 20 bp, Homo sapiens
gagacttccaaacctgacag

SEQ ID NO: 1269404 - DNA, 13 bp, Homo sapiens
gagacttctctgt

SEQ ID NO: 1269405 - DNA, 14 bp, Homo sapiens
gagacttgctctct

SEQ ID NO: 1269406 - DNA, 20 bp, Homo sapiens
gagacttggaagaggaggag

SEQ ID NO: 1269407 - DNA, 21 bp, Homo sapiens
gagacttgttcttggttcctg

SEQ ID NO: 1269408 - DNA, 13 bp, Homo sapiens
gagactttgctgt

SEQ ID NO: 1269409 - DNA, 14 bp, Homo sapiens
gagactttgctgtt

SEQ ID NO: 1269410 - DNA, 22 bp, Homo sapiens
gagacttttaatcagacaaagt

SEQ ID NO: 1269411 - DNA, 14 bp, Homo sapiens
gagagaagaggact

SEQ ID NO: 1269412 - DNA, 21 bp, Homo sapiens
gagagaagtgcccctgctgcc

SEQ ID NO: 1269413 - DNA, 18 bp, Homo sapiens
gagattttattttttgtg

SEQ ID NO: 1269414 - DNA, 16 bp, Homo sapiens
gagatttttaagaact

SEQ ID NO: 1269415 - DNA, 17 bp, Homo sapiens
gagatttttaagaactt

SEQ ID NO: 1269416 - DNA, 21 bp, Homo sapiens
gagatttttcatacttttctt

SEQ ID NO: 1269417 - DNA, 16 bp, Homo sapiens
gagatttttttttctc

SEQ ID NO: 1269418 - DNA, 22 bp, Homo sapiens
gagcaaaaggcagctcacccct

SEQ ID NO: 1269419 - DNA, 20 bp, Homo sapiens
gagcaaaatcaacatgactg

SEQ ID NO: 1269420 - DNA, 14 bp, Homo sapiens
gagcaaacccagag

SEQ ID NO: 1269421 - DNA, 19 bp, Homo sapiens
gagcaaagcgcccacccag

SEQ ID NO: 1269422 - DNA, 23 bp, Homo sapiens
gagcaaagcgcccacccaggtcc

SEQ ID NO: 1269423 - DNA, 20 bp, Homo sapiens
gagcaaaggagacaaagcag

SEQ ID NO: 1269424 - DNA, 14 bp, Homo sapiens
gagcaaaggcccat

SEQ ID NO: 1269425 - DNA, 19 bp, Homo sapiens
gagcaaatgtttctgcagt

SEQ ID NO: 1269426 - DNA, 13 bp, Homo sapiens
gagcaacatttta

SEQ ID NO: 1269427 - DNA, 18 bp, Homo sapiens
gagcaaccagctggaagg

SEQ ID NO: 1269428 - DNA, 18 bp, Homo sapiens
gagcaacccctgtaccca

SEQ ID NO: 1269429 - DNA, 21 bp, Homo sapiens
gagcaacccctgtacccagct

SEQ ID NO: 1269430 - DNA, 22 bp, Homo sapiens
gagcaacccctgtacccagctc

SEQ ID NO: 1269431 - DNA, 23 bp, Homo sapiens
gagcaacccctgtacccagctcc

SEQ ID NO: 1269432 - DNA, 16 bp, Homo sapiens
gagcaacctctcactc

SEQ ID NO: 1269433 - DNA, 19 bp, Homo sapiens
gagcaacggcccatagcct

SEQ ID NO: 1269434 - DNA, 13 bp, Homo sapiens
gagcaactctcca

SEQ ID NO: 1269435 - DNA, 23 bp, Homo sapiens
gagcaagaaggaaggaggcagac

SEQ ID NO: 1269436 - DNA, 14 bp, Homo sapiens
gagcaagagctggc

SEQ ID NO: 1269437 - DNA, 13 bp, Homo sapiens
gagcaagccggca

SEQ ID NO: 1269438 - DNA, 17 bp, Homo sapiens
gagcaaggccttctctc

SEQ ID NO: 1269439 - DNA, 16 bp, Homo sapiens
gagcaataaagtggaa

SEQ ID NO: 1269440 - DNA, 17 bp, Homo sapiens
gagcaataacactatat

SEQ ID NO: 1269441 - DNA, 19 bp, Homo sapiens
gagcaataacactatattt

SEQ ID NO: 1269442 - DNA, 18 bp, Homo sapiens
gagcaataacttctatgt

SEQ ID NO: 1269443 - DNA, 20 bp, Homo sapiens
gagcaataacttctatgttg

SEQ ID NO: 1269444 - DNA, 18 bp, Homo sapiens
gagcaatcacaggaaaat

SEQ ID NO: 1269445 - DNA, 21 bp, Homo sapiens
gagcacaaaattcaaagcatg

SEQ ID NO: 1269446 - DNA, 20 bp, Homo sapiens
gagcacactttagtggccga

SEQ ID NO: 1269447 - DNA, 17 bp, Homo sapiens
gagcacagcatgcctta

SEQ ID NO: 1269448 - DNA, 15 bp, Homo sapiens
gagcacagcccacgg

SEQ ID NO: 1269449 - DNA, 14 bp, Homo sapiens
gagcacagccctgg

SEQ ID NO: 1269450 - DNA, 15 bp, Homo sapiens
gagcacagccctggg

SEQ ID NO: 1269451 - DNA, 16 bp, Homo sapiens
gagcacagccctggga

SEQ ID NO: 1269452 - DNA, 18 bp, Homo sapiens
gagcacagcttcttctgc

SEQ ID NO: 1269453 - DNA, 15 bp, Homo sapiens
gagcacaggcagctg

SEQ ID NO: 1269454 - DNA, 20 bp, Homo sapiens
gagcacaggtgtctgcctag

SEQ ID NO: 1269455 - DNA, 18 bp, Homo sapiens
gagcacatagagcttttt

SEQ ID NO: 1269456 - DNA, 22 bp, Homo sapiens
gagcacatagtgtcctgcccac

SEQ ID NO: 1269457 - DNA, 15 bp, Homo sapiens
gagcacatctctctg

SEQ ID NO: 1269458 - DNA, 21 bp, Homo sapiens
gagcacatgttactgcttcat

SEQ ID NO: 1269459 - DNA, 13 bp, Homo sapiens
gagcaccaggcac

SEQ ID NO: 1269460 - DNA, 17 bp, Homo sapiens
gagcacccagagcaccc

SEQ ID NO: 1269461 - DNA, 22 bp, Homo sapiens
gagcacccagagcaccccctgc

SEQ ID NO: 1269462 - DNA, 18 bp, Homo sapiens
gagcacccccaagcctgg

SEQ ID NO: 1269463 - DNA, 20 bp, Homo sapiens
gagcaccccctgctccacca

SEQ ID NO: 1269464 - DNA, 22 bp, Homo sapiens
gagcaccccctgctccaccagc

SEQ ID NO: 1269465 - DNA, 13 bp, Homo sapiens
gagcaccctctcc

SEQ ID NO: 1269466 - DNA, 17 bp, Homo sapiens
gagcaccgaatattgag

SEQ ID NO: 1269467 - DNA, 23 bp, Homo sapiens
gagcaccgtgtcaagctgctctg

SEQ ID NO: 1269468 - DNA, 13 bp, Homo sapiens
gagcacctcacct

SEQ ID NO: 1269469 - DNA, 14 bp, Homo sapiens
gagcacctccacat

SEQ ID NO: 1269470 - DNA, 17 bp, Homo sapiens
gagcacctccagcctga

SEQ ID NO: 1269471 - DNA, 13 bp, Homo sapiens
gagcacctggacc

SEQ ID NO: 1269472 - DNA, 14 bp, Homo sapiens
gagcacctgggccc

SEQ ID NO: 1269473 - DNA, 20 bp, Homo sapiens
gagcacctgggccccactgg

SEQ ID NO: 1269474 - DNA, 11 bp, Homo sapiens
gagcacctgtc

SEQ ID NO: 1269475 - DNA, 15 bp, Homo sapiens
gagcacctgtctgga

SEQ ID NO: 1269476 - DNA, 23 bp, Homo sapiens
gagcaccttttaaacccctccct

SEQ ID NO: 1269477 - DNA, 15 bp, Homo sapiens
gagcacgcctgccat

SEQ ID NO: 1269478 - DNA, 16 bp, Homo sapiens
gagcacgcctgccatc

SEQ ID NO: 1269479 - DNA, 13 bp, Homo sapiens
gagcacggactct

SEQ ID NO: 1269480 - DNA, 23 bp, Homo sapiens
gagcacgtggagatagtgccagg

SEQ ID NO: 1269481 - DNA, 16 bp, Homo sapiens
gagcactctcacccca

SEQ ID NO: 1269482 - DNA, 24 bp, Homo sapiens
gagcactctcaccccaagcggcct

SEQ ID NO: 1269483 - DNA, 11 bp, Homo sapiens
gagcactgcct

SEQ ID NO: 1269484 - DNA, 18 bp, Homo sapiens
gagcactgcctctatgcc

SEQ ID NO: 1269485 - DNA, 19 bp, Homo sapiens
gagcactgcctctatgccc

SEQ ID NO: 1269486 - DNA, 13 bp, Homo sapiens
gagcactggactc

SEQ ID NO: 1269487 - DNA, 16 bp, Homo sapiens
gagcactggactccgg

SEQ ID NO: 1269488 - DNA, 22 bp, Homo sapiens
gagcactggccagagagggccc

SEQ ID NO: 1269489 - DNA, 15 bp, Homo sapiens
gagcacttaagagaa

SEQ ID NO: 1269490 - DNA, 16 bp, Homo sapiens
gagcacttaagagaat

SEQ ID NO: 1269491 - DNA, 14 bp, Homo sapiens
gagcacttagcagg

SEQ ID NO: 1269492 - DNA, 19 bp, Homo sapiens
gagcacttgttttaaaatg

SEQ ID NO: 1269493 - DNA, 12 bp, Homo sapiens
gagcagaacagg

SEQ ID NO: 1269494 - DNA, 15 bp, Homo sapiens
gagcagaacaggtag

SEQ ID NO: 1269495 - DNA, 16 bp, Homo sapiens
gagcagaacaggtagt

SEQ ID NO: 1269496 - DNA, 17 bp, Homo sapiens
gagcagaagtggagctg

SEQ ID NO: 1269497 - DNA, 21 bp, Homo sapiens
gagcagaatgttgtacttgaa

SEQ ID NO: 1269498 - DNA, 22 bp, Homo sapiens
gagcagaatgttgtacttgaaa

SEQ ID NO: 1269499 - DNA, 14 bp, Homo sapiens
gagcagacaggagg

SEQ ID NO: 1269500 - DNA, 15 bp, Homo sapiens
gagcagacaggagga

SEQ ID NO: 1269501 - DNA, 21 bp, Homo sapiens
gagcagacaggaggaatcatg

SEQ ID NO: 1269502 - DNA, 13 bp, Homo sapiens
gagcagagacact

SEQ ID NO: 1269503 - DNA, 13 bp, Homo sapiens
gagcagagagagc

SEQ ID NO: 1269504 - DNA, 19 bp, Homo sapiens
gagcagagaggtggccacc

SEQ ID NO: 1269505 - DNA, 15 bp, Homo sapiens
gagcagaggtggaaa

SEQ ID NO: 1269506 - DNA, 13 bp, Homo sapiens
gagcagagtctgg

SEQ ID NO: 1269507 - DNA, 14 bp, Homo sapiens
gagcagagtctggg

SEQ ID NO: 1269508 - DNA, 21 bp, Homo sapiens
gagcagatactgtctttgtgc

SEQ ID NO: 1269509 - DNA, 17 bp, Homo sapiens
gagcagcaagaagcagc

SEQ ID NO: 1269510 - DNA, 20 bp, Homo sapiens
gagcagcaagaagcagcctg

SEQ ID NO: 1269511 - DNA, 21 bp, Homo sapiens
gagcagcaagaagcagcctgt

SEQ ID NO: 1269512 - DNA, 14 bp, Homo sapiens
gagcagcagcacca

SEQ ID NO: 1269513 - DNA, 22 bp, Homo sapiens
gagcagcagcacctttctctga

SEQ ID NO: 1269514 - DNA, 13 bp, Homo sapiens
gagcagcagccag

SEQ ID NO: 1269515 - DNA, 13 bp, Homo sapiens
gagcagcaggaag

SEQ ID NO: 1269516 - DNA, 12 bp, Homo sapiens
gagcagcaggtg

SEQ ID NO: 1269517 - DNA, 15 bp, Homo sapiens
gagcagcaggtgctg

SEQ ID NO: 1269518 - DNA, 15 bp, Homo sapiens
gagcagccagagctg

SEQ ID NO: 1269519 - DNA, 18 bp, Homo sapiens
gagcagcctcgaggctgg

SEQ ID NO: 1269520 - DNA, 17 bp, Homo sapiens
gagcagcctcgtggagc

SEQ ID NO: 1269521 - DNA, 18 bp, Homo sapiens
gagcagcctcgtggagct

SEQ ID NO: 1269522 - DNA, 21 bp, Homo sapiens
gagcagcctctggacagccag

SEQ ID NO: 1269523 - DNA, 24 bp, Homo sapiens
gagcagcctctggacagccagtga

SEQ ID NO: 1269524 - DNA, 13 bp, Homo sapiens
gagcagcctgatg

SEQ ID NO: 1269525 - DNA, 16 bp, Homo sapiens
gagcagcctgatggcc

SEQ ID NO: 1269526 - DNA, 19 bp, Homo sapiens
gagcagcctgatggccaag

SEQ ID NO: 1269527 - DNA, 11 bp, Homo sapiens
gagcagcctgt

SEQ ID NO: 1269528 - DNA, 15 bp, Homo sapiens
gagcagcgcccaggc

SEQ ID NO: 1269529 - DNA, 22 bp, Homo sapiens
gagcagcgcccaggcctgctgg

SEQ ID NO: 1269530 - DNA, 23 bp, Homo sapiens
gagcagcgcccaggcctgctggc

SEQ ID NO: 1269531 - DNA, 19 bp, Homo sapiens
gagcagcggattgctctgg

SEQ ID NO: 1269532 - DNA, 21 bp, Homo sapiens
gagcagcggattgctctggag

SEQ ID NO: 1269533 - DNA, 13 bp, Homo sapiens
gagcagcggctct

SEQ ID NO: 1269534 - DNA, 15 bp, Homo sapiens
gagcagcggctctgg

SEQ ID NO: 1269535 - DNA, 16 bp, Homo sapiens
gagcctcctcaggggg

SEQ ID NO: 1269536 - DNA, 21 bp, Homo sapiens
gagcctcctgtgcctggcccc

SEQ ID NO: 1269537 - DNA, 17 bp, Homo sapiens
gagcctcgcccctccag

SEQ ID NO: 1269538 - DNA, 13 bp, Homo sapiens
gagcctctcctgt

SEQ ID NO: 1269539 - DNA, 16 bp, Homo sapiens
gagcctctgctggaag

SEQ ID NO: 1269540 - DNA, 14 bp, Homo sapiens
gagcctctggcccc

SEQ ID NO: 1269541 - DNA, 13 bp, Homo sapiens
gagcctctggctt

SEQ ID NO: 1269542 - DNA, 18 bp, Homo sapiens
gagcctctttttccttct

SEQ ID NO: 1269543 - DNA, 23 bp, Homo sapiens
gagcctctttttccttcttcagc

SEQ ID NO: 1269544 - DNA, 12 bp, Homo sapiens
gagcctgacctg

SEQ ID NO: 1269545 - DNA, 17 bp, Homo sapiens
gagcctgactgccagga

SEQ ID NO: 1269546 - DNA, 10 bp, Homo sapiens
gagcctgagg

SEQ ID NO: 1269547 - DNA, 13 bp, Homo sapiens
gagcctgaggcag

SEQ ID NO: 1269548 - DNA, 16 bp, Homo sapiens
gagcctgaggcaggag

SEQ ID NO: 1269549 - DNA, 17 bp, Homo sapiens
gagcctgaggcaggaga

SEQ ID NO: 1269550 - DNA, 18 bp, Homo sapiens
gagcctgaggcaggagaa

SEQ ID NO: 1269551 - DNA, 16 bp, Homo sapiens
gagcctgatctcttcc

SEQ ID NO: 1269552 - DNA, 22 bp, Homo sapiens
gagcctgccaaagtgcctggga

SEQ ID NO: 1269553 - DNA, 12 bp, Homo sapiens
gagcctgccaag

SEQ ID NO: 1269554 - DNA, 17 bp, Homo sapiens
gagcctgctcccccacc

SEQ ID NO: 1269555 - DNA, 10 bp, Homo sapiens
gagcctgctg

SEQ ID NO: 1269556 - DNA, 16 bp, Homo sapiens
gagcctgctggaagcc

SEQ ID NO: 1269557 - DNA, 12 bp, Homo sapiens
gagcctggagaa

SEQ ID NO: 1269558 - DNA, 14 bp, Homo sapiens
gagcctggagaagc

SEQ ID NO: 1269559 - DNA, 15 bp, Homo sapiens
gagcctggcaagaat

SEQ ID NO: 1269560 - DNA, 12 bp, Homo sapiens
gagcctggcccc

SEQ ID NO: 1269561 - DNA, 23 bp, Homo sapiens
gagcctggccccaggccccagac

SEQ ID NO: 1269562 - DNA, 13 bp, Homo sapiens
gagcctgggaggt

SEQ ID NO: 1269563 - DNA, 12 bp, Homo sapiens
gagcctgggcca

SEQ ID NO: 1269564 - DNA, 19 bp, Homo sapiens
gagcctggtcccacgaggg

SEQ ID NO: 1269565 - DNA, 17 bp, Homo sapiens
gagcctggtccttccct

SEQ ID NO: 1269566 - DNA, 17 bp, Homo sapiens
gagcctggtgctgctgc

SEQ ID NO: 1269567 - DNA, 19 bp, Homo sapiens
gagcctggttcagacacag

SEQ ID NO: 1269568 - DNA, 21 bp, Homo sapiens
gagcctggttcagacacagct

SEQ ID NO: 1269569 - DNA, 11 bp, Homo sapiens
gagcctgtccc

SEQ ID NO: 1269570 - DNA, 21 bp, Homo sapiens
gagcctgtccccgccttccct

SEQ ID NO: 1269571 - DNA, 22 bp, Homo sapiens
gagcctgtccccgccttccctc

SEQ ID NO: 1269572 - DNA, 18 bp, Homo sapiens
gagcctgtgaccttggga

SEQ ID NO: 1269573 - DNA, 17 bp, Homo sapiens
gagcctgtgccttcctc

SEQ ID NO: 1269574 - DNA, 23 bp, Homo sapiens
gagcctgtgttagtgtctgtcca

SEQ ID NO: 1269575 - DNA, 21 bp, Homo sapiens
gagccttcagaatgctcctga

SEQ ID NO: 1269576 - DNA, 19 bp, Homo sapiens
gagccttccatgacctccc

SEQ ID NO: 1269577 - DNA, 13 bp, Homo sapiens
gagccttgaactt

SEQ ID NO: 1269578 - DNA, 19 bp, Homo sapiens
gagccttgaactttgacct

SEQ ID NO: 1269579 - DNA, 20 bp, Homo sapiens
gagccttgataatacttgac

SEQ ID NO: 1269580 - DNA, 19 bp, Homo sapiens
gagccttgcatgtacttga

SEQ ID NO: 1269581 - DNA, 19 bp, Homo sapiens
gagccttgctgggccaggg

SEQ ID NO: 1269582 - DNA, 18 bp, Homo sapiens
gagccttggttcatcagt

SEQ ID NO: 1269583 - DNA, 22 bp, Homo sapiens
gagccttgtgagatccttcaca

SEQ ID NO: 1269584 - DNA, 13 bp, Homo sapiens
gagcctttccaaa

SEQ ID NO: 1269585 - DNA, 17 bp, Homo sapiens
gagcctttggatgacca

SEQ ID NO: 1269586 - DNA, 17 bp, Homo sapiens
gagcctttggggggcca

SEQ ID NO: 1269587 - DNA, 18 bp, Homo sapiens
gagcctttggggggccac

SEQ ID NO: 1269588 - DNA, 20 bp, Homo sapiens
gagcctttggggggccaccc

SEQ ID NO: 1269589 - DNA, 18 bp, Homo sapiens
gagcctttggttctggcc

SEQ ID NO: 1269590 - DNA, 23 bp, Homo sapiens
gagcctttggttctggccagaat

SEQ ID NO: 1269591 - DNA, 21 bp, Homo sapiens
gagcgaagggggtcaaaggaa

SEQ ID NO: 1269592 - DNA, 17 bp, Homo sapiens
gagcgacggctcctccc

SEQ ID NO: 1269593 - DNA, 22 bp, Homo sapiens
gagcgacggctcctccccgatc

SEQ ID NO: 1269594 - DNA, 17 bp, Homo sapiens
gagcgagagatcaaaga

SEQ ID NO: 1269595 - DNA, 18 bp, Homo sapiens
gagcgagcaagccggcaa

SEQ ID NO: 1269596 - DNA, 15 bp, Homo sapiens
gagcgaggaaaggat

SEQ ID NO: 1269597 - DNA, 16 bp, Homo sapiens
gagcgaggtcagagga

SEQ ID NO: 1269598 - DNA, 15 bp, Homo sapiens
gagcgatccagggga

SEQ ID NO: 1269599 - DNA, 18 bp, Homo sapiens
gagcgatccaggggaagc

SEQ ID NO: 1269600 - DNA, 20 bp, Homo sapiens
gagcgcacctgccccctggt

SEQ ID NO: 1269601 - DNA, 19 bp, Homo sapiens
gagcgcagtgttttgcaag

SEQ ID NO: 1269602 - DNA, 15 bp, Homo sapiens
gagcgccaggaagcc

SEQ ID NO: 1269603 - DNA, 21 bp, Homo sapiens
gagcgccaggaagccagagcc

SEQ ID NO: 1269604 - DNA, 18 bp, Homo sapiens
gagcgcccccgagccctg

SEQ ID NO: 1269605 - DNA, 16 bp, Homo sapiens
gagcgcctcttcctct

SEQ ID NO: 1269606 - DNA, 16 bp, Homo sapiens
gagcgcctgaccctgg

SEQ ID NO: 1269607 - DNA, 23 bp, Homo sapiens
gagcgctagtgccttgcccacag

SEQ ID NO: 1269608 - DNA, 15 bp, Homo sapiens
gagcgctcctctgcc

SEQ ID NO: 1269609 - DNA, 21 bp, Homo sapiens
gagcgcttctgcagcctcggc

SEQ ID NO: 1269610 - DNA, 14 bp, Homo sapiens
gagcggagatgagg

SEQ ID NO: 1269611 - DNA, 14 bp, Homo sapiens
gagcggaggctcgg

SEQ ID NO: 1269612 - DNA, 14 bp, Homo sapiens
gagcgggagggagt

SEQ ID NO: 1269613 - DNA, 20 bp, Homo sapiens
gagcggggctgggaggaagg

SEQ ID NO: 1269614 - DNA, 16 bp, Homo sapiens
gagcgtcactgcccac

SEQ ID NO: 1269615 - DNA, 14 bp, Homo sapiens
gagcgtggccttgg

SEQ ID NO: 1269616 - DNA, 16 bp, Homo sapiens
gagcgttctctgtcct

SEQ ID NO: 1269617 - DNA, 15 bp, Homo sapiens
gagcgtttgctgtgc

SEQ ID NO: 1269618 - DNA, 20 bp, Homo sapiens
gagctaaactccttcctggc

SEQ ID NO: 1269619 - DNA, 15 bp, Homo sapiens
gagctaagggtgggt

SEQ ID NO: 1269620 - DNA, 20 bp, Homo sapiens
gagctaagggtgggtgctca

SEQ ID NO: 1269621 - DNA, 15 bp, Homo sapiens
gagctaagtcaccca

SEQ ID NO: 1269622 - DNA, 21 bp, Homo sapiens
gagctaagtcacccagagcac

SEQ ID NO: 1269623 - DNA, 20 bp, Homo sapiens
gagctacgtatttaatagca

SEQ ID NO: 1269624 - DNA, 19 bp, Homo sapiens
gagctactctcttgccagc

SEQ ID NO: 1269625 - DNA, 14 bp, Homo sapiens
gagctactgatgaa

SEQ ID NO: 1269626 - DNA, 15 bp, Homo sapiens
gagctagcagcaggg

SEQ ID NO: 1269627 - DNA, 17 bp, Homo sapiens
gagctagcagcagggag

SEQ ID NO: 1269628 - DNA, 14 bp, Homo sapiens
gagctagcctccag

SEQ ID NO: 1269629 - DNA, 18 bp, Homo sapiens
gagctagcgctgccgcac

SEQ ID NO: 1269630 - DNA, 17 bp, Homo sapiens
gagctaggaagagtcta

SEQ ID NO: 1269631 - DNA, 21 bp, Homo sapiens
gagctaggggcgggggcggag

SEQ ID NO: 1269632 - DNA, 17 bp, Homo sapiens
gagctattttcctctgg

SEQ ID NO: 1269633 - DNA, 15 bp, Homo sapiens
gagctcagaccccca

SEQ ID NO: 1269634 - DNA, 20 bp, Homo sapiens
gagctcagacccccactctc

SEQ ID NO: 1269635 - DNA, 13 bp, Homo sapiens
gagctccactctg

SEQ ID NO: 1269636 - DNA, 21 bp, Homo sapiens
gagctccactctgcttctctg

SEQ ID NO: 1269637 - DNA, 20 bp, Homo sapiens
gagctccagacccccagcaa

SEQ ID NO: 1269638 - DNA, 15 bp, Homo sapiens
gagctcccacctccc

SEQ ID NO: 1269639 - DNA, 20 bp, Homo sapiens
gagctcccacctcccttccc

SEQ ID NO: 1269640 - DNA, 16 bp, Homo sapiens
gagctccccagatctc

SEQ ID NO: 1269641 - DNA, 17 bp, Homo sapiens
gagctccccagatctcc

SEQ ID NO: 1269642 - DNA, 20 bp, Homo sapiens
gagctccccagatctcccac

SEQ ID NO: 1269643 - DNA, 19 bp, Homo sapiens
gagctcccctccacagctg

SEQ ID NO: 1269644 - DNA, 14 bp, Homo sapiens
gagctcctctgggc

SEQ ID NO: 1269645 - DNA, 16 bp, Homo sapiens
gagctcctctgggcag

SEQ ID NO: 1269646 - DNA, 14 bp, Homo sapiens
gagctcctggccag

SEQ ID NO: 1269647 - DNA, 16 bp, Homo sapiens
gagctcctggccagga

SEQ ID NO: 1269648 - DNA, 15 bp, Homo sapiens
gagctcctggggagc

SEQ ID NO: 1269649 - DNA, 18 bp, Homo sapiens
gagctcctggggagctcc

SEQ ID NO: 1269650 - DNA, 21 bp, Homo sapiens
gagctcctggggagctcctgg

SEQ ID NO: 1269651 - DNA, 16 bp, Homo sapiens
gagctcgcagcccccg

SEQ ID NO: 1269652 - DNA, 16 bp, Homo sapiens
gagctcggggtccacc

SEQ ID NO: 1269653 - DNA, 18 bp, Homo sapiens
gagctcgtgtatcctggg

SEQ ID NO: 1269654 - DNA, 12 bp, Homo sapiens
gagctctccagg

SEQ ID NO: 1269655 - DNA, 15 bp, Homo sapiens
gagctctccaggcca

SEQ ID NO: 1269656 - DNA, 15 bp, Homo sapiens
gagctctgcgccagg

SEQ ID NO: 1269657 - DNA, 17 bp, Homo sapiens
gagctctgcgccaggca

SEQ ID NO: 1269658 - DNA, 18 bp, Homo sapiens
gaggacttgtgtctctgt

SEQ ID NO: 1269659 - DNA, 22 bp, Homo sapiens
gaggacttgtgtctctgtgctt

SEQ ID NO: 1269660 - DNA, 13 bp, Homo sapiens
gaggagaaacaca

SEQ ID NO: 1269661 - DNA, 21 bp, Homo sapiens
gaggagaaatgcaataactct

SEQ ID NO: 1269662 - DNA, 12 bp, Homo sapiens
gaggagaagaat

SEQ ID NO: 1269663 - DNA, 20 bp, Homo sapiens
gaggagaagaattttcagac

SEQ ID NO: 1269664 - DNA, 15 bp, Homo sapiens
gaggagaaggaaaac

SEQ ID NO: 1269665 - DNA, 14 bp, Homo sapiens
gaggagaaggagga

SEQ ID NO: 1269666 - DNA, 20 bp, Homo sapiens
gaggagaagggggtctctgt

SEQ ID NO: 1269667 - DNA, 16 bp, Homo sapiens
gaggagaccctggaat

SEQ ID NO: 1269668 - DNA, 12 bp, Homo sapiens
gaggagagaaga

SEQ ID NO: 1269669 - DNA, 13 bp, Homo sapiens
gaggagagaagaa

SEQ ID NO: 1269670 - DNA, 13 bp, Homo sapiens
gaggagagacggt

SEQ ID NO: 1269671 - DNA, 13 bp, Homo sapiens
gaggagagagagg

SEQ ID NO: 1269672 - DNA, 18 bp, Homo sapiens
gaggagagccactgggcc

SEQ ID NO: 1269673 - DNA, 14 bp, Homo sapiens
gaggagagtcccag

SEQ ID NO: 1269674 - DNA, 20 bp, Homo sapiens
gaggagagtggttgttgcca

SEQ ID NO: 1269675 - DNA, 19 bp, Homo sapiens
gaggagattggccagtgag

SEQ ID NO: 1269676 - DNA, 15 bp, Homo sapiens
gaggagcaagggtgg

SEQ ID NO: 1269677 - DNA, 15 bp, Homo sapiens
gaggagcagccagga

SEQ ID NO: 1269678 - DNA, 17 bp, Homo sapiens
gaggagcagcctcgagg

SEQ ID NO: 1269679 - DNA, 19 bp, Homo sapiens
gaggagcagcttccttctg

SEQ ID NO: 1269680 - DNA, 20 bp, Homo sapiens
gaggagcagcttccttctgg

SEQ ID NO: 1269681 - DNA, 19 bp, Homo sapiens
gaggagcccagtgggctgc

SEQ ID NO: 1269682 - DNA, 14 bp, Homo sapiens
gaggagccccagct

SEQ ID NO: 1269683 - DNA, 21 bp, Homo sapiens
gaggagccctgaggacctctc

SEQ ID NO: 1269684 - DNA, 22 bp, Homo sapiens
gaggagccctgaggacctctca

SEQ ID NO: 1269685 - DNA, 19 bp, Homo sapiens
gaggagccttgctgggcca

SEQ ID NO: 1269686 - DNA, 15 bp, Homo sapiens
gaggagctgagggag

SEQ ID NO: 1269687 - DNA, 12 bp, Homo sapiens
gaggagctgctg

SEQ ID NO: 1269688 - DNA, 13 bp, Homo sapiens
gaggagctgctgg

SEQ ID NO: 1269689 - DNA, 14 bp, Homo sapiens
gaggagctgggccc

SEQ ID NO: 1269690 - DNA, 19 bp, Homo sapiens
gaggaggaacgggcagcca

SEQ ID NO: 1269691 - DNA, 20 bp, Homo sapiens
gaggaggaacgggcagccac

SEQ ID NO: 1269692 - DNA, 14 bp, Homo sapiens
gaggaggaagaggg

SEQ ID NO: 1269693 - DNA, 14 bp, Homo sapiens
gaggaggacaagaa

SEQ ID NO: 1269694 - DNA, 13 bp, Homo sapiens
gaggaggacttgg

SEQ ID NO: 1269695 - DNA, 22 bp, Homo sapiens
gaggaggacttggagggtctgg

SEQ ID NO: 1269696 - DNA, 15 bp, Homo sapiens
gaggaggagccttgc

SEQ ID NO: 1269697 - DNA, 16 bp, Homo sapiens
gaggaggaggaggagg

SEQ ID NO: 1269698 - DNA, 21 bp, Homo sapiens
gaggaggatgtccctgggcca

SEQ ID NO: 1269699 - DNA, 22 bp, Homo sapiens
gaggaggatgtccctgggccag

SEQ ID NO: 1269700 - DNA, 23 bp, Homo sapiens
gaggaggatgtccctgggccagg

SEQ ID NO: 1269701 - DNA, 18 bp, Homo sapiens
gaggaggctccagagggc

SEQ ID NO: 1269702 - DNA, 22 bp, Homo sapiens
gaggagggcatgggttggcagg

SEQ ID NO: 1269703 - DNA, 18 bp, Homo sapiens
gaggaggggaagctgggc

SEQ ID NO: 1269704 - DNA, 19 bp, Homo sapiens
gaggaggggaagctgggcc

SEQ ID NO: 1269705 - DNA, 11 bp, Homo sapiens
gaggaggggag

SEQ ID NO: 1269706 - DNA, 18 bp, Homo sapiens
gaggaggggccgctgcca

SEQ ID NO: 1269707 - DNA, 13 bp, Homo sapiens
gaggaggttggga

SEQ ID NO: 1269708 - DNA, 20 bp, Homo sapiens
gaggaggtttggggtctgcc

SEQ ID NO: 1269709 - DNA, 21 bp, Homo sapiens
gaggagtaacaatacaaatgg

SEQ ID NO: 1269710 - DNA, 15 bp, Homo sapiens
gaggagtcaggggct

SEQ ID NO: 1269711 - DNA, 18 bp, Homo sapiens
gaggagtcaggggctctg

SEQ ID NO: 1269712 - DNA, 14 bp, Homo sapiens
gaggagtctgagga

SEQ ID NO: 1269713 - DNA, 13 bp, Homo sapiens
gaggagtgaggaa

SEQ ID NO: 1269714 - DNA, 21 bp, Homo sapiens
gaggagtgcagccttctccat

SEQ ID NO: 1269715 - DNA, 19 bp, Homo sapiens
gaggagtggatctgtagaa

SEQ ID NO: 1269716 - DNA, 13 bp, Homo sapiens
gaggatacagagg

SEQ ID NO: 1269717 - DNA, 14 bp, Homo sapiens
gaggatacagagga

SEQ ID NO: 1269718 - DNA, 12 bp, Homo sapiens
gaggatcctgag

SEQ ID NO: 1269719 - DNA, 18 bp, Homo sapiens
gaggatcctgagctgctg

SEQ ID NO: 1269720 - DNA, 17 bp, Homo sapiens
gaggatgagcagaccag

SEQ ID NO: 1269721 - DNA, 13 bp, Homo sapiens
gaggatgcctttt

SEQ ID NO: 1269722 - DNA, 21 bp, Homo sapiens
gaggatgggatgtatttttct

SEQ ID NO: 1269723 - DNA, 18 bp, Homo sapiens
gaggatgtccctgggcca

SEQ ID NO: 1269724 - DNA, 19 bp, Homo sapiens
gaggatgtccctgggccag

SEQ ID NO: 1269725 - DNA, 15 bp, Homo sapiens
gaggatgtgggcagc

SEQ ID NO: 1269726 - DNA, 22 bp, Homo sapiens
gaggatgtgttttgcacgtctt

SEQ ID NO: 1269727 - DNA, 18 bp, Homo sapiens
gaggattctttccccaga

SEQ ID NO: 1269728 - DNA, 14 bp, Homo sapiens
gaggattgtggaaa

SEQ ID NO: 1269729 - DNA, 20 bp, Homo sapiens
gaggatttaagggatggaaa

SEQ ID NO: 1269730 - DNA, 15 bp, Homo sapiens
gaggatttcaagcct

SEQ ID NO: 1269731 - DNA, 13 bp, Homo sapiens
gaggatttcctgg

SEQ ID NO: 1269732 - DNA, 14 bp, Homo sapiens
gaggatttcctgga

SEQ ID NO: 1269733 - DNA, 22 bp, Homo sapiens
gaggatttcctggagtgccctg

SEQ ID NO: 1269734 - DNA, 17 bp, Homo sapiens
gaggatttttttctgag

SEQ ID NO: 1269735 - DNA, 14 bp, Homo sapiens
gaggcaaacagcaa

SEQ ID NO: 1269736 - DNA, 19 bp, Homo sapiens
gaggcaacactgctgtcca

SEQ ID NO: 1269737 - DNA, 21 bp, Homo sapiens
gaggcaaccccctcggagcct

SEQ ID NO: 1269738 - DNA, 15 bp, Homo sapiens
gaggcaagagggagg

SEQ ID NO: 1269739 - DNA, 17 bp, Homo sapiens
gaggcaagctgaaattt

SEQ ID NO: 1269740 - DNA, 18 bp, Homo sapiens
gaggcaaggttatatgca

SEQ ID NO: 1269741 - DNA, 13 bp, Homo sapiens
gaggcaccagctc

SEQ ID NO: 1269742 - DNA, 16 bp, Homo sapiens
gaggcaccagctctgt

SEQ ID NO: 1269743 - DNA, 22 bp, Homo sapiens
gaggcaccagctctgtggcctg

SEQ ID NO: 1269744 - DNA, 13 bp, Homo sapiens
gaggcaccaggaa

SEQ ID NO: 1269745 - DNA, 22 bp, Homo sapiens
gaggcaccatgcaaatgtcttc

SEQ ID NO: 1269746 - DNA, 17 bp, Homo sapiens
gaggcaccggcgctgca

SEQ ID NO: 1269747 - DNA, 15 bp, Homo sapiens
gaggcacctgctgga

SEQ ID NO: 1269748 - DNA, 23 bp, Homo sapiens
gaggcagaagaattgaacccagg

SEQ ID NO: 1269749 - DNA, 21 bp, Homo sapiens
gaggcagacagcagctcaggc

SEQ ID NO: 1269750 - DNA, 20 bp, Homo sapiens
gaggcagagaatctcttggg

SEQ ID NO: 1269751 - DNA, 14 bp, Homo sapiens
gaggcagagcggga

SEQ ID NO: 1269752 - DNA, 19 bp, Homo sapiens
gaggcagagcgggagggag

SEQ ID NO: 1269753 - DNA, 20 bp, Homo sapiens
gaggcagatgtggggctgag

SEQ ID NO: 1269754 - DNA, 13 bp, Homo sapiens
gaggcagcagtgt

SEQ ID NO: 1269755 - DNA, 21 bp, Homo sapiens
gaggcagcagtgtgaggccag

SEQ ID NO: 1269756 - DNA, 14 bp, Homo sapiens
gaggcagccagacc

SEQ ID NO: 1269757 - DNA, 15 bp, Homo sapiens
gaggcagccccctcc

SEQ ID NO: 1269758 - DNA, 14 bp, Homo sapiens
gaggcagcgtgggc

SEQ ID NO: 1269759 - DNA, 17 bp, Homo sapiens
gaggcagcgtgggctct

SEQ ID NO: 1269760 - DNA, 19 bp, Homo sapiens
gaggcagcgtgggctctgc

SEQ ID NO: 1269761 - DNA, 23 bp, Homo sapiens
gaggcaggaggattgcttgagcc

SEQ ID NO: 1269762 - DNA, 14 bp, Homo sapiens
gaggcaggctccag

SEQ ID NO: 1269763 - DNA, 15 bp, Homo sapiens
gaggcagggccttgc

SEQ ID NO: 1269764 - DNA, 21 bp, Homo sapiens
gaggcagggccttgcccagag

SEQ ID NO: 1269765 - DNA, 22 bp, Homo sapiens
gaggcagggccttgcccagaga

SEQ ID NO: 1269766 - DNA, 14 bp, Homo sapiens
gaggcaggggcgga

SEQ ID NO: 1269767 - DNA, 22 bp, Homo sapiens
gaggcagtgagactgcaggtgg

SEQ ID NO: 1269768 - DNA, 20 bp, Homo sapiens
gaggcagtgctgatccggct

SEQ ID NO: 1269769 - DNA, 22 bp, Homo sapiens
gaggcagtgtggttatgttccc

SEQ ID NO: 1269770 - DNA, 21 bp, Homo sapiens
gaggcatcatggaaagactgg

SEQ ID NO: 1269771 - DNA, 22 bp, Homo sapiens
gaggcatgactaatgcttttta

SEQ ID NO: 1269772 - DNA, 22 bp, Homo sapiens
gaggcatggcaattctggaagc

SEQ ID NO: 1269773 - DNA, 18 bp, Homo sapiens
gaggcatggccctggggt

SEQ ID NO: 1269774 - DNA, 15 bp, Homo sapiens
gaggcatggggcatg

SEQ ID NO: 1269775 - DNA, 18 bp, Homo sapiens
gaggcatggggcatgtcc

SEQ ID NO: 1269776 - DNA, 17 bp, Homo sapiens
gaggccaaaggctggtg

SEQ ID NO: 1269777 - DNA, 18 bp, Homo sapiens
gaggccaagaatattgca

SEQ ID NO: 1269778 - DNA, 22 bp, Homo sapiens
gaggccaagaatattgcaaaat

SEQ ID NO: 1269779 - DNA, 20 bp, Homo sapiens
gaggccaagcagtgcctgcc

SEQ ID NO: 1269780 - DNA, 19 bp, Homo sapiens
gagggcccagcccagagcc

SEQ ID NO: 1269781 - DNA, 20 bp, Homo sapiens
gagggcccagcccagagcca

SEQ ID NO: 1269782 - DNA, 13 bp, Homo sapiens
gagggcccagctg

SEQ ID NO: 1269783 - DNA, 20 bp, Homo sapiens
gagggcccagctgtagccat

SEQ ID NO: 1269784 - DNA, 12 bp, Homo sapiens
gagggcccctct

SEQ ID NO: 1269785 - DNA, 20 bp, Homo sapiens
gagggcccctgcgtgggggc

SEQ ID NO: 1269786 - DNA, 16 bp, Homo sapiens
gagggccgcctgcctt

SEQ ID NO: 1269787 - DNA, 17 bp, Homo sapiens
gagggccggcggctctg

SEQ ID NO: 1269788 - DNA, 20 bp, Homo sapiens
gagggccggcggctctgagc

SEQ ID NO: 1269789 - DNA, 18 bp, Homo sapiens
gagggccgtaccccaccc

SEQ ID NO: 1269790 - DNA, 20 bp, Homo sapiens
gagggccgtaccccaccctc

SEQ ID NO: 1269791 - DNA, 22 bp, Homo sapiens
gagggccgtgtgacactctcgt

SEQ ID NO: 1269792 - DNA, 22 bp, Homo sapiens
gagggcctcaaaggcccgctct

SEQ ID NO: 1269793 - DNA, 20 bp, Homo sapiens
gagggcctcagagcctgacc

SEQ ID NO: 1269794 - DNA, 20 bp, Homo sapiens
gagggcctgctggaggcctc

SEQ ID NO: 1269795 - DNA, 21 bp, Homo sapiens
gagggcctgctggaggcctca

SEQ ID NO: 1269796 - DNA, 16 bp, Homo sapiens
gagggcgaaggccatt

SEQ ID NO: 1269797 - DNA, 19 bp, Homo sapiens
gagggcggcaggggcctgg

SEQ ID NO: 1269798 - DNA, 17 bp, Homo sapiens
gagggcggccagggaca

SEQ ID NO: 1269799 - DNA, 14 bp, Homo sapiens
gagggcgtcaggca

SEQ ID NO: 1269800 - DNA, 23 bp, Homo sapiens
gagggcgtcaggcagaggcaact

SEQ ID NO: 1269801 - DNA, 20 bp, Homo sapiens
gagggcgtgactcacccaag

SEQ ID NO: 1269802 - DNA, 19 bp, Homo sapiens
gagggctaattctgggaag

SEQ ID NO: 1269803 - DNA, 15 bp, Homo sapiens
gagggctagccctga

SEQ ID NO: 1269804 - DNA, 19 bp, Homo sapiens
gagggctagccctgagccc

SEQ ID NO: 1269805 - DNA, 21 bp, Homo sapiens
gagggctagccctgagcccgg

SEQ ID NO: 1269806 - DNA, 14 bp, Homo sapiens
gagggctcctgggg

SEQ ID NO: 1269807 - DNA, 20 bp, Homo sapiens
gagggctcctggggcagaga

SEQ ID NO: 1269808 - DNA, 21 bp, Homo sapiens
gagggctcgaggggtgggctg

SEQ ID NO: 1269809 - DNA, 20 bp, Homo sapiens
gagggctctgtttgtgggac

SEQ ID NO: 1269810 - DNA, 20 bp, Homo sapiens
gagggctgagcctggtccca

SEQ ID NO: 1269811 - DNA, 12 bp, Homo sapiens
gagggctgagga

SEQ ID NO: 1269812 - DNA, 16 bp, Homo sapiens
gagggctgaggagcag

SEQ ID NO: 1269813 - DNA, 22 bp, Homo sapiens
gagggctgaggagcagccagga

SEQ ID NO: 1269814 - DNA, 18 bp, Homo sapiens
gagggctgatggaggaaa

SEQ ID NO: 1269815 - DNA, 12 bp, Homo sapiens
gagggctgcagt

SEQ ID NO: 1269816 - DNA, 16 bp, Homo sapiens
gagggctgcagtcaca

SEQ ID NO: 1269817 - DNA, 17 bp, Homo sapiens
gagggctggaggcccag

SEQ ID NO: 1269818 - DNA, 20 bp, Homo sapiens
gagggctggaggcccaggct

SEQ ID NO: 1269819 - DNA, 16 bp, Homo sapiens
gagggctggctggcct

SEQ ID NO: 1269820 - DNA, 18 bp, Homo sapiens
gagggctggctggcctca

SEQ ID NO: 1269821 - DNA, 23 bp, Homo sapiens
gagggctgttggacagctgcttg

SEQ ID NO: 1269822 - DNA, 17 bp, Homo sapiens
gaggggaaaaaaatgtt

SEQ ID NO: 1269823 - DNA, 19 bp, Homo sapiens
gaggggaaatggggaaagc

SEQ ID NO: 1269824 - DNA, 12 bp, Homo sapiens
gaggggaagagg

SEQ ID NO: 1269825 - DNA, 15 bp, Homo sapiens
gaggggaagaggcct

SEQ ID NO: 1269826 - DNA, 15 bp, Homo sapiens
gaggggaagctgggc

SEQ ID NO: 1269827 - DNA, 12 bp, Homo sapiens
gaggggaaggcc

SEQ ID NO: 1269828 - DNA, 14 bp, Homo sapiens
gaggggaagggcca

SEQ ID NO: 1269829 - DNA, 15 bp, Homo sapiens
gaggggaaggggccg

SEQ ID NO: 1269830 - DNA, 19 bp, Homo sapiens
gaggggacaaaacccacct

SEQ ID NO: 1269831 - DNA, 11 bp, Homo sapiens
gaggggacaga

SEQ ID NO: 1269832 - DNA, 14 bp, Homo sapiens
gaggggacagaggc

SEQ ID NO: 1269833 - DNA, 21 bp, Homo sapiens
gaggggaccaattctggacag

SEQ ID NO: 1269834 - DNA, 15 bp, Homo sapiens
gaggggacccagctc

SEQ ID NO: 1269835 - DNA, 16 bp, Homo sapiens
gaggggacccatgggg

SEQ ID NO: 1269836 - DNA, 11 bp, Homo sapiens
gaggggagagg

SEQ ID NO: 1269837 - DNA, 17 bp, Homo sapiens
gaggggagggctcctgg

SEQ ID NO: 1269838 - DNA, 11 bp, Homo sapiens
gaggggagggg

SEQ ID NO: 1269839 - DNA, 19 bp, Homo sapiens
gaggggaggggcctaggga

SEQ ID NO: 1269840 - DNA, 20 bp, Homo sapiens
gaggggcaacgaagaaaaaa

SEQ ID NO: 1269841 - DNA, 14 bp, Homo sapiens
gaggggcagccctt

SEQ ID NO: 1269842 - DNA, 12 bp, Homo sapiens
gaggggcagcct

SEQ ID NO: 1269843 - DNA, 22 bp, Homo sapiens
gaggggccaccccgtgcccctg

SEQ ID NO: 1269844 - DNA, 20 bp, Homo sapiens
gaggggccccagcgtctgca

SEQ ID NO: 1269845 - DNA, 21 bp, Homo sapiens
gaggggccccagcgtctgcag

SEQ ID NO: 1269846 - DNA, 18 bp, Homo sapiens
gaggggccctcaggccat

SEQ ID NO: 1269847 - DNA, 20 bp, Homo sapiens
gaggggccctccatgcgcag

SEQ ID NO: 1269848 - DNA, 23 bp, Homo sapiens
gaggggccctccatgcgcagatg

SEQ ID NO: 1269849 - DNA, 13 bp, Homo sapiens
gaggggccctggc

SEQ ID NO: 1269850 - DNA, 18 bp, Homo sapiens
gaggggccctggccagga

SEQ ID NO: 1269851 - DNA, 12 bp, Homo sapiens
gaggggcctagg

SEQ ID NO: 1269852 - DNA, 17 bp, Homo sapiens
gaggggcctaggcctca

SEQ ID NO: 1269853 - DNA, 19 bp, Homo sapiens
gaggggcctaggcctcagc

SEQ ID NO: 1269854 - DNA, 22 bp, Homo sapiens
gaggggcctaggcctcagccag

SEQ ID NO: 1269855 - DNA, 13 bp, Homo sapiens
gaggggcctaggg

SEQ ID NO: 1269856 - DNA, 14 bp, Homo sapiens
gaggggcctcaggt

SEQ ID NO: 1269857 - DNA, 13 bp, Homo sapiens
gaggggcctcccc

SEQ ID NO: 1269858 - DNA, 20 bp, Homo sapiens
gaggggcctcccggggccca

SEQ ID NO: 1269859 - DNA, 15 bp, Homo sapiens
gaggggcctgatgag

SEQ ID NO: 1269860 - DNA, 13 bp, Homo sapiens
gaggggcctggca

SEQ ID NO: 1269861 - DNA, 14 bp, Homo sapiens
gaggggcctggcag

SEQ ID NO: 1269862 - DNA, 18 bp, Homo sapiens
gaggggcctggcagccgt

SEQ ID NO: 1269863 - DNA, 20 bp, Homo sapiens
gaggggcctggcagccgtgc

SEQ ID NO: 1269864 - DNA, 13 bp, Homo sapiens
gaggggcctgggc

SEQ ID NO: 1269865 - DNA, 20 bp, Homo sapiens
gaggggcgctggcccagccg

SEQ ID NO: 1269866 - DNA, 22 bp, Homo sapiens
gaggggcgctggcccagccggc

SEQ ID NO: 1269867 - DNA, 16 bp, Homo sapiens
gaggggctcaggaaaa

SEQ ID NO: 1269868 - DNA, 12 bp, Homo sapiens
gaggggctcctg

SEQ ID NO: 1269869 - DNA, 14 bp, Homo sapiens
gaggggctcctgga

SEQ ID NO: 1269870 - DNA, 12 bp, Homo sapiens
gaggggctctca

SEQ ID NO: 1269871 - DNA, 23 bp, Homo sapiens
gaggggctggggagggggtacct

SEQ ID NO: 1269872 - DNA, 11 bp, Homo sapiens
gaggggctgtc

SEQ ID NO: 1269873 - DNA, 12 bp, Homo sapiens
gagggggaagca

SEQ ID NO: 1269874 - DNA, 12 bp, Homo sapiens
gagggggacctg

SEQ ID NO: 1269875 - DNA, 16 bp, Homo sapiens
gagggggacctgtccc

SEQ ID NO: 1269876 - DNA, 19 bp, Homo sapiens
gagggggagaatgagaagg

SEQ ID NO: 1269877 - DNA, 17 bp, Homo sapiens
gagggggagtagccaag

SEQ ID NO: 1269878 - DNA, 14 bp, Homo sapiens
gagggggctctcca

SEQ ID NO: 1269879 - DNA, 12 bp, Homo sapiens
gagggggctctg

SEQ ID NO: 1269880 - DNA, 22 bp, Homo sapiens
gagggggctctgcccacctggg

SEQ ID NO: 1269881 - DNA, 14 bp, Homo sapiens
gagggggctgtcat

SEQ ID NO: 1269882 - DNA, 22 bp, Homo sapiens
gaggggggccaaggtcctgctc

SEQ ID NO: 1269883 - DNA, 14 bp, Homo sapiens
gaggggggcgggtg

SEQ ID NO: 1269884 - DNA, 17 bp, Homo sapiens
gaggggggtgctggccc

SEQ ID NO: 1269885 - DNA, 23 bp, Homo sapiens
gaggggggtgctggcccccagga

SEQ ID NO: 1269886 - DNA, 13 bp, Homo sapiens
gagggggtggagg

SEQ ID NO: 1269887 - DNA, 15 bp, Homo sapiens
gagggggttacaaac

SEQ ID NO: 1269888 - DNA, 19 bp, Homo sapiens
gagggggttacaaactgca

SEQ ID NO: 1269889 - DNA, 14 bp, Homo sapiens
gaggggtaggcaga

SEQ ID NO: 1269890 - DNA, 21 bp, Homo sapiens
gaggggtgagtcccctactcc

SEQ ID NO: 1269891 - DNA, 18 bp, Homo sapiens
gaggggtgcagaggctgt

SEQ ID NO: 1269892 - DNA, 19 bp, Homo sapiens
gaggggtgcagaggctgtg

SEQ ID NO: 1269893 - DNA, 14 bp, Homo sapiens
gaggggtgctctgc

SEQ ID NO: 1269894 - DNA, 11 bp, Homo sapiens
gaggggtgtcc

SEQ ID NO: 1269895 - DNA, 17 bp, Homo sapiens
gaggggtgtggcagtgg

SEQ ID NO: 1269896 - DNA, 18 bp, Homo sapiens
gaggggtgtggcagtggt

SEQ ID NO: 1269897 - DNA, 19 bp, Homo sapiens
gaggggtttgggagtcagg

SEQ ID NO: 1269898 - DNA, 20 bp, Homo sapiens
gaggggtttgggagtcaggc

SEQ ID NO: 1269899 - DNA, 21 bp, Homo sapiens
gagggtaactggggggccacc

SEQ ID NO: 1269900 - DNA, 23 bp, Homo sapiens
gagggtaactggggggccaccat

SEQ ID NO: 1269901 - DNA, 21 bp, Homo sapiens
gagggtaggagggtgggaagg

SEQ ID NO: 1269902 - DNA, 21 bp, Homo sapiens
gagtctggacctccatccctg

SEQ ID NO: 1269903 - DNA, 18 bp, Homo sapiens
gagtctgggcctctgact

SEQ ID NO: 1269904 - DNA, 23 bp, Homo sapiens
gagtctgtaggagcaagggcaca

SEQ ID NO: 1269905 - DNA, 21 bp, Homo sapiens
gagtcttaactgtatttcagt

SEQ ID NO: 1269906 - DNA, 22 bp, Homo sapiens
gagtcttaactgtatttcagta

SEQ ID NO: 1269907 - DNA, 14 bp, Homo sapiens
gagtcttaataaaa

SEQ ID NO: 1269908 - DNA, 14 bp, Homo sapiens
gagtcttcagaccc

SEQ ID NO: 1269909 - DNA, 17 bp, Homo sapiens
gagtcttcagacccaga

SEQ ID NO: 1269910 - DNA, 19 bp, Homo sapiens
gagtcttcagacccagaga

SEQ ID NO: 1269911 - DNA, 18 bp, Homo sapiens
gagtcttccaaggccaga

SEQ ID NO: 1269912 - DNA, 14 bp, Homo sapiens
gagtcttggtgcta

SEQ ID NO: 1269913 - DNA, 17 bp, Homo sapiens
gagtcttggttctaaag

SEQ ID NO: 1269914 - DNA, 14 bp, Homo sapiens
gagtctttgtgtgt

SEQ ID NO: 1269915 - DNA, 18 bp, Homo sapiens
gagtctttgtgtgttata

SEQ ID NO: 1269916 - DNA, 22 bp, Homo sapiens
gagtgaaaaatcttaagtacca

SEQ ID NO: 1269917 - DNA, 11 bp, Homo sapiens
gagtgaaacag

SEQ ID NO: 1269918 - DNA, 20 bp, Homo sapiens
gagtgaaacagagaaagaaa

SEQ ID NO: 1269919 - DNA, 22 bp, Homo sapiens
gagtgaaacctttagggcagct

SEQ ID NO: 1269920 - DNA, 19 bp, Homo sapiens
gagtgaaagggctatggca

SEQ ID NO: 1269921 - DNA, 22 bp, Homo sapiens
gagtgaaagggctatggcaagg

SEQ ID NO: 1269922 - DNA, 22 bp, Homo sapiens
gagtgaaataccctcaagtctc

SEQ ID NO: 1269923 - DNA, 15 bp, Homo sapiens
gagtgaatagctttc

SEQ ID NO: 1269924 - DNA, 23 bp, Homo sapiens
gagtgaattgtacctatttctga

SEQ ID NO: 1269925 - DNA, 17 bp, Homo sapiens
gagtgaatttgacctag

SEQ ID NO: 1269926 - DNA, 16 bp, Homo sapiens
gagtgacccagctact

SEQ ID NO: 1269927 - DNA, 13 bp, Homo sapiens
gagtgaccctcag

SEQ ID NO: 1269928 - DNA, 18 bp, Homo sapiens
gagtgaccctcagctgtc

SEQ ID NO: 1269929 - DNA, 22 bp, Homo sapiens
gagtgaccgggcactggcactg

SEQ ID NO: 1269930 - DNA, 21 bp, Homo sapiens
gagtgaccgggggctgctggg

SEQ ID NO: 1269931 - DNA, 18 bp, Homo sapiens
gagtgactcgagggttgg

SEQ ID NO: 1269932 - DNA, 23 bp, Homo sapiens
gagtgagaaagaataggggctga

SEQ ID NO: 1269933 - DNA, 14 bp, Homo sapiens
gagtgagacagact

SEQ ID NO: 1269934 - DNA, 16 bp, Homo sapiens
gagtgagagcctttgc

SEQ ID NO: 1269935 - DNA, 20 bp, Homo sapiens
gagtgagagcctttgccttt

SEQ ID NO: 1269936 - DNA, 22 bp, Homo sapiens
gagtgaggaatagttgagcccc

SEQ ID NO: 1269937 - DNA, 15 bp, Homo sapiens
gagtgaggggctgtg

SEQ ID NO: 1269938 - DNA, 16 bp, Homo sapiens
gagtgagtcacctgct

SEQ ID NO: 1269939 - DNA, 10 bp, Homo sapiens
gagtgatctt

SEQ ID NO: 1269940 - DNA, 14 bp, Homo sapiens
gagtgatgatttgg

SEQ ID NO: 1269941 - DNA, 21 bp, Homo sapiens
gagtgcaagcccctgctccag

SEQ ID NO: 1269942 - DNA, 17 bp, Homo sapiens
gagtgcaccaaagagaa

SEQ ID NO: 1269943 - DNA, 14 bp, Homo sapiens
gagtgcactgacct

SEQ ID NO: 1269944 - DNA, 17 bp, Homo sapiens
gagtgcactgctccctg

SEQ ID NO: 1269945 - DNA, 16 bp, Homo sapiens
gagtgcagaacacctg

SEQ ID NO: 1269946 - DNA, 13 bp, Homo sapiens
gagtgcagagaaa

SEQ ID NO: 1269947 - DNA, 16 bp, Homo sapiens
gagtgcagagaaagaa

SEQ ID NO: 1269948 - DNA, 20 bp, Homo sapiens
gagtgcagccaaaggggagc

SEQ ID NO: 1269949 - DNA, 22 bp, Homo sapiens
gagtgcagccaaaggggagcca

SEQ ID NO: 1269950 - DNA, 15 bp, Homo sapiens
gagtgcagccttctc

SEQ ID NO: 1269951 - DNA, 22 bp, Homo sapiens
gagtgcagtcctgatcagagcc

SEQ ID NO: 1269952 - DNA, 16 bp, Homo sapiens
gagtgcagtggcacaa

SEQ ID NO: 1269953 - DNA, 13 bp, Homo sapiens
gagtgccaggacc

SEQ ID NO: 1269954 - DNA, 15 bp, Homo sapiens
gagtgccaggaccag

SEQ ID NO: 1269955 - DNA, 17 bp, Homo sapiens
gagtgccaggaccagcc

SEQ ID NO: 1269956 - DNA, 19 bp, Homo sapiens
gagtgccaggaccagcctg

SEQ ID NO: 1269957 - DNA, 20 bp, Homo sapiens
gagtgccaggaccagcctgt

SEQ ID NO: 1269958 - DNA, 14 bp, Homo sapiens
gagtgccaggactc

SEQ ID NO: 1269959 - DNA, 22 bp, Homo sapiens
gagtgccaggactccccaggcc

SEQ ID NO: 1269960 - DNA, 14 bp, Homo sapiens
gagtgcccagcaga

SEQ ID NO: 1269961 - DNA, 16 bp, Homo sapiens
gagtgcccagcagagg

SEQ ID NO: 1269962 - DNA, 18 bp, Homo sapiens
gagtgcccagcagaggtt

SEQ ID NO: 1269963 - DNA, 22 bp, Homo sapiens
gagtgcccctgtcccacctggc

SEQ ID NO: 1269964 - DNA, 23 bp, Homo sapiens
gagtgcccctgtcccacctggct

SEQ ID NO: 1269965 - DNA, 14 bp, Homo sapiens
gagtgccctgcagg

SEQ ID NO: 1269966 - DNA, 22 bp, Homo sapiens
gagtgcctgcattcccaggaaa

SEQ ID NO: 1269967 - DNA, 18 bp, Homo sapiens
gagtgcggaccaccctca

SEQ ID NO: 1269968 - DNA, 15 bp, Homo sapiens
gagtgcgtgtgtgtg

SEQ ID NO: 1269969 - DNA, 22 bp, Homo sapiens
gagtgctgattcaaaccaaagc

SEQ ID NO: 1269970 - DNA, 22 bp, Homo sapiens
gagtgctgcttgtgcctccctt

SEQ ID NO: 1269971 - DNA, 24 bp, Homo sapiens
gagtgctgcttgtgcctcccttcc

SEQ ID NO: 1269972 - DNA, 19 bp, Homo sapiens
gagtgctggactgttccag

SEQ ID NO: 1269973 - DNA, 14 bp, Homo sapiens
gagtgctggctcac

SEQ ID NO: 1269974 - DNA, 21 bp, Homo sapiens
gagtgctggctcacagtacag

SEQ ID NO: 1269975 - DNA, 22 bp, Homo sapiens
gagtgctggctcacagtacagc

SEQ ID NO: 1269976 - DNA, 21 bp, Homo sapiens
gagtggaagggaggagcagca

SEQ ID NO: 1269977 - DNA, 14 bp, Homo sapiens
gagtggaatgcagg

SEQ ID NO: 1269978 - DNA, 17 bp, Homo sapiens
gagtggaatgcagggaa

SEQ ID NO: 1269979 - DNA, 21 bp, Homo sapiens
gagtggaatgcagggaagagg

SEQ ID NO: 1269980 - DNA, 21 bp, Homo sapiens
gagtggacaccgctcagtatt

SEQ ID NO: 1269981 - DNA, 15 bp, Homo sapiens
gagtggactgcattt

SEQ ID NO: 1269982 - DNA, 15 bp, Homo sapiens
gagtggagtctgagt

SEQ ID NO: 1269983 - DNA, 18 bp, Homo sapiens
gagtggatgatgtttcgt

SEQ ID NO: 1269984 - DNA, 15 bp, Homo sapiens
gagtggcagccatgc

SEQ ID NO: 1269985 - DNA, 19 bp, Homo sapiens
gagtggcagccatgcctca

SEQ ID NO: 1269986 - DNA, 21 bp, Homo sapiens
gagtggcagctgtcccctctc

SEQ ID NO: 1269987 - DNA, 19 bp, Homo sapiens
gagtggcaggggacaggag

SEQ ID NO: 1269988 - DNA, 23 bp, Homo sapiens
gagtggcaggggacaggagtcca

SEQ ID NO: 1269989 - DNA, 18 bp, Homo sapiens
gagtggcaggtgggctgc

SEQ ID NO: 1269990 - DNA, 17 bp, Homo sapiens
gagtggccagccagtgc

SEQ ID NO: 1269991 - DNA, 16 bp, Homo sapiens
gagtggccagcgccag

SEQ ID NO: 1269992 - DNA, 17 bp, Homo sapiens
gagtggccagcgccagg

SEQ ID NO: 1269993 - DNA, 20 bp, Homo sapiens
gagtggccagcgccagggcc

SEQ ID NO: 1269994 - DNA, 16 bp, Homo sapiens
gagtggcctagagcac

SEQ ID NO: 1269995 - DNA, 15 bp, Homo sapiens
gagtggcctccctgc

SEQ ID NO: 1269996 - DNA, 13 bp, Homo sapiens
gagtggcctggcc

SEQ ID NO: 1269997 - DNA, 15 bp, Homo sapiens
gagtggcctggccag

SEQ ID NO: 1269998 - DNA, 19 bp, Homo sapiens
gagtggcctggccaggagc

SEQ ID NO: 1269999 - DNA, 17 bp, Homo sapiens
gagtggctcactggctg

SEQ ID NO: 1270000 - DNA, 12 bp, Homo sapiens
gagtgggaagcc

SEQ ID NO: 1270001 - DNA, 17 bp, Homo sapiens
gagtgggacagagtctg

SEQ ID NO: 1270002 - DNA, 18 bp, Homo sapiens
gagtgggacagagtctgg

SEQ ID NO: 1270003 - DNA, 12 bp, Homo sapiens
gagtgggagagg

SEQ ID NO: 1270004 - DNA, 18 bp, Homo sapiens
gagtgggagaggctggga

SEQ ID NO: 1270005 - DNA, 21 bp, Homo sapiens
gagtgggaggcgtgcccccct

SEQ ID NO: 1270006 - DNA, 22 bp, Homo sapiens
gagtgggggagagcaggctggc

SEQ ID NO: 1270007 - DNA, 14 bp, Homo sapiens
gagtggggggacag

SEQ ID NO: 1270008 - DNA, 15 bp, Homo sapiens
gagtggggggaggaa

SEQ ID NO: 1270009 - DNA, 18 bp, Homo sapiens
gagtggggggaggaagca

SEQ ID NO: 1270010 - DNA, 21 bp, Homo sapiens
gagtgggtgacaagagcctga

SEQ ID NO: 1270011 - DNA, 21 bp, Homo sapiens
gagtggtcactggtcagggca

SEQ ID NO: 1270012 - DNA, 21 bp, Homo sapiens
gagtggtctttctggagaggt

SEQ ID NO: 1270013 - DNA, 14 bp, Homo sapiens
gagtgtaagtgtga

SEQ ID NO: 1270014 - DNA, 17 bp, Homo sapiens
gagtgtactgtgcctgg

SEQ ID NO: 1270015 - DNA, 18 bp, Homo sapiens
gagtgtactgtgcctggt

SEQ ID NO: 1270016 - DNA, 15 bp, Homo sapiens
gagtgtagactgtgg

SEQ ID NO: 1270017 - DNA, 18 bp, Homo sapiens
gagtgtagcaactacagt

SEQ ID NO: 1270018 - DNA, 21 bp, Homo sapiens
gagtgtagcctaaagggcagg

SEQ ID NO: 1270019 - DNA, 18 bp, Homo sapiens
gagtgtagctgtaagggc

SEQ ID NO: 1270020 - DNA, 20 bp, Homo sapiens
gagtgtagctgtaagggcag

SEQ ID NO: 1270021 - DNA, 23 bp, Homo sapiens
gagtgtagctgtaagggcagtgc

SEQ ID NO: 1270022 - DNA, 18 bp, Homo sapiens
gagtgtagctgtgaaatc

SEQ ID NO: 1270023 - DNA, 17 bp, Homo sapiens
gatagcgggaaaaggag

SEQ ID NO: 1270024 - DNA, 22 bp, Homo sapiens
gatagctaacattttaaataaa

SEQ ID NO: 1270025 - DNA, 16 bp, Homo sapiens
gatagctaactgtaaa

SEQ ID NO: 1270026 - DNA, 18 bp, Homo sapiens
gatagctactaaatatat

SEQ ID NO: 1270027 - DNA, 13 bp, Homo sapiens
gatagctgcatgt

SEQ ID NO: 1270028 - DNA, 16 bp, Homo sapiens
gatagcttacactgag

SEQ ID NO: 1270029 - DNA, 18 bp, Homo sapiens
gatagcttacactgagga

SEQ ID NO: 1270030 - DNA, 19 bp, Homo sapiens
gatagcttacactgaggac

SEQ ID NO: 1270031 - DNA, 23 bp, Homo sapiens
gatagcttacactgaggactgtg

SEQ ID NO: 1270032 - DNA, 19 bp, Homo sapiens
gataggaaaaatgagtaat

SEQ ID NO: 1270033 - DNA, 17 bp, Homo sapiens
gataggaactgtctcaa

SEQ ID NO: 1270034 - DNA, 15 bp, Homo sapiens
gataggaccttgggc

SEQ ID NO: 1270035 - DNA, 14 bp, Homo sapiens
gataggaggaacca

SEQ ID NO: 1270036 - DNA, 22 bp, Homo sapiens
gataggagggggcggcagggct

SEQ ID NO: 1270037 - DNA, 16 bp, Homo sapiens
gataggagttctctga

SEQ ID NO: 1270038 - DNA, 20 bp, Homo sapiens
gataggcacatagagaggga

SEQ ID NO: 1270039 - DNA, 22 bp, Homo sapiens
gataggcccaaggtcccctcca

SEQ ID NO: 1270040 - DNA, 14 bp, Homo sapiens
gataggctctgcac

SEQ ID NO: 1270041 - DNA, 20 bp, Homo sapiens
gataggctctgcacagatgg

SEQ ID NO: 1270042 - DNA, 22 bp, Homo sapiens
gatagggaacactcatccctgg

SEQ ID NO: 1270043 - DNA, 22 bp, Homo sapiens
gatagtcctttttccaatgttt

SEQ ID NO: 1270044 - DNA, 15 bp, Homo sapiens
gatagtgttctgctc

SEQ ID NO: 1270045 - DNA, 16 bp, Homo sapiens
gatagtgttctgctcc

SEQ ID NO: 1270046 - DNA, 15 bp, Homo sapiens
gatagttcaccccct

SEQ ID NO: 1270047 - DNA, 14 bp, Homo sapiens
gatagttttctcct

SEQ ID NO: 1270048 - DNA, 16 bp, Homo sapiens
gatataaaaacagatt

SEQ ID NO: 1270049 - DNA, 19 bp, Homo sapiens
gatataaaaacagattctg

SEQ ID NO: 1270050 - DNA, 20 bp, Homo sapiens
gatataaaaacagattctga

SEQ ID NO: 1270051 - DNA, 22 bp, Homo sapiens
gatataaaggaccctgtttctg

SEQ ID NO: 1270052 - DNA, 21 bp, Homo sapiens
gatataaatgcaatattaatg

SEQ ID NO: 1270053 - DNA, 15 bp, Homo sapiens
gatataaatggctgg

SEQ ID NO: 1270054 - DNA, 16 bp, Homo sapiens
gatataaatggctggt

SEQ ID NO: 1270055 - DNA, 21 bp, Homo sapiens
gatataaattgggataaacat

SEQ ID NO: 1270056 - DNA, 16 bp, Homo sapiens
gatataactgtcttgt

SEQ ID NO: 1270057 - DNA, 16 bp, Homo sapiens
gatataactttagaaa

SEQ ID NO: 1270058 - DNA, 19 bp, Homo sapiens
gatataagagaagtctcat

SEQ ID NO: 1270059 - DNA, 20 bp, Homo sapiens
gatataagagaagtctcatt

SEQ ID NO: 1270060 - DNA, 22 bp, Homo sapiens
gatataagagaagtctcattcg

SEQ ID NO: 1270061 - DNA, 20 bp, Homo sapiens
gatataagagggctttttaa

SEQ ID NO: 1270062 - DNA, 13 bp, Homo sapiens
gatataatgtatt

SEQ ID NO: 1270063 - DNA, 15 bp, Homo sapiens
gatataatgtatttt

SEQ ID NO: 1270064 - DNA, 12 bp, Homo sapiens
gatatacacagt

SEQ ID NO: 1270065 - DNA, 14 bp, Homo sapiens
gatatactccagga

SEQ ID NO: 1270066 - DNA, 17 bp, Homo sapiens
gatatactccaggactt

SEQ ID NO: 1270067 - DNA, 15 bp, Homo sapiens
gatatactgtgtgct

SEQ ID NO: 1270068 - DNA, 12 bp, Homo sapiens
gatatagaaaat

SEQ ID NO: 1270069 - DNA, 15 bp, Homo sapiens
gatatagaaagctgt

SEQ ID NO: 1270070 - DNA, 21 bp, Homo sapiens
gatatagcagaggtttaaatg

SEQ ID NO: 1270071 - DNA, 22 bp, Homo sapiens
gatatagggtgtggctcctacc

SEQ ID NO: 1270072 - DNA, 24 bp, Homo sapiens
gatatagttttacttttaaactgt

SEQ ID NO: 1270073 - DNA, 13 bp, Homo sapiens
gatatatatcata

SEQ ID NO: 1270074 - DNA, 18 bp, Homo sapiens
gatatatgctctgcatgt

SEQ ID NO: 1270075 - DNA, 23 bp, Homo sapiens
gatatatgctctgcatgttacat

SEQ ID NO: 1270076 - DNA, 20 bp, Homo sapiens
gatatatgtgtttttcacat

SEQ ID NO: 1270077 - DNA, 13 bp, Homo sapiens
gatatattaaatg

SEQ ID NO: 1270078 - DNA, 18 bp, Homo sapiens
gatatatttcacttttgt

SEQ ID NO: 1270079 - DNA, 21 bp, Homo sapiens
gatatatttcacttttgttct

SEQ ID NO: 1270080 - DNA, 18 bp, Homo sapiens
gatatcacctctcttcag

SEQ ID NO: 1270081 - DNA, 18 bp, Homo sapiens
gatatcagagctcttaat

SEQ ID NO: 1270082 - DNA, 12 bp, Homo sapiens
gatatcatttta

SEQ ID NO: 1270083 - DNA, 14 bp, Homo sapiens
gatatccacataaa

SEQ ID NO: 1270084 - DNA, 16 bp, Homo sapiens
gatatcctctccccct

SEQ ID NO: 1270085 - DNA, 18 bp, Homo sapiens
gatatccttatcagagct

SEQ ID NO: 1270086 - DNA, 17 bp, Homo sapiens
gatatctatatatgtat

SEQ ID NO: 1270087 - DNA, 19 bp, Homo sapiens
gatatctatatatgtatct

SEQ ID NO: 1270088 - DNA, 20 bp, Homo sapiens
gatatcttggacaaatcaca

SEQ ID NO: 1270089 - DNA, 13 bp, Homo sapiens
gatatgatccaga

SEQ ID NO: 1270090 - DNA, 14 bp, Homo sapiens
gatatgcaaaagct

SEQ ID NO: 1270091 - DNA, 15 bp, Homo sapiens
gatatgcaaaagctg

SEQ ID NO: 1270092 - DNA, 11 bp, Homo sapiens
gatatgcctta

SEQ ID NO: 1270093 - DNA, 20 bp, Homo sapiens
gatatgctgaacgcagaaga

SEQ ID NO: 1270094 - DNA, 20 bp, Homo sapiens
gatatggcaggactcctggc

SEQ ID NO: 1270095 - DNA, 21 bp, Homo sapiens
gatatggcattgcactgctta

SEQ ID NO: 1270096 - DNA, 12 bp, Homo sapiens
gatatggctgcc

SEQ ID NO: 1270097 - DNA, 18 bp, Homo sapiens
gatatggcttaggaatga

SEQ ID NO: 1270098 - DNA, 21 bp, Homo sapiens
gatatggcttaggaatgactt

SEQ ID NO: 1270099 - DNA, 18 bp, Homo sapiens
gatatgggtagtattttt

SEQ ID NO: 1270100 - DNA, 16 bp, Homo sapiens
gatatgtaaaacattt

SEQ ID NO: 1270101 - DNA, 18 bp, Homo sapiens
gatatgtaaaacatttat

SEQ ID NO: 1270102 - DNA, 18 bp, Homo sapiens
gatatgtatgggtagggt

SEQ ID NO: 1270103 - DNA, 20 bp, Homo sapiens
gatatgtccagtcatcctgc

SEQ ID NO: 1270104 - DNA, 22 bp, Homo sapiens
gatatgtccagtcatcctgccc

SEQ ID NO: 1270105 - DNA, 16 bp, Homo sapiens
gatattaaaggagtta

SEQ ID NO: 1270106 - DNA, 13 bp, Homo sapiens
gatattaagaatc

SEQ ID NO: 1270107 - DNA, 19 bp, Homo sapiens
gatattaagaatcttagat

SEQ ID NO: 1270108 - DNA, 20 bp, Homo sapiens
gatattagttaatgagccat

SEQ ID NO: 1270109 - DNA, 18 bp, Homo sapiens
gatattataagggagagc

SEQ ID NO: 1270110 - DNA, 12 bp, Homo sapiens
gatattatagaa

SEQ ID NO: 1270111 - DNA, 14 bp, Homo sapiens
gatattatagaaaa

SEQ ID NO: 1270112 - DNA, 16 bp, Homo sapiens
gatattatggcaagtg

SEQ ID NO: 1270113 - DNA, 13 bp, Homo sapiens
gatattatttctt

SEQ ID NO: 1270114 - DNA, 14 bp, Homo sapiens
gatattatttcttc

SEQ ID NO: 1270115 - DNA, 18 bp, Homo sapiens
gatattatttcttctctt

SEQ ID NO: 1270116 - DNA, 17 bp, Homo sapiens
gatattcagatgtatgt

SEQ ID NO: 1270117 - DNA, 19 bp, Homo sapiens
gatattcattggcagctca

SEQ ID NO: 1270118 - DNA, 18 bp, Homo sapiens
gatattccatgaatgtat

SEQ ID NO: 1270119 - DNA, 21 bp, Homo sapiens
gatattccatgaatgtatcag

SEQ ID NO: 1270120 - DNA, 23 bp, Homo sapiens
gatattgaggccaagaatattgc

SEQ ID NO: 1270121 - DNA, 12 bp, Homo sapiens
gatattgcctta

SEQ ID NO: 1270122 - DNA, 17 bp, Homo sapiens
gatattgctgaagaatc

SEQ ID NO: 1270123 - DNA, 17 bp, Homo sapiens
gatattgggaaggaaat

SEQ ID NO: 1270124 - DNA, 18 bp, Homo sapiens
gatattgttataaataaa

SEQ ID NO: 1270125 - DNA, 20 bp, Homo sapiens
gatattgttataaataaaat

SEQ ID NO: 1270126 - DNA, 21 bp, Homo sapiens
gatattgttataaataaaatt

SEQ ID NO: 1270127 - DNA, 15 bp, Homo sapiens
gatattgtttgctgt

SEQ ID NO: 1270128 - DNA, 20 bp, Homo sapiens
gatattgtttgctgttgggt

SEQ ID NO: 1270129 - DNA, 21 bp, Homo sapiens
gatattgttttctgtaaataa

SEQ ID NO: 1270130 - DNA, 13 bp, Homo sapiens
gatatttaagaaa

SEQ ID NO: 1270131 - DNA, 13 bp, Homo sapiens
gatatttaattat

SEQ ID NO: 1270132 - DNA, 21 bp, Homo sapiens
gatatttagctctgtggaatt

SEQ ID NO: 1270133 - DNA, 16 bp, Homo sapiens
gatatttatatatatt

SEQ ID NO: 1270134 - DNA, 20 bp, Homo sapiens
gatatttatttcctgctact

SEQ ID NO: 1270135 - DNA, 12 bp, Homo sapiens
gatatttcctaa

SEQ ID NO: 1270136 - DNA, 13 bp, Homo sapiens
gatatttcttgct

SEQ ID NO: 1270137 - DNA, 14 bp, Homo sapiens
gatatttcttgctt

SEQ ID NO: 1270138 - DNA, 20 bp, Homo sapiens
gatatttgcagtttttcatt

SEQ ID NO: 1270139 - DNA, 20 bp, Homo sapiens
gatattttcaaattgtatct

SEQ ID NO: 1270140 - DNA, 23 bp, Homo sapiens
gatattttcaacgcagccctgct

SEQ ID NO: 1270141 - DNA, 20 bp, Homo sapiens
gatattttccctttttaaaa

SEQ ID NO: 1270142 - DNA, 15 bp, Homo sapiens
gatattttctgtgcc

SEQ ID NO: 1270143 - DNA, 18 bp, Homo sapiens
gatattttgtaaaatgta

SEQ ID NO: 1270144 - DNA, 13 bp, Homo sapiens
gatatttttaaaa

SEQ ID NO: 1270145 - DNA, 23 bp, Homo sapiens
gatctgcctgggcctgtgcagca

SEQ ID NO: 1270146 - DNA, 18 bp, Homo sapiens
gatctgcggatctcagct

SEQ ID NO: 1270147 - DNA, 19 bp, Homo sapiens
gatctgcggatctcagctt

SEQ ID NO: 1270148 - DNA, 16 bp, Homo sapiens
gatctgctctgtttta

SEQ ID NO: 1270149 - DNA, 18 bp, Homo sapiens
gatctggacagaacattt

SEQ ID NO: 1270150 - DNA, 18 bp, Homo sapiens
gatctggattttaaatgt

SEQ ID NO: 1270151 - DNA, 17 bp, Homo sapiens
gatctggcacactccct

SEQ ID NO: 1270152 - DNA, 22 bp, Homo sapiens
gatctggcacactccctctcct

SEQ ID NO: 1270153 - DNA, 13 bp, Homo sapiens
gatctggctgcag

SEQ ID NO: 1270154 - DNA, 24 bp, Homo sapiens
gatctggcttacaggggggtcgga

SEQ ID NO: 1270155 - DNA, 14 bp, Homo sapiens
gatctgggctgtgg

SEQ ID NO: 1270156 - DNA, 21 bp, Homo sapiens
gatctggggactgagtgtggg

SEQ ID NO: 1270157 - DNA, 17 bp, Homo sapiens
gatctggggaggcaggc

SEQ ID NO: 1270158 - DNA, 21 bp, Homo sapiens
gatctggggggtggggaggag

SEQ ID NO: 1270159 - DNA, 23 bp, Homo sapiens
gatctggggggtggggaggagga

SEQ ID NO: 1270160 - DNA, 16 bp, Homo sapiens
gatctggggtgggagt

SEQ ID NO: 1270161 - DNA, 16 bp, Homo sapiens
gatctggtcctaccca

SEQ ID NO: 1270162 - DNA, 14 bp, Homo sapiens
gatctggtggtcag

SEQ ID NO: 1270163 - DNA, 22 bp, Homo sapiens
gatctggtggtcagccctagga

SEQ ID NO: 1270164 - DNA, 17 bp, Homo sapiens
gatctgtactttgtgtt

SEQ ID NO: 1270165 - DNA, 14 bp, Homo sapiens
gatctgtttccaaa

SEQ ID NO: 1270166 - DNA, 18 bp, Homo sapiens
gatctgtttgaggagagc

SEQ ID NO: 1270167 - DNA, 17 bp, Homo sapiens
gatctgttttgaaggca

SEQ ID NO: 1270168 - DNA, 22 bp, Homo sapiens
gatctgttttgtggtttggaat

SEQ ID NO: 1270169 - DNA, 13 bp, Homo sapiens
gatcttaaagatc

SEQ ID NO: 1270170 - DNA, 16 bp, Homo sapiens
gatcttcaatttggat

SEQ ID NO: 1270171 - DNA, 13 bp, Homo sapiens
gatcttcagaact

SEQ ID NO: 1270172 - DNA, 17 bp, Homo sapiens
gatcttcagaactgccc

SEQ ID NO: 1270173 - DNA, 20 bp, Homo sapiens
gatcttcagaactgcccttg

SEQ ID NO: 1270174 - DNA, 18 bp, Homo sapiens
gatcttcattaccaatag

SEQ ID NO: 1270175 - DNA, 13 bp, Homo sapiens
gatcttgatttgg

SEQ ID NO: 1270176 - DNA, 11 bp, Homo sapiens
gatctttcagg

SEQ ID NO: 1270177 - DNA, 12 bp, Homo sapiens
gatctttcagga

SEQ ID NO: 1270178 - DNA, 19 bp, Homo sapiens
gatctttctcttccctgaa

SEQ ID NO: 1270179 - DNA, 14 bp, Homo sapiens
gatctttctgggag

SEQ ID NO: 1270180 - DNA, 18 bp, Homo sapiens
gatcttttcgaagctgtt

SEQ ID NO: 1270181 - DNA, 18 bp, Homo sapiens
gatctttttatacacaat

SEQ ID NO: 1270182 - DNA, 17 bp, Homo sapiens
gatctttttatattctt

SEQ ID NO: 1270183 - DNA, 14 bp, Homo sapiens
gatgaaaacatagc

SEQ ID NO: 1270184 - DNA, 14 bp, Homo sapiens
gatgaaagaggagg

SEQ ID NO: 1270185 - DNA, 18 bp, Homo sapiens
gatgaaataactccttct

SEQ ID NO: 1270186 - DNA, 15 bp, Homo sapiens
gatgaaatctttctt

SEQ ID NO: 1270187 - DNA, 14 bp, Homo sapiens
gatgaaatgcactg

SEQ ID NO: 1270188 - DNA, 17 bp, Homo sapiens
gatgaacatattcatga

SEQ ID NO: 1270189 - DNA, 20 bp, Homo sapiens
gatgaaccagccggggcctt

SEQ ID NO: 1270190 - DNA, 22 bp, Homo sapiens
gatgaacccaggacgcttctga

SEQ ID NO: 1270191 - DNA, 23 bp, Homo sapiens
gatgaacccaggacgcttctgaa

SEQ ID NO: 1270192 - DNA, 19 bp, Homo sapiens
gatgaactctttctggcct

SEQ ID NO: 1270193 - DNA, 18 bp, Homo sapiens
gatgaactttgtcattat

SEQ ID NO: 1270194 - DNA, 20 bp, Homo sapiens
gatgaagcaaggaagatata

SEQ ID NO: 1270195 - DNA, 23 bp, Homo sapiens
gatgaatgaggtcccaggcagag

SEQ ID NO: 1270196 - DNA, 15 bp, Homo sapiens
gatgaatgccgtgga

SEQ ID NO: 1270197 - DNA, 21 bp, Homo sapiens
gatgaattcttcctctccttc

SEQ ID NO: 1270198 - DNA, 22 bp, Homo sapiens
gatgaattcttcctctccttcc

SEQ ID NO: 1270199 - DNA, 14 bp, Homo sapiens
gatgacagggcaga

SEQ ID NO: 1270200 - DNA, 18 bp, Homo sapiens
gatgacagtgacacccag

SEQ ID NO: 1270201 - DNA, 19 bp, Homo sapiens
gatgaccaaagtcccttcc

SEQ ID NO: 1270202 - DNA, 15 bp, Homo sapiens
gatgaccaatgggat

SEQ ID NO: 1270203 - DNA, 18 bp, Homo sapiens
gatgaccagaacaaggtt

SEQ ID NO: 1270204 - DNA, 17 bp, Homo sapiens
gatgacccttttcatga

SEQ ID NO: 1270205 - DNA, 12 bp, Homo sapiens
gatgactaaaat

SEQ ID NO: 1270206 - DNA, 15 bp, Homo sapiens
gatgactaaaatatt

SEQ ID NO: 1270207 - DNA, 15 bp, Homo sapiens
gatgactagaggcag

SEQ ID NO: 1270208 - DNA, 21 bp, Homo sapiens
gatgactcccttaaaatagaa

SEQ ID NO: 1270209 - DNA, 17 bp, Homo sapiens
gatgactgagtcctcgt

SEQ ID NO: 1270210 - DNA, 12 bp, Homo sapiens
gatgactgctga

SEQ ID NO: 1270211 - DNA, 14 bp, Homo sapiens
gatgactgctgatt

SEQ ID NO: 1270212 - DNA, 19 bp, Homo sapiens
gatgactggggtgggaggt

SEQ ID NO: 1270213 - DNA, 11 bp, Homo sapiens
gatgactggtc

SEQ ID NO: 1270214 - DNA, 22 bp, Homo sapiens
gatgacttagcgtcaagacatt

SEQ ID NO: 1270215 - DNA, 23 bp, Homo sapiens
gatgacttagcgtcaagacattt

SEQ ID NO: 1270216 - DNA, 12 bp, Homo sapiens
gatgagaagtgt

SEQ ID NO: 1270217 - DNA, 14 bp, Homo sapiens
gatgagaatgtgac

SEQ ID NO: 1270218 - DNA, 23 bp, Homo sapiens
gatgagactccactcaggtgcac

SEQ ID NO: 1270219 - DNA, 14 bp, Homo sapiens
gatgagaggccagc

SEQ ID NO: 1270220 - DNA, 20 bp, Homo sapiens
gatgagattggcatggcttt

SEQ ID NO: 1270221 - DNA, 17 bp, Homo sapiens
gatgagatttgccagca

SEQ ID NO: 1270222 - DNA, 16 bp, Homo sapiens
gatgagatttttaaaa

SEQ ID NO: 1270223 - DNA, 19 bp, Homo sapiens
gatgagcacatctctctgc

SEQ ID NO: 1270224 - DNA, 20 bp, Homo sapiens
gatgagccttgcagatatct

SEQ ID NO: 1270225 - DNA, 20 bp, Homo sapiens
gatgagctggaaggagtgag

SEQ ID NO: 1270226 - DNA, 18 bp, Homo sapiens
gatgagctgtgcgctgct

SEQ ID NO: 1270227 - DNA, 13 bp, Homo sapiens
gatgaggagcagc

SEQ ID NO: 1270228 - DNA, 17 bp, Homo sapiens
gatgaggagcagctggg

SEQ ID NO: 1270229 - DNA, 19 bp, Homo sapiens
gatgaggcaaacagcaaga

SEQ ID NO: 1270230 - DNA, 13 bp, Homo sapiens
gatgaggcaaccc

SEQ ID NO: 1270231 - DNA, 21 bp, Homo sapiens
gatgaggccgcggcctccccg

SEQ ID NO: 1270232 - DNA, 22 bp, Homo sapiens
gatgaggcctcttggacctctg

SEQ ID NO: 1270233 - DNA, 16 bp, Homo sapiens
gatgagggatgggcct

SEQ ID NO: 1270234 - DNA, 14 bp, Homo sapiens
gatgaggggaggaa

SEQ ID NO: 1270235 - DNA, 20 bp, Homo sapiens
gatgaggggccactgaccca

SEQ ID NO: 1270236 - DNA, 23 bp, Homo sapiens
gatgaggggcttcctgggtcctg

SEQ ID NO: 1270237 - DNA, 14 bp, Homo sapiens
gatgagggtgactg

SEQ ID NO: 1270238 - DNA, 19 bp, Homo sapiens
gatgaggtcagttgtgttt

SEQ ID NO: 1270239 - DNA, 19 bp, Homo sapiens
gatgagtaaactgaggccc

SEQ ID NO: 1270240 - DNA, 21 bp, Homo sapiens
gatgagtgggaggcgtgcccc

SEQ ID NO: 1270241 - DNA, 14 bp, Homo sapiens
gatgagttgcagtt

SEQ ID NO: 1270242 - DNA, 17 bp, Homo sapiens
gatgagttgcagttttt

SEQ ID NO: 1270243 - DNA, 19 bp, Homo sapiens
gatgagtttcactgtactg

SEQ ID NO: 1270244 - DNA, 24 bp, Homo sapiens
gatgagtttcactgtactgcatgt

SEQ ID NO: 1270245 - DNA, 19 bp, Homo sapiens
gatgataaagagacagtga

SEQ ID NO: 1270246 - DNA, 19 bp, Homo sapiens
gatgataatgatgatgacg

SEQ ID NO: 1270247 - DNA, 18 bp, Homo sapiens
gatgatacaagattagaa

SEQ ID NO: 1270248 - DNA, 21 bp, Homo sapiens
gatgatacaagattagaagct

SEQ ID NO: 1270249 - DNA, 18 bp, Homo sapiens
gatgatacatccaaagca

SEQ ID NO: 1270250 - DNA, 16 bp, Homo sapiens
gatgatactgtttctt

SEQ ID NO: 1270251 - DNA, 20 bp, Homo sapiens
gatgatagtccaatttttac

SEQ ID NO: 1270252 - DNA, 15 bp, Homo sapiens
gatgatatacacagt

SEQ ID NO: 1270253 - DNA, 17 bp, Homo sapiens
gatgatatacacagtgg

SEQ ID NO: 1270254 - DNA, 14 bp, Homo sapiens
gatgatatctatat

SEQ ID NO: 1270255 - DNA, 20 bp, Homo sapiens
gatgatcaaaacctgtgcca

SEQ ID NO: 1270256 - DNA, 19 bp, Homo sapiens
gatgatcagctgtttgtca

SEQ ID NO: 1270257 - DNA, 20 bp, Homo sapiens
gatgatcagctgtttgtcat

SEQ ID NO: 1270258 - DNA, 14 bp, Homo sapiens
gatgatcctaggca

SEQ ID NO: 1270259 - DNA, 20 bp, Homo sapiens
gatgatcgcccgataaagac

SEQ ID NO: 1270260 - DNA, 19 bp, Homo sapiens
gatgatgccaacctctgga

SEQ ID NO: 1270261 - DNA, 16 bp, Homo sapiens
gatgatgctgtgacaa

SEQ ID NO: 1270262 - DNA, 19 bp, Homo sapiens
gatgatggaaacgcactta

SEQ ID NO: 1270263 - DNA, 16 bp, Homo sapiens
gatgatggcagagcca

SEQ ID NO: 1270264 - DNA, 19 bp, Homo sapiens
gatgatgtctacagaaaat

SEQ ID NO: 1270265 - DNA, 16 bp, Homo sapiens
gatgatgtctcttgta

SEQ ID NO: 1270266 - DNA, 15 bp, Homo sapiens
gatgggtcagagcta

SEQ ID NO: 1270267 - DNA, 15 bp, Homo sapiens
gatgggtccaggggt

SEQ ID NO: 1270268 - DNA, 14 bp, Homo sapiens
gatgggtgctgccc

SEQ ID NO: 1270269 - DNA, 22 bp, Homo sapiens
gatgggtggggaggggggcggg

SEQ ID NO: 1270270 - DNA, 23 bp, Homo sapiens
gatggtaaagccatgttaaatga

SEQ ID NO: 1270271 - DNA, 17 bp, Homo sapiens
gatggtattaatcttgt

SEQ ID NO: 1270272 - DNA, 20 bp, Homo sapiens
gatggtattaatcttgtgta

SEQ ID NO: 1270273 - DNA, 13 bp, Homo sapiens
gatggtatttctt

SEQ ID NO: 1270274 - DNA, 16 bp, Homo sapiens
gatggtatttctttct

SEQ ID NO: 1270275 - DNA, 16 bp, Homo sapiens
gatggtcagagcccag

SEQ ID NO: 1270276 - DNA, 15 bp, Homo sapiens
gatggtcagctccct

SEQ ID NO: 1270277 - DNA, 20 bp, Homo sapiens
gatggtccatttgttcctgc

SEQ ID NO: 1270278 - DNA, 11 bp, Homo sapiens
gatggtcccag

SEQ ID NO: 1270279 - DNA, 15 bp, Homo sapiens
gatggtcccaggaag

SEQ ID NO: 1270280 - DNA, 16 bp, Homo sapiens
gatggtccgtgcccag

SEQ ID NO: 1270281 - DNA, 18 bp, Homo sapiens
gatggtcggatctcacag

SEQ ID NO: 1270282 - DNA, 19 bp, Homo sapiens
gatggtctcgatctcctga

SEQ ID NO: 1270283 - DNA, 19 bp, Homo sapiens
gatggtctctctccctctg

SEQ ID NO: 1270284 - DNA, 18 bp, Homo sapiens
gatggtggactaagcaat

SEQ ID NO: 1270285 - DNA, 15 bp, Homo sapiens
gatggtggagggcca

SEQ ID NO: 1270286 - DNA, 16 bp, Homo sapiens
gatggtggagtgagag

SEQ ID NO: 1270287 - DNA, 15 bp, Homo sapiens
gatggtggcacaggc

SEQ ID NO: 1270288 - DNA, 21 bp, Homo sapiens
gatggtggccacagactgacc

SEQ ID NO: 1270289 - DNA, 21 bp, Homo sapiens
gatggtggccgcccacccgcc

SEQ ID NO: 1270290 - DNA, 17 bp, Homo sapiens
gatggtggctgtgtctc

SEQ ID NO: 1270291 - DNA, 14 bp, Homo sapiens
gatggtgtccttcc

SEQ ID NO: 1270292 - DNA, 18 bp, Homo sapiens
gatggtgtccttccctgc

SEQ ID NO: 1270293 - DNA, 15 bp, Homo sapiens
gatggtgttaaagct

SEQ ID NO: 1270294 - DNA, 14 bp, Homo sapiens
gatggtgttatctt

SEQ ID NO: 1270295 - DNA, 13 bp, Homo sapiens
gatggtgtttctt

SEQ ID NO: 1270296 - DNA, 17 bp, Homo sapiens
gatggtgttttggggat

SEQ ID NO: 1270297 - DNA, 22 bp, Homo sapiens
gatggttaaaaaggccaaagat

SEQ ID NO: 1270298 - DNA, 18 bp, Homo sapiens
gatggttcccctgttcac

SEQ ID NO: 1270299 - DNA, 16 bp, Homo sapiens
gatggttgcaattgat

SEQ ID NO: 1270300 - DNA, 14 bp, Homo sapiens
gatggttgtagcat

SEQ ID NO: 1270301 - DNA, 22 bp, Homo sapiens
gatgtaacagtgcaagattttt

SEQ ID NO: 1270302 - DNA, 16 bp, Homo sapiens
gatgtaaccaagctgt

SEQ ID NO: 1270303 - DNA, 21 bp, Homo sapiens
gatgtaatctctctgcagctg

SEQ ID NO: 1270304 - DNA, 16 bp, Homo sapiens
gatgtacagtctgtca

SEQ ID NO: 1270305 - DNA, 22 bp, Homo sapiens
gatgtacatagttatttttctc

SEQ ID NO: 1270306 - DNA, 19 bp, Homo sapiens
gatgtacatttaataatat

SEQ ID NO: 1270307 - DNA, 22 bp, Homo sapiens
gatgtacatttccaaattcaca

SEQ ID NO: 1270308 - DNA, 19 bp, Homo sapiens
gatgtaccatgaaacaaag

SEQ ID NO: 1270309 - DNA, 20 bp, Homo sapiens
gatgtacttctctgtgtgca

SEQ ID NO: 1270310 - DNA, 22 bp, Homo sapiens
gatgtacttctctgtgtgcaca

SEQ ID NO: 1270311 - DNA, 13 bp, Homo sapiens
gatgtagcattgt

SEQ ID NO: 1270312 - DNA, 14 bp, Homo sapiens
gatgtagcattgtt

SEQ ID NO: 1270313 - DNA, 14 bp, Homo sapiens
gatgtagcttgaga

SEQ ID NO: 1270314 - DNA, 20 bp, Homo sapiens
gatgtaggggaagagatgtt

SEQ ID NO: 1270315 - DNA, 19 bp, Homo sapiens
gatgtagggtaaggtgcct

SEQ ID NO: 1270316 - DNA, 13 bp, Homo sapiens
gatgtagtatttt

SEQ ID NO: 1270317 - DNA, 20 bp, Homo sapiens
gatgtagttctgccaggcaa

SEQ ID NO: 1270318 - DNA, 14 bp, Homo sapiens
gatgtataaatttt

SEQ ID NO: 1270319 - DNA, 21 bp, Homo sapiens
gatgtatattcctttgaagat

SEQ ID NO: 1270320 - DNA, 13 bp, Homo sapiens
gatgtatctgagt

SEQ ID NO: 1270321 - DNA, 14 bp, Homo sapiens
gatgtattttcata

SEQ ID NO: 1270322 - DNA, 16 bp, Homo sapiens
gatgtatttttgatgt

SEQ ID NO: 1270323 - DNA, 15 bp, Homo sapiens
gatgtcaatttctgt

SEQ ID NO: 1270324 - DNA, 13 bp, Homo sapiens
gatgtcacagggc

SEQ ID NO: 1270325 - DNA, 20 bp, Homo sapiens
gatgtcacagtccaaccaga

SEQ ID NO: 1270326 - DNA, 22 bp, Homo sapiens
gatgtcagccgagccgggcctg

SEQ ID NO: 1270327 - DNA, 11 bp, Homo sapiens
gatgtcagcct

SEQ ID NO: 1270328 - DNA, 14 bp, Homo sapiens
gatgtcagccttgc

SEQ ID NO: 1270329 - DNA, 23 bp, Homo sapiens
gatgtcataataaagttgtttta

SEQ ID NO: 1270330 - DNA, 23 bp, Homo sapiens
gatgtcatatcatttcactgtct

SEQ ID NO: 1270331 - DNA, 16 bp, Homo sapiens
gatgtcatttgagcag

SEQ ID NO: 1270332 - DNA, 12 bp, Homo sapiens
gatgtccagaag

SEQ ID NO: 1270333 - DNA, 18 bp, Homo sapiens
gatgtcccaacttgtaaa

SEQ ID NO: 1270334 - DNA, 11 bp, Homo sapiens
gatgtcccagt

SEQ ID NO: 1270335 - DNA, 18 bp, Homo sapiens
gatgtcccagtgctcacc

SEQ ID NO: 1270336 - DNA, 17 bp, Homo sapiens
gatgtcccctgtcccac

SEQ ID NO: 1270337 - DNA, 19 bp, Homo sapiens
gatgtccctgggccagggt

SEQ ID NO: 1270338 - DNA, 21 bp, Homo sapiens
gatgtccctttcttggccagt

SEQ ID NO: 1270339 - DNA, 22 bp, Homo sapiens
gatgtcctctttactcccttcc

SEQ ID NO: 1270340 - DNA, 18 bp, Homo sapiens
gatgtctcctcaagcctg

SEQ ID NO: 1270341 - DNA, 12 bp, Homo sapiens
gatgtctctggg

SEQ ID NO: 1270342 - DNA, 20 bp, Homo sapiens
gatgtcttaactgtcaccca

SEQ ID NO: 1270343 - DNA, 12 bp, Homo sapiens
gatgtcttcatc

SEQ ID NO: 1270344 - DNA, 15 bp, Homo sapiens
gatgtcttccctggg

SEQ ID NO: 1270345 - DNA, 16 bp, Homo sapiens
gatgtcttctgcctgt

SEQ ID NO: 1270346 - DNA, 15 bp, Homo sapiens
gatgtcttctggtgt

SEQ ID NO: 1270347 - DNA, 19 bp, Homo sapiens
gatgtcttctggtgtcatg

SEQ ID NO: 1270348 - DNA, 22 bp, Homo sapiens
gatgtcttggaacattggaatg

SEQ ID NO: 1270349 - DNA, 15 bp, Homo sapiens
gatgtgaagataatt

SEQ ID NO: 1270350 - DNA, 13 bp, Homo sapiens
gatgtgaagccaa

SEQ ID NO: 1270351 - DNA, 23 bp, Homo sapiens
gatgtgaattgcctgcagagaga

SEQ ID NO: 1270352 - DNA, 14 bp, Homo sapiens
gatgtgactgtata

SEQ ID NO: 1270353 - DNA, 11 bp, Homo sapiens
gatgtgatata

SEQ ID NO: 1270354 - DNA, 15 bp, Homo sapiens
gatgtgattgtggaa

SEQ ID NO: 1270355 - DNA, 16 bp, Homo sapiens
gatgtgcaaaaccttt

SEQ ID NO: 1270356 - DNA, 22 bp, Homo sapiens
gatgtgcaacctgtggctcagg

SEQ ID NO: 1270357 - DNA, 12 bp, Homo sapiens
gatgtgcaataa

SEQ ID NO: 1270358 - DNA, 21 bp, Homo sapiens
gatgtgcatttttgtgaaatg

SEQ ID NO: 1270359 - DNA, 14 bp, Homo sapiens
gatgtgcctgtaat

SEQ ID NO: 1270360 - DNA, 21 bp, Homo sapiens
gatgtgcggagcgggaggcgg

SEQ ID NO: 1270361 - DNA, 13 bp, Homo sapiens
gatgtgctcagcc

SEQ ID NO: 1270362 - DNA, 18 bp, Homo sapiens
gatgtggaatgcagtcct

SEQ ID NO: 1270363 - DNA, 23 bp, Homo sapiens
gatgtggacgtcacgctccctga

SEQ ID NO: 1270364 - DNA, 13 bp, Homo sapiens
gatgtggaggaag

SEQ ID NO: 1270365 - DNA, 14 bp, Homo sapiens
gatgtggaggaaga

SEQ ID NO: 1270366 - DNA, 14 bp, Homo sapiens
gatgtggccctggc

SEQ ID NO: 1270367 - DNA, 22 bp, Homo sapiens
gatgtgggagggagcagacagg

SEQ ID NO: 1270368 - DNA, 23 bp, Homo sapiens
gatgtgggagggagcagacagga

SEQ ID NO: 1270369 - DNA, 13 bp, Homo sapiens
gatgtgggcagct

SEQ ID NO: 1270370 - DNA, 18 bp, Homo sapiens
gatgtggggctgagctgg

SEQ ID NO: 1270371 - DNA, 15 bp, Homo sapiens
gatgtggtgcctgag

SEQ ID NO: 1270372 - DNA, 22 bp, Homo sapiens
gatgtggtgcctgaggtctgta

SEQ ID NO: 1270373 - DNA, 17 bp, Homo sapiens
gatgtgtctcccagaac

SEQ ID NO: 1270374 - DNA, 19 bp, Homo sapiens
gatgtgtctgggagagcct

SEQ ID NO: 1270375 - DNA, 13 bp, Homo sapiens
gatgtgtgcatgt

SEQ ID NO: 1270376 - DNA, 14 bp, Homo sapiens
gatgtgtgctttcc

SEQ ID NO: 1270377 - DNA, 13 bp, Homo sapiens
gatgtgtggggca

SEQ ID NO: 1270378 - DNA, 16 bp, Homo sapiens
gatgtgtggggcatgg

SEQ ID NO: 1270379 - DNA, 20 bp, Homo sapiens
gatgtgttattacttcctca

SEQ ID NO: 1270380 - DNA, 18 bp, Homo sapiens
gatgtgttcattcaagct

SEQ ID NO: 1270381 - DNA, 23 bp, Homo sapiens
gatgtgttggtttacagggtata

SEQ ID NO: 1270382 - DNA, 22 bp, Homo sapiens
gatgttaaaaaaataagaagaa

SEQ ID NO: 1270383 - DNA, 20 bp, Homo sapiens
gatgttaaaataaatggttt

SEQ ID NO: 1270384 - DNA, 17 bp, Homo sapiens
gatgttaaatggaattc

SEQ ID NO: 1270385 - DNA, 14 bp, Homo sapiens
gatgttaaatgtta

SEQ ID NO: 1270386 - DNA, 15 bp, Homo sapiens
gatgttaaatgttat

SEQ ID NO: 1270387 - DNA, 21 bp, Homo sapiens
gatgttaaatgttattattac

SEQ ID NO: 1270388 - DNA, 21 bp, Homo sapiens
gcacctaaaccaccagtgccc

SEQ ID NO: 1270389 - DNA, 19 bp, Homo sapiens
gcacctacagtgtacagtc

SEQ ID NO: 1270390 - DNA, 21 bp, Homo sapiens
gcacctacagtgtacagtctt

SEQ ID NO: 1270391 - DNA, 18 bp, Homo sapiens
gcacctaccaccagggcc

SEQ ID NO: 1270392 - DNA, 20 bp, Homo sapiens
gcacctaccccttggaaatg

SEQ ID NO: 1270393 - DNA, 22 bp, Homo sapiens
gcacctatgagatggccatgct

SEQ ID NO: 1270394 - DNA, 23 bp, Homo sapiens
gcacctatgagatggccatgctc

SEQ ID NO: 1270395 - DNA, 11 bp, Homo sapiens
gcacctcagaa

SEQ ID NO: 1270396 - DNA, 14 bp, Homo sapiens
gcacctcagggcca

SEQ ID NO: 1270397 - DNA, 18 bp, Homo sapiens
gcacctccacatcctcca

SEQ ID NO: 1270398 - DNA, 22 bp, Homo sapiens
gcacctccacgccactgcctcc

SEQ ID NO: 1270399 - DNA, 15 bp, Homo sapiens
gcacctccagcctga

SEQ ID NO: 1270400 - DNA, 22 bp, Homo sapiens
gcacctccaggcaggccaggct

SEQ ID NO: 1270401 - DNA, 15 bp, Homo sapiens
gcacctccaggcctg

SEQ ID NO: 1270402 - DNA, 19 bp, Homo sapiens
gcacctccccccactgcag

SEQ ID NO: 1270403 - DNA, 21 bp, Homo sapiens
gcacctccccccactgcaggc

SEQ ID NO: 1270404 - DNA, 15 bp, Homo sapiens
gcacctccccgctgg

SEQ ID NO: 1270405 - DNA, 16 bp, Homo sapiens
gcacctccccgctggg

SEQ ID NO: 1270406 - DNA, 23 bp, Homo sapiens
gcacctccctccccagctccgga

SEQ ID NO: 1270407 - DNA, 20 bp, Homo sapiens
gcacctccgcgggctgactg

SEQ ID NO: 1270408 - DNA, 21 bp, Homo sapiens
gcacctccgcttgccagaggc

SEQ ID NO: 1270409 - DNA, 20 bp, Homo sapiens
gcacctccggctgcctagcc

SEQ ID NO: 1270410 - DNA, 21 bp, Homo sapiens
gcacctcctaccctcccacca

SEQ ID NO: 1270411 - DNA, 21 bp, Homo sapiens
gcacctcggggacaccagagc

SEQ ID NO: 1270412 - DNA, 22 bp, Homo sapiens
gcacctcggggacaccagagct

SEQ ID NO: 1270413 - DNA, 12 bp, Homo sapiens
gcacctctgccc

SEQ ID NO: 1270414 - DNA, 14 bp, Homo sapiens
gcacctctgccctt

SEQ ID NO: 1270415 - DNA, 21 bp, Homo sapiens
gcacctctgcccttcccctcc

SEQ ID NO: 1270416 - DNA, 23 bp, Homo sapiens
gcacctgaaattaatttgtgaat

SEQ ID NO: 1270417 - DNA, 16 bp, Homo sapiens
gcacctgaaccccatg

SEQ ID NO: 1270418 - DNA, 24 bp, Homo sapiens
gcacctgaaccccatgggcttgga

SEQ ID NO: 1270419 - DNA, 15 bp, Homo sapiens
gcacctgccagcctg

SEQ ID NO: 1270420 - DNA, 16 bp, Homo sapiens
gcacctgccagcctgg

SEQ ID NO: 1270421 - DNA, 22 bp, Homo sapiens
gcacctgccccctggtggacag

SEQ ID NO: 1270422 - DNA, 13 bp, Homo sapiens
gcacctgcctcag

SEQ ID NO: 1270423 - DNA, 17 bp, Homo sapiens
gcacctgcctcagcaat

SEQ ID NO: 1270424 - DNA, 19 bp, Homo sapiens
gcacctgcctgccgctgca

SEQ ID NO: 1270425 - DNA, 16 bp, Homo sapiens
gcacctgcgcacaggt

SEQ ID NO: 1270426 - DNA, 22 bp, Homo sapiens
gcacctgcgcggaggacgcgac

SEQ ID NO: 1270427 - DNA, 15 bp, Homo sapiens
gcacctgctctcttg

SEQ ID NO: 1270428 - DNA, 12 bp, Homo sapiens
gcacctgctgcg

SEQ ID NO: 1270429 - DNA, 16 bp, Homo sapiens
gcacctgctgcgtccc

SEQ ID NO: 1270430 - DNA, 16 bp, Homo sapiens
gcacctggaccccctg

SEQ ID NO: 1270431 - DNA, 13 bp, Homo sapiens
gcacctggcctgc

SEQ ID NO: 1270432 - DNA, 20 bp, Homo sapiens
gcacctggcctgctgggaac

SEQ ID NO: 1270433 - DNA, 18 bp, Homo sapiens
gcacctgggccccactgg

SEQ ID NO: 1270434 - DNA, 22 bp, Homo sapiens
gcacctgggccccactggacaa

SEQ ID NO: 1270435 - DNA, 21 bp, Homo sapiens
gcacctgtaatcccagctact

SEQ ID NO: 1270436 - DNA, 21 bp, Homo sapiens
gcacctgtactcaggaggctg

SEQ ID NO: 1270437 - DNA, 18 bp, Homo sapiens
gcacctgtccccaccctc

SEQ ID NO: 1270438 - DNA, 20 bp, Homo sapiens
gcacctgtcggtggctgcct

SEQ ID NO: 1270439 - DNA, 19 bp, Homo sapiens
gcaccttatatttctgtgt

SEQ ID NO: 1270440 - DNA, 14 bp, Homo sapiens
gcaccttcagactt

SEQ ID NO: 1270441 - DNA, 16 bp, Homo sapiens
gcaccttcagggctga

SEQ ID NO: 1270442 - DNA, 12 bp, Homo sapiens
gcaccttccccc

SEQ ID NO: 1270443 - DNA, 23 bp, Homo sapiens
gcaccttcttggcgctggagagt

SEQ ID NO: 1270444 - DNA, 18 bp, Homo sapiens
gcaccttctttctggact

SEQ ID NO: 1270445 - DNA, 19 bp, Homo sapiens
gcaccttctttctggactg

SEQ ID NO: 1270446 - DNA, 20 bp, Homo sapiens
gcaccttctttctggactgg

SEQ ID NO: 1270447 - DNA, 14 bp, Homo sapiens
gcaccttggcccag

SEQ ID NO: 1270448 - DNA, 15 bp, Homo sapiens
gcaccttggcccagg

SEQ ID NO: 1270449 - DNA, 17 bp, Homo sapiens
gcacctttctagttgaa

SEQ ID NO: 1270450 - DNA, 16 bp, Homo sapiens
gcacctttgcacagga

SEQ ID NO: 1270451 - DNA, 23 bp, Homo sapiens
gcacctttgtctggatgcacact

SEQ ID NO: 1270452 - DNA, 19 bp, Homo sapiens
gcaccttttcatgtacagc

SEQ ID NO: 1270453 - DNA, 16 bp, Homo sapiens
gcacgaacccacctgc

SEQ ID NO: 1270454 - DNA, 12 bp, Homo sapiens
gcacgcacacac

SEQ ID NO: 1270455 - DNA, 20 bp, Homo sapiens
gcacgcacacacacatacag

SEQ ID NO: 1270456 - DNA, 13 bp, Homo sapiens
gcacgcacctgta

SEQ ID NO: 1270457 - DNA, 17 bp, Homo sapiens
gcacgcccatgtgtgag

SEQ ID NO: 1270458 - DNA, 13 bp, Homo sapiens
gcacgccctactc

SEQ ID NO: 1270459 - DNA, 14 bp, Homo sapiens
gcacgccctactcc

SEQ ID NO: 1270460 - DNA, 14 bp, Homo sapiens
gcacgcctgcaggc

SEQ ID NO: 1270461 - DNA, 19 bp, Homo sapiens
gcacgcctgcaggctggag

SEQ ID NO: 1270462 - DNA, 13 bp, Homo sapiens
gcacgcctgccat

SEQ ID NO: 1270463 - DNA, 15 bp, Homo sapiens
gcacgcctgctggcc

SEQ ID NO: 1270464 - DNA, 16 bp, Homo sapiens
gcacgcctgctggccg

SEQ ID NO: 1270465 - DNA, 18 bp, Homo sapiens
gcacgcgcgagtgtgctg

SEQ ID NO: 1270466 - DNA, 18 bp, Homo sapiens
gcacgctcccctccatcc

SEQ ID NO: 1270467 - DNA, 14 bp, Homo sapiens
gcacgctcgctgcc

SEQ ID NO: 1270468 - DNA, 18 bp, Homo sapiens
gcacgctgcctgccaaag

SEQ ID NO: 1270469 - DNA, 18 bp, Homo sapiens
gcacggagccgcgggaca

SEQ ID NO: 1270470 - DNA, 21 bp, Homo sapiens
gcacggcccggcccctcaccc

SEQ ID NO: 1270471 - DNA, 19 bp, Homo sapiens
gcacggcgggatcctccac

SEQ ID NO: 1270472 - DNA, 14 bp, Homo sapiens
gcacggctccgagg

SEQ ID NO: 1270473 - DNA, 21 bp, Homo sapiens
gcacggctccgagggcggcca

SEQ ID NO: 1270474 - DNA, 14 bp, Homo sapiens
gcacggctgctcgg

SEQ ID NO: 1270475 - DNA, 19 bp, Homo sapiens
gcacgggatgcgtgggagg

SEQ ID NO: 1270476 - DNA, 14 bp, Homo sapiens
gcacggggacctgg

SEQ ID NO: 1270477 - DNA, 15 bp, Homo sapiens
gcacggggacctgga

SEQ ID NO: 1270478 - DNA, 13 bp, Homo sapiens
gcacgggtggtcc

SEQ ID NO: 1270479 - DNA, 20 bp, Homo sapiens
gcacggtggacccagacaca

SEQ ID NO: 1270480 - DNA, 20 bp, Homo sapiens
gcacgtaggttccccagaga

SEQ ID NO: 1270481 - DNA, 16 bp, Homo sapiens
gcacgtcttgctattt

SEQ ID NO: 1270482 - DNA, 16 bp, Homo sapiens
gcacgtggagagctgg

SEQ ID NO: 1270483 - DNA, 23 bp, Homo sapiens
gcacgtggcatgtggcctgtggc

SEQ ID NO: 1270484 - DNA, 15 bp, Homo sapiens
gcacgtggcctcttg

SEQ ID NO: 1270485 - DNA, 14 bp, Homo sapiens
gcacgtggggccca

SEQ ID NO: 1270486 - DNA, 23 bp, Homo sapiens
gcactaaaacccatcttccccgg

SEQ ID NO: 1270487 - DNA, 22 bp, Homo sapiens
gcactaaaccacttctctgctg

SEQ ID NO: 1270488 - DNA, 19 bp, Homo sapiens
gcactaaagtatgtaaagt

SEQ ID NO: 1270489 - DNA, 23 bp, Homo sapiens
gcactaaggggcccggccagcca

SEQ ID NO: 1270490 - DNA, 19 bp, Homo sapiens
gcactaatttgatgtttac

SEQ ID NO: 1270491 - DNA, 16 bp, Homo sapiens
gcactacaatcatggt

SEQ ID NO: 1270492 - DNA, 16 bp, Homo sapiens
gcactacataaactga

SEQ ID NO: 1270493 - DNA, 21 bp, Homo sapiens
gcactacatgtggtttataga

SEQ ID NO: 1270494 - DNA, 12 bp, Homo sapiens
gcactacattca

SEQ ID NO: 1270495 - DNA, 16 bp, Homo sapiens
gcactacattcattta

SEQ ID NO: 1270496 - DNA, 17 bp, Homo sapiens
gcactactcctctgcag

SEQ ID NO: 1270497 - DNA, 17 bp, Homo sapiens
gcactactgacatgtgg

SEQ ID NO: 1270498 - DNA, 16 bp, Homo sapiens
gcactactgggtgtca

SEQ ID NO: 1270499 - DNA, 13 bp, Homo sapiens
gcactaggaattc

SEQ ID NO: 1270500 - DNA, 14 bp, Homo sapiens
gcactaggaattct

SEQ ID NO: 1270501 - DNA, 16 bp, Homo sapiens
gcactaggcaggtaat

SEQ ID NO: 1270502 - DNA, 18 bp, Homo sapiens
gcactagtcaccgacagc

SEQ ID NO: 1270503 - DNA, 22 bp, Homo sapiens
gcactagtcaccgacagcggcc

SEQ ID NO: 1270504 - DNA, 21 bp, Homo sapiens
gcactagtttgattattatgt

SEQ ID NO: 1270505 - DNA, 22 bp, Homo sapiens
gcactataatgtaagctctact

SEQ ID NO: 1270506 - DNA, 18 bp, Homo sapiens
gcactatatgtttacaca

SEQ ID NO: 1270507 - DNA, 19 bp, Homo sapiens
gcactatatgtttacacaa

SEQ ID NO: 1270508 - DNA, 17 bp, Homo sapiens
gcactatttatttacaa

SEQ ID NO: 1270509 - DNA, 19 bp, Homo sapiens
gcagcacctttctctgaga

SEQ ID NO: 1270510 - DNA, 15 bp, Homo sapiens
gcagcacggcccggc

SEQ ID NO: 1270511 - DNA, 22 bp, Homo sapiens
gcagcacggcccggcccctcac

SEQ ID NO: 1270512 - DNA, 18 bp, Homo sapiens
gcagcactcacacaggac

SEQ ID NO: 1270513 - DNA, 22 bp, Homo sapiens
gcagcactcccgctgcacacag

SEQ ID NO: 1270514 - DNA, 17 bp, Homo sapiens
gcagcagacacatgcca

SEQ ID NO: 1270515 - DNA, 14 bp, Homo sapiens
gcagcagagagccc

SEQ ID NO: 1270516 - DNA, 16 bp, Homo sapiens
gcagcagagagccctg

SEQ ID NO: 1270517 - DNA, 17 bp, Homo sapiens
gcagcagagagccctgg

SEQ ID NO: 1270518 - DNA, 11 bp, Homo sapiens
gcagcagagga

SEQ ID NO: 1270519 - DNA, 13 bp, Homo sapiens
gcagcagcaccaa

SEQ ID NO: 1270520 - DNA, 15 bp, Homo sapiens
gcagcagcaccaacc

SEQ ID NO: 1270521 - DNA, 12 bp, Homo sapiens
gcagcagcacct

SEQ ID NO: 1270522 - DNA, 22 bp, Homo sapiens
gcagcagcacctttctctgaga

SEQ ID NO: 1270523 - DNA, 14 bp, Homo sapiens
gcagcagcagccct

SEQ ID NO: 1270524 - DNA, 16 bp, Homo sapiens
gcagcagcagccctgc

SEQ ID NO: 1270525 - DNA, 13 bp, Homo sapiens
gcagcagcaggtg

SEQ ID NO: 1270526 - DNA, 12 bp, Homo sapiens
gcagcagccacc

SEQ ID NO: 1270527 - DNA, 21 bp, Homo sapiens
gcagcagccactgcacaggag

SEQ ID NO: 1270528 - DNA, 15 bp, Homo sapiens
gcagcagccagcacc

SEQ ID NO: 1270529 - DNA, 19 bp, Homo sapiens
gcagcagccagcaccacct

SEQ ID NO: 1270530 - DNA, 21 bp, Homo sapiens
gcagcagcccaagcttccctc

SEQ ID NO: 1270531 - DNA, 15 bp, Homo sapiens
gcagcagcgggagct

SEQ ID NO: 1270532 - DNA, 23 bp, Homo sapiens
gcagcagcttttaatacagggta

SEQ ID NO: 1270533 - DNA, 20 bp, Homo sapiens
gcagcaggatgggctgagct

SEQ ID NO: 1270534 - DNA, 15 bp, Homo sapiens
gcagcaggctcaggc

SEQ ID NO: 1270535 - DNA, 18 bp, Homo sapiens
gcagcaggctcaggcaca

SEQ ID NO: 1270536 - DNA, 19 bp, Homo sapiens
gcagcagggagggcttctg

SEQ ID NO: 1270537 - DNA, 20 bp, Homo sapiens
gcagcagggatgccctggag

SEQ ID NO: 1270538 - DNA, 12 bp, Homo sapiens
gcagcagggcta

SEQ ID NO: 1270539 - DNA, 15 bp, Homo sapiens
gcagcaggggctgct

SEQ ID NO: 1270540 - DNA, 18 bp, Homo sapiens
gcagcaggtgctgggctg

SEQ ID NO: 1270541 - DNA, 15 bp, Homo sapiens
gcagcaggtgtggcc

SEQ ID NO: 1270542 - DNA, 12 bp, Homo sapiens
gcagcagtgaag

SEQ ID NO: 1270543 - DNA, 12 bp, Homo sapiens
gcagcagtgggg

SEQ ID NO: 1270544 - DNA, 21 bp, Homo sapiens
gcagcagtgtgaggccagggc

SEQ ID NO: 1270545 - DNA, 23 bp, Homo sapiens
gcagcatcggacaagacccccag

SEQ ID NO: 1270546 - DNA, 15 bp, Homo sapiens
gcagcatgagacttt

SEQ ID NO: 1270547 - DNA, 21 bp, Homo sapiens
gcagcatgcccagattcccag

SEQ ID NO: 1270548 - DNA, 14 bp, Homo sapiens
gcagcatgcttggg

SEQ ID NO: 1270549 - DNA, 18 bp, Homo sapiens
gcagcatgcttgggctga

SEQ ID NO: 1270550 - DNA, 14 bp, Homo sapiens
gcagcatggcatag

SEQ ID NO: 1270551 - DNA, 16 bp, Homo sapiens
gcagcatggcatagcc

SEQ ID NO: 1270552 - DNA, 15 bp, Homo sapiens
gcagcatggtccctg

SEQ ID NO: 1270553 - DNA, 22 bp, Homo sapiens
gcagcatgttgctgaggagtga

SEQ ID NO: 1270554 - DNA, 19 bp, Homo sapiens
gcagcattccatgaccaga

SEQ ID NO: 1270555 - DNA, 15 bp, Homo sapiens
gcagccaaaggggag

SEQ ID NO: 1270556 - DNA, 17 bp, Homo sapiens
gcagccaaaggggagcc

SEQ ID NO: 1270557 - DNA, 12 bp, Homo sapiens
gcagccaaggcc

SEQ ID NO: 1270558 - DNA, 21 bp, Homo sapiens
gcagccaaggccgaagctctg

SEQ ID NO: 1270559 - DNA, 22 bp, Homo sapiens
gcagccaaggccgaagctctgg

SEQ ID NO: 1270560 - DNA, 23 bp, Homo sapiens
gcagccaaggccgaagctctggc

SEQ ID NO: 1270561 - DNA, 22 bp, Homo sapiens
gcagccacacgcaggcggccag

SEQ ID NO: 1270562 - DNA, 12 bp, Homo sapiens
gcagccacagga

SEQ ID NO: 1270563 - DNA, 16 bp, Homo sapiens
gcagccacaggactga

SEQ ID NO: 1270564 - DNA, 19 bp, Homo sapiens
gcagccacccaagcctgct

SEQ ID NO: 1270565 - DNA, 23 bp, Homo sapiens
gcagccacccaagcctgctggct

SEQ ID NO: 1270566 - DNA, 22 bp, Homo sapiens
gcagccagacccagagccctct

SEQ ID NO: 1270567 - DNA, 15 bp, Homo sapiens
gcagccagcagaggg

SEQ ID NO: 1270568 - DNA, 20 bp, Homo sapiens
gcagccagccagtcttgcct

SEQ ID NO: 1270569 - DNA, 23 bp, Homo sapiens
gcagccagccagtcttgcctagg

SEQ ID NO: 1270570 - DNA, 16 bp, Homo sapiens
gcagccagcccagccc

SEQ ID NO: 1270571 - DNA, 17 bp, Homo sapiens
gcagccagcccagccca

SEQ ID NO: 1270572 - DNA, 23 bp, Homo sapiens
gcagccagcccagcccagctggt

SEQ ID NO: 1270573 - DNA, 18 bp, Homo sapiens
gcagccagccggtgcctg

SEQ ID NO: 1270574 - DNA, 19 bp, Homo sapiens
gcagccagccggtgcctgg

SEQ ID NO: 1270575 - DNA, 12 bp, Homo sapiens
gcagccaggaga

SEQ ID NO: 1270576 - DNA, 15 bp, Homo sapiens
gcagccaggagggac

SEQ ID NO: 1270577 - DNA, 16 bp, Homo sapiens
gcagccaggagggacc

SEQ ID NO: 1270578 - DNA, 12 bp, Homo sapiens
gcagccaggctg

SEQ ID NO: 1270579 - DNA, 16 bp, Homo sapiens
gcagccaggctgggcc

SEQ ID NO: 1270580 - DNA, 13 bp, Homo sapiens
gcagccagtctca

SEQ ID NO: 1270581 - DNA, 17 bp, Homo sapiens
gcagccagtctcagaga

SEQ ID NO: 1270582 - DNA, 20 bp, Homo sapiens
gcagccagtctcagagacca

SEQ ID NO: 1270583 - DNA, 22 bp, Homo sapiens
gcagccagtctcagagaccagc

SEQ ID NO: 1270584 - DNA, 19 bp, Homo sapiens
gcagccatcccgcttagcc

SEQ ID NO: 1270585 - DNA, 14 bp, Homo sapiens
gcagccatgcctca

SEQ ID NO: 1270586 - DNA, 17 bp, Homo sapiens
gcagccatgcctcatgc

SEQ ID NO: 1270587 - DNA, 21 bp, Homo sapiens
gcagcccaagcttccctccat

SEQ ID NO: 1270588 - DNA, 15 bp, Homo sapiens
gcagcccaccagacg

SEQ ID NO: 1270589 - DNA, 16 bp, Homo sapiens
gcagcccaccaggagc

SEQ ID NO: 1270590 - DNA, 22 bp, Homo sapiens
gcagcccagagactttgtagat

SEQ ID NO: 1270591 - DNA, 13 bp, Homo sapiens
gcagcccagcagt

SEQ ID NO: 1270592 - DNA, 21 bp, Homo sapiens
gcagcccagcctagtcagggc

SEQ ID NO: 1270593 - DNA, 20 bp, Homo sapiens
gcagcccatgcccacctgcc

SEQ ID NO: 1270594 - DNA, 14 bp, Homo sapiens
gcagccccacagtc

SEQ ID NO: 1270595 - DNA, 20 bp, Homo sapiens
gcagccccacttcaccccca

SEQ ID NO: 1270596 - DNA, 22 bp, Homo sapiens
gcagccccacttcacccccaac

SEQ ID NO: 1270597 - DNA, 18 bp, Homo sapiens
gcagccccagggcctgcg

SEQ ID NO: 1270598 - DNA, 19 bp, Homo sapiens
gcagcccccacccccaagg

SEQ ID NO: 1270599 - DNA, 13 bp, Homo sapiens
gcagccccccaga

SEQ ID NO: 1270600 - DNA, 15 bp, Homo sapiens
gcagcccccccctca

SEQ ID NO: 1270601 - DNA, 16 bp, Homo sapiens
gcagcccccgcgccct

SEQ ID NO: 1270602 - DNA, 21 bp, Homo sapiens
gcagcccccgcgccctccctc

SEQ ID NO: 1270603 - DNA, 14 bp, Homo sapiens
gcagccccctccac

SEQ ID NO: 1270604 - DNA, 16 bp, Homo sapiens
gcagccccctccacac

SEQ ID NO: 1270605 - DNA, 17 bp, Homo sapiens
gcagcccctgggccctt

SEQ ID NO: 1270606 - DNA, 16 bp, Homo sapiens
gcagcccggctgctgc

SEQ ID NO: 1270607 - DNA, 21 bp, Homo sapiens
gcagcccgtgaagcagtgcct

SEQ ID NO: 1270608 - DNA, 15 bp, Homo sapiens
gcagcccgtgtggcc

SEQ ID NO: 1270609 - DNA, 21 bp, Homo sapiens
gcagcccgtgtggccccttca

SEQ ID NO: 1270610 - DNA, 22 bp, Homo sapiens
gcagccctaaggatctctcagg

SEQ ID NO: 1270611 - DNA, 23 bp, Homo sapiens
gcagccctaaggatctctcagga

SEQ ID NO: 1270612 - DNA, 23 bp, Homo sapiens
gcagccctaccttaaggaaagtt

SEQ ID NO: 1270613 - DNA, 13 bp, Homo sapiens
gcagccctcacct

SEQ ID NO: 1270614 - DNA, 23 bp, Homo sapiens
gcagccctcacctctgaggacag

SEQ ID NO: 1270615 - DNA, 18 bp, Homo sapiens
gcagccctccatggtcct

SEQ ID NO: 1270616 - DNA, 16 bp, Homo sapiens
gcagccctcttgcccg

SEQ ID NO: 1270617 - DNA, 13 bp, Homo sapiens
gcagccctgcttt

SEQ ID NO: 1270618 - DNA, 17 bp, Homo sapiens
gcagcccttcctcctga

SEQ ID NO: 1270619 - DNA, 12 bp, Homo sapiens
gcagcccttgct

SEQ ID NO: 1270620 - DNA, 16 bp, Homo sapiens
gcagcccttgggcagt

SEQ ID NO: 1270621 - DNA, 15 bp, Homo sapiens
gcagccgccagctgg

SEQ ID NO: 1270622 - DNA, 19 bp, Homo sapiens
gcagccgccgccgcccacg

SEQ ID NO: 1270623 - DNA, 20 bp, Homo sapiens
gcagccgccgccgcccacgc

SEQ ID NO: 1270624 - DNA, 14 bp, Homo sapiens
gcagccgccgggca

SEQ ID NO: 1270625 - DNA, 20 bp, Homo sapiens
gcagccgccttaagctgatc

SEQ ID NO: 1270626 - DNA, 17 bp, Homo sapiens
gcagccgctaggagaga

SEQ ID NO: 1270627 - DNA, 21 bp, Homo sapiens
gcagccgctaggagagactga

SEQ ID NO: 1270628 - DNA, 18 bp, Homo sapiens
gcagccggaatagagcct

SEQ ID NO: 1270629 - DNA, 12 bp, Homo sapiens
gcagccggagga

SEQ ID NO: 1270630 - DNA, 16 bp, Homo sapiens
gcagccggaggaggag

SEQ ID NO: 1270631 - DNA, 16 bp, Homo sapiens
gcaggccccctaggat

SEQ ID NO: 1270632 - DNA, 14 bp, Homo sapiens
gcaggccctggcct

SEQ ID NO: 1270633 - DNA, 19 bp, Homo sapiens
gcaggccctgtccagcccc

SEQ ID NO: 1270634 - DNA, 19 bp, Homo sapiens
gcaggccctttgaagcctc

SEQ ID NO: 1270635 - DNA, 13 bp, Homo sapiens
gcaggcctaggtg

SEQ ID NO: 1270636 - DNA, 15 bp, Homo sapiens
gcaggcctatttcat

SEQ ID NO: 1270637 - DNA, 19 bp, Homo sapiens
gcaggcctctggttgcctc

SEQ ID NO: 1270638 - DNA, 22 bp, Homo sapiens
gcaggcctctggttgcctcccc

SEQ ID NO: 1270639 - DNA, 23 bp, Homo sapiens
gcaggcctctggttgcctccccc

SEQ ID NO: 1270640 - DNA, 22 bp, Homo sapiens
gcaggcctgacccacggggcag

SEQ ID NO: 1270641 - DNA, 14 bp, Homo sapiens
gcaggcctgggacc

SEQ ID NO: 1270642 - DNA, 22 bp, Homo sapiens
gcaggcctgggacccagctact

SEQ ID NO: 1270643 - DNA, 16 bp, Homo sapiens
gcaggccttgctgggg

SEQ ID NO: 1270644 - DNA, 18 bp, Homo sapiens
gcaggccttgctggggtc

SEQ ID NO: 1270645 - DNA, 21 bp, Homo sapiens
gcaggccttgctggggtccag

SEQ ID NO: 1270646 - DNA, 22 bp, Homo sapiens
gcaggccttgctggggtccagg

SEQ ID NO: 1270647 - DNA, 13 bp, Homo sapiens
gcaggcgcagagg

SEQ ID NO: 1270648 - DNA, 23 bp, Homo sapiens
gcaggcgcatgagtatctgtggg

SEQ ID NO: 1270649 - DNA, 21 bp, Homo sapiens
gcaggcggccagggcggccag

SEQ ID NO: 1270650 - DNA, 17 bp, Homo sapiens
gcaggcggccctcagtg

SEQ ID NO: 1270651 - DNA, 15 bp, Homo sapiens
gcaggcggctcctcc

SEQ ID NO: 1270652 - DNA, 13 bp, Homo sapiens
gcaggcggggcag

SEQ ID NO: 1270653 - DNA, 20 bp, Homo sapiens
gcaggcggtccccatcccca

SEQ ID NO: 1270654 - DNA, 22 bp, Homo sapiens
gcaggcggtccccatccccacc

SEQ ID NO: 1270655 - DNA, 21 bp, Homo sapiens
gcaggcgtgtggcagccacac

SEQ ID NO: 1270656 - DNA, 14 bp, Homo sapiens
gcaggctcactgcc

SEQ ID NO: 1270657 - DNA, 21 bp, Homo sapiens
gcaggctcactgccaggccag

SEQ ID NO: 1270658 - DNA, 19 bp, Homo sapiens
gcaggctcccgagtggggc

SEQ ID NO: 1270659 - DNA, 19 bp, Homo sapiens
gcaggctcctggctgtgcc

SEQ ID NO: 1270660 - DNA, 19 bp, Homo sapiens
gcaggctctctcctctctc

SEQ ID NO: 1270661 - DNA, 11 bp, Homo sapiens
gcaggctctgg

SEQ ID NO: 1270662 - DNA, 14 bp, Homo sapiens
gcaggctctgggct

SEQ ID NO: 1270663 - DNA, 16 bp, Homo sapiens
gcaggctctgggctca

SEQ ID NO: 1270664 - DNA, 18 bp, Homo sapiens
gcaggctctgggctcagg

SEQ ID NO: 1270665 - DNA, 19 bp, Homo sapiens
gcaggctctgggctcaggg

SEQ ID NO: 1270666 - DNA, 22 bp, Homo sapiens
gcaggctctgggctcagggctg

SEQ ID NO: 1270667 - DNA, 21 bp, Homo sapiens
gcaggctgaggtggggaagga

SEQ ID NO: 1270668 - DNA, 16 bp, Homo sapiens
gcaggctgagtccaga

SEQ ID NO: 1270669 - DNA, 13 bp, Homo sapiens
gcaggctgcagag

SEQ ID NO: 1270670 - DNA, 14 bp, Homo sapiens
gcaggctgcagagc

SEQ ID NO: 1270671 - DNA, 16 bp, Homo sapiens
gcaggctgcagagccc

SEQ ID NO: 1270672 - DNA, 17 bp, Homo sapiens
gcaggctgcaggagggc

SEQ ID NO: 1270673 - DNA, 19 bp, Homo sapiens
gcaggctgcaggagggcac

SEQ ID NO: 1270674 - DNA, 20 bp, Homo sapiens
gcaggctgcaggagggcact

SEQ ID NO: 1270675 - DNA, 12 bp, Homo sapiens
gcaggctggaga

SEQ ID NO: 1270676 - DNA, 13 bp, Homo sapiens
gcaggctgggcca

SEQ ID NO: 1270677 - DNA, 14 bp, Homo sapiens
gcaggctgggccat

SEQ ID NO: 1270678 - DNA, 15 bp, Homo sapiens
gcaggctgggccatg

SEQ ID NO: 1270679 - DNA, 13 bp, Homo sapiens
gcaggctggggag

SEQ ID NO: 1270680 - DNA, 21 bp, Homo sapiens
gcaggctgtggggtggagcac

SEQ ID NO: 1270681 - DNA, 23 bp, Homo sapiens
gcaggctttgccattgtgaacca

SEQ ID NO: 1270682 - DNA, 21 bp, Homo sapiens
gcagggaaaattatttgcata

SEQ ID NO: 1270683 - DNA, 13 bp, Homo sapiens
gcagggaaaggaa

SEQ ID NO: 1270684 - DNA, 16 bp, Homo sapiens
gcagggaagagggcag

SEQ ID NO: 1270685 - DNA, 17 bp, Homo sapiens
gcagggaagagggcagt

SEQ ID NO: 1270686 - DNA, 14 bp, Homo sapiens
gcagggaaggcctg

SEQ ID NO: 1270687 - DNA, 17 bp, Homo sapiens
gcagggaatgcagcagg

SEQ ID NO: 1270688 - DNA, 15 bp, Homo sapiens
gcagggaatgcctgg

SEQ ID NO: 1270689 - DNA, 16 bp, Homo sapiens
gcagggaatgcctgga

SEQ ID NO: 1270690 - DNA, 17 bp, Homo sapiens
gcagggaatgcctggag

SEQ ID NO: 1270691 - DNA, 15 bp, Homo sapiens
gcagggacaaagagg

SEQ ID NO: 1270692 - DNA, 21 bp, Homo sapiens
gcagggacaaagaggccttta

SEQ ID NO: 1270693 - DNA, 14 bp, Homo sapiens
gcagggacaccccc

SEQ ID NO: 1270694 - DNA, 18 bp, Homo sapiens
gcagggacatggggcaag

SEQ ID NO: 1270695 - DNA, 18 bp, Homo sapiens
gcagggacttgcctccac

SEQ ID NO: 1270696 - DNA, 19 bp, Homo sapiens
gcagggacttgcctccact

SEQ ID NO: 1270697 - DNA, 13 bp, Homo sapiens
gcagggagaaggg

SEQ ID NO: 1270698 - DNA, 22 bp, Homo sapiens
gcagggagccgagatcacgcca

SEQ ID NO: 1270699 - DNA, 12 bp, Homo sapiens
gcagggaggcaa

SEQ ID NO: 1270700 - DNA, 13 bp, Homo sapiens
gcagggaggccac

SEQ ID NO: 1270701 - DNA, 15 bp, Homo sapiens
gcagggaggggacta

SEQ ID NO: 1270702 - DNA, 20 bp, Homo sapiens
gcagggaggggaggcagatg

SEQ ID NO: 1270703 - DNA, 22 bp, Homo sapiens
gcagggaggtgggggcctcctc

SEQ ID NO: 1270704 - DNA, 14 bp, Homo sapiens
gcagggatcctggt

SEQ ID NO: 1270705 - DNA, 20 bp, Homo sapiens
gcagggatgatggcagagcc

SEQ ID NO: 1270706 - DNA, 13 bp, Homo sapiens
gcagggatgccct

SEQ ID NO: 1270707 - DNA, 12 bp, Homo sapiens
gcagggcacggg

SEQ ID NO: 1270708 - DNA, 15 bp, Homo sapiens
gcagggcagagggaa

SEQ ID NO: 1270709 - DNA, 14 bp, Homo sapiens
gcagggcatctcct

SEQ ID NO: 1270710 - DNA, 19 bp, Homo sapiens
gcagggccaacccttctcc

SEQ ID NO: 1270711 - DNA, 15 bp, Homo sapiens
gcagggccagggcaa

SEQ ID NO: 1270712 - DNA, 22 bp, Homo sapiens
gcagggccagggcaatgccatc

SEQ ID NO: 1270713 - DNA, 16 bp, Homo sapiens
gcagggccatgcagac

SEQ ID NO: 1270714 - DNA, 11 bp, Homo sapiens
gcagggcccac

SEQ ID NO: 1270715 - DNA, 22 bp, Homo sapiens
gcagggcctatatgccagcgcc

SEQ ID NO: 1270716 - DNA, 21 bp, Homo sapiens
gcagggccttgcccagagatg

SEQ ID NO: 1270717 - DNA, 18 bp, Homo sapiens
gcagggcgcccctgggag

SEQ ID NO: 1270718 - DNA, 20 bp, Homo sapiens
gcagggcgggcagagggctg

SEQ ID NO: 1270719 - DNA, 18 bp, Homo sapiens
gcagggcggtctcactcc

SEQ ID NO: 1270720 - DNA, 22 bp, Homo sapiens
gcagggctaccctgagctgagg

SEQ ID NO: 1270721 - DNA, 17 bp, Homo sapiens
gcagggctcacactcct

SEQ ID NO: 1270722 - DNA, 21 bp, Homo sapiens
gcagggctcacactcctgggc

SEQ ID NO: 1270723 - DNA, 18 bp, Homo sapiens
gcagggctgaagtctggc

SEQ ID NO: 1270724 - DNA, 13 bp, Homo sapiens
gcagggctgggcc

SEQ ID NO: 1270725 - DNA, 14 bp, Homo sapiens
gcaggggagaagcg

SEQ ID NO: 1270726 - DNA, 19 bp, Homo sapiens
gcaggggagacaggagcct

SEQ ID NO: 1270727 - DNA, 21 bp, Homo sapiens
gcaggggagccagggtagagc

SEQ ID NO: 1270728 - DNA, 18 bp, Homo sapiens
gcaggggagcttgggact

SEQ ID NO: 1270729 - DNA, 20 bp, Homo sapiens
gcaggggagcttgggactca

SEQ ID NO: 1270730 - DNA, 12 bp, Homo sapiens
gcaggggagggg

SEQ ID NO: 1270731 - DNA, 12 bp, Homo sapiens
gcaggggcaggc

SEQ ID NO: 1270732 - DNA, 17 bp, Homo sapiens
gcaggggcccacttggg

SEQ ID NO: 1270733 - DNA, 16 bp, Homo sapiens
gcaggggccctgagcc

SEQ ID NO: 1270734 - DNA, 17 bp, Homo sapiens
gcaggggccctgagcca

SEQ ID NO: 1270735 - DNA, 13 bp, Homo sapiens
gcaggggcctgga

SEQ ID NO: 1270736 - DNA, 14 bp, Homo sapiens
gcaggggcctggag

SEQ ID NO: 1270737 - DNA, 20 bp, Homo sapiens
gcaggggcctggagatcctc

SEQ ID NO: 1270738 - DNA, 20 bp, Homo sapiens
gcagggggccccgccagggc

SEQ ID NO: 1270739 - DNA, 21 bp, Homo sapiens
gcagggggccccgccagggct

SEQ ID NO: 1270740 - DNA, 18 bp, Homo sapiens
gcagggggccctgcccca

SEQ ID NO: 1270741 - DNA, 16 bp, Homo sapiens
gcaggggggctgtgcc

SEQ ID NO: 1270742 - DNA, 17 bp, Homo sapiens
gcaggggtcagagcact

SEQ ID NO: 1270743 - DNA, 15 bp, Homo sapiens
gcaggggtccctgct

SEQ ID NO: 1270744 - DNA, 20 bp, Homo sapiens
gcaggggtgacggccctcat

SEQ ID NO: 1270745 - DNA, 15 bp, Homo sapiens
gcaggggtgagagca

SEQ ID NO: 1270746 - DNA, 17 bp, Homo sapiens
gcaggggtgggagagcc

SEQ ID NO: 1270747 - DNA, 20 bp, Homo sapiens
gcaggggtgggagagccagc

SEQ ID NO: 1270748 - DNA, 17 bp, Homo sapiens
gcaggggtgggggtgga

SEQ ID NO: 1270749 - DNA, 13 bp, Homo sapiens
gcaggggttccca

SEQ ID NO: 1270750 - DNA, 15 bp, Homo sapiens
gcaggggttgcagtg

SEQ ID NO: 1270751 - DNA, 23 bp, Homo sapiens
gcagggtaccctttggggagcag

SEQ ID NO: 1270752 - DNA, 15 bp, Homo sapiens
gcagggtcaagcctc

SEQ ID NO: 1270753 - DNA, 16 bp, Homo sapiens
gcatcaagggctttat

SEQ ID NO: 1270754 - DNA, 21 bp, Homo sapiens
gcatcaaggtcagcatgagga

SEQ ID NO: 1270755 - DNA, 14 bp, Homo sapiens
gcatcaatcttgtt

SEQ ID NO: 1270756 - DNA, 16 bp, Homo sapiens
gcatcacactcaagga

SEQ ID NO: 1270757 - DNA, 17 bp, Homo sapiens
gcatcacactcaaggac

SEQ ID NO: 1270758 - DNA, 22 bp, Homo sapiens
gcatcacactcaaggacaggag

SEQ ID NO: 1270759 - DNA, 19 bp, Homo sapiens
gcatcacacttatatttta

SEQ ID NO: 1270760 - DNA, 15 bp, Homo sapiens
gcatcacagggcaga

SEQ ID NO: 1270761 - DNA, 16 bp, Homo sapiens
gcatcacagggcagag

SEQ ID NO: 1270762 - DNA, 17 bp, Homo sapiens
gcatcacagggcagagc

SEQ ID NO: 1270763 - DNA, 17 bp, Homo sapiens
gcatcacctcaccaagg

SEQ ID NO: 1270764 - DNA, 15 bp, Homo sapiens
gcatcacgctgcatc

SEQ ID NO: 1270765 - DNA, 19 bp, Homo sapiens
gcatcacgtaccccactgg

SEQ ID NO: 1270766 - DNA, 15 bp, Homo sapiens
gcatcactgatcatt

SEQ ID NO: 1270767 - DNA, 17 bp, Homo sapiens
gcatcaggcctgaaccc

SEQ ID NO: 1270768 - DNA, 21 bp, Homo sapiens
gcatcagggcctttctcctcc

SEQ ID NO: 1270769 - DNA, 13 bp, Homo sapiens
gcatcagggggaa

SEQ ID NO: 1270770 - DNA, 16 bp, Homo sapiens
gcatcaggtctgggca

SEQ ID NO: 1270771 - DNA, 14 bp, Homo sapiens
gcatcatctgtaga

SEQ ID NO: 1270772 - DNA, 20 bp, Homo sapiens
gcatcatctgtagatactag

SEQ ID NO: 1270773 - DNA, 20 bp, Homo sapiens
gcatcatgtttctgagacca

SEQ ID NO: 1270774 - DNA, 15 bp, Homo sapiens
gcatccaaaggtgct

SEQ ID NO: 1270775 - DNA, 17 bp, Homo sapiens
gcatccaaggcaaacaa

SEQ ID NO: 1270776 - DNA, 15 bp, Homo sapiens
gcatccacccagtgc

SEQ ID NO: 1270777 - DNA, 13 bp, Homo sapiens
gcatccagcctgt

SEQ ID NO: 1270778 - DNA, 14 bp, Homo sapiens
gcatccagcctgtg

SEQ ID NO: 1270779 - DNA, 15 bp, Homo sapiens
gcatcccagcacctg

SEQ ID NO: 1270780 - DNA, 22 bp, Homo sapiens
gcatcccagcacctgcctcctc

SEQ ID NO: 1270781 - DNA, 16 bp, Homo sapiens
gcatcccagcttgccc

SEQ ID NO: 1270782 - DNA, 13 bp, Homo sapiens
gcatcccagggga

SEQ ID NO: 1270783 - DNA, 15 bp, Homo sapiens
gcatcccaggggacc

SEQ ID NO: 1270784 - DNA, 15 bp, Homo sapiens
gcatcccagtggcct

SEQ ID NO: 1270785 - DNA, 16 bp, Homo sapiens
gcatcccattgctagc

SEQ ID NO: 1270786 - DNA, 16 bp, Homo sapiens
gcatccccctcctctc

SEQ ID NO: 1270787 - DNA, 19 bp, Homo sapiens
gcatccccttggctgtgag

SEQ ID NO: 1270788 - DNA, 19 bp, Homo sapiens
gcatcccggaggaaatctg

SEQ ID NO: 1270789 - DNA, 13 bp, Homo sapiens
gcatccctggagc

SEQ ID NO: 1270790 - DNA, 19 bp, Homo sapiens
gcatccctggagcaggagc

SEQ ID NO: 1270791 - DNA, 20 bp, Homo sapiens
gcatccctggagcaggagcc

SEQ ID NO: 1270792 - DNA, 14 bp, Homo sapiens
gcatcccttcccac

SEQ ID NO: 1270793 - DNA, 15 bp, Homo sapiens
gcatccgcaggtgct

SEQ ID NO: 1270794 - DNA, 17 bp, Homo sapiens
gcatccgtagttccctg

SEQ ID NO: 1270795 - DNA, 20 bp, Homo sapiens
gcatcctaaagataaagcca

SEQ ID NO: 1270796 - DNA, 18 bp, Homo sapiens
gcatcctatgcttaataa

SEQ ID NO: 1270797 - DNA, 21 bp, Homo sapiens
gcatcctatgcttaataaaag

SEQ ID NO: 1270798 - DNA, 14 bp, Homo sapiens
gcatcctgagcccc

SEQ ID NO: 1270799 - DNA, 16 bp, Homo sapiens
gcatcctgtgccacta

SEQ ID NO: 1270800 - DNA, 20 bp, Homo sapiens
gcatccttgtaatacctgat

SEQ ID NO: 1270801 - DNA, 14 bp, Homo sapiens
gcatccttgtcttt

SEQ ID NO: 1270802 - DNA, 22 bp, Homo sapiens
gcatcggacaagacccccagca

SEQ ID NO: 1270803 - DNA, 21 bp, Homo sapiens
gcatcggcagctgaaccctgc

SEQ ID NO: 1270804 - DNA, 17 bp, Homo sapiens
gcatcgggaaagaagaa

SEQ ID NO: 1270805 - DNA, 18 bp, Homo sapiens
gcatcgggagcacccaga

SEQ ID NO: 1270806 - DNA, 20 bp, Homo sapiens
gcatcgggagcacccagagc

SEQ ID NO: 1270807 - DNA, 15 bp, Homo sapiens
gcatcgggggcctgc

SEQ ID NO: 1270808 - DNA, 23 bp, Homo sapiens
gcatcgtcatgcacagtatttgt

SEQ ID NO: 1270809 - DNA, 19 bp, Homo sapiens
gcatcgtgacccttcaggg

SEQ ID NO: 1270810 - DNA, 21 bp, Homo sapiens
gcatcgtgacccttcagggcc

SEQ ID NO: 1270811 - DNA, 22 bp, Homo sapiens
gcatcgtgacccttcagggcca

SEQ ID NO: 1270812 - DNA, 18 bp, Homo sapiens
gcatcgtgatcactgagc

SEQ ID NO: 1270813 - DNA, 22 bp, Homo sapiens
gcatctaagcatctgggttgcc

SEQ ID NO: 1270814 - DNA, 13 bp, Homo sapiens
gcatctaatgaaa

SEQ ID NO: 1270815 - DNA, 19 bp, Homo sapiens
gcatctaatgaaaaacaaa

SEQ ID NO: 1270816 - DNA, 19 bp, Homo sapiens
gcatctactctaaagaaaa

SEQ ID NO: 1270817 - DNA, 20 bp, Homo sapiens
gcatctactctaaagaaaaa

SEQ ID NO: 1270818 - DNA, 18 bp, Homo sapiens
gcatctatctggtgattt

SEQ ID NO: 1270819 - DNA, 21 bp, Homo sapiens
gcatctcaaaacagagggctg

SEQ ID NO: 1270820 - DNA, 12 bp, Homo sapiens
gcatctcagccc

SEQ ID NO: 1270821 - DNA, 15 bp, Homo sapiens
gcatctcagcccaca

SEQ ID NO: 1270822 - DNA, 17 bp, Homo sapiens
gcatctcagcgccagct

SEQ ID NO: 1270823 - DNA, 15 bp, Homo sapiens
gcatctccttgggct

SEQ ID NO: 1270824 - DNA, 21 bp, Homo sapiens
gcatctctgtcccattccctg

SEQ ID NO: 1270825 - DNA, 18 bp, Homo sapiens
gcatctcttccccagaga

SEQ ID NO: 1270826 - DNA, 22 bp, Homo sapiens
gcatctcttccccagagaggca

SEQ ID NO: 1270827 - DNA, 14 bp, Homo sapiens
gcatctcttgaggc

SEQ ID NO: 1270828 - DNA, 18 bp, Homo sapiens
gcatctcttgaggccagg

SEQ ID NO: 1270829 - DNA, 20 bp, Homo sapiens
gcatctcttgaggccaggag

SEQ ID NO: 1270830 - DNA, 16 bp, Homo sapiens
gcatctctttaaaggc

SEQ ID NO: 1270831 - DNA, 14 bp, Homo sapiens
gcatctgacacaaa

SEQ ID NO: 1270832 - DNA, 14 bp, Homo sapiens
gcatctgaccagca

SEQ ID NO: 1270833 - DNA, 15 bp, Homo sapiens
gcatctgaccagcag

SEQ ID NO: 1270834 - DNA, 18 bp, Homo sapiens
gcatctgaccagcagcgc

SEQ ID NO: 1270835 - DNA, 20 bp, Homo sapiens
gcatctgaccagcagcgcct

SEQ ID NO: 1270836 - DNA, 15 bp, Homo sapiens
gcatctgaccccggg

SEQ ID NO: 1270837 - DNA, 18 bp, Homo sapiens
gcatctgagtccagctcc

SEQ ID NO: 1270838 - DNA, 17 bp, Homo sapiens
gcatctgcaacaaaaag

SEQ ID NO: 1270839 - DNA, 20 bp, Homo sapiens
gcatctgcaggcaccgggct

SEQ ID NO: 1270840 - DNA, 16 bp, Homo sapiens
gcatctggtgtaggaa

SEQ ID NO: 1270841 - DNA, 19 bp, Homo sapiens
gcatctgtctgtctgtggg

SEQ ID NO: 1270842 - DNA, 21 bp, Homo sapiens
gcatctgtctgtctgtgggct

SEQ ID NO: 1270843 - DNA, 14 bp, Homo sapiens
gcatctgtgtgcgt

SEQ ID NO: 1270844 - DNA, 12 bp, Homo sapiens
gcatctgtgtgt

SEQ ID NO: 1270845 - DNA, 19 bp, Homo sapiens
gcatctgttagcagagtct

SEQ ID NO: 1270846 - DNA, 13 bp, Homo sapiens
gcatcttaacatg

SEQ ID NO: 1270847 - DNA, 13 bp, Homo sapiens
gcatcttctccat

SEQ ID NO: 1270848 - DNA, 19 bp, Homo sapiens
gcatcttctggagtctcca

SEQ ID NO: 1270849 - DNA, 20 bp, Homo sapiens
gcatcttctggagtctccag

SEQ ID NO: 1270850 - DNA, 22 bp, Homo sapiens
gcatcttgggggggtggccgct

SEQ ID NO: 1270851 - DNA, 23 bp, Homo sapiens
gcatctttgccttgggctgctcc

SEQ ID NO: 1270852 - DNA, 19 bp, Homo sapiens
gcatcttttctagagacac

SEQ ID NO: 1270853 - DNA, 22 bp, Homo sapiens
gcatgaaactaggcttctgtaa

SEQ ID NO: 1270854 - DNA, 20 bp, Homo sapiens
gcatgaaattgtatctcagt

SEQ ID NO: 1270855 - DNA, 24 bp, Homo sapiens
gcatgaaattgtatctcagtctaa

SEQ ID NO: 1270856 - DNA, 22 bp, Homo sapiens
gcatgaaccctcttgccatcct

SEQ ID NO: 1270857 - DNA, 14 bp, Homo sapiens
gcatgaagagaagc

SEQ ID NO: 1270858 - DNA, 18 bp, Homo sapiens
gcatgaataacatttaaa

SEQ ID NO: 1270859 - DNA, 21 bp, Homo sapiens
gcatgaattactgtatataaa

SEQ ID NO: 1270860 - DNA, 18 bp, Homo sapiens
gcatgacaagccccaggc

SEQ ID NO: 1270861 - DNA, 21 bp, Homo sapiens
gcatgacaagccccaggcagg

SEQ ID NO: 1270862 - DNA, 15 bp, Homo sapiens
gcatgacagcctgca

SEQ ID NO: 1270863 - DNA, 11 bp, Homo sapiens
gcatgaccaaa

SEQ ID NO: 1270864 - DNA, 21 bp, Homo sapiens
gcatgacctaccaggacagaa

SEQ ID NO: 1270865 - DNA, 22 bp, Homo sapiens
gcatgacctcagtcaggcactg

SEQ ID NO: 1270866 - DNA, 22 bp, Homo sapiens
gcatgacctgtgaccagcactg

SEQ ID NO: 1270867 - DNA, 18 bp, Homo sapiens
gcatgacgtttaaggcca

SEQ ID NO: 1270868 - DNA, 22 bp, Homo sapiens
gcatgacttgtgtgtgatgaga

SEQ ID NO: 1270869 - DNA, 12 bp, Homo sapiens
gcatgagaaaga

SEQ ID NO: 1270870 - DNA, 12 bp, Homo sapiens
gcatgagacttt

SEQ ID NO: 1270871 - DNA, 15 bp, Homo sapiens
gcatgagactttctg

SEQ ID NO: 1270872 - DNA, 13 bp, Homo sapiens
gcatgagccactg

SEQ ID NO: 1270873 - DNA, 19 bp, Homo sapiens
gcatgagggatcacagggc

SEQ ID NO: 1270874 - DNA, 21 bp, Homo sapiens
gcatgagggatcacagggccc

SEQ ID NO: 1270875 - DNA, 16 bp, Homo sapiens
gcattttctgatgtat

SEQ ID NO: 1270876 - DNA, 18 bp, Homo sapiens
gcattttctgatgtatta

SEQ ID NO: 1270877 - DNA, 13 bp, Homo sapiens
gcattttgaaaca

SEQ ID NO: 1270878 - DNA, 13 bp, Homo sapiens
gcattttgctatt

SEQ ID NO: 1270879 - DNA, 22 bp, Homo sapiens
gcattttgtaagttgaagcaaa

SEQ ID NO: 1270880 - DNA, 14 bp, Homo sapiens
gcattttgtatttg

SEQ ID NO: 1270881 - DNA, 18 bp, Homo sapiens
gcatttttaaacttgaaa

SEQ ID NO: 1270882 - DNA, 21 bp, Homo sapiens
gcatttttaaacttgaaatat

SEQ ID NO: 1270883 - DNA, 18 bp, Homo sapiens
gcatttttatgcagacag

SEQ ID NO: 1270884 - DNA, 19 bp, Homo sapiens
gcatttttccatctgtgtg

SEQ ID NO: 1270885 - DNA, 17 bp, Homo sapiens
gcatttttgcaggagca

SEQ ID NO: 1270886 - DNA, 21 bp, Homo sapiens
gcatttttgtgaaatgaaaac

SEQ ID NO: 1270887 - DNA, 18 bp, Homo sapiens
gcatttttgttttgaaag

SEQ ID NO: 1270888 - DNA, 19 bp, Homo sapiens
gcatttttgttttgaaagt

SEQ ID NO: 1270889 - DNA, 20 bp, Homo sapiens
gcatttttgttttgaaagtt

SEQ ID NO: 1270890 - DNA, 22 bp, Homo sapiens
gcatttttgttttgaaagttta

SEQ ID NO: 1270891 - DNA, 20 bp, Homo sapiens
gccaaaaaggaccaactggc

SEQ ID NO: 1270892 - DNA, 16 bp, Homo sapiens
gccaaaaaggatacat

SEQ ID NO: 1270893 - DNA, 21 bp, Homo sapiens
gccaaaaccacatgggctggg

SEQ ID NO: 1270894 - DNA, 14 bp, Homo sapiens
gccaaaagctgctc

SEQ ID NO: 1270895 - DNA, 15 bp, Homo sapiens
gccaaaagtccctcc

SEQ ID NO: 1270896 - DNA, 23 bp, Homo sapiens
gccaaaagtccctccctgcctga

SEQ ID NO: 1270897 - DNA, 19 bp, Homo sapiens
gccaaaatgactttgaact

SEQ ID NO: 1270898 - DNA, 15 bp, Homo sapiens
gccaaaatgtactta

SEQ ID NO: 1270899 - DNA, 20 bp, Homo sapiens
gccaaaatgtacttaaatga

SEQ ID NO: 1270900 - DNA, 23 bp, Homo sapiens
gccaaacaaaaaggttctcaggt

SEQ ID NO: 1270901 - DNA, 15 bp, Homo sapiens
gccaaacagccacac

SEQ ID NO: 1270902 - DNA, 18 bp, Homo sapiens
gccaaaccacaagactct

SEQ ID NO: 1270903 - DNA, 21 bp, Homo sapiens
gccaaaccaggaccctgtcca

SEQ ID NO: 1270904 - DNA, 15 bp, Homo sapiens
gccaaaccctgtctg

SEQ ID NO: 1270905 - DNA, 23 bp, Homo sapiens
gccaaacccttgctttcctgggc

SEQ ID NO: 1270906 - DNA, 17 bp, Homo sapiens
gccaaactctgccagcc

SEQ ID NO: 1270907 - DNA, 21 bp, Homo sapiens
gccaaagaaatgggcctgcct

SEQ ID NO: 1270908 - DNA, 22 bp, Homo sapiens
gccaaagaaatgggcctgcctg

SEQ ID NO: 1270909 - DNA, 23 bp, Homo sapiens
gccaaagagcctcccaccagagc

SEQ ID NO: 1270910 - DNA, 16 bp, Homo sapiens
gccaaagccccatgtg

SEQ ID NO: 1270911 - DNA, 19 bp, Homo sapiens
gccaaagcctcctccagcc

SEQ ID NO: 1270912 - DNA, 16 bp, Homo sapiens
gccaaagctagggtgg

SEQ ID NO: 1270913 - DNA, 16 bp, Homo sapiens
gccaaaggatgtgata

SEQ ID NO: 1270914 - DNA, 18 bp, Homo sapiens
gccaaagttttcaaactg

SEQ ID NO: 1270915 - DNA, 22 bp, Homo sapiens
gccaaataaaaaacagaaaccg

SEQ ID NO: 1270916 - DNA, 19 bp, Homo sapiens
gccaaataaatcatcctca

SEQ ID NO: 1270917 - DNA, 21 bp, Homo sapiens
gccaaataggagggagactgt

SEQ ID NO: 1270918 - DNA, 12 bp, Homo sapiens
gccaaatatgca

SEQ ID NO: 1270919 - DNA, 14 bp, Homo sapiens
gccaaatatgcact

SEQ ID NO: 1270920 - DNA, 16 bp, Homo sapiens
gccaaatatgcacttt

SEQ ID NO: 1270921 - DNA, 24 bp, Homo sapiens
gccaaatatgcactttccctagaa

SEQ ID NO: 1270922 - DNA, 17 bp, Homo sapiens
gccaaatatgtcctggg

SEQ ID NO: 1270923 - DNA, 17 bp, Homo sapiens
gccaaatccgctctctt

SEQ ID NO: 1270924 - DNA, 19 bp, Homo sapiens
gccaaatccgctctcttcc

SEQ ID NO: 1270925 - DNA, 14 bp, Homo sapiens
gccaaatgcacaag

SEQ ID NO: 1270926 - DNA, 16 bp, Homo sapiens
gccaaatgtaattgaa

SEQ ID NO: 1270927 - DNA, 18 bp, Homo sapiens
gccaaatgtaattgaata

SEQ ID NO: 1270928 - DNA, 13 bp, Homo sapiens
gccaaatgttcat

SEQ ID NO: 1270929 - DNA, 11 bp, Homo sapiens
gccaaattatt

SEQ ID NO: 1270930 - DNA, 18 bp, Homo sapiens
gccaaattatttgtgtaa

SEQ ID NO: 1270931 - DNA, 18 bp, Homo sapiens
gccaaatttcctgtttga

SEQ ID NO: 1270932 - DNA, 14 bp, Homo sapiens
gccaaattttatct

SEQ ID NO: 1270933 - DNA, 14 bp, Homo sapiens
gccaaattttggcc

SEQ ID NO: 1270934 - DNA, 18 bp, Homo sapiens
gccaacaactctgccttt

SEQ ID NO: 1270935 - DNA, 22 bp, Homo sapiens
gccaacaactctgcctttatga

SEQ ID NO: 1270936 - DNA, 14 bp, Homo sapiens
gccaacaccaggga

SEQ ID NO: 1270937 - DNA, 20 bp, Homo sapiens
gccaacacgcacctgcctca

SEQ ID NO: 1270938 - DNA, 21 bp, Homo sapiens
gccaacacgcacctgcctcag

SEQ ID NO: 1270939 - DNA, 13 bp, Homo sapiens
gccaacagccccc

SEQ ID NO: 1270940 - DNA, 19 bp, Homo sapiens
gccaacaggtggcaggacc

SEQ ID NO: 1270941 - DNA, 20 bp, Homo sapiens
gccaacatcgtgaaaccctg

SEQ ID NO: 1270942 - DNA, 14 bp, Homo sapiens
gccaacatggtgaa

SEQ ID NO: 1270943 - DNA, 22 bp, Homo sapiens
gccaacatggtgaaactccatc

SEQ ID NO: 1270944 - DNA, 13 bp, Homo sapiens
gccaaccaggacc

SEQ ID NO: 1270945 - DNA, 23 bp, Homo sapiens
gccaaccataccttccttccctg

SEQ ID NO: 1270946 - DNA, 17 bp, Homo sapiens
gccaaccccacccagct

SEQ ID NO: 1270947 - DNA, 23 bp, Homo sapiens
gccaaccctgcctgccgctgcac

SEQ ID NO: 1270948 - DNA, 22 bp, Homo sapiens
gccaacccttctcctcttgtaa

SEQ ID NO: 1270949 - DNA, 15 bp, Homo sapiens
gccaacctaaaactc

SEQ ID NO: 1270950 - DNA, 21 bp, Homo sapiens
gccaacctcggcttgtgggct

SEQ ID NO: 1270951 - DNA, 23 bp, Homo sapiens
gccaacgagacacattgccttct

SEQ ID NO: 1270952 - DNA, 17 bp, Homo sapiens
gccaacgagattgctgg

SEQ ID NO: 1270953 - DNA, 18 bp, Homo sapiens
gccaacgagattgctgga

SEQ ID NO: 1270954 - DNA, 14 bp, Homo sapiens
gccaacgcctcctg

SEQ ID NO: 1270955 - DNA, 15 bp, Homo sapiens
gccaactaagccctc

SEQ ID NO: 1270956 - DNA, 16 bp, Homo sapiens
gccaactagcccctgg

SEQ ID NO: 1270957 - DNA, 13 bp, Homo sapiens
gccaactcctcac

SEQ ID NO: 1270958 - DNA, 17 bp, Homo sapiens
gccaactgaagccttct

SEQ ID NO: 1270959 - DNA, 22 bp, Homo sapiens
gccaactgaagccttcttctgc

SEQ ID NO: 1270960 - DNA, 15 bp, Homo sapiens
gccaactgattttgt

SEQ ID NO: 1270961 - DNA, 16 bp, Homo sapiens
gccaactgattttgta

SEQ ID NO: 1270962 - DNA, 21 bp, Homo sapiens
gccaactgattttgtatgtaa

SEQ ID NO: 1270963 - DNA, 17 bp, Homo sapiens
gccaactgctaatgcaa

SEQ ID NO: 1270964 - DNA, 17 bp, Homo sapiens
gccaactggtgtttgaa

SEQ ID NO: 1270965 - DNA, 23 bp, Homo sapiens
gccaacttctcccaccccttggc

SEQ ID NO: 1270966 - DNA, 23 bp, Homo sapiens
gccaacttgagggcccagagcag

SEQ ID NO: 1270967 - DNA, 21 bp, Homo sapiens
gccaacttgatgttccacctg

SEQ ID NO: 1270968 - DNA, 13 bp, Homo sapiens
gccaacttgccat

SEQ ID NO: 1270969 - DNA, 16 bp, Homo sapiens
gccaacttgccatgtt

SEQ ID NO: 1270970 - DNA, 14 bp, Homo sapiens
gccaacttgtaaat

SEQ ID NO: 1270971 - DNA, 20 bp, Homo sapiens
gccaacttgtaaatacacca

SEQ ID NO: 1270972 - DNA, 20 bp, Homo sapiens
gccaagaaaagggctgacat

SEQ ID NO: 1270973 - DNA, 20 bp, Homo sapiens
gccaagaaacactgcctgcc

SEQ ID NO: 1270974 - DNA, 19 bp, Homo sapiens
gccaagaagcagtggcctt

SEQ ID NO: 1270975 - DNA, 15 bp, Homo sapiens
gccaagacaaatcaa

SEQ ID NO: 1270976 - DNA, 15 bp, Homo sapiens
gccaagactcctcag

SEQ ID NO: 1270977 - DNA, 16 bp, Homo sapiens
gccaagagcagaggca

SEQ ID NO: 1270978 - DNA, 18 bp, Homo sapiens
gccaagataggaccttgg

SEQ ID NO: 1270979 - DNA, 18 bp, Homo sapiens
gccaagatgtacttctct

SEQ ID NO: 1270980 - DNA, 23 bp, Homo sapiens
gccaagattttcctcttgtgatt

SEQ ID NO: 1270981 - DNA, 20 bp, Homo sapiens
gccaagcagaaaaaaaagtg

SEQ ID NO: 1270982 - DNA, 23 bp, Homo sapiens
gccaagccctaagcctgtcccca

SEQ ID NO: 1270983 - DNA, 21 bp, Homo sapiens
gccaagccctccccatcccat

SEQ ID NO: 1270984 - DNA, 18 bp, Homo sapiens
gccaagctccctggagcc

SEQ ID NO: 1270985 - DNA, 20 bp, Homo sapiens
gccaagctccctggagccct

SEQ ID NO: 1270986 - DNA, 21 bp, Homo sapiens
gccaagctccctggagccctg

SEQ ID NO: 1270987 - DNA, 22 bp, Homo sapiens
gccaagctccctggagccctgt

SEQ ID NO: 1270988 - DNA, 14 bp, Homo sapiens
gccaagctgaagct

SEQ ID NO: 1270989 - DNA, 16 bp, Homo sapiens
gccaagctgaagctac

SEQ ID NO: 1270990 - DNA, 11 bp, Homo sapiens
gccaagctgca

SEQ ID NO: 1270991 - DNA, 13 bp, Homo sapiens
gccaagctgcaca

SEQ ID NO: 1270992 - DNA, 21 bp, Homo sapiens
gccaagctttgaggctctgtc

SEQ ID NO: 1270993 - DNA, 14 bp, Homo sapiens
gccaaggactgact

SEQ ID NO: 1270994 - DNA, 20 bp, Homo sapiens
gccaaggactgactttgcca

SEQ ID NO: 1270995 - DNA, 14 bp, Homo sapiens
gccaaggactgccg

SEQ ID NO: 1270996 - DNA, 21 bp, Homo sapiens
gccagagagcaggggagcttg

SEQ ID NO: 1270997 - DNA, 21 bp, Homo sapiens
gccagagagcctggtgctgct

SEQ ID NO: 1270998 - DNA, 18 bp, Homo sapiens
gccagagaggagcacctg

SEQ ID NO: 1270999 - DNA, 17 bp, Homo sapiens
gccagagagggcccagc

SEQ ID NO: 1271000 - DNA, 19 bp, Homo sapiens
gccagagagggcccagctg

SEQ ID NO: 1271001 - DNA, 17 bp, Homo sapiens
gccagagcaggagcccc

SEQ ID NO: 1271002 - DNA, 17 bp, Homo sapiens
gccagagccccaagcag

SEQ ID NO: 1271003 - DNA, 23 bp, Homo sapiens
gccagagcccttcactgccatga

SEQ ID NO: 1271004 - DNA, 13 bp, Homo sapiens
gccagagcctctg

SEQ ID NO: 1271005 - DNA, 15 bp, Homo sapiens
gccagagcctctggc

SEQ ID NO: 1271006 - DNA, 21 bp, Homo sapiens
gccagagcctctggcccctca

SEQ ID NO: 1271007 - DNA, 17 bp, Homo sapiens
gccagagctagggctgc

SEQ ID NO: 1271008 - DNA, 14 bp, Homo sapiens
gccagagctggaag

SEQ ID NO: 1271009 - DNA, 15 bp, Homo sapiens
gccagagctggaagg

SEQ ID NO: 1271010 - DNA, 20 bp, Homo sapiens
gccagagctggaaggcaggg

SEQ ID NO: 1271011 - DNA, 21 bp, Homo sapiens
gccagagctggaaggcagggc

SEQ ID NO: 1271012 - DNA, 17 bp, Homo sapiens
gccagagctgtgcctgc

SEQ ID NO: 1271013 - DNA, 14 bp, Homo sapiens
gccagaggaactgt

SEQ ID NO: 1271014 - DNA, 16 bp, Homo sapiens
gccagaggaaggaaaa

SEQ ID NO: 1271015 - DNA, 23 bp, Homo sapiens
gccagaggaatcctggcagccca

SEQ ID NO: 1271016 - DNA, 19 bp, Homo sapiens
gccagaggaatgatgggct

SEQ ID NO: 1271017 - DNA, 15 bp, Homo sapiens
gccagaggcccccag

SEQ ID NO: 1271018 - DNA, 23 bp, Homo sapiens
gccagaggcccccagcccagggc

SEQ ID NO: 1271019 - DNA, 22 bp, Homo sapiens
gccagaggctcgttgactggct

SEQ ID NO: 1271020 - DNA, 13 bp, Homo sapiens
gccagaggctggg

SEQ ID NO: 1271021 - DNA, 20 bp, Homo sapiens
gccagaggctgggagtccct

SEQ ID NO: 1271022 - DNA, 18 bp, Homo sapiens
gccagagggccagcaggc

SEQ ID NO: 1271023 - DNA, 13 bp, Homo sapiens
gccagaggtgctt

SEQ ID NO: 1271024 - DNA, 16 bp, Homo sapiens
gccagaggtgcttcac

SEQ ID NO: 1271025 - DNA, 12 bp, Homo sapiens
gccagaggtggg

SEQ ID NO: 1271026 - DNA, 14 bp, Homo sapiens
gccagagtctccca

SEQ ID NO: 1271027 - DNA, 21 bp, Homo sapiens
gccagagtctcccagtgggtg

SEQ ID NO: 1271028 - DNA, 23 bp, Homo sapiens
gccagagttaggttgtctccagg

SEQ ID NO: 1271029 - DNA, 16 bp, Homo sapiens
gccagataaaatgttc

SEQ ID NO: 1271030 - DNA, 17 bp, Homo sapiens
gccagataaaatgttca

SEQ ID NO: 1271031 - DNA, 21 bp, Homo sapiens
gccagatgcacatccctggaa

SEQ ID NO: 1271032 - DNA, 14 bp, Homo sapiens
gccagattctgcct

SEQ ID NO: 1271033 - DNA, 15 bp, Homo sapiens
gccagattctgcctc

SEQ ID NO: 1271034 - DNA, 13 bp, Homo sapiens
gccagatttttta

SEQ ID NO: 1271035 - DNA, 23 bp, Homo sapiens
gccagattttttaaaatttatat

SEQ ID NO: 1271036 - DNA, 13 bp, Homo sapiens
gccagcaaataaa

SEQ ID NO: 1271037 - DNA, 14 bp, Homo sapiens
gccagcaaggcagg

SEQ ID NO: 1271038 - DNA, 12 bp, Homo sapiens
gccagcacacag

SEQ ID NO: 1271039 - DNA, 20 bp, Homo sapiens
gccagcacaccaagtggctg

SEQ ID NO: 1271040 - DNA, 21 bp, Homo sapiens
gccagcacaccaagtggctgg

SEQ ID NO: 1271041 - DNA, 16 bp, Homo sapiens
gccagcaccacctaca

SEQ ID NO: 1271042 - DNA, 21 bp, Homo sapiens
gccagcaccacctacacagga

SEQ ID NO: 1271043 - DNA, 22 bp, Homo sapiens
gccagcagccagctctcagcca

SEQ ID NO: 1271044 - DNA, 13 bp, Homo sapiens
gccagcagcctcg

SEQ ID NO: 1271045 - DNA, 14 bp, Homo sapiens
gccagcagcctcgc

SEQ ID NO: 1271046 - DNA, 19 bp, Homo sapiens
gccagcagcctcgcacagg

SEQ ID NO: 1271047 - DNA, 22 bp, Homo sapiens
gccagcagcctcgcacaggccc

SEQ ID NO: 1271048 - DNA, 19 bp, Homo sapiens
gccagcagctgtcagaaca

SEQ ID NO: 1271049 - DNA, 14 bp, Homo sapiens
gccagcaggctcct

SEQ ID NO: 1271050 - DNA, 14 bp, Homo sapiens
gccagcaggggggc

SEQ ID NO: 1271051 - DNA, 16 bp, Homo sapiens
gccagcaggggggctg

SEQ ID NO: 1271052 - DNA, 19 bp, Homo sapiens
gccagcataggggggaggg

SEQ ID NO: 1271053 - DNA, 17 bp, Homo sapiens
gccagcattcagcacac

SEQ ID NO: 1271054 - DNA, 18 bp, Homo sapiens
gccagcattcagcacaca

SEQ ID NO: 1271055 - DNA, 19 bp, Homo sapiens
gccagcattcagcacacac

SEQ ID NO: 1271056 - DNA, 18 bp, Homo sapiens
gccagccaactctgggaa

SEQ ID NO: 1271057 - DNA, 19 bp, Homo sapiens
gccagccaatttcccggag

SEQ ID NO: 1271058 - DNA, 12 bp, Homo sapiens
gccagccacccc

SEQ ID NO: 1271059 - DNA, 18 bp, Homo sapiens
gccagccacccctgccac

SEQ ID NO: 1271060 - DNA, 18 bp, Homo sapiens
gccagccaggcgggctca

SEQ ID NO: 1271061 - DNA, 21 bp, Homo sapiens
gccagccaggcgggctcaagg

SEQ ID NO: 1271062 - DNA, 22 bp, Homo sapiens
gccagccagtcttgcctaggcc

SEQ ID NO: 1271063 - DNA, 21 bp, Homo sapiens
gccagcccactgcctcctgcc

SEQ ID NO: 1271064 - DNA, 17 bp, Homo sapiens
gccagcccagccaggcc

SEQ ID NO: 1271065 - DNA, 19 bp, Homo sapiens
gccagcccatggcccccaa

SEQ ID NO: 1271066 - DNA, 20 bp, Homo sapiens
gccagcccatggcccccaat

SEQ ID NO: 1271067 - DNA, 20 bp, Homo sapiens
gccagccccacccccagcca

SEQ ID NO: 1271068 - DNA, 17 bp, Homo sapiens
gccagcccccccaccca

SEQ ID NO: 1271069 - DNA, 23 bp, Homo sapiens
gccagcccccccacccaccccca

SEQ ID NO: 1271070 - DNA, 16 bp, Homo sapiens
gccagccccgctccca

SEQ ID NO: 1271071 - DNA, 20 bp, Homo sapiens
gccagccccgctcccaccta

SEQ ID NO: 1271072 - DNA, 15 bp, Homo sapiens
gccagcccctcttcc

SEQ ID NO: 1271073 - DNA, 19 bp, Homo sapiens
gccagcccctggccccagg

SEQ ID NO: 1271074 - DNA, 15 bp, Homo sapiens
gccagcccctggggc

SEQ ID NO: 1271075 - DNA, 18 bp, Homo sapiens
gccagcccctggggccca

SEQ ID NO: 1271076 - DNA, 15 bp, Homo sapiens
gccagcccggctggt

SEQ ID NO: 1271077 - DNA, 17 bp, Homo sapiens
gccagccctgcagccca

SEQ ID NO: 1271078 - DNA, 15 bp, Homo sapiens
gccagcccttccctg

SEQ ID NO: 1271079 - DNA, 16 bp, Homo sapiens
gccagccgaccctcct

SEQ ID NO: 1271080 - DNA, 17 bp, Homo sapiens
gccagccgaccctcctg

SEQ ID NO: 1271081 - DNA, 19 bp, Homo sapiens
gccagccgaccctcctggc

SEQ ID NO: 1271082 - DNA, 19 bp, Homo sapiens
gccagccgcccacccccac

SEQ ID NO: 1271083 - DNA, 15 bp, Homo sapiens
gccagccgccctggg

SEQ ID NO: 1271084 - DNA, 16 bp, Homo sapiens
gccagccgccctgggc

SEQ ID NO: 1271085 - DNA, 19 bp, Homo sapiens
gccagccgccctgggctgt

SEQ ID NO: 1271086 - DNA, 13 bp, Homo sapiens
gccagcctcaggc

SEQ ID NO: 1271087 - DNA, 13 bp, Homo sapiens
gccagcctcagtg

SEQ ID NO: 1271088 - DNA, 17 bp, Homo sapiens
gccagcctcagtgccac

SEQ ID NO: 1271089 - DNA, 15 bp, Homo sapiens
gccagcctcctctgg

SEQ ID NO: 1271090 - DNA, 16 bp, Homo sapiens
gccagcctcctctgga

SEQ ID NO: 1271091 - DNA, 18 bp, Homo sapiens
gccagcctggctctgccc

SEQ ID NO: 1271092 - DNA, 20 bp, Homo sapiens
gccagcctgggactcccagt

SEQ ID NO: 1271093 - DNA, 21 bp, Homo sapiens
gccagcctgggactcccagtg

SEQ ID NO: 1271094 - DNA, 16 bp, Homo sapiens
gccagccttcctctgc

SEQ ID NO: 1271095 - DNA, 19 bp, Homo sapiens
gccagccttcctctgcagc

SEQ ID NO: 1271096 - DNA, 21 bp, Homo sapiens
gccagccttcctctgcagctg

SEQ ID NO: 1271097 - DNA, 22 bp, Homo sapiens
gccagccttcctctgcagctga

SEQ ID NO: 1271098 - DNA, 18 bp, Homo sapiens
gccagccttgagccctgg

SEQ ID NO: 1271099 - DNA, 15 bp, Homo sapiens
gccagcgccagggcc

SEQ ID NO: 1271100 - DNA, 20 bp, Homo sapiens
gccagcgccagggcccaggc

SEQ ID NO: 1271101 - DNA, 23 bp, Homo sapiens
gccagcgccagggcccaggccat

SEQ ID NO: 1271102 - DNA, 16 bp, Homo sapiens
gccagcgcctccctcc

SEQ ID NO: 1271103 - DNA, 23 bp, Homo sapiens
gccagcgcctccctccaccccag

SEQ ID NO: 1271104 - DNA, 12 bp, Homo sapiens
gccagcgtcctc

SEQ ID NO: 1271105 - DNA, 16 bp, Homo sapiens
gccagcgtgtggagca

SEQ ID NO: 1271106 - DNA, 23 bp, Homo sapiens
gccagctaataagaagtgccaag

SEQ ID NO: 1271107 - DNA, 19 bp, Homo sapiens
gccagctaatttttgtatg

SEQ ID NO: 1271108 - DNA, 19 bp, Homo sapiens
gccagctaccccttgtggg

SEQ ID NO: 1271109 - DNA, 22 bp, Homo sapiens
gccagctaccccttgtgggcaa

SEQ ID NO: 1271110 - DNA, 17 bp, Homo sapiens
gccagctcacagtgctg

SEQ ID NO: 1271111 - DNA, 19 bp, Homo sapiens
gccagctcacagtgctgtg

SEQ ID NO: 1271112 - DNA, 19 bp, Homo sapiens
gccagctccagtgccgctc

SEQ ID NO: 1271113 - DNA, 16 bp, Homo sapiens
gccagctcctctctga

SEQ ID NO: 1271114 - DNA, 18 bp, Homo sapiens
gccagctcctctctgaag

SEQ ID NO: 1271115 - DNA, 15 bp, Homo sapiens
gccagctctcagcca

SEQ ID NO: 1271116 - DNA, 17 bp, Homo sapiens
gccagctctctctaccc

SEQ ID NO: 1271117 - DNA, 21 bp, Homo sapiens
gccaggggaaaatcagcctgc

SEQ ID NO: 1271118 - DNA, 13 bp, Homo sapiens
gccaggggcaggc

SEQ ID NO: 1271119 - DNA, 19 bp, Homo sapiens
gccaggggcgaggcccttc

SEQ ID NO: 1271120 - DNA, 14 bp, Homo sapiens
gccaggggcttccc

SEQ ID NO: 1271121 - DNA, 15 bp, Homo sapiens
gccagggggatgcca

SEQ ID NO: 1271122 - DNA, 18 bp, Homo sapiens
gccaggggtctccctgga

SEQ ID NO: 1271123 - DNA, 20 bp, Homo sapiens
gccagggtctctccctcagg

SEQ ID NO: 1271124 - DNA, 22 bp, Homo sapiens
gccagggtctctccctcaggtg

SEQ ID NO: 1271125 - DNA, 17 bp, Homo sapiens
gccagggtgagagctgc

SEQ ID NO: 1271126 - DNA, 17 bp, Homo sapiens
gccagggtgggaagaga

SEQ ID NO: 1271127 - DNA, 22 bp, Homo sapiens
gccagggtgggaagagaagaaa

SEQ ID NO: 1271128 - DNA, 18 bp, Homo sapiens
gccagggtgggctgggga

SEQ ID NO: 1271129 - DNA, 20 bp, Homo sapiens
gccagggtgggctggggact

SEQ ID NO: 1271130 - DNA, 19 bp, Homo sapiens
gccagggtttacccagtgg

SEQ ID NO: 1271131 - DNA, 20 bp, Homo sapiens
gccaggtagcaagagagcag

SEQ ID NO: 1271132 - DNA, 15 bp, Homo sapiens
gccaggtgagaaact

SEQ ID NO: 1271133 - DNA, 21 bp, Homo sapiens
gccaggtgcaatctactggaa

SEQ ID NO: 1271134 - DNA, 14 bp, Homo sapiens
gccaggtgcggcct

SEQ ID NO: 1271135 - DNA, 21 bp, Homo sapiens
gccaggtgcggcctgggggga

SEQ ID NO: 1271136 - DNA, 13 bp, Homo sapiens
gccaggtggctca

SEQ ID NO: 1271137 - DNA, 15 bp, Homo sapiens
gccaggtgggcggac

SEQ ID NO: 1271138 - DNA, 18 bp, Homo sapiens
gccaggttaggaaggcag

SEQ ID NO: 1271139 - DNA, 23 bp, Homo sapiens
gccaggttctccgttagctcctg

SEQ ID NO: 1271140 - DNA, 20 bp, Homo sapiens
gccagtaacgcgtcttcctg

SEQ ID NO: 1271141 - DNA, 21 bp, Homo sapiens
gccagtaacgcgtcttcctga

SEQ ID NO: 1271142 - DNA, 23 bp, Homo sapiens
gccagtacagagaaattctgtgg

SEQ ID NO: 1271143 - DNA, 16 bp, Homo sapiens
gccagtacttgtcata

SEQ ID NO: 1271144 - DNA, 23 bp, Homo sapiens
gccagtagttttgacacttccca

SEQ ID NO: 1271145 - DNA, 12 bp, Homo sapiens
gccagtatttta

SEQ ID NO: 1271146 - DNA, 17 bp, Homo sapiens
gccagtcaccttctggg

SEQ ID NO: 1271147 - DNA, 18 bp, Homo sapiens
gccagtcactgctgcaag

SEQ ID NO: 1271148 - DNA, 13 bp, Homo sapiens
gccagtcagcaac

SEQ ID NO: 1271149 - DNA, 12 bp, Homo sapiens
gccagtcaggcc

SEQ ID NO: 1271150 - DNA, 13 bp, Homo sapiens
gccagtccaggct

SEQ ID NO: 1271151 - DNA, 12 bp, Homo sapiens
gccagtccccat

SEQ ID NO: 1271152 - DNA, 23 bp, Homo sapiens
gccagtccccatttctgcctcgc

SEQ ID NO: 1271153 - DNA, 16 bp, Homo sapiens
gccagtcctcctggga

SEQ ID NO: 1271154 - DNA, 17 bp, Homo sapiens
gccagtcctgcctggcc

SEQ ID NO: 1271155 - DNA, 20 bp, Homo sapiens
gccagtcctgcctggccagg

SEQ ID NO: 1271156 - DNA, 20 bp, Homo sapiens
gccagtcgggagagccaggc

SEQ ID NO: 1271157 - DNA, 21 bp, Homo sapiens
gccagtcgggagagccaggct

SEQ ID NO: 1271158 - DNA, 22 bp, Homo sapiens
gccagtctcactgtgggaaggc

SEQ ID NO: 1271159 - DNA, 18 bp, Homo sapiens
gccagtctcagagaccag

SEQ ID NO: 1271160 - DNA, 20 bp, Homo sapiens
gccagtctcagagaccagca

SEQ ID NO: 1271161 - DNA, 13 bp, Homo sapiens
gccagtctcagat

SEQ ID NO: 1271162 - DNA, 14 bp, Homo sapiens
gccagtctgcccga

SEQ ID NO: 1271163 - DNA, 13 bp, Homo sapiens
gccagtctgggct

SEQ ID NO: 1271164 - DNA, 14 bp, Homo sapiens
gccagtctgggctg

SEQ ID NO: 1271165 - DNA, 15 bp, Homo sapiens
gccagtctgggctgc

SEQ ID NO: 1271166 - DNA, 13 bp, Homo sapiens
gccagtctgtgga

SEQ ID NO: 1271167 - DNA, 18 bp, Homo sapiens
gccagtcttgcctaggcc

SEQ ID NO: 1271168 - DNA, 17 bp, Homo sapiens
gccagtgaagggttttg

SEQ ID NO: 1271169 - DNA, 22 bp, Homo sapiens
gccagtgaagggttttgtgtgt

SEQ ID NO: 1271170 - DNA, 13 bp, Homo sapiens
gccagtgactttt

SEQ ID NO: 1271171 - DNA, 15 bp, Homo sapiens
gccagtgactttttc

SEQ ID NO: 1271172 - DNA, 19 bp, Homo sapiens
gccagtgactttttctgag

SEQ ID NO: 1271173 - DNA, 18 bp, Homo sapiens
gccagtgatgatgttttg

SEQ ID NO: 1271174 - DNA, 16 bp, Homo sapiens
gccagtgcagccactg

SEQ ID NO: 1271175 - DNA, 17 bp, Homo sapiens
gccagtgcagccactgg

SEQ ID NO: 1271176 - DNA, 20 bp, Homo sapiens
gccagtgccttacctcctgc

SEQ ID NO: 1271177 - DNA, 22 bp, Homo sapiens
gccagtgccttacctcctgccc

SEQ ID NO: 1271178 - DNA, 16 bp, Homo sapiens
gccagtggagctggtc

SEQ ID NO: 1271179 - DNA, 23 bp, Homo sapiens
gccagtggagctggtctgccagg

SEQ ID NO: 1271180 - DNA, 13 bp, Homo sapiens
gccagtggccccc

SEQ ID NO: 1271181 - DNA, 20 bp, Homo sapiens
gccagtggcccccgggcctg

SEQ ID NO: 1271182 - DNA, 14 bp, Homo sapiens
gccagtggggcctg

SEQ ID NO: 1271183 - DNA, 17 bp, Homo sapiens
gccagtgtgatcccaag

SEQ ID NO: 1271184 - DNA, 20 bp, Homo sapiens
gccagtgtgatcccaagtgc

SEQ ID NO: 1271185 - DNA, 22 bp, Homo sapiens
gccagtgtgcccaaaagccatg

SEQ ID NO: 1271186 - DNA, 16 bp, Homo sapiens
gccagtgttgtgggct

SEQ ID NO: 1271187 - DNA, 22 bp, Homo sapiens
gccagtgttgtgggcttcctgc

SEQ ID NO: 1271188 - DNA, 12 bp, Homo sapiens
gccagttcctgt

SEQ ID NO: 1271189 - DNA, 21 bp, Homo sapiens
gccagttctttccataataaa

SEQ ID NO: 1271190 - DNA, 13 bp, Homo sapiens
gccagttgaatat

SEQ ID NO: 1271191 - DNA, 16 bp, Homo sapiens
gccagttgatctgctc

SEQ ID NO: 1271192 - DNA, 18 bp, Homo sapiens
gccagttgatctgctctg

SEQ ID NO: 1271193 - DNA, 22 bp, Homo sapiens
gccagttgatctgctctgtttt

SEQ ID NO: 1271194 - DNA, 21 bp, Homo sapiens
gccagttgggctcgcactgcc

SEQ ID NO: 1271195 - DNA, 21 bp, Homo sapiens
gccagtttctctgccttcttc

SEQ ID NO: 1271196 - DNA, 22 bp, Homo sapiens
gccataaaaaggaacaagactg

SEQ ID NO: 1271197 - DNA, 22 bp, Homo sapiens
gccataaaacaggtaatataaa

SEQ ID NO: 1271198 - DNA, 16 bp, Homo sapiens
gccataacgtgccccc

SEQ ID NO: 1271199 - DNA, 17 bp, Homo sapiens
gccataacgtgccccca

SEQ ID NO: 1271200 - DNA, 21 bp, Homo sapiens
gccataacgtgcccccagagt

SEQ ID NO: 1271201 - DNA, 13 bp, Homo sapiens
gccataacttgaa

SEQ ID NO: 1271202 - DNA, 19 bp, Homo sapiens
gccataagatctgtatcta

SEQ ID NO: 1271203 - DNA, 13 bp, Homo sapiens
gccataattatga

SEQ ID NO: 1271204 - DNA, 15 bp, Homo sapiens
gccataattatgaaa

SEQ ID NO: 1271205 - DNA, 16 bp, Homo sapiens
gccataattatgaaaa

SEQ ID NO: 1271206 - DNA, 22 bp, Homo sapiens
gccataattctaagttatttac

SEQ ID NO: 1271207 - DNA, 22 bp, Homo sapiens
gccataccgaccatcgtccagc

SEQ ID NO: 1271208 - DNA, 15 bp, Homo sapiens
gccatacctcagata

SEQ ID NO: 1271209 - DNA, 15 bp, Homo sapiens
gccatagaggcccag

SEQ ID NO: 1271210 - DNA, 16 bp, Homo sapiens
gccatagagtttaaca

SEQ ID NO: 1271211 - DNA, 13 bp, Homo sapiens
gccatagccccag

SEQ ID NO: 1271212 - DNA, 15 bp, Homo sapiens
gccataggtgcagtt

SEQ ID NO: 1271213 - DNA, 19 bp, Homo sapiens
gccatatataacagataca

SEQ ID NO: 1271214 - DNA, 23 bp, Homo sapiens
gccatatatgaccagaagccttg

SEQ ID NO: 1271215 - DNA, 16 bp, Homo sapiens
gccatatatgctgtat

SEQ ID NO: 1271216 - DNA, 21 bp, Homo sapiens
gccatatggaggactgtgaca

SEQ ID NO: 1271217 - DNA, 23 bp, Homo sapiens
gccatatggaggactgtgacaga

SEQ ID NO: 1271218 - DNA, 23 bp, Homo sapiens
gccatattaaattttttgttgac

SEQ ID NO: 1271219 - DNA, 14 bp, Homo sapiens
gccatcaaaatgct

SEQ ID NO: 1271220 - DNA, 16 bp, Homo sapiens
gccatcaaggtccagt

SEQ ID NO: 1271221 - DNA, 15 bp, Homo sapiens
gccatcaccgctggg

SEQ ID NO: 1271222 - DNA, 16 bp, Homo sapiens
gccatcaccgctgggt

SEQ ID NO: 1271223 - DNA, 18 bp, Homo sapiens
gccatcaccgctgggtgg

SEQ ID NO: 1271224 - DNA, 18 bp, Homo sapiens
gccatcactagaagaaaa

SEQ ID NO: 1271225 - DNA, 20 bp, Homo sapiens
gccatcactagaagaaaagc

SEQ ID NO: 1271226 - DNA, 14 bp, Homo sapiens
gccatcactcagcc

SEQ ID NO: 1271227 - DNA, 17 bp, Homo sapiens
gccatcactcagcccct

SEQ ID NO: 1271228 - DNA, 13 bp, Homo sapiens
gccatcagccatg

SEQ ID NO: 1271229 - DNA, 18 bp, Homo sapiens
gccatcagcccctgggaa

SEQ ID NO: 1271230 - DNA, 21 bp, Homo sapiens
gccatcagcccctgggaacag

SEQ ID NO: 1271231 - DNA, 12 bp, Homo sapiens
gccatcagggcc

SEQ ID NO: 1271232 - DNA, 15 bp, Homo sapiens
gccatcagggccctg

SEQ ID NO: 1271233 - DNA, 23 bp, Homo sapiens
gccatcagggtgggccactctcc

SEQ ID NO: 1271234 - DNA, 24 bp, Homo sapiens
gccatcagggtgggccactctccc

SEQ ID NO: 1271235 - DNA, 12 bp, Homo sapiens
gccatcatcctc

SEQ ID NO: 1271236 - DNA, 23 bp, Homo sapiens
gccatcatgcggtgggtgctgcc

SEQ ID NO: 1271237 - DNA, 21 bp, Homo sapiens
gccatcccgcttagcctgcct

SEQ ID NO: 1271238 - DNA, 11 bp, Homo sapiens
gcccagctccg

SEQ ID NO: 1271239 - DNA, 18 bp, Homo sapiens
gcccagctccgcctgctg

SEQ ID NO: 1271240 - DNA, 19 bp, Homo sapiens
gcccagctccgcctgctgg

SEQ ID NO: 1271241 - DNA, 17 bp, Homo sapiens
gcccagctctctgacgc

SEQ ID NO: 1271242 - DNA, 13 bp, Homo sapiens
gcccagctctgaa

SEQ ID NO: 1271243 - DNA, 15 bp, Homo sapiens
gcccagctcttgctc

SEQ ID NO: 1271244 - DNA, 21 bp, Homo sapiens
gcccagctcttgctctcttgt

SEQ ID NO: 1271245 - DNA, 13 bp, Homo sapiens
gcccagctgcacc

SEQ ID NO: 1271246 - DNA, 24 bp, Homo sapiens
gcccagctgcacctgccagcctgg

SEQ ID NO: 1271247 - DNA, 22 bp, Homo sapiens
gcccagctgctcccctgccacg

SEQ ID NO: 1271248 - DNA, 15 bp, Homo sapiens
gcccagctgggctct

SEQ ID NO: 1271249 - DNA, 16 bp, Homo sapiens
gcccagctgggctctg

SEQ ID NO: 1271250 - DNA, 23 bp, Homo sapiens
gcccagctgggctctgccaccct

SEQ ID NO: 1271251 - DNA, 14 bp, Homo sapiens
gcccagctgtagcc

SEQ ID NO: 1271252 - DNA, 15 bp, Homo sapiens
gcccagctgtagcca

SEQ ID NO: 1271253 - DNA, 19 bp, Homo sapiens
gcccagctgtagccatggc

SEQ ID NO: 1271254 - DNA, 14 bp, Homo sapiens
gcccagcttcctgg

SEQ ID NO: 1271255 - DNA, 16 bp, Homo sapiens
gcccaggacagctggt

SEQ ID NO: 1271256 - DNA, 15 bp, Homo sapiens
gcccaggaccagctg

SEQ ID NO: 1271257 - DNA, 18 bp, Homo sapiens
gcccaggaccagctgggg

SEQ ID NO: 1271258 - DNA, 19 bp, Homo sapiens
gcccaggaccagctggggc

SEQ ID NO: 1271259 - DNA, 16 bp, Homo sapiens
gcccaggactgcattg

SEQ ID NO: 1271260 - DNA, 18 bp, Homo sapiens
gcccaggagacagaccac

SEQ ID NO: 1271261 - DNA, 22 bp, Homo sapiens
gcccaggagacagaccacttgc

SEQ ID NO: 1271262 - DNA, 20 bp, Homo sapiens
gcccaggagagcccccacca

SEQ ID NO: 1271263 - DNA, 16 bp, Homo sapiens
gcccaggagctctgcg

SEQ ID NO: 1271264 - DNA, 17 bp, Homo sapiens
gcccaggagctctgcgc

SEQ ID NO: 1271265 - DNA, 18 bp, Homo sapiens
gcccaggagctctgcgcc

SEQ ID NO: 1271266 - DNA, 20 bp, Homo sapiens
gcccaggagctctgcgccag

SEQ ID NO: 1271267 - DNA, 20 bp, Homo sapiens
gcccaggagctgagtcacct

SEQ ID NO: 1271268 - DNA, 22 bp, Homo sapiens
gcccaggagtttgaggctgcag

SEQ ID NO: 1271269 - DNA, 20 bp, Homo sapiens
gcccaggatactggcacaga

SEQ ID NO: 1271270 - DNA, 22 bp, Homo sapiens
gcccaggatactggcacagagg

SEQ ID NO: 1271271 - DNA, 24 bp, Homo sapiens
gcccaggatatttctgagagtgaa

SEQ ID NO: 1271272 - DNA, 14 bp, Homo sapiens
gcccaggatgctgc

SEQ ID NO: 1271273 - DNA, 15 bp, Homo sapiens
gcccaggcaccacca

SEQ ID NO: 1271274 - DNA, 17 bp, Homo sapiens
gcccaggcaccaccagg

SEQ ID NO: 1271275 - DNA, 18 bp, Homo sapiens
gcccaggcaccaccagga

SEQ ID NO: 1271276 - DNA, 19 bp, Homo sapiens
gcccaggcaccaccaggag

SEQ ID NO: 1271277 - DNA, 21 bp, Homo sapiens
gcccaggcaccaccaggagca

SEQ ID NO: 1271278 - DNA, 15 bp, Homo sapiens
gcccaggcagcctca

SEQ ID NO: 1271279 - DNA, 16 bp, Homo sapiens
gcccaggcagcctcaa

SEQ ID NO: 1271280 - DNA, 16 bp, Homo sapiens
gcccaggcaggtctgc

SEQ ID NO: 1271281 - DNA, 17 bp, Homo sapiens
gcccaggcaggtctgca

SEQ ID NO: 1271282 - DNA, 12 bp, Homo sapiens
gcccaggccagc

SEQ ID NO: 1271283 - DNA, 13 bp, Homo sapiens
gcccaggccagcc

SEQ ID NO: 1271284 - DNA, 23 bp, Homo sapiens
gcccaggccagcccccccaccca

SEQ ID NO: 1271285 - DNA, 13 bp, Homo sapiens
gcccaggccatgt

SEQ ID NO: 1271286 - DNA, 19 bp, Homo sapiens
gcccaggccatgtggcctg

SEQ ID NO: 1271287 - DNA, 21 bp, Homo sapiens
gcccaggccggggtggagcat

SEQ ID NO: 1271288 - DNA, 23 bp, Homo sapiens
gcccaggccggggtggagcatgg

SEQ ID NO: 1271289 - DNA, 23 bp, Homo sapiens
gcccaggccgttccccttggctt

SEQ ID NO: 1271290 - DNA, 12 bp, Homo sapiens
gcccaggcctca

SEQ ID NO: 1271291 - DNA, 14 bp, Homo sapiens
gcccaggcctcacc

SEQ ID NO: 1271292 - DNA, 18 bp, Homo sapiens
gcccaggcctgctggcat

SEQ ID NO: 1271293 - DNA, 13 bp, Homo sapiens
gcccaggcctgga

SEQ ID NO: 1271294 - DNA, 20 bp, Homo sapiens
gcccaggcctgggatgcagt

SEQ ID NO: 1271295 - DNA, 14 bp, Homo sapiens
gcccaggcctgggt

SEQ ID NO: 1271296 - DNA, 15 bp, Homo sapiens
gcccaggcctgggtt

SEQ ID NO: 1271297 - DNA, 23 bp, Homo sapiens
gcccaggctcggaggaccctgga

SEQ ID NO: 1271298 - DNA, 19 bp, Homo sapiens
gcccaggctggagtgcagt

SEQ ID NO: 1271299 - DNA, 20 bp, Homo sapiens
gcccaggctggagtgcagtg

SEQ ID NO: 1271300 - DNA, 16 bp, Homo sapiens
gcccaggctggtttcg

SEQ ID NO: 1271301 - DNA, 18 bp, Homo sapiens
gcccagggagaggccatg

SEQ ID NO: 1271302 - DNA, 20 bp, Homo sapiens
gcccagggaggcagcgtggg

SEQ ID NO: 1271303 - DNA, 16 bp, Homo sapiens
gcccagggagtccttg

SEQ ID NO: 1271304 - DNA, 23 bp, Homo sapiens
gcccagggcatcttgctggctac

SEQ ID NO: 1271305 - DNA, 18 bp, Homo sapiens
gcccagggcccgggcacc

SEQ ID NO: 1271306 - DNA, 17 bp, Homo sapiens
gcccagggcctgaaacc

SEQ ID NO: 1271307 - DNA, 13 bp, Homo sapiens
gcccagggctcag

SEQ ID NO: 1271308 - DNA, 14 bp, Homo sapiens
gcccagggctcagc

SEQ ID NO: 1271309 - DNA, 15 bp, Homo sapiens
gcccagggctcagcc

SEQ ID NO: 1271310 - DNA, 18 bp, Homo sapiens
gcccagggctcagcctgg

SEQ ID NO: 1271311 - DNA, 12 bp, Homo sapiens
gcccagggctcc

SEQ ID NO: 1271312 - DNA, 16 bp, Homo sapiens
gcccagggctcctgca

SEQ ID NO: 1271313 - DNA, 17 bp, Homo sapiens
gcccagggctgggagga

SEQ ID NO: 1271314 - DNA, 20 bp, Homo sapiens
gcccagggctgggaggaagg

SEQ ID NO: 1271315 - DNA, 19 bp, Homo sapiens
gcccaggggcccacaggga

SEQ ID NO: 1271316 - DNA, 23 bp, Homo sapiens
gcccaggggctgtggccgtctcc

SEQ ID NO: 1271317 - DNA, 16 bp, Homo sapiens
gcccaggggcttcaga

SEQ ID NO: 1271318 - DNA, 14 bp, Homo sapiens
gcccaggggtgccc

SEQ ID NO: 1271319 - DNA, 20 bp, Homo sapiens
gcccagggtcgtctttgtgt

SEQ ID NO: 1271320 - DNA, 20 bp, Homo sapiens
gcccagggtgcagtgtgagt

SEQ ID NO: 1271321 - DNA, 17 bp, Homo sapiens
gcccagggtggctgcca

SEQ ID NO: 1271322 - DNA, 20 bp, Homo sapiens
gcccagggtggctgccagcc

SEQ ID NO: 1271323 - DNA, 21 bp, Homo sapiens
gcccagggtggctgccagccc

SEQ ID NO: 1271324 - DNA, 21 bp, Homo sapiens
gcccagggttcccccagccct

SEQ ID NO: 1271325 - DNA, 22 bp, Homo sapiens
gcccagggttcccccagccctg

SEQ ID NO: 1271326 - DNA, 17 bp, Homo sapiens
gcccaggtaccaccctt

SEQ ID NO: 1271327 - DNA, 20 bp, Homo sapiens
gcccaggtggcctcctggcc

SEQ ID NO: 1271328 - DNA, 14 bp, Homo sapiens
gcccagtacattta

SEQ ID NO: 1271329 - DNA, 15 bp, Homo sapiens
gcccagtagaccttg

SEQ ID NO: 1271330 - DNA, 23 bp, Homo sapiens
gcccagtcctctcccaagtccac

SEQ ID NO: 1271331 - DNA, 13 bp, Homo sapiens
gcccagtcctggg

SEQ ID NO: 1271332 - DNA, 14 bp, Homo sapiens
gcccagtcctgggt

SEQ ID NO: 1271333 - DNA, 19 bp, Homo sapiens
gcccagtccttccacctcg

SEQ ID NO: 1271334 - DNA, 14 bp, Homo sapiens
gcccagtgccagct

SEQ ID NO: 1271335 - DNA, 14 bp, Homo sapiens
gcccagtgcttctc

SEQ ID NO: 1271336 - DNA, 22 bp, Homo sapiens
gcccagtggaacagtcaccctt

SEQ ID NO: 1271337 - DNA, 19 bp, Homo sapiens
gcccagtgggctgcacgct

SEQ ID NO: 1271338 - DNA, 20 bp, Homo sapiens
gcccataaagtctgagaaat

SEQ ID NO: 1271339 - DNA, 21 bp, Homo sapiens
gcccataaagtctgagaaata

SEQ ID NO: 1271340 - DNA, 19 bp, Homo sapiens
gcccataatagttagccct

SEQ ID NO: 1271341 - DNA, 22 bp, Homo sapiens
gcccataatagttagccctcag

SEQ ID NO: 1271342 - DNA, 23 bp, Homo sapiens
gcccataatagttagccctcagt

SEQ ID NO: 1271343 - DNA, 16 bp, Homo sapiens
gcccataccttctggt

SEQ ID NO: 1271344 - DNA, 16 bp, Homo sapiens
gcccatactcagcctg

SEQ ID NO: 1271345 - DNA, 19 bp, Homo sapiens
gcccatactcagcctgctg

SEQ ID NO: 1271346 - DNA, 20 bp, Homo sapiens
gcccatactcagcctgctgc

SEQ ID NO: 1271347 - DNA, 21 bp, Homo sapiens
gcccatactcagcctgctgcc

SEQ ID NO: 1271348 - DNA, 17 bp, Homo sapiens
gcccatactgagcctgc

SEQ ID NO: 1271349 - DNA, 19 bp, Homo sapiens
gcccatacttttggctcct

SEQ ID NO: 1271350 - DNA, 19 bp, Homo sapiens
gcccatagctattttcctt

SEQ ID NO: 1271351 - DNA, 14 bp, Homo sapiens
gcccatcaggcagt

SEQ ID NO: 1271352 - DNA, 19 bp, Homo sapiens
gcccatccattaggccagc

SEQ ID NO: 1271353 - DNA, 16 bp, Homo sapiens
gcccatccctgaccat

SEQ ID NO: 1271354 - DNA, 15 bp, Homo sapiens
gcccatccgtctgtc

SEQ ID NO: 1271355 - DNA, 22 bp, Homo sapiens
gcccatctatgtcccttgctgt

SEQ ID NO: 1271356 - DNA, 18 bp, Homo sapiens
gcccatctcaggtgccac

SEQ ID NO: 1271357 - DNA, 23 bp, Homo sapiens
gcccatctcaggtgccactccct

SEQ ID NO: 1271358 - DNA, 20 bp, Homo sapiens
gcccatctcggagcatcccg

SEQ ID NO: 1271359 - DNA, 17 bp, Homo sapiens
gccccccacacttccct

SEQ ID NO: 1271360 - DNA, 21 bp, Homo sapiens
gccccccacacttccctggcg

SEQ ID NO: 1271361 - DNA, 21 bp, Homo sapiens
gccccccacccctggaagagc

SEQ ID NO: 1271362 - DNA, 18 bp, Homo sapiens
gccccccagaaagctgcc

SEQ ID NO: 1271363 - DNA, 11 bp, Homo sapiens
gccccccagag

SEQ ID NO: 1271364 - DNA, 23 bp, Homo sapiens
gccccccagagagagctctgcac

SEQ ID NO: 1271365 - DNA, 12 bp, Homo sapiens
gccccccagagc

SEQ ID NO: 1271366 - DNA, 15 bp, Homo sapiens
gccccccagagccag

SEQ ID NO: 1271367 - DNA, 17 bp, Homo sapiens
gccccccagagccaggg

SEQ ID NO: 1271368 - DNA, 20 bp, Homo sapiens
gccccccagagccagggctg

SEQ ID NO: 1271369 - DNA, 24 bp, Homo sapiens
gccccccagagccagggctgtcct

SEQ ID NO: 1271370 - DNA, 12 bp, Homo sapiens
gccccccagcac

SEQ ID NO: 1271371 - DNA, 16 bp, Homo sapiens
gccccccagcctctgg

SEQ ID NO: 1271372 - DNA, 11 bp, Homo sapiens
gccccccaggg

SEQ ID NO: 1271373 - DNA, 13 bp, Homo sapiens
gccccccagggct

SEQ ID NO: 1271374 - DNA, 13 bp, Homo sapiens
gccccccagtctc

SEQ ID NO: 1271375 - DNA, 17 bp, Homo sapiens
gcccccccaacactgtg

SEQ ID NO: 1271376 - DNA, 23 bp, Homo sapiens
gcccccccaacactgtgccctgg

SEQ ID NO: 1271377 - DNA, 12 bp, Homo sapiens
gcccccccaccc

SEQ ID NO: 1271378 - DNA, 15 bp, Homo sapiens
gcccccccacccacc

SEQ ID NO: 1271379 - DNA, 19 bp, Homo sapiens
gcccccccactccagcccg

SEQ ID NO: 1271380 - DNA, 17 bp, Homo sapiens
gcccccccctccccatg

SEQ ID NO: 1271381 - DNA, 20 bp, Homo sapiens
gccccccctcttttggcctt

SEQ ID NO: 1271382 - DNA, 19 bp, Homo sapiens
gccccccgcacagccaccc

SEQ ID NO: 1271383 - DNA, 14 bp, Homo sapiens
gccccccgccctca

SEQ ID NO: 1271384 - DNA, 15 bp, Homo sapiens
gccccccgccctcat

SEQ ID NO: 1271385 - DNA, 23 bp, Homo sapiens
gccccccgcgctcgcccagcagg

SEQ ID NO: 1271386 - DNA, 16 bp, Homo sapiens
gcccccctcaaacctc

SEQ ID NO: 1271387 - DNA, 14 bp, Homo sapiens
gcccccgagccctg

SEQ ID NO: 1271388 - DNA, 20 bp, Homo sapiens
gcccccgagccctgactcct

SEQ ID NO: 1271389 - DNA, 22 bp, Homo sapiens
gcccccgagctgggggccatga

SEQ ID NO: 1271390 - DNA, 11 bp, Homo sapiens
gcccccgcccc

SEQ ID NO: 1271391 - DNA, 12 bp, Homo sapiens
gcccccgcccca

SEQ ID NO: 1271392 - DNA, 13 bp, Homo sapiens
gcccccgccccag

SEQ ID NO: 1271393 - DNA, 15 bp, Homo sapiens
gcccccgccccagag

SEQ ID NO: 1271394 - DNA, 21 bp, Homo sapiens
gcccccgccccagagtggccc

SEQ ID NO: 1271395 - DNA, 18 bp, Homo sapiens
gcccccgccccaggcttc

SEQ ID NO: 1271396 - DNA, 13 bp, Homo sapiens
gcccccgccccgc

SEQ ID NO: 1271397 - DNA, 15 bp, Homo sapiens
gcccccgccccgcgc

SEQ ID NO: 1271398 - DNA, 13 bp, Homo sapiens
gcccccgcgccct

SEQ ID NO: 1271399 - DNA, 19 bp, Homo sapiens
gcccccgcgccctccctcc

SEQ ID NO: 1271400 - DNA, 16 bp, Homo sapiens
gcccccgcgggttcta

SEQ ID NO: 1271401 - DNA, 20 bp, Homo sapiens
gcccccgctgtaatgaaaca

SEQ ID NO: 1271402 - DNA, 13 bp, Homo sapiens
gcccccggcggcg

SEQ ID NO: 1271403 - DNA, 16 bp, Homo sapiens
gcccccgggcctgcac

SEQ ID NO: 1271404 - DNA, 16 bp, Homo sapiens
gccccctcccccatgg

SEQ ID NO: 1271405 - DNA, 15 bp, Homo sapiens
gccccctccccccag

SEQ ID NO: 1271406 - DNA, 17 bp, Homo sapiens
gccccctcccttcacag

SEQ ID NO: 1271407 - DNA, 18 bp, Homo sapiens
gccccctcccttcctgcc

SEQ ID NO: 1271408 - DNA, 19 bp, Homo sapiens
gccccctcctctagctgtg

SEQ ID NO: 1271409 - DNA, 15 bp, Homo sapiens
gccccctcctctccc

SEQ ID NO: 1271410 - DNA, 11 bp, Homo sapiens
gccccctgcca

SEQ ID NO: 1271411 - DNA, 19 bp, Homo sapiens
gccccctgccagccgaccc

SEQ ID NO: 1271412 - DNA, 14 bp, Homo sapiens
gccccctgcccccc

SEQ ID NO: 1271413 - DNA, 12 bp, Homo sapiens
gccccctgccct

SEQ ID NO: 1271414 - DNA, 14 bp, Homo sapiens
gccccctgccctcc

SEQ ID NO: 1271415 - DNA, 12 bp, Homo sapiens
gccccctggatg

SEQ ID NO: 1271416 - DNA, 16 bp, Homo sapiens
gccccctggatgtccc

SEQ ID NO: 1271417 - DNA, 15 bp, Homo sapiens
gccccctggcagctg

SEQ ID NO: 1271418 - DNA, 14 bp, Homo sapiens
gccccctggcctct

SEQ ID NO: 1271419 - DNA, 21 bp, Homo sapiens
gccccctgggctggggcctca

SEQ ID NO: 1271420 - DNA, 23 bp, Homo sapiens
gcccccttccccagcccttagca

SEQ ID NO: 1271421 - DNA, 17 bp, Homo sapiens
gcccccttcgctcctcc

SEQ ID NO: 1271422 - DNA, 21 bp, Homo sapiens
gcccccttcgctcctcctctc

SEQ ID NO: 1271423 - DNA, 18 bp, Homo sapiens
gcccccttctcccacact

SEQ ID NO: 1271424 - DNA, 20 bp, Homo sapiens
gcccccttctcccacactgc

SEQ ID NO: 1271425 - DNA, 16 bp, Homo sapiens
gcccccttgccctccg

SEQ ID NO: 1271426 - DNA, 18 bp, Homo sapiens
gccccctttcagatgtct

SEQ ID NO: 1271427 - DNA, 15 bp, Homo sapiens
gccccctttcccggg

SEQ ID NO: 1271428 - DNA, 16 bp, Homo sapiens
gccccctttcccgggc

SEQ ID NO: 1271429 - DNA, 20 bp, Homo sapiens
gccccctttcccgggctgtc

SEQ ID NO: 1271430 - DNA, 13 bp, Homo sapiens
gccccgactccag

SEQ ID NO: 1271431 - DNA, 19 bp, Homo sapiens
gccccgactccagccagcg

SEQ ID NO: 1271432 - DNA, 21 bp, Homo sapiens
gccccgactccagccagcgcc

SEQ ID NO: 1271433 - DNA, 15 bp, Homo sapiens
gccccgcacccccgc

SEQ ID NO: 1271434 - DNA, 16 bp, Homo sapiens
gccccgcacccccgcc

SEQ ID NO: 1271435 - DNA, 18 bp, Homo sapiens
gccccgcacccccgccag

SEQ ID NO: 1271436 - DNA, 20 bp, Homo sapiens
gccccgcacccccgccaggc

SEQ ID NO: 1271437 - DNA, 16 bp, Homo sapiens
gccccgccagggctgg

SEQ ID NO: 1271438 - DNA, 14 bp, Homo sapiens
gccccgccccacat

SEQ ID NO: 1271439 - DNA, 19 bp, Homo sapiens
gccccgccccccagagcca

SEQ ID NO: 1271440 - DNA, 21 bp, Homo sapiens
gccccgccccccagagccagg

SEQ ID NO: 1271441 - DNA, 23 bp, Homo sapiens
gccccgccccccagagccagggc

SEQ ID NO: 1271442 - DNA, 13 bp, Homo sapiens
gccccgcccccgc

SEQ ID NO: 1271443 - DNA, 15 bp, Homo sapiens
gccccgccccgttgt

SEQ ID NO: 1271444 - DNA, 16 bp, Homo sapiens
gccccgccctcttcct

SEQ ID NO: 1271445 - DNA, 14 bp, Homo sapiens
gccccgcctgacct

SEQ ID NO: 1271446 - DNA, 15 bp, Homo sapiens
gccccgcctgagtca

SEQ ID NO: 1271447 - DNA, 21 bp, Homo sapiens
gccccgccttcgtgtgctgct

SEQ ID NO: 1271448 - DNA, 22 bp, Homo sapiens
gccccgccttcgtgtgctgctg

SEQ ID NO: 1271449 - DNA, 22 bp, Homo sapiens
gccccgctcaggcctaggaggc

SEQ ID NO: 1271450 - DNA, 17 bp, Homo sapiens
gccccgctgagcttgga

SEQ ID NO: 1271451 - DNA, 13 bp, Homo sapiens
gccccgctgggat

SEQ ID NO: 1271452 - DNA, 14 bp, Homo sapiens
gccccgctgtgtcc

SEQ ID NO: 1271453 - DNA, 22 bp, Homo sapiens
gccccgctgtgtcctccctccc

SEQ ID NO: 1271454 - DNA, 14 bp, Homo sapiens
gccccgcttgtcca

SEQ ID NO: 1271455 - DNA, 19 bp, Homo sapiens
gccccgcttgtccagcgcc

SEQ ID NO: 1271456 - DNA, 20 bp, Homo sapiens
gccccgcttgtccagcgcct

SEQ ID NO: 1271457 - DNA, 16 bp, Homo sapiens
gccccggacctacctc

SEQ ID NO: 1271458 - DNA, 18 bp, Homo sapiens
gccccggaggaagcttgg

SEQ ID NO: 1271459 - DNA, 19 bp, Homo sapiens
gccccggaggaagcttggg

SEQ ID NO: 1271460 - DNA, 23 bp, Homo sapiens
gccccggatcagagcaggacctc

SEQ ID NO: 1271461 - DNA, 17 bp, Homo sapiens
gccccggcaagccacag

SEQ ID NO: 1271462 - DNA, 13 bp, Homo sapiens
gccccggccccgg

SEQ ID NO: 1271463 - DNA, 15 bp, Homo sapiens
gccccggccttgctt

SEQ ID NO: 1271464 - DNA, 13 bp, Homo sapiens
gccccgggatatt

SEQ ID NO: 1271465 - DNA, 22 bp, Homo sapiens
gccccgggatattatagaaaat

SEQ ID NO: 1271466 - DNA, 18 bp, Homo sapiens
gccccgggctctggccac

SEQ ID NO: 1271467 - DNA, 20 bp, Homo sapiens
gccccgggctctggccaccc

SEQ ID NO: 1271468 - DNA, 22 bp, Homo sapiens
gccccgggctctggccaccctg

SEQ ID NO: 1271469 - DNA, 19 bp, Homo sapiens
gccccgggctggccctgtg

SEQ ID NO: 1271470 - DNA, 13 bp, Homo sapiens
gccccggggctgg

SEQ ID NO: 1271471 - DNA, 16 bp, Homo sapiens
gccccggggctggcaa

SEQ ID NO: 1271472 - DNA, 17 bp, Homo sapiens
gccccggggctggcaag

SEQ ID NO: 1271473 - DNA, 19 bp, Homo sapiens
gccccggggctggcaagca

SEQ ID NO: 1271474 - DNA, 23 bp, Homo sapiens
gccccggggctggcaagcaggga

SEQ ID NO: 1271475 - DNA, 19 bp, Homo sapiens
gccccggggtgagtccatt

SEQ ID NO: 1271476 - DNA, 18 bp, Homo sapiens
gccccggtcacctagcaa

SEQ ID NO: 1271477 - DNA, 21 bp, Homo sapiens
gccccgtcggactgcccccag

SEQ ID NO: 1271478 - DNA, 22 bp, Homo sapiens
gccccgtcggactgcccccaga

SEQ ID NO: 1271479 - DNA, 16 bp, Homo sapiens
gccccgtgtgaatgta

SEQ ID NO: 1271480 - DNA, 23 bp, Homo sapiens
gccccgtgtgaatgtagcttcca

SEQ ID NO: 1271481 - DNA, 20 bp, Homo sapiens
gcccgggccgaccctgcggc

SEQ ID NO: 1271482 - DNA, 22 bp, Homo sapiens
gcccgggccgaccctgcggcct

SEQ ID NO: 1271483 - DNA, 23 bp, Homo sapiens
gcccgggccgaccctgcggcctc

SEQ ID NO: 1271484 - DNA, 17 bp, Homo sapiens
gcccgggctgcctgggc

SEQ ID NO: 1271485 - DNA, 23 bp, Homo sapiens
gcccgggctgcctgggctgttgg

SEQ ID NO: 1271486 - DNA, 17 bp, Homo sapiens
gcccggggcagctgcca

SEQ ID NO: 1271487 - DNA, 22 bp, Homo sapiens
gcccggggcagctgccagagaa

SEQ ID NO: 1271488 - DNA, 15 bp, Homo sapiens
gcccgtcctcctcta

SEQ ID NO: 1271489 - DNA, 14 bp, Homo sapiens
gcccgtcctgcctg

SEQ ID NO: 1271490 - DNA, 15 bp, Homo sapiens
gcccgtcctgcctgt

SEQ ID NO: 1271491 - DNA, 16 bp, Homo sapiens
gcccgtcctgcctgtg

SEQ ID NO: 1271492 - DNA, 13 bp, Homo sapiens
gcccgtcggagct

SEQ ID NO: 1271493 - DNA, 18 bp, Homo sapiens
gcccgtcggagctgcctg

SEQ ID NO: 1271494 - DNA, 19 bp, Homo sapiens
gcccgtcggagctgcctgc

SEQ ID NO: 1271495 - DNA, 13 bp, Homo sapiens
gcccgtgaagcag

SEQ ID NO: 1271496 - DNA, 22 bp, Homo sapiens
gcccgtgaagcagtgcctcgag

SEQ ID NO: 1271497 - DNA, 13 bp, Homo sapiens
gcccgtgacagac

SEQ ID NO: 1271498 - DNA, 19 bp, Homo sapiens
gcccgtgacagactcctga

SEQ ID NO: 1271499 - DNA, 21 bp, Homo sapiens
gcccgtgacagatgccaactt

SEQ ID NO: 1271500 - DNA, 21 bp, Homo sapiens
gcccgtgcccccgcctgccac

SEQ ID NO: 1271501 - DNA, 23 bp, Homo sapiens
gcccgtgcccccgcctgccaccg

SEQ ID NO: 1271502 - DNA, 18 bp, Homo sapiens
gcccgtggacaccccaga

SEQ ID NO: 1271503 - DNA, 20 bp, Homo sapiens
gcccgtggcttggcatctgt

SEQ ID NO: 1271504 - DNA, 17 bp, Homo sapiens
gcccgtggggtctgcgc

SEQ ID NO: 1271505 - DNA, 23 bp, Homo sapiens
gcccgtggggtctgcgcttggtc

SEQ ID NO: 1271506 - DNA, 16 bp, Homo sapiens
gcccgtgtggcccctt

SEQ ID NO: 1271507 - DNA, 17 bp, Homo sapiens
gcccgtgtggccccttc

SEQ ID NO: 1271508 - DNA, 18 bp, Homo sapiens
gcccgtgtggccccttca

SEQ ID NO: 1271509 - DNA, 15 bp, Homo sapiens
gcccgttagccccag

SEQ ID NO: 1271510 - DNA, 17 bp, Homo sapiens
gcccgttgaggatgagg

SEQ ID NO: 1271511 - DNA, 15 bp, Homo sapiens
gccctaaaagcacac

SEQ ID NO: 1271512 - DNA, 16 bp, Homo sapiens
gccctaagcccccagg

SEQ ID NO: 1271513 - DNA, 19 bp, Homo sapiens
gccctaagcccccagggcc

SEQ ID NO: 1271514 - DNA, 20 bp, Homo sapiens
gccctaagcccccagggcct

SEQ ID NO: 1271515 - DNA, 23 bp, Homo sapiens
gccctaagcccccagggcctcca

SEQ ID NO: 1271516 - DNA, 13 bp, Homo sapiens
gccctaagcctgt

SEQ ID NO: 1271517 - DNA, 15 bp, Homo sapiens
gccctaagcctgtcc

SEQ ID NO: 1271518 - DNA, 17 bp, Homo sapiens
gccctaagcctgtcccc

SEQ ID NO: 1271519 - DNA, 18 bp, Homo sapiens
gccctaagcctgtcccca

SEQ ID NO: 1271520 - DNA, 21 bp, Homo sapiens
gccctaagcctgtccccagac

SEQ ID NO: 1271521 - DNA, 22 bp, Homo sapiens
gccctaagtgatttccacaggt

SEQ ID NO: 1271522 - DNA, 15 bp, Homo sapiens
gccctacaccttgag

SEQ ID NO: 1271523 - DNA, 20 bp, Homo sapiens
gccctacagagctgtggagg

SEQ ID NO: 1271524 - DNA, 16 bp, Homo sapiens
gccctacagaggtctc

SEQ ID NO: 1271525 - DNA, 21 bp, Homo sapiens
gccctaccagcgcccgctggg

SEQ ID NO: 1271526 - DNA, 22 bp, Homo sapiens
gccctaccagcgcccgctgggc

SEQ ID NO: 1271527 - DNA, 14 bp, Homo sapiens
gccctactccactg

SEQ ID NO: 1271528 - DNA, 15 bp, Homo sapiens
gccctactccactgc

SEQ ID NO: 1271529 - DNA, 22 bp, Homo sapiens
gccctactccactgccctggca

SEQ ID NO: 1271530 - DNA, 16 bp, Homo sapiens
gccctactccctgcag

SEQ ID NO: 1271531 - DNA, 20 bp, Homo sapiens
gccctactccctgcagatgc

SEQ ID NO: 1271532 - DNA, 22 bp, Homo sapiens
gccctactcctgcggctgcctg

SEQ ID NO: 1271533 - DNA, 15 bp, Homo sapiens
gccctagctgtccca

SEQ ID NO: 1271534 - DNA, 13 bp, Homo sapiens
gccctatggatgt

SEQ ID NO: 1271535 - DNA, 19 bp, Homo sapiens
gccctatgggcctgccggg

SEQ ID NO: 1271536 - DNA, 21 bp, Homo sapiens
gccctatttagatgataaaga

SEQ ID NO: 1271537 - DNA, 15 bp, Homo sapiens
gccctcaatcccagc

SEQ ID NO: 1271538 - DNA, 19 bp, Homo sapiens
gccctcaccaccacactac

SEQ ID NO: 1271539 - DNA, 15 bp, Homo sapiens
gccctcacctctgag

SEQ ID NO: 1271540 - DNA, 20 bp, Homo sapiens
gccctcacctctgaggacag

SEQ ID NO: 1271541 - DNA, 20 bp, Homo sapiens
gccctcacctgcagagaaac

SEQ ID NO: 1271542 - DNA, 20 bp, Homo sapiens
gccctcactccctctgcaga

SEQ ID NO: 1271543 - DNA, 23 bp, Homo sapiens
gccctcagacatctccagtgtgc

SEQ ID NO: 1271544 - DNA, 21 bp, Homo sapiens
gccctcagagctcttgctgtt

SEQ ID NO: 1271545 - DNA, 13 bp, Homo sapiens
gccctcaggccat

SEQ ID NO: 1271546 - DNA, 18 bp, Homo sapiens
gccctcaggggcctctct

SEQ ID NO: 1271547 - DNA, 20 bp, Homo sapiens
gccctcaggggcctctctcc

SEQ ID NO: 1271548 - DNA, 23 bp, Homo sapiens
gccctcagtagtccctgcacagt

SEQ ID NO: 1271549 - DNA, 14 bp, Homo sapiens
gccctcagtcaccc

SEQ ID NO: 1271550 - DNA, 16 bp, Homo sapiens
gccctcatcccacttc

SEQ ID NO: 1271551 - DNA, 19 bp, Homo sapiens
gccctcatgggtcctagcc

SEQ ID NO: 1271552 - DNA, 22 bp, Homo sapiens
gccctcatgggtcctagccctt

SEQ ID NO: 1271553 - DNA, 15 bp, Homo sapiens
gccctccaaaagcac

SEQ ID NO: 1271554 - DNA, 20 bp, Homo sapiens
gccctccacagccgcagcct

SEQ ID NO: 1271555 - DNA, 23 bp, Homo sapiens
gccctccacagccgcagcctccc

SEQ ID NO: 1271556 - DNA, 17 bp, Homo sapiens
gccctccagtgggctga

SEQ ID NO: 1271557 - DNA, 14 bp, Homo sapiens
gccctccatgggct

SEQ ID NO: 1271558 - DNA, 16 bp, Homo sapiens
gccctccatgggctag

SEQ ID NO: 1271559 - DNA, 17 bp, Homo sapiens
gccctccatggtcctgt

SEQ ID NO: 1271560 - DNA, 13 bp, Homo sapiens
gccctcccaccac

SEQ ID NO: 1271561 - DNA, 16 bp, Homo sapiens
gccctcccaccacccc

SEQ ID NO: 1271562 - DNA, 14 bp, Homo sapiens
gccctcccactttg

SEQ ID NO: 1271563 - DNA, 14 bp, Homo sapiens
gccctcccagccca

SEQ ID NO: 1271564 - DNA, 21 bp, Homo sapiens
gccctcccatgttgcatgcct

SEQ ID NO: 1271565 - DNA, 12 bp, Homo sapiens
gccctccccaca

SEQ ID NO: 1271566 - DNA, 15 bp, Homo sapiens
gccctccccagagca

SEQ ID NO: 1271567 - DNA, 16 bp, Homo sapiens
gccctccccagagcac

SEQ ID NO: 1271568 - DNA, 18 bp, Homo sapiens
gccctccccatggagcca

SEQ ID NO: 1271569 - DNA, 16 bp, Homo sapiens
gccctcccccagctcc

SEQ ID NO: 1271570 - DNA, 17 bp, Homo sapiens
gccctccccccagctcc

SEQ ID NO: 1271571 - DNA, 18 bp, Homo sapiens
gccctccccccagctccc

SEQ ID NO: 1271572 - DNA, 16 bp, Homo sapiens
gccctcccctcagcgc

SEQ ID NO: 1271573 - DNA, 18 bp, Homo sapiens
gccctcccctctctgcac

SEQ ID NO: 1271574 - DNA, 16 bp, Homo sapiens
gccctcccgcaccttc

SEQ ID NO: 1271575 - DNA, 20 bp, Homo sapiens
gccctcccgcaccttcctcc

SEQ ID NO: 1271576 - DNA, 14 bp, Homo sapiens
gccctccctcagcg

SEQ ID NO: 1271577 - DNA, 23 bp, Homo sapiens
gccctccctcggccccacccacc

SEQ ID NO: 1271578 - DNA, 20 bp, Homo sapiens
gccctccctctactcttcct

SEQ ID NO: 1271579 - DNA, 21 bp, Homo sapiens
gccctccctctactcttcctg

SEQ ID NO: 1271580 - DNA, 23 bp, Homo sapiens
gccctccctctactcttcctgtc

SEQ ID NO: 1271581 - DNA, 20 bp, Homo sapiens
gccctccctgactccctgtg

SEQ ID NO: 1271582 - DNA, 15 bp, Homo sapiens
gccctccctgcccct

SEQ ID NO: 1271583 - DNA, 20 bp, Homo sapiens
gccctccctgtctccagggc

SEQ ID NO: 1271584 - DNA, 19 bp, Homo sapiens
gccctcccttggaaacctg

SEQ ID NO: 1271585 - DNA, 21 bp, Homo sapiens
gccctcccttggaaacctgcc

SEQ ID NO: 1271586 - DNA, 16 bp, Homo sapiens
gccctccgacctctct

SEQ ID NO: 1271587 - DNA, 18 bp, Homo sapiens
gccctccgacctctctcg

SEQ ID NO: 1271588 - DNA, 12 bp, Homo sapiens
gccctccgcctg

SEQ ID NO: 1271589 - DNA, 17 bp, Homo sapiens
gccctccggaggagcag

SEQ ID NO: 1271590 - DNA, 14 bp, Homo sapiens
gccctcctcacccc

SEQ ID NO: 1271591 - DNA, 21 bp, Homo sapiens
gccctcctcaccccgtctggg

SEQ ID NO: 1271592 - DNA, 14 bp, Homo sapiens
gccctcctccactt

SEQ ID NO: 1271593 - DNA, 17 bp, Homo sapiens
gccctcctctcccattg

SEQ ID NO: 1271594 - DNA, 23 bp, Homo sapiens
gccctcctgaaacttacacacaa

SEQ ID NO: 1271595 - DNA, 16 bp, Homo sapiens
gccctcctttccctta

SEQ ID NO: 1271596 - DNA, 20 bp, Homo sapiens
gccctcctttctgtgcccta

SEQ ID NO: 1271597 - DNA, 17 bp, Homo sapiens
gccctcgaaccaaggca

SEQ ID NO: 1271598 - DNA, 21 bp, Homo sapiens
gccctcgaaccaaggcagcct

SEQ ID NO: 1271599 - DNA, 13 bp, Homo sapiens
gccctcgacactc

SEQ ID NO: 1271600 - DNA, 17 bp, Homo sapiens
gccctcggagctggctg

SEQ ID NO: 1271601 - DNA, 13 bp, Homo sapiens
gccctcggcctcc

SEQ ID NO: 1271602 - DNA, 16 bp, Homo sapiens
gccgcctcccacggca

SEQ ID NO: 1271603 - DNA, 12 bp, Homo sapiens
gccgcctcccag

SEQ ID NO: 1271604 - DNA, 14 bp, Homo sapiens
gccgcctcccagcc

SEQ ID NO: 1271605 - DNA, 15 bp, Homo sapiens
gccgcctcccagcct

SEQ ID NO: 1271606 - DNA, 16 bp, Homo sapiens
gccgcctcccagcctg

SEQ ID NO: 1271607 - DNA, 19 bp, Homo sapiens
gccgcctcccagcctgggg

SEQ ID NO: 1271608 - DNA, 16 bp, Homo sapiens
gccgcctgccctgcct

SEQ ID NO: 1271609 - DNA, 13 bp, Homo sapiens
gccgcctgcctta

SEQ ID NO: 1271610 - DNA, 12 bp, Homo sapiens
gccgcctgctcc

SEQ ID NO: 1271611 - DNA, 13 bp, Homo sapiens
gccgcctgctcct

SEQ ID NO: 1271612 - DNA, 16 bp, Homo sapiens
gccgccttctcccctc

SEQ ID NO: 1271613 - DNA, 19 bp, Homo sapiens
gccgccttctcccctctcc

SEQ ID NO: 1271614 - DNA, 21 bp, Homo sapiens
gccgccttctcccctctccca

SEQ ID NO: 1271615 - DNA, 15 bp, Homo sapiens
gccgcggagcctgca

SEQ ID NO: 1271616 - DNA, 16 bp, Homo sapiens
gccgcggcctccccga

SEQ ID NO: 1271617 - DNA, 21 bp, Homo sapiens
gccgcggtaggtaagggccgc

SEQ ID NO: 1271618 - DNA, 14 bp, Homo sapiens
gccgcgtgtgcgtg

SEQ ID NO: 1271619 - DNA, 15 bp, Homo sapiens
gccgctacctccctc

SEQ ID NO: 1271620 - DNA, 17 bp, Homo sapiens
gccgctacctccctccc

SEQ ID NO: 1271621 - DNA, 18 bp, Homo sapiens
gccgctagaggcctgagg

SEQ ID NO: 1271622 - DNA, 18 bp, Homo sapiens
gccgctaggagagactga

SEQ ID NO: 1271623 - DNA, 24 bp, Homo sapiens
gccgctccccttggacctccaggg

SEQ ID NO: 1271624 - DNA, 22 bp, Homo sapiens
gccgctcctccctgctcctcat

SEQ ID NO: 1271625 - DNA, 14 bp, Homo sapiens
gccgctcctgcttc

SEQ ID NO: 1271626 - DNA, 15 bp, Homo sapiens
gccgctcctgcttcc

SEQ ID NO: 1271627 - DNA, 16 bp, Homo sapiens
gccgctcctgcttccc

SEQ ID NO: 1271628 - DNA, 20 bp, Homo sapiens
gccgctcctgcttcccctcc

SEQ ID NO: 1271629 - DNA, 15 bp, Homo sapiens
gccgctgagcgagga

SEQ ID NO: 1271630 - DNA, 15 bp, Homo sapiens
gccgctgccgctgca

SEQ ID NO: 1271631 - DNA, 16 bp, Homo sapiens
gccgctgtcaaggccg

SEQ ID NO: 1271632 - DNA, 18 bp, Homo sapiens
gccgctgtgtagggacca

SEQ ID NO: 1271633 - DNA, 21 bp, Homo sapiens
gccgcttagtgctgctttgct

SEQ ID NO: 1271634 - DNA, 23 bp, Homo sapiens
gccggaatagagcctcgtctggc

SEQ ID NO: 1271635 - DNA, 13 bp, Homo sapiens
gccggacaccaag

SEQ ID NO: 1271636 - DNA, 21 bp, Homo sapiens
gccggacccccgtcagctgct

SEQ ID NO: 1271637 - DNA, 13 bp, Homo sapiens
gccggacctctga

SEQ ID NO: 1271638 - DNA, 14 bp, Homo sapiens
gccggacctctgag

SEQ ID NO: 1271639 - DNA, 15 bp, Homo sapiens
gccggacgcatctca

SEQ ID NO: 1271640 - DNA, 19 bp, Homo sapiens
gccggaggccttggggtgg

SEQ ID NO: 1271641 - DNA, 17 bp, Homo sapiens
gccggatctgagggaga

SEQ ID NO: 1271642 - DNA, 18 bp, Homo sapiens
gccggcaaccccagttct

SEQ ID NO: 1271643 - DNA, 19 bp, Homo sapiens
gccggcaaccccagttctg

SEQ ID NO: 1271644 - DNA, 20 bp, Homo sapiens
gccggcaaccccagttctgc

SEQ ID NO: 1271645 - DNA, 23 bp, Homo sapiens
gccggcaaccccagttctgctcc

SEQ ID NO: 1271646 - DNA, 17 bp, Homo sapiens
gccggcatccttgcctg

SEQ ID NO: 1271647 - DNA, 12 bp, Homo sapiens
gccggcccagat

SEQ ID NO: 1271648 - DNA, 19 bp, Homo sapiens
gccggcccagatgtgtccc

SEQ ID NO: 1271649 - DNA, 15 bp, Homo sapiens
gccggccccccctct

SEQ ID NO: 1271650 - DNA, 21 bp, Homo sapiens
gccggccggacctctgagcac

SEQ ID NO: 1271651 - DNA, 15 bp, Homo sapiens
gccggcctctctggc

SEQ ID NO: 1271652 - DNA, 13 bp, Homo sapiens
gccggcctctgct

SEQ ID NO: 1271653 - DNA, 16 bp, Homo sapiens
gccggcctctgctgcc

SEQ ID NO: 1271654 - DNA, 18 bp, Homo sapiens
gccggcctctgctgcccc

SEQ ID NO: 1271655 - DNA, 19 bp, Homo sapiens
gccggcctctgctgccccc

SEQ ID NO: 1271656 - DNA, 20 bp, Homo sapiens
gccggcctctgctgccccct

SEQ ID NO: 1271657 - DNA, 16 bp, Homo sapiens
gccggcgagggggccg

SEQ ID NO: 1271658 - DNA, 17 bp, Homo sapiens
gccggcggctactctgg

SEQ ID NO: 1271659 - DNA, 17 bp, Homo sapiens
gccggcggctctgagca

SEQ ID NO: 1271660 - DNA, 23 bp, Homo sapiens
gccggcggctctgagcaggggca

SEQ ID NO: 1271661 - DNA, 13 bp, Homo sapiens
gccggctggaaat

SEQ ID NO: 1271662 - DNA, 20 bp, Homo sapiens
gccggctggcctggaggctc

SEQ ID NO: 1271663 - DNA, 18 bp, Homo sapiens
gccgggaccaccctgagc

SEQ ID NO: 1271664 - DNA, 22 bp, Homo sapiens
gccgggaccaccctgagccggc

SEQ ID NO: 1271665 - DNA, 18 bp, Homo sapiens
gccgggagaagccacctt

SEQ ID NO: 1271666 - DNA, 20 bp, Homo sapiens
gccgggatggttcttctcca

SEQ ID NO: 1271667 - DNA, 20 bp, Homo sapiens
gccgggcacagccctcagcg

SEQ ID NO: 1271668 - DNA, 13 bp, Homo sapiens
gccgggcaggcct

SEQ ID NO: 1271669 - DNA, 14 bp, Homo sapiens
gccgggcaggcctg

SEQ ID NO: 1271670 - DNA, 14 bp, Homo sapiens
gccgggcaggtcct

SEQ ID NO: 1271671 - DNA, 13 bp, Homo sapiens
gccgggcgcagtg

SEQ ID NO: 1271672 - DNA, 19 bp, Homo sapiens
gccgggcgccaggacagca

SEQ ID NO: 1271673 - DNA, 14 bp, Homo sapiens
gccgggcgcggtgg

SEQ ID NO: 1271674 - DNA, 12 bp, Homo sapiens
gccggggagggg

SEQ ID NO: 1271675 - DNA, 23 bp, Homo sapiens
gccggggccttatcgggctccag

SEQ ID NO: 1271676 - DNA, 13 bp, Homo sapiens
gccgggggagggg

SEQ ID NO: 1271677 - DNA, 20 bp, Homo sapiens
gccgggggaggggccctcag

SEQ ID NO: 1271678 - DNA, 19 bp, Homo sapiens
gccggggggggtaggagag

SEQ ID NO: 1271679 - DNA, 22 bp, Homo sapiens
gccgggggttcataggtcactg

SEQ ID NO: 1271680 - DNA, 19 bp, Homo sapiens
gccggggtgtaacttcctg

SEQ ID NO: 1271681 - DNA, 23 bp, Homo sapiens
gccggggtgtaacttcctgctgc

SEQ ID NO: 1271682 - DNA, 21 bp, Homo sapiens
gccgggtctgcctcttctggg

SEQ ID NO: 1271683 - DNA, 13 bp, Homo sapiens
gccgggtgcggtg

SEQ ID NO: 1271684 - DNA, 16 bp, Homo sapiens
gccggtaactgtcctg

SEQ ID NO: 1271685 - DNA, 17 bp, Homo sapiens
gccggtaactgtcctgt

SEQ ID NO: 1271686 - DNA, 17 bp, Homo sapiens
gccggtcacccaggctc

SEQ ID NO: 1271687 - DNA, 16 bp, Homo sapiens
gccggtccggcgcccc

SEQ ID NO: 1271688 - DNA, 19 bp, Homo sapiens
gccggtccggcgccccgca

SEQ ID NO: 1271689 - DNA, 22 bp, Homo sapiens
gccggtcgggcagccagcagag

SEQ ID NO: 1271690 - DNA, 18 bp, Homo sapiens
gccggtgaggggaggggc

SEQ ID NO: 1271691 - DNA, 20 bp, Homo sapiens
gccggtgggaccctgtccgg

SEQ ID NO: 1271692 - DNA, 15 bp, Homo sapiens
gccggtgtccctgga

SEQ ID NO: 1271693 - DNA, 16 bp, Homo sapiens
gccggtgtccctggat

SEQ ID NO: 1271694 - DNA, 15 bp, Homo sapiens
gccgtaccccaccct

SEQ ID NO: 1271695 - DNA, 18 bp, Homo sapiens
gccgtaccccaccctcag

SEQ ID NO: 1271696 - DNA, 22 bp, Homo sapiens
gccgtaccccaccctcagcacc

SEQ ID NO: 1271697 - DNA, 20 bp, Homo sapiens
gccgtagggagtacctgctg

SEQ ID NO: 1271698 - DNA, 13 bp, Homo sapiens
gccgtcaccacca

SEQ ID NO: 1271699 - DNA, 17 bp, Homo sapiens
gccgtcaccaccacccc

SEQ ID NO: 1271700 - DNA, 18 bp, Homo sapiens
gccgtcaccaccacccct

SEQ ID NO: 1271701 - DNA, 18 bp, Homo sapiens
gccgtcagccaaatgtaa

SEQ ID NO: 1271702 - DNA, 16 bp, Homo sapiens
gccgtccatggcacca

SEQ ID NO: 1271703 - DNA, 20 bp, Homo sapiens
gccgtccatggcaccagccc

SEQ ID NO: 1271704 - DNA, 23 bp, Homo sapiens
gccgtccatggcaccagccccct

SEQ ID NO: 1271705 - DNA, 20 bp, Homo sapiens
gccgtcccaggccaccccca

SEQ ID NO: 1271706 - DNA, 19 bp, Homo sapiens
gccgtcctcccgggccctc

SEQ ID NO: 1271707 - DNA, 17 bp, Homo sapiens
gccgtccttgtctctgg

SEQ ID NO: 1271708 - DNA, 14 bp, Homo sapiens
gccgtctccagggg

SEQ ID NO: 1271709 - DNA, 21 bp, Homo sapiens
gccgtctccaggggctgcttc

SEQ ID NO: 1271710 - DNA, 15 bp, Homo sapiens
gccgtctctcctgct

SEQ ID NO: 1271711 - DNA, 21 bp, Homo sapiens
gccgtctgactccagagtctg

SEQ ID NO: 1271712 - DNA, 16 bp, Homo sapiens
gccgtctgcaggggcc

SEQ ID NO: 1271713 - DNA, 22 bp, Homo sapiens
gccgtctgtgtggtggagccag

SEQ ID NO: 1271714 - DNA, 21 bp, Homo sapiens
gccgtcttcactcgcccccgg

SEQ ID NO: 1271715 - DNA, 16 bp, Homo sapiens
gccgtgaactgtgcat

SEQ ID NO: 1271716 - DNA, 13 bp, Homo sapiens
gccgtgacctatt

SEQ ID NO: 1271717 - DNA, 17 bp, Homo sapiens
gccgtgcatggctcctg

SEQ ID NO: 1271718 - DNA, 21 bp, Homo sapiens
gccgtgcatggctcctgtctg

SEQ ID NO: 1271719 - DNA, 15 bp, Homo sapiens
gccgtgcccaggggc

SEQ ID NO: 1271720 - DNA, 15 bp, Homo sapiens
gccgtgccttcagct

SEQ ID NO: 1271721 - DNA, 17 bp, Homo sapiens
gccgtgccttcagctct

SEQ ID NO: 1271722 - DNA, 15 bp, Homo sapiens
gccgtgctgggcagc

SEQ ID NO: 1271723 - DNA, 17 bp, Homo sapiens
gccgtgctgggcagccc

SEQ ID NO: 1271724 - DNA, 17 bp, Homo sapiens
gcctctcttgccccttg

SEQ ID NO: 1271725 - DNA, 19 bp, Homo sapiens
gcctctgaagttggacagc

SEQ ID NO: 1271726 - DNA, 20 bp, Homo sapiens
gcctctgacagcagcctgtg

SEQ ID NO: 1271727 - DNA, 22 bp, Homo sapiens
gcctctgacagcagcctgtgag

SEQ ID NO: 1271728 - DNA, 23 bp, Homo sapiens
gcctctgacagcagcctgtgagg

SEQ ID NO: 1271729 - DNA, 15 bp, Homo sapiens
gcctctgacagtcca

SEQ ID NO: 1271730 - DNA, 14 bp, Homo sapiens
gcctctgaccccag

SEQ ID NO: 1271731 - DNA, 24 bp, Homo sapiens
gcctctgactctgagtccactgct

SEQ ID NO: 1271732 - DNA, 17 bp, Homo sapiens
gcctctgcaaaggaaat

SEQ ID NO: 1271733 - DNA, 17 bp, Homo sapiens
gcctctgcaactgctca

SEQ ID NO: 1271734 - DNA, 12 bp, Homo sapiens
gcctctgcattc

SEQ ID NO: 1271735 - DNA, 16 bp, Homo sapiens
gcctctgccagcgcca

SEQ ID NO: 1271736 - DNA, 20 bp, Homo sapiens
gcctctgcccaagcagcctg

SEQ ID NO: 1271737 - DNA, 17 bp, Homo sapiens
gcctctgcccgcagagc

SEQ ID NO: 1271738 - DNA, 16 bp, Homo sapiens
gcctctgccctgcctc

SEQ ID NO: 1271739 - DNA, 17 bp, Homo sapiens
gcctctgccctgcctcc

SEQ ID NO: 1271740 - DNA, 13 bp, Homo sapiens
gcctctgcctggg

SEQ ID NO: 1271741 - DNA, 17 bp, Homo sapiens
gcctctgcctggggcct

SEQ ID NO: 1271742 - DNA, 13 bp, Homo sapiens
gcctctgcctgtc

SEQ ID NO: 1271743 - DNA, 13 bp, Homo sapiens
gcctctgctccct

SEQ ID NO: 1271744 - DNA, 16 bp, Homo sapiens
gcctctgctccctctg

SEQ ID NO: 1271745 - DNA, 12 bp, Homo sapiens
gcctctgctgaa

SEQ ID NO: 1271746 - DNA, 18 bp, Homo sapiens
gcctctgctgaatgcagg

SEQ ID NO: 1271747 - DNA, 13 bp, Homo sapiens
gcctctgctgccc

SEQ ID NO: 1271748 - DNA, 16 bp, Homo sapiens
gcctctgcttactttt

SEQ ID NO: 1271749 - DNA, 16 bp, Homo sapiens
gcctctggaaaactat

SEQ ID NO: 1271750 - DNA, 17 bp, Homo sapiens
gcctctggaaaactatt

SEQ ID NO: 1271751 - DNA, 16 bp, Homo sapiens
gcctctggacagccag

SEQ ID NO: 1271752 - DNA, 20 bp, Homo sapiens
gcctctggacagccagtgac

SEQ ID NO: 1271753 - DNA, 22 bp, Homo sapiens
gcctctggacagccagtgacct

SEQ ID NO: 1271754 - DNA, 21 bp, Homo sapiens
gcctctggactggcctgtctg

SEQ ID NO: 1271755 - DNA, 21 bp, Homo sapiens
gcctctggaggcctctggccc

SEQ ID NO: 1271756 - DNA, 14 bp, Homo sapiens
gcctctggcccctc

SEQ ID NO: 1271757 - DNA, 13 bp, Homo sapiens
gcctctggccctc

SEQ ID NO: 1271758 - DNA, 16 bp, Homo sapiens
gcctctggccgccacc

SEQ ID NO: 1271759 - DNA, 17 bp, Homo sapiens
gcctctggccgccaccc

SEQ ID NO: 1271760 - DNA, 13 bp, Homo sapiens
gcctctggctaga

SEQ ID NO: 1271761 - DNA, 22 bp, Homo sapiens
gcctctggcttccctaaactgc

SEQ ID NO: 1271762 - DNA, 14 bp, Homo sapiens
gcctctgggcagcc

SEQ ID NO: 1271763 - DNA, 21 bp, Homo sapiens
gcctctgggcagcctgctttg

SEQ ID NO: 1271764 - DNA, 22 bp, Homo sapiens
gcctctgggcagcctgctttgg

SEQ ID NO: 1271765 - DNA, 17 bp, Homo sapiens
gcctctggttgcctccc

SEQ ID NO: 1271766 - DNA, 19 bp, Homo sapiens
gcctctggttgcctccccc

SEQ ID NO: 1271767 - DNA, 15 bp, Homo sapiens
gcctctgtcctccca

SEQ ID NO: 1271768 - DNA, 17 bp, Homo sapiens
gcctctgtcctcccatc

SEQ ID NO: 1271769 - DNA, 18 bp, Homo sapiens
gcctctgtcctcccatcc

SEQ ID NO: 1271770 - DNA, 23 bp, Homo sapiens
gcctctgtcctcccatcccctca

SEQ ID NO: 1271771 - DNA, 19 bp, Homo sapiens
gcctctgtgattacataga

SEQ ID NO: 1271772 - DNA, 20 bp, Homo sapiens
gcctctgtgcacagtggctt

SEQ ID NO: 1271773 - DNA, 22 bp, Homo sapiens
gcctctgtgcacagtggcttct

SEQ ID NO: 1271774 - DNA, 20 bp, Homo sapiens
gcctctgtggaagagattcc

SEQ ID NO: 1271775 - DNA, 21 bp, Homo sapiens
gcctctgtggagccccagcat

SEQ ID NO: 1271776 - DNA, 18 bp, Homo sapiens
gcctcttaaagctgcctg

SEQ ID NO: 1271777 - DNA, 22 bp, Homo sapiens
gcctcttaaagctgcctgtagt

SEQ ID NO: 1271778 - DNA, 23 bp, Homo sapiens
gcctcttaaagctgcctgtagtt

SEQ ID NO: 1271779 - DNA, 15 bp, Homo sapiens
gcctcttacttgcca

SEQ ID NO: 1271780 - DNA, 20 bp, Homo sapiens
gcctcttagtgattgtgtct

SEQ ID NO: 1271781 - DNA, 14 bp, Homo sapiens
gcctcttccaccca

SEQ ID NO: 1271782 - DNA, 14 bp, Homo sapiens
gcctcttccagtga

SEQ ID NO: 1271783 - DNA, 18 bp, Homo sapiens
gcctcttcctctgggcag

SEQ ID NO: 1271784 - DNA, 14 bp, Homo sapiens
gcctcttcctgttg

SEQ ID NO: 1271785 - DNA, 15 bp, Homo sapiens
gcctcttctacttgt

SEQ ID NO: 1271786 - DNA, 20 bp, Homo sapiens
gcctcttctacttgtaaaat

SEQ ID NO: 1271787 - DNA, 19 bp, Homo sapiens
gcctcttctcttgacagtc

SEQ ID NO: 1271788 - DNA, 22 bp, Homo sapiens
gcctcttctgaagatggaaggc

SEQ ID NO: 1271789 - DNA, 15 bp, Homo sapiens
gcctcttctgggagg

SEQ ID NO: 1271790 - DNA, 20 bp, Homo sapiens
gcctcttcttcttcagaaga

SEQ ID NO: 1271791 - DNA, 21 bp, Homo sapiens
gcctcttcttcttcagaagac

SEQ ID NO: 1271792 - DNA, 17 bp, Homo sapiens
gcctcttgaccaggctg

SEQ ID NO: 1271793 - DNA, 20 bp, Homo sapiens
gcctcttgagcagtggctgg

SEQ ID NO: 1271794 - DNA, 18 bp, Homo sapiens
gcctcttgagttcctctg

SEQ ID NO: 1271795 - DNA, 16 bp, Homo sapiens
gcctcttgcaggctga

SEQ ID NO: 1271796 - DNA, 20 bp, Homo sapiens
gcctcttgcccgtcggccct

SEQ ID NO: 1271797 - DNA, 18 bp, Homo sapiens
gcctcttggacctctgct

SEQ ID NO: 1271798 - DNA, 22 bp, Homo sapiens
gcctcttggataccagctcagg

SEQ ID NO: 1271799 - DNA, 13 bp, Homo sapiens
gcctcttggcttc

SEQ ID NO: 1271800 - DNA, 14 bp, Homo sapiens
gcctcttggcttct

SEQ ID NO: 1271801 - DNA, 16 bp, Homo sapiens
gcctcttgtaaagact

SEQ ID NO: 1271802 - DNA, 17 bp, Homo sapiens
gcctcttgtaaagactg

SEQ ID NO: 1271803 - DNA, 18 bp, Homo sapiens
gcctcttgtaaagactgg

SEQ ID NO: 1271804 - DNA, 17 bp, Homo sapiens
gcctcttgtgctcacgc

SEQ ID NO: 1271805 - DNA, 23 bp, Homo sapiens
gcctctttcatccactagtgcaa

SEQ ID NO: 1271806 - DNA, 18 bp, Homo sapiens
gcctcttttccctctcta

SEQ ID NO: 1271807 - DNA, 15 bp, Homo sapiens
gcctctttttccttc

SEQ ID NO: 1271808 - DNA, 22 bp, Homo sapiens
gcctctttttccttcttcagca

SEQ ID NO: 1271809 - DNA, 13 bp, Homo sapiens
gcctgaaacagcc

SEQ ID NO: 1271810 - DNA, 16 bp, Homo sapiens
gcctgaaagccacaat

SEQ ID NO: 1271811 - DNA, 20 bp, Homo sapiens
gcctgaacagaagctcttac

SEQ ID NO: 1271812 - DNA, 14 bp, Homo sapiens
gcctgaacatcctt

SEQ ID NO: 1271813 - DNA, 23 bp, Homo sapiens
gcctgaacccgtccattcagaaa

SEQ ID NO: 1271814 - DNA, 15 bp, Homo sapiens
gcctgaactgaggag

SEQ ID NO: 1271815 - DNA, 17 bp, Homo sapiens
gcctgaagctggcctgg

SEQ ID NO: 1271816 - DNA, 16 bp, Homo sapiens
gcctgaataaagagcc

SEQ ID NO: 1271817 - DNA, 20 bp, Homo sapiens
gcctgacaaccactggtctg

SEQ ID NO: 1271818 - DNA, 21 bp, Homo sapiens
gcctgacactgagccccacct

SEQ ID NO: 1271819 - DNA, 16 bp, Homo sapiens
gcctgacttgagccac

SEQ ID NO: 1271820 - DNA, 19 bp, Homo sapiens
gcctgagaagaagtggctg

SEQ ID NO: 1271821 - DNA, 20 bp, Homo sapiens
gcctgagaagaagtggctgc

SEQ ID NO: 1271822 - DNA, 18 bp, Homo sapiens
gcctgagaagccccgaca

SEQ ID NO: 1271823 - DNA, 13 bp, Homo sapiens
gcctgagacagca

SEQ ID NO: 1271824 - DNA, 14 bp, Homo sapiens
gcctgagacagcac

SEQ ID NO: 1271825 - DNA, 13 bp, Homo sapiens
gcctgagaggcag

SEQ ID NO: 1271826 - DNA, 16 bp, Homo sapiens
gcctgagaggcaggca

SEQ ID NO: 1271827 - DNA, 20 bp, Homo sapiens
gcctgagaggcaggcataga

SEQ ID NO: 1271828 - DNA, 17 bp, Homo sapiens
gcctgagatgcaggtga

SEQ ID NO: 1271829 - DNA, 14 bp, Homo sapiens
gcctgagctcactc

SEQ ID NO: 1271830 - DNA, 14 bp, Homo sapiens
gcctgaggatgagc

SEQ ID NO: 1271831 - DNA, 20 bp, Homo sapiens
gcctgaggatgagctggaag

SEQ ID NO: 1271832 - DNA, 17 bp, Homo sapiens
gcctgaggcaggagaat

SEQ ID NO: 1271833 - DNA, 13 bp, Homo sapiens
gcctgaggctgag

SEQ ID NO: 1271834 - DNA, 15 bp, Homo sapiens
gcctgagggcccctc

SEQ ID NO: 1271835 - DNA, 23 bp, Homo sapiens
gcctgagggcgaggggagggtgg

SEQ ID NO: 1271836 - DNA, 15 bp, Homo sapiens
gcctgagtcagtgct

SEQ ID NO: 1271837 - DNA, 16 bp, Homo sapiens
gcctgagtcagtgctc

SEQ ID NO: 1271838 - DNA, 17 bp, Homo sapiens
gcctgatactttagcca

SEQ ID NO: 1271839 - DNA, 21 bp, Homo sapiens
gcctgatactttagccatcat

SEQ ID NO: 1271840 - DNA, 15 bp, Homo sapiens
gcctgatataaatgc

SEQ ID NO: 1271841 - DNA, 20 bp, Homo sapiens
gcctgatcagaccacggctc

SEQ ID NO: 1271842 - DNA, 21 bp, Homo sapiens
gcctgatcttgcctgtctggc

SEQ ID NO: 1271843 - DNA, 14 bp, Homo sapiens
gcctgatgctccct

SEQ ID NO: 1271844 - DNA, 14 bp, Homo sapiens
gcctgatgctgccc

SEQ ID NO: 1271845 - DNA, 15 bp, Homo sapiens
gcctgatggccaagg

SEQ ID NO: 1271846 - DNA, 11 bp, Homo sapiens
gcctgggcagc

SEQ ID NO: 1271847 - DNA, 19 bp, Homo sapiens
gcctgggcagcatagcaag

SEQ ID NO: 1271848 - DNA, 18 bp, Homo sapiens
gcctgggcagccaggctg

SEQ ID NO: 1271849 - DNA, 13 bp, Homo sapiens
gcctgggcagccc

SEQ ID NO: 1271850 - DNA, 18 bp, Homo sapiens
gcctgggcagccccacag

SEQ ID NO: 1271851 - DNA, 15 bp, Homo sapiens
gcctgggcagcttct

SEQ ID NO: 1271852 - DNA, 13 bp, Homo sapiens
gcctgggccacac

SEQ ID NO: 1271853 - DNA, 17 bp, Homo sapiens
gcctgggccacacctga

SEQ ID NO: 1271854 - DNA, 20 bp, Homo sapiens
gcctgggccacagggcgaga

SEQ ID NO: 1271855 - DNA, 12 bp, Homo sapiens
gcctgggccagg

SEQ ID NO: 1271856 - DNA, 18 bp, Homo sapiens
gcctgggcccatctccct

SEQ ID NO: 1271857 - DNA, 20 bp, Homo sapiens
gcctgggcccggaagggctt

SEQ ID NO: 1271858 - DNA, 16 bp, Homo sapiens
gcctgggccctgggct

SEQ ID NO: 1271859 - DNA, 17 bp, Homo sapiens
gcctgggccctgggctg

SEQ ID NO: 1271860 - DNA, 22 bp, Homo sapiens
gcctgggccctgggctgatgga

SEQ ID NO: 1271861 - DNA, 16 bp, Homo sapiens
gcctgggccggcgagg

SEQ ID NO: 1271862 - DNA, 21 bp, Homo sapiens
gcctgggccggcgagggggcc

SEQ ID NO: 1271863 - DNA, 20 bp, Homo sapiens
gcctgggccgtggcacagct

SEQ ID NO: 1271864 - DNA, 22 bp, Homo sapiens
gcctgggcctgcttttccagga

SEQ ID NO: 1271865 - DNA, 14 bp, Homo sapiens
gcctgggcctgtgc

SEQ ID NO: 1271866 - DNA, 23 bp, Homo sapiens
gcctgggcctgtgcagcagccca

SEQ ID NO: 1271867 - DNA, 20 bp, Homo sapiens
gcctgggcgacagagcgaga

SEQ ID NO: 1271868 - DNA, 21 bp, Homo sapiens
gcctgggcgtacagagcacat

SEQ ID NO: 1271869 - DNA, 19 bp, Homo sapiens
gcctgggctcactgtgctg

SEQ ID NO: 1271870 - DNA, 23 bp, Homo sapiens
gcctgggctccctcttgtgggat

SEQ ID NO: 1271871 - DNA, 13 bp, Homo sapiens
gcctgggctctgg

SEQ ID NO: 1271872 - DNA, 15 bp, Homo sapiens
gcctgggctgttggc

SEQ ID NO: 1271873 - DNA, 18 bp, Homo sapiens
gcctgggctgttggcact

SEQ ID NO: 1271874 - DNA, 20 bp, Homo sapiens
gcctgggcttgagctgcaga

SEQ ID NO: 1271875 - DNA, 23 bp, Homo sapiens
gcctgggcttggcccgcggcctg

SEQ ID NO: 1271876 - DNA, 23 bp, Homo sapiens
gcctggggatgtaaccaagctgt

SEQ ID NO: 1271877 - DNA, 20 bp, Homo sapiens
gcctggggcccaagttgcag

SEQ ID NO: 1271878 - DNA, 13 bp, Homo sapiens
gcctggggcctga

SEQ ID NO: 1271879 - DNA, 14 bp, Homo sapiens
gcctggggcctgag

SEQ ID NO: 1271880 - DNA, 15 bp, Homo sapiens
gcctggggcctgaga

SEQ ID NO: 1271881 - DNA, 18 bp, Homo sapiens
gcctggggctccctctct

SEQ ID NO: 1271882 - DNA, 17 bp, Homo sapiens
gcctggggctggcctcc

SEQ ID NO: 1271883 - DNA, 20 bp, Homo sapiens
gcctgggggacagaaagaga

SEQ ID NO: 1271884 - DNA, 20 bp, Homo sapiens
gcctgggggacccctggctc

SEQ ID NO: 1271885 - DNA, 14 bp, Homo sapiens
gcctgggggagaga

SEQ ID NO: 1271886 - DNA, 21 bp, Homo sapiens
gcctgggggagttttcctcta

SEQ ID NO: 1271887 - DNA, 14 bp, Homo sapiens
gcctgggggcagtg

SEQ ID NO: 1271888 - DNA, 17 bp, Homo sapiens
gcctgggggcagtgact

SEQ ID NO: 1271889 - DNA, 13 bp, Homo sapiens
gcctggggggaac

SEQ ID NO: 1271890 - DNA, 16 bp, Homo sapiens
gcctgggggtgccagg

SEQ ID NO: 1271891 - DNA, 21 bp, Homo sapiens
gcctgggggtgccaggaccag

SEQ ID NO: 1271892 - DNA, 18 bp, Homo sapiens
gcctggggtccctctgaa

SEQ ID NO: 1271893 - DNA, 17 bp, Homo sapiens
gcctggggtgggacagg

SEQ ID NO: 1271894 - DNA, 18 bp, Homo sapiens
gcctggggtgggacaggg

SEQ ID NO: 1271895 - DNA, 14 bp, Homo sapiens
gcctggggtggggt

SEQ ID NO: 1271896 - DNA, 22 bp, Homo sapiens
gcctggggtggggtcatgccct

SEQ ID NO: 1271897 - DNA, 17 bp, Homo sapiens
gcctggggttgtccccg

SEQ ID NO: 1271898 - DNA, 21 bp, Homo sapiens
gcctgggtctcaccggctctc

SEQ ID NO: 1271899 - DNA, 22 bp, Homo sapiens
gcctgggtctggatgggaggag

SEQ ID NO: 1271900 - DNA, 20 bp, Homo sapiens
gcctgggtgacaagagcgaa

SEQ ID NO: 1271901 - DNA, 20 bp, Homo sapiens
gcctgggtgacagagcaaga

SEQ ID NO: 1271902 - DNA, 20 bp, Homo sapiens
gcctgggtgacagagcgaga

SEQ ID NO: 1271903 - DNA, 20 bp, Homo sapiens
gcctgggtgagaatcctgcc

SEQ ID NO: 1271904 - DNA, 21 bp, Homo sapiens
gcctgggtgctggctgcccag

SEQ ID NO: 1271905 - DNA, 13 bp, Homo sapiens
gcctgggtggcca

SEQ ID NO: 1271906 - DNA, 15 bp, Homo sapiens
gcctgggtggggctg

SEQ ID NO: 1271907 - DNA, 16 bp, Homo sapiens
gcctgggtggggctgc

SEQ ID NO: 1271908 - DNA, 18 bp, Homo sapiens
gcctgggtggggctgctc

SEQ ID NO: 1271909 - DNA, 22 bp, Homo sapiens
gcctgggtggggctgctcctcc

SEQ ID NO: 1271910 - DNA, 21 bp, Homo sapiens
gcctgggtttgttcctggggc

SEQ ID NO: 1271911 - DNA, 21 bp, Homo sapiens
gcctggtcccacgagggtgcc

SEQ ID NO: 1271912 - DNA, 19 bp, Homo sapiens
gcctggtcccagagtggct

SEQ ID NO: 1271913 - DNA, 16 bp, Homo sapiens
gcctggtccctgggag

SEQ ID NO: 1271914 - DNA, 22 bp, Homo sapiens
gcctggtccttccctgatggcc

SEQ ID NO: 1271915 - DNA, 15 bp, Homo sapiens
gcctggtctgtctgg

SEQ ID NO: 1271916 - DNA, 13 bp, Homo sapiens
gcctggtgctgct

SEQ ID NO: 1271917 - DNA, 17 bp, Homo sapiens
gcctggtgggggaaggg

SEQ ID NO: 1271918 - DNA, 18 bp, Homo sapiens
gcctggtgggggaagggg

SEQ ID NO: 1271919 - DNA, 20 bp, Homo sapiens
gcctggtgggggaaggggag

SEQ ID NO: 1271920 - DNA, 21 bp, Homo sapiens
gcctggtgtgaggaggacaaa

SEQ ID NO: 1271921 - DNA, 19 bp, Homo sapiens
gcctggttcagacacagct

SEQ ID NO: 1271922 - DNA, 21 bp, Homo sapiens
gcctggttcagacacagctct

SEQ ID NO: 1271923 - DNA, 22 bp, Homo sapiens
gcctggttcagacacagctctt

SEQ ID NO: 1271924 - DNA, 23 bp, Homo sapiens
gcctggttcagacacagctcttc

SEQ ID NO: 1271925 - DNA, 22 bp, Homo sapiens
gcctggtttgcaaagaccacct

SEQ ID NO: 1271926 - DNA, 21 bp, Homo sapiens
gcctgtaatcagctctcctgg

SEQ ID NO: 1271927 - DNA, 22 bp, Homo sapiens
gcctgtaatcagctctcctggc

SEQ ID NO: 1271928 - DNA, 20 bp, Homo sapiens
gcctgtaatcccagcacttt

SEQ ID NO: 1271929 - DNA, 17 bp, Homo sapiens
gcctgtaatcccagcag

SEQ ID NO: 1271930 - DNA, 18 bp, Homo sapiens
gcctgtaatcccagcagt

SEQ ID NO: 1271931 - DNA, 16 bp, Homo sapiens
gcctgtaatcccagct

SEQ ID NO: 1271932 - DNA, 17 bp, Homo sapiens
gcctgtaatcccagcta

SEQ ID NO: 1271933 - DNA, 23 bp, Homo sapiens
gcctgtaatctttttctccaccc

SEQ ID NO: 1271934 - DNA, 20 bp, Homo sapiens
gcctgtaccggtttggctgg

SEQ ID NO: 1271935 - DNA, 17 bp, Homo sapiens
gcctgtactaaggagca

SEQ ID NO: 1271936 - DNA, 16 bp, Homo sapiens
gcctgtagagttgctg

SEQ ID NO: 1271937 - DNA, 21 bp, Homo sapiens
gcctgtagcaatggccagagc

SEQ ID NO: 1271938 - DNA, 21 bp, Homo sapiens
gcctgtagctcccctgctgag

SEQ ID NO: 1271939 - DNA, 19 bp, Homo sapiens
gcctgtagtcccagccact

SEQ ID NO: 1271940 - DNA, 16 bp, Homo sapiens
gcctgtagttaggaaa

SEQ ID NO: 1271941 - DNA, 17 bp, Homo sapiens
gcctgtagttaggaaat

SEQ ID NO: 1271942 - DNA, 19 bp, Homo sapiens
gcctgtagttaggaaataa

SEQ ID NO: 1271943 - DNA, 23 bp, Homo sapiens
gcctgtatcctccctggcagaca

SEQ ID NO: 1271944 - DNA, 19 bp, Homo sapiens
gcctgtatgtggtgtgggg

SEQ ID NO: 1271945 - DNA, 18 bp, Homo sapiens
gcctgtcacaataaagtt

SEQ ID NO: 1271946 - DNA, 16 bp, Homo sapiens
gcctgtcacctgggag

SEQ ID NO: 1271947 - DNA, 17 bp, Homo sapiens
gcctgtcagctaaagaa

SEQ ID NO: 1271948 - DNA, 18 bp, Homo sapiens
gcctgtcagtttcatgga

SEQ ID NO: 1271949 - DNA, 15 bp, Homo sapiens
gcctgtccaccctgc

SEQ ID NO: 1271950 - DNA, 14 bp, Homo sapiens
gcctgtcccaggac

SEQ ID NO: 1271951 - DNA, 22 bp, Homo sapiens
gcctgtcccatggacactccag

SEQ ID NO: 1271952 - DNA, 22 bp, Homo sapiens
gcctgtccccgccttccctcac

SEQ ID NO: 1271953 - DNA, 11 bp, Homo sapiens
gcctgtcctca

SEQ ID NO: 1271954 - DNA, 12 bp, Homo sapiens
gcctgtcctcac

SEQ ID NO: 1271955 - DNA, 15 bp, Homo sapiens
gcctgtcgtgccagt

SEQ ID NO: 1271956 - DNA, 16 bp, Homo sapiens
gcctgtcgtgccagtc

SEQ ID NO: 1271957 - DNA, 13 bp, Homo sapiens
gcctgtctaaagc

SEQ ID NO: 1271958 - DNA, 17 bp, Homo sapiens
gcctgtctcatccccag

SEQ ID NO: 1271959 - DNA, 18 bp, Homo sapiens
gcctgtctcatccccagg

SEQ ID NO: 1271960 - DNA, 17 bp, Homo sapiens
gcctgtctcgggctgac

SEQ ID NO: 1271961 - DNA, 20 bp, Homo sapiens
gcctgtctctagctgttctg

SEQ ID NO: 1271962 - DNA, 15 bp, Homo sapiens
gcctgtctgagactc

SEQ ID NO: 1271963 - DNA, 14 bp, Homo sapiens
gcctgtctgtctct

SEQ ID NO: 1271964 - DNA, 14 bp, Homo sapiens
gcctgtctgtgtgc

SEQ ID NO: 1271965 - DNA, 16 bp, Homo sapiens
gcctgtcttaattttc

SEQ ID NO: 1271966 - DNA, 18 bp, Homo sapiens
gcctgtcttgagtagact

SEQ ID NO: 1271967 - DNA, 21 bp, Homo sapiens
gcgccagcacagaaacagagg

SEQ ID NO: 1271968 - DNA, 13 bp, Homo sapiens
gcgccagcgacct

SEQ ID NO: 1271969 - DNA, 19 bp, Homo sapiens
gcgccaggaagccagagcc

SEQ ID NO: 1271970 - DNA, 21 bp, Homo sapiens
gcgccaggaagccagagcccc

SEQ ID NO: 1271971 - DNA, 14 bp, Homo sapiens
gcgccaggacagca

SEQ ID NO: 1271972 - DNA, 16 bp, Homo sapiens
gcgccaggacagcagc

SEQ ID NO: 1271973 - DNA, 16 bp, Homo sapiens
gcgccaggcagagctg

SEQ ID NO: 1271974 - DNA, 17 bp, Homo sapiens
gcgccaggcagagctga

SEQ ID NO: 1271975 - DNA, 14 bp, Homo sapiens
gcgccaggctggag

SEQ ID NO: 1271976 - DNA, 13 bp, Homo sapiens
gcgccagtcctgc

SEQ ID NO: 1271977 - DNA, 14 bp, Homo sapiens
gcgccagtcctgct

SEQ ID NO: 1271978 - DNA, 19 bp, Homo sapiens
gcgcccagggctgggagga

SEQ ID NO: 1271979 - DNA, 20 bp, Homo sapiens
gcgcccattcgtctgtccca

SEQ ID NO: 1271980 - DNA, 16 bp, Homo sapiens
gcgcccccatctgtct

SEQ ID NO: 1271981 - DNA, 17 bp, Homo sapiens
gcgcccccatctgtctt

SEQ ID NO: 1271982 - DNA, 19 bp, Homo sapiens
gcgcccccccctccccatg

SEQ ID NO: 1271983 - DNA, 16 bp, Homo sapiens
gcgcccccgccccagg

SEQ ID NO: 1271984 - DNA, 18 bp, Homo sapiens
gcgcccccgccccaggct

SEQ ID NO: 1271985 - DNA, 21 bp, Homo sapiens
gcgccccctccgccctgccac

SEQ ID NO: 1271986 - DNA, 22 bp, Homo sapiens
gcgccccctccgccctgccact

SEQ ID NO: 1271987 - DNA, 12 bp, Homo sapiens
gcgccccgcacc

SEQ ID NO: 1271988 - DNA, 12 bp, Homo sapiens
gcgcccctggga

SEQ ID NO: 1271989 - DNA, 14 bp, Homo sapiens
gcgcccctgggaga

SEQ ID NO: 1271990 - DNA, 15 bp, Homo sapiens
gcgcccgctgggctg

SEQ ID NO: 1271991 - DNA, 16 bp, Homo sapiens
gcgcccgctgggctga

SEQ ID NO: 1271992 - DNA, 12 bp, Homo sapiens
gcgccctccctc

SEQ ID NO: 1271993 - DNA, 23 bp, Homo sapiens
gcgccctgcctcctggaggacca

SEQ ID NO: 1271994 - DNA, 16 bp, Homo sapiens
gcgccgactccctgag

SEQ ID NO: 1271995 - DNA, 23 bp, Homo sapiens
gcgccgactccctgagtctggac

SEQ ID NO: 1271996 - DNA, 20 bp, Homo sapiens
gcgccgagaccgcagaggga

SEQ ID NO: 1271997 - DNA, 23 bp, Homo sapiens
gcgccggcaaaactttggcactg

SEQ ID NO: 1271998 - DNA, 23 bp, Homo sapiens
gcgccggtccggcgccccgcacc

SEQ ID NO: 1271999 - DNA, 22 bp, Homo sapiens
gcgccgtctccaggggctgctt

SEQ ID NO: 1272000 - DNA, 17 bp, Homo sapiens
gcgccgtgctgggcagc

SEQ ID NO: 1272001 - DNA, 16 bp, Homo sapiens
gcgccgtgctgtaaat

SEQ ID NO: 1272002 - DNA, 17 bp, Homo sapiens
gcgcctcagccctcagt

SEQ ID NO: 1272003 - DNA, 15 bp, Homo sapiens
gcgcctccagaggtc

SEQ ID NO: 1272004 - DNA, 21 bp, Homo sapiens
gcgcctccatccatctgtccg

SEQ ID NO: 1272005 - DNA, 14 bp, Homo sapiens
gcgcctccctccac

SEQ ID NO: 1272006 - DNA, 16 bp, Homo sapiens
gcgcctccctccaccc

SEQ ID NO: 1272007 - DNA, 19 bp, Homo sapiens
gcgcctccctccaccccag

SEQ ID NO: 1272008 - DNA, 21 bp, Homo sapiens
gcgcctccctccaccccagga

SEQ ID NO: 1272009 - DNA, 23 bp, Homo sapiens
gcgcctccctccaccccaggacg

SEQ ID NO: 1272010 - DNA, 15 bp, Homo sapiens
gcgcctccttccttg

SEQ ID NO: 1272011 - DNA, 22 bp, Homo sapiens
gcgcctccttccttgctgtcct

SEQ ID NO: 1272012 - DNA, 14 bp, Homo sapiens
gcgcctcttcctct

SEQ ID NO: 1272013 - DNA, 18 bp, Homo sapiens
gcgcctcttcctctgggc

SEQ ID NO: 1272014 - DNA, 19 bp, Homo sapiens
gcgcctgcaggcagagctg

SEQ ID NO: 1272015 - DNA, 11 bp, Homo sapiens
gcgcctgccct

SEQ ID NO: 1272016 - DNA, 20 bp, Homo sapiens
gcgcctgccctgcccaagtg

SEQ ID NO: 1272017 - DNA, 15 bp, Homo sapiens
gcgcctgccttggga

SEQ ID NO: 1272018 - DNA, 12 bp, Homo sapiens
gcgcctgctgcc

SEQ ID NO: 1272019 - DNA, 20 bp, Homo sapiens
gcgcctgctgcctgctgaga

SEQ ID NO: 1272020 - DNA, 18 bp, Homo sapiens
gcgcctggagggatgccc

SEQ ID NO: 1272021 - DNA, 16 bp, Homo sapiens
gcgcctttcccaactc

SEQ ID NO: 1272022 - DNA, 14 bp, Homo sapiens
gcgcctttgtatta

SEQ ID NO: 1272023 - DNA, 14 bp, Homo sapiens
gcgcgactgagaac

SEQ ID NO: 1272024 - DNA, 20 bp, Homo sapiens
gcgcgccctcccttggcgtg

SEQ ID NO: 1272025 - DNA, 22 bp, Homo sapiens
gcgcgccggtccggcgccccgc

SEQ ID NO: 1272026 - DNA, 23 bp, Homo sapiens
gcgcgctcctgacccctccctgc

SEQ ID NO: 1272027 - DNA, 22 bp, Homo sapiens
gcgcgggaggcaccagctctgt

SEQ ID NO: 1272028 - DNA, 19 bp, Homo sapiens
gcgcggtggctcacgcctg

SEQ ID NO: 1272029 - DNA, 13 bp, Homo sapiens
gcgctacccactt

SEQ ID NO: 1272030 - DNA, 15 bp, Homo sapiens
gcgctagtgccttgc

SEQ ID NO: 1272031 - DNA, 21 bp, Homo sapiens
gcgctagtgccttgcccacag

SEQ ID NO: 1272032 - DNA, 22 bp, Homo sapiens
gcgctagtgccttgcccacagg

SEQ ID NO: 1272033 - DNA, 12 bp, Homo sapiens
gcgctcagaccc

SEQ ID NO: 1272034 - DNA, 14 bp, Homo sapiens
gcgctcagacccca

SEQ ID NO: 1272035 - DNA, 10 bp, Homo sapiens
gcgctcagga

SEQ ID NO: 1272036 - DNA, 12 bp, Homo sapiens
gcgctcagtaaa

SEQ ID NO: 1272037 - DNA, 14 bp, Homo sapiens
gcgctcagtaaacg

SEQ ID NO: 1272038 - DNA, 16 bp, Homo sapiens
gcgctcctctgccttg

SEQ ID NO: 1272039 - DNA, 16 bp, Homo sapiens
gcgctcgccacgctca

SEQ ID NO: 1272040 - DNA, 22 bp, Homo sapiens
gcgctcgccacgctcagtgccc

SEQ ID NO: 1272041 - DNA, 15 bp, Homo sapiens
gcgctcgcccagcag

SEQ ID NO: 1272042 - DNA, 16 bp, Homo sapiens
gcgctcgctcaggtga

SEQ ID NO: 1272043 - DNA, 15 bp, Homo sapiens
gcgctcggcccggag

SEQ ID NO: 1272044 - DNA, 22 bp, Homo sapiens
gcgctcggcccggagcagcagg

SEQ ID NO: 1272045 - DNA, 16 bp, Homo sapiens
gcgctcgttccggtcc

SEQ ID NO: 1272046 - DNA, 19 bp, Homo sapiens
gcgctctctttgcaactgt

SEQ ID NO: 1272047 - DNA, 22 bp, Homo sapiens
gcgctctggacagatggacgca

SEQ ID NO: 1272048 - DNA, 20 bp, Homo sapiens
gcgctcttggtccctggtcc

SEQ ID NO: 1272049 - DNA, 19 bp, Homo sapiens
gcgctgacaaccaccgctc

SEQ ID NO: 1272050 - DNA, 17 bp, Homo sapiens
gcgctgcctcaggcact

SEQ ID NO: 1272051 - DNA, 14 bp, Homo sapiens
gcgctgctggtgtt

SEQ ID NO: 1272052 - DNA, 13 bp, Homo sapiens
gcgctggcccagc

SEQ ID NO: 1272053 - DNA, 13 bp, Homo sapiens
gcgctggggagac

SEQ ID NO: 1272054 - DNA, 11 bp, Homo sapiens
gcgctgtcctg

SEQ ID NO: 1272055 - DNA, 23 bp, Homo sapiens
gcgctgtcctgcgttcagcccct

SEQ ID NO: 1272056 - DNA, 18 bp, Homo sapiens
gcgctgtggactgtcctg

SEQ ID NO: 1272057 - DNA, 13 bp, Homo sapiens
gcgcttccctggg

SEQ ID NO: 1272058 - DNA, 17 bp, Homo sapiens
gcgcttctgcagcctcg

SEQ ID NO: 1272059 - DNA, 13 bp, Homo sapiens
gcgcttgggcgcc

SEQ ID NO: 1272060 - DNA, 16 bp, Homo sapiens
gcgcttggtaggtgtg

SEQ ID NO: 1272061 - DNA, 20 bp, Homo sapiens
gcgcttggtctttctgtgct

SEQ ID NO: 1272062 - DNA, 16 bp, Homo sapiens
gcgctttctcctgtgc

SEQ ID NO: 1272063 - DNA, 18 bp, Homo sapiens
gcgctttctcctgtgccc

SEQ ID NO: 1272064 - DNA, 22 bp, Homo sapiens
gcgctttctggaaaagaggagt

SEQ ID NO: 1272065 - DNA, 13 bp, Homo sapiens
gcggaagccatag

SEQ ID NO: 1272066 - DNA, 16 bp, Homo sapiens
gcggacaaaagggcca

SEQ ID NO: 1272067 - DNA, 18 bp, Homo sapiens
gcggacaaaagggccagg

SEQ ID NO: 1272068 - DNA, 19 bp, Homo sapiens
gcggacaaaagggccaggt

SEQ ID NO: 1272069 - DNA, 21 bp, Homo sapiens
gcggacaaaagggccaggtgc

SEQ ID NO: 1272070 - DNA, 17 bp, Homo sapiens
gcggacaccgtggcctg

SEQ ID NO: 1272071 - DNA, 16 bp, Homo sapiens
gcggacgtgctggcct

SEQ ID NO: 1272072 - DNA, 17 bp, Homo sapiens
gcggacgtgctggcctt

SEQ ID NO: 1272073 - DNA, 15 bp, Homo sapiens
gcggagacctcctga

SEQ ID NO: 1272074 - DNA, 22 bp, Homo sapiens
gcggagagtacagtgagccaag

SEQ ID NO: 1272075 - DNA, 12 bp, Homo sapiens
gcggagccagca

SEQ ID NO: 1272076 - DNA, 13 bp, Homo sapiens
gcggagccagcag

SEQ ID NO: 1272077 - DNA, 21 bp, Homo sapiens
gcggagcccagcctgggagcc

SEQ ID NO: 1272078 - DNA, 17 bp, Homo sapiens
gcggagctggccccgcc

SEQ ID NO: 1272079 - DNA, 19 bp, Homo sapiens
gcggaggaaagcaagtgtt

SEQ ID NO: 1272080 - DNA, 23 bp, Homo sapiens
gcggaggaaggaggacccaggac

SEQ ID NO: 1272081 - DNA, 16 bp, Homo sapiens
gcggaggagagagagg

SEQ ID NO: 1272082 - DNA, 16 bp, Homo sapiens
gcggaggctgtgtgcc

SEQ ID NO: 1272083 - DNA, 21 bp, Homo sapiens
gcggagtccccggggttcccc

SEQ ID NO: 1272084 - DNA, 20 bp, Homo sapiens
gcggatccgcggggaccctg

SEQ ID NO: 1272085 - DNA, 15 bp, Homo sapiens
gcggatggatggaag

SEQ ID NO: 1272086 - DNA, 13 bp, Homo sapiens
gcggatggccgga

SEQ ID NO: 1272087 - DNA, 13 bp, Homo sapiens
gcggatgtagcat

SEQ ID NO: 1272088 - DNA, 15 bp, Homo sapiens
gcggattgctctgga

SEQ ID NO: 1272089 - DNA, 23 bp, Homo sapiens
gctagccaatattaaaagagacc

SEQ ID NO: 1272090 - DNA, 13 bp, Homo sapiens
gctagccagccaa

SEQ ID NO: 1272091 - DNA, 13 bp, Homo sapiens
gctagccctgagc

SEQ ID NO: 1272092 - DNA, 23 bp, Homo sapiens
gctagcctgttcttttaccactg

SEQ ID NO: 1272093 - DNA, 16 bp, Homo sapiens
gctagcctttcttgta

SEQ ID NO: 1272094 - DNA, 14 bp, Homo sapiens
gctagcgctgccgc

SEQ ID NO: 1272095 - DNA, 15 bp, Homo sapiens
gctagcgctgccgca

SEQ ID NO: 1272096 - DNA, 21 bp, Homo sapiens
gctagcgctgccgcaccccag

SEQ ID NO: 1272097 - DNA, 12 bp, Homo sapiens
gctagctgccac

SEQ ID NO: 1272098 - DNA, 13 bp, Homo sapiens
gctagctgccact

SEQ ID NO: 1272099 - DNA, 17 bp, Homo sapiens
gctagcttctgcttttc

SEQ ID NO: 1272100 - DNA, 23 bp, Homo sapiens
gctagcttctgcttttctgccct

SEQ ID NO: 1272101 - DNA, 12 bp, Homo sapiens
gctaggaatgaa

SEQ ID NO: 1272102 - DNA, 13 bp, Homo sapiens
gctaggaatgaaa

SEQ ID NO: 1272103 - DNA, 11 bp, Homo sapiens
gctaggactga

SEQ ID NO: 1272104 - DNA, 14 bp, Homo sapiens
gctaggactgagga

SEQ ID NO: 1272105 - DNA, 18 bp, Homo sapiens
gctaggactgaggagtgg

SEQ ID NO: 1272106 - DNA, 16 bp, Homo sapiens
gctaggcgagtgccag

SEQ ID NO: 1272107 - DNA, 21 bp, Homo sapiens
gctaggctcgccttccctcct

SEQ ID NO: 1272108 - DNA, 17 bp, Homo sapiens
gctagggaaacttcccg

SEQ ID NO: 1272109 - DNA, 19 bp, Homo sapiens
gctagggagaatgcagaga

SEQ ID NO: 1272110 - DNA, 21 bp, Homo sapiens
gctaggtgggccagcccctcc

SEQ ID NO: 1272111 - DNA, 20 bp, Homo sapiens
gctagtaccctatagagagg

SEQ ID NO: 1272112 - DNA, 21 bp, Homo sapiens
gctagtagcaatgtgccttga

SEQ ID NO: 1272113 - DNA, 16 bp, Homo sapiens
gctagtcaagctcctc

SEQ ID NO: 1272114 - DNA, 18 bp, Homo sapiens
gctagtcctttctgtgaa

SEQ ID NO: 1272115 - DNA, 16 bp, Homo sapiens
gctagtcttaagaact

SEQ ID NO: 1272116 - DNA, 15 bp, Homo sapiens
gctagtgaagtggcc

SEQ ID NO: 1272117 - DNA, 16 bp, Homo sapiens
gctagtgccttgccca

SEQ ID NO: 1272118 - DNA, 22 bp, Homo sapiens
gctagtgggccctctctctggg

SEQ ID NO: 1272119 - DNA, 17 bp, Homo sapiens
gctagtgtgagtggcag

SEQ ID NO: 1272120 - DNA, 19 bp, Homo sapiens
gctagtgtgagtggcagcc

SEQ ID NO: 1272121 - DNA, 21 bp, Homo sapiens
gctagtgtgagtggcagccat

SEQ ID NO: 1272122 - DNA, 22 bp, Homo sapiens
gctagtgtgagtggcagccatg

SEQ ID NO: 1272123 - DNA, 23 bp, Homo sapiens
gctagtgtgagtggcagccatgc

SEQ ID NO: 1272124 - DNA, 18 bp, Homo sapiens
gctagtgtttaaaaggct

SEQ ID NO: 1272125 - DNA, 22 bp, Homo sapiens
gctagttatacttatttgtata

SEQ ID NO: 1272126 - DNA, 17 bp, Homo sapiens
gctagttctgctgccct

SEQ ID NO: 1272127 - DNA, 15 bp, Homo sapiens
gctagttttacagat

SEQ ID NO: 1272128 - DNA, 22 bp, Homo sapiens
gctagttttacagattgcctcc

SEQ ID NO: 1272129 - DNA, 15 bp, Homo sapiens
gctagttttttgctt

SEQ ID NO: 1272130 - DNA, 19 bp, Homo sapiens
gctataaagcagtattttt

SEQ ID NO: 1272131 - DNA, 13 bp, Homo sapiens
gctataaatatat

SEQ ID NO: 1272132 - DNA, 18 bp, Homo sapiens
gctataaattcctctttg

SEQ ID NO: 1272133 - DNA, 23 bp, Homo sapiens
gctataaattcctctttgctttg

SEQ ID NO: 1272134 - DNA, 12 bp, Homo sapiens
gctataagtgct

SEQ ID NO: 1272135 - DNA, 14 bp, Homo sapiens
gctatacacacaca

SEQ ID NO: 1272136 - DNA, 16 bp, Homo sapiens
gctatagatgtctttt

SEQ ID NO: 1272137 - DNA, 20 bp, Homo sapiens
gctatagatgtcttttccca

SEQ ID NO: 1272138 - DNA, 16 bp, Homo sapiens
gctatagctacaggaa

SEQ ID NO: 1272139 - DNA, 17 bp, Homo sapiens
gctatagctcaggacct

SEQ ID NO: 1272140 - DNA, 16 bp, Homo sapiens
gctatagtatttgatt

SEQ ID NO: 1272141 - DNA, 22 bp, Homo sapiens
gctatagtgtataccacctgta

SEQ ID NO: 1272142 - DNA, 14 bp, Homo sapiens
gctatatataaaac

SEQ ID NO: 1272143 - DNA, 18 bp, Homo sapiens
gctatatccatgtactgt

SEQ ID NO: 1272144 - DNA, 23 bp, Homo sapiens
gctatatccatgtactgtagttt

SEQ ID NO: 1272145 - DNA, 22 bp, Homo sapiens
gctatatcgaatatagttctgt

SEQ ID NO: 1272146 - DNA, 21 bp, Homo sapiens
gctatcacatgtgaaaagctt

SEQ ID NO: 1272147 - DNA, 14 bp, Homo sapiens
gctatcacctagca

SEQ ID NO: 1272148 - DNA, 19 bp, Homo sapiens
gctatcacctagcagcctc

SEQ ID NO: 1272149 - DNA, 19 bp, Homo sapiens
gctatcagagcctctccca

SEQ ID NO: 1272150 - DNA, 22 bp, Homo sapiens
gctatcagcaatactcatcaga

SEQ ID NO: 1272151 - DNA, 16 bp, Homo sapiens
gctatcaggagaaagc

SEQ ID NO: 1272152 - DNA, 18 bp, Homo sapiens
gctatccccatctccctg

SEQ ID NO: 1272153 - DNA, 20 bp, Homo sapiens
gctatcctgccaaaatcatt

SEQ ID NO: 1272154 - DNA, 16 bp, Homo sapiens
gctatcgccctccttt

SEQ ID NO: 1272155 - DNA, 18 bp, Homo sapiens
gctatcgccctcctttcc

SEQ ID NO: 1272156 - DNA, 20 bp, Homo sapiens
gctatctagcagtaaaagat

SEQ ID NO: 1272157 - DNA, 13 bp, Homo sapiens
gctatctctgtgt

SEQ ID NO: 1272158 - DNA, 16 bp, Homo sapiens
gctatctctgtgtgca

SEQ ID NO: 1272159 - DNA, 23 bp, Homo sapiens
gctatctgcactctaaactgcaa

SEQ ID NO: 1272160 - DNA, 14 bp, Homo sapiens
gctatcttcatgta

SEQ ID NO: 1272161 - DNA, 19 bp, Homo sapiens
gctatcttcatgtaaattg

SEQ ID NO: 1272162 - DNA, 18 bp, Homo sapiens
gctatgaaaatgagccct

SEQ ID NO: 1272163 - DNA, 19 bp, Homo sapiens
gctatgaaaatgagccctg

SEQ ID NO: 1272164 - DNA, 20 bp, Homo sapiens
gctatgaaaatgagccctgg

SEQ ID NO: 1272165 - DNA, 17 bp, Homo sapiens
gctatgacagctggcta

SEQ ID NO: 1272166 - DNA, 15 bp, Homo sapiens
gctatgatggtgaca

SEQ ID NO: 1272167 - DNA, 12 bp, Homo sapiens
gctatgcatttg

SEQ ID NO: 1272168 - DNA, 17 bp, Homo sapiens
gctatgcattttcttca

SEQ ID NO: 1272169 - DNA, 13 bp, Homo sapiens
gctatgccttgca

SEQ ID NO: 1272170 - DNA, 18 bp, Homo sapiens
gctatgctaaacctcctg

SEQ ID NO: 1272171 - DNA, 15 bp, Homo sapiens
gctatggatctgatt

SEQ ID NO: 1272172 - DNA, 21 bp, Homo sapiens
gctatggcaagggggtgtcat

SEQ ID NO: 1272173 - DNA, 20 bp, Homo sapiens
gctatggcaggataagaaag

SEQ ID NO: 1272174 - DNA, 15 bp, Homo sapiens
gctatggcccagaaa

SEQ ID NO: 1272175 - DNA, 13 bp, Homo sapiens
gctatgggagccc

SEQ ID NO: 1272176 - DNA, 17 bp, Homo sapiens
gctatgggagccccagg

SEQ ID NO: 1272177 - DNA, 14 bp, Homo sapiens
gctatggtgagatg

SEQ ID NO: 1272178 - DNA, 16 bp, Homo sapiens
gctatggttgccaccc

SEQ ID NO: 1272179 - DNA, 13 bp, Homo sapiens
gctatgtaagggt

SEQ ID NO: 1272180 - DNA, 15 bp, Homo sapiens
gctatgtcccaagag

SEQ ID NO: 1272181 - DNA, 20 bp, Homo sapiens
gctatgtcccaagagccata

SEQ ID NO: 1272182 - DNA, 16 bp, Homo sapiens
gctatgtttttaatgt

SEQ ID NO: 1272183 - DNA, 16 bp, Homo sapiens
gctattaaaaaagtct

SEQ ID NO: 1272184 - DNA, 18 bp, Homo sapiens
gctattaaaagaatccaa

SEQ ID NO: 1272185 - DNA, 16 bp, Homo sapiens
gctattagcggctcct

SEQ ID NO: 1272186 - DNA, 14 bp, Homo sapiens
gctattatgtaaca

SEQ ID NO: 1272187 - DNA, 21 bp, Homo sapiens
gctattatgtaacatccagaa

SEQ ID NO: 1272188 - DNA, 22 bp, Homo sapiens
gctattatgtaacatccagaag

SEQ ID NO: 1272189 - DNA, 18 bp, Homo sapiens
gctattattttcactgta

SEQ ID NO: 1272190 - DNA, 18 bp, Homo sapiens
gctattcagtaataactc

SEQ ID NO: 1272191 - DNA, 19 bp, Homo sapiens
gctattcagtaataactct

SEQ ID NO: 1272192 - DNA, 19 bp, Homo sapiens
gctattcctttcccttcct

SEQ ID NO: 1272193 - DNA, 21 bp, Homo sapiens
gctattcctttcccttcctct

SEQ ID NO: 1272194 - DNA, 12 bp, Homo sapiens
gctattctgtgt

SEQ ID NO: 1272195 - DNA, 14 bp, Homo sapiens
gctattgacaataa

SEQ ID NO: 1272196 - DNA, 22 bp, Homo sapiens
gctattgttgtgggctttctcc

SEQ ID NO: 1272197 - DNA, 13 bp, Homo sapiens
gctatttaaaact

SEQ ID NO: 1272198 - DNA, 12 bp, Homo sapiens
gctatttaatat

SEQ ID NO: 1272199 - DNA, 16 bp, Homo sapiens
gctatttatccctttc

SEQ ID NO: 1272200 - DNA, 15 bp, Homo sapiens
gctatttattttcct

SEQ ID NO: 1272201 - DNA, 16 bp, Homo sapiens
gctatttattttccta

SEQ ID NO: 1272202 - DNA, 22 bp, Homo sapiens
gctatttattttcctaaagaga

SEQ ID NO: 1272203 - DNA, 14 bp, Homo sapiens
gctatttcagcctc

SEQ ID NO: 1272204 - DNA, 17 bp, Homo sapiens
gctatttccattccaga

SEQ ID NO: 1272205 - DNA, 14 bp, Homo sapiens
gctatttgaagtgt

SEQ ID NO: 1272206 - DNA, 14 bp, Homo sapiens
gctatttgagcatg

SEQ ID NO: 1272207 - DNA, 12 bp, Homo sapiens
gctatttggaca

SEQ ID NO: 1272208 - DNA, 15 bp, Homo sapiens
gctatttgtaaatct

SEQ ID NO: 1272209 - DNA, 13 bp, Homo sapiens
gctatttgttcag

SEQ ID NO: 1272210 - DNA, 18 bp, Homo sapiens
gctattttatattacact

SEQ ID NO: 1272211 - DNA, 18 bp, Homo sapiens
gctcctagagggaggggc

SEQ ID NO: 1272212 - DNA, 16 bp, Homo sapiens
gctcctcacctgtcta

SEQ ID NO: 1272213 - DNA, 23 bp, Homo sapiens
gctcctcactggaggagcagctt

SEQ ID NO: 1272214 - DNA, 14 bp, Homo sapiens
gctcctccagccct

SEQ ID NO: 1272215 - DNA, 15 bp, Homo sapiens
gctcctccagccctg

SEQ ID NO: 1272216 - DNA, 15 bp, Homo sapiens
gctcctccagccctt

SEQ ID NO: 1272217 - DNA, 15 bp, Homo sapiens
gctcctccagggcca

SEQ ID NO: 1272218 - DNA, 23 bp, Homo sapiens
gctcctccagggccacgtgccag

SEQ ID NO: 1272219 - DNA, 21 bp, Homo sapiens
gctcctccagggtggcagcaa

SEQ ID NO: 1272220 - DNA, 22 bp, Homo sapiens
gctcctccagggtggcagcaac

SEQ ID NO: 1272221 - DNA, 11 bp, Homo sapiens
gctcctcccac

SEQ ID NO: 1272222 - DNA, 17 bp, Homo sapiens
gctcctcccacttctca

SEQ ID NO: 1272223 - DNA, 23 bp, Homo sapiens
gctcctcccagcttgtaggagct

SEQ ID NO: 1272224 - DNA, 16 bp, Homo sapiens
gctcctcccggtgccc

SEQ ID NO: 1272225 - DNA, 14 bp, Homo sapiens
gctcctccctgccc

SEQ ID NO: 1272226 - DNA, 19 bp, Homo sapiens
gctcctccctggctgccct

SEQ ID NO: 1272227 - DNA, 22 bp, Homo sapiens
gctcctccctggctgccctggc

SEQ ID NO: 1272228 - DNA, 23 bp, Homo sapiens
gctcctccctggctgccctggcc

SEQ ID NO: 1272229 - DNA, 13 bp, Homo sapiens
gctcctccctgtg

SEQ ID NO: 1272230 - DNA, 14 bp, Homo sapiens
gctcctccctgtgc

SEQ ID NO: 1272231 - DNA, 19 bp, Homo sapiens
gctcctccctgtgccccca

SEQ ID NO: 1272232 - DNA, 22 bp, Homo sapiens
gctcctccgtctgaccctctgc

SEQ ID NO: 1272233 - DNA, 14 bp, Homo sapiens
gctcctcctaggaa

SEQ ID NO: 1272234 - DNA, 14 bp, Homo sapiens
gctcctcctcaccc

SEQ ID NO: 1272235 - DNA, 22 bp, Homo sapiens
gctcctcctcacccacctctgg

SEQ ID NO: 1272236 - DNA, 20 bp, Homo sapiens
gctcctcctccctgcatctg

SEQ ID NO: 1272237 - DNA, 14 bp, Homo sapiens
gctcctcctctcat

SEQ ID NO: 1272238 - DNA, 20 bp, Homo sapiens
gctcctccttcccagggacc

SEQ ID NO: 1272239 - DNA, 14 bp, Homo sapiens
gctcctcgccccca

SEQ ID NO: 1272240 - DNA, 17 bp, Homo sapiens
gctcctcgcccccacca

SEQ ID NO: 1272241 - DNA, 18 bp, Homo sapiens
gctcctcgcccccaccag

SEQ ID NO: 1272242 - DNA, 16 bp, Homo sapiens
gctcctctaggggcag

SEQ ID NO: 1272243 - DNA, 12 bp, Homo sapiens
gctcctctccag

SEQ ID NO: 1272244 - DNA, 17 bp, Homo sapiens
gctcctctccaggcacc

SEQ ID NO: 1272245 - DNA, 22 bp, Homo sapiens
gctcctctccaggcacccttct

SEQ ID NO: 1272246 - DNA, 24 bp, Homo sapiens
gctcctctctgaagcgactctcct

SEQ ID NO: 1272247 - DNA, 14 bp, Homo sapiens
gctcctctgccttg

SEQ ID NO: 1272248 - DNA, 14 bp, Homo sapiens
gctcctctgggcag

SEQ ID NO: 1272249 - DNA, 22 bp, Homo sapiens
gctcctcttccatgctgtgcgc

SEQ ID NO: 1272250 - DNA, 19 bp, Homo sapiens
gctcctcttgattcctggt

SEQ ID NO: 1272251 - DNA, 12 bp, Homo sapiens
gctcctctttcc

SEQ ID NO: 1272252 - DNA, 23 bp, Homo sapiens
gctcctctttcccctcctttgtc

SEQ ID NO: 1272253 - DNA, 22 bp, Homo sapiens
gctcctgacccctccctgcagg

SEQ ID NO: 1272254 - DNA, 21 bp, Homo sapiens
gctcctgaggggcatctgccc

SEQ ID NO: 1272255 - DNA, 18 bp, Homo sapiens
gctcctgagtagctgggc

SEQ ID NO: 1272256 - DNA, 21 bp, Homo sapiens
gctcctgagtagctgggcctg

SEQ ID NO: 1272257 - DNA, 23 bp, Homo sapiens
gctcctgagtagctgggcctgtg

SEQ ID NO: 1272258 - DNA, 14 bp, Homo sapiens
gctcctgcagcatg

SEQ ID NO: 1272259 - DNA, 23 bp, Homo sapiens
gctcctgcaggccacagccacct

SEQ ID NO: 1272260 - DNA, 13 bp, Homo sapiens
gctcctgcatgca

SEQ ID NO: 1272261 - DNA, 14 bp, Homo sapiens
gctcctgcccagcc

SEQ ID NO: 1272262 - DNA, 15 bp, Homo sapiens
gctcctgcccagcca

SEQ ID NO: 1272263 - DNA, 12 bp, Homo sapiens
gctcctgcttcc

SEQ ID NO: 1272264 - DNA, 15 bp, Homo sapiens
gctcctgcttcccct

SEQ ID NO: 1272265 - DNA, 16 bp, Homo sapiens
gctcctgcttcccctc

SEQ ID NO: 1272266 - DNA, 18 bp, Homo sapiens
gctcctgcttcccctccc

SEQ ID NO: 1272267 - DNA, 19 bp, Homo sapiens
gctcctgcttcccctccct

SEQ ID NO: 1272268 - DNA, 23 bp, Homo sapiens
gctcctgcttcccctccctaccc

SEQ ID NO: 1272269 - DNA, 20 bp, Homo sapiens
gctcctgcttttctgtcctg

SEQ ID NO: 1272270 - DNA, 21 bp, Homo sapiens
gctcctgcttttctgtcctgg

SEQ ID NO: 1272271 - DNA, 21 bp, Homo sapiens
gctcctggaaaggctcagtct

SEQ ID NO: 1272272 - DNA, 23 bp, Homo sapiens
gctcctggaaaggctcagtctca

SEQ ID NO: 1272273 - DNA, 19 bp, Homo sapiens
gctcctggagcctttgaat

SEQ ID NO: 1272274 - DNA, 23 bp, Homo sapiens
gctcctggccaggataatatatt

SEQ ID NO: 1272275 - DNA, 19 bp, Homo sapiens
gctcctggcccactgcatc

SEQ ID NO: 1272276 - DNA, 22 bp, Homo sapiens
gctcctggctgtgcccagcagg

SEQ ID NO: 1272277 - DNA, 18 bp, Homo sapiens
gctcctgggacccttggc

SEQ ID NO: 1272278 - DNA, 12 bp, Homo sapiens
gctcctggggag

SEQ ID NO: 1272279 - DNA, 15 bp, Homo sapiens
gctcctggggagaaa

SEQ ID NO: 1272280 - DNA, 11 bp, Homo sapiens
gctcctgggtt

SEQ ID NO: 1272281 - DNA, 18 bp, Homo sapiens
gctcctgggttggaggga

SEQ ID NO: 1272282 - DNA, 19 bp, Homo sapiens
gctcctgtacttgtcctca

SEQ ID NO: 1272283 - DNA, 16 bp, Homo sapiens
gctcctgtctgccagc

SEQ ID NO: 1272284 - DNA, 21 bp, Homo sapiens
gctcctgtggccccaccctgg

SEQ ID NO: 1272285 - DNA, 13 bp, Homo sapiens
gctcctgtttgtc

SEQ ID NO: 1272286 - DNA, 22 bp, Homo sapiens
gctcctgttttgcacagccaaa

SEQ ID NO: 1272287 - DNA, 13 bp, Homo sapiens
gctccttccagac

SEQ ID NO: 1272288 - DNA, 13 bp, Homo sapiens
gctccttcccatc

SEQ ID NO: 1272289 - DNA, 18 bp, Homo sapiens
gctccttcccatcgctgt

SEQ ID NO: 1272290 - DNA, 15 bp, Homo sapiens
gctccttcccctgca

SEQ ID NO: 1272291 - DNA, 17 bp, Homo sapiens
gctccttgagtaaaaag

SEQ ID NO: 1272292 - DNA, 23 bp, Homo sapiens
gctccttgcagcagggctgggcc

SEQ ID NO: 1272293 - DNA, 11 bp, Homo sapiens
gctccttgctg

SEQ ID NO: 1272294 - DNA, 22 bp, Homo sapiens
gctccttgctgcattgatccag

SEQ ID NO: 1272295 - DNA, 20 bp, Homo sapiens
gctccttggcacccccatgc

SEQ ID NO: 1272296 - DNA, 22 bp, Homo sapiens
gctccttggcggacactggggg

SEQ ID NO: 1272297 - DNA, 19 bp, Homo sapiens
gctccttggcttacctgac

SEQ ID NO: 1272298 - DNA, 17 bp, Homo sapiens
gctccttgggccctttg

SEQ ID NO: 1272299 - DNA, 19 bp, Homo sapiens
gctccttgggccctttgag

SEQ ID NO: 1272300 - DNA, 14 bp, Homo sapiens
gctcctttctccag

SEQ ID NO: 1272301 - DNA, 16 bp, Homo sapiens
gctcctttctccagcc

SEQ ID NO: 1272302 - DNA, 20 bp, Homo sapiens
gctcctttctccagccagca

SEQ ID NO: 1272303 - DNA, 19 bp, Homo sapiens
gctcctttctcctgtgaat

SEQ ID NO: 1272304 - DNA, 13 bp, Homo sapiens
gctcctttgtgtg

SEQ ID NO: 1272305 - DNA, 20 bp, Homo sapiens
gctcctttgtgtgtgtgtca

SEQ ID NO: 1272306 - DNA, 19 bp, Homo sapiens
gctccttttgtatcttcct

SEQ ID NO: 1272307 - DNA, 18 bp, Homo sapiens
gctccttttgtccccagg

SEQ ID NO: 1272308 - DNA, 21 bp, Homo sapiens
gctccttttgtccccagggcc

SEQ ID NO: 1272309 - DNA, 15 bp, Homo sapiens
gctcgaatctctgtg

SEQ ID NO: 1272310 - DNA, 19 bp, Homo sapiens
gctcgaatctctgtgcctt

SEQ ID NO: 1272311 - DNA, 21 bp, Homo sapiens
gctcgagcagtcctgcctcag

SEQ ID NO: 1272312 - DNA, 14 bp, Homo sapiens
gctcgattttgtat

SEQ ID NO: 1272313 - DNA, 13 bp, Homo sapiens
gctcgcactgccc

SEQ ID NO: 1272314 - DNA, 14 bp, Homo sapiens
gctcgccacgctca

SEQ ID NO: 1272315 - DNA, 13 bp, Homo sapiens
gctcgccatgccg

SEQ ID NO: 1272316 - DNA, 22 bp, Homo sapiens
gctcgcccagacaccatgtgca

SEQ ID NO: 1272317 - DNA, 23 bp, Homo sapiens
gctcgcccatacccgtgacagtg

SEQ ID NO: 1272318 - DNA, 15 bp, Homo sapiens
gctcgccccacccag

SEQ ID NO: 1272319 - DNA, 18 bp, Homo sapiens
gctcgcccctcccctcag

SEQ ID NO: 1272320 - DNA, 16 bp, Homo sapiens
gctcgcccctgttttt

SEQ ID NO: 1272321 - DNA, 19 bp, Homo sapiens
gctcgccctcctttctgtg

SEQ ID NO: 1272322 - DNA, 17 bp, Homo sapiens
gctcgccttccctcctg

SEQ ID NO: 1272323 - DNA, 22 bp, Homo sapiens
gctcgccttccctcctgctttg

SEQ ID NO: 1272324 - DNA, 14 bp, Homo sapiens
gctcgctcaggtga

SEQ ID NO: 1272325 - DNA, 12 bp, Homo sapiens
gctcgctgccat

SEQ ID NO: 1272326 - DNA, 20 bp, Homo sapiens
gctcggacccaccccaactc

SEQ ID NO: 1272327 - DNA, 23 bp, Homo sapiens
gctcggcccggagcagcaggaag

SEQ ID NO: 1272328 - DNA, 15 bp, Homo sapiens
gctcgggaagggagg

SEQ ID NO: 1272329 - DNA, 14 bp, Homo sapiens
gctcggggaggcag

SEQ ID NO: 1272330 - DNA, 15 bp, Homo sapiens
gctcggggtccacca

SEQ ID NO: 1272331 - DNA, 18 bp, Homo sapiens
gctcggtggacccaggga

SEQ ID NO: 1272332 - DNA, 20 bp, Homo sapiens
gctcttttggtggggagcac

SEQ ID NO: 1272333 - DNA, 24 bp, Homo sapiens
gctcttttggtggggagcacttgc

SEQ ID NO: 1272334 - DNA, 14 bp, Homo sapiens
gctcttttgtgatg

SEQ ID NO: 1272335 - DNA, 21 bp, Homo sapiens
gctcttttttgtttgtttctt

SEQ ID NO: 1272336 - DNA, 21 bp, Homo sapiens
gctgaaaaggatcgaggcatg

SEQ ID NO: 1272337 - DNA, 22 bp, Homo sapiens
gctgaaaaggatcgaggcatgg

SEQ ID NO: 1272338 - DNA, 17 bp, Homo sapiens
gctgaaaagggcactcc

SEQ ID NO: 1272339 - DNA, 22 bp, Homo sapiens
gctgaaaagggcactcccaacc

SEQ ID NO: 1272340 - DNA, 19 bp, Homo sapiens
gctgaaaatcaaagtaaaa

SEQ ID NO: 1272341 - DNA, 13 bp, Homo sapiens
gctgaaagccatt

SEQ ID NO: 1272342 - DNA, 16 bp, Homo sapiens
gctgaaagtcctgctt

SEQ ID NO: 1272343 - DNA, 17 bp, Homo sapiens
gctgaaagtcctgcttt

SEQ ID NO: 1272344 - DNA, 19 bp, Homo sapiens
gctgaaagtcctgctttcc

SEQ ID NO: 1272345 - DNA, 15 bp, Homo sapiens
gctgaaatgctgcat

SEQ ID NO: 1272346 - DNA, 17 bp, Homo sapiens
gctgaaattctcctgga

SEQ ID NO: 1272347 - DNA, 18 bp, Homo sapiens
gctgaaattctcctggag

SEQ ID NO: 1272348 - DNA, 23 bp, Homo sapiens
gctgaaattgggtggaggaccgt

SEQ ID NO: 1272349 - DNA, 15 bp, Homo sapiens
gctgaaattttatat

SEQ ID NO: 1272350 - DNA, 19 bp, Homo sapiens
gctgaacacagtgtctgtt

SEQ ID NO: 1272351 - DNA, 13 bp, Homo sapiens
gctgaacatgcct

SEQ ID NO: 1272352 - DNA, 19 bp, Homo sapiens
gctgaacatgcctgccaaa

SEQ ID NO: 1272353 - DNA, 20 bp, Homo sapiens
gctgaacatgcctgccaaag

SEQ ID NO: 1272354 - DNA, 17 bp, Homo sapiens
gctgaacattgcatata

SEQ ID NO: 1272355 - DNA, 15 bp, Homo sapiens
gctgaaccaaagcct

SEQ ID NO: 1272356 - DNA, 20 bp, Homo sapiens
gctgaaccaaagcctcttca

SEQ ID NO: 1272357 - DNA, 13 bp, Homo sapiens
gctgaaccacaga

SEQ ID NO: 1272358 - DNA, 17 bp, Homo sapiens
gctgaacggggagaaaa

SEQ ID NO: 1272359 - DNA, 17 bp, Homo sapiens
gctgaactaagttttgt

SEQ ID NO: 1272360 - DNA, 18 bp, Homo sapiens
gctgaactgacaatgaag

SEQ ID NO: 1272361 - DNA, 14 bp, Homo sapiens
gctgaacttggaga

SEQ ID NO: 1272362 - DNA, 22 bp, Homo sapiens
gctgaagacattcaaaacgtga

SEQ ID NO: 1272363 - DNA, 20 bp, Homo sapiens
gctgaagacctaaagtgctt

SEQ ID NO: 1272364 - DNA, 15 bp, Homo sapiens
gctgaagagaggtgc

SEQ ID NO: 1272365 - DNA, 20 bp, Homo sapiens
gctgaagaggttgaagctaa

SEQ ID NO: 1272366 - DNA, 15 bp, Homo sapiens
gctgaagatgccttg

SEQ ID NO: 1272367 - DNA, 15 bp, Homo sapiens
gctgaagctggagca

SEQ ID NO: 1272368 - DNA, 18 bp, Homo sapiens
gctgaaggctgaggcagg

SEQ ID NO: 1272369 - DNA, 15 bp, Homo sapiens
gctgaagttctgagc

SEQ ID NO: 1272370 - DNA, 16 bp, Homo sapiens
gctgaagttctgagcc

SEQ ID NO: 1272371 - DNA, 20 bp, Homo sapiens
gctgaatatctgttcacttt

SEQ ID NO: 1272372 - DNA, 17 bp, Homo sapiens
gctgaatcccatcaggc

SEQ ID NO: 1272373 - DNA, 19 bp, Homo sapiens
gctgaatcccatcaggctg

SEQ ID NO: 1272374 - DNA, 14 bp, Homo sapiens
gctgaatgcctcct

SEQ ID NO: 1272375 - DNA, 18 bp, Homo sapiens
gctgaatgtatgtaaata

SEQ ID NO: 1272376 - DNA, 17 bp, Homo sapiens
gctgaatgttgggactg

SEQ ID NO: 1272377 - DNA, 13 bp, Homo sapiens
gctgaattaaaat

SEQ ID NO: 1272378 - DNA, 11 bp, Homo sapiens
gctgaattcct

SEQ ID NO: 1272379 - DNA, 19 bp, Homo sapiens
gctgacaaccaccgctccc

SEQ ID NO: 1272380 - DNA, 18 bp, Homo sapiens
gctgacaacttagctcag

SEQ ID NO: 1272381 - DNA, 20 bp, Homo sapiens
gctgacaacttagctcaggt

SEQ ID NO: 1272382 - DNA, 20 bp, Homo sapiens
gctgacaatactgctgcctt

SEQ ID NO: 1272383 - DNA, 18 bp, Homo sapiens
gctgacacctaccatgct

SEQ ID NO: 1272384 - DNA, 19 bp, Homo sapiens
gctgacacctaccatgctg

SEQ ID NO: 1272385 - DNA, 20 bp, Homo sapiens
gctgacacctaccatgctgc

SEQ ID NO: 1272386 - DNA, 13 bp, Homo sapiens
gctgacagacact

SEQ ID NO: 1272387 - DNA, 14 bp, Homo sapiens
gctgacagacacta

SEQ ID NO: 1272388 - DNA, 13 bp, Homo sapiens
gctgacagctgct

SEQ ID NO: 1272389 - DNA, 18 bp, Homo sapiens
gctgacagctgctcctag

SEQ ID NO: 1272390 - DNA, 17 bp, Homo sapiens
gctgacatcagattgtt

SEQ ID NO: 1272391 - DNA, 21 bp, Homo sapiens
gctgacatgaagctgttgtgt

SEQ ID NO: 1272392 - DNA, 13 bp, Homo sapiens
gctgaccaagaga

SEQ ID NO: 1272393 - DNA, 16 bp, Homo sapiens
gctgaccaagagagaa

SEQ ID NO: 1272394 - DNA, 20 bp, Homo sapiens
gctgaccaagagagaaagaa

SEQ ID NO: 1272395 - DNA, 14 bp, Homo sapiens
gctgaccacagcac

SEQ ID NO: 1272396 - DNA, 19 bp, Homo sapiens
gctgaccacagcacagcca

SEQ ID NO: 1272397 - DNA, 13 bp, Homo sapiens
gctgaccagctgg

SEQ ID NO: 1272398 - DNA, 17 bp, Homo sapiens
gctgaccagctggagtg

SEQ ID NO: 1272399 - DNA, 22 bp, Homo sapiens
gctgaccatgctcatctgctgg

SEQ ID NO: 1272400 - DNA, 15 bp, Homo sapiens
gctgacccagcatct

SEQ ID NO: 1272401 - DNA, 14 bp, Homo sapiens
gctgacccaggaat

SEQ ID NO: 1272402 - DNA, 19 bp, Homo sapiens
gctgacccagtccctgggg

SEQ ID NO: 1272403 - DNA, 19 bp, Homo sapiens
gctgaccccaggtcagccc

SEQ ID NO: 1272404 - DNA, 23 bp, Homo sapiens
gctgaccccaggtcagccctgtg

SEQ ID NO: 1272405 - DNA, 18 bp, Homo sapiens
gctgacccctctggtgtg

SEQ ID NO: 1272406 - DNA, 15 bp, Homo sapiens
gctgacccttttctg

SEQ ID NO: 1272407 - DNA, 23 bp, Homo sapiens
gctgacctagaccagtttgcatg

SEQ ID NO: 1272408 - DNA, 14 bp, Homo sapiens
gctgacctctgttg

SEQ ID NO: 1272409 - DNA, 12 bp, Homo sapiens
gctgacctgctg

SEQ ID NO: 1272410 - DNA, 14 bp, Homo sapiens
gctgacctgggccc

SEQ ID NO: 1272411 - DNA, 15 bp, Homo sapiens
gctgaccttggagga

SEQ ID NO: 1272412 - DNA, 19 bp, Homo sapiens
gctgactactactctgcca

SEQ ID NO: 1272413 - DNA, 20 bp, Homo sapiens
gctgactactactctgccaa

SEQ ID NO: 1272414 - DNA, 15 bp, Homo sapiens
gctgactagaagggc

SEQ ID NO: 1272415 - DNA, 23 bp, Homo sapiens
gctgactagaagggccagtcctg

SEQ ID NO: 1272416 - DNA, 14 bp, Homo sapiens
gctgactctctgag

SEQ ID NO: 1272417 - DNA, 19 bp, Homo sapiens
gctgactctctgagctggg

SEQ ID NO: 1272418 - DNA, 22 bp, Homo sapiens
gctgactctctgagctggggag

SEQ ID NO: 1272419 - DNA, 23 bp, Homo sapiens
gctgactctctgagctggggagg

SEQ ID NO: 1272420 - DNA, 18 bp, Homo sapiens
gctgactgatgttgaggg

SEQ ID NO: 1272421 - DNA, 22 bp, Homo sapiens
gctgactgccaataacattctt

SEQ ID NO: 1272422 - DNA, 15 bp, Homo sapiens
gctgactggggctgg

SEQ ID NO: 1272423 - DNA, 16 bp, Homo sapiens
gctgactggggctggg

SEQ ID NO: 1272424 - DNA, 15 bp, Homo sapiens
gctgacttctctgaa

SEQ ID NO: 1272425 - DNA, 14 bp, Homo sapiens
gctgacttggcact

SEQ ID NO: 1272426 - DNA, 17 bp, Homo sapiens
gctgacttggcacttaa

SEQ ID NO: 1272427 - DNA, 20 bp, Homo sapiens
gctgacttggttctgaagcc

SEQ ID NO: 1272428 - DNA, 19 bp, Homo sapiens
gctgagaatctgggggtga

SEQ ID NO: 1272429 - DNA, 15 bp, Homo sapiens
gctgagaccagggtc

SEQ ID NO: 1272430 - DNA, 17 bp, Homo sapiens
gctgagacctgggattt

SEQ ID NO: 1272431 - DNA, 22 bp, Homo sapiens
gctgagagacccaaggaggaaa

SEQ ID NO: 1272432 - DNA, 18 bp, Homo sapiens
gctgagagaccctggcct

SEQ ID NO: 1272433 - DNA, 14 bp, Homo sapiens
gctgagagccccag

SEQ ID NO: 1272434 - DNA, 20 bp, Homo sapiens
gctgagattggaaaagggca

SEQ ID NO: 1272435 - DNA, 20 bp, Homo sapiens
gctgagcacttagcaggcac

SEQ ID NO: 1272436 - DNA, 12 bp, Homo sapiens
gctgagcagcct

SEQ ID NO: 1272437 - DNA, 21 bp, Homo sapiens
gctgagcaggacagccagcag

SEQ ID NO: 1272438 - DNA, 15 bp, Homo sapiens
gctgagccactcgca

SEQ ID NO: 1272439 - DNA, 19 bp, Homo sapiens
gctgagccattgagtgctg

SEQ ID NO: 1272440 - DNA, 12 bp, Homo sapiens
gctgagcccctg

SEQ ID NO: 1272441 - DNA, 13 bp, Homo sapiens
gctgagcccctgt

SEQ ID NO: 1272442 - DNA, 19 bp, Homo sapiens
gctgagcctctgctcccca

SEQ ID NO: 1272443 - DNA, 21 bp, Homo sapiens
gctgagcgcccccgagccctg

SEQ ID NO: 1272444 - DNA, 19 bp, Homo sapiens
gctgagcgtggaaggggga

SEQ ID NO: 1272445 - DNA, 21 bp, Homo sapiens
gctgagcgtggaagggggagg

SEQ ID NO: 1272446 - DNA, 18 bp, Homo sapiens
gctgagctagcctccagc

SEQ ID NO: 1272447 - DNA, 22 bp, Homo sapiens
gctgagctagcctccagctttg

SEQ ID NO: 1272448 - DNA, 11 bp, Homo sapiens
gctgagctggc

SEQ ID NO: 1272449 - DNA, 16 bp, Homo sapiens
gctgagctgggcccag

SEQ ID NO: 1272450 - DNA, 14 bp, Homo sapiens
gctgagctggggaa

SEQ ID NO: 1272451 - DNA, 13 bp, Homo sapiens
gctgagctgtgac

SEQ ID NO: 1272452 - DNA, 16 bp, Homo sapiens
gctgagcttagccttg

SEQ ID NO: 1272453 - DNA, 22 bp, Homo sapiens
gctgagcttagccttgtgccct

SEQ ID NO: 1272454 - DNA, 23 bp, Homo sapiens
gctgcctgggctgttggcactca

SEQ ID NO: 1272455 - DNA, 12 bp, Homo sapiens
gctgcctggggc

SEQ ID NO: 1272456 - DNA, 13 bp, Homo sapiens
gctgcctggtctg

SEQ ID NO: 1272457 - DNA, 13 bp, Homo sapiens
gctgcctgtagtt

SEQ ID NO: 1272458 - DNA, 15 bp, Homo sapiens
gctgcctgtagttag

SEQ ID NO: 1272459 - DNA, 12 bp, Homo sapiens
gctgcctgtgcc

SEQ ID NO: 1272460 - DNA, 13 bp, Homo sapiens
gctgcctgtgcca

SEQ ID NO: 1272461 - DNA, 20 bp, Homo sapiens
gctgccttagaacctttctt

SEQ ID NO: 1272462 - DNA, 15 bp, Homo sapiens
gctgccttccctagc

SEQ ID NO: 1272463 - DNA, 15 bp, Homo sapiens
gctgccttcctcatc

SEQ ID NO: 1272464 - DNA, 16 bp, Homo sapiens
gctgccttcctcatcc

SEQ ID NO: 1272465 - DNA, 16 bp, Homo sapiens
gctgccttggctcaga

SEQ ID NO: 1272466 - DNA, 17 bp, Homo sapiens
gctgccttggctcagac

SEQ ID NO: 1272467 - DNA, 22 bp, Homo sapiens
gctgcctttgtccccacacagc

SEQ ID NO: 1272468 - DNA, 17 bp, Homo sapiens
gctgccttttctggagt

SEQ ID NO: 1272469 - DNA, 21 bp, Homo sapiens
gctgcgcctgcaggcagagct

SEQ ID NO: 1272470 - DNA, 19 bp, Homo sapiens
gctgcgcggactcgccccc

SEQ ID NO: 1272471 - DNA, 23 bp, Homo sapiens
gctgcggacaccgtggcctgggc

SEQ ID NO: 1272472 - DNA, 15 bp, Homo sapiens
gctgctaattcccaa

SEQ ID NO: 1272473 - DNA, 18 bp, Homo sapiens
gctgctacatcagactct

SEQ ID NO: 1272474 - DNA, 12 bp, Homo sapiens
gctgctacccag

SEQ ID NO: 1272475 - DNA, 17 bp, Homo sapiens
gctgctaccgccctggg

SEQ ID NO: 1272476 - DNA, 21 bp, Homo sapiens
gctgctaccgccctgggctgg

SEQ ID NO: 1272477 - DNA, 17 bp, Homo sapiens
gctgctacctaaaaaaa

SEQ ID NO: 1272478 - DNA, 17 bp, Homo sapiens
gctgctagagaaggggg

SEQ ID NO: 1272479 - DNA, 23 bp, Homo sapiens
gctgctagcacttggagccaagg

SEQ ID NO: 1272480 - DNA, 13 bp, Homo sapiens
gctgctaggccag

SEQ ID NO: 1272481 - DNA, 17 bp, Homo sapiens
gctgctatccccatctc

SEQ ID NO: 1272482 - DNA, 21 bp, Homo sapiens
gctgctatccccatctccctg

SEQ ID NO: 1272483 - DNA, 17 bp, Homo sapiens
gctgctattgctgtctg

SEQ ID NO: 1272484 - DNA, 21 bp, Homo sapiens
gctgctattgctgtctggtga

SEQ ID NO: 1272485 - DNA, 18 bp, Homo sapiens
gctgctcaggcccatgct

SEQ ID NO: 1272486 - DNA, 20 bp, Homo sapiens
gctgctcagggaaaagcagc

SEQ ID NO: 1272487 - DNA, 19 bp, Homo sapiens
gctgctccaggcctgcagc

SEQ ID NO: 1272488 - DNA, 23 bp, Homo sapiens
gctgctccaggcctgcagcagga

SEQ ID NO: 1272489 - DNA, 23 bp, Homo sapiens
gctgctcccacacttgtgccagc

SEQ ID NO: 1272490 - DNA, 24 bp, Homo sapiens
gctgctcccacacttgtgccagcc

SEQ ID NO: 1272491 - DNA, 21 bp, Homo sapiens
gctgctccccaacacctgcct

SEQ ID NO: 1272492 - DNA, 21 bp, Homo sapiens
gctgctccccacccctaccga

SEQ ID NO: 1272493 - DNA, 13 bp, Homo sapiens
gctgctcccctgc

SEQ ID NO: 1272494 - DNA, 13 bp, Homo sapiens
gctgctcccctgg

SEQ ID NO: 1272495 - DNA, 23 bp, Homo sapiens
gctgctccggtttgggctgtctt

SEQ ID NO: 1272496 - DNA, 23 bp, Homo sapiens
gctgctcctagagggaggggcct

SEQ ID NO: 1272497 - DNA, 11 bp, Homo sapiens
gctgctcctcc

SEQ ID NO: 1272498 - DNA, 16 bp, Homo sapiens
gctgctcctccagccc

SEQ ID NO: 1272499 - DNA, 18 bp, Homo sapiens
gctgctcctccagccctt

SEQ ID NO: 1272500 - DNA, 17 bp, Homo sapiens
gctgctctagctggcag

SEQ ID NO: 1272501 - DNA, 18 bp, Homo sapiens
gctgctctagctggcagg

SEQ ID NO: 1272502 - DNA, 22 bp, Homo sapiens
gctgctctagctggcaggacac

SEQ ID NO: 1272503 - DNA, 20 bp, Homo sapiens
gctgctctgccccttgggca

SEQ ID NO: 1272504 - DNA, 19 bp, Homo sapiens
gctgctctggtgcacgcct

SEQ ID NO: 1272505 - DNA, 10 bp, Homo sapiens
gctgctgacc

SEQ ID NO: 1272506 - DNA, 12 bp, Homo sapiens
gctgctgaccaa

SEQ ID NO: 1272507 - DNA, 16 bp, Homo sapiens
gctgctgccagggctt

SEQ ID NO: 1272508 - DNA, 18 bp, Homo sapiens
gctgctgccagggcttcc

SEQ ID NO: 1272509 - DNA, 17 bp, Homo sapiens
gctgctgcccccacccc

SEQ ID NO: 1272510 - DNA, 13 bp, Homo sapiens
gctgctgcctctt

SEQ ID NO: 1272511 - DNA, 12 bp, Homo sapiens
gctgctgcctgg

SEQ ID NO: 1272512 - DNA, 12 bp, Homo sapiens
gctgctgccttg

SEQ ID NO: 1272513 - DNA, 14 bp, Homo sapiens
gctgctgctaccag

SEQ ID NO: 1272514 - DNA, 15 bp, Homo sapiens
gctgctgctattgct

SEQ ID NO: 1272515 - DNA, 14 bp, Homo sapiens
gctgctgctgctat

SEQ ID NO: 1272516 - DNA, 13 bp, Homo sapiens
gctgctgcttctg

SEQ ID NO: 1272517 - DNA, 14 bp, Homo sapiens
gctgctgcttctgc

SEQ ID NO: 1272518 - DNA, 16 bp, Homo sapiens
gctgctgcttctgctc

SEQ ID NO: 1272519 - DNA, 17 bp, Homo sapiens
gctgctggaaacacagt

SEQ ID NO: 1272520 - DNA, 21 bp, Homo sapiens
gctgctggccaaatagcaaag

SEQ ID NO: 1272521 - DNA, 22 bp, Homo sapiens
gctgctggccaaatagcaaaga

SEQ ID NO: 1272522 - DNA, 12 bp, Homo sapiens
gctgctggctga

SEQ ID NO: 1272523 - DNA, 19 bp, Homo sapiens
gctgctggctgacctgggc

SEQ ID NO: 1272524 - DNA, 15 bp, Homo sapiens
gctgctggcttgcag

SEQ ID NO: 1272525 - DNA, 19 bp, Homo sapiens
gctgctgggcgtctgttct

SEQ ID NO: 1272526 - DNA, 20 bp, Homo sapiens
gctgctgggcgtctgttctt

SEQ ID NO: 1272527 - DNA, 12 bp, Homo sapiens
gctgctggggca

SEQ ID NO: 1272528 - DNA, 23 bp, Homo sapiens
gctgctggggcatgtgtgcctgt

SEQ ID NO: 1272529 - DNA, 19 bp, Homo sapiens
gctgctggtaacagtggct

SEQ ID NO: 1272530 - DNA, 19 bp, Homo sapiens
gctgctgtaactgctgagc

SEQ ID NO: 1272531 - DNA, 21 bp, Homo sapiens
gctgctgtaactgctgagcca

SEQ ID NO: 1272532 - DNA, 22 bp, Homo sapiens
gctgctgtaactgctgagccac

SEQ ID NO: 1272533 - DNA, 15 bp, Homo sapiens
gctgctgtccctccc

SEQ ID NO: 1272534 - DNA, 16 bp, Homo sapiens
gctgctgtccctcccc

SEQ ID NO: 1272535 - DNA, 12 bp, Homo sapiens
gctgctgtgaat

SEQ ID NO: 1272536 - DNA, 12 bp, Homo sapiens
gctgctgtgccc

SEQ ID NO: 1272537 - DNA, 19 bp, Homo sapiens
gctgctgtgccccaccacg

SEQ ID NO: 1272538 - DNA, 21 bp, Homo sapiens
gctgctgtgtgctttttttgt

SEQ ID NO: 1272539 - DNA, 22 bp, Homo sapiens
gctgctgtgtgctttttttgtg

SEQ ID NO: 1272540 - DNA, 15 bp, Homo sapiens
gctgctgtgtgtgag

SEQ ID NO: 1272541 - DNA, 19 bp, Homo sapiens
gctgctgttctcaggacag

SEQ ID NO: 1272542 - DNA, 20 bp, Homo sapiens
gctgctgttctcaggacagc

SEQ ID NO: 1272543 - DNA, 20 bp, Homo sapiens
gctgcttagaatccaaactt

SEQ ID NO: 1272544 - DNA, 16 bp, Homo sapiens
gctgcttccaggctgg

SEQ ID NO: 1272545 - DNA, 22 bp, Homo sapiens
gctgcttccctctgcctgtccc

SEQ ID NO: 1272546 - DNA, 13 bp, Homo sapiens
gctgcttcctcct

SEQ ID NO: 1272547 - DNA, 16 bp, Homo sapiens
gctgcttcctcctgga

SEQ ID NO: 1272548 - DNA, 22 bp, Homo sapiens
gctgcttctacggccatgagac

SEQ ID NO: 1272549 - DNA, 16 bp, Homo sapiens
gctgcttctcccccca

SEQ ID NO: 1272550 - DNA, 20 bp, Homo sapiens
gctgcttctccccccatccc

SEQ ID NO: 1272551 - DNA, 21 bp, Homo sapiens
gctgcttctctacagaggtga

SEQ ID NO: 1272552 - DNA, 18 bp, Homo sapiens
gctgcttctgctccagcc

SEQ ID NO: 1272553 - DNA, 20 bp, Homo sapiens
gctgcttctgctccagcccc

SEQ ID NO: 1272554 - DNA, 23 bp, Homo sapiens
gctgcttctgctgcctaggttct

SEQ ID NO: 1272555 - DNA, 13 bp, Homo sapiens
gctgcttcttgct

SEQ ID NO: 1272556 - DNA, 15 bp, Homo sapiens
gctgcttgacctagc

SEQ ID NO: 1272557 - DNA, 14 bp, Homo sapiens
gctgcttgcagcca

SEQ ID NO: 1272558 - DNA, 17 bp, Homo sapiens
gctgcttgcagccagga

SEQ ID NO: 1272559 - DNA, 19 bp, Homo sapiens
gctgcttgcagccaggaga

SEQ ID NO: 1272560 - DNA, 19 bp, Homo sapiens
gctgcttgcttttgcctct

SEQ ID NO: 1272561 - DNA, 24 bp, Homo sapiens
gctgcttggatgcgagcttggcct

SEQ ID NO: 1272562 - DNA, 13 bp, Homo sapiens
gctgctttactta

SEQ ID NO: 1272563 - DNA, 20 bp, Homo sapiens
gctgctttcccctgtgggga

SEQ ID NO: 1272564 - DNA, 21 bp, Homo sapiens
gctgctttcccctgtggggat

SEQ ID NO: 1272565 - DNA, 17 bp, Homo sapiens
gctgctttttggcacag

SEQ ID NO: 1272566 - DNA, 23 bp, Homo sapiens
gctggaaacaagtgaccccaggg

SEQ ID NO: 1272567 - DNA, 20 bp, Homo sapiens
gctggaaacagactcgattc

SEQ ID NO: 1272568 - DNA, 22 bp, Homo sapiens
gctggaaaccaagtcaggccag

SEQ ID NO: 1272569 - DNA, 23 bp, Homo sapiens
gctggaaaccaagtcaggccagg

SEQ ID NO: 1272570 - DNA, 19 bp, Homo sapiens
gctggaacactttcagttt

SEQ ID NO: 1272571 - DNA, 12 bp, Homo sapiens
gctggaacattt

SEQ ID NO: 1272572 - DNA, 18 bp, Homo sapiens
gctggaactttagtgaaa

SEQ ID NO: 1272573 - DNA, 14 bp, Homo sapiens
gctggaagaacatc

SEQ ID NO: 1272574 - DNA, 21 bp, Homo sapiens
gctggaagaggtgggtggtgg

SEQ ID NO: 1272575 - DNA, 16 bp, Homo sapiens
gctggggtgagcctga

SEQ ID NO: 1272576 - DNA, 18 bp, Homo sapiens
gctgggtaagagcacagg

SEQ ID NO: 1272577 - DNA, 18 bp, Homo sapiens
gctgggtcaaaagagccc

SEQ ID NO: 1272578 - DNA, 20 bp, Homo sapiens
gctgggtcaaaagagccctg

SEQ ID NO: 1272579 - DNA, 15 bp, Homo sapiens
gctgggtcaggcagg

SEQ ID NO: 1272580 - DNA, 23 bp, Homo sapiens
gctgggtcagggccagactggaa

SEQ ID NO: 1272581 - DNA, 16 bp, Homo sapiens
gctgggtcccagcctg

SEQ ID NO: 1272582 - DNA, 17 bp, Homo sapiens
gctgggtgccctctcag

SEQ ID NO: 1272583 - DNA, 21 bp, Homo sapiens
gctgggtggcaccagcagcct

SEQ ID NO: 1272584 - DNA, 17 bp, Homo sapiens
gctgggtggcccctgtc

SEQ ID NO: 1272585 - DNA, 13 bp, Homo sapiens
gctgggtgtttca

SEQ ID NO: 1272586 - DNA, 16 bp, Homo sapiens
gctgggttcatttgtg

SEQ ID NO: 1272587 - DNA, 17 bp, Homo sapiens
gctgggttccgggaggc

SEQ ID NO: 1272588 - DNA, 16 bp, Homo sapiens
gctggtaacagtggct

SEQ ID NO: 1272589 - DNA, 13 bp, Homo sapiens
gctggtaacagtt

SEQ ID NO: 1272590 - DNA, 22 bp, Homo sapiens
gctggtaacagttcatgtttgc

SEQ ID NO: 1272591 - DNA, 15 bp, Homo sapiens
gctggtagagacccc

SEQ ID NO: 1272592 - DNA, 21 bp, Homo sapiens
gctggtagagacccccaggcc

SEQ ID NO: 1272593 - DNA, 15 bp, Homo sapiens
gctggtagcagcagg

SEQ ID NO: 1272594 - DNA, 16 bp, Homo sapiens
gctggtagctgagggg

SEQ ID NO: 1272595 - DNA, 19 bp, Homo sapiens
gctggtagctgaggggacg

SEQ ID NO: 1272596 - DNA, 22 bp, Homo sapiens
gctggtcaaacaaactctctga

SEQ ID NO: 1272597 - DNA, 23 bp, Homo sapiens
gctggtcactctgccctctgctg

SEQ ID NO: 1272598 - DNA, 15 bp, Homo sapiens
gctggtcatccttgg

SEQ ID NO: 1272599 - DNA, 15 bp, Homo sapiens
gctggtccgtgggac

SEQ ID NO: 1272600 - DNA, 16 bp, Homo sapiens
gctggtccgtgggacg

SEQ ID NO: 1272601 - DNA, 18 bp, Homo sapiens
gctggtctcaaactcctg

SEQ ID NO: 1272602 - DNA, 19 bp, Homo sapiens
gctggtctcaaactcctga

SEQ ID NO: 1272603 - DNA, 22 bp, Homo sapiens
gctggtcttcactttcctcagt

SEQ ID NO: 1272604 - DNA, 15 bp, Homo sapiens
gctggtgacagcctt

SEQ ID NO: 1272605 - DNA, 16 bp, Homo sapiens
gctggtgacagccttg

SEQ ID NO: 1272606 - DNA, 23 bp, Homo sapiens
gctggtgacagccttgggccttt

SEQ ID NO: 1272607 - DNA, 15 bp, Homo sapiens
gctggtgagaccccg

SEQ ID NO: 1272608 - DNA, 13 bp, Homo sapiens
gctggtgcaaaga

SEQ ID NO: 1272609 - DNA, 22 bp, Homo sapiens
gctggtgcattctgtttcctct

SEQ ID NO: 1272610 - DNA, 21 bp, Homo sapiens
gctggtgccaaatagccccag

SEQ ID NO: 1272611 - DNA, 14 bp, Homo sapiens
gctggtgccagcct

SEQ ID NO: 1272612 - DNA, 14 bp, Homo sapiens
gctggtgccccaca

SEQ ID NO: 1272613 - DNA, 15 bp, Homo sapiens
gctggtgccccacag

SEQ ID NO: 1272614 - DNA, 13 bp, Homo sapiens
gctggtgcccgga

SEQ ID NO: 1272615 - DNA, 14 bp, Homo sapiens
gctggtgcccggag

SEQ ID NO: 1272616 - DNA, 21 bp, Homo sapiens
gctggtggagaactctggctt

SEQ ID NO: 1272617 - DNA, 22 bp, Homo sapiens
gctggtggccctgtgcctgggc

SEQ ID NO: 1272618 - DNA, 15 bp, Homo sapiens
gctggtggccttggg

SEQ ID NO: 1272619 - DNA, 16 bp, Homo sapiens
gctggtggccttgggc

SEQ ID NO: 1272620 - DNA, 18 bp, Homo sapiens
gctggtggccttgggcct

SEQ ID NO: 1272621 - DNA, 21 bp, Homo sapiens
gctggtgggtctgagctggac

SEQ ID NO: 1272622 - DNA, 23 bp, Homo sapiens
gctggtggtttgatcatttctgc

SEQ ID NO: 1272623 - DNA, 20 bp, Homo sapiens
gctggtggttttcagagcag

SEQ ID NO: 1272624 - DNA, 20 bp, Homo sapiens
gctggtggtttttcagctcc

SEQ ID NO: 1272625 - DNA, 12 bp, Homo sapiens
gctggtgtcccc

SEQ ID NO: 1272626 - DNA, 15 bp, Homo sapiens
gctggtgtccccttc

SEQ ID NO: 1272627 - DNA, 22 bp, Homo sapiens
gctggtgtccccttcccctgct

SEQ ID NO: 1272628 - DNA, 17 bp, Homo sapiens
gctggtgtcctgaccac

SEQ ID NO: 1272629 - DNA, 18 bp, Homo sapiens
gctggtgtcctgaccacc

SEQ ID NO: 1272630 - DNA, 19 bp, Homo sapiens
gctggtgtcctgaccaccc

SEQ ID NO: 1272631 - DNA, 21 bp, Homo sapiens
gctggtgttcaccaaaaccaa

SEQ ID NO: 1272632 - DNA, 17 bp, Homo sapiens
gctggttacctgttcca

SEQ ID NO: 1272633 - DNA, 13 bp, Homo sapiens
gctggttcctctc

SEQ ID NO: 1272634 - DNA, 23 bp, Homo sapiens
gctggttcctctctcccacccta

SEQ ID NO: 1272635 - DNA, 15 bp, Homo sapiens
gctggtttaatgttt

SEQ ID NO: 1272636 - DNA, 15 bp, Homo sapiens
gctggtttcctcatt

SEQ ID NO: 1272637 - DNA, 22 bp, Homo sapiens
gctggtttgaaagattatgatg

SEQ ID NO: 1272638 - DNA, 14 bp, Homo sapiens
gctggttttcctaa

SEQ ID NO: 1272639 - DNA, 14 bp, Homo sapiens
gctggtttttcagt

SEQ ID NO: 1272640 - DNA, 16 bp, Homo sapiens
gctgtaaaatgcatga

SEQ ID NO: 1272641 - DNA, 18 bp, Homo sapiens
gctgtaactcagacattc

SEQ ID NO: 1272642 - DNA, 23 bp, Homo sapiens
gctgtaactcagacattccaagg

SEQ ID NO: 1272643 - DNA, 15 bp, Homo sapiens
gctgtaactgctgag

SEQ ID NO: 1272644 - DNA, 18 bp, Homo sapiens
gctgtaactgctgagcca

SEQ ID NO: 1272645 - DNA, 22 bp, Homo sapiens
gctgtaagcattctgagctggg

SEQ ID NO: 1272646 - DNA, 23 bp, Homo sapiens
gctgtaaggatccggaaagaaga

SEQ ID NO: 1272647 - DNA, 13 bp, Homo sapiens
gctgtaagggcag

SEQ ID NO: 1272648 - DNA, 14 bp, Homo sapiens
gctgtaagggcagt

SEQ ID NO: 1272649 - DNA, 18 bp, Homo sapiens
gctgtaagggcagtgccc

SEQ ID NO: 1272650 - DNA, 19 bp, Homo sapiens
gctgtaagggcagtgccca

SEQ ID NO: 1272651 - DNA, 22 bp, Homo sapiens
gctgtaatattgtaaatactgg

SEQ ID NO: 1272652 - DNA, 22 bp, Homo sapiens
gctgtaatcatttgtttacatt

SEQ ID NO: 1272653 - DNA, 22 bp, Homo sapiens
gctgtaatctatgaattctaag

SEQ ID NO: 1272654 - DNA, 16 bp, Homo sapiens
gctgtacaaatataag

SEQ ID NO: 1272655 - DNA, 14 bp, Homo sapiens
gctgtacaggaaaa

SEQ ID NO: 1272656 - DNA, 16 bp, Homo sapiens
gctgtacatctatttt

SEQ ID NO: 1272657 - DNA, 22 bp, Homo sapiens
gctgtacatctattttggattg

SEQ ID NO: 1272658 - DNA, 21 bp, Homo sapiens
gctgtaccacatctgctctag

SEQ ID NO: 1272659 - DNA, 18 bp, Homo sapiens
gctgtacccttccacctc

SEQ ID NO: 1272660 - DNA, 15 bp, Homo sapiens
gctgtacccttgaga

SEQ ID NO: 1272661 - DNA, 18 bp, Homo sapiens
gctgtacgacacgggtgg

SEQ ID NO: 1272662 - DNA, 15 bp, Homo sapiens
gctgtacgtactgca

SEQ ID NO: 1272663 - DNA, 14 bp, Homo sapiens
gctgtactcagagc

SEQ ID NO: 1272664 - DNA, 19 bp, Homo sapiens
gctgtactcagagcagagc

SEQ ID NO: 1272665 - DNA, 16 bp, Homo sapiens
gctgtagatcaggttt

SEQ ID NO: 1272666 - DNA, 19 bp, Homo sapiens
gctgtagatggtgacctgg

SEQ ID NO: 1272667 - DNA, 13 bp, Homo sapiens
gctgtagccatgg

SEQ ID NO: 1272668 - DNA, 17 bp, Homo sapiens
gctgtagccatggctca

SEQ ID NO: 1272669 - DNA, 19 bp, Homo sapiens
gctgtagccatggctcagg

SEQ ID NO: 1272670 - DNA, 20 bp, Homo sapiens
gctgtagccatggctcaggc

SEQ ID NO: 1272671 - DNA, 20 bp, Homo sapiens
gctgtagtagccctttctgt

SEQ ID NO: 1272672 - DNA, 20 bp, Homo sapiens
gctgtatcttgatgtttaga

SEQ ID NO: 1272673 - DNA, 14 bp, Homo sapiens
gctgtatgatttgt

SEQ ID NO: 1272674 - DNA, 16 bp, Homo sapiens
gctgtatgatttgttt

SEQ ID NO: 1272675 - DNA, 15 bp, Homo sapiens
gctgtatgtgagctg

SEQ ID NO: 1272676 - DNA, 19 bp, Homo sapiens
gctgtattgcccccatggg

SEQ ID NO: 1272677 - DNA, 15 bp, Homo sapiens
gctgtattgtctgaa

SEQ ID NO: 1272678 - DNA, 22 bp, Homo sapiens
gctgtatttctttgtagaataa

SEQ ID NO: 1272679 - DNA, 13 bp, Homo sapiens
gctgtatttgctg

SEQ ID NO: 1272680 - DNA, 15 bp, Homo sapiens
gctgtattttaacac

SEQ ID NO: 1272681 - DNA, 18 bp, Homo sapiens
gctgtattttaacacttt

SEQ ID NO: 1272682 - DNA, 22 bp, Homo sapiens
gctgtcaaggccgagggccagg

SEQ ID NO: 1272683 - DNA, 14 bp, Homo sapiens
gctgtcaaggctca

SEQ ID NO: 1272684 - DNA, 15 bp, Homo sapiens
gctgtcaataaatga

SEQ ID NO: 1272685 - DNA, 20 bp, Homo sapiens
gctgtcaataaatgacaccc

SEQ ID NO: 1272686 - DNA, 20 bp, Homo sapiens
gctgtcaccctccaccgagc

SEQ ID NO: 1272687 - DNA, 18 bp, Homo sapiens
gctgtcataagaatgaat

SEQ ID NO: 1272688 - DNA, 14 bp, Homo sapiens
gctgtcatctgtgc

SEQ ID NO: 1272689 - DNA, 15 bp, Homo sapiens
gctgtcatctgtgca

SEQ ID NO: 1272690 - DNA, 14 bp, Homo sapiens
gctgtccagcctta

SEQ ID NO: 1272691 - DNA, 13 bp, Homo sapiens
gctgtccaggcag

SEQ ID NO: 1272692 - DNA, 15 bp, Homo sapiens
gctgtccaggcagct

SEQ ID NO: 1272693 - DNA, 16 bp, Homo sapiens
gctgtcccagccccgg

SEQ ID NO: 1272694 - DNA, 21 bp, Homo sapiens
gctgtcccaggcatgcagctg

SEQ ID NO: 1272695 - DNA, 23 bp, Homo sapiens
gctgtcccaggcatgcagctgcc

SEQ ID NO: 1272696 - DNA, 19 bp, Homo sapiens
gctgtccctatacactaga

SEQ ID NO: 1272697 - DNA, 13 bp, Homo sapiens
gcttcctttctct

SEQ ID NO: 1272698 - DNA, 19 bp, Homo sapiens
gcttcctttctctcctggc

SEQ ID NO: 1272699 - DNA, 20 bp, Homo sapiens
gcttcctttctctcctggct

SEQ ID NO: 1272700 - DNA, 12 bp, Homo sapiens
gcttcctttctt

SEQ ID NO: 1272701 - DNA, 17 bp, Homo sapiens
gcttccttttaaataaa

SEQ ID NO: 1272702 - DNA, 15 bp, Homo sapiens
gcttcgactactgct

SEQ ID NO: 1272703 - DNA, 21 bp, Homo sapiens
gcttcgaggcccagcgacctc

SEQ ID NO: 1272704 - DNA, 15 bp, Homo sapiens
gcttcggagggccgc

SEQ ID NO: 1272705 - DNA, 15 bp, Homo sapiens
gcttcggccacaggc

SEQ ID NO: 1272706 - DNA, 19 bp, Homo sapiens
gcttcggccgcgccacccg

SEQ ID NO: 1272707 - DNA, 15 bp, Homo sapiens
gcttcggggcctcct

SEQ ID NO: 1272708 - DNA, 16 bp, Homo sapiens
gcttcggtgtgcagat

SEQ ID NO: 1272709 - DNA, 16 bp, Homo sapiens
gcttcggttctccaga

SEQ ID NO: 1272710 - DNA, 23 bp, Homo sapiens
gcttcggttctccagaatgtaag

SEQ ID NO: 1272711 - DNA, 14 bp, Homo sapiens
gcttcgtgctggag

SEQ ID NO: 1272712 - DNA, 17 bp, Homo sapiens
gcttcgtgctggaggaa

SEQ ID NO: 1272713 - DNA, 17 bp, Homo sapiens
gcttcgtttattttcaa

SEQ ID NO: 1272714 - DNA, 16 bp, Homo sapiens
gcttctaaatgcccag

SEQ ID NO: 1272715 - DNA, 18 bp, Homo sapiens
gcttctaagtaaatacaa

SEQ ID NO: 1272716 - DNA, 17 bp, Homo sapiens
gcttctaccatgaacag

SEQ ID NO: 1272717 - DNA, 18 bp, Homo sapiens
gcttctacggccatgaga

SEQ ID NO: 1272718 - DNA, 13 bp, Homo sapiens
gcttctactttca

SEQ ID NO: 1272719 - DNA, 16 bp, Homo sapiens
gcttctactttcatct

SEQ ID NO: 1272720 - DNA, 22 bp, Homo sapiens
gcttctactttcatcttaaact

SEQ ID NO: 1272721 - DNA, 16 bp, Homo sapiens
gcttctagaaactctg

SEQ ID NO: 1272722 - DNA, 19 bp, Homo sapiens
gcttctagaaactctggct

SEQ ID NO: 1272723 - DNA, 20 bp, Homo sapiens
gcttctagaaactctggctc

SEQ ID NO: 1272724 - DNA, 23 bp, Homo sapiens
gcttctagaaactctggctcagc

SEQ ID NO: 1272725 - DNA, 16 bp, Homo sapiens
gcttctccaagcatca

SEQ ID NO: 1272726 - DNA, 16 bp, Homo sapiens
gcttctcccatttcct

SEQ ID NO: 1272727 - DNA, 21 bp, Homo sapiens
gcttctcccatttcctgatct

SEQ ID NO: 1272728 - DNA, 13 bp, Homo sapiens
gcttctcccccca

SEQ ID NO: 1272729 - DNA, 17 bp, Homo sapiens
gcttctccccccatccc

SEQ ID NO: 1272730 - DNA, 21 bp, Homo sapiens
gcttctccccccatcccaggg

SEQ ID NO: 1272731 - DNA, 23 bp, Homo sapiens
gcttctccccccatcccagggtc

SEQ ID NO: 1272732 - DNA, 15 bp, Homo sapiens
gcttctccgccagcc

SEQ ID NO: 1272733 - DNA, 19 bp, Homo sapiens
gcttctccgccagcctcct

SEQ ID NO: 1272734 - DNA, 21 bp, Homo sapiens
gcttctccgccagcctcctct

SEQ ID NO: 1272735 - DNA, 14 bp, Homo sapiens
gcttctcctgtgac

SEQ ID NO: 1272736 - DNA, 15 bp, Homo sapiens
gcttctcctgtgacc

SEQ ID NO: 1272737 - DNA, 19 bp, Homo sapiens
gcttctcggggtccagtgc

SEQ ID NO: 1272738 - DNA, 14 bp, Homo sapiens
gcttctctacagac

SEQ ID NO: 1272739 - DNA, 21 bp, Homo sapiens
gcttctctagctctctaggcc

SEQ ID NO: 1272740 - DNA, 16 bp, Homo sapiens
gcttctctctccaggg

SEQ ID NO: 1272741 - DNA, 17 bp, Homo sapiens
gcttctctctccagggt

SEQ ID NO: 1272742 - DNA, 19 bp, Homo sapiens
gcttctctctccctgtcac

SEQ ID NO: 1272743 - DNA, 16 bp, Homo sapiens
gcttctctcttttaaa

SEQ ID NO: 1272744 - DNA, 13 bp, Homo sapiens
gcttctctgactt

SEQ ID NO: 1272745 - DNA, 20 bp, Homo sapiens
gcttctctgacttctgcctg

SEQ ID NO: 1272746 - DNA, 23 bp, Homo sapiens
gcttctcttgggaactccactct

SEQ ID NO: 1272747 - DNA, 19 bp, Homo sapiens
gcttctctttcccccaccc

SEQ ID NO: 1272748 - DNA, 14 bp, Homo sapiens
gcttctcttttcct

SEQ ID NO: 1272749 - DNA, 14 bp, Homo sapiens
gcttctgaatcact

SEQ ID NO: 1272750 - DNA, 19 bp, Homo sapiens
gcttctgaatgctgctact

SEQ ID NO: 1272751 - DNA, 13 bp, Homo sapiens
gcttctgcaccct

SEQ ID NO: 1272752 - DNA, 19 bp, Homo sapiens
gcttctgcaccctccaccc

SEQ ID NO: 1272753 - DNA, 19 bp, Homo sapiens
gcttctgcagcctcggcct

SEQ ID NO: 1272754 - DNA, 19 bp, Homo sapiens
gcttctgcgtccaccaggc

SEQ ID NO: 1272755 - DNA, 18 bp, Homo sapiens
gcttctgctccagcccct

SEQ ID NO: 1272756 - DNA, 13 bp, Homo sapiens
gcttctgctggag

SEQ ID NO: 1272757 - DNA, 19 bp, Homo sapiens
gcttctgcttttctgccct

SEQ ID NO: 1272758 - DNA, 17 bp, Homo sapiens
gcttctggaaactacca

SEQ ID NO: 1272759 - DNA, 20 bp, Homo sapiens
gcttctggaatttgttcaag

SEQ ID NO: 1272760 - DNA, 23 bp, Homo sapiens
gcttctggaatttgttcaagttt

SEQ ID NO: 1272761 - DNA, 14 bp, Homo sapiens
gcttctggagccct

SEQ ID NO: 1272762 - DNA, 18 bp, Homo sapiens
gcttctggagcccttggg

SEQ ID NO: 1272763 - DNA, 15 bp, Homo sapiens
gcttctgtccaggac

SEQ ID NO: 1272764 - DNA, 17 bp, Homo sapiens
gcttctgtgatgagctg

SEQ ID NO: 1272765 - DNA, 19 bp, Homo sapiens
gcttctgtgatgagctgat

SEQ ID NO: 1272766 - DNA, 20 bp, Homo sapiens
gcttctgtgcactagcctgt

SEQ ID NO: 1272767 - DNA, 22 bp, Homo sapiens
gcttctgtgcactagcctgtga

SEQ ID NO: 1272768 - DNA, 17 bp, Homo sapiens
gcttctgtgtaccactt

SEQ ID NO: 1272769 - DNA, 22 bp, Homo sapiens
gcttctgtgtaccacttctgtg

SEQ ID NO: 1272770 - DNA, 15 bp, Homo sapiens
gcttctgttctctgc

SEQ ID NO: 1272771 - DNA, 13 bp, Homo sapiens
gcttctgttgtaa

SEQ ID NO: 1272772 - DNA, 19 bp, Homo sapiens
gcttctgttgtaatagtcc

SEQ ID NO: 1272773 - DNA, 14 bp, Homo sapiens
gcttcttaaaaact

SEQ ID NO: 1272774 - DNA, 20 bp, Homo sapiens
gcttcttaaaaactgtgtat

SEQ ID NO: 1272775 - DNA, 18 bp, Homo sapiens
gcttcttactgataattt

SEQ ID NO: 1272776 - DNA, 19 bp, Homo sapiens
gcttcttcagatcagtgct

SEQ ID NO: 1272777 - DNA, 15 bp, Homo sapiens
gcttcttcagctgac

SEQ ID NO: 1272778 - DNA, 19 bp, Homo sapiens
gcttcttcctaggtccaag

SEQ ID NO: 1272779 - DNA, 21 bp, Homo sapiens
gcttcttcctaggtccaagcc

SEQ ID NO: 1272780 - DNA, 11 bp, Homo sapiens
gcttcttcctc

SEQ ID NO: 1272781 - DNA, 14 bp, Homo sapiens
gcttcttcctcctc

SEQ ID NO: 1272782 - DNA, 15 bp, Homo sapiens
gcttcttgcactcct

SEQ ID NO: 1272783 - DNA, 12 bp, Homo sapiens
gcttcttgcctc

SEQ ID NO: 1272784 - DNA, 14 bp, Homo sapiens
gcttcttgcctctg

SEQ ID NO: 1272785 - DNA, 14 bp, Homo sapiens
gcttcttggagctt

SEQ ID NO: 1272786 - DNA, 12 bp, Homo sapiens
gcttctttctag

SEQ ID NO: 1272787 - DNA, 23 bp, Homo sapiens
gcttcttttagttgtatctcttt

SEQ ID NO: 1272788 - DNA, 17 bp, Homo sapiens
gcttcttttgaactgtt

SEQ ID NO: 1272789 - DNA, 15 bp, Homo sapiens
gcttgaaattactgt

SEQ ID NO: 1272790 - DNA, 19 bp, Homo sapiens
gcttgaaattactgtgtaa

SEQ ID NO: 1272791 - DNA, 13 bp, Homo sapiens
gcttgaacctgct

SEQ ID NO: 1272792 - DNA, 15 bp, Homo sapiens
gcttgaacctgggaa

SEQ ID NO: 1272793 - DNA, 23 bp, Homo sapiens
gcttgaacctgggaggcagaggt

SEQ ID NO: 1272794 - DNA, 20 bp, Homo sapiens
gcttgaagccaaagaaaaat

SEQ ID NO: 1272795 - DNA, 11 bp, Homo sapiens
gcttgaagctg

SEQ ID NO: 1272796 - DNA, 17 bp, Homo sapiens
gcttgaaggactgcaga

SEQ ID NO: 1272797 - DNA, 15 bp, Homo sapiens
gcttgaaggccctgc

SEQ ID NO: 1272798 - DNA, 18 bp, Homo sapiens
gcttgaagtaactgtgga

SEQ ID NO: 1272799 - DNA, 21 bp, Homo sapiens
gcttgacatacctaccagtat

SEQ ID NO: 1272800 - DNA, 13 bp, Homo sapiens
gcttgacatgtgc

SEQ ID NO: 1272801 - DNA, 19 bp, Homo sapiens
gcttgaccgtactctcaca

SEQ ID NO: 1272802 - DNA, 21 bp, Homo sapiens
gcttgactggatggaaggaga

SEQ ID NO: 1272803 - DNA, 15 bp, Homo sapiens
gcttgagccaggagg

SEQ ID NO: 1272804 - DNA, 12 bp, Homo sapiens
gcttgagcccag

SEQ ID NO: 1272805 - DNA, 15 bp, Homo sapiens
gcttgagcccaggag

SEQ ID NO: 1272806 - DNA, 14 bp, Homo sapiens
gcttgagctcagga

SEQ ID NO: 1272807 - DNA, 19 bp, Homo sapiens
gcttgagggagggctgggc

SEQ ID NO: 1272808 - DNA, 21 bp, Homo sapiens
gcttgatctgtgatttcttct

SEQ ID NO: 1272809 - DNA, 19 bp, Homo sapiens
gcttgatgaagcaaggaag

SEQ ID NO: 1272810 - DNA, 20 bp, Homo sapiens
gcttgatgaagcaaggaaga

SEQ ID NO: 1272811 - DNA, 14 bp, Homo sapiens
gcttgattctgcag

SEQ ID NO: 1272812 - DNA, 18 bp, Homo sapiens
gcttgatttgatctttgt

SEQ ID NO: 1272813 - DNA, 23 bp, Homo sapiens
gcttgatttgatctttgtttaaa

SEQ ID NO: 1272814 - DNA, 13 bp, Homo sapiens
gcttgattttaat

SEQ ID NO: 1272815 - DNA, 14 bp, Homo sapiens
gcttgcacacttcc

SEQ ID NO: 1272816 - DNA, 15 bp, Homo sapiens
gcttgcacagccaac

SEQ ID NO: 1272817 - DNA, 23 bp, Homo sapiens
gcttgcacagccaacgagacaca

SEQ ID NO: 1272818 - DNA, 15 bp, Homo sapiens
gcttgcaccttttca

SEQ ID NO: 1272819 - DNA, 17 bp, Homo sapiens
gcttttctgccctggct

SEQ ID NO: 1272820 - DNA, 17 bp, Homo sapiens
gcttttctgtcctgggc

SEQ ID NO: 1272821 - DNA, 15 bp, Homo sapiens
gcttttctttttctg

SEQ ID NO: 1272822 - DNA, 15 bp, Homo sapiens
gcttttgagtgggcc

SEQ ID NO: 1272823 - DNA, 17 bp, Homo sapiens
gcttttgcagcagagga

SEQ ID NO: 1272824 - DNA, 11 bp, Homo sapiens
gcttttgccac

SEQ ID NO: 1272825 - DNA, 18 bp, Homo sapiens
gcttttgccactttggct

SEQ ID NO: 1272826 - DNA, 21 bp, Homo sapiens
gcttttgccactttggcttct

SEQ ID NO: 1272827 - DNA, 20 bp, Homo sapiens
gcttttgcccattttgaatc

SEQ ID NO: 1272828 - DNA, 22 bp, Homo sapiens
gcttttgccccagaaaggggaa

SEQ ID NO: 1272829 - DNA, 14 bp, Homo sapiens
gcttttgctgctgc

SEQ ID NO: 1272830 - DNA, 13 bp, Homo sapiens
gcttttgcttcta

SEQ ID NO: 1272831 - DNA, 18 bp, Homo sapiens
gcttttgcttgatccaga

SEQ ID NO: 1272832 - DNA, 11 bp, Homo sapiens
gcttttggcaa

SEQ ID NO: 1272833 - DNA, 22 bp, Homo sapiens
gcttttggttttaaacctttaa

SEQ ID NO: 1272834 - DNA, 22 bp, Homo sapiens
gcttttgtagatggcgatgtgt

SEQ ID NO: 1272835 - DNA, 20 bp, Homo sapiens
gcttttgtctaattaaaaca

SEQ ID NO: 1272836 - DNA, 12 bp, Homo sapiens
gcttttgtgcat

SEQ ID NO: 1272837 - DNA, 15 bp, Homo sapiens
gcttttgttctagac

SEQ ID NO: 1272838 - DNA, 16 bp, Homo sapiens
gcttttgttctagact

SEQ ID NO: 1272839 - DNA, 13 bp, Homo sapiens
gcttttgttctga

SEQ ID NO: 1272840 - DNA, 14 bp, Homo sapiens
gcttttgttctgag

SEQ ID NO: 1272841 - DNA, 14 bp, Homo sapiens
gcttttgttgttta

SEQ ID NO: 1272842 - DNA, 23 bp, Homo sapiens
gcttttgtttcctttttcagata

SEQ ID NO: 1272843 - DNA, 17 bp, Homo sapiens
gctttttaatagcacta

SEQ ID NO: 1272844 - DNA, 12 bp, Homo sapiens
gctttttataaa

SEQ ID NO: 1272845 - DNA, 21 bp, Homo sapiens
gctttttatttctgcatatgt

SEQ ID NO: 1272846 - DNA, 22 bp, Homo sapiens
gctttttcagaaacagggcagc

SEQ ID NO: 1272847 - DNA, 13 bp, Homo sapiens
gctttttccagag

SEQ ID NO: 1272848 - DNA, 18 bp, Homo sapiens
gctttttcctctcattgt

SEQ ID NO: 1272849 - DNA, 12 bp, Homo sapiens
gctttttggaat

SEQ ID NO: 1272850 - DNA, 16 bp, Homo sapiens
gctttttgtgtttttt

SEQ ID NO: 1272851 - DNA, 17 bp, Homo sapiens
gcttttttgttttggct

SEQ ID NO: 1272852 - DNA, 15 bp, Homo sapiens
gctttttttcttaaa

SEQ ID NO: 1272853 - DNA, 17 bp, Homo sapiens
gctttttttgtgtgtat

SEQ ID NO: 1272854 - DNA, 16 bp, Homo sapiens
ggaaaaaaaaaaagaa

SEQ ID NO: 1272855 - DNA, 15 bp, Homo sapiens
ggaaaaaaaaacagc

SEQ ID NO: 1272856 - DNA, 12 bp, Homo sapiens
ggaaaaaaaaga

SEQ ID NO: 1272857 - DNA, 16 bp, Homo sapiens
ggaaaaaaaagaaaaa

SEQ ID NO: 1272858 - DNA, 15 bp, Homo sapiens
ggaaaaaaacaaaca

SEQ ID NO: 1272859 - DNA, 13 bp, Homo sapiens
ggaaaaaaacttt

SEQ ID NO: 1272860 - DNA, 23 bp, Homo sapiens
ggaaaaaaacttttataaattaa

SEQ ID NO: 1272861 - DNA, 20 bp, Homo sapiens
ggaaaaaaagactgatgaag

SEQ ID NO: 1272862 - DNA, 17 bp, Homo sapiens
ggaaaaaaatgaatgag

SEQ ID NO: 1272863 - DNA, 16 bp, Homo sapiens
ggaaaaaactctgaag

SEQ ID NO: 1272864 - DNA, 22 bp, Homo sapiens
ggaaaaaactctgaaggagagg

SEQ ID NO: 1272865 - DNA, 11 bp, Homo sapiens
ggaaaaaagaa

SEQ ID NO: 1272866 - DNA, 18 bp, Homo sapiens
ggaaaaaagaaagaaaaa

SEQ ID NO: 1272867 - DNA, 22 bp, Homo sapiens
ggaaaaaattgaaagaacttaa

SEQ ID NO: 1272868 - DNA, 18 bp, Homo sapiens
ggaaaaaattgtattgaa

SEQ ID NO: 1272869 - DNA, 21 bp, Homo sapiens
ggaaaaacatctgaaagccac

SEQ ID NO: 1272870 - DNA, 22 bp, Homo sapiens
ggaaaaaccgagataggggagg

SEQ ID NO: 1272871 - DNA, 15 bp, Homo sapiens
ggaaaaataaacaat

SEQ ID NO: 1272872 - DNA, 23 bp, Homo sapiens
ggaaaaataatcaagattttagg

SEQ ID NO: 1272873 - DNA, 12 bp, Homo sapiens
ggaaaaatgtgt

SEQ ID NO: 1272874 - DNA, 22 bp, Homo sapiens
ggaaaacaattcaagctgagaa

SEQ ID NO: 1272875 - DNA, 18 bp, Homo sapiens
ggaaaacagactcaggtt

SEQ ID NO: 1272876 - DNA, 22 bp, Homo sapiens
ggaaaacattgcttttgaaaac

SEQ ID NO: 1272877 - DNA, 12 bp, Homo sapiens
ggaaaaccagac

SEQ ID NO: 1272878 - DNA, 22 bp, Homo sapiens
ggaaaaccagactacttgggag

SEQ ID NO: 1272879 - DNA, 14 bp, Homo sapiens
ggaaaacctggggg

SEQ ID NO: 1272880 - DNA, 19 bp, Homo sapiens
ggaaaactattgagccttg

SEQ ID NO: 1272881 - DNA, 13 bp, Homo sapiens
ggaaaactgtgtt

SEQ ID NO: 1272882 - DNA, 14 bp, Homo sapiens
ggaaaactgtgttg

SEQ ID NO: 1272883 - DNA, 22 bp, Homo sapiens
ggaaaacttgcagctaaggagg

SEQ ID NO: 1272884 - DNA, 21 bp, Homo sapiens
ggaaaagaggagtttcgaggt

SEQ ID NO: 1272885 - DNA, 17 bp, Homo sapiens
ggaaaagatccccaaga

SEQ ID NO: 1272886 - DNA, 16 bp, Homo sapiens
ggaaaagcaacttcat

SEQ ID NO: 1272887 - DNA, 22 bp, Homo sapiens
ggaaaagcaacttcatttgaca

SEQ ID NO: 1272888 - DNA, 19 bp, Homo sapiens
ggaaaagcggacatcagct

SEQ ID NO: 1272889 - DNA, 12 bp, Homo sapiens
ggaaaaggcccc

SEQ ID NO: 1272890 - DNA, 15 bp, Homo sapiens
ggaaaaggcccctgc

SEQ ID NO: 1272891 - DNA, 12 bp, Homo sapiens
ggaaaagggaag

SEQ ID NO: 1272892 - DNA, 18 bp, Homo sapiens
ggaaaagttaaactaaaa

SEQ ID NO: 1272893 - DNA, 19 bp, Homo sapiens
ggaaaatacctaattgtgg

SEQ ID NO: 1272894 - DNA, 19 bp, Homo sapiens
ggaaaataggctttttaat

SEQ ID NO: 1272895 - DNA, 16 bp, Homo sapiens
ggaaaatagtttgcaa

SEQ ID NO: 1272896 - DNA, 19 bp, Homo sapiens
ggaaaatcagcctgctcca

SEQ ID NO: 1272897 - DNA, 19 bp, Homo sapiens
ggaaaatctatatttgtct

SEQ ID NO: 1272898 - DNA, 22 bp, Homo sapiens
ggaaaatgagtatttggtccaa

SEQ ID NO: 1272899 - DNA, 20 bp, Homo sapiens
ggaaaatgtatccagaggaa

SEQ ID NO: 1272900 - DNA, 16 bp, Homo sapiens
ggaaaatgtcctgtgg

SEQ ID NO: 1272901 - DNA, 15 bp, Homo sapiens
ggaaaattcattttt

SEQ ID NO: 1272902 - DNA, 15 bp, Homo sapiens
ggaaaattgaaagta

SEQ ID NO: 1272903 - DNA, 17 bp, Homo sapiens
ggaaaattgaaagtatt

SEQ ID NO: 1272904 - DNA, 23 bp, Homo sapiens
ggaaacaaagtttacattgtcct

SEQ ID NO: 1272905 - DNA, 15 bp, Homo sapiens
ggaaacaacatttat

SEQ ID NO: 1272906 - DNA, 14 bp, Homo sapiens
ggaaacaagggaag

SEQ ID NO: 1272907 - DNA, 19 bp, Homo sapiens
ggaaacaagtgaccccagg

SEQ ID NO: 1272908 - DNA, 21 bp, Homo sapiens
ggaaacaagtgaccccagggc

SEQ ID NO: 1272909 - DNA, 22 bp, Homo sapiens
ggaaacaagtgaccccagggcc

SEQ ID NO: 1272910 - DNA, 12 bp, Homo sapiens
ggaaacaatata

SEQ ID NO: 1272911 - DNA, 13 bp, Homo sapiens
ggaaacagaactc

SEQ ID NO: 1272912 - DNA, 23 bp, Homo sapiens
ggaaacagaactcgatgcactga

SEQ ID NO: 1272913 - DNA, 20 bp, Homo sapiens
ggaaacagaccaatagacat

SEQ ID NO: 1272914 - DNA, 13 bp, Homo sapiens
ggaaacagactcg

SEQ ID NO: 1272915 - DNA, 17 bp, Homo sapiens
ggaaacagatgaaaagc

SEQ ID NO: 1272916 - DNA, 13 bp, Homo sapiens
ggaaacagcatga

SEQ ID NO: 1272917 - DNA, 20 bp, Homo sapiens
ggaaacagctttaggggtgg

SEQ ID NO: 1272918 - DNA, 17 bp, Homo sapiens
ggaaacagttgcatgta

SEQ ID NO: 1272919 - DNA, 18 bp, Homo sapiens
ggaaacagttgcatgtag

SEQ ID NO: 1272920 - DNA, 18 bp, Homo sapiens
ggaaacatacagaggatg

SEQ ID NO: 1272921 - DNA, 19 bp, Homo sapiens
ggaaaccaagtcaggccag

SEQ ID NO: 1272922 - DNA, 16 bp, Homo sapiens
ggaaaccctggagcca

SEQ ID NO: 1272923 - DNA, 12 bp, Homo sapiens
ggaaacctgccc

SEQ ID NO: 1272924 - DNA, 17 bp, Homo sapiens
ggaaacctgccctgcct

SEQ ID NO: 1272925 - DNA, 22 bp, Homo sapiens
ggaaacctgccctgcctgaggg

SEQ ID NO: 1272926 - DNA, 13 bp, Homo sapiens
ggaaaccttggag

SEQ ID NO: 1272927 - DNA, 15 bp, Homo sapiens
ggaaacgcacttaca

SEQ ID NO: 1272928 - DNA, 19 bp, Homo sapiens
ggaaactaagattctttta

SEQ ID NO: 1272929 - DNA, 15 bp, Homo sapiens
ggaaactaagcattg

SEQ ID NO: 1272930 - DNA, 16 bp, Homo sapiens
ggaaactactgccttt

SEQ ID NO: 1272931 - DNA, 23 bp, Homo sapiens
ggaaactatgtgtttttctcata

SEQ ID NO: 1272932 - DNA, 18 bp, Homo sapiens
ggaaactccacatctgcc

SEQ ID NO: 1272933 - DNA, 19 bp, Homo sapiens
ggaaactttatttaaatgc

SEQ ID NO: 1272934 - DNA, 16 bp, Homo sapiens
ggaaagaaagaaggaa

SEQ ID NO: 1272935 - DNA, 19 bp, Homo sapiens
ggaaagacaactgttttaa

SEQ ID NO: 1272936 - DNA, 22 bp, Homo sapiens
ggaaagacatccataaagaagc

SEQ ID NO: 1272937 - DNA, 16 bp, Homo sapiens
ggaaagacgtttttgt

SEQ ID NO: 1272938 - DNA, 12 bp, Homo sapiens
ggaaagagacca

SEQ ID NO: 1272939 - DNA, 14 bp, Homo sapiens
ggaaagataataaa

SEQ ID NO: 1272940 - DNA, 20 bp, Homo sapiens
ggaaagatgttaagcattta

SEQ ID NO: 1272941 - DNA, 14 bp, Homo sapiens
ggaatgtgcccctg

SEQ ID NO: 1272942 - DNA, 15 bp, Homo sapiens
ggaatgtgtccaaga

SEQ ID NO: 1272943 - DNA, 17 bp, Homo sapiens
ggaatgtgtccaagaca

SEQ ID NO: 1272944 - DNA, 15 bp, Homo sapiens
ggaatgtgtggcctg

SEQ ID NO: 1272945 - DNA, 17 bp, Homo sapiens
ggaatgttccctgcacc

SEQ ID NO: 1272946 - DNA, 15 bp, Homo sapiens
ggaatgttggataag

SEQ ID NO: 1272947 - DNA, 18 bp, Homo sapiens
ggaatgttgttttctgac

SEQ ID NO: 1272948 - DNA, 14 bp, Homo sapiens
ggaattaaaaagaa

SEQ ID NO: 1272949 - DNA, 13 bp, Homo sapiens
ggaattaaatagt

SEQ ID NO: 1272950 - DNA, 16 bp, Homo sapiens
ggaattaaatagtgtg

SEQ ID NO: 1272951 - DNA, 16 bp, Homo sapiens
ggaattacaagccctg

SEQ ID NO: 1272952 - DNA, 22 bp, Homo sapiens
ggaattagagggccttgcttct

SEQ ID NO: 1272953 - DNA, 18 bp, Homo sapiens
ggaattattttgaatgtc

SEQ ID NO: 1272954 - DNA, 16 bp, Homo sapiens
ggaattcagcaccctg

SEQ ID NO: 1272955 - DNA, 17 bp, Homo sapiens
ggaattcagcaccctgg

SEQ ID NO: 1272956 - DNA, 21 bp, Homo sapiens
ggaattcattttcatcactgg

SEQ ID NO: 1272957 - DNA, 23 bp, Homo sapiens
ggaattcattttcatcactggga

SEQ ID NO: 1272958 - DNA, 13 bp, Homo sapiens
ggaattccctccc

SEQ ID NO: 1272959 - DNA, 16 bp, Homo sapiens
ggaattccctccccct

SEQ ID NO: 1272960 - DNA, 18 bp, Homo sapiens
ggaattccctccccctcc

SEQ ID NO: 1272961 - DNA, 18 bp, Homo sapiens
ggaattcctcttttgctt

SEQ ID NO: 1272962 - DNA, 17 bp, Homo sapiens
ggaattcgtgttatgaa

SEQ ID NO: 1272963 - DNA, 22 bp, Homo sapiens
ggaattgattgtcagccacctc

SEQ ID NO: 1272964 - DNA, 20 bp, Homo sapiens
ggaattgcttaccaaaggat

SEQ ID NO: 1272965 - DNA, 14 bp, Homo sapiens
ggaattggggaggg

SEQ ID NO: 1272966 - DNA, 23 bp, Homo sapiens
ggaattggtggcagattttacaa

SEQ ID NO: 1272967 - DNA, 13 bp, Homo sapiens
ggaattgtggcta

SEQ ID NO: 1272968 - DNA, 21 bp, Homo sapiens
ggaattgtggctatcctgatt

SEQ ID NO: 1272969 - DNA, 12 bp, Homo sapiens
ggaatttcaatg

SEQ ID NO: 1272970 - DNA, 19 bp, Homo sapiens
ggaatttccctgtgtggat

SEQ ID NO: 1272971 - DNA, 17 bp, Homo sapiens
ggaatttctggcctcct

SEQ ID NO: 1272972 - DNA, 19 bp, Homo sapiens
ggaatttgattgctttgct

SEQ ID NO: 1272973 - DNA, 22 bp, Homo sapiens
ggaatttgattgctttgctgca

SEQ ID NO: 1272974 - DNA, 16 bp, Homo sapiens
ggaatttggtataatt

SEQ ID NO: 1272975 - DNA, 16 bp, Homo sapiens
ggaatttgtaacctca

SEQ ID NO: 1272976 - DNA, 20 bp, Homo sapiens
ggaatttgtacgtttatacc

SEQ ID NO: 1272977 - DNA, 18 bp, Homo sapiens
ggaatttttctgtacttc

SEQ ID NO: 1272978 - DNA, 22 bp, Homo sapiens
ggacaaaaatgaactgaagttt

SEQ ID NO: 1272979 - DNA, 18 bp, Homo sapiens
ggacaaaagggccaggtg

SEQ ID NO: 1272980 - DNA, 21 bp, Homo sapiens
ggacaaaagggccaggtgcgg

SEQ ID NO: 1272981 - DNA, 19 bp, Homo sapiens
ggacaaagtccaagtctgt

SEQ ID NO: 1272982 - DNA, 18 bp, Homo sapiens
ggacaaatcacatatttt

SEQ ID NO: 1272983 - DNA, 21 bp, Homo sapiens
ggacaaatcacatattttaaa

SEQ ID NO: 1272984 - DNA, 20 bp, Homo sapiens
ggacaaatgtatagaataaa

SEQ ID NO: 1272985 - DNA, 22 bp, Homo sapiens
ggacaaattagcatgcaagctt

SEQ ID NO: 1272986 - DNA, 20 bp, Homo sapiens
ggacaacattttactactga

SEQ ID NO: 1272987 - DNA, 18 bp, Homo sapiens
ggacaaccccccaagacc

SEQ ID NO: 1272988 - DNA, 16 bp, Homo sapiens
ggacaagacccccagc

SEQ ID NO: 1272989 - DNA, 13 bp, Homo sapiens
ggacaagcagagg

SEQ ID NO: 1272990 - DNA, 20 bp, Homo sapiens
ggacaagcagaggtggccag

SEQ ID NO: 1272991 - DNA, 17 bp, Homo sapiens
ggacaagcagtccctta

SEQ ID NO: 1272992 - DNA, 13 bp, Homo sapiens
ggacaagcagtgg

SEQ ID NO: 1272993 - DNA, 20 bp, Homo sapiens
ggacaagccaacttgtaaat

SEQ ID NO: 1272994 - DNA, 21 bp, Homo sapiens
ggacaagccaacttgtaaata

SEQ ID NO: 1272995 - DNA, 23 bp, Homo sapiens
ggacaagggggaggaaaggggcg

SEQ ID NO: 1272996 - DNA, 20 bp, Homo sapiens
ggacaatcagtcccctccca

SEQ ID NO: 1272997 - DNA, 21 bp, Homo sapiens
ggacaatcatgaaatatgcat

SEQ ID NO: 1272998 - DNA, 22 bp, Homo sapiens
ggacacaaaactccgcccccag

SEQ ID NO: 1272999 - DNA, 13 bp, Homo sapiens
ggacacaaatttt

SEQ ID NO: 1273000 - DNA, 15 bp, Homo sapiens
ggacacaaattttca

SEQ ID NO: 1273001 - DNA, 21 bp, Homo sapiens
ggacacaataggtctttctct

SEQ ID NO: 1273002 - DNA, 21 bp, Homo sapiens
ggacacacaaggtgcaaatca

SEQ ID NO: 1273003 - DNA, 15 bp, Homo sapiens
ggacacacactcacc

SEQ ID NO: 1273004 - DNA, 19 bp, Homo sapiens
ggacacactaaactctggg

SEQ ID NO: 1273005 - DNA, 17 bp, Homo sapiens
ggacacagacccaggac

SEQ ID NO: 1273006 - DNA, 18 bp, Homo sapiens
ggacacagacccaggacc

SEQ ID NO: 1273007 - DNA, 19 bp, Homo sapiens
ggacacagatcccactgga

SEQ ID NO: 1273008 - DNA, 21 bp, Homo sapiens
ggacacagatcccactggaag

SEQ ID NO: 1273009 - DNA, 22 bp, Homo sapiens
ggacacagatcccactggaaga

SEQ ID NO: 1273010 - DNA, 20 bp, Homo sapiens
ggacacagcacaagggcaca

SEQ ID NO: 1273011 - DNA, 21 bp, Homo sapiens
ggacacagcacaagggcacat

SEQ ID NO: 1273012 - DNA, 13 bp, Homo sapiens
ggacacagcagta

SEQ ID NO: 1273013 - DNA, 14 bp, Homo sapiens
ggacacagcagtat

SEQ ID NO: 1273014 - DNA, 21 bp, Homo sapiens
ggacacagttcctgggaacat

SEQ ID NO: 1273015 - DNA, 15 bp, Homo sapiens
ggacacatcacatac

SEQ ID NO: 1273016 - DNA, 17 bp, Homo sapiens
ggacacatcccggcctc

SEQ ID NO: 1273017 - DNA, 23 bp, Homo sapiens
ggacacatcccggcctcttccac

SEQ ID NO: 1273018 - DNA, 14 bp, Homo sapiens
ggacacatgcccct

SEQ ID NO: 1273019 - DNA, 15 bp, Homo sapiens
ggacacatgcccctc

SEQ ID NO: 1273020 - DNA, 23 bp, Homo sapiens
ggacacatggattttggcagggc

SEQ ID NO: 1273021 - DNA, 22 bp, Homo sapiens
ggacacattggaatgccttgga

SEQ ID NO: 1273022 - DNA, 13 bp, Homo sapiens
ggacaccagagct

SEQ ID NO: 1273023 - DNA, 14 bp, Homo sapiens
ggacacccccagct

SEQ ID NO: 1273024 - DNA, 15 bp, Homo sapiens
ggacacccccagctg

SEQ ID NO: 1273025 - DNA, 22 bp, Homo sapiens
ggacaccccccgccccccacct

SEQ ID NO: 1273026 - DNA, 15 bp, Homo sapiens
ggacaccccctcgct

SEQ ID NO: 1273027 - DNA, 19 bp, Homo sapiens
ggacaccccttatccagga

SEQ ID NO: 1273028 - DNA, 14 bp, Homo sapiens
ggacaccgctcagt

SEQ ID NO: 1273029 - DNA, 14 bp, Homo sapiens
ggacacctcccagg

SEQ ID NO: 1273030 - DNA, 17 bp, Homo sapiens
ggacacctcccagggga

SEQ ID NO: 1273031 - DNA, 20 bp, Homo sapiens
ggacacctcccaggggactg

SEQ ID NO: 1273032 - DNA, 13 bp, Homo sapiens
ggacacctgggag

SEQ ID NO: 1273033 - DNA, 14 bp, Homo sapiens
ggacacctgggaga

SEQ ID NO: 1273034 - DNA, 15 bp, Homo sapiens
ggacacgaaggctgc

SEQ ID NO: 1273035 - DNA, 19 bp, Homo sapiens
ggacacgaaggctgcccct

SEQ ID NO: 1273036 - DNA, 16 bp, Homo sapiens
ggacacgagccacaag

SEQ ID NO: 1273037 - DNA, 22 bp, Homo sapiens
ggacacgagccacaagctgcac

SEQ ID NO: 1273038 - DNA, 23 bp, Homo sapiens
ggacacgagccacaagctgcact

SEQ ID NO: 1273039 - DNA, 17 bp, Homo sapiens
ggacacgccgtctgtcc

SEQ ID NO: 1273040 - DNA, 18 bp, Homo sapiens
ggacactacacccagcaa

SEQ ID NO: 1273041 - DNA, 20 bp, Homo sapiens
ggacactacacccagcaata

SEQ ID NO: 1273042 - DNA, 22 bp, Homo sapiens
ggacactacacccagcaataga

SEQ ID NO: 1273043 - DNA, 17 bp, Homo sapiens
ggacactcaaaagctgg

SEQ ID NO: 1273044 - DNA, 14 bp, Homo sapiens
ggacactcagacct

SEQ ID NO: 1273045 - DNA, 14 bp, Homo sapiens
ggacactccaggga

SEQ ID NO: 1273046 - DNA, 23 bp, Homo sapiens
ggacactccagggacacacagcc

SEQ ID NO: 1273047 - DNA, 15 bp, Homo sapiens
ggacactccagtgcc

SEQ ID NO: 1273048 - DNA, 21 bp, Homo sapiens
ggacactgccaagagccgaca

SEQ ID NO: 1273049 - DNA, 14 bp, Homo sapiens
ggacactgggcagc

SEQ ID NO: 1273050 - DNA, 15 bp, Homo sapiens
ggacactgggcagca

SEQ ID NO: 1273051 - DNA, 18 bp, Homo sapiens
ggacactgggcagcaagg

SEQ ID NO: 1273052 - DNA, 16 bp, Homo sapiens
ggacacttaatactac

SEQ ID NO: 1273053 - DNA, 19 bp, Homo sapiens
ggacacttccctgggcctc

SEQ ID NO: 1273054 - DNA, 15 bp, Homo sapiens
ggacacttcctgcct

SEQ ID NO: 1273055 - DNA, 16 bp, Homo sapiens
ggacacttcctgccta

SEQ ID NO: 1273056 - DNA, 14 bp, Homo sapiens
ggacagaaagagac

SEQ ID NO: 1273057 - DNA, 21 bp, Homo sapiens
ggacagaacattgccttcctc

SEQ ID NO: 1273058 - DNA, 22 bp, Homo sapiens
ggacagaatgtgttcttttctc

SEQ ID NO: 1273059 - DNA, 13 bp, Homo sapiens
ggacagacacctc

SEQ ID NO: 1273060 - DNA, 18 bp, Homo sapiens
ggacagacacctccccct

SEQ ID NO: 1273061 - DNA, 23 bp, Homo sapiens
ggacagacacctccccctaccca

SEQ ID NO: 1273062 - DNA, 22 bp, Homo sapiens
ggacctttccaccacagccagc

SEQ ID NO: 1273063 - DNA, 23 bp, Homo sapiens
ggacgcacgctcgctgccatcac

SEQ ID NO: 1273064 - DNA, 15 bp, Homo sapiens
ggacgcaggccctgt

SEQ ID NO: 1273065 - DNA, 13 bp, Homo sapiens
ggacgcctgcagg

SEQ ID NO: 1273066 - DNA, 12 bp, Homo sapiens
ggacgcctgccc

SEQ ID NO: 1273067 - DNA, 17 bp, Homo sapiens
ggacgctgaccgtggag

SEQ ID NO: 1273068 - DNA, 18 bp, Homo sapiens
ggacgctgaccgtggagc

SEQ ID NO: 1273069 - DNA, 15 bp, Homo sapiens
ggacgcttttgagtg

SEQ ID NO: 1273070 - DNA, 13 bp, Homo sapiens
ggacggaccagca

SEQ ID NO: 1273071 - DNA, 18 bp, Homo sapiens
ggacggccctgcctgcct

SEQ ID NO: 1273072 - DNA, 12 bp, Homo sapiens
ggacggcgctgc

SEQ ID NO: 1273073 - DNA, 14 bp, Homo sapiens
ggacgggggtggga

SEQ ID NO: 1273074 - DNA, 17 bp, Homo sapiens
ggacggtatccagggcg

SEQ ID NO: 1273075 - DNA, 19 bp, Homo sapiens
ggacggtgcccaagccaga

SEQ ID NO: 1273076 - DNA, 15 bp, Homo sapiens
ggacggttgtaagca

SEQ ID NO: 1273077 - DNA, 22 bp, Homo sapiens
ggacggtttctagcctctgaga

SEQ ID NO: 1273078 - DNA, 23 bp, Homo sapiens
ggacggttttgctttatggctag

SEQ ID NO: 1273079 - DNA, 14 bp, Homo sapiens
ggacgtaaaattta

SEQ ID NO: 1273080 - DNA, 15 bp, Homo sapiens
ggacgtaaaatttac

SEQ ID NO: 1273081 - DNA, 21 bp, Homo sapiens
ggacgtcatcggaggctgggc

SEQ ID NO: 1273082 - DNA, 22 bp, Homo sapiens
ggacgtccttccatatccctgc

SEQ ID NO: 1273083 - DNA, 23 bp, Homo sapiens
ggacgtccttccatatccctgcc

SEQ ID NO: 1273084 - DNA, 13 bp, Homo sapiens
ggacgtgcactga

SEQ ID NO: 1273085 - DNA, 15 bp, Homo sapiens
ggacgtgcactgaca

SEQ ID NO: 1273086 - DNA, 18 bp, Homo sapiens
ggacgtggctcagccagc

SEQ ID NO: 1273087 - DNA, 19 bp, Homo sapiens
ggacgtggctcagccagca

SEQ ID NO: 1273088 - DNA, 21 bp, Homo sapiens
ggacgtgttacccactgccat

SEQ ID NO: 1273089 - DNA, 14 bp, Homo sapiens
ggacgttggttctg

SEQ ID NO: 1273090 - DNA, 14 bp, Homo sapiens
ggacgttgttttgg

SEQ ID NO: 1273091 - DNA, 18 bp, Homo sapiens
ggactaacataaaatctg

SEQ ID NO: 1273092 - DNA, 12 bp, Homo sapiens
ggactaagcaat

SEQ ID NO: 1273093 - DNA, 21 bp, Homo sapiens
ggactacgttaagggaaggaa

SEQ ID NO: 1273094 - DNA, 19 bp, Homo sapiens
ggactagagggacctctcc

SEQ ID NO: 1273095 - DNA, 21 bp, Homo sapiens
ggactaggcatgtcagaggac

SEQ ID NO: 1273096 - DNA, 14 bp, Homo sapiens
ggactcagccctga

SEQ ID NO: 1273097 - DNA, 16 bp, Homo sapiens
ggactcagccctgagg

SEQ ID NO: 1273098 - DNA, 17 bp, Homo sapiens
ggactcagccttcagac

SEQ ID NO: 1273099 - DNA, 19 bp, Homo sapiens
ggactcaggatccagtgac

SEQ ID NO: 1273100 - DNA, 23 bp, Homo sapiens
ggactcaggtctgtaactgccca

SEQ ID NO: 1273101 - DNA, 22 bp, Homo sapiens
ggactccaggcccaaggctccc

SEQ ID NO: 1273102 - DNA, 22 bp, Homo sapiens
ggactccatccacctcatcact

SEQ ID NO: 1273103 - DNA, 16 bp, Homo sapiens
ggactccccaggccag

SEQ ID NO: 1273104 - DNA, 19 bp, Homo sapiens
ggactccccaggccaggcc

SEQ ID NO: 1273105 - DNA, 15 bp, Homo sapiens
ggactcccgggccac

SEQ ID NO: 1273106 - DNA, 18 bp, Homo sapiens
ggactcccgggccacgcc

SEQ ID NO: 1273107 - DNA, 20 bp, Homo sapiens
ggactcccgggccacgcccc

SEQ ID NO: 1273108 - DNA, 18 bp, Homo sapiens
ggactccggaggactgag

SEQ ID NO: 1273109 - DNA, 12 bp, Homo sapiens
ggactcctccca

SEQ ID NO: 1273110 - DNA, 15 bp, Homo sapiens
ggactcctctgtcca

SEQ ID NO: 1273111 - DNA, 22 bp, Homo sapiens
ggactcctgccaccagcatcca

SEQ ID NO: 1273112 - DNA, 12 bp, Homo sapiens
ggactcctggca

SEQ ID NO: 1273113 - DNA, 13 bp, Homo sapiens
ggactcctggcag

SEQ ID NO: 1273114 - DNA, 13 bp, Homo sapiens
ggactcggccact

SEQ ID NO: 1273115 - DNA, 17 bp, Homo sapiens
ggactcggccactgtgt

SEQ ID NO: 1273116 - DNA, 21 bp, Homo sapiens
ggactctgaggctctttctgg

SEQ ID NO: 1273117 - DNA, 21 bp, Homo sapiens
ggactctgcatcccagcacct

SEQ ID NO: 1273118 - DNA, 11 bp, Homo sapiens
ggactctgccg

SEQ ID NO: 1273119 - DNA, 17 bp, Homo sapiens
ggactctgcttaaacaa

SEQ ID NO: 1273120 - DNA, 11 bp, Homo sapiens
ggactctggca

SEQ ID NO: 1273121 - DNA, 13 bp, Homo sapiens
ggactctggcaca

SEQ ID NO: 1273122 - DNA, 21 bp, Homo sapiens
ggactcttgctctttctactc

SEQ ID NO: 1273123 - DNA, 17 bp, Homo sapiens
ggactgaaaacctctcc

SEQ ID NO: 1273124 - DNA, 19 bp, Homo sapiens
ggactgaagcctgcaggag

SEQ ID NO: 1273125 - DNA, 21 bp, Homo sapiens
ggactgagccaaggaggcctg

SEQ ID NO: 1273126 - DNA, 17 bp, Homo sapiens
ggactgagccagtccca

SEQ ID NO: 1273127 - DNA, 18 bp, Homo sapiens
ggactgagccagtcccag

SEQ ID NO: 1273128 - DNA, 13 bp, Homo sapiens
ggactgagccccc

SEQ ID NO: 1273129 - DNA, 13 bp, Homo sapiens
ggactgaggagtg

SEQ ID NO: 1273130 - DNA, 14 bp, Homo sapiens
ggactgagggcagt

SEQ ID NO: 1273131 - DNA, 17 bp, Homo sapiens
ggactgagggcagtgcc

SEQ ID NO: 1273132 - DNA, 14 bp, Homo sapiens
ggactgaggtgcct

SEQ ID NO: 1273133 - DNA, 15 bp, Homo sapiens
ggactgagtgggaag

SEQ ID NO: 1273134 - DNA, 23 bp, Homo sapiens
ggactgcacagcgtcctgtccac

SEQ ID NO: 1273135 - DNA, 22 bp, Homo sapiens
ggactgcaggggccactccaaa

SEQ ID NO: 1273136 - DNA, 19 bp, Homo sapiens
ggactgcatggggaggcag

SEQ ID NO: 1273137 - DNA, 20 bp, Homo sapiens
ggactgcatggggaggcagc

SEQ ID NO: 1273138 - DNA, 12 bp, Homo sapiens
ggactgcattta

SEQ ID NO: 1273139 - DNA, 12 bp, Homo sapiens
ggactgccaaat

SEQ ID NO: 1273140 - DNA, 21 bp, Homo sapiens
ggactgccagtccccctgccc

SEQ ID NO: 1273141 - DNA, 11 bp, Homo sapiens
ggactgccccc

SEQ ID NO: 1273142 - DNA, 23 bp, Homo sapiens
ggactgcccccagaaagcctcct

SEQ ID NO: 1273143 - DNA, 17 bp, Homo sapiens
ggactggaggcccctgg

SEQ ID NO: 1273144 - DNA, 21 bp, Homo sapiens
ggactggaggcccctggagcc

SEQ ID NO: 1273145 - DNA, 17 bp, Homo sapiens
ggactggaggtgggcat

SEQ ID NO: 1273146 - DNA, 11 bp, Homo sapiens
ggactggccat

SEQ ID NO: 1273147 - DNA, 19 bp, Homo sapiens
ggactggccatttttctgg

SEQ ID NO: 1273148 - DNA, 21 bp, Homo sapiens
ggactggcgttcacctccctg

SEQ ID NO: 1273149 - DNA, 19 bp, Homo sapiens
ggactggctagagtcctca

SEQ ID NO: 1273150 - DNA, 23 bp, Homo sapiens
ggactggctagagtcctcactcc

SEQ ID NO: 1273151 - DNA, 18 bp, Homo sapiens
ggactggctgtgcccctg

SEQ ID NO: 1273152 - DNA, 23 bp, Homo sapiens
ggactgggaccgtgcgagctgcc

SEQ ID NO: 1273153 - DNA, 11 bp, Homo sapiens
ggactgggagg

SEQ ID NO: 1273154 - DNA, 17 bp, Homo sapiens
ggactgggagtcagagc

SEQ ID NO: 1273155 - DNA, 21 bp, Homo sapiens
ggactggggagcacaggtgtc

SEQ ID NO: 1273156 - DNA, 14 bp, Homo sapiens
ggactgtaaagatt

SEQ ID NO: 1273157 - DNA, 15 bp, Homo sapiens
ggactgtaagggatt

SEQ ID NO: 1273158 - DNA, 22 bp, Homo sapiens
ggactgtcctgaggagccctga

SEQ ID NO: 1273159 - DNA, 15 bp, Homo sapiens
ggactgtgcctcagg

SEQ ID NO: 1273160 - DNA, 13 bp, Homo sapiens
ggactgtgctggt

SEQ ID NO: 1273161 - DNA, 16 bp, Homo sapiens
ggactgtgctggtgca

SEQ ID NO: 1273162 - DNA, 22 bp, Homo sapiens
ggactgtggcgactctgcagag

SEQ ID NO: 1273163 - DNA, 13 bp, Homo sapiens
ggactgttccagg

SEQ ID NO: 1273164 - DNA, 14 bp, Homo sapiens
ggactgttccaggc

SEQ ID NO: 1273165 - DNA, 20 bp, Homo sapiens
ggactgttccaggccctcca

SEQ ID NO: 1273166 - DNA, 14 bp, Homo sapiens
ggactgttttcaat

SEQ ID NO: 1273167 - DNA, 20 bp, Homo sapiens
ggacttaaaattagtctttt

SEQ ID NO: 1273168 - DNA, 20 bp, Homo sapiens
ggacttaacggctccaggat

SEQ ID NO: 1273169 - DNA, 19 bp, Homo sapiens
ggacttagaatagtgccta

SEQ ID NO: 1273170 - DNA, 19 bp, Homo sapiens
ggacttgaatgctgcccgg

SEQ ID NO: 1273171 - DNA, 14 bp, Homo sapiens
ggacttgagaaaga

SEQ ID NO: 1273172 - DNA, 16 bp, Homo sapiens
ggacttgctaaagcac

SEQ ID NO: 1273173 - DNA, 21 bp, Homo sapiens
ggacttgctaaagcactttgc

SEQ ID NO: 1273174 - DNA, 18 bp, Homo sapiens
ggacttggagagcaaagg

SEQ ID NO: 1273175 - DNA, 19 bp, Homo sapiens
ggacttggagagcaaaggc

SEQ ID NO: 1273176 - DNA, 16 bp, Homo sapiens
ggacttggagggtctg

SEQ ID NO: 1273177 - DNA, 15 bp, Homo sapiens
ggacttggctgtcct

SEQ ID NO: 1273178 - DNA, 21 bp, Homo sapiens
ggacttggctgtccttcccct

SEQ ID NO: 1273179 - DNA, 21 bp, Homo sapiens
ggacttggtaagatgactctg

SEQ ID NO: 1273180 - DNA, 22 bp, Homo sapiens
ggacttgtaggaatctgccttc

SEQ ID NO: 1273181 - DNA, 23 bp, Homo sapiens
ggacttgtatagtgagagaggag

SEQ ID NO: 1273182 - DNA, 20 bp, Homo sapiens
ggacttgtatatttgtacaa

SEQ ID NO: 1273183 - DNA, 14 bp, Homo sapiens
ggactttaaaaaaa

SEQ ID NO: 1273184 - DNA, 16 bp, Homo sapiens
ggaggaagagccacct

SEQ ID NO: 1273185 - DNA, 19 bp, Homo sapiens
ggaggaagagccacctgca

SEQ ID NO: 1273186 - DNA, 20 bp, Homo sapiens
ggaggaagagccacctgcaa

SEQ ID NO: 1273187 - DNA, 11 bp, Homo sapiens
ggaggaagccc

SEQ ID NO: 1273188 - DNA, 12 bp, Homo sapiens
ggaggaagccca

SEQ ID NO: 1273189 - DNA, 14 bp, Homo sapiens
ggaggaagcttggg

SEQ ID NO: 1273190 - DNA, 17 bp, Homo sapiens
ggaggaaggcctttctt

SEQ ID NO: 1273191 - DNA, 21 bp, Homo sapiens
ggaggaaggtgactgtgtgtg

SEQ ID NO: 1273192 - DNA, 22 bp, Homo sapiens
ggaggaagtggggtctggcctg

SEQ ID NO: 1273193 - DNA, 14 bp, Homo sapiens
ggaggaattcagct

SEQ ID NO: 1273194 - DNA, 11 bp, Homo sapiens
ggaggacagac

SEQ ID NO: 1273195 - DNA, 12 bp, Homo sapiens
ggaggacagacg

SEQ ID NO: 1273196 - DNA, 18 bp, Homo sapiens
ggaggacaggcaggccag

SEQ ID NO: 1273197 - DNA, 22 bp, Homo sapiens
ggaggaccagggccctgggcag

SEQ ID NO: 1273198 - DNA, 18 bp, Homo sapiens
ggaggaccccgagggctg

SEQ ID NO: 1273199 - DNA, 19 bp, Homo sapiens
ggaggaccccgagggctga

SEQ ID NO: 1273200 - DNA, 22 bp, Homo sapiens
ggaggaccccgagggctgagga

SEQ ID NO: 1273201 - DNA, 17 bp, Homo sapiens
ggaggacccctgccttc

SEQ ID NO: 1273202 - DNA, 21 bp, Homo sapiens
ggaggacctggcgtgctcaga

SEQ ID NO: 1273203 - DNA, 14 bp, Homo sapiens
ggaggactgagccc

SEQ ID NO: 1273204 - DNA, 17 bp, Homo sapiens
ggaggactgagccccca

SEQ ID NO: 1273205 - DNA, 13 bp, Homo sapiens
ggaggagaatgag

SEQ ID NO: 1273206 - DNA, 21 bp, Homo sapiens
ggaggagcagcctcgaggctg

SEQ ID NO: 1273207 - DNA, 16 bp, Homo sapiens
ggaggagcagcttcct

SEQ ID NO: 1273208 - DNA, 16 bp, Homo sapiens
ggaggagcctctggct

SEQ ID NO: 1273209 - DNA, 19 bp, Homo sapiens
ggaggagccttgctgggcc

SEQ ID NO: 1273210 - DNA, 20 bp, Homo sapiens
ggaggagccttgctgggcca

SEQ ID NO: 1273211 - DNA, 12 bp, Homo sapiens
ggaggaggaaga

SEQ ID NO: 1273212 - DNA, 13 bp, Homo sapiens
ggaggaggaagcc

SEQ ID NO: 1273213 - DNA, 14 bp, Homo sapiens
ggaggaggaagccg

SEQ ID NO: 1273214 - DNA, 13 bp, Homo sapiens
ggaggaggaaggc

SEQ ID NO: 1273215 - DNA, 15 bp, Homo sapiens
ggaggaggaaggcaa

SEQ ID NO: 1273216 - DNA, 15 bp, Homo sapiens
ggaggaggagaagga

SEQ ID NO: 1273217 - DNA, 13 bp, Homo sapiens
ggaggaggagatg

SEQ ID NO: 1273218 - DNA, 11 bp, Homo sapiens
ggaggaggagc

SEQ ID NO: 1273219 - DNA, 14 bp, Homo sapiens
ggaggaggagcctt

SEQ ID NO: 1273220 - DNA, 17 bp, Homo sapiens
ggaggaggagccttgct

SEQ ID NO: 1273221 - DNA, 15 bp, Homo sapiens
ggaggaggaggagga

SEQ ID NO: 1273222 - DNA, 15 bp, Homo sapiens
ggaggaggagggagg

SEQ ID NO: 1273223 - DNA, 15 bp, Homo sapiens
ggaggaggccacctc

SEQ ID NO: 1273224 - DNA, 19 bp, Homo sapiens
ggaggaggccacctctcca

SEQ ID NO: 1273225 - DNA, 12 bp, Homo sapiens
ggaggaggctgc

SEQ ID NO: 1273226 - DNA, 21 bp, Homo sapiens
ggaggaggctgccctgagggg

SEQ ID NO: 1273227 - DNA, 15 bp, Homo sapiens
ggaggagggaggccg

SEQ ID NO: 1273228 - DNA, 19 bp, Homo sapiens
ggaggagtcaggggctctg

SEQ ID NO: 1273229 - DNA, 20 bp, Homo sapiens
ggaggatcactggagcccag

SEQ ID NO: 1273230 - DNA, 18 bp, Homo sapiens
ggaggatcagttttttgt

SEQ ID NO: 1273231 - DNA, 14 bp, Homo sapiens
ggaggatggagaga

SEQ ID NO: 1273232 - DNA, 21 bp, Homo sapiens
ggaggatgtccctgggccagg

SEQ ID NO: 1273233 - DNA, 16 bp, Homo sapiens
ggaggatgtgggcagc

SEQ ID NO: 1273234 - DNA, 23 bp, Homo sapiens
ggaggcaagagactgggagccac

SEQ ID NO: 1273235 - DNA, 12 bp, Homo sapiens
ggaggcaccagc

SEQ ID NO: 1273236 - DNA, 17 bp, Homo sapiens
ggaggcaccagctctgt

SEQ ID NO: 1273237 - DNA, 21 bp, Homo sapiens
ggaggcaccagctctgtggcc

SEQ ID NO: 1273238 - DNA, 22 bp, Homo sapiens
ggaggcactttagggctgtaaa

SEQ ID NO: 1273239 - DNA, 13 bp, Homo sapiens
ggaggcagaaacc

SEQ ID NO: 1273240 - DNA, 22 bp, Homo sapiens
ggaggcagagaatctcttggga

SEQ ID NO: 1273241 - DNA, 14 bp, Homo sapiens
ggaggcagagacct

SEQ ID NO: 1273242 - DNA, 20 bp, Homo sapiens
ggaggcagaggttgcagtga

SEQ ID NO: 1273243 - DNA, 21 bp, Homo sapiens
ggaggcagagtttgccttcct

SEQ ID NO: 1273244 - DNA, 20 bp, Homo sapiens
ggaggcagatgtggggctga

SEQ ID NO: 1273245 - DNA, 13 bp, Homo sapiens
ggaggcagccccc

SEQ ID NO: 1273246 - DNA, 15 bp, Homo sapiens
ggaggcagccccctc

SEQ ID NO: 1273247 - DNA, 23 bp, Homo sapiens
ggaggcagccccctccacaccag

SEQ ID NO: 1273248 - DNA, 21 bp, Homo sapiens
ggaggcagcgtgggctctgcc

SEQ ID NO: 1273249 - DNA, 13 bp, Homo sapiens
ggaggcaggagca

SEQ ID NO: 1273250 - DNA, 21 bp, Homo sapiens
ggaggcagggccttgcccaga

SEQ ID NO: 1273251 - DNA, 22 bp, Homo sapiens
ggaggcagtgctgatccggctg

SEQ ID NO: 1273252 - DNA, 17 bp, Homo sapiens
ggaggcatcatggaaag

SEQ ID NO: 1273253 - DNA, 15 bp, Homo sapiens
ggaggcatggccctg

SEQ ID NO: 1273254 - DNA, 16 bp, Homo sapiens
ggaggcatggccctgg

SEQ ID NO: 1273255 - DNA, 17 bp, Homo sapiens
ggaggcatggccctggg

SEQ ID NO: 1273256 - DNA, 21 bp, Homo sapiens
ggaggccaaccagcccgacag

SEQ ID NO: 1273257 - DNA, 18 bp, Homo sapiens
ggaggccaaggtgggagg

SEQ ID NO: 1273258 - DNA, 20 bp, Homo sapiens
ggaggccaaggtgggaggat

SEQ ID NO: 1273259 - DNA, 16 bp, Homo sapiens
ggaggccaataaaaag

SEQ ID NO: 1273260 - DNA, 22 bp, Homo sapiens
ggaggccaataaaaagttcaga

SEQ ID NO: 1273261 - DNA, 14 bp, Homo sapiens
ggaggccacctctc

SEQ ID NO: 1273262 - DNA, 17 bp, Homo sapiens
ggaggccacgtcccacc

SEQ ID NO: 1273263 - DNA, 22 bp, Homo sapiens
ggaggccagagtctcccagtgg

SEQ ID NO: 1273264 - DNA, 14 bp, Homo sapiens
ggaggccaggcgag

SEQ ID NO: 1273265 - DNA, 21 bp, Homo sapiens
ggaggccaggcgagcctgact

SEQ ID NO: 1273266 - DNA, 22 bp, Homo sapiens
ggaggccagtgttgtgggcttc

SEQ ID NO: 1273267 - DNA, 18 bp, Homo sapiens
ggaggccatccaagatgg

SEQ ID NO: 1273268 - DNA, 22 bp, Homo sapiens
ggaggcccaggctgggaactca

SEQ ID NO: 1273269 - DNA, 22 bp, Homo sapiens
ggaggccccaaccctgtcctcc

SEQ ID NO: 1273270 - DNA, 18 bp, Homo sapiens
ggaggccctgcctgaccc

SEQ ID NO: 1273271 - DNA, 16 bp, Homo sapiens
ggaggcccttgtcgtg

SEQ ID NO: 1273272 - DNA, 21 bp, Homo sapiens
ggaggcccttgtcgtgggatg

SEQ ID NO: 1273273 - DNA, 22 bp, Homo sapiens
ggaggccgacgttttctccgca

SEQ ID NO: 1273274 - DNA, 12 bp, Homo sapiens
ggaggcctctgg

SEQ ID NO: 1273275 - DNA, 17 bp, Homo sapiens
ggaggcctctggccctc

SEQ ID NO: 1273276 - DNA, 19 bp, Homo sapiens
ggaggcctgatgctgcccc

SEQ ID NO: 1273277 - DNA, 12 bp, Homo sapiens
ggaggcctggac

SEQ ID NO: 1273278 - DNA, 20 bp, Homo sapiens
ggaggccttccagctgctgt

SEQ ID NO: 1273279 - DNA, 16 bp, Homo sapiens
ggaggccttggggtgg

SEQ ID NO: 1273280 - DNA, 23 bp, Homo sapiens
ggaggccttggggtgggggccag

SEQ ID NO: 1273281 - DNA, 13 bp, Homo sapiens
ggaggcgcaggga

SEQ ID NO: 1273282 - DNA, 23 bp, Homo sapiens
ggaggcgcccttggcttctgtga

SEQ ID NO: 1273283 - DNA, 13 bp, Homo sapiens
ggaggcggggagg

SEQ ID NO: 1273284 - DNA, 22 bp, Homo sapiens
ggaggcggggaggaggaacggg

SEQ ID NO: 1273285 - DNA, 16 bp, Homo sapiens
ggaggcggtgcggcag

SEQ ID NO: 1273286 - DNA, 22 bp, Homo sapiens
ggaggcgtcttcatctccctgc

SEQ ID NO: 1273287 - DNA, 18 bp, Homo sapiens
ggaggcgtggaggagagg

SEQ ID NO: 1273288 - DNA, 19 bp, Homo sapiens
ggaggcgtggaggagagga

SEQ ID NO: 1273289 - DNA, 15 bp, Homo sapiens
ggaggctgagacagg

SEQ ID NO: 1273290 - DNA, 13 bp, Homo sapiens
ggaggctgaggca

SEQ ID NO: 1273291 - DNA, 15 bp, Homo sapiens
ggaggctgaggcagg

SEQ ID NO: 1273292 - DNA, 17 bp, Homo sapiens
ggaggctgaggcaggag

SEQ ID NO: 1273293 - DNA, 13 bp, Homo sapiens
ggaggctgcactg

SEQ ID NO: 1273294 - DNA, 16 bp, Homo sapiens
ggaggctgcatgctct

SEQ ID NO: 1273295 - DNA, 10 bp, Homo sapiens
ggaggctgcg

SEQ ID NO: 1273296 - DNA, 17 bp, Homo sapiens
ggaggctgcgtgccagt

SEQ ID NO: 1273297 - DNA, 12 bp, Homo sapiens
ggaggctggagg

SEQ ID NO: 1273298 - DNA, 12 bp, Homo sapiens
ggaggctggcca

SEQ ID NO: 1273299 - DNA, 13 bp, Homo sapiens
ggaggctggccaa

SEQ ID NO: 1273300 - DNA, 12 bp, Homo sapiens
ggaggctgggcc

SEQ ID NO: 1273301 - DNA, 14 bp, Homo sapiens
ggaggctgggcccc

SEQ ID NO: 1273302 - DNA, 23 bp, Homo sapiens
ggaggctgggcccctgggatggg

SEQ ID NO: 1273303 - DNA, 13 bp, Homo sapiens
ggaggctggggcc

SEQ ID NO: 1273304 - DNA, 18 bp, Homo sapiens
ggaggctgtgatttgctg

SEQ ID NO: 1273305 - DNA, 18 bp, Homo sapiens
ggaggcttgtcagagctg

SEQ ID NO: 1273306 - DNA, 19 bp, Homo sapiens
ggaggcttgtcagagctgg

SEQ ID NO: 1273307 - DNA, 16 bp, Homo sapiens
ggatcagggaatccag

SEQ ID NO: 1273308 - DNA, 19 bp, Homo sapiens
ggatcatatggagctcatg

SEQ ID NO: 1273309 - DNA, 22 bp, Homo sapiens
ggatcatatggagctcatgtca

SEQ ID NO: 1273310 - DNA, 20 bp, Homo sapiens
ggatcatttttccaggactc

SEQ ID NO: 1273311 - DNA, 22 bp, Homo sapiens
ggatccacttcttggttcctgg

SEQ ID NO: 1273312 - DNA, 16 bp, Homo sapiens
ggatccagtgacatga

SEQ ID NO: 1273313 - DNA, 21 bp, Homo sapiens
ggatccatcttgagccacagt

SEQ ID NO: 1273314 - DNA, 16 bp, Homo sapiens
ggatcccaagcctcct

SEQ ID NO: 1273315 - DNA, 19 bp, Homo sapiens
ggatccccgcctggccagg

SEQ ID NO: 1273316 - DNA, 21 bp, Homo sapiens
ggatccccgcctggccaggag

SEQ ID NO: 1273317 - DNA, 23 bp, Homo sapiens
ggatccccgcctggccaggagca

SEQ ID NO: 1273318 - DNA, 22 bp, Homo sapiens
ggatccctcatctgtccctccg

SEQ ID NO: 1273319 - DNA, 17 bp, Homo sapiens
ggatccgactgctttgg

SEQ ID NO: 1273320 - DNA, 19 bp, Homo sapiens
ggatccgactgctttggac

SEQ ID NO: 1273321 - DNA, 21 bp, Homo sapiens
ggatccgactgctttggacct

SEQ ID NO: 1273322 - DNA, 24 bp, Homo sapiens
ggatccgcggggaccctgccgagg

SEQ ID NO: 1273323 - DNA, 15 bp, Homo sapiens
ggatccgctgccacc

SEQ ID NO: 1273324 - DNA, 14 bp, Homo sapiens
ggatcctattctca

SEQ ID NO: 1273325 - DNA, 20 bp, Homo sapiens
ggatcctattctcaccagga

SEQ ID NO: 1273326 - DNA, 13 bp, Homo sapiens
ggatcctccacag

SEQ ID NO: 1273327 - DNA, 14 bp, Homo sapiens
ggatcctccacaga

SEQ ID NO: 1273328 - DNA, 17 bp, Homo sapiens
ggatcctctccaccctc

SEQ ID NO: 1273329 - DNA, 13 bp, Homo sapiens
ggatcctgcagga

SEQ ID NO: 1273330 - DNA, 17 bp, Homo sapiens
ggatccttcagcacagg

SEQ ID NO: 1273331 - DNA, 15 bp, Homo sapiens
ggatcgaggcatggg

SEQ ID NO: 1273332 - DNA, 19 bp, Homo sapiens
ggatcgagtgtagctgtga

SEQ ID NO: 1273333 - DNA, 23 bp, Homo sapiens
ggatcgagtgtagctgtgaaatc

SEQ ID NO: 1273334 - DNA, 14 bp, Homo sapiens
ggatcgtgcatttg

SEQ ID NO: 1273335 - DNA, 17 bp, Homo sapiens
ggatctaagaagggctg

SEQ ID NO: 1273336 - DNA, 15 bp, Homo sapiens
ggatctacctggagg

SEQ ID NO: 1273337 - DNA, 16 bp, Homo sapiens
ggatctacctggaggg

SEQ ID NO: 1273338 - DNA, 22 bp, Homo sapiens
ggatctataggcagcttctaag

SEQ ID NO: 1273339 - DNA, 14 bp, Homo sapiens
ggatctcaagccag

SEQ ID NO: 1273340 - DNA, 11 bp, Homo sapiens
ggatctcacag

SEQ ID NO: 1273341 - DNA, 10 bp, Homo sapiens
ggatctcagg

SEQ ID NO: 1273342 - DNA, 17 bp, Homo sapiens
ggatctcattggaccct

SEQ ID NO: 1273343 - DNA, 22 bp, Homo sapiens
ggatctcctgctgccttttctg

SEQ ID NO: 1273344 - DNA, 21 bp, Homo sapiens
ggatctctcaggagcacaggc

SEQ ID NO: 1273345 - DNA, 22 bp, Homo sapiens
ggatctctcaggagcacaggca

SEQ ID NO: 1273346 - DNA, 23 bp, Homo sapiens
ggatctctctagtgatggtcaga

SEQ ID NO: 1273347 - DNA, 17 bp, Homo sapiens
ggatctcttaagacagc

SEQ ID NO: 1273348 - DNA, 19 bp, Homo sapiens
ggatctgaccctcccagtc

SEQ ID NO: 1273349 - DNA, 14 bp, Homo sapiens
ggatctgctgaggc

SEQ ID NO: 1273350 - DNA, 15 bp, Homo sapiens
ggatctgctgaggcc

SEQ ID NO: 1273351 - DNA, 16 bp, Homo sapiens
ggatctggatctgtta

SEQ ID NO: 1273352 - DNA, 12 bp, Homo sapiens
ggatctgggtta

SEQ ID NO: 1273353 - DNA, 15 bp, Homo sapiens
ggatctggtggtcag

SEQ ID NO: 1273354 - DNA, 19 bp, Homo sapiens
ggatcttcccacaggaggg

SEQ ID NO: 1273355 - DNA, 14 bp, Homo sapiens
ggatcttgaatgtg

SEQ ID NO: 1273356 - DNA, 15 bp, Homo sapiens
ggatcttgaatgtgg

SEQ ID NO: 1273357 - DNA, 17 bp, Homo sapiens
ggatcttgcattcccag

SEQ ID NO: 1273358 - DNA, 21 bp, Homo sapiens
ggatgaaagttcccccatcag

SEQ ID NO: 1273359 - DNA, 18 bp, Homo sapiens
ggatgaatgaggtcccag

SEQ ID NO: 1273360 - DNA, 19 bp, Homo sapiens
ggatgacaccctggcctga

SEQ ID NO: 1273361 - DNA, 19 bp, Homo sapiens
ggatgacaggcgcctgcca

SEQ ID NO: 1273362 - DNA, 15 bp, Homo sapiens
ggatgacagggcaga

SEQ ID NO: 1273363 - DNA, 20 bp, Homo sapiens
ggatgacaggtgtgagccac

SEQ ID NO: 1273364 - DNA, 18 bp, Homo sapiens
ggatgactagaggcaggg

SEQ ID NO: 1273365 - DNA, 11 bp, Homo sapiens
ggatgacttta

SEQ ID NO: 1273366 - DNA, 21 bp, Homo sapiens
ggatgagaatttgagtgctct

SEQ ID NO: 1273367 - DNA, 15 bp, Homo sapiens
ggatgaggagacaga

SEQ ID NO: 1273368 - DNA, 21 bp, Homo sapiens
ggatgaggccgctagaggcct

SEQ ID NO: 1273369 - DNA, 20 bp, Homo sapiens
ggatgaggggcttcctgggt

SEQ ID NO: 1273370 - DNA, 18 bp, Homo sapiens
ggatgaggggtgctgggt

SEQ ID NO: 1273371 - DNA, 23 bp, Homo sapiens
ggatgatgtctttttattaaaat

SEQ ID NO: 1273372 - DNA, 16 bp, Homo sapiens
ggatgattcagaaatt

SEQ ID NO: 1273373 - DNA, 15 bp, Homo sapiens
ggatgattgtacaga

SEQ ID NO: 1273374 - DNA, 19 bp, Homo sapiens
ggatgatttcatcttctgg

SEQ ID NO: 1273375 - DNA, 19 bp, Homo sapiens
ggatgcacacttctgacct

SEQ ID NO: 1273376 - DNA, 11 bp, Homo sapiens
ggatgcacatt

SEQ ID NO: 1273377 - DNA, 17 bp, Homo sapiens
ggatgcacatttctgga

SEQ ID NO: 1273378 - DNA, 20 bp, Homo sapiens
ggatgcacatttctggattg

SEQ ID NO: 1273379 - DNA, 20 bp, Homo sapiens
ggatgcattcgagatggcag

SEQ ID NO: 1273380 - DNA, 16 bp, Homo sapiens
ggatgccaatttcctc

SEQ ID NO: 1273381 - DNA, 19 bp, Homo sapiens
ggatgccactcctccctcc

SEQ ID NO: 1273382 - DNA, 13 bp, Homo sapiens
ggatgcccagaag

SEQ ID NO: 1273383 - DNA, 12 bp, Homo sapiens
ggatgcccccag

SEQ ID NO: 1273384 - DNA, 17 bp, Homo sapiens
ggatgcccccaggcagc

SEQ ID NO: 1273385 - DNA, 13 bp, Homo sapiens
ggatgccctggag

SEQ ID NO: 1273386 - DNA, 16 bp, Homo sapiens
ggatgcctcaccacac

SEQ ID NO: 1273387 - DNA, 16 bp, Homo sapiens
ggatgccttttctgtg

SEQ ID NO: 1273388 - DNA, 19 bp, Homo sapiens
ggatgcgagcttggccttg

SEQ ID NO: 1273389 - DNA, 20 bp, Homo sapiens
ggatgcggctttctctgcct

SEQ ID NO: 1273390 - DNA, 17 bp, Homo sapiens
ggatgctccagggcagc

SEQ ID NO: 1273391 - DNA, 17 bp, Homo sapiens
ggatgctccgaggactg

SEQ ID NO: 1273392 - DNA, 13 bp, Homo sapiens
ggatgctgaccca

SEQ ID NO: 1273393 - DNA, 17 bp, Homo sapiens
ggatgctgacccaggaa

SEQ ID NO: 1273394 - DNA, 16 bp, Homo sapiens
ggatgctggtggctgg

SEQ ID NO: 1273395 - DNA, 17 bp, Homo sapiens
ggatgctggtggctggt

SEQ ID NO: 1273396 - DNA, 16 bp, Homo sapiens
ggatggaacgggcatg

SEQ ID NO: 1273397 - DNA, 21 bp, Homo sapiens
ggatggaagcaggacagacac

SEQ ID NO: 1273398 - DNA, 12 bp, Homo sapiens
ggatggacagac

SEQ ID NO: 1273399 - DNA, 18 bp, Homo sapiens
ggatggaccaacctgctc

SEQ ID NO: 1273400 - DNA, 11 bp, Homo sapiens
ggatggacttg

SEQ ID NO: 1273401 - DNA, 18 bp, Homo sapiens
ggatggagaaagaagtgg

SEQ ID NO: 1273402 - DNA, 17 bp, Homo sapiens
ggatggagaggcggcct

SEQ ID NO: 1273403 - DNA, 18 bp, Homo sapiens
ggatggagaggcggcctc

SEQ ID NO: 1273404 - DNA, 17 bp, Homo sapiens
ggatggagatgggaagg

SEQ ID NO: 1273405 - DNA, 13 bp, Homo sapiens
ggatggaggccag

SEQ ID NO: 1273406 - DNA, 18 bp, Homo sapiens
ggatggatttccagccaa

SEQ ID NO: 1273407 - DNA, 14 bp, Homo sapiens
ggatggcaggatcc

SEQ ID NO: 1273408 - DNA, 18 bp, Homo sapiens
ggatggcaggatccaagg

SEQ ID NO: 1273409 - DNA, 14 bp, Homo sapiens
ggatggccccagca

SEQ ID NO: 1273410 - DNA, 15 bp, Homo sapiens
ggatggcccctcctt

SEQ ID NO: 1273411 - DNA, 16 bp, Homo sapiens
ggatggcccctccttg

SEQ ID NO: 1273412 - DNA, 22 bp, Homo sapiens
ggatggcccttcccactggagg

SEQ ID NO: 1273413 - DNA, 12 bp, Homo sapiens
ggatggccgtgg

SEQ ID NO: 1273414 - DNA, 18 bp, Homo sapiens
ggatgggaacactggtgg

SEQ ID NO: 1273415 - DNA, 12 bp, Homo sapiens
ggatgggaggag

SEQ ID NO: 1273416 - DNA, 17 bp, Homo sapiens
ggatgggcattgggctg

SEQ ID NO: 1273417 - DNA, 23 bp, Homo sapiens
ggatgggcattgggctgacacct

SEQ ID NO: 1273418 - DNA, 15 bp, Homo sapiens
ggatgggctcgctga

SEQ ID NO: 1273419 - DNA, 15 bp, Homo sapiens
ggatgggctgagcta

SEQ ID NO: 1273420 - DNA, 20 bp, Homo sapiens
ggatgggctgagctagcctc

SEQ ID NO: 1273421 - DNA, 22 bp, Homo sapiens
ggatgggctgagctagcctcca

SEQ ID NO: 1273422 - DNA, 11 bp, Homo sapiens
ggatggggagg

SEQ ID NO: 1273423 - DNA, 19 bp, Homo sapiens
ggatgggggatgggccagg

SEQ ID NO: 1273424 - DNA, 22 bp, Homo sapiens
ggatgggggctggcctctggct

SEQ ID NO: 1273425 - DNA, 19 bp, Homo sapiens
ggatgggtcccctccgcca

SEQ ID NO: 1273426 - DNA, 16 bp, Homo sapiens
ggatgggtggatggcc

SEQ ID NO: 1273427 - DNA, 23 bp, Homo sapiens
ggatggtactagggggaagtgac

SEQ ID NO: 1273428 - DNA, 14 bp, Homo sapiens
ggatggtccaggat

SEQ ID NO: 1273429 - DNA, 13 bp, Homo sapiens
ggcagccagaccc

SEQ ID NO: 1273430 - DNA, 12 bp, Homo sapiens
ggcagccagcag

SEQ ID NO: 1273431 - DNA, 19 bp, Homo sapiens
ggcagccaggctgccaagg

SEQ ID NO: 1273432 - DNA, 13 bp, Homo sapiens
ggcagccatgcct

SEQ ID NO: 1273433 - DNA, 15 bp, Homo sapiens
ggcagccatgcctca

SEQ ID NO: 1273434 - DNA, 13 bp, Homo sapiens
ggcagcccagcag

SEQ ID NO: 1273435 - DNA, 13 bp, Homo sapiens
ggcagcccatggg

SEQ ID NO: 1273436 - DNA, 19 bp, Homo sapiens
ggcagcccccccctcaagg

SEQ ID NO: 1273437 - DNA, 18 bp, Homo sapiens
ggcagccccgttttgggg

SEQ ID NO: 1273438 - DNA, 20 bp, Homo sapiens
ggcagcccggctgctgcttg

SEQ ID NO: 1273439 - DNA, 21 bp, Homo sapiens
ggcagcccggctgctgcttgg

SEQ ID NO: 1273440 - DNA, 22 bp, Homo sapiens
ggcagccctgagtggtcactgg

SEQ ID NO: 1273441 - DNA, 11 bp, Homo sapiens
ggcagcccttg

SEQ ID NO: 1273442 - DNA, 17 bp, Homo sapiens
ggcagccgtcccaggcc

SEQ ID NO: 1273443 - DNA, 18 bp, Homo sapiens
ggcagccgtgccttcagc

SEQ ID NO: 1273444 - DNA, 21 bp, Homo sapiens
ggcagccgtgccttcagctct

SEQ ID NO: 1273445 - DNA, 22 bp, Homo sapiens
ggcagccgtgccttcagctcta

SEQ ID NO: 1273446 - DNA, 23 bp, Homo sapiens
ggcagcctcaaggccctcggagc

SEQ ID NO: 1273447 - DNA, 15 bp, Homo sapiens
ggcagcctccagagc

SEQ ID NO: 1273448 - DNA, 17 bp, Homo sapiens
ggcagcctccagagcca

SEQ ID NO: 1273449 - DNA, 21 bp, Homo sapiens
ggcagcctccagagccagcct

SEQ ID NO: 1273450 - DNA, 14 bp, Homo sapiens
ggcagcctcccatc

SEQ ID NO: 1273451 - DNA, 10 bp, Homo sapiens
ggcagcctgc

SEQ ID NO: 1273452 - DNA, 22 bp, Homo sapiens
ggcagcctgccgccgtctctgt

SEQ ID NO: 1273453 - DNA, 11 bp, Homo sapiens
ggcagcctgct

SEQ ID NO: 1273454 - DNA, 14 bp, Homo sapiens
ggcagcctgtgcct

SEQ ID NO: 1273455 - DNA, 15 bp, Homo sapiens
ggcagcgcagggctg

SEQ ID NO: 1273456 - DNA, 19 bp, Homo sapiens
ggcagcgcagggctggcac

SEQ ID NO: 1273457 - DNA, 20 bp, Homo sapiens
ggcagcgccaagtgcgtgcc

SEQ ID NO: 1273458 - DNA, 14 bp, Homo sapiens
ggcagcgccaggct

SEQ ID NO: 1273459 - DNA, 17 bp, Homo sapiens
ggcagctagtgccttta

SEQ ID NO: 1273460 - DNA, 14 bp, Homo sapiens
ggcagctcacccct

SEQ ID NO: 1273461 - DNA, 15 bp, Homo sapiens
ggcagctcacccctg

SEQ ID NO: 1273462 - DNA, 17 bp, Homo sapiens
ggcagctcacccctggg

SEQ ID NO: 1273463 - DNA, 21 bp, Homo sapiens
ggcagctcacccctgggcagg

SEQ ID NO: 1273464 - DNA, 19 bp, Homo sapiens
ggcagctcctccctgtgcc

SEQ ID NO: 1273465 - DNA, 21 bp, Homo sapiens
ggcagctcctccctgtgcccc

SEQ ID NO: 1273466 - DNA, 18 bp, Homo sapiens
ggcagctcctctccttgg

SEQ ID NO: 1273467 - DNA, 19 bp, Homo sapiens
ggcagctcctctccttggg

SEQ ID NO: 1273468 - DNA, 22 bp, Homo sapiens
ggcagctcctctccttgggctc

SEQ ID NO: 1273469 - DNA, 16 bp, Homo sapiens
ggcagctcgaggcccc

SEQ ID NO: 1273470 - DNA, 11 bp, Homo sapiens
ggcagctctcc

SEQ ID NO: 1273471 - DNA, 15 bp, Homo sapiens
ggcagctcttctgga

SEQ ID NO: 1273472 - DNA, 21 bp, Homo sapiens
ggcagctcttctgggcagagc

SEQ ID NO: 1273473 - DNA, 24 bp, Homo sapiens
ggcagctcttctgggcagagcctg

SEQ ID NO: 1273474 - DNA, 20 bp, Homo sapiens
ggcagctgagaccagggtct

SEQ ID NO: 1273475 - DNA, 18 bp, Homo sapiens
ggcagctgagagccctgc

SEQ ID NO: 1273476 - DNA, 13 bp, Homo sapiens
ggcagctgcccct

SEQ ID NO: 1273477 - DNA, 15 bp, Homo sapiens
ggcagctgcccctcc

SEQ ID NO: 1273478 - DNA, 19 bp, Homo sapiens
ggcagctgcccctcctgga

SEQ ID NO: 1273479 - DNA, 22 bp, Homo sapiens
ggcagctgcctctgctccctct

SEQ ID NO: 1273480 - DNA, 13 bp, Homo sapiens
ggcagctgcctgg

SEQ ID NO: 1273481 - DNA, 14 bp, Homo sapiens
ggcagctgcctggc

SEQ ID NO: 1273482 - DNA, 18 bp, Homo sapiens
ggcagctgcctggccatg

SEQ ID NO: 1273483 - DNA, 22 bp, Homo sapiens
ggcagctgctatttattttcct

SEQ ID NO: 1273484 - DNA, 13 bp, Homo sapiens
ggcagctgctctt

SEQ ID NO: 1273485 - DNA, 15 bp, Homo sapiens
ggcagctgctcttag

SEQ ID NO: 1273486 - DNA, 12 bp, Homo sapiens
ggcagctgctgt

SEQ ID NO: 1273487 - DNA, 19 bp, Homo sapiens
ggcagctggaccatctctg

SEQ ID NO: 1273488 - DNA, 21 bp, Homo sapiens
ggcagctggcccccagccctg

SEQ ID NO: 1273489 - DNA, 14 bp, Homo sapiens
ggcagctgggcccc

SEQ ID NO: 1273490 - DNA, 20 bp, Homo sapiens
ggcagctgtttctcatgaag

SEQ ID NO: 1273491 - DNA, 15 bp, Homo sapiens
ggcagcttagggccc

SEQ ID NO: 1273492 - DNA, 19 bp, Homo sapiens
ggcagcttagggccctgga

SEQ ID NO: 1273493 - DNA, 21 bp, Homo sapiens
ggcagcttctgttggcagagc

SEQ ID NO: 1273494 - DNA, 18 bp, Homo sapiens
ggcagcttgccccggccc

SEQ ID NO: 1273495 - DNA, 16 bp, Homo sapiens
ggcagctttttctgtg

SEQ ID NO: 1273496 - DNA, 22 bp, Homo sapiens
ggcagctttttctgtggaggac

SEQ ID NO: 1273497 - DNA, 17 bp, Homo sapiens
ggcaggaagggaagcgt

SEQ ID NO: 1273498 - DNA, 18 bp, Homo sapiens
ggcaggaatgggggtcag

SEQ ID NO: 1273499 - DNA, 16 bp, Homo sapiens
ggcaggacacatcccg

SEQ ID NO: 1273500 - DNA, 22 bp, Homo sapiens
ggcaggacctgcctagcatggg

SEQ ID NO: 1273501 - DNA, 20 bp, Homo sapiens
ggcaggactcctggcagggc

SEQ ID NO: 1273502 - DNA, 22 bp, Homo sapiens
ggcaggactcctggcagggcca

SEQ ID NO: 1273503 - DNA, 23 bp, Homo sapiens
ggcaggagagtgtgtgggcaggg

SEQ ID NO: 1273504 - DNA, 17 bp, Homo sapiens
ggcaggagtgccaggac

SEQ ID NO: 1273505 - DNA, 21 bp, Homo sapiens
ggcaggagtgccaggaccagc

SEQ ID NO: 1273506 - DNA, 15 bp, Homo sapiens
ggcaggagtggcagc

SEQ ID NO: 1273507 - DNA, 21 bp, Homo sapiens
ggcaggatggcctttccttcc

SEQ ID NO: 1273508 - DNA, 23 bp, Homo sapiens
ggcaggatggcctttccttccct

SEQ ID NO: 1273509 - DNA, 16 bp, Homo sapiens
ggcaggcaagcccttc

SEQ ID NO: 1273510 - DNA, 17 bp, Homo sapiens
ggcaggcacacagcagc

SEQ ID NO: 1273511 - DNA, 10 bp, Homo sapiens
ggcaggcacc

SEQ ID NO: 1273512 - DNA, 14 bp, Homo sapiens
ggcaggcattcctg

SEQ ID NO: 1273513 - DNA, 18 bp, Homo sapiens
ggcaggccagatggcccc

SEQ ID NO: 1273514 - DNA, 11 bp, Homo sapiens
ggcaggcccac

SEQ ID NO: 1273515 - DNA, 13 bp, Homo sapiens
ggcaggcccactc

SEQ ID NO: 1273516 - DNA, 18 bp, Homo sapiens
ggcaggcccactccccag

SEQ ID NO: 1273517 - DNA, 21 bp, Homo sapiens
ggcaggcccactccccagccc

SEQ ID NO: 1273518 - DNA, 22 bp, Homo sapiens
ggcaggcctgacccacggggca

SEQ ID NO: 1273519 - DNA, 13 bp, Homo sapiens
ggcaggcctggga

SEQ ID NO: 1273520 - DNA, 16 bp, Homo sapiens
ggcaggccttgctggg

SEQ ID NO: 1273521 - DNA, 17 bp, Homo sapiens
ggcaggcgatccccgct

SEQ ID NO: 1273522 - DNA, 23 bp, Homo sapiens
ggcaggcgcagaggtcccagccc

SEQ ID NO: 1273523 - DNA, 19 bp, Homo sapiens
ggcaggcgggcccatgaag

SEQ ID NO: 1273524 - DNA, 23 bp, Homo sapiens
ggcaggcggtccccatccccacc

SEQ ID NO: 1273525 - DNA, 16 bp, Homo sapiens
ggcaggcgtgtggcag

SEQ ID NO: 1273526 - DNA, 20 bp, Homo sapiens
ggcaggcgtgtggcagccac

SEQ ID NO: 1273527 - DNA, 15 bp, Homo sapiens
ggcaggctcactgcc

SEQ ID NO: 1273528 - DNA, 18 bp, Homo sapiens
ggcaggctgacatctgtg

SEQ ID NO: 1273529 - DNA, 11 bp, Homo sapiens
ggcaggctggc

SEQ ID NO: 1273530 - DNA, 12 bp, Homo sapiens
ggcaggctggcc

SEQ ID NO: 1273531 - DNA, 17 bp, Homo sapiens
ggcaggctggccagtcc

SEQ ID NO: 1273532 - DNA, 22 bp, Homo sapiens
ggcaggctgggccatgtccaaa

SEQ ID NO: 1273533 - DNA, 22 bp, Homo sapiens
ggcaggctgtctggccaggcct

SEQ ID NO: 1273534 - DNA, 22 bp, Homo sapiens
ggcagggacccggggtctcctg

SEQ ID NO: 1273535 - DNA, 18 bp, Homo sapiens
ggcagggacttgcctcca

SEQ ID NO: 1273536 - DNA, 11 bp, Homo sapiens
ggcagggaggc

SEQ ID NO: 1273537 - DNA, 14 bp, Homo sapiens
ggcagggagggctt

SEQ ID NO: 1273538 - DNA, 13 bp, Homo sapiens
ggcagggaggggc

SEQ ID NO: 1273539 - DNA, 14 bp, Homo sapiens
ggcagggcagcctg

SEQ ID NO: 1273540 - DNA, 18 bp, Homo sapiens
ggcagggccaacccttct

SEQ ID NO: 1273541 - DNA, 13 bp, Homo sapiens
ggcagggccaggg

SEQ ID NO: 1273542 - DNA, 14 bp, Homo sapiens
ggcagggccagggc

SEQ ID NO: 1273543 - DNA, 19 bp, Homo sapiens
ggcagggccagggcaatgc

SEQ ID NO: 1273544 - DNA, 14 bp, Homo sapiens
ggcagggcccacgt

SEQ ID NO: 1273545 - DNA, 17 bp, Homo sapiens
ggcagggcccacgtgta

SEQ ID NO: 1273546 - DNA, 22 bp, Homo sapiens
ggcagggcgggcagagggctgg

SEQ ID NO: 1273547 - DNA, 23 bp, Homo sapiens
ggcagggcgggcagagggctgga

SEQ ID NO: 1273548 - DNA, 13 bp, Homo sapiens
ggcagggctcaca

SEQ ID NO: 1273549 - DNA, 14 bp, Homo sapiens
ggcagggctctccc

SEQ ID NO: 1273550 - DNA, 13 bp, Homo sapiens
ggcagggctctga

SEQ ID NO: 1273551 - DNA, 19 bp, Homo sapiens
ggccacgtgtgctgtggcc

SEQ ID NO: 1273552 - DNA, 14 bp, Homo sapiens
ggccactaaagctt

SEQ ID NO: 1273553 - DNA, 16 bp, Homo sapiens
ggccactaaagcttca

SEQ ID NO: 1273554 - DNA, 21 bp, Homo sapiens
ggccactaagcagaggagggg

SEQ ID NO: 1273555 - DNA, 19 bp, Homo sapiens
ggccactcagaggccccca

SEQ ID NO: 1273556 - DNA, 20 bp, Homo sapiens
ggccactcagaggcccccag

SEQ ID NO: 1273557 - DNA, 23 bp, Homo sapiens
ggccactcagaggcccccagtgg

SEQ ID NO: 1273558 - DNA, 16 bp, Homo sapiens
ggccactctcccctcc

SEQ ID NO: 1273559 - DNA, 15 bp, Homo sapiens
ggccactgacccacc

SEQ ID NO: 1273560 - DNA, 20 bp, Homo sapiens
ggccactgacccacctgcgc

SEQ ID NO: 1273561 - DNA, 18 bp, Homo sapiens
ggccactgcgccactgcc

SEQ ID NO: 1273562 - DNA, 12 bp, Homo sapiens
ggccactgggga

SEQ ID NO: 1273563 - DNA, 14 bp, Homo sapiens
ggccactggggact

SEQ ID NO: 1273564 - DNA, 22 bp, Homo sapiens
ggccactgggtctcactcctga

SEQ ID NO: 1273565 - DNA, 15 bp, Homo sapiens
ggccactgtaggggt

SEQ ID NO: 1273566 - DNA, 20 bp, Homo sapiens
ggccactgtccctgtccttc

SEQ ID NO: 1273567 - DNA, 23 bp, Homo sapiens
ggccactgtccctgtccttctac

SEQ ID NO: 1273568 - DNA, 11 bp, Homo sapiens
ggccactgtga

SEQ ID NO: 1273569 - DNA, 16 bp, Homo sapiens
ggccactgtgaagaga

SEQ ID NO: 1273570 - DNA, 16 bp, Homo sapiens
ggccactgtgtctctg

SEQ ID NO: 1273571 - DNA, 17 bp, Homo sapiens
ggccactgtgtctctgt

SEQ ID NO: 1273572 - DNA, 15 bp, Homo sapiens
ggccacttcattcca

SEQ ID NO: 1273573 - DNA, 16 bp, Homo sapiens
ggccacttcattccag

SEQ ID NO: 1273574 - DNA, 19 bp, Homo sapiens
ggccacttcattccagcag

SEQ ID NO: 1273575 - DNA, 21 bp, Homo sapiens
ggccacttcattccagcagct

SEQ ID NO: 1273576 - DNA, 19 bp, Homo sapiens
ggccactttcagagccccc

SEQ ID NO: 1273577 - DNA, 14 bp, Homo sapiens
ggccagacgctgcc

SEQ ID NO: 1273578 - DNA, 16 bp, Homo sapiens
ggccagacgctgccgc

SEQ ID NO: 1273579 - DNA, 19 bp, Homo sapiens
ggccagagagcaggggagc

SEQ ID NO: 1273580 - DNA, 22 bp, Homo sapiens
ggccagagagcaggggagcttg

SEQ ID NO: 1273581 - DNA, 22 bp, Homo sapiens
ggccagagagcctggtgctgct

SEQ ID NO: 1273582 - DNA, 15 bp, Homo sapiens
ggccagagagggccc

SEQ ID NO: 1273583 - DNA, 16 bp, Homo sapiens
ggccagagagggccca

SEQ ID NO: 1273584 - DNA, 19 bp, Homo sapiens
ggccagagagggcccagct

SEQ ID NO: 1273585 - DNA, 21 bp, Homo sapiens
ggccagagagggcccagctgt

SEQ ID NO: 1273586 - DNA, 22 bp, Homo sapiens
ggccagagccatgccaggctgc

SEQ ID NO: 1273587 - DNA, 15 bp, Homo sapiens
ggccagagcctctgg

SEQ ID NO: 1273588 - DNA, 18 bp, Homo sapiens
ggccagagcctctggccc

SEQ ID NO: 1273589 - DNA, 17 bp, Homo sapiens
ggccagagctagggctg

SEQ ID NO: 1273590 - DNA, 20 bp, Homo sapiens
ggccagagctagggctgctg

SEQ ID NO: 1273591 - DNA, 22 bp, Homo sapiens
ggccagagctagggctgctgct

SEQ ID NO: 1273592 - DNA, 13 bp, Homo sapiens
ggccagagctgaa

SEQ ID NO: 1273593 - DNA, 13 bp, Homo sapiens
ggccagagctgga

SEQ ID NO: 1273594 - DNA, 18 bp, Homo sapiens
ggccagagctggaaggca

SEQ ID NO: 1273595 - DNA, 20 bp, Homo sapiens
ggccagagctggaaggcagg

SEQ ID NO: 1273596 - DNA, 16 bp, Homo sapiens
ggccagaggcccccag

SEQ ID NO: 1273597 - DNA, 18 bp, Homo sapiens
ggccagaggcccccagcc

SEQ ID NO: 1273598 - DNA, 19 bp, Homo sapiens
ggccagaggcccccagccc

SEQ ID NO: 1273599 - DNA, 18 bp, Homo sapiens
ggccagagggcagtggcc

SEQ ID NO: 1273600 - DNA, 14 bp, Homo sapiens
ggccagagtggcct

SEQ ID NO: 1273601 - DNA, 18 bp, Homo sapiens
ggccagagtggcctggcc

SEQ ID NO: 1273602 - DNA, 19 bp, Homo sapiens
ggccagagtggcctggcca

SEQ ID NO: 1273603 - DNA, 18 bp, Homo sapiens
ggccagatggcccctcca

SEQ ID NO: 1273604 - DNA, 22 bp, Homo sapiens
ggccagcaaaaactgtgggaag

SEQ ID NO: 1273605 - DNA, 17 bp, Homo sapiens
ggccagcaacgcttgta

SEQ ID NO: 1273606 - DNA, 12 bp, Homo sapiens
ggccagcaccct

SEQ ID NO: 1273607 - DNA, 16 bp, Homo sapiens
ggccagcaccctctcc

SEQ ID NO: 1273608 - DNA, 13 bp, Homo sapiens
ggccagcaggctc

SEQ ID NO: 1273609 - DNA, 15 bp, Homo sapiens
ggccagcaggctcct

SEQ ID NO: 1273610 - DNA, 23 bp, Homo sapiens
ggccagcaggctcctggctgtgc

SEQ ID NO: 1273611 - DNA, 21 bp, Homo sapiens
ggccagccaatttcccggagc

SEQ ID NO: 1273612 - DNA, 12 bp, Homo sapiens
ggccagccaggc

SEQ ID NO: 1273613 - DNA, 13 bp, Homo sapiens
ggccagcccagcc

SEQ ID NO: 1273614 - DNA, 14 bp, Homo sapiens
ggccagcccagcca

SEQ ID NO: 1273615 - DNA, 14 bp, Homo sapiens
ggccagccccaccc

SEQ ID NO: 1273616 - DNA, 20 bp, Homo sapiens
ggccagccccacccccagcc

SEQ ID NO: 1273617 - DNA, 22 bp, Homo sapiens
ggccagccccacccccagccag

SEQ ID NO: 1273618 - DNA, 22 bp, Homo sapiens
ggccagcccccccacccacccc

SEQ ID NO: 1273619 - DNA, 15 bp, Homo sapiens
ggccagcccctccca

SEQ ID NO: 1273620 - DNA, 21 bp, Homo sapiens
ggccagcccctcccaccacag

SEQ ID NO: 1273621 - DNA, 14 bp, Homo sapiens
ggccagcccggctg

SEQ ID NO: 1273622 - DNA, 22 bp, Homo sapiens
ggccagccgcgggactgacacc

SEQ ID NO: 1273623 - DNA, 16 bp, Homo sapiens
ggccagcctccgagag

SEQ ID NO: 1273624 - DNA, 20 bp, Homo sapiens
ggccagcctccgagagggag

SEQ ID NO: 1273625 - DNA, 15 bp, Homo sapiens
ggccagcctgtccct

SEQ ID NO: 1273626 - DNA, 16 bp, Homo sapiens
ggccagcctgtccctg

SEQ ID NO: 1273627 - DNA, 17 bp, Homo sapiens
ggccagcgccagggccc

SEQ ID NO: 1273628 - DNA, 23 bp, Homo sapiens
ggccagcgccagggcccaggcca

SEQ ID NO: 1273629 - DNA, 18 bp, Homo sapiens
ggccagcggggctgctca

SEQ ID NO: 1273630 - DNA, 17 bp, Homo sapiens
ggccagcggtgaccagc

SEQ ID NO: 1273631 - DNA, 14 bp, Homo sapiens
ggccagctctgagg

SEQ ID NO: 1273632 - DNA, 20 bp, Homo sapiens
ggccagctctgaggggaggc

SEQ ID NO: 1273633 - DNA, 19 bp, Homo sapiens
ggccagctgccccagccag

SEQ ID NO: 1273634 - DNA, 12 bp, Homo sapiens
ggccagctgggg

SEQ ID NO: 1273635 - DNA, 20 bp, Homo sapiens
ggccagctggggagatgggg

SEQ ID NO: 1273636 - DNA, 20 bp, Homo sapiens
ggccagcttcgtgctggagg

SEQ ID NO: 1273637 - DNA, 21 bp, Homo sapiens
ggccagcttcgtgctggagga

SEQ ID NO: 1273638 - DNA, 15 bp, Homo sapiens
ggccagcttttcaaa

SEQ ID NO: 1273639 - DNA, 11 bp, Homo sapiens
ggccaggcagg

SEQ ID NO: 1273640 - DNA, 19 bp, Homo sapiens
ggccaggcaggggtgggag

SEQ ID NO: 1273641 - DNA, 21 bp, Homo sapiens
ggccaggccacctccagaaac

SEQ ID NO: 1273642 - DNA, 15 bp, Homo sapiens
ggccaggccagctgc

SEQ ID NO: 1273643 - DNA, 17 bp, Homo sapiens
ggccaggccagctgcct

SEQ ID NO: 1273644 - DNA, 22 bp, Homo sapiens
ggccaggccttacatctggctg

SEQ ID NO: 1273645 - DNA, 20 bp, Homo sapiens
ggccaggcgagcctgactct

SEQ ID NO: 1273646 - DNA, 13 bp, Homo sapiens
ggccaggctgcct

SEQ ID NO: 1273647 - DNA, 18 bp, Homo sapiens
ggccaggctgcctggcct

SEQ ID NO: 1273648 - DNA, 23 bp, Homo sapiens
ggccagggaaacaaagtttacat

SEQ ID NO: 1273649 - DNA, 14 bp, Homo sapiens
ggccagggaggcag

SEQ ID NO: 1273650 - DNA, 15 bp, Homo sapiens
ggccagggaggcaga

SEQ ID NO: 1273651 - DNA, 13 bp, Homo sapiens
ggccagggaggcg

SEQ ID NO: 1273652 - DNA, 16 bp, Homo sapiens
ggccagggaggcgcag

SEQ ID NO: 1273653 - DNA, 15 bp, Homo sapiens
ggccagggcaatgcc

SEQ ID NO: 1273654 - DNA, 17 bp, Homo sapiens
ggccagggcaatgccat

SEQ ID NO: 1273655 - DNA, 21 bp, Homo sapiens
ggccagggcaatgccatcagc

SEQ ID NO: 1273656 - DNA, 14 bp, Homo sapiens
ggccagggcagatg

SEQ ID NO: 1273657 - DNA, 16 bp, Homo sapiens
ggccagggcagatgtg

SEQ ID NO: 1273658 - DNA, 13 bp, Homo sapiens
ggccagggccctg

SEQ ID NO: 1273659 - DNA, 18 bp, Homo sapiens
ggccagggccctgcagag

SEQ ID NO: 1273660 - DNA, 17 bp, Homo sapiens
ggccagggcggccaggg

SEQ ID NO: 1273661 - DNA, 18 bp, Homo sapiens
ggccagggcggccaggga

SEQ ID NO: 1273662 - DNA, 21 bp, Homo sapiens
ggccagggcggccagggaccc

SEQ ID NO: 1273663 - DNA, 14 bp, Homo sapiens
ggccagggctgccc

SEQ ID NO: 1273664 - DNA, 15 bp, Homo sapiens
ggccagggctggatg

SEQ ID NO: 1273665 - DNA, 18 bp, Homo sapiens
ggccagggcttccccatc

SEQ ID NO: 1273666 - DNA, 19 bp, Homo sapiens
ggccagggcttccccatca

SEQ ID NO: 1273667 - DNA, 14 bp, Homo sapiens
ggccaggggcaggc

SEQ ID NO: 1273668 - DNA, 19 bp, Homo sapiens
ggccaggggtgggagcatc

SEQ ID NO: 1273669 - DNA, 22 bp, Homo sapiens
ggccagggttgcggtcgcggct

SEQ ID NO: 1273670 - DNA, 23 bp, Homo sapiens
ggccaggtgcggcctggggggaa

SEQ ID NO: 1273671 - DNA, 19 bp, Homo sapiens
ggccaggtggccactccag

SEQ ID NO: 1273672 - DNA, 15 bp, Homo sapiens
ggccaggtgggaacg

SEQ ID NO: 1273673 - DNA, 17 bp, Homo sapiens
ggccctgactcctctgg

SEQ ID NO: 1273674 - DNA, 14 bp, Homo sapiens
ggccctgacttctg

SEQ ID NO: 1273675 - DNA, 21 bp, Homo sapiens
ggccctgaggcggaggctgtg

SEQ ID NO: 1273676 - DNA, 18 bp, Homo sapiens
ggccctgcacctgtgcag

SEQ ID NO: 1273677 - DNA, 13 bp, Homo sapiens
ggccctgcaggag

SEQ ID NO: 1273678 - DNA, 14 bp, Homo sapiens
ggccctgcaggagc

SEQ ID NO: 1273679 - DNA, 17 bp, Homo sapiens
ggccctgcaggagcagg

SEQ ID NO: 1273680 - DNA, 17 bp, Homo sapiens
ggccctgcaggctgcag

SEQ ID NO: 1273681 - DNA, 24 bp, Homo sapiens
ggccctgcaggctgcaggagggca

SEQ ID NO: 1273682 - DNA, 16 bp, Homo sapiens
ggccctgccattggcc

SEQ ID NO: 1273683 - DNA, 21 bp, Homo sapiens
ggccctgccattggcctcttg

SEQ ID NO: 1273684 - DNA, 17 bp, Homo sapiens
ggccctgccccacccca

SEQ ID NO: 1273685 - DNA, 13 bp, Homo sapiens
ggccctgccccag

SEQ ID NO: 1273686 - DNA, 16 bp, Homo sapiens
ggccctgccccagccc

SEQ ID NO: 1273687 - DNA, 17 bp, Homo sapiens
ggccctgcccggggagc

SEQ ID NO: 1273688 - DNA, 14 bp, Homo sapiens
ggccctgccctgta

SEQ ID NO: 1273689 - DNA, 21 bp, Homo sapiens
ggccctgccctgtactgaaga

SEQ ID NO: 1273690 - DNA, 18 bp, Homo sapiens
ggccctgcctgcctcttg

SEQ ID NO: 1273691 - DNA, 17 bp, Homo sapiens
ggccctgcgtcggccct

SEQ ID NO: 1273692 - DNA, 15 bp, Homo sapiens
ggccctgcttcctgc

SEQ ID NO: 1273693 - DNA, 12 bp, Homo sapiens
ggccctggaaga

SEQ ID NO: 1273694 - DNA, 11 bp, Homo sapiens
ggccctggagc

SEQ ID NO: 1273695 - DNA, 14 bp, Homo sapiens
ggccctggagccag

SEQ ID NO: 1273696 - DNA, 18 bp, Homo sapiens
ggccctggagccagggca

SEQ ID NO: 1273697 - DNA, 12 bp, Homo sapiens
ggccctggagga

SEQ ID NO: 1273698 - DNA, 12 bp, Homo sapiens
ggccctggccag

SEQ ID NO: 1273699 - DNA, 14 bp, Homo sapiens
ggccctggccagga

SEQ ID NO: 1273700 - DNA, 17 bp, Homo sapiens
ggccctggcctcccctg

SEQ ID NO: 1273701 - DNA, 14 bp, Homo sapiens
ggccctggcctgct

SEQ ID NO: 1273702 - DNA, 15 bp, Homo sapiens
ggccctggcctgctg

SEQ ID NO: 1273703 - DNA, 13 bp, Homo sapiens
ggccctggctccc

SEQ ID NO: 1273704 - DNA, 13 bp, Homo sapiens
ggccctgggcctc

SEQ ID NO: 1273705 - DNA, 16 bp, Homo sapiens
ggccctgggcctcagt

SEQ ID NO: 1273706 - DNA, 11 bp, Homo sapiens
ggccctgggct

SEQ ID NO: 1273707 - DNA, 13 bp, Homo sapiens
ggccctgggctgg

SEQ ID NO: 1273708 - DNA, 22 bp, Homo sapiens
ggccctgggctgggtgctggga

SEQ ID NO: 1273709 - DNA, 12 bp, Homo sapiens
ggccctggggag

SEQ ID NO: 1273710 - DNA, 22 bp, Homo sapiens
ggccctggggatcttcccacag

SEQ ID NO: 1273711 - DNA, 17 bp, Homo sapiens
ggccctgggggtctggg

SEQ ID NO: 1273712 - DNA, 22 bp, Homo sapiens
ggccctggggtaccatgtggcc

SEQ ID NO: 1273713 - DNA, 15 bp, Homo sapiens
ggccctgggttcctc

SEQ ID NO: 1273714 - DNA, 12 bp, Homo sapiens
ggccctggtcct

SEQ ID NO: 1273715 - DNA, 14 bp, Homo sapiens
ggccctgtccagcc

SEQ ID NO: 1273716 - DNA, 15 bp, Homo sapiens
ggccctgtccagccc

SEQ ID NO: 1273717 - DNA, 19 bp, Homo sapiens
ggccctgtccagcccccag

SEQ ID NO: 1273718 - DNA, 11 bp, Homo sapiens
ggccctgtccc

SEQ ID NO: 1273719 - DNA, 14 bp, Homo sapiens
ggccctgtcccagg

SEQ ID NO: 1273720 - DNA, 17 bp, Homo sapiens
ggccctgtcccctggag

SEQ ID NO: 1273721 - DNA, 16 bp, Homo sapiens
ggccctgtgcctgggc

SEQ ID NO: 1273722 - DNA, 21 bp, Homo sapiens
ggccctgtggagtccagctct

SEQ ID NO: 1273723 - DNA, 19 bp, Homo sapiens
ggcccttcccacaggacat

SEQ ID NO: 1273724 - DNA, 14 bp, Homo sapiens
ggcccttcccctcc

SEQ ID NO: 1273725 - DNA, 20 bp, Homo sapiens
ggcccttcccctcccccact

SEQ ID NO: 1273726 - DNA, 15 bp, Homo sapiens
ggcccttcctctcca

SEQ ID NO: 1273727 - DNA, 17 bp, Homo sapiens
ggcccttcctctccact

SEQ ID NO: 1273728 - DNA, 18 bp, Homo sapiens
ggcccttcctctccactg

SEQ ID NO: 1273729 - DNA, 23 bp, Homo sapiens
ggcccttcctctccactgccttc

SEQ ID NO: 1273730 - DNA, 17 bp, Homo sapiens
ggcccttcttgctgccc

SEQ ID NO: 1273731 - DNA, 23 bp, Homo sapiens
ggcccttcttgctgccctgcccc

SEQ ID NO: 1273732 - DNA, 17 bp, Homo sapiens
ggcccttggaataaagt

SEQ ID NO: 1273733 - DNA, 14 bp, Homo sapiens
ggcccttgggacag

SEQ ID NO: 1273734 - DNA, 17 bp, Homo sapiens
ggcccttggggcctggc

SEQ ID NO: 1273735 - DNA, 15 bp, Homo sapiens
ggcccttgtcctgcc

SEQ ID NO: 1273736 - DNA, 17 bp, Homo sapiens
ggcccttgtcttttcaa

SEQ ID NO: 1273737 - DNA, 23 bp, Homo sapiens
ggcccttgtgctcctctcgcaca

SEQ ID NO: 1273738 - DNA, 20 bp, Homo sapiens
ggcccttgtttacagtgagg

SEQ ID NO: 1273739 - DNA, 19 bp, Homo sapiens
ggccctttccttccagatc

SEQ ID NO: 1273740 - DNA, 18 bp, Homo sapiens
ggccctttgaagcctcag

SEQ ID NO: 1273741 - DNA, 18 bp, Homo sapiens
ggccgaagctctggctga

SEQ ID NO: 1273742 - DNA, 17 bp, Homo sapiens
ggccgacattgtctccc

SEQ ID NO: 1273743 - DNA, 17 bp, Homo sapiens
ggccgacccactgaccc

SEQ ID NO: 1273744 - DNA, 22 bp, Homo sapiens
ggccgaccctgcggcctccacc

SEQ ID NO: 1273745 - DNA, 18 bp, Homo sapiens
ggccgacgttccacctgg

SEQ ID NO: 1273746 - DNA, 15 bp, Homo sapiens
ggccgagctcctggg

SEQ ID NO: 1273747 - DNA, 15 bp, Homo sapiens
ggccgagggccaggc

SEQ ID NO: 1273748 - DNA, 16 bp, Homo sapiens
ggccgagtccaagctg

SEQ ID NO: 1273749 - DNA, 20 bp, Homo sapiens
ggccgatgggagtctccctc

SEQ ID NO: 1273750 - DNA, 18 bp, Homo sapiens
ggccgcaagggcctggac

SEQ ID NO: 1273751 - DNA, 16 bp, Homo sapiens
ggccgcacgcctctcc

SEQ ID NO: 1273752 - DNA, 20 bp, Homo sapiens
ggccgcagctcttgcccttc

SEQ ID NO: 1273753 - DNA, 21 bp, Homo sapiens
ggccgcagctcttgcccttcc

SEQ ID NO: 1273754 - DNA, 12 bp, Homo sapiens
ggccgcaggagg

SEQ ID NO: 1273755 - DNA, 20 bp, Homo sapiens
ggccgcagggcccaccttgg

SEQ ID NO: 1273756 - DNA, 21 bp, Homo sapiens
ggccgcagggcccaccttgga

SEQ ID NO: 1273757 - DNA, 17 bp, Homo sapiens
ggccgcattccctgagt

SEQ ID NO: 1273758 - DNA, 16 bp, Homo sapiens
ggccgccagcgtgtgg

SEQ ID NO: 1273759 - DNA, 17 bp, Homo sapiens
ggccgccagcgtgtgga

SEQ ID NO: 1273760 - DNA, 23 bp, Homo sapiens
ggccgccagcgtgtggagcagag

SEQ ID NO: 1273761 - DNA, 13 bp, Homo sapiens
ggccgccatctgc

SEQ ID NO: 1273762 - DNA, 20 bp, Homo sapiens
ggccgccatctgcgcagggt

SEQ ID NO: 1273763 - DNA, 22 bp, Homo sapiens
ggccgcccacccgcccgaggga

SEQ ID NO: 1273764 - DNA, 22 bp, Homo sapiens
ggccgccccctgccccccagcc

SEQ ID NO: 1273765 - DNA, 16 bp, Homo sapiens
ggccgcccctgaggct

SEQ ID NO: 1273766 - DNA, 16 bp, Homo sapiens
ggccgcccctggccac

SEQ ID NO: 1273767 - DNA, 15 bp, Homo sapiens
ggccgcctgccctgc

SEQ ID NO: 1273768 - DNA, 17 bp, Homo sapiens
ggccgccttctcccctc

SEQ ID NO: 1273769 - DNA, 19 bp, Homo sapiens
ggccgcggccctggggcgg

SEQ ID NO: 1273770 - DNA, 18 bp, Homo sapiens
ggccgcggcctccccgag

SEQ ID NO: 1273771 - DNA, 13 bp, Homo sapiens
ggccgctagaggc

SEQ ID NO: 1273772 - DNA, 14 bp, Homo sapiens
ggccgctagaggcc

SEQ ID NO: 1273773 - DNA, 17 bp, Homo sapiens
ggccgctagaggcctga

SEQ ID NO: 1273774 - DNA, 17 bp, Homo sapiens
ggccgctcctccctgct

SEQ ID NO: 1273775 - DNA, 22 bp, Homo sapiens
ggccgctcctccctgctcctca

SEQ ID NO: 1273776 - DNA, 14 bp, Homo sapiens
ggccgctgagcgcc

SEQ ID NO: 1273777 - DNA, 17 bp, Homo sapiens
ggccgctgagtggcagg

SEQ ID NO: 1273778 - DNA, 12 bp, Homo sapiens
ggccgctgccac

SEQ ID NO: 1273779 - DNA, 15 bp, Homo sapiens
ggccgctgccaccca

SEQ ID NO: 1273780 - DNA, 21 bp, Homo sapiens
ggccgctgccacccacctccc

SEQ ID NO: 1273781 - DNA, 22 bp, Homo sapiens
ggccgctggctggtgggccccc

SEQ ID NO: 1273782 - DNA, 16 bp, Homo sapiens
ggccgctgttcaccca

SEQ ID NO: 1273783 - DNA, 17 bp, Homo sapiens
ggccgcttctagagcct

SEQ ID NO: 1273784 - DNA, 17 bp, Homo sapiens
ggccggcggctctgagc

SEQ ID NO: 1273785 - DNA, 13 bp, Homo sapiens
ggccgggaagagc

SEQ ID NO: 1273786 - DNA, 15 bp, Homo sapiens
ggccgggagcctgat

SEQ ID NO: 1273787 - DNA, 19 bp, Homo sapiens
ggccgggcaggtcctgccc

SEQ ID NO: 1273788 - DNA, 14 bp, Homo sapiens
ggccgggcctgggg

SEQ ID NO: 1273789 - DNA, 21 bp, Homo sapiens
ggccggggggggtaggagagg

SEQ ID NO: 1273790 - DNA, 14 bp, Homo sapiens
ggccggggtccagg

SEQ ID NO: 1273791 - DNA, 19 bp, Homo sapiens
ggccgggtcaccctgtgac

SEQ ID NO: 1273792 - DNA, 14 bp, Homo sapiens
ggccggtgagggga

SEQ ID NO: 1273793 - DNA, 19 bp, Homo sapiens
ggccggtgaggggaggggc

SEQ ID NO: 1273794 - DNA, 12 bp, Homo sapiens
ggccggtgctgg

SEQ ID NO: 1273795 - DNA, 15 bp, Homo sapiens
ggccggtgtgggctg

SEQ ID NO: 1273796 - DNA, 14 bp, Homo sapiens
ggcggcagcagcca

SEQ ID NO: 1273797 - DNA, 16 bp, Homo sapiens
ggcggcagcagccatc

SEQ ID NO: 1273798 - DNA, 15 bp, Homo sapiens
ggcggcagccccact

SEQ ID NO: 1273799 - DNA, 21 bp, Homo sapiens
ggcggccagggacccaaagca

SEQ ID NO: 1273800 - DNA, 17 bp, Homo sapiens
ggcggccagggcggcca

SEQ ID NO: 1273801 - DNA, 18 bp, Homo sapiens
ggcggccagggcggccag

SEQ ID NO: 1273802 - DNA, 18 bp, Homo sapiens
ggcggccccaactcgggc

SEQ ID NO: 1273803 - DNA, 14 bp, Homo sapiens
ggcggccctgggga

SEQ ID NO: 1273804 - DNA, 17 bp, Homo sapiens
ggcggccctggggaggg

SEQ ID NO: 1273805 - DNA, 23 bp, Homo sapiens
ggcggccctggggaggggtggtg

SEQ ID NO: 1273806 - DNA, 18 bp, Homo sapiens
ggcggcctgcagtggtgt

SEQ ID NO: 1273807 - DNA, 14 bp, Homo sapiens
ggcggcgcagaggg

SEQ ID NO: 1273808 - DNA, 16 bp, Homo sapiens
ggcggcgcagagggaa

SEQ ID NO: 1273809 - DNA, 11 bp, Homo sapiens
ggcggcgccgg

SEQ ID NO: 1273810 - DNA, 21 bp, Homo sapiens
ggcggctactcagcagccctc

SEQ ID NO: 1273811 - DNA, 22 bp, Homo sapiens
ggcggctactcagcagccctcc

SEQ ID NO: 1273812 - DNA, 23 bp, Homo sapiens
ggcggctactcagcagccctcct

SEQ ID NO: 1273813 - DNA, 14 bp, Homo sapiens
ggcggctactctgg

SEQ ID NO: 1273814 - DNA, 13 bp, Homo sapiens
ggcggctcctcct

SEQ ID NO: 1273815 - DNA, 18 bp, Homo sapiens
ggcggctcggaggaagcc

SEQ ID NO: 1273816 - DNA, 14 bp, Homo sapiens
ggcggctgagagcc

SEQ ID NO: 1273817 - DNA, 21 bp, Homo sapiens
ggcggctgcacaacagccctg

SEQ ID NO: 1273818 - DNA, 17 bp, Homo sapiens
ggcggctgccgactccc

SEQ ID NO: 1273819 - DNA, 13 bp, Homo sapiens
ggcgggatgggct

SEQ ID NO: 1273820 - DNA, 17 bp, Homo sapiens
ggcgggcagccaggctg

SEQ ID NO: 1273821 - DNA, 12 bp, Homo sapiens
ggcgggccagcc

SEQ ID NO: 1273822 - DNA, 15 bp, Homo sapiens
ggcgggccagccagg

SEQ ID NO: 1273823 - DNA, 22 bp, Homo sapiens
ggcggggaggaggaacgggcag

SEQ ID NO: 1273824 - DNA, 15 bp, Homo sapiens
ggcgggtgacgccca

SEQ ID NO: 1273825 - DNA, 20 bp, Homo sapiens
ggcgggtgatggccagcccc

SEQ ID NO: 1273826 - DNA, 18 bp, Homo sapiens
ggcggtcatgtgtgcatg

SEQ ID NO: 1273827 - DNA, 16 bp, Homo sapiens
ggcggtccccatcccc

SEQ ID NO: 1273828 - DNA, 21 bp, Homo sapiens
ggcggtccccatccccaccag

SEQ ID NO: 1273829 - DNA, 14 bp, Homo sapiens
ggcggtggccacag

SEQ ID NO: 1273830 - DNA, 22 bp, Homo sapiens
ggcggtgggcacccaccctggg

SEQ ID NO: 1273831 - DNA, 16 bp, Homo sapiens
ggcggtgtcaggtccc

SEQ ID NO: 1273832 - DNA, 19 bp, Homo sapiens
ggcggtgtcaggtcccagc

SEQ ID NO: 1273833 - DNA, 16 bp, Homo sapiens
ggcgtaatgggcctgc

SEQ ID NO: 1273834 - DNA, 17 bp, Homo sapiens
ggcgtaatgggcctgcc

SEQ ID NO: 1273835 - DNA, 19 bp, Homo sapiens
ggcgtaatgggcctgccca

SEQ ID NO: 1273836 - DNA, 23 bp, Homo sapiens
ggcgtcaccatccaccttccctt

SEQ ID NO: 1273837 - DNA, 17 bp, Homo sapiens
ggcgtcaggcagaggca

SEQ ID NO: 1273838 - DNA, 16 bp, Homo sapiens
ggcgtcaggggtgcac

SEQ ID NO: 1273839 - DNA, 19 bp, Homo sapiens
ggcgtcaggggtgcacagt

SEQ ID NO: 1273840 - DNA, 14 bp, Homo sapiens
ggcgtccagctcag

SEQ ID NO: 1273841 - DNA, 20 bp, Homo sapiens
ggcgtccagctcagccctgg

SEQ ID NO: 1273842 - DNA, 16 bp, Homo sapiens
ggcgtcggccagaggg

SEQ ID NO: 1273843 - DNA, 13 bp, Homo sapiens
ggcgtctccccca

SEQ ID NO: 1273844 - DNA, 15 bp, Homo sapiens
ggcgtctcccccaga

SEQ ID NO: 1273845 - DNA, 21 bp, Homo sapiens
ggcgtctcccccagagtgctg

SEQ ID NO: 1273846 - DNA, 16 bp, Homo sapiens
ggcgtctgactccctc

SEQ ID NO: 1273847 - DNA, 15 bp, Homo sapiens
ggcgtctgctctggt

SEQ ID NO: 1273848 - DNA, 15 bp, Homo sapiens
ggcgtctgtcttcaa

SEQ ID NO: 1273849 - DNA, 18 bp, Homo sapiens
ggcgtcttcatctccctg

SEQ ID NO: 1273850 - DNA, 15 bp, Homo sapiens
ggcgtcttgcccagc

SEQ ID NO: 1273851 - DNA, 15 bp, Homo sapiens
ggcgtgaacccagga

SEQ ID NO: 1273852 - DNA, 14 bp, Homo sapiens
ggcgtgacccgtcc

SEQ ID NO: 1273853 - DNA, 19 bp, Homo sapiens
ggcgtgagccactgttccc

SEQ ID NO: 1273854 - DNA, 14 bp, Homo sapiens
ggcgtgctcagacc

SEQ ID NO: 1273855 - DNA, 20 bp, Homo sapiens
ggcgtggagagcccggcgcc

SEQ ID NO: 1273856 - DNA, 16 bp, Homo sapiens
ggcgtggagccaggga

SEQ ID NO: 1273857 - DNA, 17 bp, Homo sapiens
ggcgtggcccgtggcct

SEQ ID NO: 1273858 - DNA, 13 bp, Homo sapiens
ggcgtggcctccc

SEQ ID NO: 1273859 - DNA, 21 bp, Homo sapiens
ggcgtgggggcactgaccagg

SEQ ID NO: 1273860 - DNA, 18 bp, Homo sapiens
ggcgtgggtctctgggga

SEQ ID NO: 1273861 - DNA, 19 bp, Homo sapiens
ggcgtgggtctctggggac

SEQ ID NO: 1273862 - DNA, 14 bp, Homo sapiens
ggcgtgtgcatagc

SEQ ID NO: 1273863 - DNA, 20 bp, Homo sapiens
ggcgtgtgcatagcgtcctg

SEQ ID NO: 1273864 - DNA, 13 bp, Homo sapiens
ggcgtgtggcagc

SEQ ID NO: 1273865 - DNA, 16 bp, Homo sapiens
ggcgtgtggtttccct

SEQ ID NO: 1273866 - DNA, 17 bp, Homo sapiens
ggcgtgtggtttccctg

SEQ ID NO: 1273867 - DNA, 19 bp, Homo sapiens
ggcgttatggcagcccggc

SEQ ID NO: 1273868 - DNA, 16 bp, Homo sapiens
ggcgttggatttaaaa

SEQ ID NO: 1273869 - DNA, 15 bp, Homo sapiens
ggcgttggtgccact

SEQ ID NO: 1273870 - DNA, 21 bp, Homo sapiens
ggctaaacatccaatattttc

SEQ ID NO: 1273871 - DNA, 21 bp, Homo sapiens
ggctaaaggggagaaactgaa

SEQ ID NO: 1273872 - DNA, 11 bp, Homo sapiens
ggctaaatgaa

SEQ ID NO: 1273873 - DNA, 19 bp, Homo sapiens
ggctaagagctagcgctgc

SEQ ID NO: 1273874 - DNA, 23 bp, Homo sapiens
ggctaagttgggatctaggagag

SEQ ID NO: 1273875 - DNA, 18 bp, Homo sapiens
ggctaataaactgtatta

SEQ ID NO: 1273876 - DNA, 19 bp, Homo sapiens
ggctaataaactgtattaa

SEQ ID NO: 1273877 - DNA, 14 bp, Homo sapiens
ggctaatgtttgta

SEQ ID NO: 1273878 - DNA, 23 bp, Homo sapiens
ggctaattcccagagtgtgaaac

SEQ ID NO: 1273879 - DNA, 23 bp, Homo sapiens
ggctacaattttctcccaggaag

SEQ ID NO: 1273880 - DNA, 17 bp, Homo sapiens
ggctacacagacccctc

SEQ ID NO: 1273881 - DNA, 19 bp, Homo sapiens
ggctacatcccagcctgtg

SEQ ID NO: 1273882 - DNA, 23 bp, Homo sapiens
ggctacccctcgactcagcacca

SEQ ID NO: 1273883 - DNA, 14 bp, Homo sapiens
ggctacctttgtat

SEQ ID NO: 1273884 - DNA, 13 bp, Homo sapiens
ggctacgcctctt

SEQ ID NO: 1273885 - DNA, 18 bp, Homo sapiens
ggctacgttagcagccca

SEQ ID NO: 1273886 - DNA, 17 bp, Homo sapiens
ggctactgccactgtgt

SEQ ID NO: 1273887 - DNA, 13 bp, Homo sapiens
ggctactggcagc

SEQ ID NO: 1273888 - DNA, 17 bp, Homo sapiens
ggctactggcagctcct

SEQ ID NO: 1273889 - DNA, 22 bp, Homo sapiens
ggctagaggttcaaagatattt

SEQ ID NO: 1273890 - DNA, 19 bp, Homo sapiens
ggctagccctgagcccggc

SEQ ID NO: 1273891 - DNA, 20 bp, Homo sapiens
ggctagcttctgcttttctg

SEQ ID NO: 1273892 - DNA, 22 bp, Homo sapiens
ggctagcttctgcttttctgcc

SEQ ID NO: 1273893 - DNA, 22 bp, Homo sapiens
ggctagggagacgccatgtgat

SEQ ID NO: 1273894 - DNA, 16 bp, Homo sapiens
ggctagtcaagctcct

SEQ ID NO: 1273895 - DNA, 23 bp, Homo sapiens
ggctagtcaagctcctcctccct

SEQ ID NO: 1273896 - DNA, 18 bp, Homo sapiens
ggctagtgtgagtggcag

SEQ ID NO: 1273897 - DNA, 20 bp, Homo sapiens
ggctagtgtgagtggcagcc

SEQ ID NO: 1273898 - DNA, 19 bp, Homo sapiens
ggctatagctacaggaagc

SEQ ID NO: 1273899 - DNA, 13 bp, Homo sapiens
ggctatcctgatt

SEQ ID NO: 1273900 - DNA, 23 bp, Homo sapiens
ggctatctactaccagaagggct

SEQ ID NO: 1273901 - DNA, 18 bp, Homo sapiens
ggctatgaaaatgagccc

SEQ ID NO: 1273902 - DNA, 19 bp, Homo sapiens
ggctatgaaaatgagccct

SEQ ID NO: 1273903 - DNA, 15 bp, Homo sapiens
ggctatgcatttgaa

SEQ ID NO: 1273904 - DNA, 17 bp, Homo sapiens
ggctatggacacagggt

SEQ ID NO: 1273905 - DNA, 17 bp, Homo sapiens
ggctatggagggtcctc

SEQ ID NO: 1273906 - DNA, 18 bp, Homo sapiens
ggctatggcaagggggtg

SEQ ID NO: 1273907 - DNA, 16 bp, Homo sapiens
ggctatttgtaaatct

SEQ ID NO: 1273908 - DNA, 16 bp, Homo sapiens
ggctatttgtgtgtat

SEQ ID NO: 1273909 - DNA, 15 bp, Homo sapiens
ggctatttgttcaga

SEQ ID NO: 1273910 - DNA, 16 bp, Homo sapiens
ggctatttgttcagag

SEQ ID NO: 1273911 - DNA, 18 bp, Homo sapiens
ggctatttgttcagagag

SEQ ID NO: 1273912 - DNA, 13 bp, Homo sapiens
ggctcaagaataa

SEQ ID NO: 1273913 - DNA, 21 bp, Homo sapiens
ggctcaagacaaggctggcaa

SEQ ID NO: 1273914 - DNA, 21 bp, Homo sapiens
ggctcaagcaatcctcctgcc

SEQ ID NO: 1273915 - DNA, 16 bp, Homo sapiens
ggctcaagtagaaaag

SEQ ID NO: 1273916 - DNA, 21 bp, Homo sapiens
ggctcacacatccccagccag

SEQ ID NO: 1273917 - DNA, 13 bp, Homo sapiens
ggctcacagggca

SEQ ID NO: 1273918 - DNA, 12 bp, Homo sapiens
ggctgagggcct

SEQ ID NO: 1273919 - DNA, 19 bp, Homo sapiens
ggctgaggggcaacgaaga

SEQ ID NO: 1273920 - DNA, 16 bp, Homo sapiens
ggctgaggttcctctg

SEQ ID NO: 1273921 - DNA, 21 bp, Homo sapiens
ggctgaggttcctctgcctgc

SEQ ID NO: 1273922 - DNA, 22 bp, Homo sapiens
ggctgaggttcctctgcctgcc

SEQ ID NO: 1273923 - DNA, 22 bp, Homo sapiens
ggctgagtcatgatctccctgc

SEQ ID NO: 1273924 - DNA, 23 bp, Homo sapiens
ggctgagtcatgatctccctgcc

SEQ ID NO: 1273925 - DNA, 14 bp, Homo sapiens
ggctgagtgcagcc

SEQ ID NO: 1273926 - DNA, 17 bp, Homo sapiens
ggctgagtgcagccaaa

SEQ ID NO: 1273927 - DNA, 19 bp, Homo sapiens
ggctgagtggaatgcaggg

SEQ ID NO: 1273928 - DNA, 15 bp, Homo sapiens
ggctgataattttaa

SEQ ID NO: 1273929 - DNA, 19 bp, Homo sapiens
ggctgatcattaattagaa

SEQ ID NO: 1273930 - DNA, 18 bp, Homo sapiens
ggctgatggaagatggtc

SEQ ID NO: 1273931 - DNA, 18 bp, Homo sapiens
ggctgatggaggaaaaag

SEQ ID NO: 1273932 - DNA, 22 bp, Homo sapiens
ggctgatgtcaatttctgtgtt

SEQ ID NO: 1273933 - DNA, 22 bp, Homo sapiens
ggctgcaaggtttaggctggtg

SEQ ID NO: 1273934 - DNA, 18 bp, Homo sapiens
ggctgcacaacagccctg

SEQ ID NO: 1273935 - DNA, 22 bp, Homo sapiens
ggctgcacaacagccctgcctg

SEQ ID NO: 1273936 - DNA, 23 bp, Homo sapiens
ggctgcacaacagccctgcctga

SEQ ID NO: 1273937 - DNA, 14 bp, Homo sapiens
ggctgcacaggctg

SEQ ID NO: 1273938 - DNA, 22 bp, Homo sapiens
ggctgcacattgcctgttctgc

SEQ ID NO: 1273939 - DNA, 22 bp, Homo sapiens
ggctgcacctcctaccctccca

SEQ ID NO: 1273940 - DNA, 20 bp, Homo sapiens
ggctgcacgggatgcgtggg

SEQ ID NO: 1273941 - DNA, 15 bp, Homo sapiens
ggctgcactggagcc

SEQ ID NO: 1273942 - DNA, 20 bp, Homo sapiens
ggctgcactggagccacagg

SEQ ID NO: 1273943 - DNA, 18 bp, Homo sapiens
ggctgcagaggccagagg

SEQ ID NO: 1273944 - DNA, 21 bp, Homo sapiens
ggctgcagcaggtgctgggct

SEQ ID NO: 1273945 - DNA, 21 bp, Homo sapiens
ggctgcagcatgttgctgagg

SEQ ID NO: 1273946 - DNA, 15 bp, Homo sapiens
ggctgcagctggaca

SEQ ID NO: 1273947 - DNA, 18 bp, Homo sapiens
ggctgcaggagggcactg

SEQ ID NO: 1273948 - DNA, 16 bp, Homo sapiens
ggctgcatgatgtttg

SEQ ID NO: 1273949 - DNA, 14 bp, Homo sapiens
ggctgcatgctctg

SEQ ID NO: 1273950 - DNA, 18 bp, Homo sapiens
ggctgcatgctctggaag

SEQ ID NO: 1273951 - DNA, 20 bp, Homo sapiens
ggctgcatgctctggaagcc

SEQ ID NO: 1273952 - DNA, 12 bp, Homo sapiens
ggctgccagcct

SEQ ID NO: 1273953 - DNA, 10 bp, Homo sapiens
ggctgccagg

SEQ ID NO: 1273954 - DNA, 23 bp, Homo sapiens
ggctgccaggcgttggtgccact

SEQ ID NO: 1273955 - DNA, 18 bp, Homo sapiens
ggctgccatgtgaagagg

SEQ ID NO: 1273956 - DNA, 19 bp, Homo sapiens
ggctgcccacgctcctgcc

SEQ ID NO: 1273957 - DNA, 21 bp, Homo sapiens
ggctgcccagctgctcccctg

SEQ ID NO: 1273958 - DNA, 14 bp, Homo sapiens
ggctgcccaggaga

SEQ ID NO: 1273959 - DNA, 19 bp, Homo sapiens
ggctgccccaacctgctga

SEQ ID NO: 1273960 - DNA, 20 bp, Homo sapiens
ggctgccccaggccggagcc

SEQ ID NO: 1273961 - DNA, 16 bp, Homo sapiens
ggctgcccctcgcaca

SEQ ID NO: 1273962 - DNA, 15 bp, Homo sapiens
ggctgcccctctcac

SEQ ID NO: 1273963 - DNA, 13 bp, Homo sapiens
ggctgccctgaga

SEQ ID NO: 1273964 - DNA, 14 bp, Homo sapiens
ggctgccctgagaa

SEQ ID NO: 1273965 - DNA, 24 bp, Homo sapiens
ggctgccctgagaagctgctccag

SEQ ID NO: 1273966 - DNA, 17 bp, Homo sapiens
ggctgccctggccctga

SEQ ID NO: 1273967 - DNA, 20 bp, Homo sapiens
ggctgccctggccctgaggt

SEQ ID NO: 1273968 - DNA, 12 bp, Homo sapiens
ggctgccctggt

SEQ ID NO: 1273969 - DNA, 13 bp, Homo sapiens
ggctgccctggtg

SEQ ID NO: 1273970 - DNA, 15 bp, Homo sapiens
ggctgccctggtgct

SEQ ID NO: 1273971 - DNA, 20 bp, Homo sapiens
ggctgccgactcccccaacc

SEQ ID NO: 1273972 - DNA, 15 bp, Homo sapiens
ggctgccgagccacc

SEQ ID NO: 1273973 - DNA, 18 bp, Homo sapiens
ggctgccgagccaccatg

SEQ ID NO: 1273974 - DNA, 19 bp, Homo sapiens
ggctgccggatctgggctg

SEQ ID NO: 1273975 - DNA, 21 bp, Homo sapiens
ggctgccgggttctagtctcc

SEQ ID NO: 1273976 - DNA, 14 bp, Homo sapiens
ggctgcctgcccct

SEQ ID NO: 1273977 - DNA, 16 bp, Homo sapiens
ggctgcctgcccctgc

SEQ ID NO: 1273978 - DNA, 21 bp, Homo sapiens
ggctgcctgcccctgctgctt

SEQ ID NO: 1273979 - DNA, 12 bp, Homo sapiens
ggctgcctgccg

SEQ ID NO: 1273980 - DNA, 14 bp, Homo sapiens
ggctgcctgggctg

SEQ ID NO: 1273981 - DNA, 15 bp, Homo sapiens
ggctgcctgggctgt

SEQ ID NO: 1273982 - DNA, 17 bp, Homo sapiens
ggctgcctgggctgttg

SEQ ID NO: 1273983 - DNA, 19 bp, Homo sapiens
ggctgcctggtggttgatg

SEQ ID NO: 1273984 - DNA, 14 bp, Homo sapiens
ggctgccttgctgt

SEQ ID NO: 1273985 - DNA, 17 bp, Homo sapiens
ggctgcctttgtggtgg

SEQ ID NO: 1273986 - DNA, 21 bp, Homo sapiens
ggctgcctttgtggtgggcgc

SEQ ID NO: 1273987 - DNA, 16 bp, Homo sapiens
ggctgcgcccccagct

SEQ ID NO: 1273988 - DNA, 15 bp, Homo sapiens
ggctgcgctaacccc

SEQ ID NO: 1273989 - DNA, 14 bp, Homo sapiens
ggctgcggccccct

SEQ ID NO: 1273990 - DNA, 23 bp, Homo sapiens
ggctgcgtactccactggtctgt

SEQ ID NO: 1273991 - DNA, 15 bp, Homo sapiens
ggctgctacccagaa

SEQ ID NO: 1273992 - DNA, 13 bp, Homo sapiens
ggctgctaggcca

SEQ ID NO: 1273993 - DNA, 12 bp, Homo sapiens
ggctgctcctcc

SEQ ID NO: 1273994 - DNA, 13 bp, Homo sapiens
ggctgctcctcca

SEQ ID NO: 1273995 - DNA, 14 bp, Homo sapiens
ggctgctcctccag

SEQ ID NO: 1273996 - DNA, 18 bp, Homo sapiens
ggctgctcctccagccct

SEQ ID NO: 1273997 - DNA, 19 bp, Homo sapiens
ggctgctcctccagccctt

SEQ ID NO: 1273998 - DNA, 23 bp, Homo sapiens
ggctgctcctccagggccacgtg

SEQ ID NO: 1273999 - DNA, 14 bp, Homo sapiens
ggctgctgcagtga

SEQ ID NO: 1274000 - DNA, 15 bp, Homo sapiens
ggctgctgctacaat

SEQ ID NO: 1274001 - DNA, 20 bp, Homo sapiens
ggctgctgcttctgctccag

SEQ ID NO: 1274002 - DNA, 22 bp, Homo sapiens
ggctgctgcttggatgcgagct

SEQ ID NO: 1274003 - DNA, 13 bp, Homo sapiens
ggctgctggccat

SEQ ID NO: 1274004 - DNA, 19 bp, Homo sapiens
ggctgctggcttcagggag

SEQ ID NO: 1274005 - DNA, 16 bp, Homo sapiens
ggctgctggggcatgt

SEQ ID NO: 1274006 - DNA, 20 bp, Homo sapiens
ggctgctgtgatgccgtcct

SEQ ID NO: 1274007 - DNA, 20 bp, Homo sapiens
ggctgcttaggaaacctcac

SEQ ID NO: 1274008 - DNA, 16 bp, Homo sapiens
ggctgcttcccagagg

SEQ ID NO: 1274009 - DNA, 16 bp, Homo sapiens
ggctgcttgcagccag

SEQ ID NO: 1274010 - DNA, 18 bp, Homo sapiens
ggctgcttgcagccagga

SEQ ID NO: 1274011 - DNA, 19 bp, Homo sapiens
ggctgcttgcagccaggag

SEQ ID NO: 1274012 - DNA, 23 bp, Homo sapiens
ggctgcttgcagccaggagaagg

SEQ ID NO: 1274013 - DNA, 15 bp, Homo sapiens
ggctgcttgcttttg

SEQ ID NO: 1274014 - DNA, 18 bp, Homo sapiens
ggctgcttgcttttgcct

SEQ ID NO: 1274015 - DNA, 22 bp, Homo sapiens
ggctgcttttcttaagtgccca

SEQ ID NO: 1274016 - DNA, 22 bp, Homo sapiens
ggctggaagatcctgcgggtgg

SEQ ID NO: 1274017 - DNA, 16 bp, Homo sapiens
ggctggaaggggtcca

SEQ ID NO: 1274018 - DNA, 14 bp, Homo sapiens
ggctggaattaaaa

SEQ ID NO: 1274019 - DNA, 16 bp, Homo sapiens
ggctggaatttctgct

SEQ ID NO: 1274020 - DNA, 14 bp, Homo sapiens
ggctggactggcca

SEQ ID NO: 1274021 - DNA, 15 bp, Homo sapiens
ggctggactggccat

SEQ ID NO: 1274022 - DNA, 20 bp, Homo sapiens
ggctggacttctacctgccc

SEQ ID NO: 1274023 - DNA, 15 bp, Homo sapiens
ggctggagagctgct

SEQ ID NO: 1274024 - DNA, 23 bp, Homo sapiens
ggctggaggcagggccttgccca

SEQ ID NO: 1274025 - DNA, 14 bp, Homo sapiens
ggctggaggcccag

SEQ ID NO: 1274026 - DNA, 15 bp, Homo sapiens
ggctggaggcccagg

SEQ ID NO: 1274027 - DNA, 16 bp, Homo sapiens
ggctggagtcctctcc

SEQ ID NO: 1274028 - DNA, 17 bp, Homo sapiens
ggctggagtcctctcca

SEQ ID NO: 1274029 - DNA, 20 bp, Homo sapiens
ggctggagtgcagtggcgca

SEQ ID NO: 1274030 - DNA, 19 bp, Homo sapiens
ggctggagtgcagtggcgt

SEQ ID NO: 1274031 - DNA, 20 bp, Homo sapiens
ggctggagtgcagtggtgca

SEQ ID NO: 1274032 - DNA, 16 bp, Homo sapiens
ggctggagtgcgctct

SEQ ID NO: 1274033 - DNA, 15 bp, Homo sapiens
ggctggatgaaattt

SEQ ID NO: 1274034 - DNA, 19 bp, Homo sapiens
ggctggatggacagacacc

SEQ ID NO: 1274035 - DNA, 16 bp, Homo sapiens
ggctggcaagcaggga

SEQ ID NO: 1274036 - DNA, 14 bp, Homo sapiens
ggctggcacaggac

SEQ ID NO: 1274037 - DNA, 18 bp, Homo sapiens
ggctggcacgtgacaggc

SEQ ID NO: 1274038 - DNA, 22 bp, Homo sapiens
ggctggccagcaaggcaggttg

SEQ ID NO: 1274039 - DNA, 16 bp, Homo sapiens
ggctggccctgtgcag

SEQ ID NO: 1274040 - DNA, 16 bp, Homo sapiens
gggacaaagaggcctt

SEQ ID NO: 1274041 - DNA, 22 bp, Homo sapiens
gggacaaagaggcctttaacca

SEQ ID NO: 1274042 - DNA, 16 bp, Homo sapiens
gggacaagcagtccct

SEQ ID NO: 1274043 - DNA, 13 bp, Homo sapiens
gggacaagggatt

SEQ ID NO: 1274044 - DNA, 16 bp, Homo sapiens
gggacaatggcaatag

SEQ ID NO: 1274045 - DNA, 20 bp, Homo sapiens
gggacacaaaactccgcccc

SEQ ID NO: 1274046 - DNA, 22 bp, Homo sapiens
gggacacaacacagataatttt

SEQ ID NO: 1274047 - DNA, 11 bp, Homo sapiens
gggacacacac

SEQ ID NO: 1274048 - DNA, 16 bp, Homo sapiens
gggacacatgcccctc

SEQ ID NO: 1274049 - DNA, 21 bp, Homo sapiens
gggacacatgcccctccccca

SEQ ID NO: 1274050 - DNA, 17 bp, Homo sapiens
gggacaccagggaagaa

SEQ ID NO: 1274051 - DNA, 16 bp, Homo sapiens
gggacacttccctggg

SEQ ID NO: 1274052 - DNA, 11 bp, Homo sapiens
gggacagagaa

SEQ ID NO: 1274053 - DNA, 16 bp, Homo sapiens
gggacagagccacccc

SEQ ID NO: 1274054 - DNA, 23 bp, Homo sapiens
gggacagaggccctgccacgtcc

SEQ ID NO: 1274055 - DNA, 15 bp, Homo sapiens
gggacagagtctggg

SEQ ID NO: 1274056 - DNA, 22 bp, Homo sapiens
gggacagcatgccccttggctg

SEQ ID NO: 1274057 - DNA, 16 bp, Homo sapiens
gggacagcccagagcc

SEQ ID NO: 1274058 - DNA, 21 bp, Homo sapiens
gggacagcccagagcctggct

SEQ ID NO: 1274059 - DNA, 11 bp, Homo sapiens
gggacagctgt

SEQ ID NO: 1274060 - DNA, 14 bp, Homo sapiens
gggacagcttcctc

SEQ ID NO: 1274061 - DNA, 15 bp, Homo sapiens
gggacaggaccccag

SEQ ID NO: 1274062 - DNA, 17 bp, Homo sapiens
gggacaggaccccagct

SEQ ID NO: 1274063 - DNA, 12 bp, Homo sapiens
gggacaggcctc

SEQ ID NO: 1274064 - DNA, 13 bp, Homo sapiens
gggacagggaggg

SEQ ID NO: 1274065 - DNA, 14 bp, Homo sapiens
gggacagggagggg

SEQ ID NO: 1274066 - DNA, 16 bp, Homo sapiens
gggacaggtgggcctg

SEQ ID NO: 1274067 - DNA, 18 bp, Homo sapiens
gggacaggtgggcctggc

SEQ ID NO: 1274068 - DNA, 19 bp, Homo sapiens
gggacagttggcagagaag

SEQ ID NO: 1274069 - DNA, 19 bp, Homo sapiens
gggacatcaggagactggg

SEQ ID NO: 1274070 - DNA, 16 bp, Homo sapiens
gggacatggggcaagc

SEQ ID NO: 1274071 - DNA, 18 bp, Homo sapiens
gggacatggggcaagcca

SEQ ID NO: 1274072 - DNA, 19 bp, Homo sapiens
gggacatggggcaagccag

SEQ ID NO: 1274073 - DNA, 17 bp, Homo sapiens
gggacattgctctctgg

SEQ ID NO: 1274074 - DNA, 16 bp, Homo sapiens
gggaccaaagggggag

SEQ ID NO: 1274075 - DNA, 18 bp, Homo sapiens
gggaccaaaggtcaggga

SEQ ID NO: 1274076 - DNA, 19 bp, Homo sapiens
gggaccaaattgcttctag

SEQ ID NO: 1274077 - DNA, 17 bp, Homo sapiens
gggaccaaggcaaggca

SEQ ID NO: 1274078 - DNA, 12 bp, Homo sapiens
gggaccacatct

SEQ ID NO: 1274079 - DNA, 19 bp, Homo sapiens
gggaccacatctgtcctca

SEQ ID NO: 1274080 - DNA, 19 bp, Homo sapiens
gggaccaccctgagccggc

SEQ ID NO: 1274081 - DNA, 13 bp, Homo sapiens
gggaccatgtgtc

SEQ ID NO: 1274082 - DNA, 19 bp, Homo sapiens
gggacccaaagcaggatga

SEQ ID NO: 1274083 - DNA, 17 bp, Homo sapiens
gggacccacccagcccc

SEQ ID NO: 1274084 - DNA, 20 bp, Homo sapiens
gggacccacccagcccctct

SEQ ID NO: 1274085 - DNA, 20 bp, Homo sapiens
gggacccagagtcccaggcc

SEQ ID NO: 1274086 - DNA, 15 bp, Homo sapiens
gggacccagctcctc

SEQ ID NO: 1274087 - DNA, 16 bp, Homo sapiens
gggacccatgggggct

SEQ ID NO: 1274088 - DNA, 14 bp, Homo sapiens
gggacccctcccaa

SEQ ID NO: 1274089 - DNA, 19 bp, Homo sapiens
gggacccctcgcaaccctg

SEQ ID NO: 1274090 - DNA, 21 bp, Homo sapiens
gggacccctcgcaaccctgcc

SEQ ID NO: 1274091 - DNA, 14 bp, Homo sapiens
gggacccctgagct

SEQ ID NO: 1274092 - DNA, 15 bp, Homo sapiens
gggaccctgccgagg

SEQ ID NO: 1274093 - DNA, 23 bp, Homo sapiens
gggaccctgtgacatggtgcctg

SEQ ID NO: 1274094 - DNA, 13 bp, Homo sapiens
gggaccgcctggc

SEQ ID NO: 1274095 - DNA, 18 bp, Homo sapiens
gggaccgcctggccctcc

SEQ ID NO: 1274096 - DNA, 22 bp, Homo sapiens
gggaccgcctggccctccctcc

SEQ ID NO: 1274097 - DNA, 18 bp, Homo sapiens
gggaccggtacagaaagg

SEQ ID NO: 1274098 - DNA, 18 bp, Homo sapiens
gggaccgtgcgagctgcc

SEQ ID NO: 1274099 - DNA, 14 bp, Homo sapiens
gggacctcctccct

SEQ ID NO: 1274100 - DNA, 16 bp, Homo sapiens
gggacctcctccctca

SEQ ID NO: 1274101 - DNA, 16 bp, Homo sapiens
gggacctctcccaggg

SEQ ID NO: 1274102 - DNA, 17 bp, Homo sapiens
gggacctgccaggcagg

SEQ ID NO: 1274103 - DNA, 21 bp, Homo sapiens
gggacctggtaccctcctggc

SEQ ID NO: 1274104 - DNA, 15 bp, Homo sapiens
gggacgcggaggagg

SEQ ID NO: 1274105 - DNA, 21 bp, Homo sapiens
gggacgcggaggaggaagagg

SEQ ID NO: 1274106 - DNA, 22 bp, Homo sapiens
gggacgcttttgagtgggccct

SEQ ID NO: 1274107 - DNA, 23 bp, Homo sapiens
gggacgcttttgagtgggccctg

SEQ ID NO: 1274108 - DNA, 17 bp, Homo sapiens
gggacggaccagcatct

SEQ ID NO: 1274109 - DNA, 13 bp, Homo sapiens
gggacggggctga

SEQ ID NO: 1274110 - DNA, 16 bp, Homo sapiens
gggacgtccctgccca

SEQ ID NO: 1274111 - DNA, 20 bp, Homo sapiens
gggacgtggctcagccagca

SEQ ID NO: 1274112 - DNA, 19 bp, Homo sapiens
gggactaacccaatgcctg

SEQ ID NO: 1274113 - DNA, 21 bp, Homo sapiens
gggactagtgagtcagcacct

SEQ ID NO: 1274114 - DNA, 19 bp, Homo sapiens
gggactcaagggtccagaa

SEQ ID NO: 1274115 - DNA, 20 bp, Homo sapiens
gggactcaagggtccagaag

SEQ ID NO: 1274116 - DNA, 13 bp, Homo sapiens
gggactcagggac

SEQ ID NO: 1274117 - DNA, 14 bp, Homo sapiens
gggactcaggtctg

SEQ ID NO: 1274118 - DNA, 19 bp, Homo sapiens
gggactcctcaaaccactt

SEQ ID NO: 1274119 - DNA, 20 bp, Homo sapiens
gggactcggtgagccggggc

SEQ ID NO: 1274120 - DNA, 13 bp, Homo sapiens
gggactctcctcc

SEQ ID NO: 1274121 - DNA, 21 bp, Homo sapiens
gggactctgagcgggaggcag

SEQ ID NO: 1274122 - DNA, 23 bp, Homo sapiens
gggactctgagcgggaggcagag

SEQ ID NO: 1274123 - DNA, 16 bp, Homo sapiens
gggactctggcacagt

SEQ ID NO: 1274124 - DNA, 18 bp, Homo sapiens
gggactgaaaacctctcc

SEQ ID NO: 1274125 - DNA, 23 bp, Homo sapiens
gggactgccagtccccctgcccc

SEQ ID NO: 1274126 - DNA, 17 bp, Homo sapiens
gggactgcggaggaagg

SEQ ID NO: 1274127 - DNA, 15 bp, Homo sapiens
gggactgctaaataa

SEQ ID NO: 1274128 - DNA, 19 bp, Homo sapiens
gggactgctgctgcctggc

SEQ ID NO: 1274129 - DNA, 12 bp, Homo sapiens
gggactgctggc

SEQ ID NO: 1274130 - DNA, 23 bp, Homo sapiens
gggactggacagctttgctccgc

SEQ ID NO: 1274131 - DNA, 15 bp, Homo sapiens
gggactgggagtcag

SEQ ID NO: 1274132 - DNA, 17 bp, Homo sapiens
gggactggggaagggga

SEQ ID NO: 1274133 - DNA, 18 bp, Homo sapiens
gggacttccgctccctgg

SEQ ID NO: 1274134 - DNA, 20 bp, Homo sapiens
gggacttccgctccctggat

SEQ ID NO: 1274135 - DNA, 20 bp, Homo sapiens
gggacttccttgctctccct

SEQ ID NO: 1274136 - DNA, 21 bp, Homo sapiens
gggacttggagagcaaaggcc

SEQ ID NO: 1274137 - DNA, 13 bp, Homo sapiens
gggacttggctgt

SEQ ID NO: 1274138 - DNA, 16 bp, Homo sapiens
gggacttggctgtcct

SEQ ID NO: 1274139 - DNA, 17 bp, Homo sapiens
gggacttggctgtcctt

SEQ ID NO: 1274140 - DNA, 21 bp, Homo sapiens
gggacttggggctgagagagt

SEQ ID NO: 1274141 - DNA, 19 bp, Homo sapiens
gggagaaaagacggatggc

SEQ ID NO: 1274142 - DNA, 18 bp, Homo sapiens
gggagaaaatccaggtca

SEQ ID NO: 1274143 - DNA, 15 bp, Homo sapiens
gggagaaaattcaat

SEQ ID NO: 1274144 - DNA, 19 bp, Homo sapiens
gggagaaactgaaagtgtt

SEQ ID NO: 1274145 - DNA, 18 bp, Homo sapiens
gggagaaagaggggcctg

SEQ ID NO: 1274146 - DNA, 15 bp, Homo sapiens
gggagaaagggcaaa

SEQ ID NO: 1274147 - DNA, 23 bp, Homo sapiens
gggagaaatagtcggtgaagaaa

SEQ ID NO: 1274148 - DNA, 16 bp, Homo sapiens
gggagaaattgacaga

SEQ ID NO: 1274149 - DNA, 14 bp, Homo sapiens
gggagaacctcagg

SEQ ID NO: 1274150 - DNA, 16 bp, Homo sapiens
gggagaagagccctgg

SEQ ID NO: 1274151 - DNA, 16 bp, Homo sapiens
gggagaagagtgtcag

SEQ ID NO: 1274152 - DNA, 19 bp, Homo sapiens
gggagacaattagcagaat

SEQ ID NO: 1274153 - DNA, 12 bp, Homo sapiens
gggagacagcag

SEQ ID NO: 1274154 - DNA, 12 bp, Homo sapiens
gggagacagcat

SEQ ID NO: 1274155 - DNA, 19 bp, Homo sapiens
gggagacagcttctctgca

SEQ ID NO: 1274156 - DNA, 15 bp, Homo sapiens
gggagacatgtgaca

SEQ ID NO: 1274157 - DNA, 13 bp, Homo sapiens
gggagactcctgg

SEQ ID NO: 1274158 - DNA, 14 bp, Homo sapiens
gggagactgggctg

SEQ ID NO: 1274159 - DNA, 16 bp, Homo sapiens
gggagagacaggcagc

SEQ ID NO: 1274160 - DNA, 20 bp, Homo sapiens
gggagagacaggcagcccag

SEQ ID NO: 1274161 - DNA, 13 bp, Homo sapiens
gggagagaccctt

SEQ ID NO: 1274162 - DNA, 22 bp, Homo sapiens
gggagggggtcctgactcacac

SEQ ID NO: 1274163 - DNA, 20 bp, Homo sapiens
gggagggggtgagaggcagg

SEQ ID NO: 1274164 - DNA, 22 bp, Homo sapiens
gggaggggtaaaattccttagc

SEQ ID NO: 1274165 - DNA, 17 bp, Homo sapiens
gggagggttggggaggg

SEQ ID NO: 1274166 - DNA, 23 bp, Homo sapiens
gggaggtagaaggggaggacact

SEQ ID NO: 1274167 - DNA, 15 bp, Homo sapiens
gggaggtcactggaa

SEQ ID NO: 1274168 - DNA, 19 bp, Homo sapiens
gggaggtcgaggcaggagg

SEQ ID NO: 1274169 - DNA, 13 bp, Homo sapiens
gggagtacctgct

SEQ ID NO: 1274170 - DNA, 17 bp, Homo sapiens
gggagtacctgctgccc

SEQ ID NO: 1274171 - DNA, 23 bp, Homo sapiens
gggagtagcatggactctgggtt

SEQ ID NO: 1274172 - DNA, 14 bp, Homo sapiens
gggagtagccaagc

SEQ ID NO: 1274173 - DNA, 13 bp, Homo sapiens
gggagtatgttgt

SEQ ID NO: 1274174 - DNA, 14 bp, Homo sapiens
gggagtatgttgtc

SEQ ID NO: 1274175 - DNA, 20 bp, Homo sapiens
gggagtatgttgtcataaca

SEQ ID NO: 1274176 - DNA, 14 bp, Homo sapiens
gggagtcagagccc

SEQ ID NO: 1274177 - DNA, 21 bp, Homo sapiens
gggagtcaggcctgggcagga

SEQ ID NO: 1274178 - DNA, 17 bp, Homo sapiens
gggagtccaggcacagg

SEQ ID NO: 1274179 - DNA, 16 bp, Homo sapiens
gggagtccttacctcg

SEQ ID NO: 1274180 - DNA, 18 bp, Homo sapiens
gggagtccttacctcggg

SEQ ID NO: 1274181 - DNA, 16 bp, Homo sapiens
gggagtcggttagtca

SEQ ID NO: 1274182 - DNA, 20 bp, Homo sapiens
gggagtctcaggaggaggct

SEQ ID NO: 1274183 - DNA, 20 bp, Homo sapiens
gggagtcttgggtggcgctg

SEQ ID NO: 1274184 - DNA, 19 bp, Homo sapiens
gggagtgaaacagagaaag

SEQ ID NO: 1274185 - DNA, 19 bp, Homo sapiens
gggagtgagacagaagtaa

SEQ ID NO: 1274186 - DNA, 11 bp, Homo sapiens
gggagtgagca

SEQ ID NO: 1274187 - DNA, 18 bp, Homo sapiens
gggagtgaggggctgtga

SEQ ID NO: 1274188 - DNA, 15 bp, Homo sapiens
gggagtgctggctca

SEQ ID NO: 1274189 - DNA, 16 bp, Homo sapiens
gggagtgctggctcac

SEQ ID NO: 1274190 - DNA, 12 bp, Homo sapiens
gggagtgggcac

SEQ ID NO: 1274191 - DNA, 19 bp, Homo sapiens
gggagtgggcacctcagaa

SEQ ID NO: 1274192 - DNA, 13 bp, Homo sapiens
gggagtgtgtgcc

SEQ ID NO: 1274193 - DNA, 23 bp, Homo sapiens
gggagttcgagaccaacctgacc

SEQ ID NO: 1274194 - DNA, 20 bp, Homo sapiens
gggagtttaatacaggaaat

SEQ ID NO: 1274195 - DNA, 18 bp, Homo sapiens
gggataatgggagacagt

SEQ ID NO: 1274196 - DNA, 15 bp, Homo sapiens
gggataatttatttt

SEQ ID NO: 1274197 - DNA, 23 bp, Homo sapiens
gggatacttagtggtatgtctct

SEQ ID NO: 1274198 - DNA, 21 bp, Homo sapiens
gggatatgatttaaatcagcc

SEQ ID NO: 1274199 - DNA, 13 bp, Homo sapiens
gggatattgcctt

SEQ ID NO: 1274200 - DNA, 13 bp, Homo sapiens
gggatatttccta

SEQ ID NO: 1274201 - DNA, 12 bp, Homo sapiens
gggatcacagcg

SEQ ID NO: 1274202 - DNA, 14 bp, Homo sapiens
gggatcacagggcc

SEQ ID NO: 1274203 - DNA, 22 bp, Homo sapiens
gggatcactggctggcctgagc

SEQ ID NO: 1274204 - DNA, 22 bp, Homo sapiens
gggatcagcttcttgcactcct

SEQ ID NO: 1274205 - DNA, 13 bp, Homo sapiens
gggatcaggagcc

SEQ ID NO: 1274206 - DNA, 18 bp, Homo sapiens
gggatcctccacagagag

SEQ ID NO: 1274207 - DNA, 22 bp, Homo sapiens
gggatcctccacagagaggagg

SEQ ID NO: 1274208 - DNA, 14 bp, Homo sapiens
gggatcctgcctgc

SEQ ID NO: 1274209 - DNA, 21 bp, Homo sapiens
gggatcgcaccttttatacca

SEQ ID NO: 1274210 - DNA, 14 bp, Homo sapiens
gggatctcaggggc

SEQ ID NO: 1274211 - DNA, 23 bp, Homo sapiens
gggatctgagctcccacctccct

SEQ ID NO: 1274212 - DNA, 20 bp, Homo sapiens
gggatctggggggtggggag

SEQ ID NO: 1274213 - DNA, 19 bp, Homo sapiens
gggatcttcccacaggagg

SEQ ID NO: 1274214 - DNA, 19 bp, Homo sapiens
gggatgactaaaatattta

SEQ ID NO: 1274215 - DNA, 15 bp, Homo sapiens
gggatgcccagaaga

SEQ ID NO: 1274216 - DNA, 19 bp, Homo sapiens
gggatgcccccaggcagcc

SEQ ID NO: 1274217 - DNA, 17 bp, Homo sapiens
gggatgcgtgggaggca

SEQ ID NO: 1274218 - DNA, 16 bp, Homo sapiens
gggatgctgacccagg

SEQ ID NO: 1274219 - DNA, 20 bp, Homo sapiens
gggatgctgacccaggaata

SEQ ID NO: 1274220 - DNA, 14 bp, Homo sapiens
gggatgctgggctg

SEQ ID NO: 1274221 - DNA, 15 bp, Homo sapiens
gggatgctgggctgg

SEQ ID NO: 1274222 - DNA, 15 bp, Homo sapiens
gggatggaaaaggaa

SEQ ID NO: 1274223 - DNA, 16 bp, Homo sapiens
gggatggaggccagag

SEQ ID NO: 1274224 - DNA, 13 bp, Homo sapiens
gggatggcaccac

SEQ ID NO: 1274225 - DNA, 13 bp, Homo sapiens
gggatgggctcta

SEQ ID NO: 1274226 - DNA, 13 bp, Homo sapiens
gggatggggaggg

SEQ ID NO: 1274227 - DNA, 20 bp, Homo sapiens
gggatgggggatgggccagg

SEQ ID NO: 1274228 - DNA, 19 bp, Homo sapiens
gggatggtaagagaaaaga

SEQ ID NO: 1274229 - DNA, 15 bp, Homo sapiens
gggatggtccaggat

SEQ ID NO: 1274230 - DNA, 18 bp, Homo sapiens
gggatggtccaggatctc

SEQ ID NO: 1274231 - DNA, 17 bp, Homo sapiens
gggatggtggagggcca

SEQ ID NO: 1274232 - DNA, 22 bp, Homo sapiens
gggatgttcagcactgtccctt

SEQ ID NO: 1274233 - DNA, 18 bp, Homo sapiens
gggatgtttacctggtgc

SEQ ID NO: 1274234 - DNA, 16 bp, Homo sapiens
gggattaacctctgca

SEQ ID NO: 1274235 - DNA, 14 bp, Homo sapiens
gggattaagggcaa

SEQ ID NO: 1274236 - DNA, 16 bp, Homo sapiens
gggattcaggctgctt

SEQ ID NO: 1274237 - DNA, 22 bp, Homo sapiens
gggattcaggggctttgggccc

SEQ ID NO: 1274238 - DNA, 15 bp, Homo sapiens
gggattcccaccaag

SEQ ID NO: 1274239 - DNA, 21 bp, Homo sapiens
gggattcctgacccaggccgc

SEQ ID NO: 1274240 - DNA, 19 bp, Homo sapiens
gggattctggttccagggt

SEQ ID NO: 1274241 - DNA, 13 bp, Homo sapiens
gggattggctgtg

SEQ ID NO: 1274242 - DNA, 23 bp, Homo sapiens
gggattggggggaaagagggagc

SEQ ID NO: 1274243 - DNA, 15 bp, Homo sapiens
gggattttagtaagt

SEQ ID NO: 1274244 - DNA, 18 bp, Homo sapiens
gggcaaaagggcagctgt

SEQ ID NO: 1274245 - DNA, 14 bp, Homo sapiens
gggcaaagcctagt

SEQ ID NO: 1274246 - DNA, 17 bp, Homo sapiens
gggcaaaggcagggcca

SEQ ID NO: 1274247 - DNA, 13 bp, Homo sapiens
gggcaaataatga

SEQ ID NO: 1274248 - DNA, 17 bp, Homo sapiens
gggcaacgaagaaaaaa

SEQ ID NO: 1274249 - DNA, 23 bp, Homo sapiens
gggcaacgaagaaaaaaaataac

SEQ ID NO: 1274250 - DNA, 16 bp, Homo sapiens
gggcaactcttggaag

SEQ ID NO: 1274251 - DNA, 22 bp, Homo sapiens
gggcaagagatgggacaagcag

SEQ ID NO: 1274252 - DNA, 13 bp, Homo sapiens
gggcaagccaggg

SEQ ID NO: 1274253 - DNA, 20 bp, Homo sapiens
gggcaagccagggcccagag

SEQ ID NO: 1274254 - DNA, 21 bp, Homo sapiens
gggcaagccagggcccagagc

SEQ ID NO: 1274255 - DNA, 14 bp, Homo sapiens
gggcaagggctcct

SEQ ID NO: 1274256 - DNA, 14 bp, Homo sapiens
gggcaagggtgcct

SEQ ID NO: 1274257 - DNA, 18 bp, Homo sapiens
gggcaagtagcaggacta

SEQ ID NO: 1274258 - DNA, 21 bp, Homo sapiens
gggcaagtagcaggactaggc

SEQ ID NO: 1274259 - DNA, 24 bp, Homo sapiens
gggcaagtccctgactctctgtga

SEQ ID NO: 1274260 - DNA, 16 bp, Homo sapiens
gggcaagtgagagggg

SEQ ID NO: 1274261 - DNA, 17 bp, Homo sapiens
gggcaatgccatcagcc

SEQ ID NO: 1274262 - DNA, 22 bp, Homo sapiens
gggcaatgccatcagcccctgg

SEQ ID NO: 1274263 - DNA, 21 bp, Homo sapiens
gggcacaaactgcagctgtga

SEQ ID NO: 1274264 - DNA, 15 bp, Homo sapiens
gggcacaaagatgga

SEQ ID NO: 1274265 - DNA, 17 bp, Homo sapiens
gggcacaccactgccct

SEQ ID NO: 1274266 - DNA, 19 bp, Homo sapiens
gggcacaccactgccctgc

SEQ ID NO: 1274267 - DNA, 20 bp, Homo sapiens
gggcacaccactgccctgcc

SEQ ID NO: 1274268 - DNA, 22 bp, Homo sapiens
gggcacaccactgccctgcctg

SEQ ID NO: 1274269 - DNA, 23 bp, Homo sapiens
gggcacaccactgccctgcctgc

SEQ ID NO: 1274270 - DNA, 14 bp, Homo sapiens
gggcacagcctagg

SEQ ID NO: 1274271 - DNA, 17 bp, Homo sapiens
gggcacagctgccctgc

SEQ ID NO: 1274272 - DNA, 16 bp, Homo sapiens
gggcacagctgtctgc

SEQ ID NO: 1274273 - DNA, 17 bp, Homo sapiens
gggcacagctgtctgcc

SEQ ID NO: 1274274 - DNA, 21 bp, Homo sapiens
gggcacagctgtctgccaggc

SEQ ID NO: 1274275 - DNA, 22 bp, Homo sapiens
gggcacagctgtctgccaggca

SEQ ID NO: 1274276 - DNA, 23 bp, Homo sapiens
gggcacagctgtctgccaggcac

SEQ ID NO: 1274277 - DNA, 13 bp, Homo sapiens
gggcacagggtct

SEQ ID NO: 1274278 - DNA, 18 bp, Homo sapiens
gggcacagtgctgcccct

SEQ ID NO: 1274279 - DNA, 21 bp, Homo sapiens
gggcacagtgctgccccttgc

SEQ ID NO: 1274280 - DNA, 21 bp, Homo sapiens
gggcaccagcatttggcagca

SEQ ID NO: 1274281 - DNA, 12 bp, Homo sapiens
gggcacccaccc

SEQ ID NO: 1274282 - DNA, 17 bp, Homo sapiens
gggcacctccggctgcc

SEQ ID NO: 1274283 - DNA, 21 bp, Homo sapiens
gggcctgggacttccatgcct

SEQ ID NO: 1274284 - DNA, 22 bp, Homo sapiens
gggcctgggagggttcccctgg

SEQ ID NO: 1274285 - DNA, 17 bp, Homo sapiens
gggcctgggcagcccca

SEQ ID NO: 1274286 - DNA, 17 bp, Homo sapiens
gggcctggggcctgaga

SEQ ID NO: 1274287 - DNA, 18 bp, Homo sapiens
gggcctggggcctgagag

SEQ ID NO: 1274288 - DNA, 19 bp, Homo sapiens
gggcctggggcctgagaga

SEQ ID NO: 1274289 - DNA, 20 bp, Homo sapiens
gggcctgggggcagtgactg

SEQ ID NO: 1274290 - DNA, 19 bp, Homo sapiens
gggcctggtccctgggagg

SEQ ID NO: 1274291 - DNA, 16 bp, Homo sapiens
gggcctgtcgtgccag

SEQ ID NO: 1274292 - DNA, 21 bp, Homo sapiens
gggcctgtctcccttcttggg

SEQ ID NO: 1274293 - DNA, 13 bp, Homo sapiens
gggcctgtgcact

SEQ ID NO: 1274294 - DNA, 19 bp, Homo sapiens
gggcctgtgcactgggcag

SEQ ID NO: 1274295 - DNA, 18 bp, Homo sapiens
gggcctgtgcagcagccc

SEQ ID NO: 1274296 - DNA, 21 bp, Homo sapiens
gggcctgtgcagcagcccagc

SEQ ID NO: 1274297 - DNA, 20 bp, Homo sapiens
gggccttagtgggccagggc

SEQ ID NO: 1274298 - DNA, 22 bp, Homo sapiens
gggccttagtgggccagggctg

SEQ ID NO: 1274299 - DNA, 20 bp, Homo sapiens
gggccttcgggaccctgggg

SEQ ID NO: 1274300 - DNA, 17 bp, Homo sapiens
gggccttgcggaagcca

SEQ ID NO: 1274301 - DNA, 19 bp, Homo sapiens
gggccttgcggaagccata

SEQ ID NO: 1274302 - DNA, 14 bp, Homo sapiens
gggccttgctctga

SEQ ID NO: 1274303 - DNA, 18 bp, Homo sapiens
gggccttgctctgagcac

SEQ ID NO: 1274304 - DNA, 14 bp, Homo sapiens
gggccttgcttctc

SEQ ID NO: 1274305 - DNA, 15 bp, Homo sapiens
gggccttggatcgct

SEQ ID NO: 1274306 - DNA, 23 bp, Homo sapiens
gggccttgtctctcactgcattt

SEQ ID NO: 1274307 - DNA, 16 bp, Homo sapiens
gggcctttcctgtgcc

SEQ ID NO: 1274308 - DNA, 21 bp, Homo sapiens
gggcctttctcctccccacct

SEQ ID NO: 1274309 - DNA, 15 bp, Homo sapiens
gggcctttgcaagat

SEQ ID NO: 1274310 - DNA, 20 bp, Homo sapiens
gggcgagactccgtctcaaa

SEQ ID NO: 1274311 - DNA, 13 bp, Homo sapiens
gggcgccaggaca

SEQ ID NO: 1274312 - DNA, 15 bp, Homo sapiens
gggcgccaggacagc

SEQ ID NO: 1274313 - DNA, 18 bp, Homo sapiens
gggcgccaggacagcagc

SEQ ID NO: 1274314 - DNA, 23 bp, Homo sapiens
gggcgcccattcgtctgtcccag

SEQ ID NO: 1274315 - DNA, 13 bp, Homo sapiens
gggcgccctctct

SEQ ID NO: 1274316 - DNA, 14 bp, Homo sapiens
gggcgccctggaag

SEQ ID NO: 1274317 - DNA, 15 bp, Homo sapiens
gggcgccctggaagc

SEQ ID NO: 1274318 - DNA, 15 bp, Homo sapiens
gggcgcctggaggga

SEQ ID NO: 1274319 - DNA, 23 bp, Homo sapiens
gggcgcgcaggcagggagaaggg

SEQ ID NO: 1274320 - DNA, 19 bp, Homo sapiens
gggcgctcaggacccaggc

SEQ ID NO: 1274321 - DNA, 22 bp, Homo sapiens
gggcgctcaggacccaggccct

SEQ ID NO: 1274322 - DNA, 15 bp, Homo sapiens
gggcgctcgctcagg

SEQ ID NO: 1274323 - DNA, 23 bp, Homo sapiens
gggcgctggcccagccggcctct

SEQ ID NO: 1274324 - DNA, 14 bp, Homo sapiens
gggcgctgggaagg

SEQ ID NO: 1274325 - DNA, 15 bp, Homo sapiens
gggcgctgtcctgcg

SEQ ID NO: 1274326 - DNA, 18 bp, Homo sapiens
gggcggacaaaagggcca

SEQ ID NO: 1274327 - DNA, 12 bp, Homo sapiens
gggcggaggagg

SEQ ID NO: 1274328 - DNA, 12 bp, Homo sapiens
gggcggcagggc

SEQ ID NO: 1274329 - DNA, 21 bp, Homo sapiens
gggcggcaggggcctggagat

SEQ ID NO: 1274330 - DNA, 12 bp, Homo sapiens
gggcggccaggg

SEQ ID NO: 1274331 - DNA, 14 bp, Homo sapiens
gggcggccagggac

SEQ ID NO: 1274332 - DNA, 13 bp, Homo sapiens
gggcggctgagag

SEQ ID NO: 1274333 - DNA, 14 bp, Homo sapiens
gggcgggcagccag

SEQ ID NO: 1274334 - DNA, 17 bp, Homo sapiens
gggcgggctcagagctt

SEQ ID NO: 1274335 - DNA, 21 bp, Homo sapiens
gggcggggttagagccaagct

SEQ ID NO: 1274336 - DNA, 20 bp, Homo sapiens
gggcggtcacagcatggagg

SEQ ID NO: 1274337 - DNA, 15 bp, Homo sapiens
gggcggtgtcaggtc

SEQ ID NO: 1274338 - DNA, 14 bp, Homo sapiens
gggcgtcaggcaga

SEQ ID NO: 1274339 - DNA, 16 bp, Homo sapiens
gggcgtcaggggtgca

SEQ ID NO: 1274340 - DNA, 16 bp, Homo sapiens
gggcgtccagctcagc

SEQ ID NO: 1274341 - DNA, 22 bp, Homo sapiens
gggcgtctcccccagagtgctg

SEQ ID NO: 1274342 - DNA, 21 bp, Homo sapiens
gggcgtggatcgagtgtagct

SEQ ID NO: 1274343 - DNA, 13 bp, Homo sapiens
gggcgtggctggc

SEQ ID NO: 1274344 - DNA, 15 bp, Homo sapiens
gggcgtggctggcct

SEQ ID NO: 1274345 - DNA, 23 bp, Homo sapiens
gggcgtgtggtttccctgcccct

SEQ ID NO: 1274346 - DNA, 17 bp, Homo sapiens
gggcgttctcccaaaga

SEQ ID NO: 1274347 - DNA, 14 bp, Homo sapiens
gggcgttgggagcc

SEQ ID NO: 1274348 - DNA, 18 bp, Homo sapiens
gggcgttgggagcctagc

SEQ ID NO: 1274349 - DNA, 13 bp, Homo sapiens
gggctaaggcccc

SEQ ID NO: 1274350 - DNA, 14 bp, Homo sapiens
gggctaaggtccct

SEQ ID NO: 1274351 - DNA, 20 bp, Homo sapiens
gggctaattctgggaaggga

SEQ ID NO: 1274352 - DNA, 12 bp, Homo sapiens
gggctaccagga

SEQ ID NO: 1274353 - DNA, 22 bp, Homo sapiens
gggctaccctaaagggagaagg

SEQ ID NO: 1274354 - DNA, 23 bp, Homo sapiens
gggctaccctaaagggagaagga

SEQ ID NO: 1274355 - DNA, 13 bp, Homo sapiens
gggctaccctgag

SEQ ID NO: 1274356 - DNA, 20 bp, Homo sapiens
gggctacgttagcagcccag

SEQ ID NO: 1274357 - DNA, 19 bp, Homo sapiens
gggctactgccactgtgtg

SEQ ID NO: 1274358 - DNA, 15 bp, Homo sapiens
gggctactggcagct

SEQ ID NO: 1274359 - DNA, 16 bp, Homo sapiens
gggctactggcagctc

SEQ ID NO: 1274360 - DNA, 19 bp, Homo sapiens
gggctactggcagctcctc

SEQ ID NO: 1274361 - DNA, 23 bp, Homo sapiens
gggctagaaagaccactggcaga

SEQ ID NO: 1274362 - DNA, 14 bp, Homo sapiens
gggctagccctgag

SEQ ID NO: 1274363 - DNA, 16 bp, Homo sapiens
gggctagtgaagtggc

SEQ ID NO: 1274364 - DNA, 17 bp, Homo sapiens
gggctagtgtgagtggc

SEQ ID NO: 1274365 - DNA, 22 bp, Homo sapiens
gggctatcaacttaataagata

SEQ ID NO: 1274366 - DNA, 16 bp, Homo sapiens
gggctatggacacagg

SEQ ID NO: 1274367 - DNA, 15 bp, Homo sapiens
gggctatggcaaggg

SEQ ID NO: 1274368 - DNA, 16 bp, Homo sapiens
gggctatggcaagggg

SEQ ID NO: 1274369 - DNA, 17 bp, Homo sapiens
gggctatggcaaggggg

SEQ ID NO: 1274370 - DNA, 17 bp, Homo sapiens
gggctatttctctcccc

SEQ ID NO: 1274371 - DNA, 18 bp, Homo sapiens
gggctcaaagcccttcct

SEQ ID NO: 1274372 - DNA, 22 bp, Homo sapiens
gggctcaagcaatcctcctgcc

SEQ ID NO: 1274373 - DNA, 21 bp, Homo sapiens
gggctcaagcagttctcccac

SEQ ID NO: 1274374 - DNA, 15 bp, Homo sapiens
gggctcacactcctg

SEQ ID NO: 1274375 - DNA, 17 bp, Homo sapiens
gggctcacactcctggg

SEQ ID NO: 1274376 - DNA, 21 bp, Homo sapiens
gggctcacactcctgggctct

SEQ ID NO: 1274377 - DNA, 20 bp, Homo sapiens
gggctcacggggcctccaac

SEQ ID NO: 1274378 - DNA, 16 bp, Homo sapiens
gggctcagaagagcag

SEQ ID NO: 1274379 - DNA, 13 bp, Homo sapiens
gggctcagagctt

SEQ ID NO: 1274380 - DNA, 16 bp, Homo sapiens
gggctcagcctggtgg

SEQ ID NO: 1274381 - DNA, 14 bp, Homo sapiens
gggctcagggctgg

SEQ ID NO: 1274382 - DNA, 13 bp, Homo sapiens
gggctcagggttg

SEQ ID NO: 1274383 - DNA, 19 bp, Homo sapiens
gggctcagggttggccatt

SEQ ID NO: 1274384 - DNA, 12 bp, Homo sapiens
gggctcattttc

SEQ ID NO: 1274385 - DNA, 18 bp, Homo sapiens
gggctccagcaccttctt

SEQ ID NO: 1274386 - DNA, 13 bp, Homo sapiens
gggctccagcatc

SEQ ID NO: 1274387 - DNA, 17 bp, Homo sapiens
gggctccagcatccagc

SEQ ID NO: 1274388 - DNA, 23 bp, Homo sapiens
gggctccagcccctcttggagaa

SEQ ID NO: 1274389 - DNA, 13 bp, Homo sapiens
gggctcccagctc

SEQ ID NO: 1274390 - DNA, 23 bp, Homo sapiens
gggctcccagctcctttctcctg

SEQ ID NO: 1274391 - DNA, 13 bp, Homo sapiens
gggctcccagggc

SEQ ID NO: 1274392 - DNA, 14 bp, Homo sapiens
gggctcccaggggt

SEQ ID NO: 1274393 - DNA, 18 bp, Homo sapiens
gggctcccctcttcctct

SEQ ID NO: 1274394 - DNA, 19 bp, Homo sapiens
gggctcccgggtccttggc

SEQ ID NO: 1274395 - DNA, 20 bp, Homo sapiens
gggctccctacattccccag

SEQ ID NO: 1274396 - DNA, 12 bp, Homo sapiens
gggctccctcct

SEQ ID NO: 1274397 - DNA, 16 bp, Homo sapiens
gggctccctcctctgg

SEQ ID NO: 1274398 - DNA, 15 bp, Homo sapiens
gggctccctcctgga

SEQ ID NO: 1274399 - DNA, 18 bp, Homo sapiens
gggctccctcttgtggga

SEQ ID NO: 1274400 - DNA, 12 bp, Homo sapiens
gggctccctgac

SEQ ID NO: 1274401 - DNA, 14 bp, Homo sapiens
gggctccctgactg

SEQ ID NO: 1274402 - DNA, 23 bp, Homo sapiens
gggctcctccagggtggcagcaa

SEQ ID NO: 1274403 - DNA, 12 bp, Homo sapiens
gggctcctccca

SEQ ID NO: 1274404 - DNA, 12 bp, Homo sapiens
gggctcctggaa

SEQ ID NO: 1274405 - DNA, 16 bp, Homo sapiens
gggctgttggcactca

SEQ ID NO: 1274406 - DNA, 15 bp, Homo sapiens
gggcttaagaaatct

SEQ ID NO: 1274407 - DNA, 14 bp, Homo sapiens
gggcttatctcttc

SEQ ID NO: 1274408 - DNA, 17 bp, Homo sapiens
gggcttcacagccacac

SEQ ID NO: 1274409 - DNA, 12 bp, Homo sapiens
gggcttcatctg

SEQ ID NO: 1274410 - DNA, 12 bp, Homo sapiens
gggcttcctgcc

SEQ ID NO: 1274411 - DNA, 15 bp, Homo sapiens
gggcttcctgccctt

SEQ ID NO: 1274412 - DNA, 17 bp, Homo sapiens
gggcttcctgcccttcc

SEQ ID NO: 1274413 - DNA, 19 bp, Homo sapiens
gggcttcctgcccttccct

SEQ ID NO: 1274414 - DNA, 14 bp, Homo sapiens
gggcttctcctcct

SEQ ID NO: 1274415 - DNA, 13 bp, Homo sapiens
gggcttctcctga

SEQ ID NO: 1274416 - DNA, 16 bp, Homo sapiens
gggcttctgcaccctc

SEQ ID NO: 1274417 - DNA, 17 bp, Homo sapiens
gggcttctgcaccctcc

SEQ ID NO: 1274418 - DNA, 23 bp, Homo sapiens
gggcttctgcgtccaccaggcct

SEQ ID NO: 1274419 - DNA, 20 bp, Homo sapiens
gggcttctgttctctgctga

SEQ ID NO: 1274420 - DNA, 21 bp, Homo sapiens
gggcttctgttctctgctgag

SEQ ID NO: 1274421 - DNA, 16 bp, Homo sapiens
gggcttcttcctcaca

SEQ ID NO: 1274422 - DNA, 13 bp, Homo sapiens
gggcttgaagcca

SEQ ID NO: 1274423 - DNA, 17 bp, Homo sapiens
gggcttgaagccaaaga

SEQ ID NO: 1274424 - DNA, 16 bp, Homo sapiens
gggcttggcctgctgt

SEQ ID NO: 1274425 - DNA, 16 bp, Homo sapiens
gggcttggcctggaga

SEQ ID NO: 1274426 - DNA, 21 bp, Homo sapiens
gggcttggctcttggcttcca

SEQ ID NO: 1274427 - DNA, 16 bp, Homo sapiens
gggctttcacgggccc

SEQ ID NO: 1274428 - DNA, 17 bp, Homo sapiens
gggctttcggggagggc

SEQ ID NO: 1274429 - DNA, 19 bp, Homo sapiens
gggctttcggggagggcgc

SEQ ID NO: 1274430 - DNA, 12 bp, Homo sapiens
gggctttctcct

SEQ ID NO: 1274431 - DNA, 17 bp, Homo sapiens
gggctttctcctggaga

SEQ ID NO: 1274432 - DNA, 12 bp, Homo sapiens
gggctttctctt

SEQ ID NO: 1274433 - DNA, 14 bp, Homo sapiens
gggctttctcttcc

SEQ ID NO: 1274434 - DNA, 17 bp, Homo sapiens
gggctttctcttcccct

SEQ ID NO: 1274435 - DNA, 15 bp, Homo sapiens
gggctttctggagag

SEQ ID NO: 1274436 - DNA, 15 bp, Homo sapiens
gggctttctggggcc

SEQ ID NO: 1274437 - DNA, 15 bp, Homo sapiens
gggctttgcaggctc

SEQ ID NO: 1274438 - DNA, 18 bp, Homo sapiens
gggctttgcaggctctgg

SEQ ID NO: 1274439 - DNA, 19 bp, Homo sapiens
gggctttgcaggctctggg

SEQ ID NO: 1274440 - DNA, 13 bp, Homo sapiens
gggctttgggccc

SEQ ID NO: 1274441 - DNA, 14 bp, Homo sapiens
gggctttgggccca

SEQ ID NO: 1274442 - DNA, 19 bp, Homo sapiens
gggctttggttccttctct

SEQ ID NO: 1274443 - DNA, 18 bp, Homo sapiens
gggcttttgttctgaggg

SEQ ID NO: 1274444 - DNA, 14 bp, Homo sapiens
gggcttttttcttt

SEQ ID NO: 1274445 - DNA, 11 bp, Homo sapiens
ggggaaaaaaa

SEQ ID NO: 1274446 - DNA, 24 bp, Homo sapiens
ggggaaaatcagcctgctccagct

SEQ ID NO: 1274447 - DNA, 22 bp, Homo sapiens
ggggaaaggcaaggtccggccc

SEQ ID NO: 1274448 - DNA, 16 bp, Homo sapiens
ggggaaagggaggaag

SEQ ID NO: 1274449 - DNA, 22 bp, Homo sapiens
ggggaacatcaccctatatata

SEQ ID NO: 1274450 - DNA, 21 bp, Homo sapiens
ggggaacctgccatgccagga

SEQ ID NO: 1274451 - DNA, 13 bp, Homo sapiens
ggggaactcctgg

SEQ ID NO: 1274452 - DNA, 18 bp, Homo sapiens
ggggaactgacgctggag

SEQ ID NO: 1274453 - DNA, 15 bp, Homo sapiens
ggggaagctgggccc

SEQ ID NO: 1274454 - DNA, 13 bp, Homo sapiens
ggggaaggaagga

SEQ ID NO: 1274455 - DNA, 13 bp, Homo sapiens
ggggaaggagcca

SEQ ID NO: 1274456 - DNA, 15 bp, Homo sapiens
ggggaaggcagaggc

SEQ ID NO: 1274457 - DNA, 17 bp, Homo sapiens
ggggaagggttttcttt

SEQ ID NO: 1274458 - DNA, 21 bp, Homo sapiens
ggggacaaccccccaagacca

SEQ ID NO: 1274459 - DNA, 15 bp, Homo sapiens
ggggacaccagagct

SEQ ID NO: 1274460 - DNA, 13 bp, Homo sapiens
ggggacagagcca

SEQ ID NO: 1274461 - DNA, 18 bp, Homo sapiens
ggggacagagctgaggat

SEQ ID NO: 1274462 - DNA, 17 bp, Homo sapiens
ggggacagggggtggga

SEQ ID NO: 1274463 - DNA, 18 bp, Homo sapiens
ggggaccaattctggaca

SEQ ID NO: 1274464 - DNA, 15 bp, Homo sapiens
ggggacccagctcct

SEQ ID NO: 1274465 - DNA, 21 bp, Homo sapiens
ggggacccagctcctctgagc

SEQ ID NO: 1274466 - DNA, 13 bp, Homo sapiens
ggggacccccgcc

SEQ ID NO: 1274467 - DNA, 15 bp, Homo sapiens
ggggacccccgcccc

SEQ ID NO: 1274468 - DNA, 23 bp, Homo sapiens
ggggacccctcgcaaccctgcct

SEQ ID NO: 1274469 - DNA, 21 bp, Homo sapiens
ggggacccctggctctgggcc

SEQ ID NO: 1274470 - DNA, 11 bp, Homo sapiens
ggggaccctgt

SEQ ID NO: 1274471 - DNA, 23 bp, Homo sapiens
ggggaccgttcagtgtcccaggc

SEQ ID NO: 1274472 - DNA, 23 bp, Homo sapiens
ggggacctgccaccagggagctt

SEQ ID NO: 1274473 - DNA, 21 bp, Homo sapiens
ggggacctgtcccccactctc

SEQ ID NO: 1274474 - DNA, 20 bp, Homo sapiens
ggggacgggcaagtgagagg

SEQ ID NO: 1274475 - DNA, 14 bp, Homo sapiens
ggggactcagccct

SEQ ID NO: 1274476 - DNA, 11 bp, Homo sapiens
ggggactcctc

SEQ ID NO: 1274477 - DNA, 18 bp, Homo sapiens
ggggactcgggggctggt

SEQ ID NO: 1274478 - DNA, 21 bp, Homo sapiens
ggggactctgagcgggaggca

SEQ ID NO: 1274479 - DNA, 23 bp, Homo sapiens
ggggactctggcacagtgatgcc

SEQ ID NO: 1274480 - DNA, 13 bp, Homo sapiens
ggggactgccttg

SEQ ID NO: 1274481 - DNA, 12 bp, Homo sapiens
ggggactgctgc

SEQ ID NO: 1274482 - DNA, 16 bp, Homo sapiens
ggggactgctggctca

SEQ ID NO: 1274483 - DNA, 19 bp, Homo sapiens
ggggacttgtaggaatctg

SEQ ID NO: 1274484 - DNA, 17 bp, Homo sapiens
ggggagaaaattaaaag

SEQ ID NO: 1274485 - DNA, 19 bp, Homo sapiens
ggggagaaataaattttgt

SEQ ID NO: 1274486 - DNA, 16 bp, Homo sapiens
ggggagaatgcagccc

SEQ ID NO: 1274487 - DNA, 19 bp, Homo sapiens
ggggagaatgcagcccacc

SEQ ID NO: 1274488 - DNA, 12 bp, Homo sapiens
ggggagaggggg

SEQ ID NO: 1274489 - DNA, 23 bp, Homo sapiens
ggggagaggtgattctcagggct

SEQ ID NO: 1274490 - DNA, 17 bp, Homo sapiens
ggggagatggggaggag

SEQ ID NO: 1274491 - DNA, 15 bp, Homo sapiens
ggggagatgggggct

SEQ ID NO: 1274492 - DNA, 19 bp, Homo sapiens
ggggagattctgggtttgc

SEQ ID NO: 1274493 - DNA, 14 bp, Homo sapiens
ggggagcagagaca

SEQ ID NO: 1274494 - DNA, 18 bp, Homo sapiens
ggggagccaaaatctcaa

SEQ ID NO: 1274495 - DNA, 16 bp, Homo sapiens
ggggagccagctgctt

SEQ ID NO: 1274496 - DNA, 14 bp, Homo sapiens
ggggagcccagtga

SEQ ID NO: 1274497 - DNA, 13 bp, Homo sapiens
ggggagccctgat

SEQ ID NO: 1274498 - DNA, 16 bp, Homo sapiens
ggggagccctgggttc

SEQ ID NO: 1274499 - DNA, 21 bp, Homo sapiens
ggggagcctttggggggccac

SEQ ID NO: 1274500 - DNA, 13 bp, Homo sapiens
ggggagctgcaga

SEQ ID NO: 1274501 - DNA, 12 bp, Homo sapiens
ggggagcttggg

SEQ ID NO: 1274502 - DNA, 15 bp, Homo sapiens
ggggagcttgggact

SEQ ID NO: 1274503 - DNA, 11 bp, Homo sapiens
ggggaggagaa

SEQ ID NO: 1274504 - DNA, 19 bp, Homo sapiens
ggggaggagcctctggctt

SEQ ID NO: 1274505 - DNA, 22 bp, Homo sapiens
ggggaggaggaacgggcagcca

SEQ ID NO: 1274506 - DNA, 16 bp, Homo sapiens
ggggaggaggaagccg

SEQ ID NO: 1274507 - DNA, 14 bp, Homo sapiens
ggggaggagggggc

SEQ ID NO: 1274508 - DNA, 21 bp, Homo sapiens
ggggaggagtcaggggctctg

SEQ ID NO: 1274509 - DNA, 12 bp, Homo sapiens
ggggaggcaaga

SEQ ID NO: 1274510 - DNA, 13 bp, Homo sapiens
ggggaggcagggc

SEQ ID NO: 1274511 - DNA, 22 bp, Homo sapiens
ggggaggcctctttgccccgac

SEQ ID NO: 1274512 - DNA, 12 bp, Homo sapiens
ggggagggaggg

SEQ ID NO: 1274513 - DNA, 15 bp, Homo sapiens
ggggagggcaggatg

SEQ ID NO: 1274514 - DNA, 10 bp, Homo sapiens
ggggagggcg

SEQ ID NO: 1274515 - DNA, 12 bp, Homo sapiens
ggggagggctgc

SEQ ID NO: 1274516 - DNA, 21 bp, Homo sapiens
ggggaggggccctcaggccat

SEQ ID NO: 1274517 - DNA, 18 bp, Homo sapiens
ggggaggggcctccccca

SEQ ID NO: 1274518 - DNA, 16 bp, Homo sapiens
ggggagggggaagcaa

SEQ ID NO: 1274519 - DNA, 15 bp, Homo sapiens
ggggaggggggaggg

SEQ ID NO: 1274520 - DNA, 18 bp, Homo sapiens
ggggaggggggaggggga

SEQ ID NO: 1274521 - DNA, 23 bp, Homo sapiens
ggggaggggggcgggtgacgccc

SEQ ID NO: 1274522 - DNA, 14 bp, Homo sapiens
ggggagggtgacag

SEQ ID NO: 1274523 - DNA, 17 bp, Homo sapiens
ggggaggtgctggggga

SEQ ID NO: 1274524 - DNA, 14 bp, Homo sapiens
ggggaggtgggagg

SEQ ID NO: 1274525 - DNA, 22 bp, Homo sapiens
ggggagtaataggaccagagcg

SEQ ID NO: 1274526 - DNA, 15 bp, Homo sapiens
ggggagtagccaagc

SEQ ID NO: 1274527 - DNA, 15 bp, Homo sapiens
ggggagtccctgcca

SEQ ID NO: 1274528 - DNA, 18 bp, Homo sapiens
gggtctccctctcctgcc

SEQ ID NO: 1274529 - DNA, 19 bp, Homo sapiens
gggtctccctctcctgcct

SEQ ID NO: 1274530 - DNA, 19 bp, Homo sapiens
gggtctcgcagcctgaagc

SEQ ID NO: 1274531 - DNA, 22 bp, Homo sapiens
gggtctcggatgacaccctggc

SEQ ID NO: 1274532 - DNA, 18 bp, Homo sapiens
gggtctctccctcaggtg

SEQ ID NO: 1274533 - DNA, 23 bp, Homo sapiens
gggtctctctccctacctccctc

SEQ ID NO: 1274534 - DNA, 12 bp, Homo sapiens
gggtctctgaag

SEQ ID NO: 1274535 - DNA, 19 bp, Homo sapiens
gggtctctggggaccctcc

SEQ ID NO: 1274536 - DNA, 22 bp, Homo sapiens
gggtctgaaggaatagccagag

SEQ ID NO: 1274537 - DNA, 14 bp, Homo sapiens
gggtctgagctgga

SEQ ID NO: 1274538 - DNA, 18 bp, Homo sapiens
gggtctgagtctatgttc

SEQ ID NO: 1274539 - DNA, 20 bp, Homo sapiens
gggtctgagtctatgttcaa

SEQ ID NO: 1274540 - DNA, 15 bp, Homo sapiens
gggtctgcagcctgc

SEQ ID NO: 1274541 - DNA, 12 bp, Homo sapiens
gggtctgccctg

SEQ ID NO: 1274542 - DNA, 18 bp, Homo sapiens
gggtctgcgcttggtctt

SEQ ID NO: 1274543 - DNA, 21 bp, Homo sapiens
gggtctggcagagcctctgag

SEQ ID NO: 1274544 - DNA, 21 bp, Homo sapiens
gggtctgggagggggtgagag

SEQ ID NO: 1274545 - DNA, 14 bp, Homo sapiens
gggtctgggcagca

SEQ ID NO: 1274546 - DNA, 13 bp, Homo sapiens
gggtctgggcagt

SEQ ID NO: 1274547 - DNA, 15 bp, Homo sapiens
gggtctgggcagtgc

SEQ ID NO: 1274548 - DNA, 20 bp, Homo sapiens
gggtctgggcagtgccacag

SEQ ID NO: 1274549 - DNA, 22 bp, Homo sapiens
gggtctgggcgtccagctcagc

SEQ ID NO: 1274550 - DNA, 12 bp, Homo sapiens
gggtctgggctg

SEQ ID NO: 1274551 - DNA, 20 bp, Homo sapiens
gggtctgggggcagctgtcc

SEQ ID NO: 1274552 - DNA, 19 bp, Homo sapiens
gggtctgtgctgtgcctgc

SEQ ID NO: 1274553 - DNA, 15 bp, Homo sapiens
gggtctgtgtctctt

SEQ ID NO: 1274554 - DNA, 24 bp, Homo sapiens
gggtctgtgtgaatgtgggcactg

SEQ ID NO: 1274555 - DNA, 14 bp, Homo sapiens
gggtcttagctctt

SEQ ID NO: 1274556 - DNA, 22 bp, Homo sapiens
gggtcttgctctgtcccccagg

SEQ ID NO: 1274557 - DNA, 17 bp, Homo sapiens
gggtcttgggctactgg

SEQ ID NO: 1274558 - DNA, 21 bp, Homo sapiens
gggtcttgggctactggcagc

SEQ ID NO: 1274559 - DNA, 22 bp, Homo sapiens
gggtcttgggctactggcagct

SEQ ID NO: 1274560 - DNA, 18 bp, Homo sapiens
gggtgaaacttaaaaaaa

SEQ ID NO: 1274561 - DNA, 14 bp, Homo sapiens
gggtgaacagctgg

SEQ ID NO: 1274562 - DNA, 13 bp, Homo sapiens
gggtgaagagctt

SEQ ID NO: 1274563 - DNA, 21 bp, Homo sapiens
gggtgacaagatagagagcta

SEQ ID NO: 1274564 - DNA, 19 bp, Homo sapiens
gggtgacagagcaagtgag

SEQ ID NO: 1274565 - DNA, 18 bp, Homo sapiens
gggtgacagagtgagtga

SEQ ID NO: 1274566 - DNA, 20 bp, Homo sapiens
gggtgacagtcatcatcagg

SEQ ID NO: 1274567 - DNA, 18 bp, Homo sapiens
gggtgacagtgccttctc

SEQ ID NO: 1274568 - DNA, 17 bp, Homo sapiens
gggtgacccacagctct

SEQ ID NO: 1274569 - DNA, 13 bp, Homo sapiens
gggtgacgcccag

SEQ ID NO: 1274570 - DNA, 15 bp, Homo sapiens
gggtgacgcccagct

SEQ ID NO: 1274571 - DNA, 16 bp, Homo sapiens
gggtgacgcccagctc

SEQ ID NO: 1274572 - DNA, 15 bp, Homo sapiens
gggtgacgcctgaga

SEQ ID NO: 1274573 - DNA, 21 bp, Homo sapiens
gggtgacgcctgagacagcac

SEQ ID NO: 1274574 - DNA, 22 bp, Homo sapiens
gggtgactgaatttgggcctct

SEQ ID NO: 1274575 - DNA, 15 bp, Homo sapiens
gggtgataaggggcc

SEQ ID NO: 1274576 - DNA, 13 bp, Homo sapiens
gggtgattcctaa

SEQ ID NO: 1274577 - DNA, 20 bp, Homo sapiens
gggtgcaaagactctgagcc

SEQ ID NO: 1274578 - DNA, 15 bp, Homo sapiens
gggtgcacccacctg

SEQ ID NO: 1274579 - DNA, 19 bp, Homo sapiens
gggtgcacccactcaccag

SEQ ID NO: 1274580 - DNA, 23 bp, Homo sapiens
gggtgcacccactcaccagggtc

SEQ ID NO: 1274581 - DNA, 13 bp, Homo sapiens
gggtgcagccctc

SEQ ID NO: 1274582 - DNA, 19 bp, Homo sapiens
gggtgcaggcagccttgac

SEQ ID NO: 1274583 - DNA, 23 bp, Homo sapiens
gggtgcagtatcatgccctgtgc

SEQ ID NO: 1274584 - DNA, 22 bp, Homo sapiens
gggtgcatcctcctcagccccc

SEQ ID NO: 1274585 - DNA, 15 bp, Homo sapiens
gggtgccctctcagg

SEQ ID NO: 1274586 - DNA, 19 bp, Homo sapiens
gggtgcctaggttggtttc

SEQ ID NO: 1274587 - DNA, 16 bp, Homo sapiens
gggtgcctcctgcagt

SEQ ID NO: 1274588 - DNA, 21 bp, Homo sapiens
gggtgcggcggtcccagctcc

SEQ ID NO: 1274589 - DNA, 13 bp, Homo sapiens
gggtgctcagaat

SEQ ID NO: 1274590 - DNA, 18 bp, Homo sapiens
gggtgctctgaggtcaat

SEQ ID NO: 1274591 - DNA, 17 bp, Homo sapiens
gggtgctgccatgacag

SEQ ID NO: 1274592 - DNA, 17 bp, Homo sapiens
gggtgctgccctgtgta

SEQ ID NO: 1274593 - DNA, 18 bp, Homo sapiens
gggtgctggcccccagga

SEQ ID NO: 1274594 - DNA, 18 bp, Homo sapiens
gggtgctggggccagggc

SEQ ID NO: 1274595 - DNA, 22 bp, Homo sapiens
gggtgcttttatagaggctagc

SEQ ID NO: 1274596 - DNA, 13 bp, Homo sapiens
gggtggaaaagga

SEQ ID NO: 1274597 - DNA, 21 bp, Homo sapiens
gggtggaccacgccgccctcc

SEQ ID NO: 1274598 - DNA, 18 bp, Homo sapiens
gggtggaccaggcctgga

SEQ ID NO: 1274599 - DNA, 23 bp, Homo sapiens
gggtggaccccctgagtcaactg

SEQ ID NO: 1274600 - DNA, 22 bp, Homo sapiens
gggtggagctgagaagaggagg

SEQ ID NO: 1274601 - DNA, 14 bp, Homo sapiens
gggtggaggggtgt

SEQ ID NO: 1274602 - DNA, 18 bp, Homo sapiens
gggtggcacctcctgaga

SEQ ID NO: 1274603 - DNA, 20 bp, Homo sapiens
gggtggcacctcctgagaag

SEQ ID NO: 1274604 - DNA, 22 bp, Homo sapiens
gggtggcacctgtttcccgggc

SEQ ID NO: 1274605 - DNA, 22 bp, Homo sapiens
gggtggcaggcacacagcagcc

SEQ ID NO: 1274606 - DNA, 15 bp, Homo sapiens
gggtggccagggctt

SEQ ID NO: 1274607 - DNA, 13 bp, Homo sapiens
gggtggccatccc

SEQ ID NO: 1274608 - DNA, 16 bp, Homo sapiens
gggtggcccagagcct

SEQ ID NO: 1274609 - DNA, 23 bp, Homo sapiens
gggtggcccctgctgtctctctg

SEQ ID NO: 1274610 - DNA, 16 bp, Homo sapiens
gggtggctagtcagag

SEQ ID NO: 1274611 - DNA, 18 bp, Homo sapiens
gggtggctagtcagagag

SEQ ID NO: 1274612 - DNA, 21 bp, Homo sapiens
gggtggctttcaaggctgggg

SEQ ID NO: 1274613 - DNA, 22 bp, Homo sapiens
gggtgggaattggggagggaga

SEQ ID NO: 1274614 - DNA, 14 bp, Homo sapiens
gggtgggagagccc

SEQ ID NO: 1274615 - DNA, 20 bp, Homo sapiens
gggtgggaggtaggctgtgg

SEQ ID NO: 1274616 - DNA, 12 bp, Homo sapiens
gggtgggcagca

SEQ ID NO: 1274617 - DNA, 14 bp, Homo sapiens
gggtgggcccagaa

SEQ ID NO: 1274618 - DNA, 20 bp, Homo sapiens
gggtgggcctggcctgagct

SEQ ID NO: 1274619 - DNA, 13 bp, Homo sapiens
gggtggggaaagg

SEQ ID NO: 1274620 - DNA, 13 bp, Homo sapiens
gggtggggagatg

SEQ ID NO: 1274621 - DNA, 15 bp, Homo sapiens
gggtggggaggagga

SEQ ID NO: 1274622 - DNA, 12 bp, Homo sapiens
gggtggggaggc

SEQ ID NO: 1274623 - DNA, 14 bp, Homo sapiens
gggtggggctgctc

SEQ ID NO: 1274624 - DNA, 17 bp, Homo sapiens
gggtggggtagggctga

SEQ ID NO: 1274625 - DNA, 12 bp, Homo sapiens
gggtggggtgga

SEQ ID NO: 1274626 - DNA, 14 bp, Homo sapiens
gggtgggtgctcag

SEQ ID NO: 1274627 - DNA, 21 bp, Homo sapiens
gggtggtctgagcaccccctc

SEQ ID NO: 1274628 - DNA, 12 bp, Homo sapiens
gggtggtgggga

SEQ ID NO: 1274629 - DNA, 19 bp, Homo sapiens
gggtgtaacaggtctcctc

SEQ ID NO: 1274630 - DNA, 21 bp, Homo sapiens
gggtgtaggggccacctcctc

SEQ ID NO: 1274631 - DNA, 17 bp, Homo sapiens
gggtgtcatctgaggag

SEQ ID NO: 1274632 - DNA, 18 bp, Homo sapiens
gggtgtcatttcattcca

SEQ ID NO: 1274633 - DNA, 15 bp, Homo sapiens
gggtgtccgagaggc

SEQ ID NO: 1274634 - DNA, 16 bp, Homo sapiens
gggtgtccgccatcca

SEQ ID NO: 1274635 - DNA, 22 bp, Homo sapiens
gggtgtccgccatccagggtct

SEQ ID NO: 1274636 - DNA, 17 bp, Homo sapiens
gggtgtcctgcctgtct

SEQ ID NO: 1274637 - DNA, 14 bp, Homo sapiens
gggtgtctccctcg

SEQ ID NO: 1274638 - DNA, 21 bp, Homo sapiens
gggtgtcttgggcagagctgg

SEQ ID NO: 1274639 - DNA, 23 bp, Homo sapiens
gggtgtcttgggcagagctggct

SEQ ID NO: 1274640 - DNA, 21 bp, Homo sapiens
gggtgtgcaatgtctgagtga

SEQ ID NO: 1274641 - DNA, 13 bp, Homo sapiens
gggtgtgctggga

SEQ ID NO: 1274642 - DNA, 21 bp, Homo sapiens
gggtgtggcacgcacctgtag

SEQ ID NO: 1274643 - DNA, 16 bp, Homo sapiens
gggtgtggccctgcca

SEQ ID NO: 1274644 - DNA, 12 bp, Homo sapiens
gggtgtggcctc

SEQ ID NO: 1274645 - DNA, 15 bp, Homo sapiens
gggtgtggcctcagc

SEQ ID NO: 1274646 - DNA, 18 bp, Homo sapiens
gggtgtggcctcagccct

SEQ ID NO: 1274647 - DNA, 19 bp, Homo sapiens
gggtgtggcctcagccctc

SEQ ID NO: 1274648 - DNA, 19 bp, Homo sapiens
gggtgtggctcctaccagc

SEQ ID NO: 1274649 - DNA, 12 bp, Homo sapiens
ggtcagccaggg

SEQ ID NO: 1274650 - DNA, 13 bp, Homo sapiens
ggtcagccagggc

SEQ ID NO: 1274651 - DNA, 14 bp, Homo sapiens
ggtcagccattttt

SEQ ID NO: 1274652 - DNA, 18 bp, Homo sapiens
ggtcagccccaagggctg

SEQ ID NO: 1274653 - DNA, 19 bp, Homo sapiens
ggtcagccccaagggctgg

SEQ ID NO: 1274654 - DNA, 22 bp, Homo sapiens
ggtcagccctgtgtctgtcaca

SEQ ID NO: 1274655 - DNA, 23 bp, Homo sapiens
ggtcagccttaccttggggctgg

SEQ ID NO: 1274656 - DNA, 23 bp, Homo sapiens
ggtcagcgactggatgctcgcca

SEQ ID NO: 1274657 - DNA, 18 bp, Homo sapiens
ggtcagctcccttctctg

SEQ ID NO: 1274658 - DNA, 18 bp, Homo sapiens
ggtcagctgggagccagt

SEQ ID NO: 1274659 - DNA, 18 bp, Homo sapiens
ggtcaggaccatcagaga

SEQ ID NO: 1274660 - DNA, 19 bp, Homo sapiens
ggtcaggacggctcctcag

SEQ ID NO: 1274661 - DNA, 20 bp, Homo sapiens
ggtcaggacggctcctcaga

SEQ ID NO: 1274662 - DNA, 19 bp, Homo sapiens
ggtcaggatgcacatttct

SEQ ID NO: 1274663 - DNA, 22 bp, Homo sapiens
ggtcaggatgcacatttctgga

SEQ ID NO: 1274664 - DNA, 13 bp, Homo sapiens
ggtcaggcagggt

SEQ ID NO: 1274665 - DNA, 15 bp, Homo sapiens
ggtcaggctggtctc

SEQ ID NO: 1274666 - DNA, 16 bp, Homo sapiens
ggtcagggagtgctgg

SEQ ID NO: 1274667 - DNA, 20 bp, Homo sapiens
ggtcagggagtgctggctca

SEQ ID NO: 1274668 - DNA, 23 bp, Homo sapiens
ggtcagggagtgctggctcacag

SEQ ID NO: 1274669 - DNA, 19 bp, Homo sapiens
ggtcagggggagtctttgc

SEQ ID NO: 1274670 - DNA, 16 bp, Homo sapiens
ggtcaggtgccactga

SEQ ID NO: 1274671 - DNA, 17 bp, Homo sapiens
ggtcaggtggactctgg

SEQ ID NO: 1274672 - DNA, 17 bp, Homo sapiens
ggtcaggtgtcaggccc

SEQ ID NO: 1274673 - DNA, 17 bp, Homo sapiens
ggtcaggtttaacattt

SEQ ID NO: 1274674 - DNA, 14 bp, Homo sapiens
ggtcagtgctgcct

SEQ ID NO: 1274675 - DNA, 15 bp, Homo sapiens
ggtcagtgctgcctg

SEQ ID NO: 1274676 - DNA, 19 bp, Homo sapiens
ggtcagtgtggagaggggt

SEQ ID NO: 1274677 - DNA, 11 bp, Homo sapiens
ggtcataaaat

SEQ ID NO: 1274678 - DNA, 16 bp, Homo sapiens
ggtcatagtttcctga

SEQ ID NO: 1274679 - DNA, 14 bp, Homo sapiens
ggtcatcagatgcc

SEQ ID NO: 1274680 - DNA, 17 bp, Homo sapiens
ggtcatcatgaaaggtt

SEQ ID NO: 1274681 - DNA, 15 bp, Homo sapiens
ggtcatgccctcctc

SEQ ID NO: 1274682 - DNA, 16 bp, Homo sapiens
ggtcatgggccactgc

SEQ ID NO: 1274683 - DNA, 21 bp, Homo sapiens
ggtcatgtctgtaatcccagc

SEQ ID NO: 1274684 - DNA, 13 bp, Homo sapiens
ggtcatgtgtgca

SEQ ID NO: 1274685 - DNA, 19 bp, Homo sapiens
ggtcatgtttgcaggggtg

SEQ ID NO: 1274686 - DNA, 16 bp, Homo sapiens
ggtcattatttcagtg

SEQ ID NO: 1274687 - DNA, 18 bp, Homo sapiens
ggtccaaaaaaaggaaaa

SEQ ID NO: 1274688 - DNA, 22 bp, Homo sapiens
ggtccaaacccttcaactcctg

SEQ ID NO: 1274689 - DNA, 23 bp, Homo sapiens
ggtccaaacccttcaactcctgg

SEQ ID NO: 1274690 - DNA, 13 bp, Homo sapiens
ggtccaagagaca

SEQ ID NO: 1274691 - DNA, 15 bp, Homo sapiens
ggtccaagattctgg

SEQ ID NO: 1274692 - DNA, 18 bp, Homo sapiens
ggtccaatcctaggacag

SEQ ID NO: 1274693 - DNA, 17 bp, Homo sapiens
ggtccaattagtttcct

SEQ ID NO: 1274694 - DNA, 19 bp, Homo sapiens
ggtccaccagtgtgtgggg

SEQ ID NO: 1274695 - DNA, 20 bp, Homo sapiens
ggtccaccagtgtgtggggg

SEQ ID NO: 1274696 - DNA, 21 bp, Homo sapiens
ggtccaccagtgtgtggggga

SEQ ID NO: 1274697 - DNA, 16 bp, Homo sapiens
ggtccacccagcaaag

SEQ ID NO: 1274698 - DNA, 22 bp, Homo sapiens
ggtccacgcctctgctgtagct

SEQ ID NO: 1274699 - DNA, 15 bp, Homo sapiens
ggtccactccctgct

SEQ ID NO: 1274700 - DNA, 17 bp, Homo sapiens
ggtccactccctgctcc

SEQ ID NO: 1274701 - DNA, 21 bp, Homo sapiens
ggtccagaaactcctgtttct

SEQ ID NO: 1274702 - DNA, 22 bp, Homo sapiens
ggtccagcctcgttggaagagg

SEQ ID NO: 1274703 - DNA, 11 bp, Homo sapiens
ggtccagctct

SEQ ID NO: 1274704 - DNA, 13 bp, Homo sapiens
ggtccagctctga

SEQ ID NO: 1274705 - DNA, 18 bp, Homo sapiens
ggtccagctctgacatcc

SEQ ID NO: 1274706 - DNA, 22 bp, Homo sapiens
ggtccagctctgacatcccttc

SEQ ID NO: 1274707 - DNA, 14 bp, Homo sapiens
ggtccagctctgga

SEQ ID NO: 1274708 - DNA, 13 bp, Homo sapiens
ggtccagctggcc

SEQ ID NO: 1274709 - DNA, 16 bp, Homo sapiens
ggtccaggaaggcagc

SEQ ID NO: 1274710 - DNA, 17 bp, Homo sapiens
ggtccaggagagcctgg

SEQ ID NO: 1274711 - DNA, 18 bp, Homo sapiens
ggtccaggccctgtggca

SEQ ID NO: 1274712 - DNA, 21 bp, Homo sapiens
ggtccagggaagctggccgag

SEQ ID NO: 1274713 - DNA, 12 bp, Homo sapiens
ggtccagggagc

SEQ ID NO: 1274714 - DNA, 13 bp, Homo sapiens
ggtccagggctgt

SEQ ID NO: 1274715 - DNA, 18 bp, Homo sapiens
ggtccagggctgttggag

SEQ ID NO: 1274716 - DNA, 16 bp, Homo sapiens
ggtccatttgttcctg

SEQ ID NO: 1274717 - DNA, 21 bp, Homo sapiens
ggtcccaattcggggcctgct

SEQ ID NO: 1274718 - DNA, 19 bp, Homo sapiens
ggtcccacaaatgggcgcc

SEQ ID NO: 1274719 - DNA, 23 bp, Homo sapiens
ggtcccacccccaacccccagag

SEQ ID NO: 1274720 - DNA, 15 bp, Homo sapiens
ggtcccagccacccc

SEQ ID NO: 1274721 - DNA, 19 bp, Homo sapiens
ggtcccagccccaggcctg

SEQ ID NO: 1274722 - DNA, 20 bp, Homo sapiens
ggtcccagccccaggcctgg

SEQ ID NO: 1274723 - DNA, 15 bp, Homo sapiens
ggtcccagctccctg

SEQ ID NO: 1274724 - DNA, 20 bp, Homo sapiens
ggtcccagctccctggctcc

SEQ ID NO: 1274725 - DNA, 13 bp, Homo sapiens
ggtcccaggaagc

SEQ ID NO: 1274726 - DNA, 17 bp, Homo sapiens
ggtcccaggaagcaggg

SEQ ID NO: 1274727 - DNA, 14 bp, Homo sapiens
ggtcccaggcagag

SEQ ID NO: 1274728 - DNA, 13 bp, Homo sapiens
ggtcccagggctg

SEQ ID NO: 1274729 - DNA, 22 bp, Homo sapiens
ggtcccagtgggaggggcaggc

SEQ ID NO: 1274730 - DNA, 13 bp, Homo sapiens
ggtcccatccagg

SEQ ID NO: 1274731 - DNA, 16 bp, Homo sapiens
ggtcccatccaggcag

SEQ ID NO: 1274732 - DNA, 17 bp, Homo sapiens
ggtcccatccaggcagt

SEQ ID NO: 1274733 - DNA, 23 bp, Homo sapiens
ggtccccacagactgccccagcc

SEQ ID NO: 1274734 - DNA, 14 bp, Homo sapiens
ggtccccactgctg

SEQ ID NO: 1274735 - DNA, 21 bp, Homo sapiens
ggtccccatcatcccagctgc

SEQ ID NO: 1274736 - DNA, 13 bp, Homo sapiens
ggtccccatcccc

SEQ ID NO: 1274737 - DNA, 22 bp, Homo sapiens
ggtccccatccccaccagctcg

SEQ ID NO: 1274738 - DNA, 23 bp, Homo sapiens
ggtcccccgaccaatccccagcc

SEQ ID NO: 1274739 - DNA, 16 bp, Homo sapiens
ggtcccccgactgcct

SEQ ID NO: 1274740 - DNA, 18 bp, Homo sapiens
ggtcccccgactgcctgt

SEQ ID NO: 1274741 - DNA, 15 bp, Homo sapiens
ggtccccggttgctg

SEQ ID NO: 1274742 - DNA, 10 bp, Homo sapiens
ggtcccctcc

SEQ ID NO: 1274743 - DNA, 12 bp, Homo sapiens
ggtcccctccac

SEQ ID NO: 1274744 - DNA, 13 bp, Homo sapiens
ggtcccctccctc

SEQ ID NO: 1274745 - DNA, 12 bp, Homo sapiens
ggtcccctgcca

SEQ ID NO: 1274746 - DNA, 23 bp, Homo sapiens
ggtcccgcgcttcgaactccagg

SEQ ID NO: 1274747 - DNA, 17 bp, Homo sapiens
ggtcccgcttagttctt

SEQ ID NO: 1274748 - DNA, 14 bp, Homo sapiens
ggtcccggtcaccg

SEQ ID NO: 1274749 - DNA, 17 bp, Homo sapiens
ggtccctccaccccaca

SEQ ID NO: 1274750 - DNA, 21 bp, Homo sapiens
ggtccctccaccccacagaac

SEQ ID NO: 1274751 - DNA, 15 bp, Homo sapiens
ggtccctcttctctc

SEQ ID NO: 1274752 - DNA, 19 bp, Homo sapiens
ggtccctgcagaagccaga

SEQ ID NO: 1274753 - DNA, 15 bp, Homo sapiens
ggtccctggaagctt

SEQ ID NO: 1274754 - DNA, 19 bp, Homo sapiens
ggtccctggtccctcgtcc

SEQ ID NO: 1274755 - DNA, 18 bp, Homo sapiens
ggtcccttccatgccctg

SEQ ID NO: 1274756 - DNA, 18 bp, Homo sapiens
ggtcccttcccgacccag

SEQ ID NO: 1274757 - DNA, 19 bp, Homo sapiens
ggtcccttcccgacccagc

SEQ ID NO: 1274758 - DNA, 23 bp, Homo sapiens
ggtcccttcccgacccagccagc

SEQ ID NO: 1274759 - DNA, 19 bp, Homo sapiens
ggtcccttgagacctcagc

SEQ ID NO: 1274760 - DNA, 21 bp, Homo sapiens
ggtcccttgagacctcagcca

SEQ ID NO: 1274761 - DNA, 23 bp, Homo sapiens
ggtcccttgcagctagttttcta

SEQ ID NO: 1274762 - DNA, 17 bp, Homo sapiens
ggtccgcaccagctgct

SEQ ID NO: 1274763 - DNA, 19 bp, Homo sapiens
ggtccgcaccagctgctct

SEQ ID NO: 1274764 - DNA, 22 bp, Homo sapiens
ggtccgcaccagctgctctgcc

SEQ ID NO: 1274765 - DNA, 13 bp, Homo sapiens
ggtccgcggcctg

SEQ ID NO: 1274766 - DNA, 14 bp, Homo sapiens
ggtccggcgccccg

SEQ ID NO: 1274767 - DNA, 17 bp, Homo sapiens
ggtccgtgcccaggccc

SEQ ID NO: 1274768 - DNA, 19 bp, Homo sapiens
ggtccgtgcccaggccctt

SEQ ID NO: 1274769 - DNA, 22 bp, Homo sapiens
ggtcctaattaccagtctttaa

SEQ ID NO: 1274770 - DNA, 23 bp, Homo sapiens
ggtcctagaaattccccaccctg

SEQ ID NO: 1274771 - DNA, 19 bp, Homo sapiens
ggtgcaaaaaaaaacttaa

SEQ ID NO: 1274772 - DNA, 16 bp, Homo sapiens
ggtgcaaagactctga

SEQ ID NO: 1274773 - DNA, 20 bp, Homo sapiens
ggtgcaaagactctgagcca

SEQ ID NO: 1274774 - DNA, 12 bp, Homo sapiens
ggtgcaaatcct

SEQ ID NO: 1274775 - DNA, 21 bp, Homo sapiens
ggtgcacacatcaccaggtgc

SEQ ID NO: 1274776 - DNA, 22 bp, Homo sapiens
ggtgcacagcacaaattagtta

SEQ ID NO: 1274777 - DNA, 18 bp, Homo sapiens
ggtgcacagtccacagct

SEQ ID NO: 1274778 - DNA, 16 bp, Homo sapiens
ggtgcacagtgatttt

SEQ ID NO: 1274779 - DNA, 15 bp, Homo sapiens
ggtgcacccacctgt

SEQ ID NO: 1274780 - DNA, 17 bp, Homo sapiens
ggtgcacccacctgttt

SEQ ID NO: 1274781 - DNA, 22 bp, Homo sapiens
ggtgcacccacctgttttctga

SEQ ID NO: 1274782 - DNA, 20 bp, Homo sapiens
ggtgcacccactcaccaggg

SEQ ID NO: 1274783 - DNA, 17 bp, Homo sapiens
ggtgcacgcctgagcgt

SEQ ID NO: 1274784 - DNA, 15 bp, Homo sapiens
ggtgcagacagaagt

SEQ ID NO: 1274785 - DNA, 13 bp, Homo sapiens
ggtgcagaggctg

SEQ ID NO: 1274786 - DNA, 14 bp, Homo sapiens
ggtgcagaggctgt

SEQ ID NO: 1274787 - DNA, 16 bp, Homo sapiens
ggtgcagatgggctgt

SEQ ID NO: 1274788 - DNA, 20 bp, Homo sapiens
ggtgcagccccagggcctgc

SEQ ID NO: 1274789 - DNA, 15 bp, Homo sapiens
ggtgcagctgggtgg

SEQ ID NO: 1274790 - DNA, 20 bp, Homo sapiens
ggtgcagttgacagcaggtg

SEQ ID NO: 1274791 - DNA, 18 bp, Homo sapiens
ggtgcagttttccaggaa

SEQ ID NO: 1274792 - DNA, 21 bp, Homo sapiens
ggtgcatcctcctcagccccc

SEQ ID NO: 1274793 - DNA, 13 bp, Homo sapiens
ggtgcatgggctc

SEQ ID NO: 1274794 - DNA, 17 bp, Homo sapiens
ggtgcattctgtttcct

SEQ ID NO: 1274795 - DNA, 22 bp, Homo sapiens
ggtgccaagggccccaggggca

SEQ ID NO: 1274796 - DNA, 15 bp, Homo sapiens
ggtgccactccctga

SEQ ID NO: 1274797 - DNA, 16 bp, Homo sapiens
ggtgccactccctgag

SEQ ID NO: 1274798 - DNA, 17 bp, Homo sapiens
ggtgccactccctgagc

SEQ ID NO: 1274799 - DNA, 13 bp, Homo sapiens
ggtgccactgacc

SEQ ID NO: 1274800 - DNA, 14 bp, Homo sapiens
ggtgccactgaccg

SEQ ID NO: 1274801 - DNA, 14 bp, Homo sapiens
ggtgccagccttcc

SEQ ID NO: 1274802 - DNA, 12 bp, Homo sapiens
ggtgccaggaca

SEQ ID NO: 1274803 - DNA, 13 bp, Homo sapiens
ggtgccaggacaa

SEQ ID NO: 1274804 - DNA, 17 bp, Homo sapiens
ggtgccagttgggctcg

SEQ ID NO: 1274805 - DNA, 14 bp, Homo sapiens
ggtgcccaagccag

SEQ ID NO: 1274806 - DNA, 21 bp, Homo sapiens
ggtgcccaagccagaggctgg

SEQ ID NO: 1274807 - DNA, 19 bp, Homo sapiens
ggtgcccagaacttccctg

SEQ ID NO: 1274808 - DNA, 13 bp, Homo sapiens
ggtgcccatttgt

SEQ ID NO: 1274809 - DNA, 15 bp, Homo sapiens
ggtgccccacagcta

SEQ ID NO: 1274810 - DNA, 21 bp, Homo sapiens
ggtgccccacagctacctgag

SEQ ID NO: 1274811 - DNA, 21 bp, Homo sapiens
ggtgccctctgctcaggcctc

SEQ ID NO: 1274812 - DNA, 19 bp, Homo sapiens
ggtgccctgaaagggccct

SEQ ID NO: 1274813 - DNA, 15 bp, Homo sapiens
ggtgccctggatgcc

SEQ ID NO: 1274814 - DNA, 18 bp, Homo sapiens
ggtgccctggatgcccag

SEQ ID NO: 1274815 - DNA, 13 bp, Homo sapiens
ggtgccggtgctt

SEQ ID NO: 1274816 - DNA, 22 bp, Homo sapiens
ggtgcctaggttggtttcccct

SEQ ID NO: 1274817 - DNA, 17 bp, Homo sapiens
ggtgcctcagagcaggc

SEQ ID NO: 1274818 - DNA, 18 bp, Homo sapiens
ggtgcctcagagcaggct

SEQ ID NO: 1274819 - DNA, 20 bp, Homo sapiens
ggtgcctcagagcaggctca

SEQ ID NO: 1274820 - DNA, 21 bp, Homo sapiens
ggtgcctcccacacttgctgg

SEQ ID NO: 1274821 - DNA, 13 bp, Homo sapiens
ggtgcctcctgca

SEQ ID NO: 1274822 - DNA, 23 bp, Homo sapiens
ggtgcctcctgcagtttgggaga

SEQ ID NO: 1274823 - DNA, 16 bp, Homo sapiens
ggtgcctctgtgcaca

SEQ ID NO: 1274824 - DNA, 17 bp, Homo sapiens
ggtgcctgagaggcagg

SEQ ID NO: 1274825 - DNA, 23 bp, Homo sapiens
ggtgcctgggtggggctgctcct

SEQ ID NO: 1274826 - DNA, 13 bp, Homo sapiens
ggtgcctgtccca

SEQ ID NO: 1274827 - DNA, 20 bp, Homo sapiens
ggtgcgagtgtgagagtgtg

SEQ ID NO: 1274828 - DNA, 18 bp, Homo sapiens
ggtgcgtgcctgtagtgc

SEQ ID NO: 1274829 - DNA, 16 bp, Homo sapiens
ggtgcgtgttcagcag

SEQ ID NO: 1274830 - DNA, 21 bp, Homo sapiens
ggtgcgtgttcagcagaacct

SEQ ID NO: 1274831 - DNA, 21 bp, Homo sapiens
ggtgctaaagccaaccagcct

SEQ ID NO: 1274832 - DNA, 23 bp, Homo sapiens
ggtgctacacccttttccagctg

SEQ ID NO: 1274833 - DNA, 14 bp, Homo sapiens
ggtgctaggaagag

SEQ ID NO: 1274834 - DNA, 24 bp, Homo sapiens
ggtgctagtgggccctctctctgg

SEQ ID NO: 1274835 - DNA, 21 bp, Homo sapiens
ggtgctataggctggagaagc

SEQ ID NO: 1274836 - DNA, 19 bp, Homo sapiens
ggtgctcacaccccattgg

SEQ ID NO: 1274837 - DNA, 14 bp, Homo sapiens
ggtgctctctgcca

SEQ ID NO: 1274838 - DNA, 20 bp, Homo sapiens
ggtgctctgaatctgtacat

SEQ ID NO: 1274839 - DNA, 15 bp, Homo sapiens
ggtgctctgaggtca

SEQ ID NO: 1274840 - DNA, 14 bp, Homo sapiens
ggtgctctggcggc

SEQ ID NO: 1274841 - DNA, 19 bp, Homo sapiens
ggtgctctggcggcttcct

SEQ ID NO: 1274842 - DNA, 23 bp, Homo sapiens
ggtgctctgtgttcccagaggca

SEQ ID NO: 1274843 - DNA, 20 bp, Homo sapiens
ggtgctgaatgaagctgcca

SEQ ID NO: 1274844 - DNA, 20 bp, Homo sapiens
ggtgctgacaatactgctgc

SEQ ID NO: 1274845 - DNA, 21 bp, Homo sapiens
ggtgctgcaggagtgtcctgc

SEQ ID NO: 1274846 - DNA, 22 bp, Homo sapiens
ggtgctgccatgacagaggctg

SEQ ID NO: 1274847 - DNA, 16 bp, Homo sapiens
ggtgctggatattttc

SEQ ID NO: 1274848 - DNA, 14 bp, Homo sapiens
ggtgctggccccca

SEQ ID NO: 1274849 - DNA, 20 bp, Homo sapiens
ggtgctgggaggagggagag

SEQ ID NO: 1274850 - DNA, 17 bp, Homo sapiens
ggtgctgggctggactg

SEQ ID NO: 1274851 - DNA, 17 bp, Homo sapiens
ggtgctgggggcacagc

SEQ ID NO: 1274852 - DNA, 18 bp, Homo sapiens
ggtgctgggggcacagct

SEQ ID NO: 1274853 - DNA, 19 bp, Homo sapiens
ggtgctggtgggtctgagc

SEQ ID NO: 1274854 - DNA, 22 bp, Homo sapiens
ggtgctggtgggtctgagctgg

SEQ ID NO: 1274855 - DNA, 19 bp, Homo sapiens
ggtgctgtggccagggtga

SEQ ID NO: 1274856 - DNA, 13 bp, Homo sapiens
ggtgctgtttaaa

SEQ ID NO: 1274857 - DNA, 17 bp, Homo sapiens
ggtgcttacacatctca

SEQ ID NO: 1274858 - DNA, 13 bp, Homo sapiens
ggtgcttccccca

SEQ ID NO: 1274859 - DNA, 21 bp, Homo sapiens
ggtgctttttataaaaagata

SEQ ID NO: 1274860 - DNA, 21 bp, Homo sapiens
ggtggaaaggtgtgagactgg

SEQ ID NO: 1274861 - DNA, 21 bp, Homo sapiens
ggtggaaataatttgaatgta

SEQ ID NO: 1274862 - DNA, 19 bp, Homo sapiens
ggtggaacatatggtctcc

SEQ ID NO: 1274863 - DNA, 18 bp, Homo sapiens
ggtggaagccctccttcc

SEQ ID NO: 1274864 - DNA, 21 bp, Homo sapiens
ggtggaagggggtgtgcgtgc

SEQ ID NO: 1274865 - DNA, 14 bp, Homo sapiens
ggtggacagtcctg

SEQ ID NO: 1274866 - DNA, 15 bp, Homo sapiens
ggtggacagtcctgg

SEQ ID NO: 1274867 - DNA, 20 bp, Homo sapiens
ggtggaccacgccgccctcc

SEQ ID NO: 1274868 - DNA, 17 bp, Homo sapiens
ggtggaccaggcctgga

SEQ ID NO: 1274869 - DNA, 14 bp, Homo sapiens
ggtggacccaggga

SEQ ID NO: 1274870 - DNA, 16 bp, Homo sapiens
ggtggagaaagcactg

SEQ ID NO: 1274871 - DNA, 16 bp, Homo sapiens
ggtggagagcactaga

SEQ ID NO: 1274872 - DNA, 23 bp, Homo sapiens
ggtggagagggagatgtgtgagc

SEQ ID NO: 1274873 - DNA, 15 bp, Homo sapiens
ggtggagcagccaga

SEQ ID NO: 1274874 - DNA, 19 bp, Homo sapiens
ggtggagcagccagagctg

SEQ ID NO: 1274875 - DNA, 13 bp, Homo sapiens
ggtggagccaggg

SEQ ID NO: 1274876 - DNA, 14 bp, Homo sapiens
ggtggagggaagga

SEQ ID NO: 1274877 - DNA, 21 bp, Homo sapiens
ggtggagggcacttcaggtcc

SEQ ID NO: 1274878 - DNA, 20 bp, Homo sapiens
ggtggagggtggggggcgct

SEQ ID NO: 1274879 - DNA, 14 bp, Homo sapiens
ggtggatggcccca

SEQ ID NO: 1274880 - DNA, 17 bp, Homo sapiens
ggtggcaatgcttaaac

SEQ ID NO: 1274881 - DNA, 23 bp, Homo sapiens
ggtggcacaggagtgtcctcttc

SEQ ID NO: 1274882 - DNA, 15 bp, Homo sapiens
ggtggcacaggcact

SEQ ID NO: 1274883 - DNA, 20 bp, Homo sapiens
ggtggcaccagcagcctgga

SEQ ID NO: 1274884 - DNA, 14 bp, Homo sapiens
ggtggcacctgttt

SEQ ID NO: 1274885 - DNA, 18 bp, Homo sapiens
ggtggcacgggccctccc

SEQ ID NO: 1274886 - DNA, 19 bp, Homo sapiens
ggtggcacgggccctccct

SEQ ID NO: 1274887 - DNA, 16 bp, Homo sapiens
ggtggcactgagcccc

SEQ ID NO: 1274888 - DNA, 17 bp, Homo sapiens
ggtggcagatgtcttcc

SEQ ID NO: 1274889 - DNA, 14 bp, Homo sapiens
ggtggcagcaacaa

SEQ ID NO: 1274890 - DNA, 17 bp, Homo sapiens
ggtggcaggaccaggac

SEQ ID NO: 1274891 - DNA, 18 bp, Homo sapiens
ggtggcaggaccaggact

SEQ ID NO: 1274892 - DNA, 23 bp, Homo sapiens
gtaaaggtttatttttctgttac

SEQ ID NO: 1274893 - DNA, 17 bp, Homo sapiens
gtaaagtatgtattatt

SEQ ID NO: 1274894 - DNA, 22 bp, Homo sapiens
gtaaagtatgtattatttacat

SEQ ID NO: 1274895 - DNA, 21 bp, Homo sapiens
gtaaagtatgtttttaaattt

SEQ ID NO: 1274896 - DNA, 19 bp, Homo sapiens
gtaaagtatgtttttacat

SEQ ID NO: 1274897 - DNA, 18 bp, Homo sapiens
gtaaagttggttggataa

SEQ ID NO: 1274898 - DNA, 19 bp, Homo sapiens
gtaaagtttgttgaaaaca

SEQ ID NO: 1274899 - DNA, 16 bp, Homo sapiens
gtaaataaaatgtgta

SEQ ID NO: 1274900 - DNA, 14 bp, Homo sapiens
gtaaataatttatt

SEQ ID NO: 1274901 - DNA, 18 bp, Homo sapiens
gtaaataattttctaaga

SEQ ID NO: 1274902 - DNA, 21 bp, Homo sapiens
gtaaatacaaattttgtataa

SEQ ID NO: 1274903 - DNA, 19 bp, Homo sapiens
gtaaatacacaacacacac

SEQ ID NO: 1274904 - DNA, 14 bp, Homo sapiens
gtaaatacaggtag

SEQ ID NO: 1274905 - DNA, 16 bp, Homo sapiens
gtaaatactcatgaat

SEQ ID NO: 1274906 - DNA, 23 bp, Homo sapiens
gtaaatactggactcaggaactt

SEQ ID NO: 1274907 - DNA, 13 bp, Homo sapiens
gtaaataggtttc

SEQ ID NO: 1274908 - DNA, 21 bp, Homo sapiens
gtaaataggtttctaaaaagt

SEQ ID NO: 1274909 - DNA, 16 bp, Homo sapiens
gtaaatataatcagac

SEQ ID NO: 1274910 - DNA, 19 bp, Homo sapiens
gtaaatatataaatatata

SEQ ID NO: 1274911 - DNA, 19 bp, Homo sapiens
gtaaatatattatatatgg

SEQ ID NO: 1274912 - DNA, 19 bp, Homo sapiens
gtaaatatccctcccctct

SEQ ID NO: 1274913 - DNA, 16 bp, Homo sapiens
gtaaatattcatatta

SEQ ID NO: 1274914 - DNA, 13 bp, Homo sapiens
gtaaatattctat

SEQ ID NO: 1274915 - DNA, 12 bp, Homo sapiens
gtaaatattctt

SEQ ID NO: 1274916 - DNA, 13 bp, Homo sapiens
gtaaatattttga

SEQ ID NO: 1274917 - DNA, 15 bp, Homo sapiens
gtaaatatttttccc

SEQ ID NO: 1274918 - DNA, 16 bp, Homo sapiens
gtaaatcaaatttgaa

SEQ ID NO: 1274919 - DNA, 15 bp, Homo sapiens
gtaaatcagaaagta

SEQ ID NO: 1274920 - DNA, 14 bp, Homo sapiens
gtaaatcagtaaga

SEQ ID NO: 1274921 - DNA, 20 bp, Homo sapiens
gtaaatcctagacttgaaag

SEQ ID NO: 1274922 - DNA, 21 bp, Homo sapiens
gtaaatcctagacttgaaagt

SEQ ID NO: 1274923 - DNA, 16 bp, Homo sapiens
gtaaatcctgccattt

SEQ ID NO: 1274924 - DNA, 21 bp, Homo sapiens
gtaaatctaacattattactt

SEQ ID NO: 1274925 - DNA, 21 bp, Homo sapiens
gtaaatctgaagaaagttatt

SEQ ID NO: 1274926 - DNA, 12 bp, Homo sapiens
gtaaatgatgtg

SEQ ID NO: 1274927 - DNA, 19 bp, Homo sapiens
gtaaatgctcattttcttt

SEQ ID NO: 1274928 - DNA, 22 bp, Homo sapiens
gtaaatgctcattttctttagg

SEQ ID NO: 1274929 - DNA, 19 bp, Homo sapiens
gtaaatgctcgtgtgattt

SEQ ID NO: 1274930 - DNA, 21 bp, Homo sapiens
gtaaatgctcgtgtgatttcc

SEQ ID NO: 1274931 - DNA, 22 bp, Homo sapiens
gtaaatggtatgatcaataaag

SEQ ID NO: 1274932 - DNA, 20 bp, Homo sapiens
gtaaatggtgtacataatgt

SEQ ID NO: 1274933 - DNA, 16 bp, Homo sapiens
gtaaatggttaaattt

SEQ ID NO: 1274934 - DNA, 21 bp, Homo sapiens
gtaaatggttaaattttacat

SEQ ID NO: 1274935 - DNA, 23 bp, Homo sapiens
gtaaatggttaaattttacatga

SEQ ID NO: 1274936 - DNA, 18 bp, Homo sapiens
gtaaatgtggattttgta

SEQ ID NO: 1274937 - DNA, 20 bp, Homo sapiens
gtaaatgtggattttgtaga

SEQ ID NO: 1274938 - DNA, 21 bp, Homo sapiens
gtaaatgtgttagcactgata

SEQ ID NO: 1274939 - DNA, 22 bp, Homo sapiens
gtaaattaacttttataaactt

SEQ ID NO: 1274940 - DNA, 15 bp, Homo sapiens
gtaaattattgtaaa

SEQ ID NO: 1274941 - DNA, 17 bp, Homo sapiens
gtaaattatttgctaag

SEQ ID NO: 1274942 - DNA, 15 bp, Homo sapiens
gtaaattctggtata

SEQ ID NO: 1274943 - DNA, 16 bp, Homo sapiens
gtaaattggaaacatt

SEQ ID NO: 1274944 - DNA, 20 bp, Homo sapiens
gtaaattgtcgggggagaga

SEQ ID NO: 1274945 - DNA, 19 bp, Homo sapiens
gtaaatttagcatatcaat

SEQ ID NO: 1274946 - DNA, 12 bp, Homo sapiens
gtaaatttttga

SEQ ID NO: 1274947 - DNA, 19 bp, Homo sapiens
gtaaatttttgaaaaatat

SEQ ID NO: 1274948 - DNA, 13 bp, Homo sapiens
gtaacaaatgaac

SEQ ID NO: 1274949 - DNA, 22 bp, Homo sapiens
gtaacaaattgggatctgtctt

SEQ ID NO: 1274950 - DNA, 12 bp, Homo sapiens
gtaacaagaaaa

SEQ ID NO: 1274951 - DNA, 18 bp, Homo sapiens
gtaacaagaaagtggtct

SEQ ID NO: 1274952 - DNA, 13 bp, Homo sapiens
gtaacaagccaga

SEQ ID NO: 1274953 - DNA, 15 bp, Homo sapiens
gtaacaagccagatt

SEQ ID NO: 1274954 - DNA, 16 bp, Homo sapiens
gtaacaagccagattt

SEQ ID NO: 1274955 - DNA, 15 bp, Homo sapiens
gtaacaaggtgtctt

SEQ ID NO: 1274956 - DNA, 14 bp, Homo sapiens
gtaacaatacaaat

SEQ ID NO: 1274957 - DNA, 17 bp, Homo sapiens
gtaacaatacatgagaa

SEQ ID NO: 1274958 - DNA, 20 bp, Homo sapiens
gtaacaatacatgagaaaga

SEQ ID NO: 1274959 - DNA, 19 bp, Homo sapiens
gtaacacaagccacagaag

SEQ ID NO: 1274960 - DNA, 15 bp, Homo sapiens
gtaacactaatatat

SEQ ID NO: 1274961 - DNA, 11 bp, Homo sapiens
gtaacagacac

SEQ ID NO: 1274962 - DNA, 16 bp, Homo sapiens
gtaacagctgaggtct

SEQ ID NO: 1274963 - DNA, 16 bp, Homo sapiens
gtaacagggcagaaat

SEQ ID NO: 1274964 - DNA, 18 bp, Homo sapiens
gtaacataactgcttctt

SEQ ID NO: 1274965 - DNA, 19 bp, Homo sapiens
gtaacatcataattacatt

SEQ ID NO: 1274966 - DNA, 14 bp, Homo sapiens
gtaacatccagaag

SEQ ID NO: 1274967 - DNA, 12 bp, Homo sapiens
gtaacatgatgt

SEQ ID NO: 1274968 - DNA, 18 bp, Homo sapiens
gtaacatttatagaagaa

SEQ ID NO: 1274969 - DNA, 14 bp, Homo sapiens
gtaacatttgctgt

SEQ ID NO: 1274970 - DNA, 22 bp, Homo sapiens
gtaacatttgctgttttaaaca

SEQ ID NO: 1274971 - DNA, 20 bp, Homo sapiens
gtaaccaaatattaaagatt

SEQ ID NO: 1274972 - DNA, 20 bp, Homo sapiens
gtaaccaagagttaagatat

SEQ ID NO: 1274973 - DNA, 23 bp, Homo sapiens
gtaacccagattttgctgtatat

SEQ ID NO: 1274974 - DNA, 21 bp, Homo sapiens
gtaaccgtaacccacccccaa

SEQ ID NO: 1274975 - DNA, 15 bp, Homo sapiens
gtaacctcagctctg

SEQ ID NO: 1274976 - DNA, 18 bp, Homo sapiens
gtaacctcttcagaggcc

SEQ ID NO: 1274977 - DNA, 17 bp, Homo sapiens
gtaacctggccactgtc

SEQ ID NO: 1274978 - DNA, 21 bp, Homo sapiens
gtaacgagggcaacagggagc

SEQ ID NO: 1274979 - DNA, 16 bp, Homo sapiens
gtaacgcgtcttcctg

SEQ ID NO: 1274980 - DNA, 17 bp, Homo sapiens
gtaacgcgtcttcctga

SEQ ID NO: 1274981 - DNA, 17 bp, Homo sapiens
gtaacgtgattgattca

SEQ ID NO: 1274982 - DNA, 16 bp, Homo sapiens
gtaacgtgctgctcaa

SEQ ID NO: 1274983 - DNA, 13 bp, Homo sapiens
gtaactaaaataa

SEQ ID NO: 1274984 - DNA, 20 bp, Homo sapiens
gtaactacaaagctttgcta

SEQ ID NO: 1274985 - DNA, 17 bp, Homo sapiens
gtaactactgctaatgt

SEQ ID NO: 1274986 - DNA, 18 bp, Homo sapiens
gtaactactgctaatgtt

SEQ ID NO: 1274987 - DNA, 14 bp, Homo sapiens
gtaactactttata

SEQ ID NO: 1274988 - DNA, 19 bp, Homo sapiens
gtaactactttttatactc

SEQ ID NO: 1274989 - DNA, 20 bp, Homo sapiens
gtaactactttttatactcc

SEQ ID NO: 1274990 - DNA, 12 bp, Homo sapiens
gtaactccacca

SEQ ID NO: 1274991 - DNA, 19 bp, Homo sapiens
gtaactctaattcccattt

SEQ ID NO: 1274992 - DNA, 12 bp, Homo sapiens
gtaactctccag

SEQ ID NO: 1274993 - DNA, 18 bp, Homo sapiens
gtaactgaggtaaaatgt

SEQ ID NO: 1274994 - DNA, 13 bp, Homo sapiens
gtaactgcccagc

SEQ ID NO: 1274995 - DNA, 16 bp, Homo sapiens
gtaactgcccagcccc

SEQ ID NO: 1274996 - DNA, 14 bp, Homo sapiens
gtaactgctgagcc

SEQ ID NO: 1274997 - DNA, 16 bp, Homo sapiens
gtaactgctgagccac

SEQ ID NO: 1274998 - DNA, 18 bp, Homo sapiens
gtaactgctgagccactc

SEQ ID NO: 1274999 - DNA, 17 bp, Homo sapiens
gtaactgctttctgttc

SEQ ID NO: 1275000 - DNA, 19 bp, Homo sapiens
gtaactgctttctgttcca

SEQ ID NO: 1275001 - DNA, 20 bp, Homo sapiens
gtaactgctttctgttccaa

SEQ ID NO: 1275002 - DNA, 15 bp, Homo sapiens
gtaactggttgctgt

SEQ ID NO: 1275003 - DNA, 13 bp, Homo sapiens
gtaactgtcctgt

SEQ ID NO: 1275004 - DNA, 16 bp, Homo sapiens
gtaacttaaggacctt

SEQ ID NO: 1275005 - DNA, 17 bp, Homo sapiens
gtaacttcctgctgcac

SEQ ID NO: 1275006 - DNA, 21 bp, Homo sapiens
gtaacttgcttaaatttctta

SEQ ID NO: 1275007 - DNA, 13 bp, Homo sapiens
gtaactttaaaca

SEQ ID NO: 1275008 - DNA, 16 bp, Homo sapiens
gtaactttaaacatct

SEQ ID NO: 1275009 - DNA, 17 bp, Homo sapiens
gtaactttaaacatcta

SEQ ID NO: 1275010 - DNA, 15 bp, Homo sapiens
gtaactttatgtgta

SEQ ID NO: 1275011 - DNA, 18 bp, Homo sapiens
gtaactttgcaggcggcc

SEQ ID NO: 1275012 - DNA, 19 bp, Homo sapiens
gtaacttttgtaaatacac

SEQ ID NO: 1275013 - DNA, 16 bp, Homo sapiens
gtaactttttttcagt

SEQ ID NO: 1275014 - DNA, 19 bp, Homo sapiens
gtacatgaaaacacatttt

SEQ ID NO: 1275015 - DNA, 20 bp, Homo sapiens
gtacatgaaaacacattttt

SEQ ID NO: 1275016 - DNA, 11 bp, Homo sapiens
gtacatgagaa

SEQ ID NO: 1275017 - DNA, 21 bp, Homo sapiens
gtacatgctatgctgaagaca

SEQ ID NO: 1275018 - DNA, 21 bp, Homo sapiens
gtacattataaaccttcagaa

SEQ ID NO: 1275019 - DNA, 14 bp, Homo sapiens
gtacattctagctg

SEQ ID NO: 1275020 - DNA, 12 bp, Homo sapiens
gtacattctgcc

SEQ ID NO: 1275021 - DNA, 14 bp, Homo sapiens
gtacattctgccta

SEQ ID NO: 1275022 - DNA, 21 bp, Homo sapiens
gtacattctgcctagagtgta

SEQ ID NO: 1275023 - DNA, 23 bp, Homo sapiens
gtacattcttccatcatcactgt

SEQ ID NO: 1275024 - DNA, 14 bp, Homo sapiens
gtacatttaaattt

SEQ ID NO: 1275025 - DNA, 13 bp, Homo sapiens
gtacatttaataa

SEQ ID NO: 1275026 - DNA, 19 bp, Homo sapiens
gtacatttatttattactg

SEQ ID NO: 1275027 - DNA, 18 bp, Homo sapiens
gtacatttccaaatgaac

SEQ ID NO: 1275028 - DNA, 17 bp, Homo sapiens
gtacatttctctgagca

SEQ ID NO: 1275029 - DNA, 18 bp, Homo sapiens
gtacatttttggggggag

SEQ ID NO: 1275030 - DNA, 22 bp, Homo sapiens
gtacatttttggggggagagac

SEQ ID NO: 1275031 - DNA, 22 bp, Homo sapiens
gtaccacagacacaatatgtat

SEQ ID NO: 1275032 - DNA, 17 bp, Homo sapiens
gtaccagctgcgcttgc

SEQ ID NO: 1275033 - DNA, 10 bp, Homo sapiens
gtaccagtta

SEQ ID NO: 1275034 - DNA, 11 bp, Homo sapiens
gtaccagttaa

SEQ ID NO: 1275035 - DNA, 17 bp, Homo sapiens
gtaccatagaaaaatgt

SEQ ID NO: 1275036 - DNA, 16 bp, Homo sapiens
gtaccatcaataaagt

SEQ ID NO: 1275037 - DNA, 17 bp, Homo sapiens
gtaccatcaataaagta

SEQ ID NO: 1275038 - DNA, 18 bp, Homo sapiens
gtaccattccttcaaata

SEQ ID NO: 1275039 - DNA, 23 bp, Homo sapiens
gtaccatttaatggggaggacaa

SEQ ID NO: 1275040 - DNA, 21 bp, Homo sapiens
gtaccatttatacaaattaga

SEQ ID NO: 1275041 - DNA, 13 bp, Homo sapiens
gtaccattttaaa

SEQ ID NO: 1275042 - DNA, 23 bp, Homo sapiens
gtacccaccccagcacagccacc

SEQ ID NO: 1275043 - DNA, 18 bp, Homo sapiens
gtacccagccatgtgttg

SEQ ID NO: 1275044 - DNA, 12 bp, Homo sapiens
gtacccagctcc

SEQ ID NO: 1275045 - DNA, 13 bp, Homo sapiens
gtaccccaccctc

SEQ ID NO: 1275046 - DNA, 23 bp, Homo sapiens
gtaccccaccctcagcacccctt

SEQ ID NO: 1275047 - DNA, 17 bp, Homo sapiens
gtaccccctttcccttc

SEQ ID NO: 1275048 - DNA, 17 bp, Homo sapiens
gtaccctcctggctctt

SEQ ID NO: 1275049 - DNA, 15 bp, Homo sapiens
gtaccctctggaggg

SEQ ID NO: 1275050 - DNA, 14 bp, Homo sapiens
gtaccgaatcaact

SEQ ID NO: 1275051 - DNA, 17 bp, Homo sapiens
gtaccgtcgacaagaat

SEQ ID NO: 1275052 - DNA, 16 bp, Homo sapiens
gtacctagctgtaatg

SEQ ID NO: 1275053 - DNA, 13 bp, Homo sapiens
gtacctataaagt

SEQ ID NO: 1275054 - DNA, 21 bp, Homo sapiens
gtacctataaagtaaagctaa

SEQ ID NO: 1275055 - DNA, 14 bp, Homo sapiens
gtacctatagaaat

SEQ ID NO: 1275056 - DNA, 14 bp, Homo sapiens
gtacctatttctga

SEQ ID NO: 1275057 - DNA, 20 bp, Homo sapiens
gtacctatttctgatgatgt

SEQ ID NO: 1275058 - DNA, 19 bp, Homo sapiens
gtacctcaagccccatttc

SEQ ID NO: 1275059 - DNA, 12 bp, Homo sapiens
gtacctcagtgg

SEQ ID NO: 1275060 - DNA, 19 bp, Homo sapiens
gtacctcctctcagtgttt

SEQ ID NO: 1275061 - DNA, 18 bp, Homo sapiens
gtacctctagctgttctt

SEQ ID NO: 1275062 - DNA, 12 bp, Homo sapiens
gtacctctcaag

SEQ ID NO: 1275063 - DNA, 13 bp, Homo sapiens
gtacctcttgagc

SEQ ID NO: 1275064 - DNA, 21 bp, Homo sapiens
gtacctcttgagccttgaact

SEQ ID NO: 1275065 - DNA, 18 bp, Homo sapiens
gtacctgaaaagtaactt

SEQ ID NO: 1275066 - DNA, 19 bp, Homo sapiens
gtacctgctgccccagctg

SEQ ID NO: 1275067 - DNA, 18 bp, Homo sapiens
gtacctgggaaaggaccc

SEQ ID NO: 1275068 - DNA, 21 bp, Homo sapiens
gtacctgtagtgagaaactga

SEQ ID NO: 1275069 - DNA, 19 bp, Homo sapiens
gtacctgtgggttagcatc

SEQ ID NO: 1275070 - DNA, 17 bp, Homo sapiens
gtacctgttcctccccc

SEQ ID NO: 1275071 - DNA, 18 bp, Homo sapiens
gtaccttcagccctggcc

SEQ ID NO: 1275072 - DNA, 15 bp, Homo sapiens
gtaccttgtgcccag

SEQ ID NO: 1275073 - DNA, 15 bp, Homo sapiens
gtacctttctagcct

SEQ ID NO: 1275074 - DNA, 16 bp, Homo sapiens
gtacctttctagcctt

SEQ ID NO: 1275075 - DNA, 18 bp, Homo sapiens
gtacctttctagccttag

SEQ ID NO: 1275076 - DNA, 23 bp, Homo sapiens
gtacgaacctacagttttaactg

SEQ ID NO: 1275077 - DNA, 22 bp, Homo sapiens
gtacgatcaagttgttgactgt

SEQ ID NO: 1275078 - DNA, 23 bp, Homo sapiens
gtacgatcaagttgttgactgtg

SEQ ID NO: 1275079 - DNA, 14 bp, Homo sapiens
gtacgcccaggaca

SEQ ID NO: 1275080 - DNA, 23 bp, Homo sapiens
gtacgtcccagcggcctcagggt

SEQ ID NO: 1275081 - DNA, 17 bp, Homo sapiens
gtacgtttgtatgtgtg

SEQ ID NO: 1275082 - DNA, 14 bp, Homo sapiens
gtactaagccagga

SEQ ID NO: 1275083 - DNA, 23 bp, Homo sapiens
gtactaaggaatctttctgcttt

SEQ ID NO: 1275084 - DNA, 16 bp, Homo sapiens
gtactaaggagcatga

SEQ ID NO: 1275085 - DNA, 15 bp, Homo sapiens
gtactacctgtgtat

SEQ ID NO: 1275086 - DNA, 19 bp, Homo sapiens
gtactagatgcatcactgg

SEQ ID NO: 1275087 - DNA, 21 bp, Homo sapiens
gtactagatgcatcactgggt

SEQ ID NO: 1275088 - DNA, 14 bp, Homo sapiens
gtactagtgttctg

SEQ ID NO: 1275089 - DNA, 17 bp, Homo sapiens
gtactagtgttctgttt

SEQ ID NO: 1275090 - DNA, 17 bp, Homo sapiens
gtactagttacacatct

SEQ ID NO: 1275091 - DNA, 17 bp, Homo sapiens
gtactatgatgggcttc

SEQ ID NO: 1275092 - DNA, 13 bp, Homo sapiens
gtactatgtctga

SEQ ID NO: 1275093 - DNA, 13 bp, Homo sapiens
gtactatgttaat

SEQ ID NO: 1275094 - DNA, 17 bp, Homo sapiens
gtactcacttttcactt

SEQ ID NO: 1275095 - DNA, 13 bp, Homo sapiens
gtactcagagcag

SEQ ID NO: 1275096 - DNA, 14 bp, Homo sapiens
gtactcagagcaga

SEQ ID NO: 1275097 - DNA, 16 bp, Homo sapiens
gtactcatcggcaggc

SEQ ID NO: 1275098 - DNA, 17 bp, Homo sapiens
gtactccagcctgggtg

SEQ ID NO: 1275099 - DNA, 15 bp, Homo sapiens
gtactccctgcaccg

SEQ ID NO: 1275100 - DNA, 22 bp, Homo sapiens
gtactccctgcaccgtctcact

SEQ ID NO: 1275101 - DNA, 16 bp, Homo sapiens
gtactcctcacttttc

SEQ ID NO: 1275102 - DNA, 22 bp, Homo sapiens
gtactctacaattcctctgata

SEQ ID NO: 1275103 - DNA, 17 bp, Homo sapiens
gtactctacgccaaagt

SEQ ID NO: 1275104 - DNA, 14 bp, Homo sapiens
gtactctcctagag

SEQ ID NO: 1275105 - DNA, 15 bp, Homo sapiens
gtactctctgctcta

SEQ ID NO: 1275106 - DNA, 21 bp, Homo sapiens
gtactctgttgagtaaaacac

SEQ ID NO: 1275107 - DNA, 13 bp, Homo sapiens
gtactcttccgaa

SEQ ID NO: 1275108 - DNA, 14 bp, Homo sapiens
gtactcttccgaaa

SEQ ID NO: 1275109 - DNA, 22 bp, Homo sapiens
gtactcttccgaaaaatcctct

SEQ ID NO: 1275110 - DNA, 23 bp, Homo sapiens
gtactctttatttctagcagagt

SEQ ID NO: 1275111 - DNA, 20 bp, Homo sapiens
gtactgaagaaaaggggagc

SEQ ID NO: 1275112 - DNA, 19 bp, Homo sapiens
gtactgaagactctgcagc

SEQ ID NO: 1275113 - DNA, 15 bp, Homo sapiens
gtactgagacagggt

SEQ ID NO: 1275114 - DNA, 17 bp, Homo sapiens
gtactgagacagggtgc

SEQ ID NO: 1275115 - DNA, 14 bp, Homo sapiens
gtactgataaaata

SEQ ID NO: 1275116 - DNA, 20 bp, Homo sapiens
gtactgcattctctcccatc

SEQ ID NO: 1275117 - DNA, 21 bp, Homo sapiens
gtactgccccccatgaggaag

SEQ ID NO: 1275118 - DNA, 23 bp, Homo sapiens
gtactgccccccatgaggaagga

SEQ ID NO: 1275119 - DNA, 16 bp, Homo sapiens
gtactgcctgccaccg

SEQ ID NO: 1275120 - DNA, 16 bp, Homo sapiens
gtactggaataaacag

SEQ ID NO: 1275121 - DNA, 18 bp, Homo sapiens
gtactggaataaacagtg

SEQ ID NO: 1275122 - DNA, 12 bp, Homo sapiens
gtactggcacaa

SEQ ID NO: 1275123 - DNA, 19 bp, Homo sapiens
gtactggtaagattgttat

SEQ ID NO: 1275124 - DNA, 13 bp, Homo sapiens
gtactggtccctt

SEQ ID NO: 1275125 - DNA, 16 bp, Homo sapiens
gtactggtcccttcct

SEQ ID NO: 1275126 - DNA, 19 bp, Homo sapiens
gtactgtaactgctcagag

SEQ ID NO: 1275127 - DNA, 14 bp, Homo sapiens
gtactgtagttttt

SEQ ID NO: 1275128 - DNA, 16 bp, Homo sapiens
gtactgtattgggctt

SEQ ID NO: 1275129 - DNA, 15 bp, Homo sapiens
gtactgtctgttatg

SEQ ID NO: 1275130 - DNA, 13 bp, Homo sapiens
gtactgtgcctgg

SEQ ID NO: 1275131 - DNA, 17 bp, Homo sapiens
gtactgttcggaagggg

SEQ ID NO: 1275132 - DNA, 19 bp, Homo sapiens
gtacttaaatgaaagcatg

SEQ ID NO: 1275133 - DNA, 19 bp, Homo sapiens
gtacttaaatgagttactt

SEQ ID NO: 1275134 - DNA, 23 bp, Homo sapiens
gtacttagccagttcaaagtgta

SEQ ID NO: 1275135 - DNA, 21 bp, Homo sapiens
gtacttcactgtcaggaagaa

SEQ ID NO: 1275136 - DNA, 19 bp, Homo sapiens
gtagtttatggcagaaggg

SEQ ID NO: 1275137 - DNA, 18 bp, Homo sapiens
gtagtttggatatttttg

SEQ ID NO: 1275138 - DNA, 19 bp, Homo sapiens
gtagtttggatatttttgt

SEQ ID NO: 1275139 - DNA, 11 bp, Homo sapiens
gtagtttttca

SEQ ID NO: 1275140 - DNA, 17 bp, Homo sapiens
gtagtttttcttcaaca

SEQ ID NO: 1275141 - DNA, 14 bp, Homo sapiens
gtagttttttcatc

SEQ ID NO: 1275142 - DNA, 21 bp, Homo sapiens
gtataaaaaggaaattagtct

SEQ ID NO: 1275143 - DNA, 19 bp, Homo sapiens
gtataaaactttcctcgcc

SEQ ID NO: 1275144 - DNA, 16 bp, Homo sapiens
gtataaaatccataga

SEQ ID NO: 1275145 - DNA, 21 bp, Homo sapiens
gtataaacatgaccctgggct

SEQ ID NO: 1275146 - DNA, 16 bp, Homo sapiens
gtataaactgctgtca

SEQ ID NO: 1275147 - DNA, 13 bp, Homo sapiens
gtataaagaaaag

SEQ ID NO: 1275148 - DNA, 13 bp, Homo sapiens
gtataaagacaag

SEQ ID NO: 1275149 - DNA, 18 bp, Homo sapiens
gtataaagattgtactta

SEQ ID NO: 1275150 - DNA, 21 bp, Homo sapiens
gtataaagcaactgttatgaa

SEQ ID NO: 1275151 - DNA, 13 bp, Homo sapiens
gtataaataagag

SEQ ID NO: 1275152 - DNA, 19 bp, Homo sapiens
gtataaataataaagaact

SEQ ID NO: 1275153 - DNA, 22 bp, Homo sapiens
gtataaatgacaaagtgttgaa

SEQ ID NO: 1275154 - DNA, 23 bp, Homo sapiens
gtataaatgacaaagtgttgaaa

SEQ ID NO: 1275155 - DNA, 22 bp, Homo sapiens
gtataaattaaataaactgttt

SEQ ID NO: 1275156 - DNA, 21 bp, Homo sapiens
gtataaattatcttatgaaaa

SEQ ID NO: 1275157 - DNA, 13 bp, Homo sapiens
gtataaatttatt

SEQ ID NO: 1275158 - DNA, 14 bp, Homo sapiens
gtataaatttattt

SEQ ID NO: 1275159 - DNA, 23 bp, Homo sapiens
gtataaatttatttactgctagt

SEQ ID NO: 1275160 - DNA, 15 bp, Homo sapiens
gtataaccaagtgtg

SEQ ID NO: 1275161 - DNA, 19 bp, Homo sapiens
gtataaccaagtgtgctct

SEQ ID NO: 1275162 - DNA, 21 bp, Homo sapiens
gtataacggtttaattctgtc

SEQ ID NO: 1275163 - DNA, 20 bp, Homo sapiens
gtataacttttgatgacttc

SEQ ID NO: 1275164 - DNA, 23 bp, Homo sapiens
gtataagccacttgtcttgaaaa

SEQ ID NO: 1275165 - DNA, 14 bp, Homo sapiens
gtataagtcaagca

SEQ ID NO: 1275166 - DNA, 17 bp, Homo sapiens
gtataagtcaagcacat

SEQ ID NO: 1275167 - DNA, 20 bp, Homo sapiens
gtataagtggaggcacttta

SEQ ID NO: 1275168 - DNA, 18 bp, Homo sapiens
gtataagttgctgtaaaa

SEQ ID NO: 1275169 - DNA, 14 bp, Homo sapiens
gtataatctttcta

SEQ ID NO: 1275170 - DNA, 19 bp, Homo sapiens
gtataatggttgactgggt

SEQ ID NO: 1275171 - DNA, 21 bp, Homo sapiens
gtataatggttgactgggttt

SEQ ID NO: 1275172 - DNA, 14 bp, Homo sapiens
gtataatgtgtctg

SEQ ID NO: 1275173 - DNA, 21 bp, Homo sapiens
gtataatgtgtctgtgttgct

SEQ ID NO: 1275174 - DNA, 13 bp, Homo sapiens
gtataatgtttaa

SEQ ID NO: 1275175 - DNA, 19 bp, Homo sapiens
gtataatgtttaaatcatg

SEQ ID NO: 1275176 - DNA, 15 bp, Homo sapiens
gtataatgtttatta

SEQ ID NO: 1275177 - DNA, 20 bp, Homo sapiens
gtataatgtttattaaatgc

SEQ ID NO: 1275178 - DNA, 19 bp, Homo sapiens
gtataattggatttcctaa

SEQ ID NO: 1275179 - DNA, 13 bp, Homo sapiens
gtatacacacata

SEQ ID NO: 1275180 - DNA, 15 bp, Homo sapiens
gtatacacacatata

SEQ ID NO: 1275181 - DNA, 12 bp, Homo sapiens
gtatacatgcca

SEQ ID NO: 1275182 - DNA, 21 bp, Homo sapiens
gtatacattttgttatagaat

SEQ ID NO: 1275183 - DNA, 19 bp, Homo sapiens
gtataccaatgtgttttct

SEQ ID NO: 1275184 - DNA, 14 bp, Homo sapiens
gtataccacctgta

SEQ ID NO: 1275185 - DNA, 17 bp, Homo sapiens
gtataccacctgtacat

SEQ ID NO: 1275186 - DNA, 18 bp, Homo sapiens
gtataccacctgtacata

SEQ ID NO: 1275187 - DNA, 21 bp, Homo sapiens
gtataccacctgtacatacat

SEQ ID NO: 1275188 - DNA, 15 bp, Homo sapiens
gtatacctgattttt

SEQ ID NO: 1275189 - DNA, 18 bp, Homo sapiens
gtatacgtataaatatca

SEQ ID NO: 1275190 - DNA, 23 bp, Homo sapiens
gtatactagggagccatttgaga

SEQ ID NO: 1275191 - DNA, 23 bp, Homo sapiens
gtatactgtaaaagttataataa

SEQ ID NO: 1275192 - DNA, 11 bp, Homo sapiens
gtatactgtgt

SEQ ID NO: 1275193 - DNA, 14 bp, Homo sapiens
gtatagaaaatctt

SEQ ID NO: 1275194 - DNA, 14 bp, Homo sapiens
gtatagaaatgctg

SEQ ID NO: 1275195 - DNA, 18 bp, Homo sapiens
gtatagaagtctggaaaa

SEQ ID NO: 1275196 - DNA, 14 bp, Homo sapiens
gtatagaccaaagc

SEQ ID NO: 1275197 - DNA, 15 bp, Homo sapiens
gtataggccatctgt

SEQ ID NO: 1275198 - DNA, 22 bp, Homo sapiens
gtataggccatctgtaaatatc

SEQ ID NO: 1275199 - DNA, 18 bp, Homo sapiens
gtataggtagatccagat

SEQ ID NO: 1275200 - DNA, 15 bp, Homo sapiens
gtatagtatctgtat

SEQ ID NO: 1275201 - DNA, 21 bp, Homo sapiens
gtatagtgtctattatcacat

SEQ ID NO: 1275202 - DNA, 22 bp, Homo sapiens
gtatagtgttcacaaactgtga

SEQ ID NO: 1275203 - DNA, 23 bp, Homo sapiens
gtatagtgttcacaaactgtgaa

SEQ ID NO: 1275204 - DNA, 14 bp, Homo sapiens
gtatagttaacaca

SEQ ID NO: 1275205 - DNA, 20 bp, Homo sapiens
gtatagttttataaaactca

SEQ ID NO: 1275206 - DNA, 14 bp, Homo sapiens
gtatataaaaatgg

SEQ ID NO: 1275207 - DNA, 23 bp, Homo sapiens
gtatataatttactttgtagact

SEQ ID NO: 1275208 - DNA, 12 bp, Homo sapiens
gtatataatttt

SEQ ID NO: 1275209 - DNA, 14 bp, Homo sapiens
gtatatagtatatt

SEQ ID NO: 1275210 - DNA, 21 bp, Homo sapiens
gtatatagtatatttatactc

SEQ ID NO: 1275211 - DNA, 22 bp, Homo sapiens
gtatatagtatatttatactct

SEQ ID NO: 1275212 - DNA, 14 bp, Homo sapiens
gtatatatagaatc

SEQ ID NO: 1275213 - DNA, 15 bp, Homo sapiens
gtatatatatatagt

SEQ ID NO: 1275214 - DNA, 20 bp, Homo sapiens
gtatatatatttatatatat

SEQ ID NO: 1275215 - DNA, 20 bp, Homo sapiens
gtatatatggatcagaggag

SEQ ID NO: 1275216 - DNA, 16 bp, Homo sapiens
gtatatatgtgtgttt

SEQ ID NO: 1275217 - DNA, 18 bp, Homo sapiens
gtatatattttatatgtt

SEQ ID NO: 1275218 - DNA, 21 bp, Homo sapiens
gtatatcattctacagaataa

SEQ ID NO: 1275219 - DNA, 22 bp, Homo sapiens
gtatatcattctacagaataat

SEQ ID NO: 1275220 - DNA, 16 bp, Homo sapiens
gtatatggtatttatt

SEQ ID NO: 1275221 - DNA, 23 bp, Homo sapiens
gtatatgtagatgtatgcacaca

SEQ ID NO: 1275222 - DNA, 19 bp, Homo sapiens
gtatatgtgccacattttc

SEQ ID NO: 1275223 - DNA, 16 bp, Homo sapiens
gtatatgttgggtgca

SEQ ID NO: 1275224 - DNA, 17 bp, Homo sapiens
gtatatgttgtaataaa

SEQ ID NO: 1275225 - DNA, 16 bp, Homo sapiens
gtatatgtttatatac

SEQ ID NO: 1275226 - DNA, 13 bp, Homo sapiens
gtatattaaaaaa

SEQ ID NO: 1275227 - DNA, 14 bp, Homo sapiens
gtatattaaaatag

SEQ ID NO: 1275228 - DNA, 22 bp, Homo sapiens
gtatattaaaatagcatactgt

SEQ ID NO: 1275229 - DNA, 15 bp, Homo sapiens
gtatattacaatgat

SEQ ID NO: 1275230 - DNA, 21 bp, Homo sapiens
gtatattatgtatttatattt

SEQ ID NO: 1275231 - DNA, 23 bp, Homo sapiens
gtatattatgtatttatattttg

SEQ ID NO: 1275232 - DNA, 13 bp, Homo sapiens
gtatattctggaa

SEQ ID NO: 1275233 - DNA, 22 bp, Homo sapiens
gtatattctttggttgtgaatc

SEQ ID NO: 1275234 - DNA, 13 bp, Homo sapiens
gtatattgctaag

SEQ ID NO: 1275235 - DNA, 13 bp, Homo sapiens
gtatattggtgta

SEQ ID NO: 1275236 - DNA, 18 bp, Homo sapiens
gtatatttagttacgtat

SEQ ID NO: 1275237 - DNA, 14 bp, Homo sapiens
gtatatttattcat

SEQ ID NO: 1275238 - DNA, 18 bp, Homo sapiens
gtatatttattcataatg

SEQ ID NO: 1275239 - DNA, 16 bp, Homo sapiens
gtatatttccgcactt

SEQ ID NO: 1275240 - DNA, 12 bp, Homo sapiens
gtatatttgaaa

SEQ ID NO: 1275241 - DNA, 12 bp, Homo sapiens
gtatatttgcaa

SEQ ID NO: 1275242 - DNA, 21 bp, Homo sapiens
gtatatttgcaaaccctttgt

SEQ ID NO: 1275243 - DNA, 15 bp, Homo sapiens
gtatatttgctgcaa

SEQ ID NO: 1275244 - DNA, 22 bp, Homo sapiens
gtatatttgctgcaaagagaaa

SEQ ID NO: 1275245 - DNA, 12 bp, Homo sapiens
gtatatttgctt

SEQ ID NO: 1275246 - DNA, 15 bp, Homo sapiens
gtatatttgcttcaa

SEQ ID NO: 1275247 - DNA, 13 bp, Homo sapiens
gtatatttgtaca

SEQ ID NO: 1275248 - DNA, 15 bp, Homo sapiens
gtatatttgtacaaa

SEQ ID NO: 1275249 - DNA, 13 bp, Homo sapiens
gtatatttgtcat

SEQ ID NO: 1275250 - DNA, 15 bp, Homo sapiens
gtatatttgtcatga

SEQ ID NO: 1275251 - DNA, 19 bp, Homo sapiens
gtatatttgtcatgacagt

SEQ ID NO: 1275252 - DNA, 22 bp, Homo sapiens
gtatatttgtcatgacagtgct

SEQ ID NO: 1275253 - DNA, 19 bp, Homo sapiens
gtatattttaatagaattt

SEQ ID NO: 1275254 - DNA, 17 bp, Homo sapiens
gtatattttatttcaat

SEQ ID NO: 1275255 - DNA, 22 bp, Homo sapiens
gtatatttttatctatataaaa

SEQ ID NO: 1275256 - DNA, 19 bp, Homo sapiens
gtatcaaatacatttaaaa

SEQ ID NO: 1275257 - DNA, 13 bp, Homo sapiens
gtatcaaatctgt

SEQ ID NO: 1275258 - DNA, 17 bp, Homo sapiens
gtcaagctgctctgagc

SEQ ID NO: 1275259 - DNA, 20 bp, Homo sapiens
gtcaagctgctctgagccac

SEQ ID NO: 1275260 - DNA, 22 bp, Homo sapiens
gtcaagctgctctgagccacag

SEQ ID NO: 1275261 - DNA, 12 bp, Homo sapiens
gtcaagcttact

SEQ ID NO: 1275262 - DNA, 15 bp, Homo sapiens
gtcaaggccgagggc

SEQ ID NO: 1275263 - DNA, 18 bp, Homo sapiens
gtcaaggccgagggccag

SEQ ID NO: 1275264 - DNA, 20 bp, Homo sapiens
gtcaaggccgagggccaggc

SEQ ID NO: 1275265 - DNA, 18 bp, Homo sapiens
gtcaaggctgcttagaat

SEQ ID NO: 1275266 - DNA, 14 bp, Homo sapiens
gtcaagggaaaacc

SEQ ID NO: 1275267 - DNA, 15 bp, Homo sapiens
gtcaaggtggcatcc

SEQ ID NO: 1275268 - DNA, 13 bp, Homo sapiens
gtcaagtcaacca

SEQ ID NO: 1275269 - DNA, 15 bp, Homo sapiens
gtcaagtgaaaaagg

SEQ ID NO: 1275270 - DNA, 18 bp, Homo sapiens
gtcaagttaacaaggaat

SEQ ID NO: 1275271 - DNA, 14 bp, Homo sapiens
gtcaagttcccaac

SEQ ID NO: 1275272 - DNA, 22 bp, Homo sapiens
gtcaagttggacttgttttaac

SEQ ID NO: 1275273 - DNA, 18 bp, Homo sapiens
gtcaagttgtgcttgttt

SEQ ID NO: 1275274 - DNA, 17 bp, Homo sapiens
gtcaataaaagagctgt

SEQ ID NO: 1275275 - DNA, 19 bp, Homo sapiens
gtcaataaaagagctgtct

SEQ ID NO: 1275276 - DNA, 21 bp, Homo sapiens
gtcaataaaagagctgtctga

SEQ ID NO: 1275277 - DNA, 20 bp, Homo sapiens
gtcaataaacaacagctgaa

SEQ ID NO: 1275278 - DNA, 20 bp, Homo sapiens
gtcaataaacagcttcatgc

SEQ ID NO: 1275279 - DNA, 21 bp, Homo sapiens
gtcaataaagcagagccaagg

SEQ ID NO: 1275280 - DNA, 22 bp, Homo sapiens
gtcaataaagcagagccaaggc

SEQ ID NO: 1275281 - DNA, 21 bp, Homo sapiens
gtcaataaatgacacccagac

SEQ ID NO: 1275282 - DNA, 23 bp, Homo sapiens
gtcaataaatgacacccagacct

SEQ ID NO: 1275283 - DNA, 18 bp, Homo sapiens
gtcaatattaaatacaga

SEQ ID NO: 1275284 - DNA, 20 bp, Homo sapiens
gtcaatattaaatacagaca

SEQ ID NO: 1275285 - DNA, 22 bp, Homo sapiens
gtcaatattaaatacagacact

SEQ ID NO: 1275286 - DNA, 13 bp, Homo sapiens
gtcaatcagcctt

SEQ ID NO: 1275287 - DNA, 17 bp, Homo sapiens
gtcaatcccctcattca

SEQ ID NO: 1275288 - DNA, 22 bp, Homo sapiens
gtcaatcccctcattcaggaaa

SEQ ID NO: 1275289 - DNA, 16 bp, Homo sapiens
gtcaatcctgtgggtg

SEQ ID NO: 1275290 - DNA, 21 bp, Homo sapiens
gtcaatgccaggatttctcat

SEQ ID NO: 1275291 - DNA, 13 bp, Homo sapiens
gtcaatggcttgt

SEQ ID NO: 1275292 - DNA, 16 bp, Homo sapiens
gtcaattaaacagctg

SEQ ID NO: 1275293 - DNA, 18 bp, Homo sapiens
gtcaattaaacagctggt

SEQ ID NO: 1275294 - DNA, 20 bp, Homo sapiens
gtcaattctgatgttactga

SEQ ID NO: 1275295 - DNA, 18 bp, Homo sapiens
gtcaatttatgaatataa

SEQ ID NO: 1275296 - DNA, 15 bp, Homo sapiens
gtcaatttgctgaaa

SEQ ID NO: 1275297 - DNA, 21 bp, Homo sapiens
gtcaatttgtatatcatgaaa

SEQ ID NO: 1275298 - DNA, 21 bp, Homo sapiens
gtcacaaatcctaaaagaagc

SEQ ID NO: 1275299 - DNA, 13 bp, Homo sapiens
gtcacaaattgat

SEQ ID NO: 1275300 - DNA, 11 bp, Homo sapiens
gtcacaataaa

SEQ ID NO: 1275301 - DNA, 22 bp, Homo sapiens
gtcacaataaatggccagtgct

SEQ ID NO: 1275302 - DNA, 17 bp, Homo sapiens
gtcacaattatgtgcaa

SEQ ID NO: 1275303 - DNA, 14 bp, Homo sapiens
gtcacacactggac

SEQ ID NO: 1275304 - DNA, 22 bp, Homo sapiens
gtcacacactggaccccactgg

SEQ ID NO: 1275305 - DNA, 23 bp, Homo sapiens
gtcacacactggaccccactggc

SEQ ID NO: 1275306 - DNA, 19 bp, Homo sapiens
gtcacacagtgttggaggt

SEQ ID NO: 1275307 - DNA, 15 bp, Homo sapiens
gtcacactggtgctg

SEQ ID NO: 1275308 - DNA, 17 bp, Homo sapiens
gtcacactggtgctgag

SEQ ID NO: 1275309 - DNA, 21 bp, Homo sapiens
gtcacactgtgtgaggctgtg

SEQ ID NO: 1275310 - DNA, 17 bp, Homo sapiens
gtcacagcatggaggag

SEQ ID NO: 1275311 - DNA, 12 bp, Homo sapiens
gtcacagccacc

SEQ ID NO: 1275312 - DNA, 14 bp, Homo sapiens
gtcacagctgcagc

SEQ ID NO: 1275313 - DNA, 17 bp, Homo sapiens
gtcacagctgcagctgg

SEQ ID NO: 1275314 - DNA, 18 bp, Homo sapiens
gtcacagctgcagctggg

SEQ ID NO: 1275315 - DNA, 21 bp, Homo sapiens
gtcacagctgcagctgggccc

SEQ ID NO: 1275316 - DNA, 12 bp, Homo sapiens
gtcacaggctgg

SEQ ID NO: 1275317 - DNA, 16 bp, Homo sapiens
gtcacagtaaaaataa

SEQ ID NO: 1275318 - DNA, 22 bp, Homo sapiens
gtcacagtaaaaataaaatact

SEQ ID NO: 1275319 - DNA, 23 bp, Homo sapiens
gtcacagtcctatgtacagagct

SEQ ID NO: 1275320 - DNA, 15 bp, Homo sapiens
gtcacattatttatt

SEQ ID NO: 1275321 - DNA, 20 bp, Homo sapiens
gtcacattatttattaaaaa

SEQ ID NO: 1275322 - DNA, 22 bp, Homo sapiens
gtcacattgatgtaaggactgt

SEQ ID NO: 1275323 - DNA, 15 bp, Homo sapiens
gtcaccaaatttgta

SEQ ID NO: 1275324 - DNA, 17 bp, Homo sapiens
gtcaccaagctcacagt

SEQ ID NO: 1275325 - DNA, 13 bp, Homo sapiens
gtcaccaaggaaa

SEQ ID NO: 1275326 - DNA, 20 bp, Homo sapiens
gtcaccaaggcagtgcatgc

SEQ ID NO: 1275327 - DNA, 14 bp, Homo sapiens
gtcaccacccagcc

SEQ ID NO: 1275328 - DNA, 15 bp, Homo sapiens
gtcaccacccagccc

SEQ ID NO: 1275329 - DNA, 18 bp, Homo sapiens
gtcaccacccagcccttc

SEQ ID NO: 1275330 - DNA, 16 bp, Homo sapiens
gtcaccaccttcccag

SEQ ID NO: 1275331 - DNA, 16 bp, Homo sapiens
gtcaccagacggggct

SEQ ID NO: 1275332 - DNA, 14 bp, Homo sapiens
gtcaccagctcctc

SEQ ID NO: 1275333 - DNA, 16 bp, Homo sapiens
gtcaccagctcctccc

SEQ ID NO: 1275334 - DNA, 21 bp, Homo sapiens
gtcaccagctgctgtgcccca

SEQ ID NO: 1275335 - DNA, 12 bp, Homo sapiens
gtcaccaggact

SEQ ID NO: 1275336 - DNA, 19 bp, Homo sapiens
gtcaccagttaaaagcatt

SEQ ID NO: 1275337 - DNA, 17 bp, Homo sapiens
gtcaccatcctcagagg

SEQ ID NO: 1275338 - DNA, 15 bp, Homo sapiens
gtcaccatctcaggc

SEQ ID NO: 1275339 - DNA, 16 bp, Homo sapiens
gtcaccatctcaggcc

SEQ ID NO: 1275340 - DNA, 17 bp, Homo sapiens
gtcaccatctcaggcca

SEQ ID NO: 1275341 - DNA, 21 bp, Homo sapiens
gtcaccatctcaggccacctg

SEQ ID NO: 1275342 - DNA, 23 bp, Homo sapiens
gtcaccattggacagtctccctg

SEQ ID NO: 1275343 - DNA, 20 bp, Homo sapiens
gtcacccaaacacttctgct

SEQ ID NO: 1275344 - DNA, 21 bp, Homo sapiens
gtcacccaaacacttctgctt

SEQ ID NO: 1275345 - DNA, 19 bp, Homo sapiens
gtcacccaaagcctgtccc

SEQ ID NO: 1275346 - DNA, 23 bp, Homo sapiens
gtcacccaaagcctgtcccagga

SEQ ID NO: 1275347 - DNA, 15 bp, Homo sapiens
gtcacccccacttcc

SEQ ID NO: 1275348 - DNA, 20 bp, Homo sapiens
gtcacccctccaggaatgat

SEQ ID NO: 1275349 - DNA, 20 bp, Homo sapiens
gtcacccctccctccctctt

SEQ ID NO: 1275350 - DNA, 21 bp, Homo sapiens
gtcacccctccctccctcttt

SEQ ID NO: 1275351 - DNA, 23 bp, Homo sapiens
gtcaccctcctcacagacctctg

SEQ ID NO: 1275352 - DNA, 15 bp, Homo sapiens
gtcaccctggggctg

SEQ ID NO: 1275353 - DNA, 20 bp, Homo sapiens
gtcaccctggggctgcttag

SEQ ID NO: 1275354 - DNA, 19 bp, Homo sapiens
gtcaccctgtgaccctctc

SEQ ID NO: 1275355 - DNA, 14 bp, Homo sapiens
gtcacccttctggg

SEQ ID NO: 1275356 - DNA, 17 bp, Homo sapiens
gtcaccgacagcggcct

SEQ ID NO: 1275357 - DNA, 17 bp, Homo sapiens
gtcaccggtcagtgcct

SEQ ID NO: 1275358 - DNA, 18 bp, Homo sapiens
gtcaccgtggaccttcct

SEQ ID NO: 1275359 - DNA, 21 bp, Homo sapiens
gtcaccgtggaccttcctgcc

SEQ ID NO: 1275360 - DNA, 12 bp, Homo sapiens
gtcacctgcaag

SEQ ID NO: 1275361 - DNA, 24 bp, Homo sapiens
gtcacctgcaagccccagggcctg

SEQ ID NO: 1275362 - DNA, 22 bp, Homo sapiens
gtcacctgccccgtagagaatg

SEQ ID NO: 1275363 - DNA, 23 bp, Homo sapiens
gtcacctgccccgtagagaatgt

SEQ ID NO: 1275364 - DNA, 19 bp, Homo sapiens
gtcacctgctcacagggat

SEQ ID NO: 1275365 - DNA, 16 bp, Homo sapiens
gtcacctgctccagaa

SEQ ID NO: 1275366 - DNA, 21 bp, Homo sapiens
gtcacctggctgctaggccag

SEQ ID NO: 1275367 - DNA, 13 bp, Homo sapiens
gtcacctgtgctt

SEQ ID NO: 1275368 - DNA, 21 bp, Homo sapiens
gtcacctgttggctacacaga

SEQ ID NO: 1275369 - DNA, 17 bp, Homo sapiens
gtcaccttcccttgcca

SEQ ID NO: 1275370 - DNA, 11 bp, Homo sapiens
gtcaccttctg

SEQ ID NO: 1275371 - DNA, 14 bp, Homo sapiens
gtcaccttctgggc

SEQ ID NO: 1275372 - DNA, 15 bp, Homo sapiens
gtcaccttgcactcc

SEQ ID NO: 1275373 - DNA, 16 bp, Homo sapiens
gtcacctttctgggct

SEQ ID NO: 1275374 - DNA, 17 bp, Homo sapiens
gtcacctttctgggctt

SEQ ID NO: 1275375 - DNA, 19 bp, Homo sapiens
gtcacgcggcagcttcagg

SEQ ID NO: 1275376 - DNA, 20 bp, Homo sapiens
gtcacggctgcgcactgtgt

SEQ ID NO: 1275377 - DNA, 13 bp, Homo sapiens
gtcactaagactt

SEQ ID NO: 1275378 - DNA, 14 bp, Homo sapiens
gtcactactcacag

SEQ ID NO: 1275379 - DNA, 18 bp, Homo sapiens
gtcactaggatgcagatg

SEQ ID NO: 1275380 - DNA, 19 bp, Homo sapiens
gtcactagtgaacaattcg

SEQ ID NO: 1275381 - DNA, 12 bp, Homo sapiens
gtcactcctggg

SEQ ID NO: 1275382 - DNA, 12 bp, Homo sapiens
gtcactctgccc

SEQ ID NO: 1275383 - DNA, 14 bp, Homo sapiens
gtcactctgccctc

SEQ ID NO: 1275384 - DNA, 19 bp, Homo sapiens
gtcactctgccctctgctg

SEQ ID NO: 1275385 - DNA, 15 bp, Homo sapiens
gtcactgaacaaaac

SEQ ID NO: 1275386 - DNA, 17 bp, Homo sapiens
gtcactgaaccactgct

SEQ ID NO: 1275387 - DNA, 18 bp, Homo sapiens
gtcactgagcacagtcag

SEQ ID NO: 1275388 - DNA, 12 bp, Homo sapiens
gtcactgccaaa

SEQ ID NO: 1275389 - DNA, 18 bp, Homo sapiens
gtcactgcccaccaaagg

SEQ ID NO: 1275390 - DNA, 22 bp, Homo sapiens
gtcactgccgacatccctcccc

SEQ ID NO: 1275391 - DNA, 19 bp, Homo sapiens
gtcactggaccactgggca

SEQ ID NO: 1275392 - DNA, 16 bp, Homo sapiens
gtcactggctctccaa

SEQ ID NO: 1275393 - DNA, 18 bp, Homo sapiens
gtcactggctctccaagt

SEQ ID NO: 1275394 - DNA, 15 bp, Homo sapiens
gtcactggtcagggc

SEQ ID NO: 1275395 - DNA, 16 bp, Homo sapiens
gtcactggtcagggca

SEQ ID NO: 1275396 - DNA, 12 bp, Homo sapiens
gtcactgtagtt

SEQ ID NO: 1275397 - DNA, 12 bp, Homo sapiens
gtcactgtcact

SEQ ID NO: 1275398 - DNA, 17 bp, Homo sapiens
gtcactgttccttgtca

SEQ ID NO: 1275399 - DNA, 13 bp, Homo sapiens
gtcactgtttctc

SEQ ID NO: 1275400 - DNA, 14 bp, Homo sapiens
gtcactgtttttat

SEQ ID NO: 1275401 - DNA, 16 bp, Homo sapiens
gtcacttatttcataa

SEQ ID NO: 1275402 - DNA, 14 bp, Homo sapiens
gtcacttccagtgt

SEQ ID NO: 1275403 - DNA, 22 bp, Homo sapiens
gtcacttccagtgttggctgtg

SEQ ID NO: 1275404 - DNA, 17 bp, Homo sapiens
gtcacttcttcacctct

SEQ ID NO: 1275405 - DNA, 21 bp, Homo sapiens
gtcacttcttcacctcttcca

SEQ ID NO: 1275406 - DNA, 23 bp, Homo sapiens
gtcacttgatgtgccattttaaa

SEQ ID NO: 1275407 - DNA, 21 bp, Homo sapiens
gtcacttgccacatggtgtct

SEQ ID NO: 1275408 - DNA, 18 bp, Homo sapiens
gtcacttgtgctttgctc

SEQ ID NO: 1275409 - DNA, 16 bp, Homo sapiens
gtcactttgctctggg

SEQ ID NO: 1275410 - DNA, 14 bp, Homo sapiens
gtcacttttccttt

SEQ ID NO: 1275411 - DNA, 18 bp, Homo sapiens
gtcacttttccttttctt

SEQ ID NO: 1275412 - DNA, 14 bp, Homo sapiens
gtcactttttctga

SEQ ID NO: 1275413 - DNA, 21 bp, Homo sapiens
gtcagaaaataacagatgctg

SEQ ID NO: 1275414 - DNA, 13 bp, Homo sapiens
gtcagaaactgtt

SEQ ID NO: 1275415 - DNA, 16 bp, Homo sapiens
gtcagaacagcagact

SEQ ID NO: 1275416 - DNA, 19 bp, Homo sapiens
gtcagaacagcagactcag

SEQ ID NO: 1275417 - DNA, 18 bp, Homo sapiens
gtcagaactgcagggcct

SEQ ID NO: 1275418 - DNA, 18 bp, Homo sapiens
gtcagaagaagtgggagc

SEQ ID NO: 1275419 - DNA, 19 bp, Homo sapiens
gtcagaagaagtgggagca

SEQ ID NO: 1275420 - DNA, 20 bp, Homo sapiens
gtcagaagaagtgggagcag

SEQ ID NO: 1275421 - DNA, 22 bp, Homo sapiens
gtcagaagaagtgggagcagct

SEQ ID NO: 1275422 - DNA, 16 bp, Homo sapiens
gtcagaataggaaaac

SEQ ID NO: 1275423 - DNA, 23 bp, Homo sapiens
gtcagaatcagaatcatggagaa

SEQ ID NO: 1275424 - DNA, 23 bp, Homo sapiens
gtcagaatggaatccatctgtct

SEQ ID NO: 1275425 - DNA, 19 bp, Homo sapiens
gtcagaatgtgaaaaagga

SEQ ID NO: 1275426 - DNA, 18 bp, Homo sapiens
gtcagacacagattggcc

SEQ ID NO: 1275427 - DNA, 20 bp, Homo sapiens
gtcagacatccatgtttgta

SEQ ID NO: 1275428 - DNA, 21 bp, Homo sapiens
gtcagactgaaacgccttgca

SEQ ID NO: 1275429 - DNA, 16 bp, Homo sapiens
gtcagactgctgggac

SEQ ID NO: 1275430 - DNA, 24 bp, Homo sapiens
gtcagactgctgggactggccagg

SEQ ID NO: 1275431 - DNA, 14 bp, Homo sapiens
gtcagactggctgg

SEQ ID NO: 1275432 - DNA, 22 bp, Homo sapiens
gtcagactggctggctgcagtg

SEQ ID NO: 1275433 - DNA, 23 bp, Homo sapiens
gtcagacttccaaatcctggaag

SEQ ID NO: 1275434 - DNA, 15 bp, Homo sapiens
gtcagactttaaaga

SEQ ID NO: 1275435 - DNA, 13 bp, Homo sapiens
gtcagactttgct

SEQ ID NO: 1275436 - DNA, 18 bp, Homo sapiens
gtcagagcccaggggaga

SEQ ID NO: 1275437 - DNA, 12 bp, Homo sapiens
gtcagagccctg

SEQ ID NO: 1275438 - DNA, 16 bp, Homo sapiens
gtcagagccctggctg

SEQ ID NO: 1275439 - DNA, 19 bp, Homo sapiens
gtcagaggaccccagggtg

SEQ ID NO: 1275440 - DNA, 13 bp, Homo sapiens
gtcagaggagcgc

SEQ ID NO: 1275441 - DNA, 17 bp, Homo sapiens
gtcagagtccagtgctc

SEQ ID NO: 1275442 - DNA, 20 bp, Homo sapiens
gtcagagtccagtgctctgc

SEQ ID NO: 1275443 - DNA, 13 bp, Homo sapiens
gtcagagtgttgt

SEQ ID NO: 1275444 - DNA, 16 bp, Homo sapiens
gtcagatcgttcattg

SEQ ID NO: 1275445 - DNA, 21 bp, Homo sapiens
gtcagatgagaacaaagctgt

SEQ ID NO: 1275446 - DNA, 22 bp, Homo sapiens
gtcagatgagaacaaagctgtt

SEQ ID NO: 1275447 - DNA, 13 bp, Homo sapiens
gtcagatgaggca

SEQ ID NO: 1275448 - DNA, 21 bp, Homo sapiens
gtcagatggaggttctcagag

SEQ ID NO: 1275449 - DNA, 13 bp, Homo sapiens
gtcagatttctgg

SEQ ID NO: 1275450 - DNA, 21 bp, Homo sapiens
gtcagatttctggttgatttg

SEQ ID NO: 1275451 - DNA, 15 bp, Homo sapiens
gtcagcaaaaagcaa

SEQ ID NO: 1275452 - DNA, 11 bp, Homo sapiens
gtcagcacctt

SEQ ID NO: 1275453 - DNA, 12 bp, Homo sapiens
gtcagcaccttg

SEQ ID NO: 1275454 - DNA, 21 bp, Homo sapiens
gtcagcaccttggcccaggag

SEQ ID NO: 1275455 - DNA, 24 bp, Homo sapiens
gtcagcaccttggcccaggagctc

SEQ ID NO: 1275456 - DNA, 16 bp, Homo sapiens
gtcagcagatgccagt

SEQ ID NO: 1275457 - DNA, 16 bp, Homo sapiens
gtcagcaggcaggctg

SEQ ID NO: 1275458 - DNA, 19 bp, Homo sapiens
gtcagcaggcaggctgggg

SEQ ID NO: 1275459 - DNA, 13 bp, Homo sapiens
gtcagcagggacc

SEQ ID NO: 1275460 - DNA, 15 bp, Homo sapiens
gtcagcatctggctg

SEQ ID NO: 1275461 - DNA, 18 bp, Homo sapiens
gtcagcatctggctgtct

SEQ ID NO: 1275462 - DNA, 15 bp, Homo sapiens
gtcagccacactggg

SEQ ID NO: 1275463 - DNA, 16 bp, Homo sapiens
gtcagccacactgggc

SEQ ID NO: 1275464 - DNA, 17 bp, Homo sapiens
gtcagccacactgggcc

SEQ ID NO: 1275465 - DNA, 19 bp, Homo sapiens
gtcagccacactgggcctg

SEQ ID NO: 1275466 - DNA, 13 bp, Homo sapiens
gtcagccacctgg

SEQ ID NO: 1275467 - DNA, 15 bp, Homo sapiens
gtcagccacctggga

SEQ ID NO: 1275468 - DNA, 16 bp, Homo sapiens
gtcagccacctgggaa

SEQ ID NO: 1275469 - DNA, 11 bp, Homo sapiens
gtcagccagcc

SEQ ID NO: 1275470 - DNA, 18 bp, Homo sapiens
gtcagccagccgccctgg

SEQ ID NO: 1275471 - DNA, 12 bp, Homo sapiens
gtcagccaggct

SEQ ID NO: 1275472 - DNA, 11 bp, Homo sapiens
gtcagccaggg

SEQ ID NO: 1275473 - DNA, 14 bp, Homo sapiens
gtcagccagggcca

SEQ ID NO: 1275474 - DNA, 15 bp, Homo sapiens
gtcagccatcagcca

SEQ ID NO: 1275475 - DNA, 20 bp, Homo sapiens
gtcagccatcgtcctgggac

SEQ ID NO: 1275476 - DNA, 15 bp, Homo sapiens
gtcagccccaagggc

SEQ ID NO: 1275477 - DNA, 17 bp, Homo sapiens
gtcagccccaagggctg

SEQ ID NO: 1275478 - DNA, 18 bp, Homo sapiens
gtcagccccaagggctgg

SEQ ID NO: 1275479 - DNA, 18 bp, Homo sapiens
gtcagcccgaatgcctgt

SEQ ID NO: 1275480 - DNA, 12 bp, Homo sapiens
gtcagccctgtg

SEQ ID NO: 1275481 - DNA, 15 bp, Homo sapiens
gtcagccctgtgtct

SEQ ID NO: 1275482 - DNA, 11 bp, Homo sapiens
gtcagcccttg

SEQ ID NO: 1275483 - DNA, 16 bp, Homo sapiens
gtcagccgagccgggc

SEQ ID NO: 1275484 - DNA, 21 bp, Homo sapiens
gtcagccgagccgggcctggg

SEQ ID NO: 1275485 - DNA, 22 bp, Homo sapiens
gtcagccttccccctcccaggg

SEQ ID NO: 1275486 - DNA, 13 bp, Homo sapiens
gtcagcctttgtt

SEQ ID NO: 1275487 - DNA, 14 bp, Homo sapiens
gtcagcgactggat

SEQ ID NO: 1275488 - DNA, 22 bp, Homo sapiens
gtcagcgactggatgctcgcca

SEQ ID NO: 1275489 - DNA, 13 bp, Homo sapiens
gtcagctaaagaa

SEQ ID NO: 1275490 - DNA, 17 bp, Homo sapiens
gtcagctactaatgatg

SEQ ID NO: 1275491 - DNA, 18 bp, Homo sapiens
gtcagctcaggcagctcg

SEQ ID NO: 1275492 - DNA, 20 bp, Homo sapiens
gtcagctcaggcagctcgag

SEQ ID NO: 1275493 - DNA, 15 bp, Homo sapiens
gtcagctcccttctc

SEQ ID NO: 1275494 - DNA, 16 bp, Homo sapiens
gtcagctcccttctct

SEQ ID NO: 1275495 - DNA, 17 bp, Homo sapiens
gtcagctctctgccctg

SEQ ID NO: 1275496 - DNA, 21 bp, Homo sapiens
gtcagctctctgccctgtgta

SEQ ID NO: 1275497 - DNA, 23 bp, Homo sapiens
gtcagctgaggctgggggagagc

SEQ ID NO: 1275498 - DNA, 20 bp, Homo sapiens
gtcagctgctccctggcatt

SEQ ID NO: 1275499 - DNA, 18 bp, Homo sapiens
gtcagctgggagccagtg

SEQ ID NO: 1275500 - DNA, 22 bp, Homo sapiens
gtcagctgggagccagtgtgcc

SEQ ID NO: 1275501 - DNA, 19 bp, Homo sapiens
gtcagctgtgaaggcttca

SEQ ID NO: 1275502 - DNA, 11 bp, Homo sapiens
gtccccactcc

SEQ ID NO: 1275503 - DNA, 16 bp, Homo sapiens
gtccccactcccttgg

SEQ ID NO: 1275504 - DNA, 19 bp, Homo sapiens
gtccccactgctgagctgg

SEQ ID NO: 1275505 - DNA, 20 bp, Homo sapiens
gtccccactgctgagctggc

SEQ ID NO: 1275506 - DNA, 15 bp, Homo sapiens
gtccccagaccaacc

SEQ ID NO: 1275507 - DNA, 21 bp, Homo sapiens
gtccccagaccaaccctggga

SEQ ID NO: 1275508 - DNA, 18 bp, Homo sapiens
gtccccagccctgggctt

SEQ ID NO: 1275509 - DNA, 14 bp, Homo sapiens
gtccccagcccttc

SEQ ID NO: 1275510 - DNA, 20 bp, Homo sapiens
gtccccagcccttctgcctt

SEQ ID NO: 1275511 - DNA, 12 bp, Homo sapiens
gtccccaggccc

SEQ ID NO: 1275512 - DNA, 17 bp, Homo sapiens
gtccccaggcccagccc

SEQ ID NO: 1275513 - DNA, 19 bp, Homo sapiens
gtccccaggcccagccctc

SEQ ID NO: 1275514 - DNA, 15 bp, Homo sapiens
gtccccagtccccag

SEQ ID NO: 1275515 - DNA, 17 bp, Homo sapiens
gtccccagtccccagcc

SEQ ID NO: 1275516 - DNA, 21 bp, Homo sapiens
gtccccagtccccagccctgg

SEQ ID NO: 1275517 - DNA, 19 bp, Homo sapiens
gtccccagtttgcagaaaa

SEQ ID NO: 1275518 - DNA, 17 bp, Homo sapiens
gtccccatcatcccagc

SEQ ID NO: 1275519 - DNA, 23 bp, Homo sapiens
gtccccatcccattttcatcctg

SEQ ID NO: 1275520 - DNA, 16 bp, Homo sapiens
gtccccatccccacca

SEQ ID NO: 1275521 - DNA, 20 bp, Homo sapiens
gtcccccaactctgagccca

SEQ ID NO: 1275522 - DNA, 16 bp, Homo sapiens
gtcccccaacttgaga

SEQ ID NO: 1275523 - DNA, 14 bp, Homo sapiens
gtcccccacccacc

SEQ ID NO: 1275524 - DNA, 15 bp, Homo sapiens
gtcccccacccacct

SEQ ID NO: 1275525 - DNA, 17 bp, Homo sapiens
gtcccccacccacctcc

SEQ ID NO: 1275526 - DNA, 20 bp, Homo sapiens
gtcccccacccacctcctgc

SEQ ID NO: 1275527 - DNA, 12 bp, Homo sapiens
gtcccccactct

SEQ ID NO: 1275528 - DNA, 13 bp, Homo sapiens
gtcccccactctc

SEQ ID NO: 1275529 - DNA, 13 bp, Homo sapiens
gtcccccactgct

SEQ ID NO: 1275530 - DNA, 21 bp, Homo sapiens
gtcccccactgctaaggctgc

SEQ ID NO: 1275531 - DNA, 23 bp, Homo sapiens
gtcccccactgctaaggctgctg

SEQ ID NO: 1275532 - DNA, 19 bp, Homo sapiens
gtccccccacagctccagg

SEQ ID NO: 1275533 - DNA, 23 bp, Homo sapiens
gtccccccacagctccaggacac

SEQ ID NO: 1275534 - DNA, 20 bp, Homo sapiens
gtccccccaccgctcagtgt

SEQ ID NO: 1275535 - DNA, 21 bp, Homo sapiens
gtccccccccaacctttccct

SEQ ID NO: 1275536 - DNA, 15 bp, Homo sapiens
gtccccccccaggcc

SEQ ID NO: 1275537 - DNA, 21 bp, Homo sapiens
gtccccccccaggccctccca

SEQ ID NO: 1275538 - DNA, 21 bp, Homo sapiens
gtccccccttgaagcaataac

SEQ ID NO: 1275539 - DNA, 20 bp, Homo sapiens
gtcccccgaccaatccccag

SEQ ID NO: 1275540 - DNA, 17 bp, Homo sapiens
gtcccccgactgcctgt

SEQ ID NO: 1275541 - DNA, 18 bp, Homo sapiens
gtcccccgactgcctgtc

SEQ ID NO: 1275542 - DNA, 20 bp, Homo sapiens
gtcccccgactgcctgtctc

SEQ ID NO: 1275543 - DNA, 22 bp, Homo sapiens
gtcccccgactgcctgtctcca

SEQ ID NO: 1275544 - DNA, 17 bp, Homo sapiens
gtccccctacccaccga

SEQ ID NO: 1275545 - DNA, 13 bp, Homo sapiens
gtccccctccctg

SEQ ID NO: 1275546 - DNA, 16 bp, Homo sapiens
gtccccctccctgccc

SEQ ID NO: 1275547 - DNA, 14 bp, Homo sapiens
gtccccctctggct

SEQ ID NO: 1275548 - DNA, 13 bp, Homo sapiens
gtccccctctgtc

SEQ ID NO: 1275549 - DNA, 21 bp, Homo sapiens
gtccccctctgtccaggcact

SEQ ID NO: 1275550 - DNA, 22 bp, Homo sapiens
gtccccctggggcttctcctga

SEQ ID NO: 1275551 - DNA, 17 bp, Homo sapiens
gtccccgaggagctggg

SEQ ID NO: 1275552 - DNA, 19 bp, Homo sapiens
gtccccgaggagctgggcc

SEQ ID NO: 1275553 - DNA, 14 bp, Homo sapiens
gtccccgccttccc

SEQ ID NO: 1275554 - DNA, 15 bp, Homo sapiens
gtccccgccttccct

SEQ ID NO: 1275555 - DNA, 19 bp, Homo sapiens
gtccccggttgctggtcag

SEQ ID NO: 1275556 - DNA, 22 bp, Homo sapiens
gtccccgtgccccgcctccccg

SEQ ID NO: 1275557 - DNA, 11 bp, Homo sapiens
gtcccctactc

SEQ ID NO: 1275558 - DNA, 16 bp, Homo sapiens
gtcccctactccctct

SEQ ID NO: 1275559 - DNA, 12 bp, Homo sapiens
gtcccctcacct

SEQ ID NO: 1275560 - DNA, 20 bp, Homo sapiens
gtcccctcacgcaagtgcca

SEQ ID NO: 1275561 - DNA, 13 bp, Homo sapiens
gtcccctcactct

SEQ ID NO: 1275562 - DNA, 14 bp, Homo sapiens
gtcccctcccatct

SEQ ID NO: 1275563 - DNA, 21 bp, Homo sapiens
gtcccctccccagctcccttg

SEQ ID NO: 1275564 - DNA, 13 bp, Homo sapiens
gtcccctccccca

SEQ ID NO: 1275565 - DNA, 16 bp, Homo sapiens
gtcccctccccggccc

SEQ ID NO: 1275566 - DNA, 22 bp, Homo sapiens
gtcccctccccggccctaccag

SEQ ID NO: 1275567 - DNA, 14 bp, Homo sapiens
gtcccctccctcgt

SEQ ID NO: 1275568 - DNA, 16 bp, Homo sapiens
gtcccctccctcgtgg

SEQ ID NO: 1275569 - DNA, 12 bp, Homo sapiens
gtcccctccgcc

SEQ ID NO: 1275570 - DNA, 15 bp, Homo sapiens
gtcccctctctctgg

SEQ ID NO: 1275571 - DNA, 21 bp, Homo sapiens
gtcccctctgtcatcactccc

SEQ ID NO: 1275572 - DNA, 16 bp, Homo sapiens
gtcccctctgtgcttc

SEQ ID NO: 1275573 - DNA, 20 bp, Homo sapiens
gtcccctgcagcctgggtct

SEQ ID NO: 1275574 - DNA, 15 bp, Homo sapiens
gtcccctgcctggaa

SEQ ID NO: 1275575 - DNA, 15 bp, Homo sapiens
gtcccctgtcccacc

SEQ ID NO: 1275576 - DNA, 19 bp, Homo sapiens
gtcccctgtcccaccaact

SEQ ID NO: 1275577 - DNA, 19 bp, Homo sapiens
gtcccctgtggtgatgtgc

SEQ ID NO: 1275578 - DNA, 21 bp, Homo sapiens
gtcccctgtggtgatgtgcct

SEQ ID NO: 1275579 - DNA, 17 bp, Homo sapiens
gtccccttcccctgctg

SEQ ID NO: 1275580 - DNA, 22 bp, Homo sapiens
gtccccttttcttttctaccct

SEQ ID NO: 1275581 - DNA, 16 bp, Homo sapiens
gtcccgcacagtggac

SEQ ID NO: 1275582 - DNA, 19 bp, Homo sapiens
gtcccgccttcctcctcca

SEQ ID NO: 1275583 - DNA, 20 bp, Homo sapiens
gtcccgcgcttcgaactcca

SEQ ID NO: 1275584 - DNA, 13 bp, Homo sapiens
gtcccgctgcctc

SEQ ID NO: 1275585 - DNA, 18 bp, Homo sapiens
gtcccgctgcctcctgct

SEQ ID NO: 1275586 - DNA, 17 bp, Homo sapiens
gtcccgctgctgtgctc

SEQ ID NO: 1275587 - DNA, 20 bp, Homo sapiens
gtcccgctgctgtgctctgg

SEQ ID NO: 1275588 - DNA, 16 bp, Homo sapiens
gtcccgcttagttctt

SEQ ID NO: 1275589 - DNA, 23 bp, Homo sapiens
gtcccgcttattctcctccctgt

SEQ ID NO: 1275590 - DNA, 20 bp, Homo sapiens
gtcccggagtgcccgtgaag

SEQ ID NO: 1275591 - DNA, 15 bp, Homo sapiens
gtcccggggccagca

SEQ ID NO: 1275592 - DNA, 17 bp, Homo sapiens
gtcccggggccagcact

SEQ ID NO: 1275593 - DNA, 23 bp, Homo sapiens
gtcccggtgtatcctggccctgg

SEQ ID NO: 1275594 - DNA, 17 bp, Homo sapiens
gtcccggttcaccttgc

SEQ ID NO: 1275595 - DNA, 19 bp, Homo sapiens
gtcccgtcaggacgttgag

SEQ ID NO: 1275596 - DNA, 16 bp, Homo sapiens
gtcccgtcgtgcagtc

SEQ ID NO: 1275597 - DNA, 15 bp, Homo sapiens
gtccctaaagaaaaa

SEQ ID NO: 1275598 - DNA, 23 bp, Homo sapiens
gtccctaagcatgtgtcccagga

SEQ ID NO: 1275599 - DNA, 23 bp, Homo sapiens
gtccctaagtaagtttcttcctg

SEQ ID NO: 1275600 - DNA, 21 bp, Homo sapiens
gtccctacacccctcccctgc

SEQ ID NO: 1275601 - DNA, 15 bp, Homo sapiens
gtccctatgcatatc

SEQ ID NO: 1275602 - DNA, 22 bp, Homo sapiens
gtccctatgtatttgcagttca

SEQ ID NO: 1275603 - DNA, 20 bp, Homo sapiens
gtccctcaaatgacccaaag

SEQ ID NO: 1275604 - DNA, 20 bp, Homo sapiens
gtccctcacgtttcttcccc

SEQ ID NO: 1275605 - DNA, 21 bp, Homo sapiens
gtccctcacgtttcttcccca

SEQ ID NO: 1275606 - DNA, 11 bp, Homo sapiens
gtccctccctg

SEQ ID NO: 1275607 - DNA, 22 bp, Homo sapiens
gtccctcggagctgccagccgg

SEQ ID NO: 1275608 - DNA, 16 bp, Homo sapiens
gtccctcgtccacagg

SEQ ID NO: 1275609 - DNA, 23 bp, Homo sapiens
gtccctcgtctcttgtgactcag

SEQ ID NO: 1275610 - DNA, 11 bp, Homo sapiens
gtccctctcag

SEQ ID NO: 1275611 - DNA, 12 bp, Homo sapiens
gtccctctcaga

SEQ ID NO: 1275612 - DNA, 21 bp, Homo sapiens
gtccctctcagatacccagtg

SEQ ID NO: 1275613 - DNA, 13 bp, Homo sapiens
gtccctctcaggc

SEQ ID NO: 1275614 - DNA, 21 bp, Homo sapiens
gtccctctgccccatcctcca

SEQ ID NO: 1275615 - DNA, 13 bp, Homo sapiens
gtccctctgtgta

SEQ ID NO: 1275616 - DNA, 12 bp, Homo sapiens
gtccctcttctc

SEQ ID NO: 1275617 - DNA, 19 bp, Homo sapiens
gtccctcttctctcctcag

SEQ ID NO: 1275618 - DNA, 15 bp, Homo sapiens
gtccctgcactgtgc

SEQ ID NO: 1275619 - DNA, 15 bp, Homo sapiens
gtccctgcagaagcc

SEQ ID NO: 1275620 - DNA, 22 bp, Homo sapiens
gtccctgcagaagccagaaggt

SEQ ID NO: 1275621 - DNA, 20 bp, Homo sapiens
gtccctgctcccctttgggg

SEQ ID NO: 1275622 - DNA, 17 bp, Homo sapiens
gtccctggcgcaggtgg

SEQ ID NO: 1275623 - DNA, 14 bp, Homo sapiens
gtccctgggccagg

SEQ ID NO: 1275624 - DNA, 17 bp, Homo sapiens
gtccttgcctcctggaa

SEQ ID NO: 1275625 - DNA, 20 bp, Homo sapiens
gtccttgcctcctggaagaa

SEQ ID NO: 1275626 - DNA, 20 bp, Homo sapiens
gtccttgcctgaactccaga

SEQ ID NO: 1275627 - DNA, 22 bp, Homo sapiens
gtccttgcgtcccatgaggtct

SEQ ID NO: 1275628 - DNA, 17 bp, Homo sapiens
gtccttggaagtttcat

SEQ ID NO: 1275629 - DNA, 13 bp, Homo sapiens
gtccttggccccc

SEQ ID NO: 1275630 - DNA, 23 bp, Homo sapiens
gtccttggccccctttcccgggc

SEQ ID NO: 1275631 - DNA, 15 bp, Homo sapiens
gtcctttaggcagcc

SEQ ID NO: 1275632 - DNA, 21 bp, Homo sapiens
gtcctttaggcagcctgccgc

SEQ ID NO: 1275633 - DNA, 14 bp, Homo sapiens
gtcctttagtacct

SEQ ID NO: 1275634 - DNA, 21 bp, Homo sapiens
gtcctttatgtggaaaacaga

SEQ ID NO: 1275635 - DNA, 22 bp, Homo sapiens
gtcctttatgtggaaaacagaa

SEQ ID NO: 1275636 - DNA, 22 bp, Homo sapiens
gtcctttccaaggcttctccaa

SEQ ID NO: 1275637 - DNA, 21 bp, Homo sapiens
gtcctttcccaccattcctgc

SEQ ID NO: 1275638 - DNA, 21 bp, Homo sapiens
gtcctttgcaattgctcttct

SEQ ID NO: 1275639 - DNA, 22 bp, Homo sapiens
gtccttttcataggtctgaaat

SEQ ID NO: 1275640 - DNA, 15 bp, Homo sapiens
gtccttttgacactg

SEQ ID NO: 1275641 - DNA, 16 bp, Homo sapiens
gtccttttgacactgc

SEQ ID NO: 1275642 - DNA, 22 bp, Homo sapiens
gtccttttgtaccatggtgtga

SEQ ID NO: 1275643 - DNA, 21 bp, Homo sapiens
gtcctttttcactttgaaaag

SEQ ID NO: 1275644 - DNA, 16 bp, Homo sapiens
gtcctttttttccatc

SEQ ID NO: 1275645 - DNA, 19 bp, Homo sapiens
gtcctttttttccatcttt

SEQ ID NO: 1275646 - DNA, 14 bp, Homo sapiens
gtcgacaagaatgt

SEQ ID NO: 1275647 - DNA, 13 bp, Homo sapiens
gtcgagagctggc

SEQ ID NO: 1275648 - DNA, 14 bp, Homo sapiens
gtcgagagctggcc

SEQ ID NO: 1275649 - DNA, 16 bp, Homo sapiens
gtcgagagctggccaa

SEQ ID NO: 1275650 - DNA, 16 bp, Homo sapiens
gtcgaggggctctcag

SEQ ID NO: 1275651 - DNA, 20 bp, Homo sapiens
gtcgagtctttgtgtgttat

SEQ ID NO: 1275652 - DNA, 22 bp, Homo sapiens
gtcgagtctttgtgtgttatat

SEQ ID NO: 1275653 - DNA, 14 bp, Homo sapiens
gtcgatagagctgt

SEQ ID NO: 1275654 - DNA, 17 bp, Homo sapiens
gtcgcacccacagcgaa

SEQ ID NO: 1275655 - DNA, 19 bp, Homo sapiens
gtcgcagaccagagctgtc

SEQ ID NO: 1275656 - DNA, 16 bp, Homo sapiens
gtcgccaaaaatacag

SEQ ID NO: 1275657 - DNA, 16 bp, Homo sapiens
gtcgcccacccagctg

SEQ ID NO: 1275658 - DNA, 18 bp, Homo sapiens
gtcgcccacccagctggt

SEQ ID NO: 1275659 - DNA, 19 bp, Homo sapiens
gtcgcccacccagctggtc

SEQ ID NO: 1275660 - DNA, 20 bp, Homo sapiens
gtcgcccacccagctggtcc

SEQ ID NO: 1275661 - DNA, 13 bp, Homo sapiens
gtcgcccaggaga

SEQ ID NO: 1275662 - DNA, 13 bp, Homo sapiens
gtcgccccaggcc

SEQ ID NO: 1275663 - DNA, 14 bp, Homo sapiens
gtcgccccaggccc

SEQ ID NO: 1275664 - DNA, 18 bp, Homo sapiens
gtcgccccaggccctccc

SEQ ID NO: 1275665 - DNA, 21 bp, Homo sapiens
gtcgcccttctcccggccctc

SEQ ID NO: 1275666 - DNA, 12 bp, Homo sapiens
gtcgcctctgca

SEQ ID NO: 1275667 - DNA, 15 bp, Homo sapiens
gtcgcgcgtctccca

SEQ ID NO: 1275668 - DNA, 13 bp, Homo sapiens
gtcgctcaggctg

SEQ ID NO: 1275669 - DNA, 16 bp, Homo sapiens
gtcgctcatgtgtgca

SEQ ID NO: 1275670 - DNA, 15 bp, Homo sapiens
gtcgctcctgcccac

SEQ ID NO: 1275671 - DNA, 16 bp, Homo sapiens
gtcgctgtgccacagg

SEQ ID NO: 1275672 - DNA, 20 bp, Homo sapiens
gtcggagaggctgtctgggg

SEQ ID NO: 1275673 - DNA, 13 bp, Homo sapiens
gtcggagctgcct

SEQ ID NO: 1275674 - DNA, 21 bp, Homo sapiens
gtcggagctgcctgcagcaca

SEQ ID NO: 1275675 - DNA, 14 bp, Homo sapiens
gtcggccccatctc

SEQ ID NO: 1275676 - DNA, 14 bp, Homo sapiens
gtcggccctgccca

SEQ ID NO: 1275677 - DNA, 20 bp, Homo sapiens
gtcggccgccatagccccag

SEQ ID NO: 1275678 - DNA, 11 bp, Homo sapiens
gtcggctcctg

SEQ ID NO: 1275679 - DNA, 18 bp, Homo sapiens
gtcggctgaccatgctca

SEQ ID NO: 1275680 - DNA, 15 bp, Homo sapiens
gtcgggagagccagg

SEQ ID NO: 1275681 - DNA, 18 bp, Homo sapiens
gtcgggcaccagccagcg

SEQ ID NO: 1275682 - DNA, 13 bp, Homo sapiens
gtcgggcagggcc

SEQ ID NO: 1275683 - DNA, 22 bp, Homo sapiens
gtcgggcccttcttgctgccct

SEQ ID NO: 1275684 - DNA, 17 bp, Homo sapiens
gtcgggcgtgggtctct

SEQ ID NO: 1275685 - DNA, 21 bp, Homo sapiens
gtcgggcgtgggtctctgggg

SEQ ID NO: 1275686 - DNA, 18 bp, Homo sapiens
gtcgggggctgaggggca

SEQ ID NO: 1275687 - DNA, 15 bp, Homo sapiens
gtcgggggctggcct

SEQ ID NO: 1275688 - DNA, 14 bp, Homo sapiens
gtcggggttggggt

SEQ ID NO: 1275689 - DNA, 23 bp, Homo sapiens
gtcggggttggggtgggagggcg

SEQ ID NO: 1275690 - DNA, 15 bp, Homo sapiens
gtcggtcctggtgcc

SEQ ID NO: 1275691 - DNA, 17 bp, Homo sapiens
gtcggtcctggtgccct

SEQ ID NO: 1275692 - DNA, 17 bp, Homo sapiens
gtcggtgaccccatcac

SEQ ID NO: 1275693 - DNA, 15 bp, Homo sapiens
gtcgtagaattcctt

SEQ ID NO: 1275694 - DNA, 16 bp, Homo sapiens
gtcgtctttgtgtatg

SEQ ID NO: 1275695 - DNA, 18 bp, Homo sapiens
gtcgtgaatcttgttcaa

SEQ ID NO: 1275696 - DNA, 17 bp, Homo sapiens
gtcgtgatgtggaggaa

SEQ ID NO: 1275697 - DNA, 12 bp, Homo sapiens
gtcgtgcctgtg

SEQ ID NO: 1275698 - DNA, 14 bp, Homo sapiens
gtcgtgcctgtgtc

SEQ ID NO: 1275699 - DNA, 22 bp, Homo sapiens
gtcgtggcagataatcagcctc

SEQ ID NO: 1275700 - DNA, 23 bp, Homo sapiens
gtcgtggcagataatcagcctct

SEQ ID NO: 1275701 - DNA, 11 bp, Homo sapiens
gtcgttttcca

SEQ ID NO: 1275702 - DNA, 15 bp, Homo sapiens
gtcgttttccaaaga

SEQ ID NO: 1275703 - DNA, 23 bp, Homo sapiens
gtcgttttttttttttcttttct

SEQ ID NO: 1275704 - DNA, 16 bp, Homo sapiens
gtctaaacaatgctga

SEQ ID NO: 1275705 - DNA, 21 bp, Homo sapiens
gtctaaacaatgctgatttgg

SEQ ID NO: 1275706 - DNA, 21 bp, Homo sapiens
gtctaaaccaagattatgtga

SEQ ID NO: 1275707 - DNA, 10 bp, Homo sapiens
gtctaaactg

SEQ ID NO: 1275708 - DNA, 21 bp, Homo sapiens
gtctaaactgagctcgcagcc

SEQ ID NO: 1275709 - DNA, 12 bp, Homo sapiens
gtctaacatatt

SEQ ID NO: 1275710 - DNA, 16 bp, Homo sapiens
gtctacagttgtcctg

SEQ ID NO: 1275711 - DNA, 23 bp, Homo sapiens
gtctacattcttggttgttaatt

SEQ ID NO: 1275712 - DNA, 21 bp, Homo sapiens
gtctaccaccgaatccctagt

SEQ ID NO: 1275713 - DNA, 16 bp, Homo sapiens
gtctaccctgtccttt

SEQ ID NO: 1275714 - DNA, 17 bp, Homo sapiens
gtctactcctagaagaa

SEQ ID NO: 1275715 - DNA, 13 bp, Homo sapiens
gtctactctgaag

SEQ ID NO: 1275716 - DNA, 11 bp, Homo sapiens
gtctactgtgg

SEQ ID NO: 1275717 - DNA, 16 bp, Homo sapiens
gtctactttttaattt

SEQ ID NO: 1275718 - DNA, 16 bp, Homo sapiens
gtctagaaccagttat

SEQ ID NO: 1275719 - DNA, 13 bp, Homo sapiens
gtctagagaggga

SEQ ID NO: 1275720 - DNA, 15 bp, Homo sapiens
gtctagagagggagg

SEQ ID NO: 1275721 - DNA, 16 bp, Homo sapiens
gtctagagtcatgtga

SEQ ID NO: 1275722 - DNA, 20 bp, Homo sapiens
gtctagagtcatgtgagcct

SEQ ID NO: 1275723 - DNA, 18 bp, Homo sapiens
gtctagatggctcctctc

SEQ ID NO: 1275724 - DNA, 21 bp, Homo sapiens
gtctagatggctcctctcagt

SEQ ID NO: 1275725 - DNA, 20 bp, Homo sapiens
gtctagattaatactctatt

SEQ ID NO: 1275726 - DNA, 19 bp, Homo sapiens
gtctagcagagcaggggca

SEQ ID NO: 1275727 - DNA, 14 bp, Homo sapiens
gtctagccactccc

SEQ ID NO: 1275728 - DNA, 22 bp, Homo sapiens
gtctagctatgctgtatctgtg

SEQ ID NO: 1275729 - DNA, 14 bp, Homo sapiens
gtctaggacacagt

SEQ ID NO: 1275730 - DNA, 16 bp, Homo sapiens
gtctaggactgcagtg

SEQ ID NO: 1275731 - DNA, 22 bp, Homo sapiens
gtctaggataacttgctttctt

SEQ ID NO: 1275732 - DNA, 12 bp, Homo sapiens
gtctagggagag

SEQ ID NO: 1275733 - DNA, 16 bp, Homo sapiens
gtctagggcacaaaga

SEQ ID NO: 1275734 - DNA, 13 bp, Homo sapiens
gtctagtcttctg

SEQ ID NO: 1275735 - DNA, 15 bp, Homo sapiens
gtctagtttctagtg

SEQ ID NO: 1275736 - DNA, 15 bp, Homo sapiens
gtctataaagcattt

SEQ ID NO: 1275737 - DNA, 21 bp, Homo sapiens
gtctataatcccagcactttg

SEQ ID NO: 1275738 - DNA, 17 bp, Homo sapiens
gtctatatcataactat

SEQ ID NO: 1275739 - DNA, 18 bp, Homo sapiens
gtctatatcataactata

SEQ ID NO: 1275740 - DNA, 22 bp, Homo sapiens
gtctatcaaccccagacactgg

SEQ ID NO: 1275741 - DNA, 18 bp, Homo sapiens
gtctatgaagttgctgtt

SEQ ID NO: 1275742 - DNA, 22 bp, Homo sapiens
gtctatgaagttgctgtttatt

SEQ ID NO: 1275743 - DNA, 15 bp, Homo sapiens
gtctatgttcaaaga

SEQ ID NO: 1275744 - DNA, 14 bp, Homo sapiens
gtctattatcacat

SEQ ID NO: 1275745 - DNA, 17 bp, Homo sapiens
gtctattatcacattaa

SEQ ID NO: 1275746 - DNA, 23 bp, Homo sapiens
gtctggaaaaaaacaaaaacaga

SEQ ID NO: 1275747 - DNA, 20 bp, Homo sapiens
gtctggaaagtgatgtcaga

SEQ ID NO: 1275748 - DNA, 13 bp, Homo sapiens
gtctggaccccgt

SEQ ID NO: 1275749 - DNA, 14 bp, Homo sapiens
gtctggagaagcag

SEQ ID NO: 1275750 - DNA, 17 bp, Homo sapiens
gtctggagaagcagtga

SEQ ID NO: 1275751 - DNA, 21 bp, Homo sapiens
gtctggagaagctcccaggaa

SEQ ID NO: 1275752 - DNA, 14 bp, Homo sapiens
gtctggatcagtaa

SEQ ID NO: 1275753 - DNA, 14 bp, Homo sapiens
gtctggatgggagg

SEQ ID NO: 1275754 - DNA, 15 bp, Homo sapiens
gtctggatgggagga

SEQ ID NO: 1275755 - DNA, 13 bp, Homo sapiens
gtctggcagagcc

SEQ ID NO: 1275756 - DNA, 15 bp, Homo sapiens
gtctggcagagcctc

SEQ ID NO: 1275757 - DNA, 20 bp, Homo sapiens
gtctggcagagcctctgaga

SEQ ID NO: 1275758 - DNA, 12 bp, Homo sapiens
gtctggcagcct

SEQ ID NO: 1275759 - DNA, 14 bp, Homo sapiens
gtctggccaggcac

SEQ ID NO: 1275760 - DNA, 21 bp, Homo sapiens
gtctggcgttctcaagaatct

SEQ ID NO: 1275761 - DNA, 14 bp, Homo sapiens
gtctggctccctgc

SEQ ID NO: 1275762 - DNA, 20 bp, Homo sapiens
gtctggctcggacccacccc

SEQ ID NO: 1275763 - DNA, 15 bp, Homo sapiens
gtctggctgagctga

SEQ ID NO: 1275764 - DNA, 15 bp, Homo sapiens
gtctggctttgctct

SEQ ID NO: 1275765 - DNA, 23 bp, Homo sapiens
gtctgggaacttgcgagtccaag

SEQ ID NO: 1275766 - DNA, 21 bp, Homo sapiens
gtctgggacttccttgctctc

SEQ ID NO: 1275767 - DNA, 24 bp, Homo sapiens
gtctgggacttccttgctctccct

SEQ ID NO: 1275768 - DNA, 15 bp, Homo sapiens
gtctgggagagcctg

SEQ ID NO: 1275769 - DNA, 16 bp, Homo sapiens
gtctgggagagcctgg

SEQ ID NO: 1275770 - DNA, 18 bp, Homo sapiens
gtctgggagagcctggca

SEQ ID NO: 1275771 - DNA, 18 bp, Homo sapiens
gtctgggatatggctgcc

SEQ ID NO: 1275772 - DNA, 22 bp, Homo sapiens
gtctgggatatggctgcccagg

SEQ ID NO: 1275773 - DNA, 16 bp, Homo sapiens
gtctgggatgtagaac

SEQ ID NO: 1275774 - DNA, 21 bp, Homo sapiens
gtctgggcaagtagcaggact

SEQ ID NO: 1275775 - DNA, 23 bp, Homo sapiens
gtctgggcaccacctctgtgggc

SEQ ID NO: 1275776 - DNA, 17 bp, Homo sapiens
gtctgggcagtgccaca

SEQ ID NO: 1275777 - DNA, 19 bp, Homo sapiens
gtctgggcagtgccacagc

SEQ ID NO: 1275778 - DNA, 12 bp, Homo sapiens
gtctgggcctct

SEQ ID NO: 1275779 - DNA, 21 bp, Homo sapiens
gtctgggcgtccagctcagcc

SEQ ID NO: 1275780 - DNA, 14 bp, Homo sapiens
gtctgggctgggca

SEQ ID NO: 1275781 - DNA, 13 bp, Homo sapiens
gtctgggggcagc

SEQ ID NO: 1275782 - DNA, 23 bp, Homo sapiens
gtctggggttcagcccctcctct

SEQ ID NO: 1275783 - DNA, 19 bp, Homo sapiens
gtctgggtctaccaggaac

SEQ ID NO: 1275784 - DNA, 17 bp, Homo sapiens
gtctgggtgcagctggg

SEQ ID NO: 1275785 - DNA, 23 bp, Homo sapiens
gtctggtgaggtggcccaggccc

SEQ ID NO: 1275786 - DNA, 15 bp, Homo sapiens
gtctggttaaatagt

SEQ ID NO: 1275787 - DNA, 18 bp, Homo sapiens
gtctggttgggcagccag

SEQ ID NO: 1275788 - DNA, 23 bp, Homo sapiens
gtctggtttctgtccccggggca

SEQ ID NO: 1275789 - DNA, 15 bp, Homo sapiens
gtctgtaaaaaatgg

SEQ ID NO: 1275790 - DNA, 20 bp, Homo sapiens
gtctgtaaaaaatggagctc

SEQ ID NO: 1275791 - DNA, 19 bp, Homo sapiens
gtctgtaaatctaacatta

SEQ ID NO: 1275792 - DNA, 18 bp, Homo sapiens
gtctgtaactgcccagcc

SEQ ID NO: 1275793 - DNA, 20 bp, Homo sapiens
gtctgtaactgcccagcccc

SEQ ID NO: 1275794 - DNA, 14 bp, Homo sapiens
gtctgtaatacact

SEQ ID NO: 1275795 - DNA, 11 bp, Homo sapiens
gtctgtacata

SEQ ID NO: 1275796 - DNA, 17 bp, Homo sapiens
gtctgtacatactggcc

SEQ ID NO: 1275797 - DNA, 16 bp, Homo sapiens
gtctgtaggagcaagg

SEQ ID NO: 1275798 - DNA, 20 bp, Homo sapiens
gtctgtaggtgtctctgggc

SEQ ID NO: 1275799 - DNA, 22 bp, Homo sapiens
gtctgtatactcctgtcaccta

SEQ ID NO: 1275800 - DNA, 15 bp, Homo sapiens
gtctgtatatacatt

SEQ ID NO: 1275801 - DNA, 21 bp, Homo sapiens
gtctgtcaaatgtttccttaa

SEQ ID NO: 1275802 - DNA, 14 bp, Homo sapiens
gtctgtcacaggct

SEQ ID NO: 1275803 - DNA, 18 bp, Homo sapiens
gtctgtcacaggctgggt

SEQ ID NO: 1275804 - DNA, 20 bp, Homo sapiens
gtctgtcaccagctatctgt

SEQ ID NO: 1275805 - DNA, 17 bp, Homo sapiens
gtctgtccatctgtctg

SEQ ID NO: 1275806 - DNA, 15 bp, Homo sapiens
gtctgtcccaccagc

SEQ ID NO: 1275807 - DNA, 18 bp, Homo sapiens
gtctgtcccttccccttc

SEQ ID NO: 1275808 - DNA, 15 bp, Homo sapiens
gtctgtcccttttct

SEQ ID NO: 1275809 - DNA, 21 bp, Homo sapiens
gtctgtcccttttctttgacc

SEQ ID NO: 1275810 - DNA, 16 bp, Homo sapiens
gtctgtcctcacgccc

SEQ ID NO: 1275811 - DNA, 16 bp, Homo sapiens
gtctgtcgtgatgggg

SEQ ID NO: 1275812 - DNA, 18 bp, Homo sapiens
gtctgtctagtgtctggg

SEQ ID NO: 1275813 - DNA, 21 bp, Homo sapiens
gtctgtctcagagtcccagga

SEQ ID NO: 1275814 - DNA, 23 bp, Homo sapiens
gtctgtctccctcccctctcaga

SEQ ID NO: 1275815 - DNA, 14 bp, Homo sapiens
gtctgtctctcccc

SEQ ID NO: 1275816 - DNA, 21 bp, Homo sapiens
gtctgtcttgagatctgattt

SEQ ID NO: 1275817 - DNA, 13 bp, Homo sapiens
gtctgtgaagagc

SEQ ID NO: 1275818 - DNA, 14 bp, Homo sapiens
gtctgtgaagagcc

SEQ ID NO: 1275819 - DNA, 11 bp, Homo sapiens
gtctgtgactg

SEQ ID NO: 1275820 - DNA, 17 bp, Homo sapiens
gtctgtgagaggcagct

SEQ ID NO: 1275821 - DNA, 20 bp, Homo sapiens
gtctgtgagtacctggtcat

SEQ ID NO: 1275822 - DNA, 13 bp, Homo sapiens
gtctgtgccatgg

SEQ ID NO: 1275823 - DNA, 15 bp, Homo sapiens
gtctgtgccatggcc

SEQ ID NO: 1275824 - DNA, 12 bp, Homo sapiens
gtctgtgctgag

SEQ ID NO: 1275825 - DNA, 13 bp, Homo sapiens
gtctgtgctgagg

SEQ ID NO: 1275826 - DNA, 16 bp, Homo sapiens
gtctgtgctgtgcctg

SEQ ID NO: 1275827 - DNA, 16 bp, Homo sapiens
gtctgtggattttttc

SEQ ID NO: 1275828 - DNA, 15 bp, Homo sapiens
gtctgtgggcttcag

SEQ ID NO: 1275829 - DNA, 16 bp, Homo sapiens
gtctgtgggcttcagc

SEQ ID NO: 1275830 - DNA, 14 bp, Homo sapiens
gtctgtggggaggg

SEQ ID NO: 1275831 - DNA, 23 bp, Homo sapiens
gtctgtggggaggggttgttttg

SEQ ID NO: 1275832 - DNA, 20 bp, Homo sapiens
gtctgtgtaactttaaacat

SEQ ID NO: 1275833 - DNA, 14 bp, Homo sapiens
gtctgtgtgaatgt

SEQ ID NO: 1275834 - DNA, 15 bp, Homo sapiens
gtctgtgtgaatgtg

SEQ ID NO: 1275835 - DNA, 17 bp, Homo sapiens
gtctgtgtgcaagtgtg

SEQ ID NO: 1275836 - DNA, 20 bp, Homo sapiens
gtctgtgtggtggagccagg

SEQ ID NO: 1275837 - DNA, 23 bp, Homo sapiens
gtctgtgtggtggagccagggcc

SEQ ID NO: 1275838 - DNA, 22 bp, Homo sapiens
gtctgtgttgcgtgtcgtgggt

SEQ ID NO: 1275839 - DNA, 14 bp, Homo sapiens
gtctgttacactgg

SEQ ID NO: 1275840 - DNA, 16 bp, Homo sapiens
gtctgttatttattat

SEQ ID NO: 1275841 - DNA, 17 bp, Homo sapiens
gtctgttcacttttcct

SEQ ID NO: 1275842 - DNA, 21 bp, Homo sapiens
gtctgttccccatggccactt

SEQ ID NO: 1275843 - DNA, 22 bp, Homo sapiens
gtctgttccttttctctcctgt

SEQ ID NO: 1275844 - DNA, 11 bp, Homo sapiens
gtctgttgagt

SEQ ID NO: 1275845 - DNA, 16 bp, Homo sapiens
gtctgttgattaaaga

SEQ ID NO: 1275846 - DNA, 19 bp, Homo sapiens
gtctgttgattaaagatga

SEQ ID NO: 1275847 - DNA, 16 bp, Homo sapiens
gtctgttggcaggctg

SEQ ID NO: 1275848 - DNA, 22 bp, Homo sapiens
gtctgttggcaggctggccagt

SEQ ID NO: 1275849 - DNA, 14 bp, Homo sapiens
gtctgtttaaagtg

SEQ ID NO: 1275850 - DNA, 22 bp, Homo sapiens
gtctgtttcaatgacctgtatt

SEQ ID NO: 1275851 - DNA, 21 bp, Homo sapiens
gtctgtttgccacttgatggg

SEQ ID NO: 1275852 - DNA, 17 bp, Homo sapiens
gtctgtttgtctgaaca

SEQ ID NO: 1275853 - DNA, 14 bp, Homo sapiens
gtctgtttgtttca

SEQ ID NO: 1275854 - DNA, 17 bp, Homo sapiens
gtctgtttgtttcaaga

SEQ ID NO: 1275855 - DNA, 23 bp, Homo sapiens
gtctgtttgtttcaagaacctgg

SEQ ID NO: 1275856 - DNA, 20 bp, Homo sapiens
gtctgttttggtcccctccc

SEQ ID NO: 1275857 - DNA, 22 bp, Homo sapiens
gtctgttttggtcccctccctc

SEQ ID NO: 1275858 - DNA, 14 bp, Homo sapiens
gtctgtttttgtat

SEQ ID NO: 1275859 - DNA, 22 bp, Homo sapiens
gtcttaaagcatttcaggccag

SEQ ID NO: 1275860 - DNA, 14 bp, Homo sapiens
gtcttaaataaaac

SEQ ID NO: 1275861 - DNA, 16 bp, Homo sapiens
gtcttaaataaaacta

SEQ ID NO: 1275862 - DNA, 23 bp, Homo sapiens
gtcttaaataaaactatttaaaa

SEQ ID NO: 1275863 - DNA, 14 bp, Homo sapiens
gtcttaaatgctca

SEQ ID NO: 1275864 - DNA, 22 bp, Homo sapiens
gtcttaaatgctcataaagatg

SEQ ID NO: 1275865 - DNA, 17 bp, Homo sapiens
gtcttaaatgctcattt

SEQ ID NO: 1275866 - DNA, 18 bp, Homo sapiens
gtcttaaatgctcatttt

SEQ ID NO: 1275867 - DNA, 18 bp, Homo sapiens
gtcttaaattttcttcct

SEQ ID NO: 1275868 - DNA, 17 bp, Homo sapiens
gtgaattattgacactg

SEQ ID NO: 1275869 - DNA, 19 bp, Homo sapiens
gtgaattattgacactgaa

SEQ ID NO: 1275870 - DNA, 11 bp, Homo sapiens
gtgaattctgc

SEQ ID NO: 1275871 - DNA, 20 bp, Homo sapiens
gtgaattgcctgcagagaga

SEQ ID NO: 1275872 - DNA, 19 bp, Homo sapiens
gtgaattgtacctatttct

SEQ ID NO: 1275873 - DNA, 16 bp, Homo sapiens
gtgaattgtcttttag

SEQ ID NO: 1275874 - DNA, 18 bp, Homo sapiens
gtgaattgtcttttagac

SEQ ID NO: 1275875 - DNA, 14 bp, Homo sapiens
gtgaatttatgaga

SEQ ID NO: 1275876 - DNA, 16 bp, Homo sapiens
gtgaatttctaaatgt

SEQ ID NO: 1275877 - DNA, 19 bp, Homo sapiens
gtgaatttctgaaagatga

SEQ ID NO: 1275878 - DNA, 19 bp, Homo sapiens
gtgaatttcttcactgttg

SEQ ID NO: 1275879 - DNA, 14 bp, Homo sapiens
gtgaatttgaatga

SEQ ID NO: 1275880 - DNA, 18 bp, Homo sapiens
gtgaattttcaaggcctt

SEQ ID NO: 1275881 - DNA, 13 bp, Homo sapiens
gtgaatttttatt

SEQ ID NO: 1275882 - DNA, 15 bp, Homo sapiens
gtgaatttttctcta

SEQ ID NO: 1275883 - DNA, 17 bp, Homo sapiens
gtgaatttttttttcct

SEQ ID NO: 1275884 - DNA, 21 bp, Homo sapiens
gtgacaaaagcagcacaagga

SEQ ID NO: 1275885 - DNA, 21 bp, Homo sapiens
gtgacaaaatgggaggaggaa

SEQ ID NO: 1275886 - DNA, 18 bp, Homo sapiens
gtgacaaagactcctctg

SEQ ID NO: 1275887 - DNA, 19 bp, Homo sapiens
gtgacaaagactcctctgg

SEQ ID NO: 1275888 - DNA, 21 bp, Homo sapiens
gtgacaaagactcctctgggc

SEQ ID NO: 1275889 - DNA, 23 bp, Homo sapiens
gtgacaagctcctggtcttgaga

SEQ ID NO: 1275890 - DNA, 19 bp, Homo sapiens
gtgacaatatacttcactg

SEQ ID NO: 1275891 - DNA, 15 bp, Homo sapiens
gtgacaatctgcctt

SEQ ID NO: 1275892 - DNA, 12 bp, Homo sapiens
gtgacacagcag

SEQ ID NO: 1275893 - DNA, 19 bp, Homo sapiens
gtgacacagcagcttcacc

SEQ ID NO: 1275894 - DNA, 18 bp, Homo sapiens
gtgacacaggtcagggct

SEQ ID NO: 1275895 - DNA, 22 bp, Homo sapiens
gtgacacatcaagcttttctgt

SEQ ID NO: 1275896 - DNA, 20 bp, Homo sapiens
gtgacaccaataaatgtttg

SEQ ID NO: 1275897 - DNA, 14 bp, Homo sapiens
gtgacacctccccc

SEQ ID NO: 1275898 - DNA, 14 bp, Homo sapiens
gtgacactctcgtg

SEQ ID NO: 1275899 - DNA, 21 bp, Homo sapiens
gtgacactgatgagtttcact

SEQ ID NO: 1275900 - DNA, 18 bp, Homo sapiens
gtgacacttcagagagct

SEQ ID NO: 1275901 - DNA, 15 bp, Homo sapiens
gtgacagacaggctc

SEQ ID NO: 1275902 - DNA, 16 bp, Homo sapiens
gtgacagacaggctct

SEQ ID NO: 1275903 - DNA, 16 bp, Homo sapiens
gtgacagactcctgag

SEQ ID NO: 1275904 - DNA, 16 bp, Homo sapiens
gtgacagccttgggcc

SEQ ID NO: 1275905 - DNA, 21 bp, Homo sapiens
gtgacagcgatggcaggcctg

SEQ ID NO: 1275906 - DNA, 17 bp, Homo sapiens
gtgacaggaaagccctc

SEQ ID NO: 1275907 - DNA, 20 bp, Homo sapiens
gtgacagggaaacctttttt

SEQ ID NO: 1275908 - DNA, 14 bp, Homo sapiens
gtgacagggccagt

SEQ ID NO: 1275909 - DNA, 19 bp, Homo sapiens
gtgacagtattttggttct

SEQ ID NO: 1275910 - DNA, 11 bp, Homo sapiens
gtgacagtcat

SEQ ID NO: 1275911 - DNA, 13 bp, Homo sapiens
gtgacagtcatca

SEQ ID NO: 1275912 - DNA, 20 bp, Homo sapiens
gtgacagtcatcatcagggc

SEQ ID NO: 1275913 - DNA, 22 bp, Homo sapiens
gtgacagtcatcatcagggcct

SEQ ID NO: 1275914 - DNA, 13 bp, Homo sapiens
gtgacagtgaaat

SEQ ID NO: 1275915 - DNA, 23 bp, Homo sapiens
gtgacagtgcctgggaatgtatt

SEQ ID NO: 1275916 - DNA, 18 bp, Homo sapiens
gtgacataattgtccagt

SEQ ID NO: 1275917 - DNA, 16 bp, Homo sapiens
gtgacatagcctcatg

SEQ ID NO: 1275918 - DNA, 18 bp, Homo sapiens
gtgacatcagtggcatgg

SEQ ID NO: 1275919 - DNA, 16 bp, Homo sapiens
gtgacatcggaaaaat

SEQ ID NO: 1275920 - DNA, 18 bp, Homo sapiens
gtgacatcggaaaaataa

SEQ ID NO: 1275921 - DNA, 14 bp, Homo sapiens
gtgacatctcttac

SEQ ID NO: 1275922 - DNA, 23 bp, Homo sapiens
gtgacatggtgcctgagaggcag

SEQ ID NO: 1275923 - DNA, 13 bp, Homo sapiens
gtgacattcactg

SEQ ID NO: 1275924 - DNA, 17 bp, Homo sapiens
gtgaccaaaagttacat

SEQ ID NO: 1275925 - DNA, 19 bp, Homo sapiens
gtgaccaactgtgttgtat

SEQ ID NO: 1275926 - DNA, 16 bp, Homo sapiens
gtgaccaccttctgtc

SEQ ID NO: 1275927 - DNA, 19 bp, Homo sapiens
gtgaccaccttctgtcccc

SEQ ID NO: 1275928 - DNA, 17 bp, Homo sapiens
gtgaccagcggaaacag

SEQ ID NO: 1275929 - DNA, 12 bp, Homo sapiens
gtgaccagggaa

SEQ ID NO: 1275930 - DNA, 14 bp, Homo sapiens
gtgaccaggggtga

SEQ ID NO: 1275931 - DNA, 11 bp, Homo sapiens
gtgaccatgtt

SEQ ID NO: 1275932 - DNA, 18 bp, Homo sapiens
gtgaccatgttttgttta

SEQ ID NO: 1275933 - DNA, 17 bp, Homo sapiens
gtgaccattctgcctct

SEQ ID NO: 1275934 - DNA, 19 bp, Homo sapiens
gtgaccattctgcctctcc

SEQ ID NO: 1275935 - DNA, 15 bp, Homo sapiens
gtgaccatttataat

SEQ ID NO: 1275936 - DNA, 13 bp, Homo sapiens
gtgacccacagct

SEQ ID NO: 1275937 - DNA, 15 bp, Homo sapiens
gtgacccacagctct

SEQ ID NO: 1275938 - DNA, 16 bp, Homo sapiens
gtgacccacagctctg

SEQ ID NO: 1275939 - DNA, 18 bp, Homo sapiens
gtgacccacagctctggg

SEQ ID NO: 1275940 - DNA, 22 bp, Homo sapiens
gtgacccacagctctgggcctc

SEQ ID NO: 1275941 - DNA, 16 bp, Homo sapiens
gtgacccagagccacc

SEQ ID NO: 1275942 - DNA, 11 bp, Homo sapiens
gtgacccagct

SEQ ID NO: 1275943 - DNA, 23 bp, Homo sapiens
gtgacccagctactgaaccagcc

SEQ ID NO: 1275944 - DNA, 14 bp, Homo sapiens
gtgaccccagggcc

SEQ ID NO: 1275945 - DNA, 16 bp, Homo sapiens
gtgaccccagggcctg

SEQ ID NO: 1275946 - DNA, 17 bp, Homo sapiens
gtgaccccagggcctgt

SEQ ID NO: 1275947 - DNA, 23 bp, Homo sapiens
gtgaccccatcactcgcaggacc

SEQ ID NO: 1275948 - DNA, 15 bp, Homo sapiens
gtgacccccagctcc

SEQ ID NO: 1275949 - DNA, 15 bp, Homo sapiens
gtgacccgtgaatgt

SEQ ID NO: 1275950 - DNA, 12 bp, Homo sapiens
gtgaccctctca

SEQ ID NO: 1275951 - DNA, 19 bp, Homo sapiens
gtgaccgactaccccagtc

SEQ ID NO: 1275952 - DNA, 22 bp, Homo sapiens
gtgaccgactaccccagtccca

SEQ ID NO: 1275953 - DNA, 19 bp, Homo sapiens
gtgaccgggcactggcact

SEQ ID NO: 1275954 - DNA, 21 bp, Homo sapiens
gtgaccgggggctgctgggcg

SEQ ID NO: 1275955 - DNA, 18 bp, Homo sapiens
gtgacctccacagctacc

SEQ ID NO: 1275956 - DNA, 14 bp, Homo sapiens
gtgacctcctgtca

SEQ ID NO: 1275957 - DNA, 16 bp, Homo sapiens
gtgacctcctgtcact

SEQ ID NO: 1275958 - DNA, 13 bp, Homo sapiens
gtgacctcttcaa

SEQ ID NO: 1275959 - DNA, 19 bp, Homo sapiens
gtgacctgatttcagaaga

SEQ ID NO: 1275960 - DNA, 23 bp, Homo sapiens
gtgacctgatttcagaagagact

SEQ ID NO: 1275961 - DNA, 23 bp, Homo sapiens
gtgacctgccccgcccagctgca

SEQ ID NO: 1275962 - DNA, 20 bp, Homo sapiens
gtgacctgggtatcccctgc

SEQ ID NO: 1275963 - DNA, 21 bp, Homo sapiens
gtgacctgggtatcccctgcc

SEQ ID NO: 1275964 - DNA, 23 bp, Homo sapiens
gtgacctgtggggatttctccca

SEQ ID NO: 1275965 - DNA, 19 bp, Homo sapiens
gtgaccttgggaccaaagg

SEQ ID NO: 1275966 - DNA, 20 bp, Homo sapiens
gtgacctttaagaaaaatga

SEQ ID NO: 1275967 - DNA, 18 bp, Homo sapiens
gtgacgatgggtgttgct

SEQ ID NO: 1275968 - DNA, 20 bp, Homo sapiens
gtgacgatgggtgttgctgt

SEQ ID NO: 1275969 - DNA, 13 bp, Homo sapiens
gtgacgcccagct

SEQ ID NO: 1275970 - DNA, 14 bp, Homo sapiens
gtgacgcccagctc

SEQ ID NO: 1275971 - DNA, 15 bp, Homo sapiens
gtgacgcccagctcc

SEQ ID NO: 1275972 - DNA, 17 bp, Homo sapiens
gtgacgcctgccctccc

SEQ ID NO: 1275973 - DNA, 21 bp, Homo sapiens
gtgacggtcctttaggcagcc

SEQ ID NO: 1275974 - DNA, 24 bp, Homo sapiens
gtgacggtcctttaggcagcctgc

SEQ ID NO: 1275975 - DNA, 17 bp, Homo sapiens
gtgactaaaagggcttc

SEQ ID NO: 1275976 - DNA, 17 bp, Homo sapiens
gtgactaggcatacact

SEQ ID NO: 1275977 - DNA, 15 bp, Homo sapiens
gtgactcagcagagg

SEQ ID NO: 1275978 - DNA, 16 bp, Homo sapiens
gtgactcagcagaggc

SEQ ID NO: 1275979 - DNA, 15 bp, Homo sapiens
gtgactccctgggag

SEQ ID NO: 1275980 - DNA, 18 bp, Homo sapiens
gtgactcctgaagggaag

SEQ ID NO: 1275981 - DNA, 18 bp, Homo sapiens
gtgactcgggagctgcac

SEQ ID NO: 1275982 - DNA, 19 bp, Homo sapiens
gtgactcgggagctgcaca

SEQ ID NO: 1275983 - DNA, 22 bp, Homo sapiens
gtgactctcctgcctcagcctc

SEQ ID NO: 1275984 - DNA, 14 bp, Homo sapiens
gtgactctgggcag

SEQ ID NO: 1275985 - DNA, 16 bp, Homo sapiens
gtgactctttttaggg

SEQ ID NO: 1275986 - DNA, 15 bp, Homo sapiens
gtgactgaagaagat

SEQ ID NO: 1275987 - DNA, 19 bp, Homo sapiens
gtgactgaaggggcacacc

SEQ ID NO: 1275988 - DNA, 21 bp, Homo sapiens
gtgactgaaggggcacaccac

SEQ ID NO: 1275989 - DNA, 16 bp, Homo sapiens
gtgactgaatttcttt

SEQ ID NO: 1275990 - DNA, 16 bp, Homo sapiens
gtgccagcaactgaat

SEQ ID NO: 1275991 - DNA, 21 bp, Homo sapiens
gtgccagcaactgaataaata

SEQ ID NO: 1275992 - DNA, 11 bp, Homo sapiens
gtgccagcagc

SEQ ID NO: 1275993 - DNA, 23 bp, Homo sapiens
gtgccagcatacattttctggtg

SEQ ID NO: 1275994 - DNA, 12 bp, Homo sapiens
gtgccagccaat

SEQ ID NO: 1275995 - DNA, 14 bp, Homo sapiens
gtgccagctccagt

SEQ ID NO: 1275996 - DNA, 13 bp, Homo sapiens
gtgccaggacaat

SEQ ID NO: 1275997 - DNA, 13 bp, Homo sapiens
gtgccaggaccag

SEQ ID NO: 1275998 - DNA, 15 bp, Homo sapiens
gtgccaggaccagcc

SEQ ID NO: 1275999 - DNA, 17 bp, Homo sapiens
gtgccaggagggcacag

SEQ ID NO: 1276000 - DNA, 18 bp, Homo sapiens
gtgccaggagggcacagc

SEQ ID NO: 1276001 - DNA, 16 bp, Homo sapiens
gtgccaggcagatcct

SEQ ID NO: 1276002 - DNA, 12 bp, Homo sapiens
gtgccaggcccg

SEQ ID NO: 1276003 - DNA, 17 bp, Homo sapiens
gtgccaggctgtaagca

SEQ ID NO: 1276004 - DNA, 18 bp, Homo sapiens
gtgccaggcttgcctggg

SEQ ID NO: 1276005 - DNA, 19 bp, Homo sapiens
gtgccaggcttgcctgggc

SEQ ID NO: 1276006 - DNA, 21 bp, Homo sapiens
gtgccaggcttgcctgggctg

SEQ ID NO: 1276007 - DNA, 19 bp, Homo sapiens
gtgccagggtgggctgggg

SEQ ID NO: 1276008 - DNA, 21 bp, Homo sapiens
gtgccagggtgggctggggac

SEQ ID NO: 1276009 - DNA, 16 bp, Homo sapiens
gtgccaggtggctcag

SEQ ID NO: 1276010 - DNA, 22 bp, Homo sapiens
gtgccaggtggctcagtgccac

SEQ ID NO: 1276011 - DNA, 14 bp, Homo sapiens
gtgccagttcctgt

SEQ ID NO: 1276012 - DNA, 15 bp, Homo sapiens
gtgccagttcctgta

SEQ ID NO: 1276013 - DNA, 23 bp, Homo sapiens
gtgccatagagtttaacacaagt

SEQ ID NO: 1276014 - DNA, 23 bp, Homo sapiens
gtgccatctgtacatattactgt

SEQ ID NO: 1276015 - DNA, 13 bp, Homo sapiens
gtgccatggcccc

SEQ ID NO: 1276016 - DNA, 20 bp, Homo sapiens
gtgccatggccccccactcc

SEQ ID NO: 1276017 - DNA, 18 bp, Homo sapiens
gtgccatgtcacagcatg

SEQ ID NO: 1276018 - DNA, 16 bp, Homo sapiens
gtgccattactactgt

SEQ ID NO: 1276019 - DNA, 13 bp, Homo sapiens
gtgccattttaaa

SEQ ID NO: 1276020 - DNA, 23 bp, Homo sapiens
gtgcccaagaatagatgctgact

SEQ ID NO: 1276021 - DNA, 15 bp, Homo sapiens
gtgcccaagagtggg

SEQ ID NO: 1276022 - DNA, 19 bp, Homo sapiens
gtgcccaagccagaggctg

SEQ ID NO: 1276023 - DNA, 13 bp, Homo sapiens
gtgcccacagcag

SEQ ID NO: 1276024 - DNA, 13 bp, Homo sapiens
gtgcccaccgccc

SEQ ID NO: 1276025 - DNA, 20 bp, Homo sapiens
gtgcccaccgccctcctcca

SEQ ID NO: 1276026 - DNA, 17 bp, Homo sapiens
gtgcccacgagggtctc

SEQ ID NO: 1276027 - DNA, 18 bp, Homo sapiens
gtgcccacggtctgagct

SEQ ID NO: 1276028 - DNA, 21 bp, Homo sapiens
gtgcccacggtctgagctagc

SEQ ID NO: 1276029 - DNA, 22 bp, Homo sapiens
gtgcccacggtctgagctagct

SEQ ID NO: 1276030 - DNA, 20 bp, Homo sapiens
gtgcccagaacttccctgat

SEQ ID NO: 1276031 - DNA, 14 bp, Homo sapiens
gtgcccagcaggcc

SEQ ID NO: 1276032 - DNA, 18 bp, Homo sapiens
gtgcccagcaggcccagc

SEQ ID NO: 1276033 - DNA, 20 bp, Homo sapiens
gtgcccagcctccatgtttt

SEQ ID NO: 1276034 - DNA, 12 bp, Homo sapiens
gtgcccaggccc

SEQ ID NO: 1276035 - DNA, 13 bp, Homo sapiens
gtgcccaggccct

SEQ ID NO: 1276036 - DNA, 14 bp, Homo sapiens
gtgcccaggccctt

SEQ ID NO: 1276037 - DNA, 19 bp, Homo sapiens
gtgcccaggggcccacagg

SEQ ID NO: 1276038 - DNA, 16 bp, Homo sapiens
gtgcccatcctgccat

SEQ ID NO: 1276039 - DNA, 13 bp, Homo sapiens
gtgcccatttgtg

SEQ ID NO: 1276040 - DNA, 13 bp, Homo sapiens
gtgccccacagct

SEQ ID NO: 1276041 - DNA, 11 bp, Homo sapiens
gtgccccacca

SEQ ID NO: 1276042 - DNA, 13 bp, Homo sapiens
gtgccccagactg

SEQ ID NO: 1276043 - DNA, 13 bp, Homo sapiens
gtgccccagctgc

SEQ ID NO: 1276044 - DNA, 18 bp, Homo sapiens
gtgccccagctgccaggc

SEQ ID NO: 1276045 - DNA, 19 bp, Homo sapiens
gtgccccagctgccaggcg

SEQ ID NO: 1276046 - DNA, 22 bp, Homo sapiens
gtgccccagctgccaggcggcc

SEQ ID NO: 1276047 - DNA, 21 bp, Homo sapiens
gtgccccagggagtccagggt

SEQ ID NO: 1276048 - DNA, 22 bp, Homo sapiens
gtgcccccagagtgtagggggc

SEQ ID NO: 1276049 - DNA, 18 bp, Homo sapiens
gtgcccccagcctcagcc

SEQ ID NO: 1276050 - DNA, 21 bp, Homo sapiens
gtgccccccacccctggaaga

SEQ ID NO: 1276051 - DNA, 14 bp, Homo sapiens
gtgcccccctcctc

SEQ ID NO: 1276052 - DNA, 19 bp, Homo sapiens
gtgcccccctcctccagta

SEQ ID NO: 1276053 - DNA, 13 bp, Homo sapiens
gtgccccccttgc

SEQ ID NO: 1276054 - DNA, 19 bp, Homo sapiens
gtgcccccgcctgccaccg

SEQ ID NO: 1276055 - DNA, 16 bp, Homo sapiens
gtgcccccgggaatgg

SEQ ID NO: 1276056 - DNA, 17 bp, Homo sapiens
gtgccccctcctctccc

SEQ ID NO: 1276057 - DNA, 20 bp, Homo sapiens
gtgccccctcctctcccatc

SEQ ID NO: 1276058 - DNA, 13 bp, Homo sapiens
gtgccccctctgg

SEQ ID NO: 1276059 - DNA, 22 bp, Homo sapiens
gtgccccgcgggctttgttgct

SEQ ID NO: 1276060 - DNA, 14 bp, Homo sapiens
gtgcccctgatgca

SEQ ID NO: 1276061 - DNA, 19 bp, Homo sapiens
gtgcccctgatgcagcctg

SEQ ID NO: 1276062 - DNA, 23 bp, Homo sapiens
gtgcccctgatgcagcctgtggc

SEQ ID NO: 1276063 - DNA, 19 bp, Homo sapiens
gtgcccctgctgcctcccc

SEQ ID NO: 1276064 - DNA, 16 bp, Homo sapiens
gtgcccgcaggaactg

SEQ ID NO: 1276065 - DNA, 15 bp, Homo sapiens
gtgcccggggcagca

SEQ ID NO: 1276066 - DNA, 23 bp, Homo sapiens
gtgcccggggcagcagcagccct

SEQ ID NO: 1276067 - DNA, 20 bp, Homo sapiens
gtgccctactcattggggtt

SEQ ID NO: 1276068 - DNA, 14 bp, Homo sapiens
gtgccctccaaaga

SEQ ID NO: 1276069 - DNA, 20 bp, Homo sapiens
gtgccctccacagccgcagc

SEQ ID NO: 1276070 - DNA, 21 bp, Homo sapiens
gtgccctcctgagggaggacc

SEQ ID NO: 1276071 - DNA, 14 bp, Homo sapiens
gtgccctgccccca

SEQ ID NO: 1276072 - DNA, 22 bp, Homo sapiens
gtgccctgcccccatctcccca

SEQ ID NO: 1276073 - DNA, 19 bp, Homo sapiens
gtgccctggatgcccagga

SEQ ID NO: 1276074 - DNA, 17 bp, Homo sapiens
gtgccctggctccttgc

SEQ ID NO: 1276075 - DNA, 12 bp, Homo sapiens
gtgccctgggcc

SEQ ID NO: 1276076 - DNA, 19 bp, Homo sapiens
gtgccctgggccaggcagg

SEQ ID NO: 1276077 - DNA, 20 bp, Homo sapiens
gtgccctgggccaggcaggc

SEQ ID NO: 1276078 - DNA, 21 bp, Homo sapiens
gtgccctgggccaggcaggcg

SEQ ID NO: 1276079 - DNA, 17 bp, Homo sapiens
gtgcccttgcccttgga

SEQ ID NO: 1276080 - DNA, 19 bp, Homo sapiens
gtgccgaatgactatgtcc

SEQ ID NO: 1276081 - DNA, 17 bp, Homo sapiens
gtgccgcctgctcctca

SEQ ID NO: 1276082 - DNA, 14 bp, Homo sapiens
gtgccgctcctgct

SEQ ID NO: 1276083 - DNA, 19 bp, Homo sapiens
gtgccgctcctgcttcccc

SEQ ID NO: 1276084 - DNA, 20 bp, Homo sapiens
gtgccgctcctgcttcccct

SEQ ID NO: 1276085 - DNA, 21 bp, Homo sapiens
gtgccggcggcagccccactt

SEQ ID NO: 1276086 - DNA, 22 bp, Homo sapiens
gtgccggcggcagccccacttc

SEQ ID NO: 1276087 - DNA, 13 bp, Homo sapiens
gtgccggctgtgg

SEQ ID NO: 1276088 - DNA, 17 bp, Homo sapiens
gtgccgggagaggactc

SEQ ID NO: 1276089 - DNA, 18 bp, Homo sapiens
gtgccggggaggggcaga

SEQ ID NO: 1276090 - DNA, 22 bp, Homo sapiens
gtgccgtagggagtacctgctg

SEQ ID NO: 1276091 - DNA, 18 bp, Homo sapiens
gtgccgtgtgagtgtgac

SEQ ID NO: 1276092 - DNA, 20 bp, Homo sapiens
gtgccgtgtgagtgtgacag

SEQ ID NO: 1276093 - DNA, 21 bp, Homo sapiens
gtgccgtgtgagtgtgacagg

SEQ ID NO: 1276094 - DNA, 21 bp, Homo sapiens
gtgccgttactctccaacctg

SEQ ID NO: 1276095 - DNA, 15 bp, Homo sapiens
gtgcctaaaattgta

SEQ ID NO: 1276096 - DNA, 16 bp, Homo sapiens
gtgcctaatggagaag

SEQ ID NO: 1276097 - DNA, 19 bp, Homo sapiens
gtgcctagttcctgtggcc

SEQ ID NO: 1276098 - DNA, 18 bp, Homo sapiens
gtgcctatagtcccagct

SEQ ID NO: 1276099 - DNA, 15 bp, Homo sapiens
gtgcctcagagacca

SEQ ID NO: 1276100 - DNA, 20 bp, Homo sapiens
gtgcctcagagcaggctcag

SEQ ID NO: 1276101 - DNA, 21 bp, Homo sapiens
gtgcctcaggccagggctcac

SEQ ID NO: 1276102 - DNA, 16 bp, Homo sapiens
gtgcctcagttttcct

SEQ ID NO: 1276103 - DNA, 21 bp, Homo sapiens
gtgcctcatagcatagccagc

SEQ ID NO: 1276104 - DNA, 15 bp, Homo sapiens
gtgcctccaccacca

SEQ ID NO: 1276105 - DNA, 17 bp, Homo sapiens
gtgcctccaccaccact

SEQ ID NO: 1276106 - DNA, 20 bp, Homo sapiens
gtgcctccaccaccactggc

SEQ ID NO: 1276107 - DNA, 23 bp, Homo sapiens
gtgcctccaccaccactggccac

SEQ ID NO: 1276108 - DNA, 15 bp, Homo sapiens
gtgcctccaggacca

SEQ ID NO: 1276109 - DNA, 13 bp, Homo sapiens
gtgcctccaggtg

SEQ ID NO: 1276110 - DNA, 15 bp, Homo sapiens
gtgcctccaggtgtg

SEQ ID NO: 1276111 - DNA, 21 bp, Homo sapiens
gtgcctccccccagaccccgc

SEQ ID NO: 1276112 - DNA, 18 bp, Homo sapiens
gtggaccaggcctggagg

SEQ ID NO: 1276113 - DNA, 22 bp, Homo sapiens
gtggaccaggcctggagggcac

SEQ ID NO: 1276114 - DNA, 22 bp, Homo sapiens
gtggacccagggatgacatgtc

SEQ ID NO: 1276115 - DNA, 14 bp, Homo sapiens
gtggaccctgtggc

SEQ ID NO: 1276116 - DNA, 13 bp, Homo sapiens
gtggacctagcct

SEQ ID NO: 1276117 - DNA, 15 bp, Homo sapiens
gtggacctagcctgg

SEQ ID NO: 1276118 - DNA, 22 bp, Homo sapiens
gtggacctagcctggatggccc

SEQ ID NO: 1276119 - DNA, 21 bp, Homo sapiens
gtggaccttaggccttcctct

SEQ ID NO: 1276120 - DNA, 20 bp, Homo sapiens
gtggacgcaattgtgggatg

SEQ ID NO: 1276121 - DNA, 15 bp, Homo sapiens
gtggacgtcacgctc

SEQ ID NO: 1276122 - DNA, 18 bp, Homo sapiens
gtggacgtcacgctccct

SEQ ID NO: 1276123 - DNA, 18 bp, Homo sapiens
gtggactcagaaagccaa

SEQ ID NO: 1276124 - DNA, 14 bp, Homo sapiens
gtggactcagggca

SEQ ID NO: 1276125 - DNA, 21 bp, Homo sapiens
gtggactctgaggactcctga

SEQ ID NO: 1276126 - DNA, 18 bp, Homo sapiens
gtggactgagtgggaagc

SEQ ID NO: 1276127 - DNA, 20 bp, Homo sapiens
gtggactgcatttaaatttg

SEQ ID NO: 1276128 - DNA, 14 bp, Homo sapiens
gtggactgcgctgg

SEQ ID NO: 1276129 - DNA, 15 bp, Homo sapiens
gtggactggctgtgc

SEQ ID NO: 1276130 - DNA, 15 bp, Homo sapiens
gtggactgtcctgag

SEQ ID NO: 1276131 - DNA, 19 bp, Homo sapiens
gtggactgtgcctcaggcc

SEQ ID NO: 1276132 - DNA, 21 bp, Homo sapiens
gtggactgtgcctcaggccag

SEQ ID NO: 1276133 - DNA, 12 bp, Homo sapiens
gtggacttggag

SEQ ID NO: 1276134 - DNA, 14 bp, Homo sapiens
gtggacttggagct

SEQ ID NO: 1276135 - DNA, 22 bp, Homo sapiens
gtggactttccaccccctccct

SEQ ID NO: 1276136 - DNA, 17 bp, Homo sapiens
gtggagaaaattggaac

SEQ ID NO: 1276137 - DNA, 20 bp, Homo sapiens
gtggagaaagcactgacctg

SEQ ID NO: 1276138 - DNA, 17 bp, Homo sapiens
gtggagactttctgtta

SEQ ID NO: 1276139 - DNA, 15 bp, Homo sapiens
gtggagagaagtgag

SEQ ID NO: 1276140 - DNA, 17 bp, Homo sapiens
gtggagagaagtgagca

SEQ ID NO: 1276141 - DNA, 14 bp, Homo sapiens
gtggagagcccggc

SEQ ID NO: 1276142 - DNA, 16 bp, Homo sapiens
gtggagagctggtgcc

SEQ ID NO: 1276143 - DNA, 18 bp, Homo sapiens
gtggagatggactcagga

SEQ ID NO: 1276144 - DNA, 14 bp, Homo sapiens
gtggagcaaaaggc

SEQ ID NO: 1276145 - DNA, 21 bp, Homo sapiens
gtggagcaaaaggcagctcac

SEQ ID NO: 1276146 - DNA, 19 bp, Homo sapiens
gtggagcagcagccactgc

SEQ ID NO: 1276147 - DNA, 15 bp, Homo sapiens
gtggagcagccagag

SEQ ID NO: 1276148 - DNA, 14 bp, Homo sapiens
gtggagccagggcc

SEQ ID NO: 1276149 - DNA, 12 bp, Homo sapiens
gtggagccaggt

SEQ ID NO: 1276150 - DNA, 16 bp, Homo sapiens
gtggagctcgcccctc

SEQ ID NO: 1276151 - DNA, 17 bp, Homo sapiens
gtggagctcgcccctcc

SEQ ID NO: 1276152 - DNA, 12 bp, Homo sapiens
gtggagctggga

SEQ ID NO: 1276153 - DNA, 12 bp, Homo sapiens
gtggagctggtc

SEQ ID NO: 1276154 - DNA, 15 bp, Homo sapiens
gtggagctggtctgc

SEQ ID NO: 1276155 - DNA, 23 bp, Homo sapiens
gtggagcttaagccactgcctct

SEQ ID NO: 1276156 - DNA, 16 bp, Homo sapiens
gtggaggaagagccac

SEQ ID NO: 1276157 - DNA, 21 bp, Homo sapiens
gtggaggaagagccacctgca

SEQ ID NO: 1276158 - DNA, 16 bp, Homo sapiens
gtggaggagctgaggg

SEQ ID NO: 1276159 - DNA, 17 bp, Homo sapiens
gtggaggaggaaggcaa

SEQ ID NO: 1276160 - DNA, 16 bp, Homo sapiens
gtggaggaggttggga

SEQ ID NO: 1276161 - DNA, 13 bp, Homo sapiens
gtggaggcctgat

SEQ ID NO: 1276162 - DNA, 16 bp, Homo sapiens
gtggaggcctgatgct

SEQ ID NO: 1276163 - DNA, 18 bp, Homo sapiens
gtggaggcctgatgctgc

SEQ ID NO: 1276164 - DNA, 14 bp, Homo sapiens
gtggaggcttcctg

SEQ ID NO: 1276165 - DNA, 15 bp, Homo sapiens
gtggagggcacttca

SEQ ID NO: 1276166 - DNA, 15 bp, Homo sapiens
gtggaggggtgtggc

SEQ ID NO: 1276167 - DNA, 16 bp, Homo sapiens
gtggaggggtgtggca

SEQ ID NO: 1276168 - DNA, 13 bp, Homo sapiens
gtggaggtgggct

SEQ ID NO: 1276169 - DNA, 18 bp, Homo sapiens
gtggaggtgggctgggcc

SEQ ID NO: 1276170 - DNA, 22 bp, Homo sapiens
gtggaggttctgtattttaaga

SEQ ID NO: 1276171 - DNA, 19 bp, Homo sapiens
gtggaggttgagtgagccg

SEQ ID NO: 1276172 - DNA, 16 bp, Homo sapiens
gtggaggttgcagtga

SEQ ID NO: 1276173 - DNA, 16 bp, Homo sapiens
gtggaggttgtgcatg

SEQ ID NO: 1276174 - DNA, 13 bp, Homo sapiens
gtggagtccagct

SEQ ID NO: 1276175 - DNA, 15 bp, Homo sapiens
gtggagtccagctct

SEQ ID NO: 1276176 - DNA, 18 bp, Homo sapiens
gtggagtccagctctact

SEQ ID NO: 1276177 - DNA, 17 bp, Homo sapiens
gtggagtgagagccttt

SEQ ID NO: 1276178 - DNA, 15 bp, Homo sapiens
gtggataagggagag

SEQ ID NO: 1276179 - DNA, 15 bp, Homo sapiens
gtggatatcagggta

SEQ ID NO: 1276180 - DNA, 20 bp, Homo sapiens
gtggatatgacccacactgc

SEQ ID NO: 1276181 - DNA, 14 bp, Homo sapiens
gtggatattgttac

SEQ ID NO: 1276182 - DNA, 13 bp, Homo sapiens
gtggatcacctga

SEQ ID NO: 1276183 - DNA, 21 bp, Homo sapiens
gtggatcacgaggtcaggaga

SEQ ID NO: 1276184 - DNA, 22 bp, Homo sapiens
gtggatcacgaggtcaggagat

SEQ ID NO: 1276185 - DNA, 19 bp, Homo sapiens
gtggatccaaactgatcca

SEQ ID NO: 1276186 - DNA, 18 bp, Homo sapiens
gtggatctccaaggacca

SEQ ID NO: 1276187 - DNA, 19 bp, Homo sapiens
gtggatctccaaggaccag

SEQ ID NO: 1276188 - DNA, 14 bp, Homo sapiens
gtggatctggggac

SEQ ID NO: 1276189 - DNA, 18 bp, Homo sapiens
gtggatctgtccaaggaa

SEQ ID NO: 1276190 - DNA, 13 bp, Homo sapiens
gtggatcttcaga

SEQ ID NO: 1276191 - DNA, 15 bp, Homo sapiens
gtggatgactgttga

SEQ ID NO: 1276192 - DNA, 16 bp, Homo sapiens
gtggatgaggagacag

SEQ ID NO: 1276193 - DNA, 21 bp, Homo sapiens
gtggatgccacagcccagctt

SEQ ID NO: 1276194 - DNA, 18 bp, Homo sapiens
gtggatgctccagggcag

SEQ ID NO: 1276195 - DNA, 15 bp, Homo sapiens
gtggatggcccagca

SEQ ID NO: 1276196 - DNA, 20 bp, Homo sapiens
gtggatggcccagcaggcag

SEQ ID NO: 1276197 - DNA, 16 bp, Homo sapiens
gtggatggccccagca

SEQ ID NO: 1276198 - DNA, 19 bp, Homo sapiens
gtggatggccccagcacag

SEQ ID NO: 1276199 - DNA, 13 bp, Homo sapiens
gtggatgtcttcc

SEQ ID NO: 1276200 - DNA, 22 bp, Homo sapiens
gtggattataaaaaatgtaaca

SEQ ID NO: 1276201 - DNA, 16 bp, Homo sapiens
gtggattctccctggg

SEQ ID NO: 1276202 - DNA, 13 bp, Homo sapiens
gtggattctttaa

SEQ ID NO: 1276203 - DNA, 20 bp, Homo sapiens
gtggatttaacagaaatgta

SEQ ID NO: 1276204 - DNA, 21 bp, Homo sapiens
gtggatttaacagaaatgtac

SEQ ID NO: 1276205 - DNA, 23 bp, Homo sapiens
gtggatttaacagaaatgtacag

SEQ ID NO: 1276206 - DNA, 18 bp, Homo sapiens
gtggcaaagtgctgtacc

SEQ ID NO: 1276207 - DNA, 20 bp, Homo sapiens
gtggcaaagtgctgtaccct

SEQ ID NO: 1276208 - DNA, 19 bp, Homo sapiens
gtggcaagtgaatttgcct

SEQ ID NO: 1276209 - DNA, 12 bp, Homo sapiens
gtggcaattagt

SEQ ID NO: 1276210 - DNA, 22 bp, Homo sapiens
gtggcacaatctcggcccgctg

SEQ ID NO: 1276211 - DNA, 16 bp, Homo sapiens
gtggcacaggccccct

SEQ ID NO: 1276212 - DNA, 18 bp, Homo sapiens
gtggcaccagcagcctgg

SEQ ID NO: 1276213 - DNA, 12 bp, Homo sapiens
gtggcacctcct

SEQ ID NO: 1276214 - DNA, 13 bp, Homo sapiens
gtggcacctcctg

SEQ ID NO: 1276215 - DNA, 17 bp, Homo sapiens
gtggcacctcctgagaa

SEQ ID NO: 1276216 - DNA, 20 bp, Homo sapiens
gtggcacctcctgagaaggc

SEQ ID NO: 1276217 - DNA, 22 bp, Homo sapiens
gtggcacgggccctccctccca

SEQ ID NO: 1276218 - DNA, 21 bp, Homo sapiens
gtggcactcaactctgagccc

SEQ ID NO: 1276219 - DNA, 22 bp, Homo sapiens
gtggcactcagtctctcttctc

SEQ ID NO: 1276220 - DNA, 19 bp, Homo sapiens
gtggcagaaaagaggagac

SEQ ID NO: 1276221 - DNA, 22 bp, Homo sapiens
gtggcagaagtgtcaccctgtg

SEQ ID NO: 1276222 - DNA, 20 bp, Homo sapiens
gtggcagataatcagcctct

SEQ ID NO: 1276223 - DNA, 23 bp, Homo sapiens
gtggcagataatcagcctcttaa

SEQ ID NO: 1276224 - DNA, 19 bp, Homo sapiens
gtggcagattttacaaaag

SEQ ID NO: 1276225 - DNA, 22 bp, Homo sapiens
gtggcagccatgcctcatgcca

SEQ ID NO: 1276226 - DNA, 21 bp, Homo sapiens
gtggcagccgtcccaggccac

SEQ ID NO: 1276227 - DNA, 14 bp, Homo sapiens
gtggcagctgtccc

SEQ ID NO: 1276228 - DNA, 19 bp, Homo sapiens
gtggcagctgttagggctg

SEQ ID NO: 1276229 - DNA, 17 bp, Homo sapiens
gtggcaggaccaggact

SEQ ID NO: 1276230 - DNA, 16 bp, Homo sapiens
gtggcaggtcactgtc

SEQ ID NO: 1276231 - DNA, 20 bp, Homo sapiens
gtggcaggtcactgtcactg

SEQ ID NO: 1276232 - DNA, 21 bp, Homo sapiens
gtggcaggtgggctgcctgct

SEQ ID NO: 1276233 - DNA, 20 bp, Homo sapiens
gtggcatctttgccttgggc

SEQ ID NO: 1276234 - DNA, 13 bp, Homo sapiens
gtgggctgatggc

SEQ ID NO: 1276235 - DNA, 15 bp, Homo sapiens
gtgggctgatggcct

SEQ ID NO: 1276236 - DNA, 17 bp, Homo sapiens
gtgggctgcacgctccc

SEQ ID NO: 1276237 - DNA, 13 bp, Homo sapiens
gtgggctgcagca

SEQ ID NO: 1276238 - DNA, 16 bp, Homo sapiens
gtgggctgcccctcgc

SEQ ID NO: 1276239 - DNA, 13 bp, Homo sapiens
gtgggctgcctgc

SEQ ID NO: 1276240 - DNA, 17 bp, Homo sapiens
gtgggctggacttctac

SEQ ID NO: 1276241 - DNA, 17 bp, Homo sapiens
gtgggctggcccagcca

SEQ ID NO: 1276242 - DNA, 12 bp, Homo sapiens
gtgggctgggcc

SEQ ID NO: 1276243 - DNA, 19 bp, Homo sapiens
gtgggctgggcccacccag

SEQ ID NO: 1276244 - DNA, 13 bp, Homo sapiens
gtgggctggggct

SEQ ID NO: 1276245 - DNA, 18 bp, Homo sapiens
gtgggctggggctgctcc

SEQ ID NO: 1276246 - DNA, 22 bp, Homo sapiens
gtgggctggtattctctctatg

SEQ ID NO: 1276247 - DNA, 13 bp, Homo sapiens
gtgggctggtgcc

SEQ ID NO: 1276248 - DNA, 13 bp, Homo sapiens
gtgggctgtgagt

SEQ ID NO: 1276249 - DNA, 14 bp, Homo sapiens
gtgggctgtgagtg

SEQ ID NO: 1276250 - DNA, 15 bp, Homo sapiens
gtgggcttcctgccc

SEQ ID NO: 1276251 - DNA, 20 bp, Homo sapiens
gtgggcttctgcgtccacca

SEQ ID NO: 1276252 - DNA, 14 bp, Homo sapiens
gtgggcttgattct

SEQ ID NO: 1276253 - DNA, 23 bp, Homo sapiens
gtggggaaaggaatcaattattt

SEQ ID NO: 1276254 - DNA, 19 bp, Homo sapiens
gtggggaaggagggacttg

SEQ ID NO: 1276255 - DNA, 19 bp, Homo sapiens
gtggggacagggaggggga

SEQ ID NO: 1276256 - DNA, 13 bp, Homo sapiens
gtggggacccagg

SEQ ID NO: 1276257 - DNA, 17 bp, Homo sapiens
gtggggagatgcttctc

SEQ ID NO: 1276258 - DNA, 23 bp, Homo sapiens
gtggggagcagttttcccctggc

SEQ ID NO: 1276259 - DNA, 18 bp, Homo sapiens
gtggggaggaggaagccg

SEQ ID NO: 1276260 - DNA, 19 bp, Homo sapiens
gtggggaggcccaaatgat

SEQ ID NO: 1276261 - DNA, 14 bp, Homo sapiens
gtggggaggccctg

SEQ ID NO: 1276262 - DNA, 11 bp, Homo sapiens
gtggggagggg

SEQ ID NO: 1276263 - DNA, 13 bp, Homo sapiens
gtggggaggtgtc

SEQ ID NO: 1276264 - DNA, 15 bp, Homo sapiens
gtggggattgcccat

SEQ ID NO: 1276265 - DNA, 14 bp, Homo sapiens
gtggggccaggacc

SEQ ID NO: 1276266 - DNA, 14 bp, Homo sapiens
gtggggccaggtca

SEQ ID NO: 1276267 - DNA, 21 bp, Homo sapiens
gtggggccatgcctcctcagg

SEQ ID NO: 1276268 - DNA, 12 bp, Homo sapiens
gtggggcccact

SEQ ID NO: 1276269 - DNA, 23 bp, Homo sapiens
gtggggcccttggccccagagga

SEQ ID NO: 1276270 - DNA, 15 bp, Homo sapiens
gtggggcctagatcc

SEQ ID NO: 1276271 - DNA, 18 bp, Homo sapiens
gtggggcctcagcctggg

SEQ ID NO: 1276272 - DNA, 22 bp, Homo sapiens
gtggggcgaattcatcccctcc

SEQ ID NO: 1276273 - DNA, 20 bp, Homo sapiens
gtggggctccggaggggacc

SEQ ID NO: 1276274 - DNA, 17 bp, Homo sapiens
gtggggctcgccatgcc

SEQ ID NO: 1276275 - DNA, 14 bp, Homo sapiens
gtggggctgccgga

SEQ ID NO: 1276276 - DNA, 17 bp, Homo sapiens
gtggggctgctcctcca

SEQ ID NO: 1276277 - DNA, 15 bp, Homo sapiens
gtggggctgggcacc

SEQ ID NO: 1276278 - DNA, 21 bp, Homo sapiens
gtggggctgggcaccgtgtcc

SEQ ID NO: 1276279 - DNA, 22 bp, Homo sapiens
gtgggggagattctgggtttgc

SEQ ID NO: 1276280 - DNA, 14 bp, Homo sapiens
gtgggggaggagcc

SEQ ID NO: 1276281 - DNA, 22 bp, Homo sapiens
gtgggggcagagggcagaggct

SEQ ID NO: 1276282 - DNA, 15 bp, Homo sapiens
gtgggggcagcccag

SEQ ID NO: 1276283 - DNA, 18 bp, Homo sapiens
gtgggggccacctgcctg

SEQ ID NO: 1276284 - DNA, 15 bp, Homo sapiens
gtgggggccaggcct

SEQ ID NO: 1276285 - DNA, 19 bp, Homo sapiens
gtgggggctgtggccctgc

SEQ ID NO: 1276286 - DNA, 16 bp, Homo sapiens
gtgggggggagaagaa

SEQ ID NO: 1276287 - DNA, 19 bp, Homo sapiens
gtgggggtcatcagggagg

SEQ ID NO: 1276288 - DNA, 20 bp, Homo sapiens
gtgggggtggaggcttcctg

SEQ ID NO: 1276289 - DNA, 16 bp, Homo sapiens
gtggggtacaggcagt

SEQ ID NO: 1276290 - DNA, 14 bp, Homo sapiens
gtggggtctccctc

SEQ ID NO: 1276291 - DNA, 15 bp, Homo sapiens
gtggggtctggcctg

SEQ ID NO: 1276292 - DNA, 13 bp, Homo sapiens
gtggggtctggga

SEQ ID NO: 1276293 - DNA, 17 bp, Homo sapiens
gtggggtgaacagctgg

SEQ ID NO: 1276294 - DNA, 19 bp, Homo sapiens
gtggggtgatggccagagg

SEQ ID NO: 1276295 - DNA, 11 bp, Homo sapiens
gtggggtggga

SEQ ID NO: 1276296 - DNA, 13 bp, Homo sapiens
gtggggtgggggt

SEQ ID NO: 1276297 - DNA, 16 bp, Homo sapiens
gtggggtgtgctggga

SEQ ID NO: 1276298 - DNA, 14 bp, Homo sapiens
gtggggttatgtga

SEQ ID NO: 1276299 - DNA, 21 bp, Homo sapiens
gtggggttatgtgagggtatg

SEQ ID NO: 1276300 - DNA, 16 bp, Homo sapiens
gtggggttcagtagag

SEQ ID NO: 1276301 - DNA, 15 bp, Homo sapiens
gtggggttgctgaag

SEQ ID NO: 1276302 - DNA, 18 bp, Homo sapiens
gtggggttggggcaaagc

SEQ ID NO: 1276303 - DNA, 16 bp, Homo sapiens
gtgggtaaagggacag

SEQ ID NO: 1276304 - DNA, 22 bp, Homo sapiens
gtgggtaatccaggcacagctg

SEQ ID NO: 1276305 - DNA, 20 bp, Homo sapiens
gtgggtagatcacgagatca

SEQ ID NO: 1276306 - DNA, 12 bp, Homo sapiens
gtgggtccagga

SEQ ID NO: 1276307 - DNA, 18 bp, Homo sapiens
gtgggtccatgggcagag

SEQ ID NO: 1276308 - DNA, 18 bp, Homo sapiens
gtgggtcccgcactctgc

SEQ ID NO: 1276309 - DNA, 15 bp, Homo sapiens
gtgggtcgaggattc

SEQ ID NO: 1276310 - DNA, 22 bp, Homo sapiens
gtgggtcgaggattctgtgcct

SEQ ID NO: 1276311 - DNA, 19 bp, Homo sapiens
gtgggtctatgttccccag

SEQ ID NO: 1276312 - DNA, 16 bp, Homo sapiens
gtgggtctctggggac

SEQ ID NO: 1276313 - DNA, 17 bp, Homo sapiens
gtgggtctctggggacc

SEQ ID NO: 1276314 - DNA, 14 bp, Homo sapiens
gtgggtctgagctg

SEQ ID NO: 1276315 - DNA, 13 bp, Homo sapiens
gtgggtctgggat

SEQ ID NO: 1276316 - DNA, 20 bp, Homo sapiens
gtgggtctttaataaaacaa

SEQ ID NO: 1276317 - DNA, 17 bp, Homo sapiens
gtgggtctttttctctt

SEQ ID NO: 1276318 - DNA, 20 bp, Homo sapiens
gtgggtctttttctcttctg

SEQ ID NO: 1276319 - DNA, 13 bp, Homo sapiens
gtgggtgagccag

SEQ ID NO: 1276320 - DNA, 22 bp, Homo sapiens
gtgggtgatgcttttgctgctg

SEQ ID NO: 1276321 - DNA, 23 bp, Homo sapiens
gtgggtgatgcttttgctgctgc

SEQ ID NO: 1276322 - DNA, 14 bp, Homo sapiens
gtgggtgctcagaa

SEQ ID NO: 1276323 - DNA, 15 bp, Homo sapiens
gtgggtgctcagaat

SEQ ID NO: 1276324 - DNA, 13 bp, Homo sapiens
gtgggtgctgata

SEQ ID NO: 1276325 - DNA, 17 bp, Homo sapiens
gtgggtggcacctcctg

SEQ ID NO: 1276326 - DNA, 18 bp, Homo sapiens
gtgggtggcacctcctga

SEQ ID NO: 1276327 - DNA, 20 bp, Homo sapiens
gtgggtggcacctcctgaga

SEQ ID NO: 1276328 - DNA, 13 bp, Homo sapiens
gtgggtgggagtg

SEQ ID NO: 1276329 - DNA, 22 bp, Homo sapiens
gtgggtggggaggccctgcctg

SEQ ID NO: 1276330 - DNA, 12 bp, Homo sapiens
gtgggtggtgga

SEQ ID NO: 1276331 - DNA, 19 bp, Homo sapiens
gtgggtggtgtatttgaga

SEQ ID NO: 1276332 - DNA, 14 bp, Homo sapiens
gtgggtgtagccag

SEQ ID NO: 1276333 - DNA, 18 bp, Homo sapiens
gtgggtgtcctgcctgtc

SEQ ID NO: 1276334 - DNA, 22 bp, Homo sapiens
gtgggtgtcctgcctgtctgcc

SEQ ID NO: 1276335 - DNA, 13 bp, Homo sapiens
gtgggtgtgtgcg

SEQ ID NO: 1276336 - DNA, 20 bp, Homo sapiens
gtgggtgttctttcctgccc

SEQ ID NO: 1276337 - DNA, 17 bp, Homo sapiens
gtgggtttctctgtgct

SEQ ID NO: 1276338 - DNA, 16 bp, Homo sapiens
gtgggtttggttagag

SEQ ID NO: 1276339 - DNA, 14 bp, Homo sapiens
gtggtacaggaagg

SEQ ID NO: 1276340 - DNA, 22 bp, Homo sapiens
gtggtaccttcagccctggcca

SEQ ID NO: 1276341 - DNA, 17 bp, Homo sapiens
gtggtaggcctataaaa

SEQ ID NO: 1276342 - DNA, 22 bp, Homo sapiens
gtggtatgacattggatagaac

SEQ ID NO: 1276343 - DNA, 14 bp, Homo sapiens
gtggtatgtctctt

SEQ ID NO: 1276344 - DNA, 15 bp, Homo sapiens
gtggtatgtctgcca

SEQ ID NO: 1276345 - DNA, 18 bp, Homo sapiens
gtggtattaattttgata

SEQ ID NO: 1276346 - DNA, 16 bp, Homo sapiens
gtggtattctggtagg

SEQ ID NO: 1276347 - DNA, 14 bp, Homo sapiens
gtggtattctgtca

SEQ ID NO: 1276348 - DNA, 21 bp, Homo sapiens
gtggtattttcaatagccact

SEQ ID NO: 1276349 - DNA, 22 bp, Homo sapiens
gtggtcaaaccgcactcaccca

SEQ ID NO: 1276350 - DNA, 16 bp, Homo sapiens
gtggtcacagcggagg

SEQ ID NO: 1276351 - DNA, 22 bp, Homo sapiens
gtggtcacagcggaggtgtgga

SEQ ID NO: 1276352 - DNA, 20 bp, Homo sapiens
gtggtcactggtcagggcag

SEQ ID NO: 1276353 - DNA, 18 bp, Homo sapiens
gtggtccaaccaggagct

SEQ ID NO: 1276354 - DNA, 20 bp, Homo sapiens
gtggtctataaaataaactt

SEQ ID NO: 1276355 - DNA, 14 bp, Homo sapiens
gtggtctctgctgg

SEQ ID NO: 1276356 - DNA, 19 bp, Homo sapiens
gtggtctcttcctgtctgg

SEQ ID NO: 1276357 - DNA, 19 bp, Homo sapiens
gtgtgtccacgactgtctc

SEQ ID NO: 1276358 - DNA, 20 bp, Homo sapiens
gtgtgtccacgactgtctcc

SEQ ID NO: 1276359 - DNA, 21 bp, Homo sapiens
gtgtgtccaggctctgggcac

SEQ ID NO: 1276360 - DNA, 23 bp, Homo sapiens
gtgtgtccaggctctgggcacag

SEQ ID NO: 1276361 - DNA, 19 bp, Homo sapiens
gtgtgtccttgaactgagg

SEQ ID NO: 1276362 - DNA, 18 bp, Homo sapiens
gtgtgtctcgtgtcagta

SEQ ID NO: 1276363 - DNA, 15 bp, Homo sapiens
gtgtgtctgctcagt

SEQ ID NO: 1276364 - DNA, 17 bp, Homo sapiens
gtgtgtctgcttttaaa

SEQ ID NO: 1276365 - DNA, 21 bp, Homo sapiens
gtgtgtcttaattattatttg

SEQ ID NO: 1276366 - DNA, 17 bp, Homo sapiens
gtgtgtgacaattctgt

SEQ ID NO: 1276367 - DNA, 10 bp, Homo sapiens
gtgtgtgcac

SEQ ID NO: 1276368 - DNA, 14 bp, Homo sapiens
gtgtgtgccctggg

SEQ ID NO: 1276369 - DNA, 15 bp, Homo sapiens
gtgtgtgccctgggc

SEQ ID NO: 1276370 - DNA, 16 bp, Homo sapiens
gtgtgtgccctgggcc

SEQ ID NO: 1276371 - DNA, 15 bp, Homo sapiens
gtgtgtggtgctaca

SEQ ID NO: 1276372 - DNA, 16 bp, Homo sapiens
gtgtgtggttggaaaa

SEQ ID NO: 1276373 - DNA, 17 bp, Homo sapiens
gtgtgtgtatgtttgca

SEQ ID NO: 1276374 - DNA, 9 bp, Homo sapiens
gtgtgtgtg

SEQ ID NO: 1276375 - DNA, 13 bp, Homo sapiens
gtgtgtgtgaatg

SEQ ID NO: 1276376 - DNA, 13 bp, Homo sapiens
gtgtgtgtgcatg

SEQ ID NO: 1276377 - DNA, 12 bp, Homo sapiens
gtgtgtgtgcgc

SEQ ID NO: 1276378 - DNA, 13 bp, Homo sapiens
gtgtgtgtgggtg

SEQ ID NO: 1276379 - DNA, 10 bp, Homo sapiens
gtgtgtgtgt

SEQ ID NO: 1276380 - DNA, 14 bp, Homo sapiens
gtgtgtgtgtgtgt

SEQ ID NO: 1276381 - DNA, 13 bp, Homo sapiens
gtgtgttaatgtc

SEQ ID NO: 1276382 - DNA, 19 bp, Homo sapiens
gtgtgttatattccaagga

SEQ ID NO: 1276383 - DNA, 14 bp, Homo sapiens
gtgtgttatttaaa

SEQ ID NO: 1276384 - DNA, 18 bp, Homo sapiens
gtgtgttccaactgcccc

SEQ ID NO: 1276385 - DNA, 13 bp, Homo sapiens
gtgtgttctgtag

SEQ ID NO: 1276386 - DNA, 23 bp, Homo sapiens
gtgtgttcttttgagtccttgta

SEQ ID NO: 1276387 - DNA, 16 bp, Homo sapiens
gtgtgttgtctcttga

SEQ ID NO: 1276388 - DNA, 13 bp, Homo sapiens
gtgtgttgtcttg

SEQ ID NO: 1276389 - DNA, 19 bp, Homo sapiens
gtgtgttgtgctttcaaga

SEQ ID NO: 1276390 - DNA, 23 bp, Homo sapiens
gtgtgtttccagatcgatcctgg

SEQ ID NO: 1276391 - DNA, 19 bp, Homo sapiens
gtgtgtttctgtcctgtaa

SEQ ID NO: 1276392 - DNA, 20 bp, Homo sapiens
gtgtgttttcccaaagcact

SEQ ID NO: 1276393 - DNA, 19 bp, Homo sapiens
gtgttaaatgaaattgtaa

SEQ ID NO: 1276394 - DNA, 21 bp, Homo sapiens
gtgttaaatgtgatgaatact

SEQ ID NO: 1276395 - DNA, 20 bp, Homo sapiens
gtgttaaggcaacattcctt

SEQ ID NO: 1276396 - DNA, 20 bp, Homo sapiens
gtgttaattgcgtagaggct

SEQ ID NO: 1276397 - DNA, 14 bp, Homo sapiens
gtgttacccactgc

SEQ ID NO: 1276398 - DNA, 12 bp, Homo sapiens
gtgttacctgta

SEQ ID NO: 1276399 - DNA, 16 bp, Homo sapiens
gtgttacctgtgtgct

SEQ ID NO: 1276400 - DNA, 12 bp, Homo sapiens
gtgttactaagt

SEQ ID NO: 1276401 - DNA, 15 bp, Homo sapiens
gtgttactgctttgc

SEQ ID NO: 1276402 - DNA, 15 bp, Homo sapiens
gtgttactgtaattc

SEQ ID NO: 1276403 - DNA, 16 bp, Homo sapiens
gtgttacttatggaag

SEQ ID NO: 1276404 - DNA, 22 bp, Homo sapiens
gtgttagcactgatagtccttt

SEQ ID NO: 1276405 - DNA, 16 bp, Homo sapiens
gtgttaggaggctgca

SEQ ID NO: 1276406 - DNA, 17 bp, Homo sapiens
gtgttagtgtgtgtgca

SEQ ID NO: 1276407 - DNA, 12 bp, Homo sapiens
gtgttagttccc

SEQ ID NO: 1276408 - DNA, 15 bp, Homo sapiens
gtgttataccaacta

SEQ ID NO: 1276409 - DNA, 17 bp, Homo sapiens
gtgttatgaatctgtgc

SEQ ID NO: 1276410 - DNA, 19 bp, Homo sapiens
gtgttatgaatctgtgctg

SEQ ID NO: 1276411 - DNA, 17 bp, Homo sapiens
gtgttcaaaacaaaatg

SEQ ID NO: 1276412 - DNA, 23 bp, Homo sapiens
gtgttcaatatttagaaaatttt

SEQ ID NO: 1276413 - DNA, 21 bp, Homo sapiens
gtgttcaccttcaaaatgttc

SEQ ID NO: 1276414 - DNA, 24 bp, Homo sapiens
gtgttcaccttcaaaatgttctat

SEQ ID NO: 1276415 - DNA, 22 bp, Homo sapiens
gtgttcccattaagtggtagta

SEQ ID NO: 1276416 - DNA, 18 bp, Homo sapiens
gtgttcccctcttgtctc

SEQ ID NO: 1276417 - DNA, 20 bp, Homo sapiens
gtgttcccctcttgtctccc

SEQ ID NO: 1276418 - DNA, 22 bp, Homo sapiens
gtgttcccctcttgtctcccct

SEQ ID NO: 1276419 - DNA, 22 bp, Homo sapiens
gtgttccccttccactgagggc

SEQ ID NO: 1276420 - DNA, 18 bp, Homo sapiens
gtgttcctccattttctt

SEQ ID NO: 1276421 - DNA, 18 bp, Homo sapiens
gtgttcctgaagctgctg

SEQ ID NO: 1276422 - DNA, 20 bp, Homo sapiens
gtgttcctgaagctgctgtg

SEQ ID NO: 1276423 - DNA, 22 bp, Homo sapiens
gtgttcctgaagctgctgtgtc

SEQ ID NO: 1276424 - DNA, 10 bp, Homo sapiens
gtgttcctgg

SEQ ID NO: 1276425 - DNA, 12 bp, Homo sapiens
gtgttcctggaa

SEQ ID NO: 1276426 - DNA, 21 bp, Homo sapiens
gtgttcctttttaaatgtgaa

SEQ ID NO: 1276427 - DNA, 22 bp, Homo sapiens
gtgttcgggggagcagagagag

SEQ ID NO: 1276428 - DNA, 19 bp, Homo sapiens
gtgttcgtttccatcatgt

SEQ ID NO: 1276429 - DNA, 18 bp, Homo sapiens
gtgttctcatgaagcagg

SEQ ID NO: 1276430 - DNA, 16 bp, Homo sapiens
gtgttctccttttcct

SEQ ID NO: 1276431 - DNA, 16 bp, Homo sapiens
gtgttctgagctgtat

SEQ ID NO: 1276432 - DNA, 16 bp, Homo sapiens
gtgttctgattagaaa

SEQ ID NO: 1276433 - DNA, 13 bp, Homo sapiens
gtgttctgctcct

SEQ ID NO: 1276434 - DNA, 17 bp, Homo sapiens
gtgttctgctcctgctt

SEQ ID NO: 1276435 - DNA, 13 bp, Homo sapiens
gtgttctgggctg

SEQ ID NO: 1276436 - DNA, 16 bp, Homo sapiens
gtgttctgggctgggg

SEQ ID NO: 1276437 - DNA, 18 bp, Homo sapiens
gtgttctgggctggggcc

SEQ ID NO: 1276438 - DNA, 21 bp, Homo sapiens
gtgttcttttctcctttacca

SEQ ID NO: 1276439 - DNA, 21 bp, Homo sapiens
gtgttgaaaatgtatttcctg

SEQ ID NO: 1276440 - DNA, 16 bp, Homo sapiens
gtgttgaaaatgttca

SEQ ID NO: 1276441 - DNA, 19 bp, Homo sapiens
gtgttgaccactccagaga

SEQ ID NO: 1276442 - DNA, 20 bp, Homo sapiens
gtgttgagaagaatcaggag

SEQ ID NO: 1276443 - DNA, 19 bp, Homo sapiens
gtgttgagccttttccctc

SEQ ID NO: 1276444 - DNA, 19 bp, Homo sapiens
gtgttgccacagtagaact

SEQ ID NO: 1276445 - DNA, 12 bp, Homo sapiens
gtgttgctgttt

SEQ ID NO: 1276446 - DNA, 23 bp, Homo sapiens
gtgttgctgtttttcttgtcgtt

SEQ ID NO: 1276447 - DNA, 21 bp, Homo sapiens
gtgttgggaaggggtcctgca

SEQ ID NO: 1276448 - DNA, 14 bp, Homo sapiens
gtgttggtctttct

SEQ ID NO: 1276449 - DNA, 15 bp, Homo sapiens
gtgttggtctttcta

SEQ ID NO: 1276450 - DNA, 23 bp, Homo sapiens
gtgttggtctttctaatgtagct

SEQ ID NO: 1276451 - DNA, 14 bp, Homo sapiens
gtgttgtatgcctt

SEQ ID NO: 1276452 - DNA, 18 bp, Homo sapiens
gtgttgtattaacaaaag

SEQ ID NO: 1276453 - DNA, 19 bp, Homo sapiens
gtgttgtattaacaaaagt

SEQ ID NO: 1276454 - DNA, 15 bp, Homo sapiens
gtgttgtcattgtaa

SEQ ID NO: 1276455 - DNA, 21 bp, Homo sapiens
gtgttgtcattgtaaacaaac

SEQ ID NO: 1276456 - DNA, 19 bp, Homo sapiens
gtgttgtcccatctgccct

SEQ ID NO: 1276457 - DNA, 17 bp, Homo sapiens
gtgttgtcttcagcagt

SEQ ID NO: 1276458 - DNA, 18 bp, Homo sapiens
gtgttgtcttgaaagatt

SEQ ID NO: 1276459 - DNA, 16 bp, Homo sapiens
gtgttgtgctttcaag

SEQ ID NO: 1276460 - DNA, 17 bp, Homo sapiens
gtgttgtgggcttcctg

SEQ ID NO: 1276461 - DNA, 19 bp, Homo sapiens
gtgttgtgtccattttgca

SEQ ID NO: 1276462 - DNA, 14 bp, Homo sapiens
gtgttgtgttcctg

SEQ ID NO: 1276463 - DNA, 16 bp, Homo sapiens
gtgttgtgttcctggc

SEQ ID NO: 1276464 - DNA, 17 bp, Homo sapiens
gtgttgttgctctagga

SEQ ID NO: 1276465 - DNA, 21 bp, Homo sapiens
gtgtttaaagttcaacatgtt

SEQ ID NO: 1276466 - DNA, 16 bp, Homo sapiens
gtgtttaaataaagta

SEQ ID NO: 1276467 - DNA, 14 bp, Homo sapiens
gtgtttaacattca

SEQ ID NO: 1276468 - DNA, 20 bp, Homo sapiens
gtgtttaacattcacagccc

SEQ ID NO: 1276469 - DNA, 23 bp, Homo sapiens
gtgtttactttttggctggagcg

SEQ ID NO: 1276470 - DNA, 18 bp, Homo sapiens
gtgtttatgtgctattaa

SEQ ID NO: 1276471 - DNA, 18 bp, Homo sapiens
gtgtttccacagcctgca

SEQ ID NO: 1276472 - DNA, 23 bp, Homo sapiens
gtgtttccactcaaaatatgtca

SEQ ID NO: 1276473 - DNA, 14 bp, Homo sapiens
gtgtttcccttcct

SEQ ID NO: 1276474 - DNA, 15 bp, Homo sapiens
gtgtttcccttcctc

SEQ ID NO: 1276475 - DNA, 17 bp, Homo sapiens
gtgtttctattgacttc

SEQ ID NO: 1276476 - DNA, 18 bp, Homo sapiens
gtgtttctgacacaagat

SEQ ID NO: 1276477 - DNA, 18 bp, Homo sapiens
gtgtttctgtaacaaatt

SEQ ID NO: 1276478 - DNA, 13 bp, Homo sapiens
gtgtttctgtcct

SEQ ID NO: 1276479 - DNA, 13 bp, Homo sapiens
gttatcagtgctt

SEQ ID NO: 1276480 - DNA, 14 bp, Homo sapiens
gttatcatgaattt

SEQ ID NO: 1276481 - DNA, 19 bp, Homo sapiens
gttatcatgaattttaaag

SEQ ID NO: 1276482 - DNA, 20 bp, Homo sapiens
gttatcatgaattttaaagt

SEQ ID NO: 1276483 - DNA, 16 bp, Homo sapiens
gttatcctcttgtata

SEQ ID NO: 1276484 - DNA, 21 bp, Homo sapiens
gttatcctcttgtatacttgt

SEQ ID NO: 1276485 - DNA, 13 bp, Homo sapiens
gttatcctgctag

SEQ ID NO: 1276486 - DNA, 15 bp, Homo sapiens
gttatctaaaagaaa

SEQ ID NO: 1276487 - DNA, 15 bp, Homo sapiens
gttatctaagttaat

SEQ ID NO: 1276488 - DNA, 18 bp, Homo sapiens
gttatctaagttaattta

SEQ ID NO: 1276489 - DNA, 21 bp, Homo sapiens
gttatctaagttaatttaaag

SEQ ID NO: 1276490 - DNA, 19 bp, Homo sapiens
gttatctgaatagtgtcac

SEQ ID NO: 1276491 - DNA, 15 bp, Homo sapiens
gttatctgcctggcc

SEQ ID NO: 1276492 - DNA, 19 bp, Homo sapiens
gttatcttatactgtacaa

SEQ ID NO: 1276493 - DNA, 22 bp, Homo sapiens
gttatcttatactgtacaataa

SEQ ID NO: 1276494 - DNA, 23 bp, Homo sapiens
gttatcttatactgtacaataaa

SEQ ID NO: 1276495 - DNA, 21 bp, Homo sapiens
gttatcttctttattattcct

SEQ ID NO: 1276496 - DNA, 16 bp, Homo sapiens
gttatgaaacatatca

SEQ ID NO: 1276497 - DNA, 20 bp, Homo sapiens
gttatgaaattcaccccctt

SEQ ID NO: 1276498 - DNA, 13 bp, Homo sapiens
gttatgaacagct

SEQ ID NO: 1276499 - DNA, 18 bp, Homo sapiens
gttatgaacagctgtgtc

SEQ ID NO: 1276500 - DNA, 23 bp, Homo sapiens
gttatgaacagctgtgtctgcca

SEQ ID NO: 1276501 - DNA, 15 bp, Homo sapiens
gttatgactatgtaa

SEQ ID NO: 1276502 - DNA, 21 bp, Homo sapiens
gttatgatattgtttaaaatt

SEQ ID NO: 1276503 - DNA, 22 bp, Homo sapiens
gttatgatattgtttaaaattc

SEQ ID NO: 1276504 - DNA, 20 bp, Homo sapiens
gttatgatttttttttcata

SEQ ID NO: 1276505 - DNA, 19 bp, Homo sapiens
gttatggcagcccggctgc

SEQ ID NO: 1276506 - DNA, 14 bp, Homo sapiens
gttatgtacaaact

SEQ ID NO: 1276507 - DNA, 17 bp, Homo sapiens
gttatgtactagtgttc

SEQ ID NO: 1276508 - DNA, 22 bp, Homo sapiens
gttatgtactagtgttctgttt

SEQ ID NO: 1276509 - DNA, 20 bp, Homo sapiens
gttatgtatgaaggaatcat

SEQ ID NO: 1276510 - DNA, 23 bp, Homo sapiens
gttatgtatttcctggatgtttg

SEQ ID NO: 1276511 - DNA, 21 bp, Homo sapiens
gttattaaacgtatgcatgtg

SEQ ID NO: 1276512 - DNA, 13 bp, Homo sapiens
gttattaaatgta

SEQ ID NO: 1276513 - DNA, 18 bp, Homo sapiens
gttattaccaaaacagga

SEQ ID NO: 1276514 - DNA, 21 bp, Homo sapiens
gttattagggtggtatttagt

SEQ ID NO: 1276515 - DNA, 12 bp, Homo sapiens
gttattatgaag

SEQ ID NO: 1276516 - DNA, 23 bp, Homo sapiens
gttattattaccagcatttgtcc

SEQ ID NO: 1276517 - DNA, 14 bp, Homo sapiens
gttattcaaatgaa

SEQ ID NO: 1276518 - DNA, 19 bp, Homo sapiens
gttattcattattcctcag

SEQ ID NO: 1276519 - DNA, 16 bp, Homo sapiens
gttattcgcccacccg

SEQ ID NO: 1276520 - DNA, 21 bp, Homo sapiens
gttattctaagccctttgcca

SEQ ID NO: 1276521 - DNA, 13 bp, Homo sapiens
gttattctcttca

SEQ ID NO: 1276522 - DNA, 22 bp, Homo sapiens
gttattgggagtcttaataaaa

SEQ ID NO: 1276523 - DNA, 20 bp, Homo sapiens
gttattgggcaagtgattga

SEQ ID NO: 1276524 - DNA, 22 bp, Homo sapiens
gttattggtgtaaggtactttc

SEQ ID NO: 1276525 - DNA, 12 bp, Homo sapiens
gttattgtgaat

SEQ ID NO: 1276526 - DNA, 14 bp, Homo sapiens
gttattgtgaatga

SEQ ID NO: 1276527 - DNA, 12 bp, Homo sapiens
gttattgttgaa

SEQ ID NO: 1276528 - DNA, 11 bp, Homo sapiens
gttatttaaat

SEQ ID NO: 1276529 - DNA, 15 bp, Homo sapiens
gttatttaaatgagt

SEQ ID NO: 1276530 - DNA, 18 bp, Homo sapiens
gttatttaatatggtatt

SEQ ID NO: 1276531 - DNA, 14 bp, Homo sapiens
gttatttacactgg

SEQ ID NO: 1276532 - DNA, 16 bp, Homo sapiens
gttatttacactggtc

SEQ ID NO: 1276533 - DNA, 17 bp, Homo sapiens
gttatttacactggtct

SEQ ID NO: 1276534 - DNA, 22 bp, Homo sapiens
gttatttacactggtctaatgt

SEQ ID NO: 1276535 - DNA, 19 bp, Homo sapiens
gttatttactcctcctgct

SEQ ID NO: 1276536 - DNA, 20 bp, Homo sapiens
gttatttactcctcctgctc

SEQ ID NO: 1276537 - DNA, 17 bp, Homo sapiens
gttatttatcaattttt

SEQ ID NO: 1276538 - DNA, 13 bp, Homo sapiens
gttatttctgttt

SEQ ID NO: 1276539 - DNA, 17 bp, Homo sapiens
gttatttgtaatagatg

SEQ ID NO: 1276540 - DNA, 18 bp, Homo sapiens
gttatttgttattttcag

SEQ ID NO: 1276541 - DNA, 19 bp, Homo sapiens
gttattttaaatataaata

SEQ ID NO: 1276542 - DNA, 16 bp, Homo sapiens
gttattttatttgctt

SEQ ID NO: 1276543 - DNA, 14 bp, Homo sapiens
gttattttcagtat

SEQ ID NO: 1276544 - DNA, 17 bp, Homo sapiens
gttattttcagtatttt

SEQ ID NO: 1276545 - DNA, 13 bp, Homo sapiens
gttattttccagg

SEQ ID NO: 1276546 - DNA, 14 bp, Homo sapiens
gttattttctacag

SEQ ID NO: 1276547 - DNA, 23 bp, Homo sapiens
gttattttctttgaaattgttta

SEQ ID NO: 1276548 - DNA, 13 bp, Homo sapiens
gttattttgcaac

SEQ ID NO: 1276549 - DNA, 14 bp, Homo sapiens
gttattttgctttg

SEQ ID NO: 1276550 - DNA, 16 bp, Homo sapiens
gttattttgctttggt

SEQ ID NO: 1276551 - DNA, 20 bp, Homo sapiens
gttattttgtgtacaagttg

SEQ ID NO: 1276552 - DNA, 16 bp, Homo sapiens
gttatttttatatcag

SEQ ID NO: 1276553 - DNA, 19 bp, Homo sapiens
gttatttttattaaatgta

SEQ ID NO: 1276554 - DNA, 23 bp, Homo sapiens
gttatttttatttatttaaattt

SEQ ID NO: 1276555 - DNA, 21 bp, Homo sapiens
gttatttttctttttaagaga

SEQ ID NO: 1276556 - DNA, 16 bp, Homo sapiens
gttattttttaattat

SEQ ID NO: 1276557 - DNA, 12 bp, Homo sapiens
gttcaaaatcat

SEQ ID NO: 1276558 - DNA, 13 bp, Homo sapiens
gttcaaaatgtct

SEQ ID NO: 1276559 - DNA, 15 bp, Homo sapiens
gttcaaactactgta

SEQ ID NO: 1276560 - DNA, 19 bp, Homo sapiens
gttcaaactactgtacatt

SEQ ID NO: 1276561 - DNA, 22 bp, Homo sapiens
gttcaaagaggtgaacattaaa

SEQ ID NO: 1276562 - DNA, 12 bp, Homo sapiens
gttcaaagccag

SEQ ID NO: 1276563 - DNA, 13 bp, Homo sapiens
gttcaaagccagc

SEQ ID NO: 1276564 - DNA, 13 bp, Homo sapiens
gttcaaagtgtat

SEQ ID NO: 1276565 - DNA, 18 bp, Homo sapiens
gttcaaagtgtatattta

SEQ ID NO: 1276566 - DNA, 15 bp, Homo sapiens
gttcaacccacagct

SEQ ID NO: 1276567 - DNA, 15 bp, Homo sapiens
gttcaacttccagaa

SEQ ID NO: 1276568 - DNA, 16 bp, Homo sapiens
gttcaactttcagaag

SEQ ID NO: 1276569 - DNA, 15 bp, Homo sapiens
gttcaagaccagcct

SEQ ID NO: 1276570 - DNA, 15 bp, Homo sapiens
gttcaagaggcgtgt

SEQ ID NO: 1276571 - DNA, 18 bp, Homo sapiens
gttcaagcacactggaat

SEQ ID NO: 1276572 - DNA, 14 bp, Homo sapiens
gttcaagcctgtgg

SEQ ID NO: 1276573 - DNA, 16 bp, Homo sapiens
gttcaagcctgtggga

SEQ ID NO: 1276574 - DNA, 22 bp, Homo sapiens
gttcaaggtcactgtttcctgg

SEQ ID NO: 1276575 - DNA, 15 bp, Homo sapiens
gttcaatgttccatt

SEQ ID NO: 1276576 - DNA, 13 bp, Homo sapiens
gttcaattagaat

SEQ ID NO: 1276577 - DNA, 16 bp, Homo sapiens
gttcacaaactacctc

SEQ ID NO: 1276578 - DNA, 20 bp, Homo sapiens
gttcacaaactacctctgga

SEQ ID NO: 1276579 - DNA, 18 bp, Homo sapiens
gttcacaacataaggaga

SEQ ID NO: 1276580 - DNA, 13 bp, Homo sapiens
gttcacagaaaaa

SEQ ID NO: 1276581 - DNA, 17 bp, Homo sapiens
gttcacagaaaaagcat

SEQ ID NO: 1276582 - DNA, 17 bp, Homo sapiens
gttcacagtagagtagg

SEQ ID NO: 1276583 - DNA, 16 bp, Homo sapiens
gttcacattagaatta

SEQ ID NO: 1276584 - DNA, 17 bp, Homo sapiens
gttcacattagaattag

SEQ ID NO: 1276585 - DNA, 21 bp, Homo sapiens
gttcacctccaagcatttcat

SEQ ID NO: 1276586 - DNA, 21 bp, Homo sapiens
gttcaccttcaaaatgttcta

SEQ ID NO: 1276587 - DNA, 15 bp, Homo sapiens
gttcaccttggaagg

SEQ ID NO: 1276588 - DNA, 21 bp, Homo sapiens
gttcacgtaagatacaagttt

SEQ ID NO: 1276589 - DNA, 22 bp, Homo sapiens
gttcactcattgacatgatata

SEQ ID NO: 1276590 - DNA, 21 bp, Homo sapiens
gttcactgagctccccagatc

SEQ ID NO: 1276591 - DNA, 16 bp, Homo sapiens
gttcacttgccatgca

SEQ ID NO: 1276592 - DNA, 17 bp, Homo sapiens
gttcacttgccatgcag

SEQ ID NO: 1276593 - DNA, 19 bp, Homo sapiens
gttcacttgggctctctct

SEQ ID NO: 1276594 - DNA, 20 bp, Homo sapiens
gttcacttgggctctctcta

SEQ ID NO: 1276595 - DNA, 20 bp, Homo sapiens
gttcacttttgacaaaggca

SEQ ID NO: 1276596 - DNA, 18 bp, Homo sapiens
gttcagaaatgctgcctg

SEQ ID NO: 1276597 - DNA, 15 bp, Homo sapiens
gttcagacacagctc

SEQ ID NO: 1276598 - DNA, 17 bp, Homo sapiens
gttcagacacagctctt

SEQ ID NO: 1276599 - DNA, 14 bp, Homo sapiens
gttcagacacctgt

SEQ ID NO: 1276600 - DNA, 17 bp, Homo sapiens
gttcagaggcagcacca

SEQ ID NO: 1276601 - DNA, 22 bp, Homo sapiens
gttgaagggaggtggcaagagt

SEQ ID NO: 1276602 - DNA, 13 bp, Homo sapiens
gttgaaggtgcca

SEQ ID NO: 1276603 - DNA, 18 bp, Homo sapiens
gttgaataaaagtgcaca

SEQ ID NO: 1276604 - DNA, 13 bp, Homo sapiens
gttgaatactttt

SEQ ID NO: 1276605 - DNA, 20 bp, Homo sapiens
gttgaatattggtaattaaa

SEQ ID NO: 1276606 - DNA, 20 bp, Homo sapiens
gttgaatctgagctgcaggt

SEQ ID NO: 1276607 - DNA, 15 bp, Homo sapiens
gttgaatctgggagg

SEQ ID NO: 1276608 - DNA, 19 bp, Homo sapiens
gttgaatgacaacagaagc

SEQ ID NO: 1276609 - DNA, 16 bp, Homo sapiens
gttgaatggcctgcct

SEQ ID NO: 1276610 - DNA, 13 bp, Homo sapiens
gttgaatgttgca

SEQ ID NO: 1276611 - DNA, 17 bp, Homo sapiens
gttgacaacctagaatg

SEQ ID NO: 1276612 - DNA, 15 bp, Homo sapiens
gttgacaactgtgac

SEQ ID NO: 1276613 - DNA, 16 bp, Homo sapiens
gttgacaattctgcat

SEQ ID NO: 1276614 - DNA, 17 bp, Homo sapiens
gttgacaattctgcatg

SEQ ID NO: 1276615 - DNA, 16 bp, Homo sapiens
gttgacagcaaaatgt

SEQ ID NO: 1276616 - DNA, 14 bp, Homo sapiens
gttgacatatttaa

SEQ ID NO: 1276617 - DNA, 15 bp, Homo sapiens
gttgacattctgaat

SEQ ID NO: 1276618 - DNA, 13 bp, Homo sapiens
gttgaccactcca

SEQ ID NO: 1276619 - DNA, 22 bp, Homo sapiens
gttgacccaaaaatgttccctt

SEQ ID NO: 1276620 - DNA, 19 bp, Homo sapiens
gttgaccgttttcatcctg

SEQ ID NO: 1276621 - DNA, 16 bp, Homo sapiens
gttgacgggccgcagg

SEQ ID NO: 1276622 - DNA, 15 bp, Homo sapiens
gttgactgactgagc

SEQ ID NO: 1276623 - DNA, 19 bp, Homo sapiens
gttgactgtgattagatca

SEQ ID NO: 1276624 - DNA, 24 bp, Homo sapiens
gttgacttatagtacatgataaat

SEQ ID NO: 1276625 - DNA, 18 bp, Homo sapiens
gttgactttataaatttc

SEQ ID NO: 1276626 - DNA, 12 bp, Homo sapiens
gttgagaaatga

SEQ ID NO: 1276627 - DNA, 12 bp, Homo sapiens
gttgagaagaat

SEQ ID NO: 1276628 - DNA, 13 bp, Homo sapiens
gttgagagccagt

SEQ ID NO: 1276629 - DNA, 15 bp, Homo sapiens
gttgagccaggcctg

SEQ ID NO: 1276630 - DNA, 20 bp, Homo sapiens
gttgagccatgctacagtta

SEQ ID NO: 1276631 - DNA, 15 bp, Homo sapiens
gttgagccccaagtc

SEQ ID NO: 1276632 - DNA, 19 bp, Homo sapiens
gttgagccccagtgctgga

SEQ ID NO: 1276633 - DNA, 17 bp, Homo sapiens
gttgagggaaagagctt

SEQ ID NO: 1276634 - DNA, 17 bp, Homo sapiens
gttgagggaacagacag

SEQ ID NO: 1276635 - DNA, 15 bp, Homo sapiens
gttgaggggaggagg

SEQ ID NO: 1276636 - DNA, 23 bp, Homo sapiens
gttgaggtggaagccctccttcc

SEQ ID NO: 1276637 - DNA, 16 bp, Homo sapiens
gttgaggtttttaaat

SEQ ID NO: 1276638 - DNA, 18 bp, Homo sapiens
gttgataaattccactgg

SEQ ID NO: 1276639 - DNA, 21 bp, Homo sapiens
gttgataaattccactggact

SEQ ID NO: 1276640 - DNA, 15 bp, Homo sapiens
gttgataatttcagg

SEQ ID NO: 1276641 - DNA, 22 bp, Homo sapiens
gttgatagcaagtgaatttttc

SEQ ID NO: 1276642 - DNA, 23 bp, Homo sapiens
gttgatagcaagtgaatttttct

SEQ ID NO: 1276643 - DNA, 23 bp, Homo sapiens
gttgatattcaaggctttaaaag

SEQ ID NO: 1276644 - DNA, 16 bp, Homo sapiens
gttgatattgtttgct

SEQ ID NO: 1276645 - DNA, 20 bp, Homo sapiens
gttgatatttcgaaagctgc

SEQ ID NO: 1276646 - DNA, 22 bp, Homo sapiens
gttgatcatgtactttttagta

SEQ ID NO: 1276647 - DNA, 16 bp, Homo sapiens
gttgatctacccgtgc

SEQ ID NO: 1276648 - DNA, 20 bp, Homo sapiens
gttgatctacccgtgcctgg

SEQ ID NO: 1276649 - DNA, 13 bp, Homo sapiens
gttgatctgctct

SEQ ID NO: 1276650 - DNA, 19 bp, Homo sapiens
gttgatcttacaagatatt

SEQ ID NO: 1276651 - DNA, 14 bp, Homo sapiens
gttgatcttcttca

SEQ ID NO: 1276652 - DNA, 14 bp, Homo sapiens
gttgatgactttct

SEQ ID NO: 1276653 - DNA, 16 bp, Homo sapiens
gttgatgaggcctctt

SEQ ID NO: 1276654 - DNA, 15 bp, Homo sapiens
gttgatggaaaataa

SEQ ID NO: 1276655 - DNA, 18 bp, Homo sapiens
gttgatttctttccagag

SEQ ID NO: 1276656 - DNA, 16 bp, Homo sapiens
gttgattttgaacttt

SEQ ID NO: 1276657 - DNA, 22 bp, Homo sapiens
gttgatttttttttttttttcc

SEQ ID NO: 1276658 - DNA, 23 bp, Homo sapiens
gttgatttttttttttttttcct

SEQ ID NO: 1276659 - DNA, 16 bp, Homo sapiens
gttgcaagatgtgaat

SEQ ID NO: 1276660 - DNA, 21 bp, Homo sapiens
gttgcaaggatttttccatgt

SEQ ID NO: 1276661 - DNA, 23 bp, Homo sapiens
gttgcaaggatttttccatgtgt

SEQ ID NO: 1276662 - DNA, 23 bp, Homo sapiens
gttgcaaggccgctgttcaccca

SEQ ID NO: 1276663 - DNA, 16 bp, Homo sapiens
gttgcaatgtgaaaaa

SEQ ID NO: 1276664 - DNA, 17 bp, Homo sapiens
gttgcaccatctgcttg

SEQ ID NO: 1276665 - DNA, 14 bp, Homo sapiens
gttgcactgaacag

SEQ ID NO: 1276666 - DNA, 16 bp, Homo sapiens
gttgcactgccccctg

SEQ ID NO: 1276667 - DNA, 21 bp, Homo sapiens
gttgcactttagacatttttg

SEQ ID NO: 1276668 - DNA, 14 bp, Homo sapiens
gttgcagcactgcc

SEQ ID NO: 1276669 - DNA, 21 bp, Homo sapiens
gttgcagcatgagactttctg

SEQ ID NO: 1276670 - DNA, 23 bp, Homo sapiens
gttgcagctgttttgttgacatt

SEQ ID NO: 1276671 - DNA, 13 bp, Homo sapiens
gttgcagtgagct

SEQ ID NO: 1276672 - DNA, 19 bp, Homo sapiens
gttgcatactgagccaagt

SEQ ID NO: 1276673 - DNA, 18 bp, Homo sapiens
gttgcatatgagcctgcc

SEQ ID NO: 1276674 - DNA, 14 bp, Homo sapiens
gttgcatggaaatc

SEQ ID NO: 1276675 - DNA, 18 bp, Homo sapiens
gttgcattcctttgtctt

SEQ ID NO: 1276676 - DNA, 23 bp, Homo sapiens
gttgcattttaaccctattttac

SEQ ID NO: 1276677 - DNA, 18 bp, Homo sapiens
gttgccaaacagccacac

SEQ ID NO: 1276678 - DNA, 20 bp, Homo sapiens
gttgccaaatatgtcctggg

SEQ ID NO: 1276679 - DNA, 21 bp, Homo sapiens
gttgccaaatatgtcctgggg

SEQ ID NO: 1276680 - DNA, 19 bp, Homo sapiens
gttgccaactaagccctcg

SEQ ID NO: 1276681 - DNA, 18 bp, Homo sapiens
gttgccaagctccaagcc

SEQ ID NO: 1276682 - DNA, 20 bp, Homo sapiens
gttgccacaccaatcagaga

SEQ ID NO: 1276683 - DNA, 19 bp, Homo sapiens
gttgccacagtagaactgt

SEQ ID NO: 1276684 - DNA, 19 bp, Homo sapiens
gttgccaccacctctgtgg

SEQ ID NO: 1276685 - DNA, 18 bp, Homo sapiens
gttgccacctgttaaaat

SEQ ID NO: 1276686 - DNA, 12 bp, Homo sapiens
gttgccatttct

SEQ ID NO: 1276687 - DNA, 18 bp, Homo sapiens
gttgccatttctctgctt

SEQ ID NO: 1276688 - DNA, 13 bp, Homo sapiens
gttgcccaggctg

SEQ ID NO: 1276689 - DNA, 21 bp, Homo sapiens
gttgcccgaaactaagccagg

SEQ ID NO: 1276690 - DNA, 13 bp, Homo sapiens
gttgccgtgctcc

SEQ ID NO: 1276691 - DNA, 16 bp, Homo sapiens
gttgcctaataaacat

SEQ ID NO: 1276692 - DNA, 14 bp, Homo sapiens
gttgcctctctaag

SEQ ID NO: 1276693 - DNA, 21 bp, Homo sapiens
gttgccttgaaccacttccct

SEQ ID NO: 1276694 - DNA, 16 bp, Homo sapiens
gttgcgacggagagaa

SEQ ID NO: 1276695 - DNA, 22 bp, Homo sapiens
gttgctaagaagcgagcactga

SEQ ID NO: 1276696 - DNA, 15 bp, Homo sapiens
gttgctagggagagg

SEQ ID NO: 1276697 - DNA, 22 bp, Homo sapiens
gttgctagttttttgcttctct

SEQ ID NO: 1276698 - DNA, 15 bp, Homo sapiens
gttgctatacatgtt

SEQ ID NO: 1276699 - DNA, 20 bp, Homo sapiens
gttgctcaaatctattcaga

SEQ ID NO: 1276700 - DNA, 22 bp, Homo sapiens
gttgctccaggatgcattctga

SEQ ID NO: 1276701 - DNA, 19 bp, Homo sapiens
gttgctccgcctggcctgg

SEQ ID NO: 1276702 - DNA, 19 bp, Homo sapiens
gttgctcttggaaagctga

SEQ ID NO: 1276703 - DNA, 21 bp, Homo sapiens
gttgctgaccagctggagtga

SEQ ID NO: 1276704 - DNA, 21 bp, Homo sapiens
gttgctgactactactctgcc

SEQ ID NO: 1276705 - DNA, 18 bp, Homo sapiens
gttgctgatgtttataaa

SEQ ID NO: 1276706 - DNA, 14 bp, Homo sapiens
gttgctggaggggc

SEQ ID NO: 1276707 - DNA, 21 bp, Homo sapiens
gttgctggaggggctgtcctc

SEQ ID NO: 1276708 - DNA, 23 bp, Homo sapiens
gttgctggaggggctgtcctcct

SEQ ID NO: 1276709 - DNA, 16 bp, Homo sapiens
gttgctgtacaggaaa

SEQ ID NO: 1276710 - DNA, 17 bp, Homo sapiens
gttgctgtgccgtgtcc

SEQ ID NO: 1276711 - DNA, 15 bp, Homo sapiens
gttgctgtttatttt

SEQ ID NO: 1276712 - DNA, 18 bp, Homo sapiens
gttgctgttttcctccct

SEQ ID NO: 1276713 - DNA, 21 bp, Homo sapiens
gttgctgttttcctcccttct

SEQ ID NO: 1276714 - DNA, 23 bp, Homo sapiens
gttgctgttttcctcccttctgc

SEQ ID NO: 1276715 - DNA, 23 bp, Homo sapiens
gttgcttaggatgtgtgcatgtg

SEQ ID NO: 1276716 - DNA, 23 bp, Homo sapiens
gttgctttaaagtacctgtagtg

SEQ ID NO: 1276717 - DNA, 13 bp, Homo sapiens
gttggaaaaaatt

SEQ ID NO: 1276718 - DNA, 16 bp, Homo sapiens
gttggaaactgtaaaa

SEQ ID NO: 1276719 - DNA, 14 bp, Homo sapiens
gttggaaatgtgtt

SEQ ID NO: 1276720 - DNA, 15 bp, Homo sapiens
gttggaaatgtgttt

SEQ ID NO: 1276721 - DNA, 21 bp, Homo sapiens
gttggaactatacccgggacc

SEQ ID NO: 1276722 - DNA, 23 bp, Homo sapiens
gtttatgtgctattaatatttgt

SEQ ID NO: 1276723 - DNA, 15 bp, Homo sapiens
gtttattaaatgctt

SEQ ID NO: 1276724 - DNA, 15 bp, Homo sapiens
gtttattaaattgca

SEQ ID NO: 1276725 - DNA, 23 bp, Homo sapiens
gtttattaacaaattatgttaca

SEQ ID NO: 1276726 - DNA, 18 bp, Homo sapiens
gtttattaactactgaat

SEQ ID NO: 1276727 - DNA, 14 bp, Homo sapiens
gtttattaatctta

SEQ ID NO: 1276728 - DNA, 18 bp, Homo sapiens
gtttattaatcttagtgt

SEQ ID NO: 1276729 - DNA, 21 bp, Homo sapiens
gtttattaatcttagtgtatg

SEQ ID NO: 1276730 - DNA, 20 bp, Homo sapiens
gtttattacttccatgaatt

SEQ ID NO: 1276731 - DNA, 21 bp, Homo sapiens
gtttattcccaagtatgcctt

SEQ ID NO: 1276732 - DNA, 22 bp, Homo sapiens
gtttattccttctgtagtgtat

SEQ ID NO: 1276733 - DNA, 16 bp, Homo sapiens
gtttatttcacttgat

SEQ ID NO: 1276734 - DNA, 14 bp, Homo sapiens
gtttatttctctct

SEQ ID NO: 1276735 - DNA, 13 bp, Homo sapiens
gtttatttgagaa

SEQ ID NO: 1276736 - DNA, 13 bp, Homo sapiens
gtttattttttct

SEQ ID NO: 1276737 - DNA, 14 bp, Homo sapiens
gtttcaaactttac

SEQ ID NO: 1276738 - DNA, 13 bp, Homo sapiens
gtttcaaagcaca

SEQ ID NO: 1276739 - DNA, 22 bp, Homo sapiens
gtttcaaagcacaataactagt

SEQ ID NO: 1276740 - DNA, 17 bp, Homo sapiens
gtttcaacccaactgac

SEQ ID NO: 1276741 - DNA, 18 bp, Homo sapiens
gtttcaacggaaagtgct

SEQ ID NO: 1276742 - DNA, 17 bp, Homo sapiens
gtttcaagaaaatcttt

SEQ ID NO: 1276743 - DNA, 16 bp, Homo sapiens
gtttcaagttattcaa

SEQ ID NO: 1276744 - DNA, 19 bp, Homo sapiens
gtttcaagttattcaaatt

SEQ ID NO: 1276745 - DNA, 20 bp, Homo sapiens
gtttcaagttattcaaattt

SEQ ID NO: 1276746 - DNA, 17 bp, Homo sapiens
gtttcaagttttaaagt

SEQ ID NO: 1276747 - DNA, 23 bp, Homo sapiens
gtttcaatgcatacaataaaaga

SEQ ID NO: 1276748 - DNA, 19 bp, Homo sapiens
gtttcaatgtgattctaat

SEQ ID NO: 1276749 - DNA, 21 bp, Homo sapiens
gtttcaatgtgattctaatgt

SEQ ID NO: 1276750 - DNA, 23 bp, Homo sapiens
gtttcacagcctataaccagaca

SEQ ID NO: 1276751 - DNA, 22 bp, Homo sapiens
gtttcacaggtcaataaactta

SEQ ID NO: 1276752 - DNA, 21 bp, Homo sapiens
gtttcaccatgttggccaggc

SEQ ID NO: 1276753 - DNA, 16 bp, Homo sapiens
gtttcacccttaaccc

SEQ ID NO: 1276754 - DNA, 22 bp, Homo sapiens
gtttcacccttaacccaaggag

SEQ ID NO: 1276755 - DNA, 14 bp, Homo sapiens
gtttcaccttccct

SEQ ID NO: 1276756 - DNA, 15 bp, Homo sapiens
gtttcaccttccctc

SEQ ID NO: 1276757 - DNA, 17 bp, Homo sapiens
gtttcactattcctatg

SEQ ID NO: 1276758 - DNA, 13 bp, Homo sapiens
gtttcactccacc

SEQ ID NO: 1276759 - DNA, 23 bp, Homo sapiens
gtttcactcctgcttctctcagc

SEQ ID NO: 1276760 - DNA, 18 bp, Homo sapiens
gtttcactgaaatgtttg

SEQ ID NO: 1276761 - DNA, 14 bp, Homo sapiens
gtttcactgagagc

SEQ ID NO: 1276762 - DNA, 20 bp, Homo sapiens
gtttcactgagagctgcctc

SEQ ID NO: 1276763 - DNA, 21 bp, Homo sapiens
gtttcactgtactgcatgtga

SEQ ID NO: 1276764 - DNA, 13 bp, Homo sapiens
gtttcagaaatgt

SEQ ID NO: 1276765 - DNA, 13 bp, Homo sapiens
gtttcagaccccc

SEQ ID NO: 1276766 - DNA, 22 bp, Homo sapiens
gtttcagagagtcaatgtcatt

SEQ ID NO: 1276767 - DNA, 16 bp, Homo sapiens
gtttcagatatatatc

SEQ ID NO: 1276768 - DNA, 17 bp, Homo sapiens
gtttcagatatatatca

SEQ ID NO: 1276769 - DNA, 21 bp, Homo sapiens
gtttcagatatatatcatatt

SEQ ID NO: 1276770 - DNA, 12 bp, Homo sapiens
gtttcagatgag

SEQ ID NO: 1276771 - DNA, 22 bp, Homo sapiens
gtttcagatgtgcaataatttg

SEQ ID NO: 1276772 - DNA, 16 bp, Homo sapiens
gtttcaggagtgcaag

SEQ ID NO: 1276773 - DNA, 19 bp, Homo sapiens
gtttcaggatacatgtgcc

SEQ ID NO: 1276774 - DNA, 16 bp, Homo sapiens
gtttcaggtttccatt

SEQ ID NO: 1276775 - DNA, 10 bp, Homo sapiens
gtttcagttg

SEQ ID NO: 1276776 - DNA, 12 bp, Homo sapiens
gtttcagtttga

SEQ ID NO: 1276777 - DNA, 14 bp, Homo sapiens
gtttcatatttctt

SEQ ID NO: 1276778 - DNA, 21 bp, Homo sapiens
gtttcatgttagttaccttat

SEQ ID NO: 1276779 - DNA, 19 bp, Homo sapiens
gtttcatgttttgtgacta

SEQ ID NO: 1276780 - DNA, 13 bp, Homo sapiens
gtttcattcactg

SEQ ID NO: 1276781 - DNA, 14 bp, Homo sapiens
gtttcattcactgt

SEQ ID NO: 1276782 - DNA, 20 bp, Homo sapiens
gtttcattgcgaatcttttt

SEQ ID NO: 1276783 - DNA, 19 bp, Homo sapiens
gtttcatttagtcatgtga

SEQ ID NO: 1276784 - DNA, 20 bp, Homo sapiens
gtttcatttagtcatgtgac

SEQ ID NO: 1276785 - DNA, 21 bp, Homo sapiens
gtttcatttagtcatgtgacc

SEQ ID NO: 1276786 - DNA, 19 bp, Homo sapiens
gtttcatttctactgtgac

SEQ ID NO: 1276787 - DNA, 15 bp, Homo sapiens
gtttcatttcttatc

SEQ ID NO: 1276788 - DNA, 20 bp, Homo sapiens
gtttccaaatccctttcatg

SEQ ID NO: 1276789 - DNA, 14 bp, Homo sapiens
gtttccaaggtgca

SEQ ID NO: 1276790 - DNA, 23 bp, Homo sapiens
gtttccacaggaacaacagcatc

SEQ ID NO: 1276791 - DNA, 20 bp, Homo sapiens
gtttccagacttccttgaga

SEQ ID NO: 1276792 - DNA, 23 bp, Homo sapiens
gtttccagtacacctttcagcca

SEQ ID NO: 1276793 - DNA, 21 bp, Homo sapiens
gtttccatagcaacaggaaaa

SEQ ID NO: 1276794 - DNA, 16 bp, Homo sapiens
gtttccatcatgtctg

SEQ ID NO: 1276795 - DNA, 18 bp, Homo sapiens
gtttccatcatgtctgta

SEQ ID NO: 1276796 - DNA, 21 bp, Homo sapiens
gtttccatttctcaatcagtg

SEQ ID NO: 1276797 - DNA, 22 bp, Homo sapiens
gtttccatttctcaatcagtgc

SEQ ID NO: 1276798 - DNA, 16 bp, Homo sapiens
gtttcccaagagctac

SEQ ID NO: 1276799 - DNA, 14 bp, Homo sapiens
gtttcccaccacct

SEQ ID NO: 1276800 - DNA, 14 bp, Homo sapiens
gtttcccaggccca

SEQ ID NO: 1276801 - DNA, 15 bp, Homo sapiens
gtttcccataatttt

SEQ ID NO: 1276802 - DNA, 19 bp, Homo sapiens
gtttccccagggaaggaaa

SEQ ID NO: 1276803 - DNA, 14 bp, Homo sapiens
gtttccccatctct

SEQ ID NO: 1276804 - DNA, 21 bp, Homo sapiens
gtttccccatctctgtctggg

SEQ ID NO: 1276805 - DNA, 19 bp, Homo sapiens
gtttcccccacagttttaa

SEQ ID NO: 1276806 - DNA, 19 bp, Homo sapiens
gtttcccggttcaggacca

SEQ ID NO: 1276807 - DNA, 23 bp, Homo sapiens
gtttccctcaaatgcgcgtgtgc

SEQ ID NO: 1276808 - DNA, 18 bp, Homo sapiens
gtttccctgcccctgtcc

SEQ ID NO: 1276809 - DNA, 14 bp, Homo sapiens
gtttcccttcctcg

SEQ ID NO: 1276810 - DNA, 15 bp, Homo sapiens
gtttcccttgctttg

SEQ ID NO: 1276811 - DNA, 21 bp, Homo sapiens
gtttcctaaatccaaccattt

SEQ ID NO: 1276812 - DNA, 18 bp, Homo sapiens
gtttcctaactgtgattt

SEQ ID NO: 1276813 - DNA, 20 bp, Homo sapiens
gtttcctcattcctgaaaga

SEQ ID NO: 1276814 - DNA, 18 bp, Homo sapiens
gtttcctctagttctttg

SEQ ID NO: 1276815 - DNA, 13 bp, Homo sapiens
gtttcctctgttc

SEQ ID NO: 1276816 - DNA, 14 bp, Homo sapiens
gtttcctgctccag

SEQ ID NO: 1276817 - DNA, 21 bp, Homo sapiens
gtttcctgggtgccctggctc

SEQ ID NO: 1276818 - DNA, 23 bp, Homo sapiens
gtttccttgtttatcagatacat

SEQ ID NO: 1276819 - DNA, 22 bp, Homo sapiens
gtttcctttaccttttctataa

SEQ ID NO: 1276820 - DNA, 13 bp, Homo sapiens
gtttcctttctca

SEQ ID NO: 1276821 - DNA, 22 bp, Homo sapiens
gtttccttttggaacatttctt

SEQ ID NO: 1276822 - DNA, 16 bp, Homo sapiens
gtttcgactggtccag

SEQ ID NO: 1276823 - DNA, 17 bp, Homo sapiens
gtttcgactggtccagc

SEQ ID NO: 1276824 - DNA, 19 bp, Homo sapiens
gtttcgactggtccagctc

SEQ ID NO: 1276825 - DNA, 22 bp, Homo sapiens
gtttcgactggtccagctctga

SEQ ID NO: 1276826 - DNA, 16 bp, Homo sapiens
gtttcgacttatttct

SEQ ID NO: 1276827 - DNA, 20 bp, Homo sapiens
gtttcgcattaagcacacac

SEQ ID NO: 1276828 - DNA, 13 bp, Homo sapiens
gtttcggaaaaaa

SEQ ID NO: 1276829 - DNA, 15 bp, Homo sapiens
gtttcgtttctgtat

SEQ ID NO: 1276830 - DNA, 13 bp, Homo sapiens
gtttctaaaaaca

SEQ ID NO: 1276831 - DNA, 19 bp, Homo sapiens
gtttctaaaggctaccttt

SEQ ID NO: 1276832 - DNA, 20 bp, Homo sapiens
gtttctagaggcctcagttt

SEQ ID NO: 1276833 - DNA, 18 bp, Homo sapiens
gtttctagctagaaatat

SEQ ID NO: 1276834 - DNA, 23 bp, Homo sapiens
gtttctagctagaaatatgattt

SEQ ID NO: 1276835 - DNA, 15 bp, Homo sapiens
gtttctcatttgttt

SEQ ID NO: 1276836 - DNA, 22 bp, Homo sapiens
gtttctccacaacagcctgggg

SEQ ID NO: 1276837 - DNA, 17 bp, Homo sapiens
gtttctccatgttggtc

SEQ ID NO: 1276838 - DNA, 15 bp, Homo sapiens
gtttctccccctggg

SEQ ID NO: 1276839 - DNA, 22 bp, Homo sapiens
gtttctccccctgggctctgcc

SEQ ID NO: 1276840 - DNA, 23 bp, Homo sapiens
gtttctccccctgggctctgccc

SEQ ID NO: 1276841 - DNA, 12 bp, Homo sapiens
gtttctctgctg

SEQ ID NO: 1276842 - DNA, 17 bp, Homo sapiens
gtttctctgctgtcaac

SEQ ID NO: 1276843 - DNA, 19 bp, Homo sapiens
gttttctgtttgtaaatta

SEQ ID NO: 1276844 - DNA, 21 bp, Homo sapiens
gttttcttgccaccctctggg

SEQ ID NO: 1276845 - DNA, 23 bp, Homo sapiens
gttttcttgccaccctctgggag

SEQ ID NO: 1276846 - DNA, 20 bp, Homo sapiens
gttttctttgcaaagtattg

SEQ ID NO: 1276847 - DNA, 17 bp, Homo sapiens
gttttgaataaaaagtg

SEQ ID NO: 1276848 - DNA, 18 bp, Homo sapiens
gttttgaataaattttca

SEQ ID NO: 1276849 - DNA, 12 bp, Homo sapiens
gttttgaatttt

SEQ ID NO: 1276850 - DNA, 16 bp, Homo sapiens
gttttgacggatgatt

SEQ ID NO: 1276851 - DNA, 15 bp, Homo sapiens
gttttgatataatct

SEQ ID NO: 1276852 - DNA, 20 bp, Homo sapiens
gttttgatatttatttcctg

SEQ ID NO: 1276853 - DNA, 23 bp, Homo sapiens
gttttgatgtttgtggcctcaga

SEQ ID NO: 1276854 - DNA, 23 bp, Homo sapiens
gttttgattaatgtttcttaaat

SEQ ID NO: 1276855 - DNA, 19 bp, Homo sapiens
gttttgatttgtactgaaa

SEQ ID NO: 1276856 - DNA, 21 bp, Homo sapiens
gttttgattttggaaagatgt

SEQ ID NO: 1276857 - DNA, 20 bp, Homo sapiens
gttttgcttgggcctccctg

SEQ ID NO: 1276858 - DNA, 14 bp, Homo sapiens
gttttgcttttgtt

SEQ ID NO: 1276859 - DNA, 19 bp, Homo sapiens
gttttggagagtttgcctg

SEQ ID NO: 1276860 - DNA, 15 bp, Homo sapiens
gttttggcagctgac

SEQ ID NO: 1276861 - DNA, 23 bp, Homo sapiens
gttttggctgaaattctcctgga

SEQ ID NO: 1276862 - DNA, 14 bp, Homo sapiens
gttttgggatcagg

SEQ ID NO: 1276863 - DNA, 15 bp, Homo sapiens
gttttgggggtcagg

SEQ ID NO: 1276864 - DNA, 24 bp, Homo sapiens
gttttggtcccctccctcgtgggc

SEQ ID NO: 1276865 - DNA, 15 bp, Homo sapiens
gttttggttccacaa

SEQ ID NO: 1276866 - DNA, 14 bp, Homo sapiens
gttttggttttttt

SEQ ID NO: 1276867 - DNA, 16 bp, Homo sapiens
gttttgtaagatgctg

SEQ ID NO: 1276868 - DNA, 17 bp, Homo sapiens
gttttgtaagatgctgg

SEQ ID NO: 1276869 - DNA, 14 bp, Homo sapiens
gttttgtaagccct

SEQ ID NO: 1276870 - DNA, 15 bp, Homo sapiens
gttttgtaagccctc

SEQ ID NO: 1276871 - DNA, 20 bp, Homo sapiens
gttttgtaagccctctttaa

SEQ ID NO: 1276872 - DNA, 17 bp, Homo sapiens
gttttgtacatagattt

SEQ ID NO: 1276873 - DNA, 20 bp, Homo sapiens
gttttgtagatggagtttca

SEQ ID NO: 1276874 - DNA, 19 bp, Homo sapiens
gttttgtataaataataaa

SEQ ID NO: 1276875 - DNA, 22 bp, Homo sapiens
gttttgtataaataataaagaa

SEQ ID NO: 1276876 - DNA, 16 bp, Homo sapiens
gttttgtatatgatct

SEQ ID NO: 1276877 - DNA, 12 bp, Homo sapiens
gttttgtattct

SEQ ID NO: 1276878 - DNA, 15 bp, Homo sapiens
gttttgtattgcttc

SEQ ID NO: 1276879 - DNA, 22 bp, Homo sapiens
gttttgtattttttaaaacact

SEQ ID NO: 1276880 - DNA, 24 bp, Homo sapiens
gttttgtcaaactgtagaaatgat

SEQ ID NO: 1276881 - DNA, 16 bp, Homo sapiens
gttttgtcagacttcc

SEQ ID NO: 1276882 - DNA, 24 bp, Homo sapiens
gttttgtgactatatagagatgtt

SEQ ID NO: 1276883 - DNA, 21 bp, Homo sapiens
gttttgtgtatatttgcttca

SEQ ID NO: 1276884 - DNA, 15 bp, Homo sapiens
gttttgtgtgtatat

SEQ ID NO: 1276885 - DNA, 14 bp, Homo sapiens
gttttgttgacatt

SEQ ID NO: 1276886 - DNA, 16 bp, Homo sapiens
gttttgttgacattct

SEQ ID NO: 1276887 - DNA, 21 bp, Homo sapiens
gttttgttgacattctgaatg

SEQ ID NO: 1276888 - DNA, 17 bp, Homo sapiens
gttttgtttattaaata

SEQ ID NO: 1276889 - DNA, 19 bp, Homo sapiens
gttttgtttcctttcactg

SEQ ID NO: 1276890 - DNA, 17 bp, Homo sapiens
gtttttaaaaagcaaat

SEQ ID NO: 1276891 - DNA, 15 bp, Homo sapiens
gtttttaaaagtttc

SEQ ID NO: 1276892 - DNA, 16 bp, Homo sapiens
gtttttaaaagtttca

SEQ ID NO: 1276893 - DNA, 15 bp, Homo sapiens
gtttttaaactgtac

SEQ ID NO: 1276894 - DNA, 17 bp, Homo sapiens
gtttttaaactgtacag

SEQ ID NO: 1276895 - DNA, 13 bp, Homo sapiens
gtttttaagctgt

SEQ ID NO: 1276896 - DNA, 14 bp, Homo sapiens
gtttttaagctgtt

SEQ ID NO: 1276897 - DNA, 21 bp, Homo sapiens
gtttttaagggtttgtggaaa

SEQ ID NO: 1276898 - DNA, 18 bp, Homo sapiens
gtttttaagtaacttaag

SEQ ID NO: 1276899 - DNA, 17 bp, Homo sapiens
gtttttaataaagacag

SEQ ID NO: 1276900 - DNA, 17 bp, Homo sapiens
gtttttaatctcctgtt

SEQ ID NO: 1276901 - DNA, 19 bp, Homo sapiens
gtttttaattaaaaacttt

SEQ ID NO: 1276902 - DNA, 11 bp, Homo sapiens
gtttttacagc

SEQ ID NO: 1276903 - DNA, 13 bp, Homo sapiens
gtttttacattat

SEQ ID NO: 1276904 - DNA, 16 bp, Homo sapiens
gtttttactacagttg

SEQ ID NO: 1276905 - DNA, 23 bp, Homo sapiens
gtttttagagaatgtgtttcaaa

SEQ ID NO: 1276906 - DNA, 17 bp, Homo sapiens
gtttttagctttgtgtt

SEQ ID NO: 1276907 - DNA, 20 bp, Homo sapiens
gtttttatatagtctacagt

SEQ ID NO: 1276908 - DNA, 21 bp, Homo sapiens
gtttttatatagtctacagtt

SEQ ID NO: 1276909 - DNA, 17 bp, Homo sapiens
gtttttatattaatgta

SEQ ID NO: 1276910 - DNA, 15 bp, Homo sapiens
gtttttatgagaaac

SEQ ID NO: 1276911 - DNA, 22 bp, Homo sapiens
gtttttatggcttttgtgcatt

SEQ ID NO: 1276912 - DNA, 21 bp, Homo sapiens
gtttttcagcacccccaccca

SEQ ID NO: 1276913 - DNA, 22 bp, Homo sapiens
gtttttcagcacccccacccac

SEQ ID NO: 1276914 - DNA, 12 bp, Homo sapiens
gtttttcagttt

SEQ ID NO: 1276915 - DNA, 20 bp, Homo sapiens
gtttttcatcttttgaagag

SEQ ID NO: 1276916 - DNA, 18 bp, Homo sapiens
gtttttcattaaataaat

SEQ ID NO: 1276917 - DNA, 20 bp, Homo sapiens
gtttttcctatcatgttaac

SEQ ID NO: 1276918 - DNA, 12 bp, Homo sapiens
gtttttcctccc

SEQ ID NO: 1276919 - DNA, 22 bp, Homo sapiens
gtttttcctttcttaattttgt

SEQ ID NO: 1276920 - DNA, 13 bp, Homo sapiens
gtttttctatata

SEQ ID NO: 1276921 - DNA, 17 bp, Homo sapiens
gtttttctgccagggag

SEQ ID NO: 1276922 - DNA, 17 bp, Homo sapiens
gtttttctgcttttgaa

SEQ ID NO: 1276923 - DNA, 20 bp, Homo sapiens
gtttttctgtgtgtcagttt

SEQ ID NO: 1276924 - DNA, 22 bp, Homo sapiens
gtttttcttcaacatcaatgtt

SEQ ID NO: 1276925 - DNA, 22 bp, Homo sapiens
gtttttcttggggtactcttga

SEQ ID NO: 1276926 - DNA, 19 bp, Homo sapiens
gtttttgttactgcctgga

SEQ ID NO: 1276927 - DNA, 15 bp, Homo sapiens
gtttttgttcaaagc

SEQ ID NO: 1276928 - DNA, 16 bp, Homo sapiens
gtttttgtttttgcat

SEQ ID NO: 1276929 - DNA, 15 bp, Homo sapiens
gttttttaaagcaag

SEQ ID NO: 1276930 - DNA, 16 bp, Homo sapiens
gttttttacacgagat

SEQ ID NO: 1276931 - DNA, 13 bp, Homo sapiens
gttttttactttg

SEQ ID NO: 1276932 - DNA, 16 bp, Homo sapiens
gttttttagatcaaat

SEQ ID NO: 1276933 - DNA, 15 bp, Homo sapiens
gttttttcaaaatag

SEQ ID NO: 1276934 - DNA, 11 bp, Homo sapiens
gttttttcatc

SEQ ID NO: 1276935 - DNA, 13 bp, Homo sapiens
gttttttccccct

SEQ ID NO: 1276936 - DNA, 15 bp, Homo sapiens
gttttttcctcagtg

SEQ ID NO: 1276937 - DNA, 21 bp, Homo sapiens
gttttttcctgagcttggcca

SEQ ID NO: 1276938 - DNA, 14 bp, Homo sapiens
gttttttgccacag

SEQ ID NO: 1276939 - DNA, 23 bp, Homo sapiens
gttttttgccacagcttttgcaa

SEQ ID NO: 1276940 - DNA, 22 bp, Homo sapiens
gttttttgttggagtgtttcta

SEQ ID NO: 1276941 - DNA, 22 bp, Homo sapiens
gtttttttccctccataagttt

SEQ ID NO: 1276942 - DNA, 14 bp, Homo sapiens
gtttttttctaaaa

SEQ ID NO: 1276943 - DNA, 10 bp, Homo sapiens
gtttttttgc

SEQ ID NO: 1276944 - DNA, 20 bp, Homo sapiens
gtttttttggtcactccagt

SEQ ID NO: 1276945 - DNA, 19 bp, Homo sapiens
gtttttttgtatagaccaa

SEQ ID NO: 1276946 - DNA, 16 bp, Homo sapiens
gttttttttcagccac

SEQ ID NO: 1276947 - DNA, 17 bp, Homo sapiens
gttttttttgtttgcct

SEQ ID NO: 1276948 - DNA, 22 bp, Homo sapiens
gttttttttttaagtgcaacat

SEQ ID NO: 1276949 - DNA, 16 bp, Homo sapiens
gttttttttttctgaa

SEQ ID NO: 1276950 - DNA, 21 bp, Homo sapiens
gttttttttttcttgtctata

SEQ ID NO: 1276951 - DNA, 18 bp, Homo sapiens
gtttttttttttgagaca

SEQ ID NO: 1276952 - DNA, 21 bp, Homo sapiens
gtttttttttttttttctgtc

SEQ ID NO: 1276953 - DNA, 19 bp, Homo sapiens
gttttttttttttttttgg

SEQ ID NO: 1276954 - DNA, 22 bp, Homo sapiens
taaaaaaaaaaaaaatgttctt

SEQ ID NO: 1276955 - DNA, 18 bp, Homo sapiens
taaaaaaaaaaggatgaa

SEQ ID NO: 1276956 - DNA, 19 bp, Homo sapiens
taaaaaaaaagatctgttt

SEQ ID NO: 1276957 - DNA, 14 bp, Homo sapiens
taaaaaaaaaggca

SEQ ID NO: 1276958 - DNA, 15 bp, Homo sapiens
taaaaaaaaagtcag

SEQ ID NO: 1276959 - DNA, 17 bp, Homo sapiens
taaaaaaaacaaaaaga

SEQ ID NO: 1276960 - DNA, 21 bp, Homo sapiens
taaaaaaaacaaaaagaacaa

SEQ ID NO: 1276961 - DNA, 12 bp, Homo sapiens
taaaaaaaagaa

SEQ ID NO: 1276962 - DNA, 14 bp, Homo sapiens
taaaaaaaagaaaa

SEQ ID NO: 1276963 - DNA, 22 bp, Homo sapiens
taaaaaaaatccttgtgactta

SEQ ID NO: 1276964 - DNA, 19 bp, Homo sapiens
taaaagtgcatttaaggag

SEQ ID NO: 1276965 - DNA, 21 bp, Homo sapiens
taaaagtgcatttaaggagat

SEQ ID NO: 1276966 - DNA, 19 bp, Homo sapiens
taaaagtgggcttgattct

SEQ ID NO: 1276967 - DNA, 18 bp, Homo sapiens
taaaagtggtctctgctg

SEQ ID NO: 1276968 - DNA, 20 bp, Homo sapiens
taaaagtggtctctgctggg

SEQ ID NO: 1276969 - DNA, 16 bp, Homo sapiens
taaaagttataataac

SEQ ID NO: 1276970 - DNA, 17 bp, Homo sapiens
taaaagttcctctccct

SEQ ID NO: 1276971 - DNA, 22 bp, Homo sapiens
taaaagttgcgtttaagttgta

SEQ ID NO: 1276972 - DNA, 23 bp, Homo sapiens
taaaagttgcgtttaagttgtat

SEQ ID NO: 1276973 - DNA, 21 bp, Homo sapiens
taaaagttgtgattccagata

SEQ ID NO: 1276974 - DNA, 23 bp, Homo sapiens
taaaagtttgggtgtattttctt

SEQ ID NO: 1276975 - DNA, 15 bp, Homo sapiens
taaaagttttctaat

SEQ ID NO: 1276976 - DNA, 22 bp, Homo sapiens
taaaagttttctaatttgcact

SEQ ID NO: 1276977 - DNA, 11 bp, Homo sapiens
taaaagttttg

SEQ ID NO: 1276978 - DNA, 16 bp, Homo sapiens
taaaataaaataaaat

SEQ ID NO: 1276979 - DNA, 15 bp, Homo sapiens
taaaataaaatgaaa

SEQ ID NO: 1276980 - DNA, 16 bp, Homo sapiens
taaaataaaatgaaaa

SEQ ID NO: 1276981 - DNA, 22 bp, Homo sapiens
taaaataaaatgaaaattgtat

SEQ ID NO: 1276982 - DNA, 17 bp, Homo sapiens
taaaataaaatgcctca

SEQ ID NO: 1276983 - DNA, 13 bp, Homo sapiens
taaaataaactag

SEQ ID NO: 1276984 - DNA, 13 bp, Homo sapiens
taaaataaacttc

SEQ ID NO: 1276985 - DNA, 14 bp, Homo sapiens
taaaataaacttct

SEQ ID NO: 1276986 - DNA, 16 bp, Homo sapiens
taaaataaacttctta

SEQ ID NO: 1276987 - DNA, 14 bp, Homo sapiens
taaaataaataatt

SEQ ID NO: 1276988 - DNA, 15 bp, Homo sapiens
taaaataaataattt

SEQ ID NO: 1276989 - DNA, 14 bp, Homo sapiens
taaaataaatatat

SEQ ID NO: 1276990 - DNA, 14 bp, Homo sapiens
taaaataaattagt

SEQ ID NO: 1276991 - DNA, 15 bp, Homo sapiens
taaaataaattccta

SEQ ID NO: 1276992 - DNA, 17 bp, Homo sapiens
taaaataactaaaatgt

SEQ ID NO: 1276993 - DNA, 24 bp, Homo sapiens
taaaataactagtgttgcttggac

SEQ ID NO: 1276994 - DNA, 15 bp, Homo sapiens
taaaataagaagggg

SEQ ID NO: 1276995 - DNA, 21 bp, Homo sapiens
taaaataagctttctcagaat

SEQ ID NO: 1276996 - DNA, 19 bp, Homo sapiens
taaaataaggataataatc

SEQ ID NO: 1276997 - DNA, 14 bp, Homo sapiens
taaaataagtctga

SEQ ID NO: 1276998 - DNA, 19 bp, Homo sapiens
taaaataattatataactg

SEQ ID NO: 1276999 - DNA, 20 bp, Homo sapiens
taaaataattatataactgt

SEQ ID NO: 1277000 - DNA, 18 bp, Homo sapiens
taaaataatttctctaca

SEQ ID NO: 1277001 - DNA, 13 bp, Homo sapiens
taaaataattttg

SEQ ID NO: 1277002 - DNA, 18 bp, Homo sapiens
taaaatacaagactgcca

SEQ ID NO: 1277003 - DNA, 22 bp, Homo sapiens
taaaatacgatcggtttcatat

SEQ ID NO: 1277004 - DNA, 18 bp, Homo sapiens
taaaatacggtacctggc

SEQ ID NO: 1277005 - DNA, 18 bp, Homo sapiens
taaaatactatgcagtat

SEQ ID NO: 1277006 - DNA, 23 bp, Homo sapiens
taaaatactctagcctgggccag

SEQ ID NO: 1277007 - DNA, 14 bp, Homo sapiens
taaaatacttttac

SEQ ID NO: 1277008 - DNA, 20 bp, Homo sapiens
taaaatacttttactctgcc

SEQ ID NO: 1277009 - DNA, 21 bp, Homo sapiens
taaaatacttttactctgcct

SEQ ID NO: 1277010 - DNA, 14 bp, Homo sapiens
taaaatagaataat

SEQ ID NO: 1277011 - DNA, 16 bp, Homo sapiens
taaaatagaataattc

SEQ ID NO: 1277012 - DNA, 19 bp, Homo sapiens
taaaatagaataattcttt

SEQ ID NO: 1277013 - DNA, 22 bp, Homo sapiens
taaaatagcaaaagaagaagtt

SEQ ID NO: 1277014 - DNA, 19 bp, Homo sapiens
taaaatagcatactgtgta

SEQ ID NO: 1277015 - DNA, 20 bp, Homo sapiens
taaaatagcatactgtgtat

SEQ ID NO: 1277016 - DNA, 19 bp, Homo sapiens
taaaatagcgttcttgtaa

SEQ ID NO: 1277017 - DNA, 16 bp, Homo sapiens
taaaataggcatatta

SEQ ID NO: 1277018 - DNA, 18 bp, Homo sapiens
taaaatataaaactgaaa

SEQ ID NO: 1277019 - DNA, 18 bp, Homo sapiens
taaaatatagctgtacaa

SEQ ID NO: 1277020 - DNA, 19 bp, Homo sapiens
taaaatatagctgtacaaa

SEQ ID NO: 1277021 - DNA, 16 bp, Homo sapiens
taaaatatatctggaa

SEQ ID NO: 1277022 - DNA, 13 bp, Homo sapiens
taaaatatatgta

SEQ ID NO: 1277023 - DNA, 14 bp, Homo sapiens
taaaatatatgtct

SEQ ID NO: 1277024 - DNA, 15 bp, Homo sapiens
taaaatatatgttct

SEQ ID NO: 1277025 - DNA, 16 bp, Homo sapiens
taaaatatatgttctg

SEQ ID NO: 1277026 - DNA, 17 bp, Homo sapiens
taaaatatcctgtaact

SEQ ID NO: 1277027 - DNA, 14 bp, Homo sapiens
taaaatatctccaa

SEQ ID NO: 1277028 - DNA, 18 bp, Homo sapiens
taaaatatggctataaat

SEQ ID NO: 1277029 - DNA, 17 bp, Homo sapiens
taaaatatgtgaagttt

SEQ ID NO: 1277030 - DNA, 19 bp, Homo sapiens
taaaatatgtgaagttttc

SEQ ID NO: 1277031 - DNA, 14 bp, Homo sapiens
taaaatattatttg

SEQ ID NO: 1277032 - DNA, 20 bp, Homo sapiens
taaaatattatttgatatct

SEQ ID NO: 1277033 - DNA, 16 bp, Homo sapiens
taaaatatttaacttt

SEQ ID NO: 1277034 - DNA, 17 bp, Homo sapiens
taaaatatttaactttt

SEQ ID NO: 1277035 - DNA, 19 bp, Homo sapiens
taaaatatttaactttttt

SEQ ID NO: 1277036 - DNA, 18 bp, Homo sapiens
taaaatatttgaatgaaa

SEQ ID NO: 1277037 - DNA, 22 bp, Homo sapiens
taaaatatttgaatgaaaacat

SEQ ID NO: 1277038 - DNA, 15 bp, Homo sapiens
taaaatcacgttaaa

SEQ ID NO: 1277039 - DNA, 10 bp, Homo sapiens
taaaatcact

SEQ ID NO: 1277040 - DNA, 20 bp, Homo sapiens
taaaatcactattgaaaaat

SEQ ID NO: 1277041 - DNA, 16 bp, Homo sapiens
taaaatcacttcagat

SEQ ID NO: 1277042 - DNA, 17 bp, Homo sapiens
taaaatcacttcagatc

SEQ ID NO: 1277043 - DNA, 14 bp, Homo sapiens
taaaatccacagct

SEQ ID NO: 1277044 - DNA, 14 bp, Homo sapiens
taaaatccatttta

SEQ ID NO: 1277045 - DNA, 15 bp, Homo sapiens
taaaatcctcaatcc

SEQ ID NO: 1277046 - DNA, 12 bp, Homo sapiens
taaaatctaaaa

SEQ ID NO: 1277047 - DNA, 17 bp, Homo sapiens
taaaatctcctaaatgc

SEQ ID NO: 1277048 - DNA, 19 bp, Homo sapiens
taaaatctcttgattataa

SEQ ID NO: 1277049 - DNA, 20 bp, Homo sapiens
taaaatctgagggaaatgtt

SEQ ID NO: 1277050 - DNA, 14 bp, Homo sapiens
taaaatctggaaat

SEQ ID NO: 1277051 - DNA, 14 bp, Homo sapiens
taaaatctgtcacg

SEQ ID NO: 1277052 - DNA, 13 bp, Homo sapiens
taaaatctgtgaa

SEQ ID NO: 1277053 - DNA, 16 bp, Homo sapiens
taaaatcttgaaaatg

SEQ ID NO: 1277054 - DNA, 15 bp, Homo sapiens
taaaatgaaaattgt

SEQ ID NO: 1277055 - DNA, 15 bp, Homo sapiens
taaaatgaaatgcta

SEQ ID NO: 1277056 - DNA, 17 bp, Homo sapiens
taaaatgaacatctctt

SEQ ID NO: 1277057 - DNA, 23 bp, Homo sapiens
taaaatgaacatctcttgaaacc

SEQ ID NO: 1277058 - DNA, 17 bp, Homo sapiens
taaaatgacaaagccat

SEQ ID NO: 1277059 - DNA, 23 bp, Homo sapiens
taaaatgacaaagccattctttt

SEQ ID NO: 1277060 - DNA, 16 bp, Homo sapiens
taaaatgattgtaaaa

SEQ ID NO: 1277061 - DNA, 14 bp, Homo sapiens
taaaatgattttat

SEQ ID NO: 1277062 - DNA, 16 bp, Homo sapiens
taaaatgcaaatgaat

SEQ ID NO: 1277063 - DNA, 17 bp, Homo sapiens
taaaatgcaaatgaatc

SEQ ID NO: 1277064 - DNA, 18 bp, Homo sapiens
taaaatgcaaatgaatca

SEQ ID NO: 1277065 - DNA, 22 bp, Homo sapiens
taaaatgcaaatgaatcattgt

SEQ ID NO: 1277066 - DNA, 18 bp, Homo sapiens
taaaatgcagattcatag

SEQ ID NO: 1277067 - DNA, 16 bp, Homo sapiens
taaaatgcattgaaag

SEQ ID NO: 1277068 - DNA, 18 bp, Homo sapiens
taaaatgcctcagctatg

SEQ ID NO: 1277069 - DNA, 20 bp, Homo sapiens
taaaatgcctcagctatgta

SEQ ID NO: 1277070 - DNA, 17 bp, Homo sapiens
taaaatgcgaaattatt

SEQ ID NO: 1277071 - DNA, 17 bp, Homo sapiens
taaaatgctcaatttca

SEQ ID NO: 1277072 - DNA, 21 bp, Homo sapiens
taaaatggacacaaattttca

SEQ ID NO: 1277073 - DNA, 18 bp, Homo sapiens
taaaatggatgccttgaa

SEQ ID NO: 1277074 - DNA, 17 bp, Homo sapiens
taaaatggcgaacatgt

SEQ ID NO: 1277075 - DNA, 18 bp, Homo sapiens
taaaatggtttgtcctga

SEQ ID NO: 1277076 - DNA, 21 bp, Homo sapiens
taaaatgtaagaaaagctgat

SEQ ID NO: 1277077 - DNA, 13 bp, Homo sapiens
taaaatgtataaa

SEQ ID NO: 1277078 - DNA, 17 bp, Homo sapiens
taaaatgtattcaagca

SEQ ID NO: 1277079 - DNA, 20 bp, Homo sapiens
taaaatgtcggatttatctt

SEQ ID NO: 1277080 - DNA, 15 bp, Homo sapiens
taaaatgtctttcca

SEQ ID NO: 1277081 - DNA, 18 bp, Homo sapiens
taaaatgtgatttttctg

SEQ ID NO: 1277082 - DNA, 17 bp, Homo sapiens
taaaatgtgtatttttc

SEQ ID NO: 1277083 - DNA, 21 bp, Homo sapiens
taaaatgtgtatttttcaagg

SEQ ID NO: 1277084 - DNA, 14 bp, Homo sapiens
taaaatgttgaaaa

SEQ ID NO: 1277085 - DNA, 18 bp, Homo sapiens
taaaatgttgaaaagtca

SEQ ID NO: 1277086 - DNA, 20 bp, Homo sapiens
taaagatggtcgtgtgtgtg

SEQ ID NO: 1277087 - DNA, 23 bp, Homo sapiens
taaagattctctttaaaaaagac

SEQ ID NO: 1277088 - DNA, 20 bp, Homo sapiens
taaagatttatacagttgaa

SEQ ID NO: 1277089 - DNA, 23 bp, Homo sapiens
taaagatttatacagttgaaaac

SEQ ID NO: 1277090 - DNA, 22 bp, Homo sapiens
taaagatttctagtaggcagca

SEQ ID NO: 1277091 - DNA, 23 bp, Homo sapiens
taaagcaaaatagtattgctgaa

SEQ ID NO: 1277092 - DNA, 15 bp, Homo sapiens
taaagcactttgcac

SEQ ID NO: 1277093 - DNA, 18 bp, Homo sapiens
taaagcagagccaaggcc

SEQ ID NO: 1277094 - DNA, 16 bp, Homo sapiens
taaagcagcgtttcta

SEQ ID NO: 1277095 - DNA, 17 bp, Homo sapiens
taaagcagcgtttctat

SEQ ID NO: 1277096 - DNA, 19 bp, Homo sapiens
taaagcagcgtttctatga

SEQ ID NO: 1277097 - DNA, 16 bp, Homo sapiens
taaagcaggttcttgt

SEQ ID NO: 1277098 - DNA, 13 bp, Homo sapiens
taaagcagtggac

SEQ ID NO: 1277099 - DNA, 22 bp, Homo sapiens
taaagcatgaatggtatggaac

SEQ ID NO: 1277100 - DNA, 15 bp, Homo sapiens
taaagcattctttaa

SEQ ID NO: 1277101 - DNA, 13 bp, Homo sapiens
taaagcatttaga

SEQ ID NO: 1277102 - DNA, 13 bp, Homo sapiens
taaagcatttata

SEQ ID NO: 1277103 - DNA, 11 bp, Homo sapiens
taaagccaagg

SEQ ID NO: 1277104 - DNA, 23 bp, Homo sapiens
taaagccacttctggcttcagcc

SEQ ID NO: 1277105 - DNA, 18 bp, Homo sapiens
taaagccatcatgccttg

SEQ ID NO: 1277106 - DNA, 15 bp, Homo sapiens
taaagccatgttaaa

SEQ ID NO: 1277107 - DNA, 16 bp, Homo sapiens
taaagcccccttctcc

SEQ ID NO: 1277108 - DNA, 20 bp, Homo sapiens
taaagccctgtgttaagtgt

SEQ ID NO: 1277109 - DNA, 11 bp, Homo sapiens
taaagcctcaa

SEQ ID NO: 1277110 - DNA, 14 bp, Homo sapiens
taaagcctggcttc

SEQ ID NO: 1277111 - DNA, 20 bp, Homo sapiens
taaagcctgtattctcaaac

SEQ ID NO: 1277112 - DNA, 19 bp, Homo sapiens
taaagcctttaaaaccagt

SEQ ID NO: 1277113 - DNA, 11 bp, Homo sapiens
taaagcctttt

SEQ ID NO: 1277114 - DNA, 21 bp, Homo sapiens
taaagcgtttgcacagatcaa

SEQ ID NO: 1277115 - DNA, 22 bp, Homo sapiens
taaagctaaaataaagaaatag

SEQ ID NO: 1277116 - DNA, 16 bp, Homo sapiens
taaagctatgttacat

SEQ ID NO: 1277117 - DNA, 15 bp, Homo sapiens
taaagctcaggaggg

SEQ ID NO: 1277118 - DNA, 12 bp, Homo sapiens
taaagctccctt

SEQ ID NO: 1277119 - DNA, 16 bp, Homo sapiens
taaagctcttcatttc

SEQ ID NO: 1277120 - DNA, 16 bp, Homo sapiens
taaagctgcctgtagt

SEQ ID NO: 1277121 - DNA, 17 bp, Homo sapiens
taaagctgcctgtagtt

SEQ ID NO: 1277122 - DNA, 21 bp, Homo sapiens
taaagctgcctgtagttagga

SEQ ID NO: 1277123 - DNA, 18 bp, Homo sapiens
taaagctgcttagaatct

SEQ ID NO: 1277124 - DNA, 17 bp, Homo sapiens
taaagcttaaactgaat

SEQ ID NO: 1277125 - DNA, 17 bp, Homo sapiens
taaagcttatttttatg

SEQ ID NO: 1277126 - DNA, 22 bp, Homo sapiens
taaagcttccctctcagctgct

SEQ ID NO: 1277127 - DNA, 23 bp, Homo sapiens
taaagcttgatttgatctttgtt

SEQ ID NO: 1277128 - DNA, 17 bp, Homo sapiens
taaagcttgtggcccct

SEQ ID NO: 1277129 - DNA, 15 bp, Homo sapiens
taaagctttatcttt

SEQ ID NO: 1277130 - DNA, 16 bp, Homo sapiens
taaagctttatctttg

SEQ ID NO: 1277131 - DNA, 22 bp, Homo sapiens
taaagcttttttttttttccca

SEQ ID NO: 1277132 - DNA, 14 bp, Homo sapiens
taaaggaaacacta

SEQ ID NO: 1277133 - DNA, 21 bp, Homo sapiens
taaaggaaacactaaggctgc

SEQ ID NO: 1277134 - DNA, 19 bp, Homo sapiens
taaaggaaaggccctgcac

SEQ ID NO: 1277135 - DNA, 14 bp, Homo sapiens
taaaggaaggaaaa

SEQ ID NO: 1277136 - DNA, 18 bp, Homo sapiens
taaaggaatgtgaaattt

SEQ ID NO: 1277137 - DNA, 19 bp, Homo sapiens
taaaggaatgtgaaattta

SEQ ID NO: 1277138 - DNA, 18 bp, Homo sapiens
taaaggaccctgtttctg

SEQ ID NO: 1277139 - DNA, 19 bp, Homo sapiens
taaaggaccctgtttctgt

SEQ ID NO: 1277140 - DNA, 20 bp, Homo sapiens
taaaggaccctgtttctgta

SEQ ID NO: 1277141 - DNA, 24 bp, Homo sapiens
taaaggaccctgtttctgtagaaa

SEQ ID NO: 1277142 - DNA, 12 bp, Homo sapiens
taaaggactgta

SEQ ID NO: 1277143 - DNA, 22 bp, Homo sapiens
taaaggagaaggcatgaaattg

SEQ ID NO: 1277144 - DNA, 16 bp, Homo sapiens
taaaggagttaagagt

SEQ ID NO: 1277145 - DNA, 19 bp, Homo sapiens
taaaggatggaaaaataaa

SEQ ID NO: 1277146 - DNA, 17 bp, Homo sapiens
taaaggatgttggtgtt

SEQ ID NO: 1277147 - DNA, 21 bp, Homo sapiens
taaaggcaatggtttgtgtca

SEQ ID NO: 1277148 - DNA, 11 bp, Homo sapiens
taaaggcagct

SEQ ID NO: 1277149 - DNA, 21 bp, Homo sapiens
taaaggcagctgcctctgctc

SEQ ID NO: 1277150 - DNA, 22 bp, Homo sapiens
taaaggcagctgcctctgctcc

SEQ ID NO: 1277151 - DNA, 15 bp, Homo sapiens
taaaggcagtccaga

SEQ ID NO: 1277152 - DNA, 15 bp, Homo sapiens
taaaggcccagcccc

SEQ ID NO: 1277153 - DNA, 17 bp, Homo sapiens
taaaggcccagccccta

SEQ ID NO: 1277154 - DNA, 22 bp, Homo sapiens
taaaggcctttaataagtcatt

SEQ ID NO: 1277155 - DNA, 19 bp, Homo sapiens
taaaggctcgattttgtat

SEQ ID NO: 1277156 - DNA, 17 bp, Homo sapiens
taaagggaccatctgct

SEQ ID NO: 1277157 - DNA, 19 bp, Homo sapiens
taaagggaccatctgctgc

SEQ ID NO: 1277158 - DNA, 17 bp, Homo sapiens
taaagggagaaatgcca

SEQ ID NO: 1277159 - DNA, 13 bp, Homo sapiens
taaagggcagggc

SEQ ID NO: 1277160 - DNA, 18 bp, Homo sapiens
taaaggggagaaactgaa

SEQ ID NO: 1277161 - DNA, 22 bp, Homo sapiens
taaaggggagaaactgaaagtg

SEQ ID NO: 1277162 - DNA, 14 bp, Homo sapiens
taaaggggggaggg

SEQ ID NO: 1277163 - DNA, 19 bp, Homo sapiens
taaagggtgcccatttgtg

SEQ ID NO: 1277164 - DNA, 20 bp, Homo sapiens
taaagggtgcccatttgtga

SEQ ID NO: 1277165 - DNA, 13 bp, Homo sapiens
taaaggtaaaatc

SEQ ID NO: 1277166 - DNA, 14 bp, Homo sapiens
taaaggtaaaatca

SEQ ID NO: 1277167 - DNA, 18 bp, Homo sapiens
taaaggtaaaatcacttc

SEQ ID NO: 1277168 - DNA, 21 bp, Homo sapiens
taaaggtaaaatcacttcaga

SEQ ID NO: 1277169 - DNA, 22 bp, Homo sapiens
taaaggtacactggtatttata

SEQ ID NO: 1277170 - DNA, 21 bp, Homo sapiens
taaaggtaccaaacaaggaag

SEQ ID NO: 1277171 - DNA, 22 bp, Homo sapiens
taaaggtaccaaacaaggaagc

SEQ ID NO: 1277172 - DNA, 21 bp, Homo sapiens
taaaggtacgattatacttga

SEQ ID NO: 1277173 - DNA, 23 bp, Homo sapiens
taaaggtacgattatacttgaga

SEQ ID NO: 1277174 - DNA, 14 bp, Homo sapiens
taaaggtctgcact

SEQ ID NO: 1277175 - DNA, 14 bp, Homo sapiens
taaaggtgtattta

SEQ ID NO: 1277176 - DNA, 20 bp, Homo sapiens
taaaggttgacaataaatgt

SEQ ID NO: 1277177 - DNA, 17 bp, Homo sapiens
taaaggttggaatcttt

SEQ ID NO: 1277178 - DNA, 17 bp, Homo sapiens
taaaggtttttaaattg

SEQ ID NO: 1277179 - DNA, 17 bp, Homo sapiens
taaagtaaagctaaaat

SEQ ID NO: 1277180 - DNA, 19 bp, Homo sapiens
taaagtaataatgtgcaaa

SEQ ID NO: 1277181 - DNA, 16 bp, Homo sapiens
taaagtaatgatgaaa

SEQ ID NO: 1277182 - DNA, 22 bp, Homo sapiens
taaagtaatgatgaaatctttc

SEQ ID NO: 1277183 - DNA, 13 bp, Homo sapiens
taaagtaattcat

SEQ ID NO: 1277184 - DNA, 12 bp, Homo sapiens
taaagtacaaat

SEQ ID NO: 1277185 - DNA, 15 bp, Homo sapiens
taaagtacaaatgaa

SEQ ID NO: 1277186 - DNA, 18 bp, Homo sapiens
taaagtacaaatgaagaa

SEQ ID NO: 1277187 - DNA, 22 bp, Homo sapiens
taaagtacaaatgaagaaagtc

SEQ ID NO: 1277188 - DNA, 16 bp, Homo sapiens
taaagtacctgtagtg

SEQ ID NO: 1277189 - DNA, 21 bp, Homo sapiens
taaagtacctgtagtgagaaa

SEQ ID NO: 1277190 - DNA, 22 bp, Homo sapiens
taaagtacctgtagtgagaaac

SEQ ID NO: 1277191 - DNA, 17 bp, Homo sapiens
taaagtagtcctgtgaa

SEQ ID NO: 1277192 - DNA, 13 bp, Homo sapiens
taaagtataatgt

SEQ ID NO: 1277193 - DNA, 16 bp, Homo sapiens
taaagtatagaaatat

SEQ ID NO: 1277194 - DNA, 14 bp, Homo sapiens
taaagtatcatgca

SEQ ID NO: 1277195 - DNA, 17 bp, Homo sapiens
taaagtatcatgcattc

SEQ ID NO: 1277196 - DNA, 21 bp, Homo sapiens
taaagtatgcattattaaatt

SEQ ID NO: 1277197 - DNA, 13 bp, Homo sapiens
taaagtatgtaaa

SEQ ID NO: 1277198 - DNA, 22 bp, Homo sapiens
taaagtattcaacaatttcaat

SEQ ID NO: 1277199 - DNA, 14 bp, Homo sapiens
taaagtattccacc

SEQ ID NO: 1277200 - DNA, 21 bp, Homo sapiens
taaagtattccaccttaaatt

SEQ ID NO: 1277201 - DNA, 23 bp, Homo sapiens
taaagtattccaccttaaattaa

SEQ ID NO: 1277202 - DNA, 14 bp, Homo sapiens
taaagtattcttct

SEQ ID NO: 1277203 - DNA, 13 bp, Homo sapiens
taaagtattcttt

SEQ ID NO: 1277204 - DNA, 21 bp, Homo sapiens
taaagtatttataaaaatata

SEQ ID NO: 1277205 - DNA, 16 bp, Homo sapiens
taaagtcacttccagt

SEQ ID NO: 1277206 - DNA, 18 bp, Homo sapiens
taaagtcacttccagtgt

SEQ ID NO: 1277207 - DNA, 21 bp, Homo sapiens
taaatggtttctgaaaatgtt

SEQ ID NO: 1277208 - DNA, 17 bp, Homo sapiens
taaatgtaaaatttgga

SEQ ID NO: 1277209 - DNA, 18 bp, Homo sapiens
taaatgtacagacatatt

SEQ ID NO: 1277210 - DNA, 23 bp, Homo sapiens
taaatgtagcttcagtcattaaa

SEQ ID NO: 1277211 - DNA, 13 bp, Homo sapiens
taaatgtatacta

SEQ ID NO: 1277212 - DNA, 20 bp, Homo sapiens
taaatgtatcatttttgtgc

SEQ ID NO: 1277213 - DNA, 19 bp, Homo sapiens
taaatgtatttaattaaat

SEQ ID NO: 1277214 - DNA, 14 bp, Homo sapiens
taaatgtcactgcc

SEQ ID NO: 1277215 - DNA, 10 bp, Homo sapiens
taaatgtgaa

SEQ ID NO: 1277216 - DNA, 22 bp, Homo sapiens
taaatgtgcaatagaaggtgat

SEQ ID NO: 1277217 - DNA, 18 bp, Homo sapiens
taaatgtggattttgtag

SEQ ID NO: 1277218 - DNA, 20 bp, Homo sapiens
taaatgtggattttgtagat

SEQ ID NO: 1277219 - DNA, 22 bp, Homo sapiens
taaatgtgttagcactgatagt

SEQ ID NO: 1277220 - DNA, 13 bp, Homo sapiens
taaatgtgttcct

SEQ ID NO: 1277221 - DNA, 13 bp, Homo sapiens
taaatgttattat

SEQ ID NO: 1277222 - DNA, 22 bp, Homo sapiens
taaatgttattattcttgagtt

SEQ ID NO: 1277223 - DNA, 18 bp, Homo sapiens
taaatgttctaacagatc

SEQ ID NO: 1277224 - DNA, 12 bp, Homo sapiens
taaatgtttaaa

SEQ ID NO: 1277225 - DNA, 12 bp, Homo sapiens
taaatgtttctt

SEQ ID NO: 1277226 - DNA, 12 bp, Homo sapiens
taaatgtttgga

SEQ ID NO: 1277227 - DNA, 20 bp, Homo sapiens
taaatgttttgccagccact

SEQ ID NO: 1277228 - DNA, 13 bp, Homo sapiens
taaattaaacaat

SEQ ID NO: 1277229 - DNA, 15 bp, Homo sapiens
taaattaaacatttt

SEQ ID NO: 1277230 - DNA, 15 bp, Homo sapiens
taaattaaataaaat

SEQ ID NO: 1277231 - DNA, 15 bp, Homo sapiens
taaattaaataaact

SEQ ID NO: 1277232 - DNA, 17 bp, Homo sapiens
taaattaacttttataa

SEQ ID NO: 1277233 - DNA, 19 bp, Homo sapiens
taaattaacttttataaac

SEQ ID NO: 1277234 - DNA, 19 bp, Homo sapiens
taaattaatacttcatttg

SEQ ID NO: 1277235 - DNA, 11 bp, Homo sapiens
taaattaatat

SEQ ID NO: 1277236 - DNA, 17 bp, Homo sapiens
taaattaatatctttct

SEQ ID NO: 1277237 - DNA, 23 bp, Homo sapiens
taaattacaattttatctgtttc

SEQ ID NO: 1277238 - DNA, 19 bp, Homo sapiens
taaattacacaataaagca

SEQ ID NO: 1277239 - DNA, 20 bp, Homo sapiens
taaattacacaataaagcag

SEQ ID NO: 1277240 - DNA, 13 bp, Homo sapiens
taaattacatttt

SEQ ID NO: 1277241 - DNA, 17 bp, Homo sapiens
taaattactatagcaaa

SEQ ID NO: 1277242 - DNA, 21 bp, Homo sapiens
taaattactatctgttgaaaa

SEQ ID NO: 1277243 - DNA, 12 bp, Homo sapiens
taaattactgtt

SEQ ID NO: 1277244 - DNA, 14 bp, Homo sapiens
taaattactgtttt

SEQ ID NO: 1277245 - DNA, 12 bp, Homo sapiens
taaattagaaaa

SEQ ID NO: 1277246 - DNA, 16 bp, Homo sapiens
taaattagaaaatatt

SEQ ID NO: 1277247 - DNA, 18 bp, Homo sapiens
taaattagaaaatattct

SEQ ID NO: 1277248 - DNA, 22 bp, Homo sapiens
taaattaggaataaataaaaat

SEQ ID NO: 1277249 - DNA, 22 bp, Homo sapiens
taaattataacttaaaatattt

SEQ ID NO: 1277250 - DNA, 16 bp, Homo sapiens
taaattatactggaga

SEQ ID NO: 1277251 - DNA, 14 bp, Homo sapiens
taaattatggcatt

SEQ ID NO: 1277252 - DNA, 21 bp, Homo sapiens
taaattatgtgaccataatgt

SEQ ID NO: 1277253 - DNA, 14 bp, Homo sapiens
taaattattaagca

SEQ ID NO: 1277254 - DNA, 12 bp, Homo sapiens
taaattattcag

SEQ ID NO: 1277255 - DNA, 18 bp, Homo sapiens
taaattattgtaaacttt

SEQ ID NO: 1277256 - DNA, 10 bp, Homo sapiens
taaattattt

SEQ ID NO: 1277257 - DNA, 20 bp, Homo sapiens
taaattatttgattatttaa

SEQ ID NO: 1277258 - DNA, 23 bp, Homo sapiens
taaattatttgattatttaagac

SEQ ID NO: 1277259 - DNA, 13 bp, Homo sapiens
taaattattttat

SEQ ID NO: 1277260 - DNA, 22 bp, Homo sapiens
taaattattttatatcatacag

SEQ ID NO: 1277261 - DNA, 15 bp, Homo sapiens
taaattcaaagaagt

SEQ ID NO: 1277262 - DNA, 23 bp, Homo sapiens
taaattcagatatatttttcaca

SEQ ID NO: 1277263 - DNA, 15 bp, Homo sapiens
taaattcagatcaaa

SEQ ID NO: 1277264 - DNA, 15 bp, Homo sapiens
taaattcatttctag

SEQ ID NO: 1277265 - DNA, 21 bp, Homo sapiens
taaattcatttctagactcaa

SEQ ID NO: 1277266 - DNA, 17 bp, Homo sapiens
taaattccactgaaaat

SEQ ID NO: 1277267 - DNA, 14 bp, Homo sapiens
taaattccactgga

SEQ ID NO: 1277268 - DNA, 17 bp, Homo sapiens
taaattcccaacttctc

SEQ ID NO: 1277269 - DNA, 18 bp, Homo sapiens
taaattcccgttttgtca

SEQ ID NO: 1277270 - DNA, 16 bp, Homo sapiens
taaattcctctttgct

SEQ ID NO: 1277271 - DNA, 19 bp, Homo sapiens
taaattctacctccttgtg

SEQ ID NO: 1277272 - DNA, 20 bp, Homo sapiens
taaattctagtgtccataaa

SEQ ID NO: 1277273 - DNA, 20 bp, Homo sapiens
taaattctatgttaaatact

SEQ ID NO: 1277274 - DNA, 21 bp, Homo sapiens
taaattctatgttaaatactg

SEQ ID NO: 1277275 - DNA, 14 bp, Homo sapiens
taaattctggtata

SEQ ID NO: 1277276 - DNA, 17 bp, Homo sapiens
taaattctggtatacat

SEQ ID NO: 1277277 - DNA, 13 bp, Homo sapiens
taaattgatttgt

SEQ ID NO: 1277278 - DNA, 21 bp, Homo sapiens
taaattgatttttataaatac

SEQ ID NO: 1277279 - DNA, 16 bp, Homo sapiens
taaattgcaacatatt

SEQ ID NO: 1277280 - DNA, 19 bp, Homo sapiens
taaattgcctgatttgttt

SEQ ID NO: 1277281 - DNA, 16 bp, Homo sapiens
taaattgctaatgttg

SEQ ID NO: 1277282 - DNA, 21 bp, Homo sapiens
taaattggcatggaaatttaa

SEQ ID NO: 1277283 - DNA, 16 bp, Homo sapiens
taaattggtcatggta

SEQ ID NO: 1277284 - DNA, 13 bp, Homo sapiens
taaattgtacatt

SEQ ID NO: 1277285 - DNA, 21 bp, Homo sapiens
taaattgtcagatcgttcatt

SEQ ID NO: 1277286 - DNA, 23 bp, Homo sapiens
taaattgtctttaaaaactgttt

SEQ ID NO: 1277287 - DNA, 14 bp, Homo sapiens
taaattgtttcata

SEQ ID NO: 1277288 - DNA, 15 bp, Homo sapiens
taaatttaactttaa

SEQ ID NO: 1277289 - DNA, 23 bp, Homo sapiens
taaatttaagaaaacaagtatat

SEQ ID NO: 1277290 - DNA, 13 bp, Homo sapiens
taaatttaagcaa

SEQ ID NO: 1277291 - DNA, 14 bp, Homo sapiens
taaatttaatgctg

SEQ ID NO: 1277292 - DNA, 14 bp, Homo sapiens
taaatttagtgttt

SEQ ID NO: 1277293 - DNA, 18 bp, Homo sapiens
taaatttatatacttttt

SEQ ID NO: 1277294 - DNA, 14 bp, Homo sapiens
taaatttatttact

SEQ ID NO: 1277295 - DNA, 17 bp, Homo sapiens
taaatttcaaatgcaga

SEQ ID NO: 1277296 - DNA, 11 bp, Homo sapiens
taaatttcagt

SEQ ID NO: 1277297 - DNA, 22 bp, Homo sapiens
taaatttcccagttaaagatta

SEQ ID NO: 1277298 - DNA, 14 bp, Homo sapiens
taaatttctgggat

SEQ ID NO: 1277299 - DNA, 21 bp, Homo sapiens
taaatttctgggatatttaac

SEQ ID NO: 1277300 - DNA, 16 bp, Homo sapiens
taaatttcttatgtga

SEQ ID NO: 1277301 - DNA, 19 bp, Homo sapiens
taaatttcttggcaaattt

SEQ ID NO: 1277302 - DNA, 19 bp, Homo sapiens
taaatttgacttttctgta

SEQ ID NO: 1277303 - DNA, 14 bp, Homo sapiens
taaatttgatttcc

SEQ ID NO: 1277304 - DNA, 13 bp, Homo sapiens
taaatttgctagc

SEQ ID NO: 1277305 - DNA, 11 bp, Homo sapiens
taaatttggtg

SEQ ID NO: 1277306 - DNA, 13 bp, Homo sapiens
taaatttgttgaa

SEQ ID NO: 1277307 - DNA, 19 bp, Homo sapiens
taaattttattaaacaatt

SEQ ID NO: 1277308 - DNA, 17 bp, Homo sapiens
taaattttcaaatcctt

SEQ ID NO: 1277309 - DNA, 18 bp, Homo sapiens
taaattttcatgaatgtg

SEQ ID NO: 1277310 - DNA, 21 bp, Homo sapiens
taaattttcatgaatgtgctg

SEQ ID NO: 1277311 - DNA, 15 bp, Homo sapiens
taaattttctgaaac

SEQ ID NO: 1277312 - DNA, 15 bp, Homo sapiens
taaattttgtaatga

SEQ ID NO: 1277313 - DNA, 20 bp, Homo sapiens
taaatttttagccatttctc

SEQ ID NO: 1277314 - DNA, 12 bp, Homo sapiens
taaatttttgaa

SEQ ID NO: 1277315 - DNA, 13 bp, Homo sapiens
taaatttttgaaa

SEQ ID NO: 1277316 - DNA, 15 bp, Homo sapiens
taaatttttgaaaaa

SEQ ID NO: 1277317 - DNA, 16 bp, Homo sapiens
taaatttttgaaaaat

SEQ ID NO: 1277318 - DNA, 17 bp, Homo sapiens
taaatttttgaaaaata

SEQ ID NO: 1277319 - DNA, 20 bp, Homo sapiens
taaattttttgttgacatta

SEQ ID NO: 1277320 - DNA, 19 bp, Homo sapiens
taaattttttttgtttcat

SEQ ID NO: 1277321 - DNA, 14 bp, Homo sapiens
taacaaaaaatgta

SEQ ID NO: 1277322 - DNA, 16 bp, Homo sapiens
taacaaaaaatgtaat

SEQ ID NO: 1277323 - DNA, 13 bp, Homo sapiens
taacaaaaataaa

SEQ ID NO: 1277324 - DNA, 14 bp, Homo sapiens
taacaaaatgagat

SEQ ID NO: 1277325 - DNA, 20 bp, Homo sapiens
taacaaaccaacatctttgc

SEQ ID NO: 1277326 - DNA, 13 bp, Homo sapiens
taacaaagacaaa

SEQ ID NO: 1277327 - DNA, 14 bp, Homo sapiens
taacaaagcacata

SEQ ID NO: 1277328 - DNA, 21 bp, Homo sapiens
taacaaagcacataactggat

SEQ ID NO: 1277329 - DNA, 19 bp, Homo sapiens
taacaaaggaatgagaata

SEQ ID NO: 1277330 - DNA, 15 bp, Homo sapiens
taacttttataaact

SEQ ID NO: 1277331 - DNA, 20 bp, Homo sapiens
taacttttcaatgacatttt

SEQ ID NO: 1277332 - DNA, 12 bp, Homo sapiens
taacttttcctt

SEQ ID NO: 1277333 - DNA, 22 bp, Homo sapiens
taacttttccttgtatgttctt

SEQ ID NO: 1277334 - DNA, 17 bp, Homo sapiens
taacttttgatgacttc

SEQ ID NO: 1277335 - DNA, 13 bp, Homo sapiens
taacttttgtaag

SEQ ID NO: 1277336 - DNA, 22 bp, Homo sapiens
taacttttttgtggcaattagt

SEQ ID NO: 1277337 - DNA, 16 bp, Homo sapiens
taacttttttgtgtat

SEQ ID NO: 1277338 - DNA, 18 bp, Homo sapiens
taacttttttgtgtatgt

SEQ ID NO: 1277339 - DNA, 19 bp, Homo sapiens
taacttttttgtgtatgta

SEQ ID NO: 1277340 - DNA, 21 bp, Homo sapiens
taactttttttcttctacttt

SEQ ID NO: 1277341 - DNA, 19 bp, Homo sapiens
taactttttttgagaagga

SEQ ID NO: 1277342 - DNA, 20 bp, Homo sapiens
taacttttttttttttaaca

SEQ ID NO: 1277343 - DNA, 23 bp, Homo sapiens
taacttttttttttttaacatct

SEQ ID NO: 1277344 - DNA, 16 bp, Homo sapiens
taagaaaaaaagcaca

SEQ ID NO: 1277345 - DNA, 13 bp, Homo sapiens
taagaaaaacaaa

SEQ ID NO: 1277346 - DNA, 15 bp, Homo sapiens
taagaaaaacttttt

SEQ ID NO: 1277347 - DNA, 18 bp, Homo sapiens
taagaaaaaggatgcaca

SEQ ID NO: 1277348 - DNA, 19 bp, Homo sapiens
taagaaaaaggatgcacag

SEQ ID NO: 1277349 - DNA, 16 bp, Homo sapiens
taagaaaaatcatgtt

SEQ ID NO: 1277350 - DNA, 19 bp, Homo sapiens
taagaaaaatgaaaacttt

SEQ ID NO: 1277351 - DNA, 14 bp, Homo sapiens
taagaaaacaagta

SEQ ID NO: 1277352 - DNA, 12 bp, Homo sapiens
taagaaaagatt

SEQ ID NO: 1277353 - DNA, 17 bp, Homo sapiens
taagaaaatacaataaa

SEQ ID NO: 1277354 - DNA, 17 bp, Homo sapiens
taagaaaatattttgtc

SEQ ID NO: 1277355 - DNA, 21 bp, Homo sapiens
taagaaaatattttgtctaaa

SEQ ID NO: 1277356 - DNA, 21 bp, Homo sapiens
taagaaaatgtaaaggttttt

SEQ ID NO: 1277357 - DNA, 23 bp, Homo sapiens
taagaaaatgttacggcatcaca

SEQ ID NO: 1277358 - DNA, 19 bp, Homo sapiens
taagaaacatgatgtgaga

SEQ ID NO: 1277359 - DNA, 13 bp, Homo sapiens
taagaaacttttt

SEQ ID NO: 1277360 - DNA, 24 bp, Homo sapiens
taagaaagactatctaaatgttga

SEQ ID NO: 1277361 - DNA, 21 bp, Homo sapiens
taagaaagagaatgaactgtg

SEQ ID NO: 1277362 - DNA, 20 bp, Homo sapiens
taagaaagccaccttgttac

SEQ ID NO: 1277363 - DNA, 18 bp, Homo sapiens
taagaaaggaagcattgt

SEQ ID NO: 1277364 - DNA, 22 bp, Homo sapiens
taagaaaggaagcattgtaaaa

SEQ ID NO: 1277365 - DNA, 18 bp, Homo sapiens
taagaaagtgaagcaaat

SEQ ID NO: 1277366 - DNA, 15 bp, Homo sapiens
taagaaataatgcct

SEQ ID NO: 1277367 - DNA, 13 bp, Homo sapiens
taagaaatagaat

SEQ ID NO: 1277368 - DNA, 18 bp, Homo sapiens
taagaaatatctgtgaaa

SEQ ID NO: 1277369 - DNA, 15 bp, Homo sapiens
taagaaatcaagtaa

SEQ ID NO: 1277370 - DNA, 24 bp, Homo sapiens
taagaaatctagtatttcatgctg

SEQ ID NO: 1277371 - DNA, 17 bp, Homo sapiens
taagaaatgaacaaaag

SEQ ID NO: 1277372 - DNA, 13 bp, Homo sapiens
taagaaattgttt

SEQ ID NO: 1277373 - DNA, 17 bp, Homo sapiens
taagaacccctctgctt

SEQ ID NO: 1277374 - DNA, 22 bp, Homo sapiens
taagaactgcttcatgtgaaca

SEQ ID NO: 1277375 - DNA, 14 bp, Homo sapiens
taagaactgtacat

SEQ ID NO: 1277376 - DNA, 15 bp, Homo sapiens
taagaactgtacatt

SEQ ID NO: 1277377 - DNA, 17 bp, Homo sapiens
taagaacttcattttta

SEQ ID NO: 1277378 - DNA, 21 bp, Homo sapiens
taagaagaaaattgctgtgcc

SEQ ID NO: 1277379 - DNA, 13 bp, Homo sapiens
taagaagaaacta

SEQ ID NO: 1277380 - DNA, 21 bp, Homo sapiens
taagaagaatgcttaatcaga

SEQ ID NO: 1277381 - DNA, 12 bp, Homo sapiens
taagaagacatt

SEQ ID NO: 1277382 - DNA, 13 bp, Homo sapiens
taagaagacattt

SEQ ID NO: 1277383 - DNA, 12 bp, Homo sapiens
taagaagagact

SEQ ID NO: 1277384 - DNA, 15 bp, Homo sapiens
taagaagattcaaga

SEQ ID NO: 1277385 - DNA, 16 bp, Homo sapiens
taagaagcaatctttg

SEQ ID NO: 1277386 - DNA, 21 bp, Homo sapiens
taagaagcaatctttgaaata

SEQ ID NO: 1277387 - DNA, 17 bp, Homo sapiens
taagaaggcaaaaatgt

SEQ ID NO: 1277388 - DNA, 15 bp, Homo sapiens
taagaaggcaatatt

SEQ ID NO: 1277389 - DNA, 20 bp, Homo sapiens
taagaaggcaatattaacct

SEQ ID NO: 1277390 - DNA, 16 bp, Homo sapiens
taagaagttagaaggc

SEQ ID NO: 1277391 - DNA, 23 bp, Homo sapiens
taagaagttattttcttgtttaa

SEQ ID NO: 1277392 - DNA, 18 bp, Homo sapiens
taagaagttgaactatga

SEQ ID NO: 1277393 - DNA, 17 bp, Homo sapiens
taagaagtttgtgtctt

SEQ ID NO: 1277394 - DNA, 17 bp, Homo sapiens
taagaataaaatgttga

SEQ ID NO: 1277395 - DNA, 19 bp, Homo sapiens
taagaataaaatgttgaaa

SEQ ID NO: 1277396 - DNA, 21 bp, Homo sapiens
taagaataaaatgttgaaaag

SEQ ID NO: 1277397 - DNA, 13 bp, Homo sapiens
taagaataataaa

SEQ ID NO: 1277398 - DNA, 17 bp, Homo sapiens
taagaataataaaatca

SEQ ID NO: 1277399 - DNA, 19 bp, Homo sapiens
taagaatagttctaaaatt

SEQ ID NO: 1277400 - DNA, 17 bp, Homo sapiens
taagaatgaagttctgc

SEQ ID NO: 1277401 - DNA, 22 bp, Homo sapiens
taagaatgcagattcctgggcc

SEQ ID NO: 1277402 - DNA, 13 bp, Homo sapiens
taagaatggccaa

SEQ ID NO: 1277403 - DNA, 21 bp, Homo sapiens
taagaattagacatcttcaga

SEQ ID NO: 1277404 - DNA, 16 bp, Homo sapiens
taagaattcagacatc

SEQ ID NO: 1277405 - DNA, 19 bp, Homo sapiens
taagaattgaccatctgct

SEQ ID NO: 1277406 - DNA, 22 bp, Homo sapiens
taagaattgaccatctgctttt

SEQ ID NO: 1277407 - DNA, 20 bp, Homo sapiens
taagaattgagtaatggtgt

SEQ ID NO: 1277408 - DNA, 22 bp, Homo sapiens
taagaattgagtaatggtgtag

SEQ ID NO: 1277409 - DNA, 16 bp, Homo sapiens
taagaatttagggaga

SEQ ID NO: 1277410 - DNA, 20 bp, Homo sapiens
taagaatttgaggtctacat

SEQ ID NO: 1277411 - DNA, 14 bp, Homo sapiens
taagaatttgcata

SEQ ID NO: 1277412 - DNA, 14 bp, Homo sapiens
taagaattttgctt

SEQ ID NO: 1277413 - DNA, 18 bp, Homo sapiens
taagacaaaaagccttga

SEQ ID NO: 1277414 - DNA, 19 bp, Homo sapiens
taagacaaatattcctttg

SEQ ID NO: 1277415 - DNA, 19 bp, Homo sapiens
taagacagagtcttgctct

SEQ ID NO: 1277416 - DNA, 11 bp, Homo sapiens
taagacagcat

SEQ ID NO: 1277417 - DNA, 19 bp, Homo sapiens
taagacagggtctcattct

SEQ ID NO: 1277418 - DNA, 11 bp, Homo sapiens
taagacagtgt

SEQ ID NO: 1277419 - DNA, 13 bp, Homo sapiens
taagacagtgtac

SEQ ID NO: 1277420 - DNA, 18 bp, Homo sapiens
taagacagtgtacaaaac

SEQ ID NO: 1277421 - DNA, 21 bp, Homo sapiens
taagacagtgtacaaaactgt

SEQ ID NO: 1277422 - DNA, 13 bp, Homo sapiens
taagacagttttt

SEQ ID NO: 1277423 - DNA, 17 bp, Homo sapiens
taagacatgatttcctt

SEQ ID NO: 1277424 - DNA, 20 bp, Homo sapiens
taagacatgcttacttttta

SEQ ID NO: 1277425 - DNA, 20 bp, Homo sapiens
taagacatgtgaggaggaaa

SEQ ID NO: 1277426 - DNA, 21 bp, Homo sapiens
taagacatgtgaggaggaaaa

SEQ ID NO: 1277427 - DNA, 19 bp, Homo sapiens
taagacatttgtttgctgt

SEQ ID NO: 1277428 - DNA, 19 bp, Homo sapiens
taagaccgtgtcccaagga

SEQ ID NO: 1277429 - DNA, 19 bp, Homo sapiens
taagacgtatgtaacatga

SEQ ID NO: 1277430 - DNA, 14 bp, Homo sapiens
taagacgttggaag

SEQ ID NO: 1277431 - DNA, 18 bp, Homo sapiens
taagactcattccctaga

SEQ ID NO: 1277432 - DNA, 14 bp, Homo sapiens
taagactgaatgtt

SEQ ID NO: 1277433 - DNA, 19 bp, Homo sapiens
taagactgaatgttttatt

SEQ ID NO: 1277434 - DNA, 20 bp, Homo sapiens
taagactgaatgttttattt

SEQ ID NO: 1277435 - DNA, 16 bp, Homo sapiens
taagacttaatgagac

SEQ ID NO: 1277436 - DNA, 15 bp, Homo sapiens
taagactttgggata

SEQ ID NO: 1277437 - DNA, 20 bp, Homo sapiens
taagagaagtagaaatcata

SEQ ID NO: 1277438 - DNA, 18 bp, Homo sapiens
taagagaagtctcattcg

SEQ ID NO: 1277439 - DNA, 21 bp, Homo sapiens
taagagaattatatatttcta

SEQ ID NO: 1277440 - DNA, 16 bp, Homo sapiens
taagagagatgagaaa

SEQ ID NO: 1277441 - DNA, 22 bp, Homo sapiens
taagagattggatcaagtatta

SEQ ID NO: 1277442 - DNA, 19 bp, Homo sapiens
taagagcaccttcctcact

SEQ ID NO: 1277443 - DNA, 20 bp, Homo sapiens
taagagcaccttcctcactt

SEQ ID NO: 1277444 - DNA, 14 bp, Homo sapiens
taagagcagtcaca

SEQ ID NO: 1277445 - DNA, 15 bp, Homo sapiens
taagagcatgatttg

SEQ ID NO: 1277446 - DNA, 22 bp, Homo sapiens
taagagccatttaggggccact

SEQ ID NO: 1277447 - DNA, 16 bp, Homo sapiens
taagagctagcgctgc

SEQ ID NO: 1277448 - DNA, 18 bp, Homo sapiens
taagagctagcgctgccg

SEQ ID NO: 1277449 - DNA, 17 bp, Homo sapiens
taagagctatttgtggt

SEQ ID NO: 1277450 - DNA, 16 bp, Homo sapiens
taagagcttgctccag

SEQ ID NO: 1277451 - DNA, 18 bp, Homo sapiens
taagtgatttttttgtcc

SEQ ID NO: 1277452 - DNA, 19 bp, Homo sapiens
taagtgcaacatttctgta

SEQ ID NO: 1277453 - DNA, 20 bp, Homo sapiens
taagtgcaacatttctgtat

SEQ ID NO: 1277454 - DNA, 17 bp, Homo sapiens
taagtgcacttttttat

SEQ ID NO: 1277455 - DNA, 19 bp, Homo sapiens
taagtgccattactactgt

SEQ ID NO: 1277456 - DNA, 15 bp, Homo sapiens
taagtgctgcattta

SEQ ID NO: 1277457 - DNA, 20 bp, Homo sapiens
taagtgcttcacatttgtat

SEQ ID NO: 1277458 - DNA, 22 bp, Homo sapiens
taagtgctttacctaagtgttg

SEQ ID NO: 1277459 - DNA, 13 bp, Homo sapiens
taagtgctttgta

SEQ ID NO: 1277460 - DNA, 15 bp, Homo sapiens
taagtggaggcactt

SEQ ID NO: 1277461 - DNA, 21 bp, Homo sapiens
taagtggattggctttgtgct

SEQ ID NO: 1277462 - DNA, 17 bp, Homo sapiens
taagtggcgtgtgcata

SEQ ID NO: 1277463 - DNA, 17 bp, Homo sapiens
taagtggtgcttagaaa

SEQ ID NO: 1277464 - DNA, 15 bp, Homo sapiens
taagtgtaaaaaatg

SEQ ID NO: 1277465 - DNA, 18 bp, Homo sapiens
taagtgtaaaaaatgtct

SEQ ID NO: 1277466 - DNA, 14 bp, Homo sapiens
taagtgtaaatata

SEQ ID NO: 1277467 - DNA, 21 bp, Homo sapiens
taagtgtacaattgatctttt

SEQ ID NO: 1277468 - DNA, 22 bp, Homo sapiens
taagtgtacaattgatcttttt

SEQ ID NO: 1277469 - DNA, 14 bp, Homo sapiens
taagtgtattttga

SEQ ID NO: 1277470 - DNA, 20 bp, Homo sapiens
taagtgtatttttcaataaa

SEQ ID NO: 1277471 - DNA, 23 bp, Homo sapiens
taagtgtatttttcaataaagca

SEQ ID NO: 1277472 - DNA, 19 bp, Homo sapiens
taagtgtgagtaagagctg

SEQ ID NO: 1277473 - DNA, 18 bp, Homo sapiens
taagtgtggttttgtaat

SEQ ID NO: 1277474 - DNA, 23 bp, Homo sapiens
taagtgttcgtctttagttttga

SEQ ID NO: 1277475 - DNA, 17 bp, Homo sapiens
taagtgttggaaaaaat

SEQ ID NO: 1277476 - DNA, 15 bp, Homo sapiens
taagtgtttagaaat

SEQ ID NO: 1277477 - DNA, 20 bp, Homo sapiens
taagttaaaggcagtccaga

SEQ ID NO: 1277478 - DNA, 14 bp, Homo sapiens
taagttaataatgt

SEQ ID NO: 1277479 - DNA, 15 bp, Homo sapiens
taagttacaatgttt

SEQ ID NO: 1277480 - DNA, 18 bp, Homo sapiens
taagttatagtgaatact

SEQ ID NO: 1277481 - DNA, 13 bp, Homo sapiens
taagttatctttg

SEQ ID NO: 1277482 - DNA, 23 bp, Homo sapiens
taagttattacctctccagttcc

SEQ ID NO: 1277483 - DNA, 12 bp, Homo sapiens
taagttattgca

SEQ ID NO: 1277484 - DNA, 16 bp, Homo sapiens
taagttattgcagttt

SEQ ID NO: 1277485 - DNA, 20 bp, Homo sapiens
taagttattgcagtttatca

SEQ ID NO: 1277486 - DNA, 19 bp, Homo sapiens
taagttcaaattcttctga

SEQ ID NO: 1277487 - DNA, 20 bp, Homo sapiens
taagttcaaattcttctgaa

SEQ ID NO: 1277488 - DNA, 22 bp, Homo sapiens
taagttcatattccatatttat

SEQ ID NO: 1277489 - DNA, 16 bp, Homo sapiens
taagttcatgtttgta

SEQ ID NO: 1277490 - DNA, 15 bp, Homo sapiens
taagttccactgagc

SEQ ID NO: 1277491 - DNA, 13 bp, Homo sapiens
taagttctttgat

SEQ ID NO: 1277492 - DNA, 19 bp, Homo sapiens
taagttctttgatttgtac

SEQ ID NO: 1277493 - DNA, 22 bp, Homo sapiens
taagttctttgatttgtaccat

SEQ ID NO: 1277494 - DNA, 18 bp, Homo sapiens
taagttgagtggaatgtg

SEQ ID NO: 1277495 - DNA, 13 bp, Homo sapiens
taagttgtaccaa

SEQ ID NO: 1277496 - DNA, 17 bp, Homo sapiens
taagttgtcaaagaagc

SEQ ID NO: 1277497 - DNA, 18 bp, Homo sapiens
taagtttatccaaatctt

SEQ ID NO: 1277498 - DNA, 20 bp, Homo sapiens
taagtttcaaacttactatt

SEQ ID NO: 1277499 - DNA, 17 bp, Homo sapiens
taagtttcagttgattt

SEQ ID NO: 1277500 - DNA, 14 bp, Homo sapiens
taagtttctgggac

SEQ ID NO: 1277501 - DNA, 12 bp, Homo sapiens
taagtttgaagg

SEQ ID NO: 1277502 - DNA, 18 bp, Homo sapiens
taagtttgaaggaaacag

SEQ ID NO: 1277503 - DNA, 20 bp, Homo sapiens
taagtttgcaacatttattg

SEQ ID NO: 1277504 - DNA, 20 bp, Homo sapiens
taagtttggagcactagttt

SEQ ID NO: 1277505 - DNA, 17 bp, Homo sapiens
taagtttgtgttagaaa

SEQ ID NO: 1277506 - DNA, 19 bp, Homo sapiens
taagtttgtgttagaaaag

SEQ ID NO: 1277507 - DNA, 20 bp, Homo sapiens
taagtttgtgttagaaaagt

SEQ ID NO: 1277508 - DNA, 14 bp, Homo sapiens
taagttttgatata

SEQ ID NO: 1277509 - DNA, 19 bp, Homo sapiens
taataaaaaaagaaagcat

SEQ ID NO: 1277510 - DNA, 15 bp, Homo sapiens
taataaaaaatggaa

SEQ ID NO: 1277511 - DNA, 19 bp, Homo sapiens
taataaaaaatggaaagaa

SEQ ID NO: 1277512 - DNA, 15 bp, Homo sapiens
taataaaaagacaac

SEQ ID NO: 1277513 - DNA, 13 bp, Homo sapiens
taataaaaagatt

SEQ ID NO: 1277514 - DNA, 14 bp, Homo sapiens
taataaaaatatat

SEQ ID NO: 1277515 - DNA, 16 bp, Homo sapiens
taataaaaatatatat

SEQ ID NO: 1277516 - DNA, 12 bp, Homo sapiens
taataaaacaac

SEQ ID NO: 1277517 - DNA, 23 bp, Homo sapiens
taataaaacaacaacaaaaacag

SEQ ID NO: 1277518 - DNA, 12 bp, Homo sapiens
taataaaagatt

SEQ ID NO: 1277519 - DNA, 21 bp, Homo sapiens
taataaaagatttacattcca

SEQ ID NO: 1277520 - DNA, 17 bp, Homo sapiens
taataaaagtacatgtt

SEQ ID NO: 1277521 - DNA, 16 bp, Homo sapiens
taataaaagtattctt

SEQ ID NO: 1277522 - DNA, 18 bp, Homo sapiens
taataaaatgcaaatgaa

SEQ ID NO: 1277523 - DNA, 19 bp, Homo sapiens
taataaaatgcaaatgaat

SEQ ID NO: 1277524 - DNA, 19 bp, Homo sapiens
taataaaatggcaccttcc

SEQ ID NO: 1277525 - DNA, 13 bp, Homo sapiens
taataaactaata

SEQ ID NO: 1277526 - DNA, 19 bp, Homo sapiens
taataaactaataattgca

SEQ ID NO: 1277527 - DNA, 13 bp, Homo sapiens
taataaactgtat

SEQ ID NO: 1277528 - DNA, 16 bp, Homo sapiens
taataaactgtattaa

SEQ ID NO: 1277529 - DNA, 20 bp, Homo sapiens
taataaactgtattaaatct

SEQ ID NO: 1277530 - DNA, 21 bp, Homo sapiens
taataaactgtattaaatctt

SEQ ID NO: 1277531 - DNA, 18 bp, Homo sapiens
taataaactttgtgctga

SEQ ID NO: 1277532 - DNA, 19 bp, Homo sapiens
taataaacttttttttgag

SEQ ID NO: 1277533 - DNA, 21 bp, Homo sapiens
taataaacttttttttgagaa

SEQ ID NO: 1277534 - DNA, 19 bp, Homo sapiens
taataaagagatagttcta

SEQ ID NO: 1277535 - DNA, 13 bp, Homo sapiens
taataaagcattc

SEQ ID NO: 1277536 - DNA, 12 bp, Homo sapiens
taataaaggact

SEQ ID NO: 1277537 - DNA, 13 bp, Homo sapiens
taataaaggactg

SEQ ID NO: 1277538 - DNA, 14 bp, Homo sapiens
taataaagtatata

SEQ ID NO: 1277539 - DNA, 13 bp, Homo sapiens
taataaagtattc

SEQ ID NO: 1277540 - DNA, 17 bp, Homo sapiens
taataaagtttccatta

SEQ ID NO: 1277541 - DNA, 18 bp, Homo sapiens
taataaatacacaatgaa

SEQ ID NO: 1277542 - DNA, 15 bp, Homo sapiens
taataaatagttctt

SEQ ID NO: 1277543 - DNA, 20 bp, Homo sapiens
taataaatatgtttcacaca

SEQ ID NO: 1277544 - DNA, 13 bp, Homo sapiens
taataaattcaga

SEQ ID NO: 1277545 - DNA, 15 bp, Homo sapiens
taataaattcagata

SEQ ID NO: 1277546 - DNA, 19 bp, Homo sapiens
taataaattgcttactgat

SEQ ID NO: 1277547 - DNA, 21 bp, Homo sapiens
taataaattgcttactgatat

SEQ ID NO: 1277548 - DNA, 20 bp, Homo sapiens
taataacctgccagtcccag

SEQ ID NO: 1277549 - DNA, 18 bp, Homo sapiens
taataacgtgaaacttat

SEQ ID NO: 1277550 - DNA, 16 bp, Homo sapiens
taataactttattgca

SEQ ID NO: 1277551 - DNA, 20 bp, Homo sapiens
taataactttattgcatata

SEQ ID NO: 1277552 - DNA, 12 bp, Homo sapiens
taataagaaagt

SEQ ID NO: 1277553 - DNA, 15 bp, Homo sapiens
taataagattagttg

SEQ ID NO: 1277554 - DNA, 18 bp, Homo sapiens
taataagctaaagaggct

SEQ ID NO: 1277555 - DNA, 17 bp, Homo sapiens
taataagtgatgtgctg

SEQ ID NO: 1277556 - DNA, 13 bp, Homo sapiens
taataagtttgtg

SEQ ID NO: 1277557 - DNA, 16 bp, Homo sapiens
taataataaagaatag

SEQ ID NO: 1277558 - DNA, 13 bp, Homo sapiens
taataataaatag

SEQ ID NO: 1277559 - DNA, 18 bp, Homo sapiens
taataataaatagttctt

SEQ ID NO: 1277560 - DNA, 12 bp, Homo sapiens
taataataaatt

SEQ ID NO: 1277561 - DNA, 14 bp, Homo sapiens
taataataatgttt

SEQ ID NO: 1277562 - DNA, 13 bp, Homo sapiens
taataatagtgga

SEQ ID NO: 1277563 - DNA, 17 bp, Homo sapiens
taataatttgtaaattg

SEQ ID NO: 1277564 - DNA, 19 bp, Homo sapiens
taataatttgtaaattgaa

SEQ ID NO: 1277565 - DNA, 18 bp, Homo sapiens
taatacaccactacattc

SEQ ID NO: 1277566 - DNA, 19 bp, Homo sapiens
taatacaccactacattct

SEQ ID NO: 1277567 - DNA, 21 bp, Homo sapiens
taatacaccactacattctgt

SEQ ID NO: 1277568 - DNA, 23 bp, Homo sapiens
taatacaccactacattctgtta

SEQ ID NO: 1277569 - DNA, 20 bp, Homo sapiens
taatacactaattcctttct

SEQ ID NO: 1277570 - DNA, 21 bp, Homo sapiens
taatacagcaacaatttatga

SEQ ID NO: 1277571 - DNA, 22 bp, Homo sapiens
taataccaaagactatttcaaa

SEQ ID NO: 1277572 - DNA, 16 bp, Homo sapiens
taataccaccatttaa

SEQ ID NO: 1277573 - DNA, 21 bp, Homo sapiens
taatgcccagccagccacccc

SEQ ID NO: 1277574 - DNA, 23 bp, Homo sapiens
taatgcctagcagagaactgcct

SEQ ID NO: 1277575 - DNA, 19 bp, Homo sapiens
taatgctaatttaaagaga

SEQ ID NO: 1277576 - DNA, 17 bp, Homo sapiens
taatgctatgcaaaaaa

SEQ ID NO: 1277577 - DNA, 20 bp, Homo sapiens
taatgctcacctttatcacc

SEQ ID NO: 1277578 - DNA, 18 bp, Homo sapiens
taatgctggcctgactgg

SEQ ID NO: 1277579 - DNA, 22 bp, Homo sapiens
taatgctggcctgactggttgt

SEQ ID NO: 1277580 - DNA, 18 bp, Homo sapiens
taatgctgtctttgtgga

SEQ ID NO: 1277581 - DNA, 16 bp, Homo sapiens
taatgctgttgcctca

SEQ ID NO: 1277582 - DNA, 14 bp, Homo sapiens
taatgctgtttcta

SEQ ID NO: 1277583 - DNA, 20 bp, Homo sapiens
taatgcttagagaatgttct

SEQ ID NO: 1277584 - DNA, 17 bp, Homo sapiens
taatgcttcaagtgttg

SEQ ID NO: 1277585 - DNA, 14 bp, Homo sapiens
taatgcttcagata

SEQ ID NO: 1277586 - DNA, 16 bp, Homo sapiens
taatgcttggaatggc

SEQ ID NO: 1277587 - DNA, 16 bp, Homo sapiens
taatgctttctgagtg

SEQ ID NO: 1277588 - DNA, 11 bp, Homo sapiens
taatggaaaaa

SEQ ID NO: 1277589 - DNA, 17 bp, Homo sapiens
taatggaaaaaaagact

SEQ ID NO: 1277590 - DNA, 16 bp, Homo sapiens
taatggaaaaatagta

SEQ ID NO: 1277591 - DNA, 21 bp, Homo sapiens
taatggaaaatgccatgaatt

SEQ ID NO: 1277592 - DNA, 11 bp, Homo sapiens
taatggaaaca

SEQ ID NO: 1277593 - DNA, 12 bp, Homo sapiens
taatggaaacat

SEQ ID NO: 1277594 - DNA, 19 bp, Homo sapiens
taatggaactgaccccctc

SEQ ID NO: 1277595 - DNA, 19 bp, Homo sapiens
taatggaagtgtatttatt

SEQ ID NO: 1277596 - DNA, 20 bp, Homo sapiens
taatggaagtgtatttattt

SEQ ID NO: 1277597 - DNA, 19 bp, Homo sapiens
taatggacatgagataatg

SEQ ID NO: 1277598 - DNA, 20 bp, Homo sapiens
taatggactgtgaatttcaa

SEQ ID NO: 1277599 - DNA, 17 bp, Homo sapiens
taatggagaatcacttt

SEQ ID NO: 1277600 - DNA, 15 bp, Homo sapiens
taatggatttcagaa

SEQ ID NO: 1277601 - DNA, 19 bp, Homo sapiens
taatggcagctagtgcctt

SEQ ID NO: 1277602 - DNA, 23 bp, Homo sapiens
taatggcttccctctttcatctc

SEQ ID NO: 1277603 - DNA, 15 bp, Homo sapiens
taatgggattttctt

SEQ ID NO: 1277604 - DNA, 16 bp, Homo sapiens
taatgggcctgcccaa

SEQ ID NO: 1277605 - DNA, 17 bp, Homo sapiens
taatgggggtagcagct

SEQ ID NO: 1277606 - DNA, 23 bp, Homo sapiens
taatggtactgactttgcttgct

SEQ ID NO: 1277607 - DNA, 14 bp, Homo sapiens
taatggtcccatcc

SEQ ID NO: 1277608 - DNA, 16 bp, Homo sapiens
taatggtcccatccag

SEQ ID NO: 1277609 - DNA, 18 bp, Homo sapiens
taatggtcccatccaggc

SEQ ID NO: 1277610 - DNA, 20 bp, Homo sapiens
taatggtcccatccaggcag

SEQ ID NO: 1277611 - DNA, 16 bp, Homo sapiens
taatggttgtgaaatg

SEQ ID NO: 1277612 - DNA, 11 bp, Homo sapiens
taatgtaaact

SEQ ID NO: 1277613 - DNA, 15 bp, Homo sapiens
taatgtacaagtttt

SEQ ID NO: 1277614 - DNA, 21 bp, Homo sapiens
taatgtacaagttttgtataa

SEQ ID NO: 1277615 - DNA, 13 bp, Homo sapiens
taatgtactgcat

SEQ ID NO: 1277616 - DNA, 15 bp, Homo sapiens
taatgtactgtacat

SEQ ID NO: 1277617 - DNA, 16 bp, Homo sapiens
taatgtagctattttt

SEQ ID NO: 1277618 - DNA, 14 bp, Homo sapiens
taatgtaggactgt

SEQ ID NO: 1277619 - DNA, 17 bp, Homo sapiens
taatgtatatttgctgc

SEQ ID NO: 1277620 - DNA, 19 bp, Homo sapiens
taatgtatatttgctgcaa

SEQ ID NO: 1277621 - DNA, 18 bp, Homo sapiens
taatgtattagtatggtt

SEQ ID NO: 1277622 - DNA, 16 bp, Homo sapiens
taatgtattcccttca

SEQ ID NO: 1277623 - DNA, 18 bp, Homo sapiens
taatgtcactgtttttat

SEQ ID NO: 1277624 - DNA, 14 bp, Homo sapiens
taatgtcattgcta

SEQ ID NO: 1277625 - DNA, 17 bp, Homo sapiens
taatgtcattgctaaaa

SEQ ID NO: 1277626 - DNA, 18 bp, Homo sapiens
taatgtcattgctaaaaa

SEQ ID NO: 1277627 - DNA, 14 bp, Homo sapiens
taatgtccccactc

SEQ ID NO: 1277628 - DNA, 15 bp, Homo sapiens
taatgtccccactcc

SEQ ID NO: 1277629 - DNA, 16 bp, Homo sapiens
taatgtccccactccc

SEQ ID NO: 1277630 - DNA, 15 bp, Homo sapiens
taatgtctcactgtt

SEQ ID NO: 1277631 - DNA, 17 bp, Homo sapiens
taatgtctcactgttct

SEQ ID NO: 1277632 - DNA, 18 bp, Homo sapiens
taatgtctcactgttctg

SEQ ID NO: 1277633 - DNA, 16 bp, Homo sapiens
taatgtctcttcctct

SEQ ID NO: 1277634 - DNA, 13 bp, Homo sapiens
taatgtcttcatt

SEQ ID NO: 1277635 - DNA, 21 bp, Homo sapiens
taatgtcttcatttcattgta

SEQ ID NO: 1277636 - DNA, 14 bp, Homo sapiens
taatgtgaaaatca

SEQ ID NO: 1277637 - DNA, 12 bp, Homo sapiens
taatgtgaaact

SEQ ID NO: 1277638 - DNA, 20 bp, Homo sapiens
taatgtgaaactggattaaa

SEQ ID NO: 1277639 - DNA, 23 bp, Homo sapiens
taatgtgaaatgtaactgtccgt

SEQ ID NO: 1277640 - DNA, 19 bp, Homo sapiens
taatgtgaatttttgccta

SEQ ID NO: 1277641 - DNA, 19 bp, Homo sapiens
taatgtgaggaactcacat

SEQ ID NO: 1277642 - DNA, 21 bp, Homo sapiens
taatgtgagtgtgaagctttg

SEQ ID NO: 1277643 - DNA, 22 bp, Homo sapiens
taatgtgatcatatgaggacct

SEQ ID NO: 1277644 - DNA, 18 bp, Homo sapiens
taatgtgcaaattttgca

SEQ ID NO: 1277645 - DNA, 15 bp, Homo sapiens
taatgtgtcccctga

SEQ ID NO: 1277646 - DNA, 17 bp, Homo sapiens
taatgtgtgttgtgtga

SEQ ID NO: 1277647 - DNA, 24 bp, Homo sapiens
taatgtgtgttgtgtgagcgtggc

SEQ ID NO: 1277648 - DNA, 17 bp, Homo sapiens
taatgttaagctttatt

SEQ ID NO: 1277649 - DNA, 14 bp, Homo sapiens
taatgttactgatc

SEQ ID NO: 1277650 - DNA, 15 bp, Homo sapiens
taatgttactgatca

SEQ ID NO: 1277651 - DNA, 14 bp, Homo sapiens
taatgttagaattt

SEQ ID NO: 1277652 - DNA, 13 bp, Homo sapiens
taatgttattcat

SEQ ID NO: 1277653 - DNA, 20 bp, Homo sapiens
taatgttctgaataatttct

SEQ ID NO: 1277654 - DNA, 18 bp, Homo sapiens
taatgttctgtgatacag

SEQ ID NO: 1277655 - DNA, 16 bp, Homo sapiens
taatgttctttaatgt

SEQ ID NO: 1277656 - DNA, 14 bp, Homo sapiens
taatgttgaatgta

SEQ ID NO: 1277657 - DNA, 14 bp, Homo sapiens
taatgttgatcagc

SEQ ID NO: 1277658 - DNA, 21 bp, Homo sapiens
taatgttgatcagcaaattta

SEQ ID NO: 1277659 - DNA, 14 bp, Homo sapiens
taatgttgttattt

SEQ ID NO: 1277660 - DNA, 15 bp, Homo sapiens
taatgtttaaatcat

SEQ ID NO: 1277661 - DNA, 21 bp, Homo sapiens
taatgtttaaatcatgtatgt

SEQ ID NO: 1277662 - DNA, 16 bp, Homo sapiens
taatgtttatgagcca

SEQ ID NO: 1277663 - DNA, 11 bp, Homo sapiens
taatgtttcct

SEQ ID NO: 1277664 - DNA, 17 bp, Homo sapiens
taatgtttctatctgat

SEQ ID NO: 1277665 - DNA, 19 bp, Homo sapiens
taatgtttcttaaatggaa

SEQ ID NO: 1277666 - DNA, 17 bp, Homo sapiens
taatgtttgatttagta

SEQ ID NO: 1277667 - DNA, 14 bp, Homo sapiens
taatgtttgtgaga

SEQ ID NO: 1277668 - DNA, 15 bp, Homo sapiens
taatgttttaaatgt

SEQ ID NO: 1277669 - DNA, 20 bp, Homo sapiens
taatgttttaaatgtacaga

SEQ ID NO: 1277670 - DNA, 15 bp, Homo sapiens
taatgttttcattat

SEQ ID NO: 1277671 - DNA, 12 bp, Homo sapiens
taatgttttctg

SEQ ID NO: 1277672 - DNA, 13 bp, Homo sapiens
taatgttttcttt

SEQ ID NO: 1277673 - DNA, 18 bp, Homo sapiens
taatgttttctttgcaaa

SEQ ID NO: 1277674 - DNA, 14 bp, Homo sapiens
taatgttttgtaca

SEQ ID NO: 1277675 - DNA, 16 bp, Homo sapiens
taatgttttgtacaat

SEQ ID NO: 1277676 - DNA, 15 bp, Homo sapiens
taattaaaaacttta

SEQ ID NO: 1277677 - DNA, 19 bp, Homo sapiens
taattaaaaactttaaaga

SEQ ID NO: 1277678 - DNA, 15 bp, Homo sapiens
taattaaaacacttt

SEQ ID NO: 1277679 - DNA, 18 bp, Homo sapiens
taattaaaagcaaatcat

SEQ ID NO: 1277680 - DNA, 19 bp, Homo sapiens
taattaaaagcaaatcatt

SEQ ID NO: 1277681 - DNA, 12 bp, Homo sapiens
taattaaaatct

SEQ ID NO: 1277682 - DNA, 18 bp, Homo sapiens
taattaaaatctggaaat

SEQ ID NO: 1277683 - DNA, 16 bp, Homo sapiens
taattaaatctcaaat

SEQ ID NO: 1277684 - DNA, 16 bp, Homo sapiens
taattaacttaactga

SEQ ID NO: 1277685 - DNA, 17 bp, Homo sapiens
taattaagtactatgta

SEQ ID NO: 1277686 - DNA, 22 bp, Homo sapiens
taattaatatattaaaattcca

SEQ ID NO: 1277687 - DNA, 14 bp, Homo sapiens
taattaattaagta

SEQ ID NO: 1277688 - DNA, 21 bp, Homo sapiens
taattaattgggccagctttt

SEQ ID NO: 1277689 - DNA, 17 bp, Homo sapiens
taattagagaactggag

SEQ ID NO: 1277690 - DNA, 20 bp, Homo sapiens
taattagagaactggaggaa

SEQ ID NO: 1277691 - DNA, 17 bp, Homo sapiens
taattagatccattaat

SEQ ID NO: 1277692 - DNA, 13 bp, Homo sapiens
taattagctgtgc

SEQ ID NO: 1277693 - DNA, 17 bp, Homo sapiens
taattaggggttgctaa

SEQ ID NO: 1277694 - DNA, 21 bp, Homo sapiens
taattagtgccacttaatgta

SEQ ID NO: 1277695 - DNA, 23 bp, Homo sapiens
taattagttcctcattagcattt

SEQ ID NO: 1277696 - DNA, 21 bp, Homo sapiens
tacaatttttaataaattgaa

SEQ ID NO: 1277697 - DNA, 13 bp, Homo sapiens
tacacaactcact

SEQ ID NO: 1277698 - DNA, 22 bp, Homo sapiens
tacacaactcactccttttaaa

SEQ ID NO: 1277699 - DNA, 18 bp, Homo sapiens
tacacaactttgcaaatt

SEQ ID NO: 1277700 - DNA, 13 bp, Homo sapiens
tacacaagaatct

SEQ ID NO: 1277701 - DNA, 14 bp, Homo sapiens
tacacaagtaaaca

SEQ ID NO: 1277702 - DNA, 15 bp, Homo sapiens
tacacaagtaaacat

SEQ ID NO: 1277703 - DNA, 16 bp, Homo sapiens
tacacaagtaaacatt

SEQ ID NO: 1277704 - DNA, 17 bp, Homo sapiens
tacacaatatacgaaaa

SEQ ID NO: 1277705 - DNA, 17 bp, Homo sapiens
tacacaatggtttttaa

SEQ ID NO: 1277706 - DNA, 16 bp, Homo sapiens
tacacacacaaaccat

SEQ ID NO: 1277707 - DNA, 16 bp, Homo sapiens
tacacacacacacaca

SEQ ID NO: 1277708 - DNA, 17 bp, Homo sapiens
tacacacacacacatac

SEQ ID NO: 1277709 - DNA, 21 bp, Homo sapiens
tacacacacgttgacgggccg

SEQ ID NO: 1277710 - DNA, 18 bp, Homo sapiens
tacacacatatacatata

SEQ ID NO: 1277711 - DNA, 19 bp, Homo sapiens
tacacacatgccctcctgg

SEQ ID NO: 1277712 - DNA, 22 bp, Homo sapiens
tacacactgcatgtttgtgatt

SEQ ID NO: 1277713 - DNA, 18 bp, Homo sapiens
tacacactgtacacataa

SEQ ID NO: 1277714 - DNA, 17 bp, Homo sapiens
tacacagaaatgctgct

SEQ ID NO: 1277715 - DNA, 19 bp, Homo sapiens
tacacagaaatgctgctgg

SEQ ID NO: 1277716 - DNA, 22 bp, Homo sapiens
tacacagaaatgctgctggcca

SEQ ID NO: 1277717 - DNA, 23 bp, Homo sapiens
tacacagaaatgctgctggccaa

SEQ ID NO: 1277718 - DNA, 24 bp, Homo sapiens
tacacagatatatacacacagtgg

SEQ ID NO: 1277719 - DNA, 19 bp, Homo sapiens
tacacagattctgccttgt

SEQ ID NO: 1277720 - DNA, 21 bp, Homo sapiens
tacacagattctgccttgttt

SEQ ID NO: 1277721 - DNA, 20 bp, Homo sapiens
tacacagcacaccagccgct

SEQ ID NO: 1277722 - DNA, 22 bp, Homo sapiens
tacacagtaaaaacttgtacta

SEQ ID NO: 1277723 - DNA, 19 bp, Homo sapiens
tacacagtaagtcatttaa

SEQ ID NO: 1277724 - DNA, 19 bp, Homo sapiens
tacacagtactttattgta

SEQ ID NO: 1277725 - DNA, 13 bp, Homo sapiens
tacacagttaaat

SEQ ID NO: 1277726 - DNA, 23 bp, Homo sapiens
tacacataagaccgtgtcccaag

SEQ ID NO: 1277727 - DNA, 17 bp, Homo sapiens
tacacatacatacacat

SEQ ID NO: 1277728 - DNA, 23 bp, Homo sapiens
tacacatagcatgtaatggtatc

SEQ ID NO: 1277729 - DNA, 20 bp, Homo sapiens
tacacatgtaaaatatgtaa

SEQ ID NO: 1277730 - DNA, 23 bp, Homo sapiens
tacacatgtaaaatatgtaaaac

SEQ ID NO: 1277731 - DNA, 18 bp, Homo sapiens
tacacattaagtaatcaa

SEQ ID NO: 1277732 - DNA, 23 bp, Homo sapiens
tacacattattatgactagaagt

SEQ ID NO: 1277733 - DNA, 20 bp, Homo sapiens
tacacattcggctccctgga

SEQ ID NO: 1277734 - DNA, 18 bp, Homo sapiens
tacaccacctcactcctg

SEQ ID NO: 1277735 - DNA, 17 bp, Homo sapiens
tacaccactacattctg

SEQ ID NO: 1277736 - DNA, 18 bp, Homo sapiens
tacaccactacattctgt

SEQ ID NO: 1277737 - DNA, 24 bp, Homo sapiens
tacaccatgtttgagctcagaccc

SEQ ID NO: 1277738 - DNA, 19 bp, Homo sapiens
tacaccattatcttggaaa

SEQ ID NO: 1277739 - DNA, 11 bp, Homo sapiens
tacacccagca

SEQ ID NO: 1277740 - DNA, 15 bp, Homo sapiens
tacaccccttttcca

SEQ ID NO: 1277741 - DNA, 16 bp, Homo sapiens
tacaccccttttccag

SEQ ID NO: 1277742 - DNA, 15 bp, Homo sapiens
tacacccttttccag

SEQ ID NO: 1277743 - DNA, 16 bp, Homo sapiens
tacacccttttccagc

SEQ ID NO: 1277744 - DNA, 23 bp, Homo sapiens
tacacctaaaggtgtatttaaac

SEQ ID NO: 1277745 - DNA, 13 bp, Homo sapiens
tacacctccctcc

SEQ ID NO: 1277746 - DNA, 20 bp, Homo sapiens
tacacctcctttaagattta

SEQ ID NO: 1277747 - DNA, 22 bp, Homo sapiens
tacacctggctgaggttcctct

SEQ ID NO: 1277748 - DNA, 14 bp, Homo sapiens
tacaccttgctttt

SEQ ID NO: 1277749 - DNA, 19 bp, Homo sapiens
tacaccttgcttttttact

SEQ ID NO: 1277750 - DNA, 13 bp, Homo sapiens
tacacgggactga

SEQ ID NO: 1277751 - DNA, 15 bp, Homo sapiens
tacactaaaaggtga

SEQ ID NO: 1277752 - DNA, 20 bp, Homo sapiens
tacactaatatatggaccta

SEQ ID NO: 1277753 - DNA, 22 bp, Homo sapiens
tacactaccaaacactcagtcc

SEQ ID NO: 1277754 - DNA, 18 bp, Homo sapiens
tacactaggaaacgtgtt

SEQ ID NO: 1277755 - DNA, 17 bp, Homo sapiens
tacactatgataaagtt

SEQ ID NO: 1277756 - DNA, 19 bp, Homo sapiens
tacactatgataaagttgt

SEQ ID NO: 1277757 - DNA, 22 bp, Homo sapiens
tacactatgataaagttgtaaa

SEQ ID NO: 1277758 - DNA, 20 bp, Homo sapiens
tacactgaagttaacagaga

SEQ ID NO: 1277759 - DNA, 20 bp, Homo sapiens
tacactgaggactgtggcga

SEQ ID NO: 1277760 - DNA, 13 bp, Homo sapiens
tacactgcacttt

SEQ ID NO: 1277761 - DNA, 19 bp, Homo sapiens
tacactggaggagagaaga

SEQ ID NO: 1277762 - DNA, 18 bp, Homo sapiens
tacactggtctaatgttt

SEQ ID NO: 1277763 - DNA, 21 bp, Homo sapiens
tacactggtttgagcttagtg

SEQ ID NO: 1277764 - DNA, 23 bp, Homo sapiens
tacactgtagtttttgaaaatta

SEQ ID NO: 1277765 - DNA, 16 bp, Homo sapiens
tacactgtattacata

SEQ ID NO: 1277766 - DNA, 20 bp, Homo sapiens
tacactgtcagcagggactg

SEQ ID NO: 1277767 - DNA, 17 bp, Homo sapiens
tacactgtttcaaactt

SEQ ID NO: 1277768 - DNA, 18 bp, Homo sapiens
tacactgtttcaaacttt

SEQ ID NO: 1277769 - DNA, 13 bp, Homo sapiens
tacacttcttttg

SEQ ID NO: 1277770 - DNA, 18 bp, Homo sapiens
tacacttgagatgatttc

SEQ ID NO: 1277771 - DNA, 14 bp, Homo sapiens
tacacttggagccc

SEQ ID NO: 1277772 - DNA, 13 bp, Homo sapiens
tacacttggattt

SEQ ID NO: 1277773 - DNA, 17 bp, Homo sapiens
tacacttggatttcatt

SEQ ID NO: 1277774 - DNA, 16 bp, Homo sapiens
tacacttggtgtactg

SEQ ID NO: 1277775 - DNA, 22 bp, Homo sapiens
tacactttatgccggatgtgct

SEQ ID NO: 1277776 - DNA, 15 bp, Homo sapiens
tacactttgttgcaa

SEQ ID NO: 1277777 - DNA, 19 bp, Homo sapiens
tacagaaaaacaatggtaa

SEQ ID NO: 1277778 - DNA, 17 bp, Homo sapiens
tacagaaaaatactttg

SEQ ID NO: 1277779 - DNA, 15 bp, Homo sapiens
tacagaaaacatgtt

SEQ ID NO: 1277780 - DNA, 13 bp, Homo sapiens
tacagaaaagaaa

SEQ ID NO: 1277781 - DNA, 14 bp, Homo sapiens
tacagaaaagaaat

SEQ ID NO: 1277782 - DNA, 16 bp, Homo sapiens
tacagaaaatgctggc

SEQ ID NO: 1277783 - DNA, 20 bp, Homo sapiens
tacagaaatactgctctgaa

SEQ ID NO: 1277784 - DNA, 21 bp, Homo sapiens
tacagaaatgtttttaacact

SEQ ID NO: 1277785 - DNA, 22 bp, Homo sapiens
tacagaaattgaaaatgaccaa

SEQ ID NO: 1277786 - DNA, 18 bp, Homo sapiens
tacagaacagagggccag

SEQ ID NO: 1277787 - DNA, 20 bp, Homo sapiens
tacagaacagagggccagag

SEQ ID NO: 1277788 - DNA, 17 bp, Homo sapiens
tacagaactctttcaaa

SEQ ID NO: 1277789 - DNA, 15 bp, Homo sapiens
tacagaacttcagaa

SEQ ID NO: 1277790 - DNA, 14 bp, Homo sapiens
tacagaagaaactg

SEQ ID NO: 1277791 - DNA, 23 bp, Homo sapiens
tacagaagccaagctccctggag

SEQ ID NO: 1277792 - DNA, 13 bp, Homo sapiens
tacagaaggcaaa

SEQ ID NO: 1277793 - DNA, 16 bp, Homo sapiens
tacagaataatccagt

SEQ ID NO: 1277794 - DNA, 18 bp, Homo sapiens
tacagaatcttgttttga

SEQ ID NO: 1277795 - DNA, 16 bp, Homo sapiens
tacagaatgcattaaa

SEQ ID NO: 1277796 - DNA, 19 bp, Homo sapiens
tacagaatgcattaaaaaa

SEQ ID NO: 1277797 - DNA, 21 bp, Homo sapiens
tacagaattctgctacctcac

SEQ ID NO: 1277798 - DNA, 18 bp, Homo sapiens
tacagacaaggttctgcc

SEQ ID NO: 1277799 - DNA, 11 bp, Homo sapiens
tacagacacta

SEQ ID NO: 1277800 - DNA, 18 bp, Homo sapiens
tacagacactaagttata

SEQ ID NO: 1277801 - DNA, 19 bp, Homo sapiens
tacagacactaagttatag

SEQ ID NO: 1277802 - DNA, 14 bp, Homo sapiens
tacagacagacata

SEQ ID NO: 1277803 - DNA, 17 bp, Homo sapiens
tacagacagacatacat

SEQ ID NO: 1277804 - DNA, 23 bp, Homo sapiens
tacagacagacatacatagacat

SEQ ID NO: 1277805 - DNA, 19 bp, Homo sapiens
tacagacatatttaactgg

SEQ ID NO: 1277806 - DNA, 18 bp, Homo sapiens
tacagaccgagaggccag

SEQ ID NO: 1277807 - DNA, 18 bp, Homo sapiens
tacagactgcagacattc

SEQ ID NO: 1277808 - DNA, 19 bp, Homo sapiens
tacagagaaattctgtggt

SEQ ID NO: 1277809 - DNA, 20 bp, Homo sapiens
tacagagaaattctgtggtg

SEQ ID NO: 1277810 - DNA, 12 bp, Homo sapiens
tacagagaattt

SEQ ID NO: 1277811 - DNA, 20 bp, Homo sapiens
tacagagaggagaaacacat

SEQ ID NO: 1277812 - DNA, 21 bp, Homo sapiens
tacagagaggagaaacacatc

SEQ ID NO: 1277813 - DNA, 22 bp, Homo sapiens
tacagagaggagaaacacatct

SEQ ID NO: 1277814 - DNA, 21 bp, Homo sapiens
tacagagaggatacatttaat

SEQ ID NO: 1277815 - DNA, 22 bp, Homo sapiens
tacagagatatacaaatatatt

SEQ ID NO: 1277816 - DNA, 18 bp, Homo sapiens
tacatttatttattactg

SEQ ID NO: 1277817 - DNA, 20 bp, Homo sapiens
tacatttatttattactgtc

SEQ ID NO: 1277818 - DNA, 18 bp, Homo sapiens
tacatttcacattattct

SEQ ID NO: 1277819 - DNA, 15 bp, Homo sapiens
tacatttcatacaac

SEQ ID NO: 1277820 - DNA, 17 bp, Homo sapiens
tacatttccaaatgaac

SEQ ID NO: 1277821 - DNA, 18 bp, Homo sapiens
tacatttccatttattgt

SEQ ID NO: 1277822 - DNA, 22 bp, Homo sapiens
tacatttccatttattgtttga

SEQ ID NO: 1277823 - DNA, 16 bp, Homo sapiens
tacatttctactatga

SEQ ID NO: 1277824 - DNA, 22 bp, Homo sapiens
tacatttcttagactacattta

SEQ ID NO: 1277825 - DNA, 22 bp, Homo sapiens
tacatttgagggcccagccagg

SEQ ID NO: 1277826 - DNA, 21 bp, Homo sapiens
tacatttgggagtttttatga

SEQ ID NO: 1277827 - DNA, 18 bp, Homo sapiens
tacattttacacactgta

SEQ ID NO: 1277828 - DNA, 22 bp, Homo sapiens
tacattttacacactgtacaca

SEQ ID NO: 1277829 - DNA, 13 bp, Homo sapiens
tacattttagttt

SEQ ID NO: 1277830 - DNA, 14 bp, Homo sapiens
tacattttataatt

SEQ ID NO: 1277831 - DNA, 19 bp, Homo sapiens
tacattttatatttttgta

SEQ ID NO: 1277832 - DNA, 23 bp, Homo sapiens
tacattttatatttttgtacata

SEQ ID NO: 1277833 - DNA, 23 bp, Homo sapiens
tacattttattaagctttttgga

SEQ ID NO: 1277834 - DNA, 20 bp, Homo sapiens
tacattttcgtcctgtagca

SEQ ID NO: 1277835 - DNA, 14 bp, Homo sapiens
tacattttctggtg

SEQ ID NO: 1277836 - DNA, 14 bp, Homo sapiens
tacattttgtaaaa

SEQ ID NO: 1277837 - DNA, 12 bp, Homo sapiens
tacattttgtta

SEQ ID NO: 1277838 - DNA, 14 bp, Homo sapiens
tacatttttaagct

SEQ ID NO: 1277839 - DNA, 18 bp, Homo sapiens
tacatttttaagctccat

SEQ ID NO: 1277840 - DNA, 14 bp, Homo sapiens
tacatttttaagtg

SEQ ID NO: 1277841 - DNA, 19 bp, Homo sapiens
tacatttttaagtgctgca

SEQ ID NO: 1277842 - DNA, 17 bp, Homo sapiens
tacatttttacaataaa

SEQ ID NO: 1277843 - DNA, 15 bp, Homo sapiens
taccaaaaaccatgt

SEQ ID NO: 1277844 - DNA, 16 bp, Homo sapiens
taccaaaaattgccaa

SEQ ID NO: 1277845 - DNA, 15 bp, Homo sapiens
taccaaaaattttgt

SEQ ID NO: 1277846 - DNA, 23 bp, Homo sapiens
taccaaagactatttcaaaatgt

SEQ ID NO: 1277847 - DNA, 17 bp, Homo sapiens
taccaaagtgtcttttg

SEQ ID NO: 1277848 - DNA, 21 bp, Homo sapiens
taccaaagtgtcttttgacat

SEQ ID NO: 1277849 - DNA, 18 bp, Homo sapiens
taccaaatagcttctgtt

SEQ ID NO: 1277850 - DNA, 13 bp, Homo sapiens
taccaaatatttt

SEQ ID NO: 1277851 - DNA, 15 bp, Homo sapiens
taccaaatattttag

SEQ ID NO: 1277852 - DNA, 18 bp, Homo sapiens
taccaaatccacaagcca

SEQ ID NO: 1277853 - DNA, 18 bp, Homo sapiens
taccaaatgcctgttgta

SEQ ID NO: 1277854 - DNA, 20 bp, Homo sapiens
taccaaattgcttgagcctg

SEQ ID NO: 1277855 - DNA, 12 bp, Homo sapiens
taccaacctgtt

SEQ ID NO: 1277856 - DNA, 14 bp, Homo sapiens
taccaacttcctct

SEQ ID NO: 1277857 - DNA, 12 bp, Homo sapiens
taccaactttac

SEQ ID NO: 1277858 - DNA, 13 bp, Homo sapiens
taccaactttctg

SEQ ID NO: 1277859 - DNA, 17 bp, Homo sapiens
taccaagagtaacttta

SEQ ID NO: 1277860 - DNA, 23 bp, Homo sapiens
taccaagagtaactttactctgt

SEQ ID NO: 1277861 - DNA, 15 bp, Homo sapiens
taccaagtatgaagt

SEQ ID NO: 1277862 - DNA, 20 bp, Homo sapiens
taccaagttgtgcttttctg

SEQ ID NO: 1277863 - DNA, 15 bp, Homo sapiens
taccaataaactgag

SEQ ID NO: 1277864 - DNA, 13 bp, Homo sapiens
taccaatgaaaaa

SEQ ID NO: 1277865 - DNA, 14 bp, Homo sapiens
taccaatgcatgca

SEQ ID NO: 1277866 - DNA, 17 bp, Homo sapiens
taccaatgctgttgtaa

SEQ ID NO: 1277867 - DNA, 14 bp, Homo sapiens
taccaatgggaagc

SEQ ID NO: 1277868 - DNA, 20 bp, Homo sapiens
taccaatgtgttttctgtag

SEQ ID NO: 1277869 - DNA, 17 bp, Homo sapiens
taccacaaaccctgctg

SEQ ID NO: 1277870 - DNA, 13 bp, Homo sapiens
taccacactgagt

SEQ ID NO: 1277871 - DNA, 15 bp, Homo sapiens
taccacactgagttc

SEQ ID NO: 1277872 - DNA, 16 bp, Homo sapiens
taccacactgagttct

SEQ ID NO: 1277873 - DNA, 16 bp, Homo sapiens
taccacatctgctcta

SEQ ID NO: 1277874 - DNA, 21 bp, Homo sapiens
taccaccatttaaaaatgtta

SEQ ID NO: 1277875 - DNA, 14 bp, Homo sapiens
taccaccccttcct

SEQ ID NO: 1277876 - DNA, 16 bp, Homo sapiens
taccaccccttcctgt

SEQ ID NO: 1277877 - DNA, 20 bp, Homo sapiens
taccacccttcagaccccag

SEQ ID NO: 1277878 - DNA, 13 bp, Homo sapiens
taccacctgtaca

SEQ ID NO: 1277879 - DNA, 17 bp, Homo sapiens
taccacctgtacataca

SEQ ID NO: 1277880 - DNA, 16 bp, Homo sapiens
taccacctttactgtg

SEQ ID NO: 1277881 - DNA, 17 bp, Homo sapiens
taccacgccttgacctt

SEQ ID NO: 1277882 - DNA, 15 bp, Homo sapiens
taccactaactcctg

SEQ ID NO: 1277883 - DNA, 19 bp, Homo sapiens
taccactaactcctgagaa

SEQ ID NO: 1277884 - DNA, 16 bp, Homo sapiens
taccactatttaagtt

SEQ ID NO: 1277885 - DNA, 16 bp, Homo sapiens
taccactctgtaattg

SEQ ID NO: 1277886 - DNA, 18 bp, Homo sapiens
taccactctgtaattgca

SEQ ID NO: 1277887 - DNA, 19 bp, Homo sapiens
taccactcttttgctgtgc

SEQ ID NO: 1277888 - DNA, 20 bp, Homo sapiens
taccactgctgatattttct

SEQ ID NO: 1277889 - DNA, 12 bp, Homo sapiens
taccactggtta

SEQ ID NO: 1277890 - DNA, 12 bp, Homo sapiens
taccacttctgt

SEQ ID NO: 1277891 - DNA, 15 bp, Homo sapiens
taccacttctgtggg

SEQ ID NO: 1277892 - DNA, 15 bp, Homo sapiens
taccacttgcctttt

SEQ ID NO: 1277893 - DNA, 17 bp, Homo sapiens
taccacttttgcaaata

SEQ ID NO: 1277894 - DNA, 15 bp, Homo sapiens
taccagacctcttct

SEQ ID NO: 1277895 - DNA, 20 bp, Homo sapiens
taccagagctctatccccat

SEQ ID NO: 1277896 - DNA, 12 bp, Homo sapiens
taccagatataa

SEQ ID NO: 1277897 - DNA, 22 bp, Homo sapiens
taccagatccttttccagaaat

SEQ ID NO: 1277898 - DNA, 15 bp, Homo sapiens
taccagatgctactg

SEQ ID NO: 1277899 - DNA, 16 bp, Homo sapiens
taccagatgctactgg

SEQ ID NO: 1277900 - DNA, 21 bp, Homo sapiens
taccagatgctactggacttg

SEQ ID NO: 1277901 - DNA, 14 bp, Homo sapiens
taccagcatttgtc

SEQ ID NO: 1277902 - DNA, 15 bp, Homo sapiens
taccagccagcctca

SEQ ID NO: 1277903 - DNA, 20 bp, Homo sapiens
taccagctcatacaaaataa

SEQ ID NO: 1277904 - DNA, 11 bp, Homo sapiens
taccagctcct

SEQ ID NO: 1277905 - DNA, 13 bp, Homo sapiens
taccagctcctcc

SEQ ID NO: 1277906 - DNA, 14 bp, Homo sapiens
taccagctcctcca

SEQ ID NO: 1277907 - DNA, 15 bp, Homo sapiens
taccagctcctccag

SEQ ID NO: 1277908 - DNA, 17 bp, Homo sapiens
taccaggcaccaaaaga

SEQ ID NO: 1277909 - DNA, 18 bp, Homo sapiens
taccaggcaccaaaagaa

SEQ ID NO: 1277910 - DNA, 14 bp, Homo sapiens
taccaggtgttcta

SEQ ID NO: 1277911 - DNA, 12 bp, Homo sapiens
taccagtattta

SEQ ID NO: 1277912 - DNA, 13 bp, Homo sapiens
taccagtctgatt

SEQ ID NO: 1277913 - DNA, 22 bp, Homo sapiens
taccagtctgattataccatgt

SEQ ID NO: 1277914 - DNA, 21 bp, Homo sapiens
taccagtctttaaaggcccag

SEQ ID NO: 1277915 - DNA, 15 bp, Homo sapiens
taccagtgaaccaaa

SEQ ID NO: 1277916 - DNA, 17 bp, Homo sapiens
taccagtgttgggtttt

SEQ ID NO: 1277917 - DNA, 15 bp, Homo sapiens
taccagttaattact

SEQ ID NO: 1277918 - DNA, 18 bp, Homo sapiens
taccagttaatttttcca

SEQ ID NO: 1277919 - DNA, 14 bp, Homo sapiens
taccataaagcctt

SEQ ID NO: 1277920 - DNA, 16 bp, Homo sapiens
taccataaagccttta

SEQ ID NO: 1277921 - DNA, 22 bp, Homo sapiens
taccataacaccgtcccagggc

SEQ ID NO: 1277922 - DNA, 20 bp, Homo sapiens
taccataagggactgtgcca

SEQ ID NO: 1277923 - DNA, 15 bp, Homo sapiens
taccataatgtattt

SEQ ID NO: 1277924 - DNA, 16 bp, Homo sapiens
taccatagaaaaatgt

SEQ ID NO: 1277925 - DNA, 17 bp, Homo sapiens
taccatagaaaaatgta

SEQ ID NO: 1277926 - DNA, 20 bp, Homo sapiens
taccataggaagacataaaa

SEQ ID NO: 1277927 - DNA, 20 bp, Homo sapiens
taccatagtaccatttatac

SEQ ID NO: 1277928 - DNA, 18 bp, Homo sapiens
taccatatgtctgcttct

SEQ ID NO: 1277929 - DNA, 19 bp, Homo sapiens
taccatatgtctgcttctg

SEQ ID NO: 1277930 - DNA, 20 bp, Homo sapiens
taccatatgtctgcttctgt

SEQ ID NO: 1277931 - DNA, 15 bp, Homo sapiens
taccatcaataaagt

SEQ ID NO: 1277932 - DNA, 16 bp, Homo sapiens
taccatcaataaagta

SEQ ID NO: 1277933 - DNA, 18 bp, Homo sapiens
taccatcagggacaggat

SEQ ID NO: 1277934 - DNA, 12 bp, Homo sapiens
taccatgctgct

SEQ ID NO: 1277935 - DNA, 13 bp, Homo sapiens
taccatgctgctt

SEQ ID NO: 1277936 - DNA, 18 bp, Homo sapiens
taccatgcttcacaatgt

SEQ ID NO: 1277937 - DNA, 15 bp, Homo sapiens
taccatgtaatggca

SEQ ID NO: 1277938 - DNA, 15 bp, Homo sapiens
taccatgtggatgca

SEQ ID NO: 1277939 - DNA, 12 bp, Homo sapiens
tactatttaaag

SEQ ID NO: 1277940 - DNA, 22 bp, Homo sapiens
tactatttaaagcctcctcatc

SEQ ID NO: 1277941 - DNA, 17 bp, Homo sapiens
tactcaaatgagtaaca

SEQ ID NO: 1277942 - DNA, 19 bp, Homo sapiens
tactcaaatggtgtcatgg

SEQ ID NO: 1277943 - DNA, 22 bp, Homo sapiens
tactcaacccattgttgtcaag

SEQ ID NO: 1277944 - DNA, 15 bp, Homo sapiens
tactcaagcccgcgg

SEQ ID NO: 1277945 - DNA, 15 bp, Homo sapiens
tactcactgaagcct

SEQ ID NO: 1277946 - DNA, 22 bp, Homo sapiens
tactcagaactgtcccatcccc

SEQ ID NO: 1277947 - DNA, 23 bp, Homo sapiens
tactcagaactgtcccatcccca

SEQ ID NO: 1277948 - DNA, 19 bp, Homo sapiens
tactcagaagcctgaggct

SEQ ID NO: 1277949 - DNA, 18 bp, Homo sapiens
tactcagcagccctcctc

SEQ ID NO: 1277950 - DNA, 19 bp, Homo sapiens
tactcagcagccctcctca

SEQ ID NO: 1277951 - DNA, 22 bp, Homo sapiens
tactcagccctgggccccacca

SEQ ID NO: 1277952 - DNA, 21 bp, Homo sapiens
tactcaggaggctgaggcagg

SEQ ID NO: 1277953 - DNA, 20 bp, Homo sapiens
tactcagggctcctcccagc

SEQ ID NO: 1277954 - DNA, 21 bp, Homo sapiens
tactcagggctcctcccagct

SEQ ID NO: 1277955 - DNA, 12 bp, Homo sapiens
tactcaggtttg

SEQ ID NO: 1277956 - DNA, 15 bp, Homo sapiens
tactcatgaatgaaa

SEQ ID NO: 1277957 - DNA, 16 bp, Homo sapiens
tactcatttttcatga

SEQ ID NO: 1277958 - DNA, 12 bp, Homo sapiens
tactccactgcc

SEQ ID NO: 1277959 - DNA, 20 bp, Homo sapiens
tactccactgccctggcagc

SEQ ID NO: 1277960 - DNA, 20 bp, Homo sapiens
tactccactggtctgtcttt

SEQ ID NO: 1277961 - DNA, 14 bp, Homo sapiens
tactccagtggtga

SEQ ID NO: 1277962 - DNA, 18 bp, Homo sapiens
tactcccccaccactcag

SEQ ID NO: 1277963 - DNA, 14 bp, Homo sapiens
tactcccctgggca

SEQ ID NO: 1277964 - DNA, 14 bp, Homo sapiens
tactccctcttcca

SEQ ID NO: 1277965 - DNA, 13 bp, Homo sapiens
tactccctgcacc

SEQ ID NO: 1277966 - DNA, 13 bp, Homo sapiens
tactcccttcctg

SEQ ID NO: 1277967 - DNA, 17 bp, Homo sapiens
tactcccttcctggcct

SEQ ID NO: 1277968 - DNA, 18 bp, Homo sapiens
tactcccttcctggcctc

SEQ ID NO: 1277969 - DNA, 20 bp, Homo sapiens
tactcccttctcgtgtttgc

SEQ ID NO: 1277970 - DNA, 21 bp, Homo sapiens
tactcccttctcgtgtttgct

SEQ ID NO: 1277971 - DNA, 16 bp, Homo sapiens
tactccgttcctggca

SEQ ID NO: 1277972 - DNA, 15 bp, Homo sapiens
tactcctacctcagc

SEQ ID NO: 1277973 - DNA, 20 bp, Homo sapiens
tactcctcacttttcaattt

SEQ ID NO: 1277974 - DNA, 15 bp, Homo sapiens
tactcctcccctctt

SEQ ID NO: 1277975 - DNA, 11 bp, Homo sapiens
tactcctcctc

SEQ ID NO: 1277976 - DNA, 19 bp, Homo sapiens
tactcctcctctttctctc

SEQ ID NO: 1277977 - DNA, 22 bp, Homo sapiens
tactcctcctctttctctcccc

SEQ ID NO: 1277978 - DNA, 14 bp, Homo sapiens
tactcctctgaccc

SEQ ID NO: 1277979 - DNA, 19 bp, Homo sapiens
tactcctctgaccctcctt

SEQ ID NO: 1277980 - DNA, 14 bp, Homo sapiens
tactcctctgcagt

SEQ ID NO: 1277981 - DNA, 21 bp, Homo sapiens
tactcctctgcagtgccttgg

SEQ ID NO: 1277982 - DNA, 17 bp, Homo sapiens
tactcctctttacactg

SEQ ID NO: 1277983 - DNA, 14 bp, Homo sapiens
tactcctgcaaaat

SEQ ID NO: 1277984 - DNA, 18 bp, Homo sapiens
tactcctgcggctgcctg

SEQ ID NO: 1277985 - DNA, 20 bp, Homo sapiens
tactcctggctcaagccctg

SEQ ID NO: 1277986 - DNA, 16 bp, Homo sapiens
tactcctggtttgatt

SEQ ID NO: 1277987 - DNA, 14 bp, Homo sapiens
tactccttaagaac

SEQ ID NO: 1277988 - DNA, 14 bp, Homo sapiens
tactcggcttcctg

SEQ ID NO: 1277989 - DNA, 16 bp, Homo sapiens
tactcggcttcctgtg

SEQ ID NO: 1277990 - DNA, 15 bp, Homo sapiens
tactcgggaggctga

SEQ ID NO: 1277991 - DNA, 22 bp, Homo sapiens
tactctaaaatggacattttct

SEQ ID NO: 1277992 - DNA, 22 bp, Homo sapiens
tactctacaattcctctgataa

SEQ ID NO: 1277993 - DNA, 23 bp, Homo sapiens
tactctacaattcctctgataat

SEQ ID NO: 1277994 - DNA, 22 bp, Homo sapiens
tactctaccctcttagaaaaac

SEQ ID NO: 1277995 - DNA, 20 bp, Homo sapiens
tactctagaacatgcacatt

SEQ ID NO: 1277996 - DNA, 22 bp, Homo sapiens
tactctagaacatgcacattta

SEQ ID NO: 1277997 - DNA, 14 bp, Homo sapiens
tactctagatgaag

SEQ ID NO: 1277998 - DNA, 17 bp, Homo sapiens
tactctagttctgttgt

SEQ ID NO: 1277999 - DNA, 22 bp, Homo sapiens
tactctagttctgttgttttgt

SEQ ID NO: 1278000 - DNA, 12 bp, Homo sapiens
tactctcctaga

SEQ ID NO: 1278001 - DNA, 19 bp, Homo sapiens
tactctcctcggccccctc

SEQ ID NO: 1278002 - DNA, 14 bp, Homo sapiens
tactctctgctcta

SEQ ID NO: 1278003 - DNA, 12 bp, Homo sapiens
tactctgaaggg

SEQ ID NO: 1278004 - DNA, 12 bp, Homo sapiens
tactctgagccc

SEQ ID NO: 1278005 - DNA, 13 bp, Homo sapiens
tactctgccaatc

SEQ ID NO: 1278006 - DNA, 22 bp, Homo sapiens
tactctgccgatctaattacag

SEQ ID NO: 1278007 - DNA, 21 bp, Homo sapiens
tactctggtggattgttctag

SEQ ID NO: 1278008 - DNA, 15 bp, Homo sapiens
tactctggttctttg

SEQ ID NO: 1278009 - DNA, 11 bp, Homo sapiens
tactctgtcca

SEQ ID NO: 1278010 - DNA, 13 bp, Homo sapiens
tactctgtccagg

SEQ ID NO: 1278011 - DNA, 14 bp, Homo sapiens
tactctgtccaggc

SEQ ID NO: 1278012 - DNA, 19 bp, Homo sapiens
tactctgtccatttatcca

SEQ ID NO: 1278013 - DNA, 16 bp, Homo sapiens
tactctgtctcccagg

SEQ ID NO: 1278014 - DNA, 13 bp, Homo sapiens
tactctgtgtaaa

SEQ ID NO: 1278015 - DNA, 15 bp, Homo sapiens
tactctgtgtttaaa

SEQ ID NO: 1278016 - DNA, 14 bp, Homo sapiens
tactctgttccttc

SEQ ID NO: 1278017 - DNA, 23 bp, Homo sapiens
tactcttacagagccttgagaga

SEQ ID NO: 1278018 - DNA, 18 bp, Homo sapiens
tactcttaggaagagaaa

SEQ ID NO: 1278019 - DNA, 17 bp, Homo sapiens
tactcttcctctaacat

SEQ ID NO: 1278020 - DNA, 19 bp, Homo sapiens
tactcttcctctaacattt

SEQ ID NO: 1278021 - DNA, 22 bp, Homo sapiens
tactcttcctctaacatttttg

SEQ ID NO: 1278022 - DNA, 15 bp, Homo sapiens
tactcttcctgtcct

SEQ ID NO: 1278023 - DNA, 16 bp, Homo sapiens
tactcttgaaaggcca

SEQ ID NO: 1278024 - DNA, 19 bp, Homo sapiens
tactcttgatgtgaagata

SEQ ID NO: 1278025 - DNA, 13 bp, Homo sapiens
tactcttgctgat

SEQ ID NO: 1278026 - DNA, 22 bp, Homo sapiens
tactcttgtcatttttaatatt

SEQ ID NO: 1278027 - DNA, 18 bp, Homo sapiens
tactctttcaataaatgt

SEQ ID NO: 1278028 - DNA, 17 bp, Homo sapiens
tactctttgagatagaa

SEQ ID NO: 1278029 - DNA, 20 bp, Homo sapiens
tactctttttctaaagtgtt

SEQ ID NO: 1278030 - DNA, 20 bp, Homo sapiens
tactgaaagatctctgtcac

SEQ ID NO: 1278031 - DNA, 22 bp, Homo sapiens
tactgaacaatcaaagcacttg

SEQ ID NO: 1278032 - DNA, 21 bp, Homo sapiens
tactgaacacatgtgtatgat

SEQ ID NO: 1278033 - DNA, 19 bp, Homo sapiens
tactgaacatctgagtcct

SEQ ID NO: 1278034 - DNA, 17 bp, Homo sapiens
tactgaaggtaaaattg

SEQ ID NO: 1278035 - DNA, 15 bp, Homo sapiens
tactgaagtggctgg

SEQ ID NO: 1278036 - DNA, 18 bp, Homo sapiens
tactgaatttttttgtaa

SEQ ID NO: 1278037 - DNA, 15 bp, Homo sapiens
tactgacaacattat

SEQ ID NO: 1278038 - DNA, 17 bp, Homo sapiens
tactgacacttcctgtc

SEQ ID NO: 1278039 - DNA, 23 bp, Homo sapiens
tactgacactttgccagaaagca

SEQ ID NO: 1278040 - DNA, 18 bp, Homo sapiens
tactgacagggagcagcc

SEQ ID NO: 1278041 - DNA, 22 bp, Homo sapiens
tactgacatgtggggccaggtc

SEQ ID NO: 1278042 - DNA, 22 bp, Homo sapiens
tactgacttcagtgggactcgg

SEQ ID NO: 1278043 - DNA, 16 bp, Homo sapiens
tactgactttctgatt

SEQ ID NO: 1278044 - DNA, 16 bp, Homo sapiens
tactgactttgcttgc

SEQ ID NO: 1278045 - DNA, 18 bp, Homo sapiens
tactgactttgcttgctt

SEQ ID NO: 1278046 - DNA, 22 bp, Homo sapiens
tactgactttgcttgctttgaa

SEQ ID NO: 1278047 - DNA, 18 bp, Homo sapiens
tactgagacttgttcttg

SEQ ID NO: 1278048 - DNA, 21 bp, Homo sapiens
tactgagacttgttcttggtt

SEQ ID NO: 1278049 - DNA, 16 bp, Homo sapiens
tactgagatgctgggc

SEQ ID NO: 1278050 - DNA, 21 bp, Homo sapiens
tactgagcatttgcacctctg

SEQ ID NO: 1278051 - DNA, 22 bp, Homo sapiens
tactgagcatttgcacctctgt

SEQ ID NO: 1278052 - DNA, 11 bp, Homo sapiens
tactgagcctg

SEQ ID NO: 1278053 - DNA, 15 bp, Homo sapiens
tactgagccttgtaa

SEQ ID NO: 1278054 - DNA, 18 bp, Homo sapiens
tactgagccttgtaattc

SEQ ID NO: 1278055 - DNA, 18 bp, Homo sapiens
tactgagcttctctgtga

SEQ ID NO: 1278056 - DNA, 22 bp, Homo sapiens
tactgaggcctaaaagtaaaca

SEQ ID NO: 1278057 - DNA, 19 bp, Homo sapiens
tactgaggggattctctac

SEQ ID NO: 1278058 - DNA, 16 bp, Homo sapiens
tactgagtaaacccta

SEQ ID NO: 1278059 - DNA, 16 bp, Homo sapiens
tactgataaagaaaga

SEQ ID NO: 1278060 - DNA, 15 bp, Homo sapiens
tactgatgaaatctg

SEQ ID NO: 1278061 - DNA, 16 bp, Homo sapiens
tagaactcactctggg

SEQ ID NO: 1278062 - DNA, 14 bp, Homo sapiens
tagaactcagcagt

SEQ ID NO: 1278063 - DNA, 16 bp, Homo sapiens
tagaactccaggccct

SEQ ID NO: 1278064 - DNA, 16 bp, Homo sapiens
tagaactgtctgtgaa

SEQ ID NO: 1278065 - DNA, 23 bp, Homo sapiens
tagaacttcaagaagtaagagct

SEQ ID NO: 1278066 - DNA, 15 bp, Homo sapiens
tagaacttcatggat

SEQ ID NO: 1278067 - DNA, 21 bp, Homo sapiens
tagaacttcatggatcagatc

SEQ ID NO: 1278068 - DNA, 15 bp, Homo sapiens
tagaacttgcctttt

SEQ ID NO: 1278069 - DNA, 20 bp, Homo sapiens
tagaactttattaagtaaaa

SEQ ID NO: 1278070 - DNA, 21 bp, Homo sapiens
tagaactttctgctttgcaca

SEQ ID NO: 1278071 - DNA, 12 bp, Homo sapiens
tagaagaaaagc

SEQ ID NO: 1278072 - DNA, 16 bp, Homo sapiens
tagaagaaagatgttt

SEQ ID NO: 1278073 - DNA, 18 bp, Homo sapiens
tagaagaacatccaagga

SEQ ID NO: 1278074 - DNA, 22 bp, Homo sapiens
tagaagaacatccaaggagaaa

SEQ ID NO: 1278075 - DNA, 20 bp, Homo sapiens
tagaagaaccaaatacctca

SEQ ID NO: 1278076 - DNA, 21 bp, Homo sapiens
tagaagaaccaaatacctcaa

SEQ ID NO: 1278077 - DNA, 12 bp, Homo sapiens
tagaagaactgc

SEQ ID NO: 1278078 - DNA, 18 bp, Homo sapiens
tagaagacaaaatgttca

SEQ ID NO: 1278079 - DNA, 13 bp, Homo sapiens
tagaagacattta

SEQ ID NO: 1278080 - DNA, 14 bp, Homo sapiens
tagaagagagaggt

SEQ ID NO: 1278081 - DNA, 22 bp, Homo sapiens
tagaagagagaggttgaaaaac

SEQ ID NO: 1278082 - DNA, 22 bp, Homo sapiens
tagaagaggtagtgtgaatatt

SEQ ID NO: 1278083 - DNA, 22 bp, Homo sapiens
tagaagatagcatgggaggtga

SEQ ID NO: 1278084 - DNA, 19 bp, Homo sapiens
tagaagatggactctgaaa

SEQ ID NO: 1278085 - DNA, 22 bp, Homo sapiens
tagaagatgtgtaaacaggtat

SEQ ID NO: 1278086 - DNA, 21 bp, Homo sapiens
tagaagcatttgatattatct

SEQ ID NO: 1278087 - DNA, 24 bp, Homo sapiens
tagaagcgatttaagttacaatgt

SEQ ID NO: 1278088 - DNA, 14 bp, Homo sapiens
tagaagctcttgga

SEQ ID NO: 1278089 - DNA, 16 bp, Homo sapiens
tagaagctgtagtagc

SEQ ID NO: 1278090 - DNA, 21 bp, Homo sapiens
tagaaggaaagcatgtctctg

SEQ ID NO: 1278091 - DNA, 15 bp, Homo sapiens
tagaaggaatttgta

SEQ ID NO: 1278092 - DNA, 16 bp, Homo sapiens
tagaaggaatttgtac

SEQ ID NO: 1278093 - DNA, 21 bp, Homo sapiens
tagaaggatgtacatttccaa

SEQ ID NO: 1278094 - DNA, 14 bp, Homo sapiens
tagaaggctgtctt

SEQ ID NO: 1278095 - DNA, 17 bp, Homo sapiens
tagaaggcttaagaact

SEQ ID NO: 1278096 - DNA, 19 bp, Homo sapiens
tagaaggttgacacagttg

SEQ ID NO: 1278097 - DNA, 21 bp, Homo sapiens
tagaagtctgtctttctatag

SEQ ID NO: 1278098 - DNA, 22 bp, Homo sapiens
tagaagtctgtctttctataga

SEQ ID NO: 1278099 - DNA, 17 bp, Homo sapiens
tagaagtcttagatgta

SEQ ID NO: 1278100 - DNA, 20 bp, Homo sapiens
tagaagtcttagatgtatat

SEQ ID NO: 1278101 - DNA, 17 bp, Homo sapiens
tagaagtgagagaaaaa

SEQ ID NO: 1278102 - DNA, 20 bp, Homo sapiens
tagaagtgagtttgtaaata

SEQ ID NO: 1278103 - DNA, 16 bp, Homo sapiens
tagaagtggaccagga

SEQ ID NO: 1278104 - DNA, 18 bp, Homo sapiens
tagaagtggaccaggaca

SEQ ID NO: 1278105 - DNA, 16 bp, Homo sapiens
tagaagtgggccagga

SEQ ID NO: 1278106 - DNA, 19 bp, Homo sapiens
tagaagtgggccaggacag

SEQ ID NO: 1278107 - DNA, 20 bp, Homo sapiens
tagaagtgggccaggacagg

SEQ ID NO: 1278108 - DNA, 23 bp, Homo sapiens
tagaataaaagctataaagtata

SEQ ID NO: 1278109 - DNA, 15 bp, Homo sapiens
tagaataaatggttt

SEQ ID NO: 1278110 - DNA, 17 bp, Homo sapiens
tagaataagaatttgca

SEQ ID NO: 1278111 - DNA, 18 bp, Homo sapiens
tagaataagaatttgcat

SEQ ID NO: 1278112 - DNA, 16 bp, Homo sapiens
tagaataatctattat

SEQ ID NO: 1278113 - DNA, 14 bp, Homo sapiens
tagaataattcttt

SEQ ID NO: 1278114 - DNA, 18 bp, Homo sapiens
tagaatactttttaaaag

SEQ ID NO: 1278115 - DNA, 21 bp, Homo sapiens
tagaatacttttttctagttt

SEQ ID NO: 1278116 - DNA, 22 bp, Homo sapiens
tagaataggcactttaaaacac

SEQ ID NO: 1278117 - DNA, 15 bp, Homo sapiens
tagaatataggtctc

SEQ ID NO: 1278118 - DNA, 16 bp, Homo sapiens
tagaatataggtctct

SEQ ID NO: 1278119 - DNA, 19 bp, Homo sapiens
tagaatataggtctcttct

SEQ ID NO: 1278120 - DNA, 21 bp, Homo sapiens
tagaatataggtctcttctcc

SEQ ID NO: 1278121 - DNA, 12 bp, Homo sapiens
tagaatatttat

SEQ ID NO: 1278122 - DNA, 21 bp, Homo sapiens
tagaatcagcctaggggtcag

SEQ ID NO: 1278123 - DNA, 17 bp, Homo sapiens
tagaatgaaaactcatt

SEQ ID NO: 1278124 - DNA, 20 bp, Homo sapiens
tagaatgaagaactgcatgt

SEQ ID NO: 1278125 - DNA, 16 bp, Homo sapiens
tagaatgattaatcaa

SEQ ID NO: 1278126 - DNA, 20 bp, Homo sapiens
tagaatgcatctcatcaact

SEQ ID NO: 1278127 - DNA, 21 bp, Homo sapiens
tagaatgtcagatttctggtt

SEQ ID NO: 1278128 - DNA, 10 bp, Homo sapiens
tagaatgtgg

SEQ ID NO: 1278129 - DNA, 16 bp, Homo sapiens
tagaattaccatttgt

SEQ ID NO: 1278130 - DNA, 22 bp, Homo sapiens
tagaattatctaatttataaaa

SEQ ID NO: 1278131 - DNA, 23 bp, Homo sapiens
tagaattatctaatttataaaaa

SEQ ID NO: 1278132 - DNA, 22 bp, Homo sapiens
tagaattatttttcactctaag

SEQ ID NO: 1278133 - DNA, 14 bp, Homo sapiens
tagaattcttttat

SEQ ID NO: 1278134 - DNA, 13 bp, Homo sapiens
tagaattgaaaat

SEQ ID NO: 1278135 - DNA, 19 bp, Homo sapiens
tagaattgacattgaaatc

SEQ ID NO: 1278136 - DNA, 21 bp, Homo sapiens
tagaattgacattgaaatcta

SEQ ID NO: 1278137 - DNA, 17 bp, Homo sapiens
tagaattgagtgtttaa

SEQ ID NO: 1278138 - DNA, 16 bp, Homo sapiens
tagaattgcaggtctc

SEQ ID NO: 1278139 - DNA, 22 bp, Homo sapiens
tagaattgggaagctgggggaa

SEQ ID NO: 1278140 - DNA, 13 bp, Homo sapiens
tagaattgtatat

SEQ ID NO: 1278141 - DNA, 19 bp, Homo sapiens
tagaattttgagtattcca

SEQ ID NO: 1278142 - DNA, 18 bp, Homo sapiens
tagaattttgggtattgt

SEQ ID NO: 1278143 - DNA, 14 bp, Homo sapiens
tagaatttttaaca

SEQ ID NO: 1278144 - DNA, 15 bp, Homo sapiens
tagaatttttaccca

SEQ ID NO: 1278145 - DNA, 14 bp, Homo sapiens
tagacaaaaagtat

SEQ ID NO: 1278146 - DNA, 16 bp, Homo sapiens
tagacaaaaagtatat

SEQ ID NO: 1278147 - DNA, 19 bp, Homo sapiens
tagacaaatagaaaatggt

SEQ ID NO: 1278148 - DNA, 15 bp, Homo sapiens
tagacaaccctgcaa

SEQ ID NO: 1278149 - DNA, 15 bp, Homo sapiens
tagacaacctttctg

SEQ ID NO: 1278150 - DNA, 21 bp, Homo sapiens
tagacaacgatgaatttcttc

SEQ ID NO: 1278151 - DNA, 15 bp, Homo sapiens
tagacaactagattt

SEQ ID NO: 1278152 - DNA, 14 bp, Homo sapiens
tagacaatatacaa

SEQ ID NO: 1278153 - DNA, 15 bp, Homo sapiens
tagacaattgaggta

SEQ ID NO: 1278154 - DNA, 16 bp, Homo sapiens
tagacaatttattatg

SEQ ID NO: 1278155 - DNA, 19 bp, Homo sapiens
tagacacatatgaggggga

SEQ ID NO: 1278156 - DNA, 21 bp, Homo sapiens
tagacactccccgaagtcttt

SEQ ID NO: 1278157 - DNA, 14 bp, Homo sapiens
tagacactggacat

SEQ ID NO: 1278158 - DNA, 23 bp, Homo sapiens
tagacactttggaatctaaccac

SEQ ID NO: 1278159 - DNA, 12 bp, Homo sapiens
tagacagaagaa

SEQ ID NO: 1278160 - DNA, 19 bp, Homo sapiens
tagacagtaaaatactatt

SEQ ID NO: 1278161 - DNA, 22 bp, Homo sapiens
tagacagtattgccacctctgg

SEQ ID NO: 1278162 - DNA, 18 bp, Homo sapiens
tagacagtctcactttgt

SEQ ID NO: 1278163 - DNA, 20 bp, Homo sapiens
tagacatcaatcctggtaac

SEQ ID NO: 1278164 - DNA, 21 bp, Homo sapiens
tagacatcaatcctggtaacc

SEQ ID NO: 1278165 - DNA, 19 bp, Homo sapiens
tagacatgcccaaaactta

SEQ ID NO: 1278166 - DNA, 13 bp, Homo sapiens
tagacattatgtg

SEQ ID NO: 1278167 - DNA, 18 bp, Homo sapiens
tagacatttcaaaattaa

SEQ ID NO: 1278168 - DNA, 23 bp, Homo sapiens
tagacatttcaaaattaatagct

SEQ ID NO: 1278169 - DNA, 19 bp, Homo sapiens
tagacatttgtaaatgtaa

SEQ ID NO: 1278170 - DNA, 13 bp, Homo sapiens
tagaccaaagcaa

SEQ ID NO: 1278171 - DNA, 17 bp, Homo sapiens
tagaccagtttgcatga

SEQ ID NO: 1278172 - DNA, 20 bp, Homo sapiens
tagacccactggactcacct

SEQ ID NO: 1278173 - DNA, 19 bp, Homo sapiens
tagacccatagcagctttg

SEQ ID NO: 1278174 - DNA, 18 bp, Homo sapiens
tagaccccatacaagttt

SEQ ID NO: 1278175 - DNA, 12 bp, Homo sapiens
tagaccctgggt

SEQ ID NO: 1278176 - DNA, 19 bp, Homo sapiens
tagacctagggaggacctt

SEQ ID NO: 1278177 - DNA, 14 bp, Homo sapiens
tagacctatactga

SEQ ID NO: 1278178 - DNA, 11 bp, Homo sapiens
tagacctcagc

SEQ ID NO: 1278179 - DNA, 12 bp, Homo sapiens
tagacctcagcc

SEQ ID NO: 1278180 - DNA, 15 bp, Homo sapiens
tagacctcagcctgt

SEQ ID NO: 1278181 - DNA, 14 bp, Homo sapiens
tagaccttgagggt

SEQ ID NO: 1278182 - DNA, 21 bp, Homo sapiens
tagcaattttctttgtttctt

SEQ ID NO: 1278183 - DNA, 13 bp, Homo sapiens
tagcacagagagg

SEQ ID NO: 1278184 - DNA, 22 bp, Homo sapiens
tagcacagtaaaagtaaagact

SEQ ID NO: 1278185 - DNA, 22 bp, Homo sapiens
tagcacatgtctgtcctcagag

SEQ ID NO: 1278186 - DNA, 13 bp, Homo sapiens
tagcaccatggca

SEQ ID NO: 1278187 - DNA, 21 bp, Homo sapiens
tagcacgctgcctgccaaagt

SEQ ID NO: 1278188 - DNA, 17 bp, Homo sapiens
tagcactatttaaaata

SEQ ID NO: 1278189 - DNA, 21 bp, Homo sapiens
tagcactcctcaagactttga

SEQ ID NO: 1278190 - DNA, 16 bp, Homo sapiens
tagcactgagctcaca

SEQ ID NO: 1278191 - DNA, 11 bp, Homo sapiens
tagcactgagg

SEQ ID NO: 1278192 - DNA, 16 bp, Homo sapiens
tagcactgttgatgta

SEQ ID NO: 1278193 - DNA, 23 bp, Homo sapiens
tagcactgttgatgtatctgagt

SEQ ID NO: 1278194 - DNA, 19 bp, Homo sapiens
tagcacttaaattcctcaa

SEQ ID NO: 1278195 - DNA, 17 bp, Homo sapiens
tagcacttatgttactg

SEQ ID NO: 1278196 - DNA, 13 bp, Homo sapiens
tagcagacagaaa

SEQ ID NO: 1278197 - DNA, 20 bp, Homo sapiens
tagcagacagaaactggatt

SEQ ID NO: 1278198 - DNA, 21 bp, Homo sapiens
tagcagactttcccaaatgta

SEQ ID NO: 1278199 - DNA, 23 bp, Homo sapiens
tagcagactttcccaaatgtatt

SEQ ID NO: 1278200 - DNA, 23 bp, Homo sapiens
tagcagagtccttattcttctca

SEQ ID NO: 1278201 - DNA, 11 bp, Homo sapiens
tagcagagtct

SEQ ID NO: 1278202 - DNA, 14 bp, Homo sapiens
tagcagagtctgtc

SEQ ID NO: 1278203 - DNA, 15 bp, Homo sapiens
tagcagagtctgtct

SEQ ID NO: 1278204 - DNA, 17 bp, Homo sapiens
tagcagagtctgtctct

SEQ ID NO: 1278205 - DNA, 14 bp, Homo sapiens
tagcagagttaaat

SEQ ID NO: 1278206 - DNA, 14 bp, Homo sapiens
tagcagatggtttc

SEQ ID NO: 1278207 - DNA, 23 bp, Homo sapiens
tagcagcccttgtgtgtgccctg

SEQ ID NO: 1278208 - DNA, 16 bp, Homo sapiens
tagcagcctttctctc

SEQ ID NO: 1278209 - DNA, 22 bp, Homo sapiens
tagcagcggaacaaggagtcag

SEQ ID NO: 1278210 - DNA, 12 bp, Homo sapiens
tagcagctggac

SEQ ID NO: 1278211 - DNA, 12 bp, Homo sapiens
tagcagctggcc

SEQ ID NO: 1278212 - DNA, 23 bp, Homo sapiens
tagcagctggcctaatcactctg

SEQ ID NO: 1278213 - DNA, 14 bp, Homo sapiens
tagcagcttccaga

SEQ ID NO: 1278214 - DNA, 15 bp, Homo sapiens
tagcagcttccagat

SEQ ID NO: 1278215 - DNA, 14 bp, Homo sapiens
tagcaggcccccta

SEQ ID NO: 1278216 - DNA, 17 bp, Homo sapiens
tagcaggccccctagga

SEQ ID NO: 1278217 - DNA, 12 bp, Homo sapiens
tagcaggctgtt

SEQ ID NO: 1278218 - DNA, 16 bp, Homo sapiens
tagcaggctgttccat

SEQ ID NO: 1278219 - DNA, 20 bp, Homo sapiens
tagcagtaaaagatgaagtt

SEQ ID NO: 1278220 - DNA, 20 bp, Homo sapiens
tagcagtgtgctttgcattt

SEQ ID NO: 1278221 - DNA, 20 bp, Homo sapiens
tagcagttctgcaaatagaa

SEQ ID NO: 1278222 - DNA, 20 bp, Homo sapiens
tagcagttgctcacatgtct

SEQ ID NO: 1278223 - DNA, 13 bp, Homo sapiens
tagcataaataaa

SEQ ID NO: 1278224 - DNA, 16 bp, Homo sapiens
tagcataaataaaact

SEQ ID NO: 1278225 - DNA, 18 bp, Homo sapiens
tagcataaataaaactga

SEQ ID NO: 1278226 - DNA, 14 bp, Homo sapiens
tagcataatatgaa

SEQ ID NO: 1278227 - DNA, 19 bp, Homo sapiens
tagcatacgtacacatttt

SEQ ID NO: 1278228 - DNA, 19 bp, Homo sapiens
tagcatattcatggttgtt

SEQ ID NO: 1278229 - DNA, 22 bp, Homo sapiens
tagcatcttctggagtctccag

SEQ ID NO: 1278230 - DNA, 16 bp, Homo sapiens
tagcatgaaataaaat

SEQ ID NO: 1278231 - DNA, 22 bp, Homo sapiens
tagcatgacaagccccaggcag

SEQ ID NO: 1278232 - DNA, 14 bp, Homo sapiens
tagcatgacaggct

SEQ ID NO: 1278233 - DNA, 21 bp, Homo sapiens
tagcatgcaagcttggtcaaa

SEQ ID NO: 1278234 - DNA, 23 bp, Homo sapiens
tagcatgcaagcttggtcaaact

SEQ ID NO: 1278235 - DNA, 14 bp, Homo sapiens
tagcatgcttcctt

SEQ ID NO: 1278236 - DNA, 16 bp, Homo sapiens
tagcatgcttcctttc

SEQ ID NO: 1278237 - DNA, 21 bp, Homo sapiens
tagcatgcttcctttctctcc

SEQ ID NO: 1278238 - DNA, 19 bp, Homo sapiens
tagcatggggtcagcccca

SEQ ID NO: 1278239 - DNA, 20 bp, Homo sapiens
tagcatgtactctgttgagt

SEQ ID NO: 1278240 - DNA, 21 bp, Homo sapiens
tagcatgtgtttggttctggg

SEQ ID NO: 1278241 - DNA, 22 bp, Homo sapiens
tagcatgtgtttggttctgggg

SEQ ID NO: 1278242 - DNA, 16 bp, Homo sapiens
tagcattcctcaggaa

SEQ ID NO: 1278243 - DNA, 18 bp, Homo sapiens
tagcattgaacatttctt

SEQ ID NO: 1278244 - DNA, 19 bp, Homo sapiens
tagcattgaacatttctta

SEQ ID NO: 1278245 - DNA, 17 bp, Homo sapiens
tagcattgataatcttc

SEQ ID NO: 1278246 - DNA, 18 bp, Homo sapiens
tagcattgataatcttca

SEQ ID NO: 1278247 - DNA, 20 bp, Homo sapiens
tagcattgataatcttcagg

SEQ ID NO: 1278248 - DNA, 18 bp, Homo sapiens
tagcattgtaaaagcatt

SEQ ID NO: 1278249 - DNA, 19 bp, Homo sapiens
tagcattgtaaaagcattt

SEQ ID NO: 1278250 - DNA, 14 bp, Homo sapiens
tagcattgttccac

SEQ ID NO: 1278251 - DNA, 16 bp, Homo sapiens
tagcattgttccacac

SEQ ID NO: 1278252 - DNA, 19 bp, Homo sapiens
tagcatttaaaatggaaaa

SEQ ID NO: 1278253 - DNA, 13 bp, Homo sapiens
tagcatttcttga

SEQ ID NO: 1278254 - DNA, 16 bp, Homo sapiens
tagcattttcttgaac

SEQ ID NO: 1278255 - DNA, 18 bp, Homo sapiens
tagcatttttattcatgc

SEQ ID NO: 1278256 - DNA, 16 bp, Homo sapiens
tagccaaaaatagcta

SEQ ID NO: 1278257 - DNA, 21 bp, Homo sapiens
tagccaaaaatagctaaatac

SEQ ID NO: 1278258 - DNA, 19 bp, Homo sapiens
tagccaagccctaagcctg

SEQ ID NO: 1278259 - DNA, 17 bp, Homo sapiens
tagccaagttatattga

SEQ ID NO: 1278260 - DNA, 14 bp, Homo sapiens
tagccaatgtggga

SEQ ID NO: 1278261 - DNA, 20 bp, Homo sapiens
tagccacatttggaatactt

SEQ ID NO: 1278262 - DNA, 14 bp, Homo sapiens
tagccactcaggag

SEQ ID NO: 1278263 - DNA, 14 bp, Homo sapiens
tagccactccctcc

SEQ ID NO: 1278264 - DNA, 16 bp, Homo sapiens
tagccactccctccca

SEQ ID NO: 1278265 - DNA, 21 bp, Homo sapiens
tagccagacaaaatttgagaa

SEQ ID NO: 1278266 - DNA, 14 bp, Homo sapiens
tagccagacactct

SEQ ID NO: 1278267 - DNA, 16 bp, Homo sapiens
tagccagacactctgc

SEQ ID NO: 1278268 - DNA, 17 bp, Homo sapiens
tagccagagggtgggag

SEQ ID NO: 1278269 - DNA, 20 bp, Homo sapiens
tagccagagggtgggagcct

SEQ ID NO: 1278270 - DNA, 21 bp, Homo sapiens
tagccagagggtgggagccta

SEQ ID NO: 1278271 - DNA, 15 bp, Homo sapiens
tagccagatttgtct

SEQ ID NO: 1278272 - DNA, 19 bp, Homo sapiens
tagccagcacacagggcag

SEQ ID NO: 1278273 - DNA, 18 bp, Homo sapiens
tagccagcccctcttccc

SEQ ID NO: 1278274 - DNA, 13 bp, Homo sapiens
tagccagctgtca

SEQ ID NO: 1278275 - DNA, 20 bp, Homo sapiens
tagccaggagtctgtgctct

SEQ ID NO: 1278276 - DNA, 22 bp, Homo sapiens
tagccagggtgtggccctgcca

SEQ ID NO: 1278277 - DNA, 16 bp, Homo sapiens
tagccaggtactgcat

SEQ ID NO: 1278278 - DNA, 14 bp, Homo sapiens
tagccagtgacttt

SEQ ID NO: 1278279 - DNA, 22 bp, Homo sapiens
tagccagttcaaagtgtatatt

SEQ ID NO: 1278280 - DNA, 14 bp, Homo sapiens
tagccataataaaa

SEQ ID NO: 1278281 - DNA, 14 bp, Homo sapiens
tagccatggctcag

SEQ ID NO: 1278282 - DNA, 15 bp, Homo sapiens
tagccatggctcagg

SEQ ID NO: 1278283 - DNA, 23 bp, Homo sapiens
tagccatggctcaggcaagcccc

SEQ ID NO: 1278284 - DNA, 18 bp, Homo sapiens
tagccattcctggtaccc

SEQ ID NO: 1278285 - DNA, 22 bp, Homo sapiens
tagccattcctggtacccagcc

SEQ ID NO: 1278286 - DNA, 13 bp, Homo sapiens
tagccattgaaat

SEQ ID NO: 1278287 - DNA, 19 bp, Homo sapiens
tagccatttctccatgggc

SEQ ID NO: 1278288 - DNA, 18 bp, Homo sapiens
tagccatttttcaaagca

SEQ ID NO: 1278289 - DNA, 20 bp, Homo sapiens
tagccatttttcaaagcaat

SEQ ID NO: 1278290 - DNA, 22 bp, Homo sapiens
tagccatttttcaaagcaattg

SEQ ID NO: 1278291 - DNA, 15 bp, Homo sapiens
tagcccaagaggtct

SEQ ID NO: 1278292 - DNA, 20 bp, Homo sapiens
tagcccaagaggtctgagcc

SEQ ID NO: 1278293 - DNA, 15 bp, Homo sapiens
tagcccactccctgc

SEQ ID NO: 1278294 - DNA, 12 bp, Homo sapiens
tagcccaggagc

SEQ ID NO: 1278295 - DNA, 21 bp, Homo sapiens
tagcccaggagcaacagccta

SEQ ID NO: 1278296 - DNA, 13 bp, Homo sapiens
tagccccaaatct

SEQ ID NO: 1278297 - DNA, 12 bp, Homo sapiens
tagccccagact

SEQ ID NO: 1278298 - DNA, 19 bp, Homo sapiens
tagccccaggtcttttctt

SEQ ID NO: 1278299 - DNA, 13 bp, Homo sapiens
tagccccagtgac

SEQ ID NO: 1278300 - DNA, 18 bp, Homo sapiens
tagcccccaggctgctgg

SEQ ID NO: 1278301 - DNA, 19 bp, Homo sapiens
tagcccccaggctgctgga

SEQ ID NO: 1278302 - DNA, 16 bp, Homo sapiens
tagccccgccccagcc

SEQ ID NO: 1278303 - DNA, 19 bp, Homo sapiens
tagccccgccccagccctc

SEQ ID NO: 1278304 - DNA, 23 bp, Homo sapiens
taggatgcggctttctctgcctc

SEQ ID NO: 1278305 - DNA, 15 bp, Homo sapiens
taggatgtctgtaat

SEQ ID NO: 1278306 - DNA, 13 bp, Homo sapiens
taggatgtttttc

SEQ ID NO: 1278307 - DNA, 18 bp, Homo sapiens
taggatgtttttcatgaa

SEQ ID NO: 1278308 - DNA, 19 bp, Homo sapiens
taggatgtttttcatgaaa

SEQ ID NO: 1278309 - DNA, 22 bp, Homo sapiens
taggattattgaaagagtctgg

SEQ ID NO: 1278310 - DNA, 13 bp, Homo sapiens
taggattgctggg

SEQ ID NO: 1278311 - DNA, 22 bp, Homo sapiens
taggattgcttcaattaaaatt

SEQ ID NO: 1278312 - DNA, 17 bp, Homo sapiens
taggatttatgtatttt

SEQ ID NO: 1278313 - DNA, 15 bp, Homo sapiens
taggatttttttcct

SEQ ID NO: 1278314 - DNA, 18 bp, Homo sapiens
taggcactcttaaatgat

SEQ ID NO: 1278315 - DNA, 11 bp, Homo sapiens
taggcagacac

SEQ ID NO: 1278316 - DNA, 12 bp, Homo sapiens
taggcagacaca

SEQ ID NO: 1278317 - DNA, 14 bp, Homo sapiens
taggcagacacagg

SEQ ID NO: 1278318 - DNA, 13 bp, Homo sapiens
taggcagaggctg

SEQ ID NO: 1278319 - DNA, 14 bp, Homo sapiens
taggcagcagagag

SEQ ID NO: 1278320 - DNA, 12 bp, Homo sapiens
taggcagcctct

SEQ ID NO: 1278321 - DNA, 16 bp, Homo sapiens
taggcagcctgcaggg

SEQ ID NO: 1278322 - DNA, 18 bp, Homo sapiens
taggcaggaacatacaga

SEQ ID NO: 1278323 - DNA, 19 bp, Homo sapiens
taggcataaattaaaatgt

SEQ ID NO: 1278324 - DNA, 14 bp, Homo sapiens
taggcatcccaggg

SEQ ID NO: 1278325 - DNA, 19 bp, Homo sapiens
taggcatcccaggggacca

SEQ ID NO: 1278326 - DNA, 17 bp, Homo sapiens
taggcatctctgtactt

SEQ ID NO: 1278327 - DNA, 14 bp, Homo sapiens
taggcatgtaaaca

SEQ ID NO: 1278328 - DNA, 13 bp, Homo sapiens
taggcattattta

SEQ ID NO: 1278329 - DNA, 23 bp, Homo sapiens
taggcatttcattatgctttgaa

SEQ ID NO: 1278330 - DNA, 12 bp, Homo sapiens
taggcatttcct

SEQ ID NO: 1278331 - DNA, 15 bp, Homo sapiens
taggcatttcctgct

SEQ ID NO: 1278332 - DNA, 20 bp, Homo sapiens
taggcatttcctgctgaacg

SEQ ID NO: 1278333 - DNA, 20 bp, Homo sapiens
taggcatttgctgaatacag

SEQ ID NO: 1278334 - DNA, 22 bp, Homo sapiens
taggccaccattataatttata

SEQ ID NO: 1278335 - DNA, 14 bp, Homo sapiens
taggccactcctcc

SEQ ID NO: 1278336 - DNA, 16 bp, Homo sapiens
taggccagagccatgc

SEQ ID NO: 1278337 - DNA, 20 bp, Homo sapiens
taggccagggcatgtgtatg

SEQ ID NO: 1278338 - DNA, 17 bp, Homo sapiens
taggccatctgtaaata

SEQ ID NO: 1278339 - DNA, 21 bp, Homo sapiens
taggccatctgtaaatatccc

SEQ ID NO: 1278340 - DNA, 19 bp, Homo sapiens
taggcccaggcctgggttt

SEQ ID NO: 1278341 - DNA, 21 bp, Homo sapiens
taggccccccagaaagctgcc

SEQ ID NO: 1278342 - DNA, 18 bp, Homo sapiens
taggcccttgtcctgcca

SEQ ID NO: 1278343 - DNA, 23 bp, Homo sapiens
taggcccttgtcctgccagctgc

SEQ ID NO: 1278344 - DNA, 22 bp, Homo sapiens
taggcctactggggatcagagt

SEQ ID NO: 1278345 - DNA, 16 bp, Homo sapiens
taggcctcagccagag

SEQ ID NO: 1278346 - DNA, 15 bp, Homo sapiens
taggcctcatttctt

SEQ ID NO: 1278347 - DNA, 22 bp, Homo sapiens
taggcctcatttctttgtcttt

SEQ ID NO: 1278348 - DNA, 15 bp, Homo sapiens
taggcctctctgcct

SEQ ID NO: 1278349 - DNA, 13 bp, Homo sapiens
taggcctgggtgc

SEQ ID NO: 1278350 - DNA, 16 bp, Homo sapiens
taggcctgggtgctgg

SEQ ID NO: 1278351 - DNA, 22 bp, Homo sapiens
taggcctgtgaggtaactggga

SEQ ID NO: 1278352 - DNA, 14 bp, Homo sapiens
taggcgagtgccag

SEQ ID NO: 1278353 - DNA, 21 bp, Homo sapiens
taggcgggcggtcaggggttc

SEQ ID NO: 1278354 - DNA, 15 bp, Homo sapiens
taggctaaaaggtct

SEQ ID NO: 1278355 - DNA, 14 bp, Homo sapiens
taggctattcacaa

SEQ ID NO: 1278356 - DNA, 15 bp, Homo sapiens
taggctattcacaac

SEQ ID NO: 1278357 - DNA, 15 bp, Homo sapiens
taggctattcctgag

SEQ ID NO: 1278358 - DNA, 16 bp, Homo sapiens
taggctatttgtaaat

SEQ ID NO: 1278359 - DNA, 20 bp, Homo sapiens
taggctatttgtaaatctgc

SEQ ID NO: 1278360 - DNA, 11 bp, Homo sapiens
taggctctgca

SEQ ID NO: 1278361 - DNA, 15 bp, Homo sapiens
taggctctgcacaga

SEQ ID NO: 1278362 - DNA, 12 bp, Homo sapiens
taggctggagaa

SEQ ID NO: 1278363 - DNA, 14 bp, Homo sapiens
taggctggagaagc

SEQ ID NO: 1278364 - DNA, 19 bp, Homo sapiens
taggctggagaagctcacc

SEQ ID NO: 1278365 - DNA, 15 bp, Homo sapiens
taggctggtggccca

SEQ ID NO: 1278366 - DNA, 16 bp, Homo sapiens
taggctggtggcccag

SEQ ID NO: 1278367 - DNA, 12 bp, Homo sapiens
taggctgtgggg

SEQ ID NO: 1278368 - DNA, 21 bp, Homo sapiens
taggctgtggggtctggctgt

SEQ ID NO: 1278369 - DNA, 16 bp, Homo sapiens
taggctgttccctttg

SEQ ID NO: 1278370 - DNA, 16 bp, Homo sapiens
taggcttaaacctgga

SEQ ID NO: 1278371 - DNA, 14 bp, Homo sapiens
taggcttctgtaat

SEQ ID NO: 1278372 - DNA, 18 bp, Homo sapiens
taggctttcaaaataagg

SEQ ID NO: 1278373 - DNA, 18 bp, Homo sapiens
taggcttttaagaaacac

SEQ ID NO: 1278374 - DNA, 15 bp, Homo sapiens
taggcttttctgcct

SEQ ID NO: 1278375 - DNA, 14 bp, Homo sapiens
taggctttttaatc

SEQ ID NO: 1278376 - DNA, 11 bp, Homo sapiens
tagggaaaaac

SEQ ID NO: 1278377 - DNA, 19 bp, Homo sapiens
tagggaaaccttggagagg

SEQ ID NO: 1278378 - DNA, 14 bp, Homo sapiens
tagggaacaatttg

SEQ ID NO: 1278379 - DNA, 13 bp, Homo sapiens
tagggaactctgg

SEQ ID NO: 1278380 - DNA, 21 bp, Homo sapiens
tagggaagcagggacaccccc

SEQ ID NO: 1278381 - DNA, 21 bp, Homo sapiens
tagggaaggatacaaaagcat

SEQ ID NO: 1278382 - DNA, 22 bp, Homo sapiens
tagggaataaaatcctaagaca

SEQ ID NO: 1278383 - DNA, 22 bp, Homo sapiens
tagggacaggaccccagctctg

SEQ ID NO: 1278384 - DNA, 19 bp, Homo sapiens
tagggagatgagttgcagt

SEQ ID NO: 1278385 - DNA, 22 bp, Homo sapiens
tagggagccccaaaacctacca

SEQ ID NO: 1278386 - DNA, 18 bp, Homo sapiens
tagggagtacctgctgcc

SEQ ID NO: 1278387 - DNA, 16 bp, Homo sapiens
tagggagtgaagccac

SEQ ID NO: 1278388 - DNA, 13 bp, Homo sapiens
tagggataattta

SEQ ID NO: 1278389 - DNA, 16 bp, Homo sapiens
tagggatataaaaaca

SEQ ID NO: 1278390 - DNA, 17 bp, Homo sapiens
tagggatataaaaacag

SEQ ID NO: 1278391 - DNA, 18 bp, Homo sapiens
tagggatatggcaggact

SEQ ID NO: 1278392 - DNA, 19 bp, Homo sapiens
tagggatggggctgtgggg

SEQ ID NO: 1278393 - DNA, 19 bp, Homo sapiens
tagggcaagggtgcctcag

SEQ ID NO: 1278394 - DNA, 21 bp, Homo sapiens
tagggcaagggtgcctcagga

SEQ ID NO: 1278395 - DNA, 20 bp, Homo sapiens
tagggcaccaggggtttctc

SEQ ID NO: 1278396 - DNA, 15 bp, Homo sapiens
tagggcagcttgccc

SEQ ID NO: 1278397 - DNA, 16 bp, Homo sapiens
tagggcattgtatctg

SEQ ID NO: 1278398 - DNA, 16 bp, Homo sapiens
tagggccaagcccagc

SEQ ID NO: 1278399 - DNA, 23 bp, Homo sapiens
tagggccaagcccagcactgctt

SEQ ID NO: 1278400 - DNA, 14 bp, Homo sapiens
tagggccaggcagg

SEQ ID NO: 1278401 - DNA, 15 bp, Homo sapiens
tagggccaggcaggt

SEQ ID NO: 1278402 - DNA, 21 bp, Homo sapiens
tagggccaggcaggtgcctgg

SEQ ID NO: 1278403 - DNA, 18 bp, Homo sapiens
tagggcctgcatggagaa

SEQ ID NO: 1278404 - DNA, 21 bp, Homo sapiens
tagggctgaggggcctgcgcc

SEQ ID NO: 1278405 - DNA, 16 bp, Homo sapiens
tagggctgctgcttct

SEQ ID NO: 1278406 - DNA, 20 bp, Homo sapiens
tagggctgctgcttctgctc

SEQ ID NO: 1278407 - DNA, 20 bp, Homo sapiens
tagggctgttgctagggaga

SEQ ID NO: 1278408 - DNA, 23 bp, Homo sapiens
tagggcttcaaggccctcagaga

SEQ ID NO: 1278409 - DNA, 18 bp, Homo sapiens
tagggctttagctttctt

SEQ ID NO: 1278410 - DNA, 20 bp, Homo sapiens
tagggcttttattttttctt

SEQ ID NO: 1278411 - DNA, 18 bp, Homo sapiens
taggggaaccctgtccct

SEQ ID NO: 1278412 - DNA, 15 bp, Homo sapiens
taggggaagggggtg

SEQ ID NO: 1278413 - DNA, 15 bp, Homo sapiens
taggggagggcaggc

SEQ ID NO: 1278414 - DNA, 17 bp, Homo sapiens
taggggatggtccagga

SEQ ID NO: 1278415 - DNA, 22 bp, Homo sapiens
taggggcagcctccgtcatcca

SEQ ID NO: 1278416 - DNA, 16 bp, Homo sapiens
taggggccacctcctc

SEQ ID NO: 1278417 - DNA, 15 bp, Homo sapiens
taggggctgaagacg

SEQ ID NO: 1278418 - DNA, 23 bp, Homo sapiens
taggggcttataataaaggactg

SEQ ID NO: 1278419 - DNA, 21 bp, Homo sapiens
tagggggccttgcggaagcca

SEQ ID NO: 1278420 - DNA, 22 bp, Homo sapiens
tagggggccttgcggaagccat

SEQ ID NO: 1278421 - DNA, 13 bp, Homo sapiens
tagggggctgcac

SEQ ID NO: 1278422 - DNA, 14 bp, Homo sapiens
taggggtcaaagaa

SEQ ID NO: 1278423 - DNA, 19 bp, Homo sapiens
taggggttaaagcagacag

SEQ ID NO: 1278424 - DNA, 14 bp, Homo sapiens
tagggtaaaaaaag

SEQ ID NO: 1278425 - DNA, 12 bp, Homo sapiens
tagggtaaatca

SEQ ID NO: 1278426 - DNA, 17 bp, Homo sapiens
tagttaccttatagtta

SEQ ID NO: 1278427 - DNA, 19 bp, Homo sapiens
tagttaccttatagttact

SEQ ID NO: 1278428 - DNA, 23 bp, Homo sapiens
tagttaccttatagttactgtgt

SEQ ID NO: 1278429 - DNA, 15 bp, Homo sapiens
tagttacgtataatg

SEQ ID NO: 1278430 - DNA, 18 bp, Homo sapiens
tagttacgtataatgctt

SEQ ID NO: 1278431 - DNA, 17 bp, Homo sapiens
tagttactgtgtaatta

SEQ ID NO: 1278432 - DNA, 20 bp, Homo sapiens
tagttagccatctaatgctt

SEQ ID NO: 1278433 - DNA, 22 bp, Homo sapiens
tagttagctaataaaaagcttt

SEQ ID NO: 1278434 - DNA, 15 bp, Homo sapiens
tagttaggatagcat

SEQ ID NO: 1278435 - DNA, 16 bp, Homo sapiens
tagttagtagcatgtt

SEQ ID NO: 1278436 - DNA, 12 bp, Homo sapiens
tagttatagtgt

SEQ ID NO: 1278437 - DNA, 16 bp, Homo sapiens
tagttatagtttcaga

SEQ ID NO: 1278438 - DNA, 15 bp, Homo sapiens
tagttatatgtacag

SEQ ID NO: 1278439 - DNA, 12 bp, Homo sapiens
tagttcaataca

SEQ ID NO: 1278440 - DNA, 13 bp, Homo sapiens
tagttcaatacag

SEQ ID NO: 1278441 - DNA, 14 bp, Homo sapiens
tagttcaatacagt

SEQ ID NO: 1278442 - DNA, 23 bp, Homo sapiens
tagttcagaatttagtgtatcca

SEQ ID NO: 1278443 - DNA, 22 bp, Homo sapiens
tagttcagcatccgcaggtgct

SEQ ID NO: 1278444 - DNA, 19 bp, Homo sapiens
tagttcagccattgtggaa

SEQ ID NO: 1278445 - DNA, 23 bp, Homo sapiens
tagttcagccattgtggaagaca

SEQ ID NO: 1278446 - DNA, 13 bp, Homo sapiens
tagttcatatata

SEQ ID NO: 1278447 - DNA, 14 bp, Homo sapiens
tagttcatccaatc

SEQ ID NO: 1278448 - DNA, 14 bp, Homo sapiens
tagttccactgaga

SEQ ID NO: 1278449 - DNA, 15 bp, Homo sapiens
tagttccactgagac

SEQ ID NO: 1278450 - DNA, 21 bp, Homo sapiens
tagttccttactgtttacagt

SEQ ID NO: 1278451 - DNA, 14 bp, Homo sapiens
tagttccttgcctt

SEQ ID NO: 1278452 - DNA, 16 bp, Homo sapiens
tagttccttgccttaa

SEQ ID NO: 1278453 - DNA, 13 bp, Homo sapiens
tagttctaaaatt

SEQ ID NO: 1278454 - DNA, 20 bp, Homo sapiens
tagttctcactgttccctct

SEQ ID NO: 1278455 - DNA, 12 bp, Homo sapiens
tagttctgccag

SEQ ID NO: 1278456 - DNA, 20 bp, Homo sapiens
tagttcttagctttgaaact

SEQ ID NO: 1278457 - DNA, 23 bp, Homo sapiens
tagttcttgggggaggccacccc

SEQ ID NO: 1278458 - DNA, 21 bp, Homo sapiens
tagttgacaacctagaatgtc

SEQ ID NO: 1278459 - DNA, 12 bp, Homo sapiens
tagttgagcccc

SEQ ID NO: 1278460 - DNA, 13 bp, Homo sapiens
tagttgccaacag

SEQ ID NO: 1278461 - DNA, 22 bp, Homo sapiens
tagttgggatgccaatttcctc

SEQ ID NO: 1278462 - DNA, 16 bp, Homo sapiens
tagttgggtagaaaaa

SEQ ID NO: 1278463 - DNA, 23 bp, Homo sapiens
tagtttaaacccaagaagggcac

SEQ ID NO: 1278464 - DNA, 18 bp, Homo sapiens
tagtttaagggtggaaaa

SEQ ID NO: 1278465 - DNA, 20 bp, Homo sapiens
tagtttacagaaaaatcttg

SEQ ID NO: 1278466 - DNA, 18 bp, Homo sapiens
tagtttaccacttgcctt

SEQ ID NO: 1278467 - DNA, 22 bp, Homo sapiens
tagtttagatcccatgtcacct

SEQ ID NO: 1278468 - DNA, 17 bp, Homo sapiens
tagtttaggaaaatgag

SEQ ID NO: 1278469 - DNA, 15 bp, Homo sapiens
tagtttagttctgtt

SEQ ID NO: 1278470 - DNA, 17 bp, Homo sapiens
tagtttcaccactcctc

SEQ ID NO: 1278471 - DNA, 22 bp, Homo sapiens
tagtttcaccactcctctccct

SEQ ID NO: 1278472 - DNA, 21 bp, Homo sapiens
tagtttcacgtaaatattcat

SEQ ID NO: 1278473 - DNA, 21 bp, Homo sapiens
tagtttcagtagattgcagaa

SEQ ID NO: 1278474 - DNA, 19 bp, Homo sapiens
tagtttcatataaagtatc

SEQ ID NO: 1278475 - DNA, 15 bp, Homo sapiens
tagtttgattaaatt

SEQ ID NO: 1278476 - DNA, 12 bp, Homo sapiens
tagtttgcagtt

SEQ ID NO: 1278477 - DNA, 22 bp, Homo sapiens
tagtttgcctgcagtttcttgt

SEQ ID NO: 1278478 - DNA, 17 bp, Homo sapiens
tagtttggatatttttg

SEQ ID NO: 1278479 - DNA, 20 bp, Homo sapiens
tagtttggatatttttgtac

SEQ ID NO: 1278480 - DNA, 19 bp, Homo sapiens
tagtttgtaccatttatga

SEQ ID NO: 1278481 - DNA, 18 bp, Homo sapiens
tagtttgtataacttctt

SEQ ID NO: 1278482 - DNA, 19 bp, Homo sapiens
tagtttgtgtgttgtctct

SEQ ID NO: 1278483 - DNA, 14 bp, Homo sapiens
tagttttaatctct

SEQ ID NO: 1278484 - DNA, 23 bp, Homo sapiens
tagttttaatctcttaatattga

SEQ ID NO: 1278485 - DNA, 22 bp, Homo sapiens
tagttttacactaggaaacgtg

SEQ ID NO: 1278486 - DNA, 16 bp, Homo sapiens
tagttttacattttaa

SEQ ID NO: 1278487 - DNA, 20 bp, Homo sapiens
tagttttagaggcattgtta

SEQ ID NO: 1278488 - DNA, 16 bp, Homo sapiens
tagttttagttgcaga

SEQ ID NO: 1278489 - DNA, 14 bp, Homo sapiens
tagttttagttttc

SEQ ID NO: 1278490 - DNA, 20 bp, Homo sapiens
tagttttatggcatgattta

SEQ ID NO: 1278491 - DNA, 12 bp, Homo sapiens
tagttttcaaaa

SEQ ID NO: 1278492 - DNA, 15 bp, Homo sapiens
tagttttcagccttg

SEQ ID NO: 1278493 - DNA, 17 bp, Homo sapiens
tagttttccctgcactg

SEQ ID NO: 1278494 - DNA, 22 bp, Homo sapiens
tagttttgtaaaaactgaagaa

SEQ ID NO: 1278495 - DNA, 13 bp, Homo sapiens
tagttttgtcaaa

SEQ ID NO: 1278496 - DNA, 19 bp, Homo sapiens
tagtttttacaaaactgct

SEQ ID NO: 1278497 - DNA, 15 bp, Homo sapiens
tagtttttatatgtt

SEQ ID NO: 1278498 - DNA, 21 bp, Homo sapiens
tagtttttcctatcatgttaa

SEQ ID NO: 1278499 - DNA, 17 bp, Homo sapiens
tagtttttcttcaacat

SEQ ID NO: 1278500 - DNA, 20 bp, Homo sapiens
tagtttttgaaaattatgca

SEQ ID NO: 1278501 - DNA, 23 bp, Homo sapiens
tagtttttgatcaagaatgcaat

SEQ ID NO: 1278502 - DNA, 17 bp, Homo sapiens
tagttttttcatcttca

SEQ ID NO: 1278503 - DNA, 11 bp, Homo sapiens
tataaaaaaga

SEQ ID NO: 1278504 - DNA, 14 bp, Homo sapiens
tataaaaaatatgt

SEQ ID NO: 1278505 - DNA, 22 bp, Homo sapiens
tataaaaaatcatgccagtatt

SEQ ID NO: 1278506 - DNA, 21 bp, Homo sapiens
tataaaaaatggttcagaatt

SEQ ID NO: 1278507 - DNA, 18 bp, Homo sapiens
tataaaaacagattctga

SEQ ID NO: 1278508 - DNA, 18 bp, Homo sapiens
tataaaaagcttccatga

SEQ ID NO: 1278509 - DNA, 12 bp, Homo sapiens
tataaaaaggaa

SEQ ID NO: 1278510 - DNA, 14 bp, Homo sapiens
tataaaaaggaaat

SEQ ID NO: 1278511 - DNA, 22 bp, Homo sapiens
tataaaaaggaaattagtcttt

SEQ ID NO: 1278512 - DNA, 16 bp, Homo sapiens
tataaaaatataaatt

SEQ ID NO: 1278513 - DNA, 19 bp, Homo sapiens
tataaaaatgtcagaaaat

SEQ ID NO: 1278514 - DNA, 16 bp, Homo sapiens
tataaaaattatcaaa

SEQ ID NO: 1278515 - DNA, 19 bp, Homo sapiens
tataaaaattatcaaaaag

SEQ ID NO: 1278516 - DNA, 13 bp, Homo sapiens
tataaaactgaaa

SEQ ID NO: 1278517 - DNA, 15 bp, Homo sapiens
tataaaactgaaata

SEQ ID NO: 1278518 - DNA, 17 bp, Homo sapiens
tataaaactgaaataaa

SEQ ID NO: 1278519 - DNA, 19 bp, Homo sapiens
tataaaactgtacttcact

SEQ ID NO: 1278520 - DNA, 15 bp, Homo sapiens
tataaaactttcctc

SEQ ID NO: 1278521 - DNA, 22 bp, Homo sapiens
tataaaaggatgttacaagttt

SEQ ID NO: 1278522 - DNA, 14 bp, Homo sapiens
tataaaataaactt

SEQ ID NO: 1278523 - DNA, 15 bp, Homo sapiens
tataaaataaacttc

SEQ ID NO: 1278524 - DNA, 16 bp, Homo sapiens
tataaaataaacttct

SEQ ID NO: 1278525 - DNA, 18 bp, Homo sapiens
tataaaataaacttctta

SEQ ID NO: 1278526 - DNA, 16 bp, Homo sapiens
tataaaataaatatat

SEQ ID NO: 1278527 - DNA, 15 bp, Homo sapiens
tataaaataactaaa

SEQ ID NO: 1278528 - DNA, 22 bp, Homo sapiens
tataaaatggtgttttcatgta

SEQ ID NO: 1278529 - DNA, 15 bp, Homo sapiens
tataaaatgtattca

SEQ ID NO: 1278530 - DNA, 20 bp, Homo sapiens
tataaaatgtattcaagcaa

SEQ ID NO: 1278531 - DNA, 15 bp, Homo sapiens
tataaaattaagcaa

SEQ ID NO: 1278532 - DNA, 15 bp, Homo sapiens
tataaacacattgaa

SEQ ID NO: 1278533 - DNA, 18 bp, Homo sapiens
tataaacacattgaatgc

SEQ ID NO: 1278534 - DNA, 14 bp, Homo sapiens
tataaacatcacac

SEQ ID NO: 1278535 - DNA, 15 bp, Homo sapiens
tataaacctaaaaaa

SEQ ID NO: 1278536 - DNA, 16 bp, Homo sapiens
tataaacctaaaaaag

SEQ ID NO: 1278537 - DNA, 19 bp, Homo sapiens
tataaactatcagtttgtc

SEQ ID NO: 1278538 - DNA, 12 bp, Homo sapiens
tataaactcatt

SEQ ID NO: 1278539 - DNA, 11 bp, Homo sapiens
tataaactgaa

SEQ ID NO: 1278540 - DNA, 20 bp, Homo sapiens
tataaactgaaaaatgtcag

SEQ ID NO: 1278541 - DNA, 17 bp, Homo sapiens
tataaacttaagggcaa

SEQ ID NO: 1278542 - DNA, 14 bp, Homo sapiens
tataaactttacct

SEQ ID NO: 1278543 - DNA, 21 bp, Homo sapiens
tataaactttagagtagcatg

SEQ ID NO: 1278544 - DNA, 12 bp, Homo sapiens
tataaactttta

SEQ ID NO: 1278545 - DNA, 18 bp, Homo sapiens
tataaagaagaacttgca

SEQ ID NO: 1278546 - DNA, 10 bp, Homo sapiens
tataaagaca

SEQ ID NO: 1278547 - DNA, 21 bp, Homo sapiens
tataaagataaaatatcctca

SEQ ID NO: 1278548 - DNA, 13 bp, Homo sapiens
tatagaacttcat

SEQ ID NO: 1278549 - DNA, 13 bp, Homo sapiens
tatagaagaaatg

SEQ ID NO: 1278550 - DNA, 17 bp, Homo sapiens
tatagaagtctggaaaa

SEQ ID NO: 1278551 - DNA, 19 bp, Homo sapiens
tatagaataaaagctataa

SEQ ID NO: 1278552 - DNA, 20 bp, Homo sapiens
tatagaatacttttttctag

SEQ ID NO: 1278553 - DNA, 14 bp, Homo sapiens
tatagaccaaagca

SEQ ID NO: 1278554 - DNA, 12 bp, Homo sapiens
tatagatgtcta

SEQ ID NO: 1278555 - DNA, 14 bp, Homo sapiens
tatagatgtctttt

SEQ ID NO: 1278556 - DNA, 18 bp, Homo sapiens
tatagatgtcttttccca

SEQ ID NO: 1278557 - DNA, 22 bp, Homo sapiens
tatagatttagttttgtaactt

SEQ ID NO: 1278558 - DNA, 13 bp, Homo sapiens
tatagcaaaatga

SEQ ID NO: 1278559 - DNA, 16 bp, Homo sapiens
tatagcaagatattga

SEQ ID NO: 1278560 - DNA, 21 bp, Homo sapiens
tatagcaagatattgatcaaa

SEQ ID NO: 1278561 - DNA, 15 bp, Homo sapiens
tatagcactgagctc

SEQ ID NO: 1278562 - DNA, 19 bp, Homo sapiens
tatagcactgagctcacat

SEQ ID NO: 1278563 - DNA, 16 bp, Homo sapiens
tatagcatgaaataaa

SEQ ID NO: 1278564 - DNA, 20 bp, Homo sapiens
tatagcatgaaataaaatat

SEQ ID NO: 1278565 - DNA, 19 bp, Homo sapiens
tatagcattgataatcttc

SEQ ID NO: 1278566 - DNA, 22 bp, Homo sapiens
tatagcattgataatcttcagg

SEQ ID NO: 1278567 - DNA, 14 bp, Homo sapiens
tatagccaatataa

SEQ ID NO: 1278568 - DNA, 22 bp, Homo sapiens
tatagcccagccaggccccagg

SEQ ID NO: 1278569 - DNA, 21 bp, Homo sapiens
tatagcctaagcggctgttta

SEQ ID NO: 1278570 - DNA, 11 bp, Homo sapiens
tataggaaagt

SEQ ID NO: 1278571 - DNA, 12 bp, Homo sapiens
tataggagagga

SEQ ID NO: 1278572 - DNA, 17 bp, Homo sapiens
tataggatagacactgg

SEQ ID NO: 1278573 - DNA, 19 bp, Homo sapiens
tataggatagacactggac

SEQ ID NO: 1278574 - DNA, 19 bp, Homo sapiens
tataggatttatttaaaat

SEQ ID NO: 1278575 - DNA, 22 bp, Homo sapiens
tataggccagggcatgtgtatg

SEQ ID NO: 1278576 - DNA, 17 bp, Homo sapiens
tataggccatctgtaaa

SEQ ID NO: 1278577 - DNA, 18 bp, Homo sapiens
tataggccatctgtaaat

SEQ ID NO: 1278578 - DNA, 19 bp, Homo sapiens
tataggccatctgtaaata

SEQ ID NO: 1278579 - DNA, 21 bp, Homo sapiens
tataggctattttctaaagac

SEQ ID NO: 1278580 - DNA, 21 bp, Homo sapiens
tataggggtcctgggggcagg

SEQ ID NO: 1278581 - DNA, 22 bp, Homo sapiens
tatagggttttttttaatgtga

SEQ ID NO: 1278582 - DNA, 23 bp, Homo sapiens
tatagggttttttttaatgtgaa

SEQ ID NO: 1278583 - DNA, 17 bp, Homo sapiens
tataggtagatccagat

SEQ ID NO: 1278584 - DNA, 14 bp, Homo sapiens
tataggtcactcct

SEQ ID NO: 1278585 - DNA, 17 bp, Homo sapiens
tataggtcactcctggg

SEQ ID NO: 1278586 - DNA, 20 bp, Homo sapiens
tataggtctcaatatttatt

SEQ ID NO: 1278587 - DNA, 22 bp, Homo sapiens
tataggtctcttctcccagaat

SEQ ID NO: 1278588 - DNA, 17 bp, Homo sapiens
tataggtgatgtttgct

SEQ ID NO: 1278589 - DNA, 22 bp, Homo sapiens
tataggttgtgcaaattaacag

SEQ ID NO: 1278590 - DNA, 22 bp, Homo sapiens
tatagtaactactttttatact

SEQ ID NO: 1278591 - DNA, 13 bp, Homo sapiens
tatagtacatgat

SEQ ID NO: 1278592 - DNA, 16 bp, Homo sapiens
tatagtacatgataaa

SEQ ID NO: 1278593 - DNA, 13 bp, Homo sapiens
tatagtagaaaga

SEQ ID NO: 1278594 - DNA, 21 bp, Homo sapiens
tatagtagaaagacatctgcc

SEQ ID NO: 1278595 - DNA, 23 bp, Homo sapiens
tatagtagaaagacatctgcctg

SEQ ID NO: 1278596 - DNA, 24 bp, Homo sapiens
tatagtagaaagacatctgcctgt

SEQ ID NO: 1278597 - DNA, 19 bp, Homo sapiens
tatagtaggggttgaagaa

SEQ ID NO: 1278598 - DNA, 18 bp, Homo sapiens
tatagtatatctggacaa

SEQ ID NO: 1278599 - DNA, 18 bp, Homo sapiens
tatagtatatttatactc

SEQ ID NO: 1278600 - DNA, 13 bp, Homo sapiens
tatagtatctgta

SEQ ID NO: 1278601 - DNA, 14 bp, Homo sapiens
tatagtatgtgact

SEQ ID NO: 1278602 - DNA, 22 bp, Homo sapiens
tatagtcaatggcttgttcatc

SEQ ID NO: 1278603 - DNA, 20 bp, Homo sapiens
tatagtcccagctactcaga

SEQ ID NO: 1278604 - DNA, 14 bp, Homo sapiens
tatagtctacagtt

SEQ ID NO: 1278605 - DNA, 13 bp, Homo sapiens
tatagtgatgtaa

SEQ ID NO: 1278606 - DNA, 18 bp, Homo sapiens
tatagtgatgtaatcttg

SEQ ID NO: 1278607 - DNA, 19 bp, Homo sapiens
tatagtgcaaattcatttt

SEQ ID NO: 1278608 - DNA, 11 bp, Homo sapiens
tatagtgccta

SEQ ID NO: 1278609 - DNA, 15 bp, Homo sapiens
tatagtgctgtttaa

SEQ ID NO: 1278610 - DNA, 21 bp, Homo sapiens
tatagtgtaaaataagaatga

SEQ ID NO: 1278611 - DNA, 14 bp, Homo sapiens
tatagtgtatagaa

SEQ ID NO: 1278612 - DNA, 16 bp, Homo sapiens
tatagtgttcacaaac

SEQ ID NO: 1278613 - DNA, 18 bp, Homo sapiens
tatagtgtttaactggca

SEQ ID NO: 1278614 - DNA, 17 bp, Homo sapiens
tatagttaacacactac

SEQ ID NO: 1278615 - DNA, 15 bp, Homo sapiens
tatagttactgtgta

SEQ ID NO: 1278616 - DNA, 22 bp, Homo sapiens
tatagttactgtgtaattagtg

SEQ ID NO: 1278617 - DNA, 17 bp, Homo sapiens
tatagttaggatagcat

SEQ ID NO: 1278618 - DNA, 18 bp, Homo sapiens
tatagttaggatagcatt

SEQ ID NO: 1278619 - DNA, 19 bp, Homo sapiens
tatagttaggatagcattt

SEQ ID NO: 1278620 - DNA, 16 bp, Homo sapiens
tatagttatatgtaca

SEQ ID NO: 1278621 - DNA, 23 bp, Homo sapiens
tatagttccttgccttaataaat

SEQ ID NO: 1278622 - DNA, 12 bp, Homo sapiens
tatagttctgtg

SEQ ID NO: 1278623 - DNA, 17 bp, Homo sapiens
tatagttctgtgtagag

SEQ ID NO: 1278624 - DNA, 14 bp, Homo sapiens
tatagttgcttgcc

SEQ ID NO: 1278625 - DNA, 22 bp, Homo sapiens
tatagtttcagatatatatcat

SEQ ID NO: 1278626 - DNA, 20 bp, Homo sapiens
tatagtttggaaataaaaat

SEQ ID NO: 1278627 - DNA, 15 bp, Homo sapiens
tatagtttgtacatg

SEQ ID NO: 1278628 - DNA, 17 bp, Homo sapiens
tatagttttacttttaa

SEQ ID NO: 1278629 - DNA, 22 bp, Homo sapiens
tatataaaataaatatatataa

SEQ ID NO: 1278630 - DNA, 13 bp, Homo sapiens
tatataaaataac

SEQ ID NO: 1278631 - DNA, 14 bp, Homo sapiens
tatataaaataact

SEQ ID NO: 1278632 - DNA, 18 bp, Homo sapiens
tatataaaatgtattcaa

SEQ ID NO: 1278633 - DNA, 22 bp, Homo sapiens
tatataaacactccacagtgtt

SEQ ID NO: 1278634 - DNA, 22 bp, Homo sapiens
tatataaacagaactcccttca

SEQ ID NO: 1278635 - DNA, 22 bp, Homo sapiens
tatataaccctaggaatttaga

SEQ ID NO: 1278636 - DNA, 24 bp, Homo sapiens
tatataaccttcatttttaagact

SEQ ID NO: 1278637 - DNA, 13 bp, Homo sapiens
tatataactcttt

SEQ ID NO: 1278638 - DNA, 19 bp, Homo sapiens
tatataagaaaaaattctt

SEQ ID NO: 1278639 - DNA, 16 bp, Homo sapiens
tatataaggtaatgta

SEQ ID NO: 1278640 - DNA, 19 bp, Homo sapiens
tatataagtgtacatatgt

SEQ ID NO: 1278641 - DNA, 13 bp, Homo sapiens
tatataataactt

SEQ ID NO: 1278642 - DNA, 15 bp, Homo sapiens
tatataataacttta

SEQ ID NO: 1278643 - DNA, 13 bp, Homo sapiens
tatataatatcta

SEQ ID NO: 1278644 - DNA, 17 bp, Homo sapiens
tatataatatgtcacct

SEQ ID NO: 1278645 - DNA, 20 bp, Homo sapiens
tatataatcatgctcatgta

SEQ ID NO: 1278646 - DNA, 20 bp, Homo sapiens
tatataatttgagtgtatat

SEQ ID NO: 1278647 - DNA, 13 bp, Homo sapiens
tatataattttat

SEQ ID NO: 1278648 - DNA, 22 bp, Homo sapiens
tatatacacatacatacacata

SEQ ID NO: 1278649 - DNA, 14 bp, Homo sapiens
tatatacagtaact

SEQ ID NO: 1278650 - DNA, 21 bp, Homo sapiens
tatataccaaagcacatttta

SEQ ID NO: 1278651 - DNA, 19 bp, Homo sapiens
tatatacctggcttttact

SEQ ID NO: 1278652 - DNA, 14 bp, Homo sapiens
tatatagagatgtt

SEQ ID NO: 1278653 - DNA, 19 bp, Homo sapiens
tatatagagatgtttttaa

SEQ ID NO: 1278654 - DNA, 14 bp, Homo sapiens
tatatagtatattt

SEQ ID NO: 1278655 - DNA, 15 bp, Homo sapiens
tatatagtctacagt

SEQ ID NO: 1278656 - DNA, 17 bp, Homo sapiens
tatatagtctacagttg

SEQ ID NO: 1278657 - DNA, 13 bp, Homo sapiens
tatatataaaacg

SEQ ID NO: 1278658 - DNA, 13 bp, Homo sapiens
tatatataaaata

SEQ ID NO: 1278659 - DNA, 17 bp, Homo sapiens
tatatataatatgtata

SEQ ID NO: 1278660 - DNA, 22 bp, Homo sapiens
tatatataatttgagtgtatat

SEQ ID NO: 1278661 - DNA, 17 bp, Homo sapiens
tatatatacacatacat

SEQ ID NO: 1278662 - DNA, 16 bp, Homo sapiens
tatatatacatatgta

SEQ ID NO: 1278663 - DNA, 17 bp, Homo sapiens
tatatatacatatgtaa

SEQ ID NO: 1278664 - DNA, 13 bp, Homo sapiens
tatatatagaatc

SEQ ID NO: 1278665 - DNA, 11 bp, Homo sapiens
tatatatataa

SEQ ID NO: 1278666 - DNA, 11 bp, Homo sapiens
tatatatatat

SEQ ID NO: 1278667 - DNA, 14 bp, Homo sapiens
tatatatatatata

SEQ ID NO: 1278668 - DNA, 14 bp, Homo sapiens
tatatatatatgta

SEQ ID NO: 1278669 - DNA, 14 bp, Homo sapiens
tatatatatattta

SEQ ID NO: 1278670 - DNA, 15 bp, Homo sapiens
tatcaccacagtaag

SEQ ID NO: 1278671 - DNA, 18 bp, Homo sapiens
tatcacctaagcacttct

SEQ ID NO: 1278672 - DNA, 18 bp, Homo sapiens
tatcacctagcagcctca

SEQ ID NO: 1278673 - DNA, 14 bp, Homo sapiens
tatcacctcccctc

SEQ ID NO: 1278674 - DNA, 16 bp, Homo sapiens
tatcacctcccctcct

SEQ ID NO: 1278675 - DNA, 16 bp, Homo sapiens
tatcacctctcttcag

SEQ ID NO: 1278676 - DNA, 13 bp, Homo sapiens
tatcactcattaa

SEQ ID NO: 1278677 - DNA, 22 bp, Homo sapiens
tatcacttaaacttgcatcact

SEQ ID NO: 1278678 - DNA, 22 bp, Homo sapiens
tatcactttaactcaggaggca

SEQ ID NO: 1278679 - DNA, 15 bp, Homo sapiens
tatcactttaagttt

SEQ ID NO: 1278680 - DNA, 21 bp, Homo sapiens
tatcagaagaccacaaaaatt

SEQ ID NO: 1278681 - DNA, 23 bp, Homo sapiens
tatcagaaggtggtttgacagca

SEQ ID NO: 1278682 - DNA, 18 bp, Homo sapiens
tatcagaatacttgcact

SEQ ID NO: 1278683 - DNA, 17 bp, Homo sapiens
tatcagaattctcagaa

SEQ ID NO: 1278684 - DNA, 16 bp, Homo sapiens
tatcagacaagcacta

SEQ ID NO: 1278685 - DNA, 14 bp, Homo sapiens
tatcagagatgtcc

SEQ ID NO: 1278686 - DNA, 22 bp, Homo sapiens
tatcagagctcttaatgttgct

SEQ ID NO: 1278687 - DNA, 13 bp, Homo sapiens
tatcagaggtcta

SEQ ID NO: 1278688 - DNA, 22 bp, Homo sapiens
tatcagaggtctatttttacct

SEQ ID NO: 1278689 - DNA, 18 bp, Homo sapiens
tatcagatacatcactgc

SEQ ID NO: 1278690 - DNA, 14 bp, Homo sapiens
tatcagcaaaaaag

SEQ ID NO: 1278691 - DNA, 17 bp, Homo sapiens
tatcagcattgtttcaa

SEQ ID NO: 1278692 - DNA, 17 bp, Homo sapiens
tatcagccagccttccc

SEQ ID NO: 1278693 - DNA, 19 bp, Homo sapiens
tatcagcctgagtctcctg

SEQ ID NO: 1278694 - DNA, 14 bp, Homo sapiens
tatcagctctctgc

SEQ ID NO: 1278695 - DNA, 14 bp, Homo sapiens
tatcagcttcagaa

SEQ ID NO: 1278696 - DNA, 14 bp, Homo sapiens
tatcagcttttctg

SEQ ID NO: 1278697 - DNA, 13 bp, Homo sapiens
tatcaggtaataa

SEQ ID NO: 1278698 - DNA, 15 bp, Homo sapiens
tatcaggtctcccac

SEQ ID NO: 1278699 - DNA, 15 bp, Homo sapiens
tatcaggtgtataaa

SEQ ID NO: 1278700 - DNA, 21 bp, Homo sapiens
tatcaggtgtataaatgtaca

SEQ ID NO: 1278701 - DNA, 16 bp, Homo sapiens
tatcagtattctgaca

SEQ ID NO: 1278702 - DNA, 21 bp, Homo sapiens
tatcagtattctgacatgtaa

SEQ ID NO: 1278703 - DNA, 21 bp, Homo sapiens
tatcagtcaatatttttagat

SEQ ID NO: 1278704 - DNA, 20 bp, Homo sapiens
tatcagtgacagagttcact

SEQ ID NO: 1278705 - DNA, 23 bp, Homo sapiens
tatcagtgctcgagacacagtga

SEQ ID NO: 1278706 - DNA, 15 bp, Homo sapiens
tatcagtgtttatgt

SEQ ID NO: 1278707 - DNA, 14 bp, Homo sapiens
tatcagttaccaaa

SEQ ID NO: 1278708 - DNA, 16 bp, Homo sapiens
tatcagttacccactc

SEQ ID NO: 1278709 - DNA, 17 bp, Homo sapiens
tatcagttatatgatat

SEQ ID NO: 1278710 - DNA, 17 bp, Homo sapiens
tatcagttatcctttgt

SEQ ID NO: 1278711 - DNA, 13 bp, Homo sapiens
tatcagtttgcta

SEQ ID NO: 1278712 - DNA, 23 bp, Homo sapiens
tatcagtttgctagcagaaatct

SEQ ID NO: 1278713 - DNA, 22 bp, Homo sapiens
tatcatacaaatcagttagttt

SEQ ID NO: 1278714 - DNA, 12 bp, Homo sapiens
tatcatacagtt

SEQ ID NO: 1278715 - DNA, 14 bp, Homo sapiens
tatcatacagtttt

SEQ ID NO: 1278716 - DNA, 14 bp, Homo sapiens
tatcatagaaatgt

SEQ ID NO: 1278717 - DNA, 20 bp, Homo sapiens
tatcatattaacatattcta

SEQ ID NO: 1278718 - DNA, 16 bp, Homo sapiens
tatcatattattatcc

SEQ ID NO: 1278719 - DNA, 18 bp, Homo sapiens
tatcatcaagcaggaatt

SEQ ID NO: 1278720 - DNA, 22 bp, Homo sapiens
tatcatcaagcaggaattatgt

SEQ ID NO: 1278721 - DNA, 18 bp, Homo sapiens
tatcatcacgtatgttat

SEQ ID NO: 1278722 - DNA, 23 bp, Homo sapiens
tatcatcagtgtagaacctaatt

SEQ ID NO: 1278723 - DNA, 15 bp, Homo sapiens
tatcatcccaacagc

SEQ ID NO: 1278724 - DNA, 13 bp, Homo sapiens
tatcatctccatc

SEQ ID NO: 1278725 - DNA, 11 bp, Homo sapiens
tatcatgaagc

SEQ ID NO: 1278726 - DNA, 18 bp, Homo sapiens
tatcatgaagccttgctg

SEQ ID NO: 1278727 - DNA, 24 bp, Homo sapiens
tatcatgaattttaaagtatgcat

SEQ ID NO: 1278728 - DNA, 17 bp, Homo sapiens
tatcatgacaaagactg

SEQ ID NO: 1278729 - DNA, 15 bp, Homo sapiens
tatcatgcaaaatat

SEQ ID NO: 1278730 - DNA, 16 bp, Homo sapiens
tatcatgcaaatgctg

SEQ ID NO: 1278731 - DNA, 18 bp, Homo sapiens
tatcatgcccctgtactc

SEQ ID NO: 1278732 - DNA, 20 bp, Homo sapiens
tatcatgggaaaagaccagg

SEQ ID NO: 1278733 - DNA, 16 bp, Homo sapiens
tatcatggtaatgaca

SEQ ID NO: 1278734 - DNA, 23 bp, Homo sapiens
tatcatggtaatgacagatgcaa

SEQ ID NO: 1278735 - DNA, 19 bp, Homo sapiens
tatcatgttaaattagaat

SEQ ID NO: 1278736 - DNA, 13 bp, Homo sapiens
tatcatgttaacc

SEQ ID NO: 1278737 - DNA, 18 bp, Homo sapiens
tatcatgttttataattt

SEQ ID NO: 1278738 - DNA, 22 bp, Homo sapiens
tatcatgttttataatttgaat

SEQ ID NO: 1278739 - DNA, 13 bp, Homo sapiens
tatcattaaaata

SEQ ID NO: 1278740 - DNA, 18 bp, Homo sapiens
tatcattaaacaaataaa

SEQ ID NO: 1278741 - DNA, 13 bp, Homo sapiens
tatcattcaagtg

SEQ ID NO: 1278742 - DNA, 18 bp, Homo sapiens
tatcattcattcttagct

SEQ ID NO: 1278743 - DNA, 16 bp, Homo sapiens
tatcattccaattcta

SEQ ID NO: 1278744 - DNA, 18 bp, Homo sapiens
tatcattccaattctaaa

SEQ ID NO: 1278745 - DNA, 22 bp, Homo sapiens
tatcattgctcccctgatagaa

SEQ ID NO: 1278746 - DNA, 20 bp, Homo sapiens
tatcatttattttttacatt

SEQ ID NO: 1278747 - DNA, 17 bp, Homo sapiens
tatcatttgtgaagaat

SEQ ID NO: 1278748 - DNA, 21 bp, Homo sapiens
tatcattttaaaaactttatt

SEQ ID NO: 1278749 - DNA, 14 bp, Homo sapiens
tatcatttttgtat

SEQ ID NO: 1278750 - DNA, 17 bp, Homo sapiens
tatcatttttgtataaa

SEQ ID NO: 1278751 - DNA, 19 bp, Homo sapiens
tatcatttttgtataaaaa

SEQ ID NO: 1278752 - DNA, 17 bp, Homo sapiens
tatcatttttgtgcaca

SEQ ID NO: 1278753 - DNA, 13 bp, Homo sapiens
tatccaaaagctt

SEQ ID NO: 1278754 - DNA, 18 bp, Homo sapiens
tatccaaaatgtgtattt

SEQ ID NO: 1278755 - DNA, 22 bp, Homo sapiens
tatccaaaatgtgtatttctta

SEQ ID NO: 1278756 - DNA, 23 bp, Homo sapiens
tatccaaagaacttgatttgcat

SEQ ID NO: 1278757 - DNA, 14 bp, Homo sapiens
tatccaaagactgt

SEQ ID NO: 1278758 - DNA, 15 bp, Homo sapiens
tatccaaagactgta

SEQ ID NO: 1278759 - DNA, 19 bp, Homo sapiens
tatccaaagactgtactgg

SEQ ID NO: 1278760 - DNA, 21 bp, Homo sapiens
tatccaaagactgtactggcc

SEQ ID NO: 1278761 - DNA, 23 bp, Homo sapiens
tatccaaagggaatactcacatt

SEQ ID NO: 1278762 - DNA, 19 bp, Homo sapiens
tatccaacatcaacatctt

SEQ ID NO: 1278763 - DNA, 18 bp, Homo sapiens
tatccaaccaacttggtt

SEQ ID NO: 1278764 - DNA, 23 bp, Homo sapiens
tatccaaggaaacattttatcat

SEQ ID NO: 1278765 - DNA, 15 bp, Homo sapiens
tatccacaaagtact

SEQ ID NO: 1278766 - DNA, 16 bp, Homo sapiens
tatccacataaatgct

SEQ ID NO: 1278767 - DNA, 15 bp, Homo sapiens
tatccaccacctccc

SEQ ID NO: 1278768 - DNA, 12 bp, Homo sapiens
tatccacccagc

SEQ ID NO: 1278769 - DNA, 20 bp, Homo sapiens
tatccacccagcccattctc

SEQ ID NO: 1278770 - DNA, 20 bp, Homo sapiens
tatccacttttcttcttcct

SEQ ID NO: 1278771 - DNA, 20 bp, Homo sapiens
tatccagaaataaaacaact

SEQ ID NO: 1278772 - DNA, 18 bp, Homo sapiens
tatccagaaggggagctt

SEQ ID NO: 1278773 - DNA, 14 bp, Homo sapiens
tatccagaggaatt

SEQ ID NO: 1278774 - DNA, 18 bp, Homo sapiens
tatccagctagtgccaaa

SEQ ID NO: 1278775 - DNA, 18 bp, Homo sapiens
tatccaggcaccaggact

SEQ ID NO: 1278776 - DNA, 24 bp, Homo sapiens
tatccataatgcattcttctctgt

SEQ ID NO: 1278777 - DNA, 17 bp, Homo sapiens
tatccatatagaaatct

SEQ ID NO: 1278778 - DNA, 17 bp, Homo sapiens
tatccatattgagtcaa

SEQ ID NO: 1278779 - DNA, 15 bp, Homo sapiens
tatccatgtaataag

SEQ ID NO: 1278780 - DNA, 20 bp, Homo sapiens
tatccatgtaataagcactt

SEQ ID NO: 1278781 - DNA, 16 bp, Homo sapiens
tatccattaacctggg

SEQ ID NO: 1278782 - DNA, 17 bp, Homo sapiens
tatccatttcttttact

SEQ ID NO: 1278783 - DNA, 20 bp, Homo sapiens
tatccatttcttttactctg

SEQ ID NO: 1278784 - DNA, 16 bp, Homo sapiens
tatcccaacattctgc

SEQ ID NO: 1278785 - DNA, 21 bp, Homo sapiens
tatcccaacattctgcaatgg

SEQ ID NO: 1278786 - DNA, 21 bp, Homo sapiens
tatcccaatcaaagaattaca

SEQ ID NO: 1278787 - DNA, 20 bp, Homo sapiens
tatcccagcttgctgagggg

SEQ ID NO: 1278788 - DNA, 19 bp, Homo sapiens
tatcccattctccctctca

SEQ ID NO: 1278789 - DNA, 21 bp, Homo sapiens
tatccccagggacagaaacca

SEQ ID NO: 1278790 - DNA, 17 bp, Homo sapiens
tatccccatctccctgc

SEQ ID NO: 1278791 - DNA, 18 bp, Homo sapiens
tatgaatattactctcaa

SEQ ID NO: 1278792 - DNA, 13 bp, Homo sapiens
tatgaatctatgc

SEQ ID NO: 1278793 - DNA, 22 bp, Homo sapiens
tatgaatctatgccaaagatca

SEQ ID NO: 1278794 - DNA, 15 bp, Homo sapiens
tatgaatctgagaga

SEQ ID NO: 1278795 - DNA, 15 bp, Homo sapiens
tatgaatgatatctt

SEQ ID NO: 1278796 - DNA, 20 bp, Homo sapiens
tatgaatgcccccagctggc

SEQ ID NO: 1278797 - DNA, 20 bp, Homo sapiens
tatgaatggaggatattcta

SEQ ID NO: 1278798 - DNA, 18 bp, Homo sapiens
tatgaattcacagatatt

SEQ ID NO: 1278799 - DNA, 13 bp, Homo sapiens
tatgaattgtcta

SEQ ID NO: 1278800 - DNA, 19 bp, Homo sapiens
tatgaatttaaatataatt

SEQ ID NO: 1278801 - DNA, 19 bp, Homo sapiens
tatgacaatcttattgtca

SEQ ID NO: 1278802 - DNA, 22 bp, Homo sapiens
tatgacacatgcaaggtcattt

SEQ ID NO: 1278803 - DNA, 23 bp, Homo sapiens
tatgacataagcaatcattttat

SEQ ID NO: 1278804 - DNA, 22 bp, Homo sapiens
tatgacataggccaaggcccaa

SEQ ID NO: 1278805 - DNA, 20 bp, Homo sapiens
tatgacatcacttgtacaaa

SEQ ID NO: 1278806 - DNA, 21 bp, Homo sapiens
tatgacattggatagaacatg

SEQ ID NO: 1278807 - DNA, 18 bp, Homo sapiens
tatgacatttttttctga

SEQ ID NO: 1278808 - DNA, 13 bp, Homo sapiens
tatgaccagaagc

SEQ ID NO: 1278809 - DNA, 16 bp, Homo sapiens
tatgaccagaagcctt

SEQ ID NO: 1278810 - DNA, 18 bp, Homo sapiens
tatgaccagaagccttgg

SEQ ID NO: 1278811 - DNA, 23 bp, Homo sapiens
tatgacccacactgccagaagag

SEQ ID NO: 1278812 - DNA, 20 bp, Homo sapiens
tatgacgcggctcaaaagga

SEQ ID NO: 1278813 - DNA, 20 bp, Homo sapiens
tatgactaaagagagaatgt

SEQ ID NO: 1278814 - DNA, 21 bp, Homo sapiens
tatgactaaagagagaatgta

SEQ ID NO: 1278815 - DNA, 15 bp, Homo sapiens
tatgactaaattttc

SEQ ID NO: 1278816 - DNA, 12 bp, Homo sapiens
tatgactggagt

SEQ ID NO: 1278817 - DNA, 13 bp, Homo sapiens
tatgactggagta

SEQ ID NO: 1278818 - DNA, 13 bp, Homo sapiens
tatgacttctgct

SEQ ID NO: 1278819 - DNA, 22 bp, Homo sapiens
tatgactttcctcagaacatga

SEQ ID NO: 1278820 - DNA, 19 bp, Homo sapiens
tatgactttttataaaatg

SEQ ID NO: 1278821 - DNA, 22 bp, Homo sapiens
tatgagaaaaatattcaagtaa

SEQ ID NO: 1278822 - DNA, 21 bp, Homo sapiens
tatgagaaactggcaaagcag

SEQ ID NO: 1278823 - DNA, 21 bp, Homo sapiens
tatgagaatataccttattta

SEQ ID NO: 1278824 - DNA, 23 bp, Homo sapiens
tatgagacagggtcttgctctgt

SEQ ID NO: 1278825 - DNA, 15 bp, Homo sapiens
tatgagaggcaatga

SEQ ID NO: 1278826 - DNA, 14 bp, Homo sapiens
tatgagatactttg

SEQ ID NO: 1278827 - DNA, 21 bp, Homo sapiens
tatgagatctaatgtgaaaat

SEQ ID NO: 1278828 - DNA, 19 bp, Homo sapiens
tatgagatggttaaaaagg

SEQ ID NO: 1278829 - DNA, 20 bp, Homo sapiens
tatgagatggttaaaaaggc

SEQ ID NO: 1278830 - DNA, 14 bp, Homo sapiens
tatgagatttactg

SEQ ID NO: 1278831 - DNA, 16 bp, Homo sapiens
tatgagctacaacaaa

SEQ ID NO: 1278832 - DNA, 18 bp, Homo sapiens
tatgagctacaacaaaag

SEQ ID NO: 1278833 - DNA, 20 bp, Homo sapiens
tatgagcttcaatataagaa

SEQ ID NO: 1278834 - DNA, 17 bp, Homo sapiens
tatgaggaataattatt

SEQ ID NO: 1278835 - DNA, 13 bp, Homo sapiens
tatgaggagggga

SEQ ID NO: 1278836 - DNA, 22 bp, Homo sapiens
tatgaggatataatgtgtgctt

SEQ ID NO: 1278837 - DNA, 21 bp, Homo sapiens
tatgaggcatttgtttgaact

SEQ ID NO: 1278838 - DNA, 15 bp, Homo sapiens
tatgaggtcctcagg

SEQ ID NO: 1278839 - DNA, 19 bp, Homo sapiens
tatgaggtcctcaggtcag

SEQ ID NO: 1278840 - DNA, 14 bp, Homo sapiens
tatgaggtgaaatg

SEQ ID NO: 1278841 - DNA, 17 bp, Homo sapiens
tatgagtcaatgtgcag

SEQ ID NO: 1278842 - DNA, 23 bp, Homo sapiens
tatgagtcaatgtgcagtgtagc

SEQ ID NO: 1278843 - DNA, 13 bp, Homo sapiens
tatgagtgctgat

SEQ ID NO: 1278844 - DNA, 18 bp, Homo sapiens
tatgagttgcatttgtaa

SEQ ID NO: 1278845 - DNA, 21 bp, Homo sapiens
tatgagtttttgatagcttta

SEQ ID NO: 1278846 - DNA, 20 bp, Homo sapiens
tatgatacttgaattttttg

SEQ ID NO: 1278847 - DNA, 23 bp, Homo sapiens
tatgatacttgaattttttgaaa

SEQ ID NO: 1278848 - DNA, 12 bp, Homo sapiens
tatgatattctt

SEQ ID NO: 1278849 - DNA, 14 bp, Homo sapiens
tatgatcacagtga

SEQ ID NO: 1278850 - DNA, 20 bp, Homo sapiens
tatgatcagaagaacatgat

SEQ ID NO: 1278851 - DNA, 18 bp, Homo sapiens
tatgatcaggtaactttc

SEQ ID NO: 1278852 - DNA, 18 bp, Homo sapiens
tatgatcagtgttactgc

SEQ ID NO: 1278853 - DNA, 17 bp, Homo sapiens
tatgatcagtgttgttg

SEQ ID NO: 1278854 - DNA, 20 bp, Homo sapiens
tatgatcattgaaatacttt

SEQ ID NO: 1278855 - DNA, 20 bp, Homo sapiens
tatgatccagagcagagttt

SEQ ID NO: 1278856 - DNA, 18 bp, Homo sapiens
tatgatccctaatgtgtt

SEQ ID NO: 1278857 - DNA, 13 bp, Homo sapiens
tatgatccttttt

SEQ ID NO: 1278858 - DNA, 14 bp, Homo sapiens
tatgatctgtctgt

SEQ ID NO: 1278859 - DNA, 21 bp, Homo sapiens
tatgatgactcccttaaaata

SEQ ID NO: 1278860 - DNA, 16 bp, Homo sapiens
tatgatgcatacagtt

SEQ ID NO: 1278861 - DNA, 16 bp, Homo sapiens
tatgatggttttaaac

SEQ ID NO: 1278862 - DNA, 22 bp, Homo sapiens
tatgatgtaatctctctgcagc

SEQ ID NO: 1278863 - DNA, 16 bp, Homo sapiens
tatgatgttttccctt

SEQ ID NO: 1278864 - DNA, 16 bp, Homo sapiens
tatgattctagtacat

SEQ ID NO: 1278865 - DNA, 20 bp, Homo sapiens
tatgattctagtacataatt

SEQ ID NO: 1278866 - DNA, 14 bp, Homo sapiens
tatgattctctgtg

SEQ ID NO: 1278867 - DNA, 18 bp, Homo sapiens
tatgattggttcagtttt

SEQ ID NO: 1278868 - DNA, 14 bp, Homo sapiens
tatgatttatagtt

SEQ ID NO: 1278869 - DNA, 15 bp, Homo sapiens
tatgatttatagttt

SEQ ID NO: 1278870 - DNA, 18 bp, Homo sapiens
tatgatttccttcaatgt

SEQ ID NO: 1278871 - DNA, 16 bp, Homo sapiens
tatgatttgttttgaa

SEQ ID NO: 1278872 - DNA, 19 bp, Homo sapiens
tatgatttgttttgaattt

SEQ ID NO: 1278873 - DNA, 15 bp, Homo sapiens
tatgattttattaca

SEQ ID NO: 1278874 - DNA, 18 bp, Homo sapiens
tatgattttattacagaa

SEQ ID NO: 1278875 - DNA, 17 bp, Homo sapiens
tatgatttttttttcca

SEQ ID NO: 1278876 - DNA, 22 bp, Homo sapiens
tatgcaaaagttctgacttgac

SEQ ID NO: 1278877 - DNA, 21 bp, Homo sapiens
tatgcaaggtatttctccagt

SEQ ID NO: 1278878 - DNA, 16 bp, Homo sapiens
tatgcaatttcctttt

SEQ ID NO: 1278879 - DNA, 14 bp, Homo sapiens
tatgcacacacata

SEQ ID NO: 1278880 - DNA, 12 bp, Homo sapiens
tatgcacagcct

SEQ ID NO: 1278881 - DNA, 13 bp, Homo sapiens
tatgcacagccta

SEQ ID NO: 1278882 - DNA, 14 bp, Homo sapiens
tatgcacagtaaaa

SEQ ID NO: 1278883 - DNA, 12 bp, Homo sapiens
tatgcacccctg

SEQ ID NO: 1278884 - DNA, 15 bp, Homo sapiens
tatgcactgtggttt

SEQ ID NO: 1278885 - DNA, 11 bp, Homo sapiens
tatgcactttc

SEQ ID NO: 1278886 - DNA, 20 bp, Homo sapiens
tatgcactttccctagaaag

SEQ ID NO: 1278887 - DNA, 20 bp, Homo sapiens
tatgcagaacgtatttagcc

SEQ ID NO: 1278888 - DNA, 23 bp, Homo sapiens
tatgcagaacgtatttagccatt

SEQ ID NO: 1278889 - DNA, 23 bp, Homo sapiens
tatgcagaagcatattttgctgg

SEQ ID NO: 1278890 - DNA, 23 bp, Homo sapiens
tatgcagacagtctgttatgcac

SEQ ID NO: 1278891 - DNA, 19 bp, Homo sapiens
tatgcagacatctctggag

SEQ ID NO: 1278892 - DNA, 20 bp, Homo sapiens
tatgcagacatctctggagc

SEQ ID NO: 1278893 - DNA, 17 bp, Homo sapiens
tatgcaggcagcacagc

SEQ ID NO: 1278894 - DNA, 13 bp, Homo sapiens
tatgcagggagca

SEQ ID NO: 1278895 - DNA, 17 bp, Homo sapiens
tatgcagggagcactgt

SEQ ID NO: 1278896 - DNA, 20 bp, Homo sapiens
tatgcagggagcactgttca

SEQ ID NO: 1278897 - DNA, 23 bp, Homo sapiens
tatgcagttgataagaggaattt

SEQ ID NO: 1278898 - DNA, 19 bp, Homo sapiens
tatgcataaaaaaatgatg

SEQ ID NO: 1278899 - DNA, 23 bp, Homo sapiens
tatgcatactaatttttgcttaa

SEQ ID NO: 1278900 - DNA, 14 bp, Homo sapiens
tatgcatatttgtt

SEQ ID NO: 1278901 - DNA, 23 bp, Homo sapiens
tatgcatcagataacaactgtga

SEQ ID NO: 1278902 - DNA, 13 bp, Homo sapiens
tatgcatgaagta

SEQ ID NO: 1278903 - DNA, 20 bp, Homo sapiens
tatgcatggaaacctgaaaa

SEQ ID NO: 1278904 - DNA, 16 bp, Homo sapiens
tatgcattatatcaaa

SEQ ID NO: 1278905 - DNA, 12 bp, Homo sapiens
tatgcattcaca

SEQ ID NO: 1278906 - DNA, 19 bp, Homo sapiens
tatgcattcacatttagaa

SEQ ID NO: 1278907 - DNA, 15 bp, Homo sapiens
tatgcatttcattca

SEQ ID NO: 1278908 - DNA, 24 bp, Homo sapiens
tatgcatttgaaaattttgatgtt

SEQ ID NO: 1278909 - DNA, 17 bp, Homo sapiens
tatgcattttcttcaca

SEQ ID NO: 1278910 - DNA, 14 bp, Homo sapiens
tatgccaaagatca

SEQ ID NO: 1278911 - DNA, 17 bp, Homo sapiens
tatgccacacctggcct

SEQ ID NO: 1278912 - DNA, 16 bp, Homo sapiens
tattactgatttagaa

SEQ ID NO: 1278913 - DNA, 23 bp, Homo sapiens
tattactggtattagttaaaaca

SEQ ID NO: 1278914 - DNA, 14 bp, Homo sapiens
tattactgtcttta

SEQ ID NO: 1278915 - DNA, 22 bp, Homo sapiens
tattactgtctttattcttatt

SEQ ID NO: 1278916 - DNA, 17 bp, Homo sapiens
tattactgttgcattta

SEQ ID NO: 1278917 - DNA, 22 bp, Homo sapiens
tattactgttgcatttactttt

SEQ ID NO: 1278918 - DNA, 17 bp, Homo sapiens
tattactgttttgggcc

SEQ ID NO: 1278919 - DNA, 18 bp, Homo sapiens
tattacttaggttatttt

SEQ ID NO: 1278920 - DNA, 23 bp, Homo sapiens
tattacttaggttattttgcttt

SEQ ID NO: 1278921 - DNA, 13 bp, Homo sapiens
tattacttccatg

SEQ ID NO: 1278922 - DNA, 14 bp, Homo sapiens
tattacttccatga

SEQ ID NO: 1278923 - DNA, 20 bp, Homo sapiens
tattacttcctcaataaaaa

SEQ ID NO: 1278924 - DNA, 13 bp, Homo sapiens
tattacttctgtt

SEQ ID NO: 1278925 - DNA, 15 bp, Homo sapiens
tattacttgtgcact

SEQ ID NO: 1278926 - DNA, 16 bp, Homo sapiens
tattacttgtgcactt

SEQ ID NO: 1278927 - DNA, 21 bp, Homo sapiens
tattactttatgaacaatttt

SEQ ID NO: 1278928 - DNA, 17 bp, Homo sapiens
tattactttctgccgct

SEQ ID NO: 1278929 - DNA, 19 bp, Homo sapiens
tattacttttgtaaatatt

SEQ ID NO: 1278930 - DNA, 15 bp, Homo sapiens
tattactttttttgt

SEQ ID NO: 1278931 - DNA, 19 bp, Homo sapiens
tattactttttttgtagat

SEQ ID NO: 1278932 - DNA, 21 bp, Homo sapiens
tattagaatcaaacattttga

SEQ ID NO: 1278933 - DNA, 16 bp, Homo sapiens
tattagagcattgaat

SEQ ID NO: 1278934 - DNA, 15 bp, Homo sapiens
tattagagtatttcc

SEQ ID NO: 1278935 - DNA, 16 bp, Homo sapiens
tattagagtatttccc

SEQ ID NO: 1278936 - DNA, 18 bp, Homo sapiens
tattagagtgtctttcca

SEQ ID NO: 1278937 - DNA, 16 bp, Homo sapiens
tattagctttactgtt

SEQ ID NO: 1278938 - DNA, 15 bp, Homo sapiens
tattagctttctcct

SEQ ID NO: 1278939 - DNA, 17 bp, Homo sapiens
tattaggcataaattaa

SEQ ID NO: 1278940 - DNA, 21 bp, Homo sapiens
tattagggagaaaattcaatt

SEQ ID NO: 1278941 - DNA, 18 bp, Homo sapiens
tattaggtccattcatta

SEQ ID NO: 1278942 - DNA, 15 bp, Homo sapiens
tattaggtggaaatt

SEQ ID NO: 1278943 - DNA, 15 bp, Homo sapiens
tattaggttgtcacg

SEQ ID NO: 1278944 - DNA, 16 bp, Homo sapiens
tattagtattgttgtc

SEQ ID NO: 1278945 - DNA, 19 bp, Homo sapiens
tattagtattgttgtcctt

SEQ ID NO: 1278946 - DNA, 21 bp, Homo sapiens
tattagtattgttgtcctttt

SEQ ID NO: 1278947 - DNA, 14 bp, Homo sapiens
tattagtgattctg

SEQ ID NO: 1278948 - DNA, 22 bp, Homo sapiens
tattagtgattctgatttcagt

SEQ ID NO: 1278949 - DNA, 16 bp, Homo sapiens
tattagttacaaagtt

SEQ ID NO: 1278950 - DNA, 22 bp, Homo sapiens
tattagttccccaaatacaaag

SEQ ID NO: 1278951 - DNA, 13 bp, Homo sapiens
tattataaaaata

SEQ ID NO: 1278952 - DNA, 12 bp, Homo sapiens
tattataaaagc

SEQ ID NO: 1278953 - DNA, 15 bp, Homo sapiens
tattataaactataa

SEQ ID NO: 1278954 - DNA, 21 bp, Homo sapiens
tattataaagccaattatctg

SEQ ID NO: 1278955 - DNA, 16 bp, Homo sapiens
tattataacttaaaaa

SEQ ID NO: 1278956 - DNA, 22 bp, Homo sapiens
tattataagggagagctgagcc

SEQ ID NO: 1278957 - DNA, 23 bp, Homo sapiens
tattataagggagagctgagcca

SEQ ID NO: 1278958 - DNA, 21 bp, Homo sapiens
tattataatactaaaactcag

SEQ ID NO: 1278959 - DNA, 19 bp, Homo sapiens
tattataatcttataattg

SEQ ID NO: 1278960 - DNA, 13 bp, Homo sapiens
tattataattgtt

SEQ ID NO: 1278961 - DNA, 13 bp, Homo sapiens
tattatacctttt

SEQ ID NO: 1278962 - DNA, 12 bp, Homo sapiens
tattatagaaaa

SEQ ID NO: 1278963 - DNA, 15 bp, Homo sapiens
tattatataaatata

SEQ ID NO: 1278964 - DNA, 23 bp, Homo sapiens
tattatatatttacagaagaaaa

SEQ ID NO: 1278965 - DNA, 17 bp, Homo sapiens
tattatatcagcttttc

SEQ ID NO: 1278966 - DNA, 14 bp, Homo sapiens
tattatatttgaca

SEQ ID NO: 1278967 - DNA, 21 bp, Homo sapiens
tattatatttgacatgggtat

SEQ ID NO: 1278968 - DNA, 15 bp, Homo sapiens
tattatcaacaatag

SEQ ID NO: 1278969 - DNA, 18 bp, Homo sapiens
tattatcatgcaaatgct

SEQ ID NO: 1278970 - DNA, 22 bp, Homo sapiens
tattatcctcctgttctgaaac

SEQ ID NO: 1278971 - DNA, 15 bp, Homo sapiens
tattatctacctgtt

SEQ ID NO: 1278972 - DNA, 15 bp, Homo sapiens
tattatctatggaaa

SEQ ID NO: 1278973 - DNA, 16 bp, Homo sapiens
tattatctatggaaat

SEQ ID NO: 1278974 - DNA, 13 bp, Homo sapiens
tattatctgtcag

SEQ ID NO: 1278975 - DNA, 20 bp, Homo sapiens
tattatcttgttcaggaaaa

SEQ ID NO: 1278976 - DNA, 14 bp, Homo sapiens
tattatgaaggaat

SEQ ID NO: 1278977 - DNA, 21 bp, Homo sapiens
tattatggaagattttaaatt

SEQ ID NO: 1278978 - DNA, 14 bp, Homo sapiens
tattatgtaaatat

SEQ ID NO: 1278979 - DNA, 15 bp, Homo sapiens
tattatgtaaatatg

SEQ ID NO: 1278980 - DNA, 19 bp, Homo sapiens
tattatgtaacatccagaa

SEQ ID NO: 1278981 - DNA, 14 bp, Homo sapiens
tattatgttgttca

SEQ ID NO: 1278982 - DNA, 14 bp, Homo sapiens
tattatgtttatta

SEQ ID NO: 1278983 - DNA, 21 bp, Homo sapiens
tattattaaggtaactactgc

SEQ ID NO: 1278984 - DNA, 16 bp, Homo sapiens
tattattaataatgaa

SEQ ID NO: 1278985 - DNA, 15 bp, Homo sapiens
tattattaatttatt

SEQ ID NO: 1278986 - DNA, 14 bp, Homo sapiens
tattattacaaata

SEQ ID NO: 1278987 - DNA, 21 bp, Homo sapiens
tattattactctacactgaaa

SEQ ID NO: 1278988 - DNA, 13 bp, Homo sapiens
tattattagaaat

SEQ ID NO: 1278989 - DNA, 18 bp, Homo sapiens
tattattagaaattagaa

SEQ ID NO: 1278990 - DNA, 12 bp, Homo sapiens
tattattagggc

SEQ ID NO: 1278991 - DNA, 13 bp, Homo sapiens
tattattcaaacc

SEQ ID NO: 1278992 - DNA, 18 bp, Homo sapiens
tattattcaaaccaattt

SEQ ID NO: 1278993 - DNA, 16 bp, Homo sapiens
tattattcaagtgcct

SEQ ID NO: 1278994 - DNA, 23 bp, Homo sapiens
tattattcccgacgacacatata

SEQ ID NO: 1278995 - DNA, 17 bp, Homo sapiens
tattattcctagtcttt

SEQ ID NO: 1278996 - DNA, 13 bp, Homo sapiens
tattattctgcag

SEQ ID NO: 1278997 - DNA, 22 bp, Homo sapiens
tattattctgttttgcacagtt

SEQ ID NO: 1278998 - DNA, 14 bp, Homo sapiens
tattattgctgaag

SEQ ID NO: 1278999 - DNA, 15 bp, Homo sapiens
tattatttataattc

SEQ ID NO: 1279000 - DNA, 23 bp, Homo sapiens
tattatttctccatcccctccct

SEQ ID NO: 1279001 - DNA, 17 bp, Homo sapiens
tattatttctgttctta

SEQ ID NO: 1279002 - DNA, 12 bp, Homo sapiens
tattatttcttc

SEQ ID NO: 1279003 - DNA, 17 bp, Homo sapiens
tattatttcttctctta

SEQ ID NO: 1279004 - DNA, 12 bp, Homo sapiens
tattatttgata

SEQ ID NO: 1279005 - DNA, 17 bp, Homo sapiens
tattatttggagttagg

SEQ ID NO: 1279006 - DNA, 22 bp, Homo sapiens
tattattttagcttcagttgtt

SEQ ID NO: 1279007 - DNA, 13 bp, Homo sapiens
tattatttttacc

SEQ ID NO: 1279008 - DNA, 15 bp, Homo sapiens
tattatttttaccta

SEQ ID NO: 1279009 - DNA, 18 bp, Homo sapiens
tattatttttttaaacaa

SEQ ID NO: 1279010 - DNA, 21 bp, Homo sapiens
tattcaaaaaatcatgtttat

SEQ ID NO: 1279011 - DNA, 14 bp, Homo sapiens
tattcaaaatggtt

SEQ ID NO: 1279012 - DNA, 20 bp, Homo sapiens
tattcaaaccaatttcttcc

SEQ ID NO: 1279013 - DNA, 23 bp, Homo sapiens
tattcaaaccaatttcttccttc

SEQ ID NO: 1279014 - DNA, 14 bp, Homo sapiens
tattcaaatttgta

SEQ ID NO: 1279015 - DNA, 16 bp, Homo sapiens
tattcaaatttgtaca

SEQ ID NO: 1279016 - DNA, 18 bp, Homo sapiens
tattcaagaatgaaaaat

SEQ ID NO: 1279017 - DNA, 21 bp, Homo sapiens
tattcaagagtggggggagga

SEQ ID NO: 1279018 - DNA, 18 bp, Homo sapiens
tattcaagcaaacatcaa

SEQ ID NO: 1279019 - DNA, 20 bp, Homo sapiens
tattcaagcaaacatcaaat

SEQ ID NO: 1279020 - DNA, 11 bp, Homo sapiens
tattcaagtaa

SEQ ID NO: 1279021 - DNA, 19 bp, Homo sapiens
tattcaagtgcctcttgtt

SEQ ID NO: 1279022 - DNA, 20 bp, Homo sapiens
tattcaataaaaaaaagaaa

SEQ ID NO: 1279023 - DNA, 23 bp, Homo sapiens
tattcaataaaaaaaagaaatga

SEQ ID NO: 1279024 - DNA, 21 bp, Homo sapiens
tattcaataccgctcagtatt

SEQ ID NO: 1279025 - DNA, 16 bp, Homo sapiens
tattcaattcctctgg

SEQ ID NO: 1279026 - DNA, 17 bp, Homo sapiens
tattcaattcctctggg

SEQ ID NO: 1279027 - DNA, 18 bp, Homo sapiens
tattcaattcctctggga

SEQ ID NO: 1279028 - DNA, 19 bp, Homo sapiens
tattcacatagtcctcagg

SEQ ID NO: 1279029 - DNA, 15 bp, Homo sapiens
tattcactgtaagtt

SEQ ID NO: 1279030 - DNA, 12 bp, Homo sapiens
tattcagaaatt

SEQ ID NO: 1279031 - DNA, 20 bp, Homo sapiens
tattcagaaattaaaatatt

SEQ ID NO: 1279032 - DNA, 18 bp, Homo sapiens
tattcagaatctttgtta

SEQ ID NO: 1279033 - DNA, 17 bp, Homo sapiens
tattcagacaaaatgga

SEQ ID NO: 1279034 - DNA, 20 bp, Homo sapiens
tattgttttcagtgtacatg

SEQ ID NO: 1279035 - DNA, 14 bp, Homo sapiens
tattgttttctgta

SEQ ID NO: 1279036 - DNA, 20 bp, Homo sapiens
tattgttttctgtaaataac

SEQ ID NO: 1279037 - DNA, 14 bp, Homo sapiens
tatttaaaaacaaa

SEQ ID NO: 1279038 - DNA, 17 bp, Homo sapiens
tatttaaaaatatttca

SEQ ID NO: 1279039 - DNA, 20 bp, Homo sapiens
tatttaaaaatatttcagat

SEQ ID NO: 1279040 - DNA, 17 bp, Homo sapiens
tatttaaaaatgtcttg

SEQ ID NO: 1279041 - DNA, 19 bp, Homo sapiens
tatttaaaaattgtttctt

SEQ ID NO: 1279042 - DNA, 15 bp, Homo sapiens
tatttaaaactctgg

SEQ ID NO: 1279043 - DNA, 23 bp, Homo sapiens
tatttaaaactctggtgataaaa

SEQ ID NO: 1279044 - DNA, 16 bp, Homo sapiens
tatttaaaagagtaga

SEQ ID NO: 1279045 - DNA, 12 bp, Homo sapiens
tatttaaaaggg

SEQ ID NO: 1279046 - DNA, 15 bp, Homo sapiens
tatttaaaataaaga

SEQ ID NO: 1279047 - DNA, 21 bp, Homo sapiens
tatttaaaatgctcaatttca

SEQ ID NO: 1279048 - DNA, 15 bp, Homo sapiens
tatttaaaattggca

SEQ ID NO: 1279049 - DNA, 16 bp, Homo sapiens
tatttaaaattggcac

SEQ ID NO: 1279050 - DNA, 14 bp, Homo sapiens
tatttaaacatggt

SEQ ID NO: 1279051 - DNA, 19 bp, Homo sapiens
tatttaaagaaagtgaaaa

SEQ ID NO: 1279052 - DNA, 12 bp, Homo sapiens
tatttaaagaca

SEQ ID NO: 1279053 - DNA, 13 bp, Homo sapiens
tatttaaagacaa

SEQ ID NO: 1279054 - DNA, 21 bp, Homo sapiens
tatttaaatcctgaagagcat

SEQ ID NO: 1279055 - DNA, 18 bp, Homo sapiens
tatttaaatgcatgtctt

SEQ ID NO: 1279056 - DNA, 19 bp, Homo sapiens
tatttaaatgcatgtctta

SEQ ID NO: 1279057 - DNA, 18 bp, Homo sapiens
tatttaaattacaatttt

SEQ ID NO: 1279058 - DNA, 17 bp, Homo sapiens
tatttaacaaaaaatgt

SEQ ID NO: 1279059 - DNA, 23 bp, Homo sapiens
tatttaactctctttatgtctgt

SEQ ID NO: 1279060 - DNA, 21 bp, Homo sapiens
tatttaactgattaaaaatac

SEQ ID NO: 1279061 - DNA, 13 bp, Homo sapiens
tatttaagaaaat

SEQ ID NO: 1279062 - DNA, 14 bp, Homo sapiens
tatttaagactaaa

SEQ ID NO: 1279063 - DNA, 17 bp, Homo sapiens
tatttaagactgataat

SEQ ID NO: 1279064 - DNA, 20 bp, Homo sapiens
tatttaagataattataata

SEQ ID NO: 1279065 - DNA, 12 bp, Homo sapiens
tatttaagatgt

SEQ ID NO: 1279066 - DNA, 16 bp, Homo sapiens
tatttaagcttatgtc

SEQ ID NO: 1279067 - DNA, 16 bp, Homo sapiens
tatttaaggaatcaaa

SEQ ID NO: 1279068 - DNA, 13 bp, Homo sapiens
tatttaagtatgg

SEQ ID NO: 1279069 - DNA, 16 bp, Homo sapiens
tatttaagtatggaat

SEQ ID NO: 1279070 - DNA, 22 bp, Homo sapiens
tatttaagtatggaatattcat

SEQ ID NO: 1279071 - DNA, 18 bp, Homo sapiens
tatttaagtgaaggagaa

SEQ ID NO: 1279072 - DNA, 14 bp, Homo sapiens
tatttaagttatca

SEQ ID NO: 1279073 - DNA, 19 bp, Homo sapiens
tatttaagttatcaacttt

SEQ ID NO: 1279074 - DNA, 17 bp, Homo sapiens
tatttaatacttttgct

SEQ ID NO: 1279075 - DNA, 20 bp, Homo sapiens
tatttaatagcaaagaattg

SEQ ID NO: 1279076 - DNA, 18 bp, Homo sapiens
tatttaatgatgattatg

SEQ ID NO: 1279077 - DNA, 21 bp, Homo sapiens
tatttaatgcattaaacctgt

SEQ ID NO: 1279078 - DNA, 21 bp, Homo sapiens
tatttaatgccgatatactct

SEQ ID NO: 1279079 - DNA, 15 bp, Homo sapiens
tatttaatgttatgt

SEQ ID NO: 1279080 - DNA, 15 bp, Homo sapiens
tatttaatgttttaa

SEQ ID NO: 1279081 - DNA, 17 bp, Homo sapiens
tatttaatgttttaaat

SEQ ID NO: 1279082 - DNA, 20 bp, Homo sapiens
tatttaatgttttaaatgta

SEQ ID NO: 1279083 - DNA, 22 bp, Homo sapiens
tatttaatgttttaaatgtaca

SEQ ID NO: 1279084 - DNA, 13 bp, Homo sapiens
tatttaattgaaa

SEQ ID NO: 1279085 - DNA, 15 bp, Homo sapiens
tatttaattgaaact

SEQ ID NO: 1279086 - DNA, 14 bp, Homo sapiens
tatttaatttgtat

SEQ ID NO: 1279087 - DNA, 17 bp, Homo sapiens
tatttaatttgtatgct

SEQ ID NO: 1279088 - DNA, 21 bp, Homo sapiens
tatttaatttgtatgctaaat

SEQ ID NO: 1279089 - DNA, 15 bp, Homo sapiens
tatttacaaataaaa

SEQ ID NO: 1279090 - DNA, 14 bp, Homo sapiens
tatttacagaagaa

SEQ ID NO: 1279091 - DNA, 21 bp, Homo sapiens
tatttacatgaattgcatttt

SEQ ID NO: 1279092 - DNA, 21 bp, Homo sapiens
tatttacattttatatttttg

SEQ ID NO: 1279093 - DNA, 19 bp, Homo sapiens
tatttaccgttgcttgaaa

SEQ ID NO: 1279094 - DNA, 21 bp, Homo sapiens
tatttaccgttgcttgaaatt

SEQ ID NO: 1279095 - DNA, 14 bp, Homo sapiens
tatttacgctttga

SEQ ID NO: 1279096 - DNA, 19 bp, Homo sapiens
tatttacgctttgattcat

SEQ ID NO: 1279097 - DNA, 13 bp, Homo sapiens
tatttactaacta

SEQ ID NO: 1279098 - DNA, 14 bp, Homo sapiens
tatttactaactaa

SEQ ID NO: 1279099 - DNA, 17 bp, Homo sapiens
tatttactaactaaata

SEQ ID NO: 1279100 - DNA, 16 bp, Homo sapiens
tatttactgagcttct

SEQ ID NO: 1279101 - DNA, 22 bp, Homo sapiens
tatttactgagcttctctgtga

SEQ ID NO: 1279102 - DNA, 15 bp, Homo sapiens
tatttagaactttgt

SEQ ID NO: 1279103 - DNA, 15 bp, Homo sapiens
tatttagaatatgtt

SEQ ID NO: 1279104 - DNA, 13 bp, Homo sapiens
tatttagacaaga

SEQ ID NO: 1279105 - DNA, 19 bp, Homo sapiens
tatttagactgtggccata

SEQ ID NO: 1279106 - DNA, 21 bp, Homo sapiens
tatttagactgtggccatata

SEQ ID NO: 1279107 - DNA, 21 bp, Homo sapiens
tatttagatgataaagagaca

SEQ ID NO: 1279108 - DNA, 14 bp, Homo sapiens
tatttaggaaacac

SEQ ID NO: 1279109 - DNA, 15 bp, Homo sapiens
tatttaggaagtgtt

SEQ ID NO: 1279110 - DNA, 20 bp, Homo sapiens
tatttagggccttttctgtg

SEQ ID NO: 1279111 - DNA, 18 bp, Homo sapiens
tatttaggtttttggctg

SEQ ID NO: 1279112 - DNA, 13 bp, Homo sapiens
tatttagttacgt

SEQ ID NO: 1279113 - DNA, 20 bp, Homo sapiens
tatttagttatagtttcaga

SEQ ID NO: 1279114 - DNA, 14 bp, Homo sapiens
tatttataaaactt

SEQ ID NO: 1279115 - DNA, 17 bp, Homo sapiens
tatttataaatatattt

SEQ ID NO: 1279116 - DNA, 14 bp, Homo sapiens
tatttataacagca

SEQ ID NO: 1279117 - DNA, 18 bp, Homo sapiens
tatttataacagcattct

SEQ ID NO: 1279118 - DNA, 13 bp, Homo sapiens
tatttataactca

SEQ ID NO: 1279119 - DNA, 21 bp, Homo sapiens
tatttataactcatcataaaa

SEQ ID NO: 1279120 - DNA, 22 bp, Homo sapiens
tatttataactcatcataaaat

SEQ ID NO: 1279121 - DNA, 15 bp, Homo sapiens
tatttataattccta

SEQ ID NO: 1279122 - DNA, 18 bp, Homo sapiens
tatttataatttaaatga

SEQ ID NO: 1279123 - DNA, 19 bp, Homo sapiens
tatttatacaagattgaaa

SEQ ID NO: 1279124 - DNA, 11 bp, Homo sapiens
tatttatactc

SEQ ID NO: 1279125 - DNA, 12 bp, Homo sapiens
tatttatatata

SEQ ID NO: 1279126 - DNA, 24 bp, Homo sapiens
tatttatatatatgatgtggacat

SEQ ID NO: 1279127 - DNA, 23 bp, Homo sapiens
tatttatatatgtatttataaat

SEQ ID NO: 1279128 - DNA, 17 bp, Homo sapiens
tatttatatatttataa

SEQ ID NO: 1279129 - DNA, 13 bp, Homo sapiens
tatttatattccg

SEQ ID NO: 1279130 - DNA, 15 bp, Homo sapiens
tatttatatttcact

SEQ ID NO: 1279131 - DNA, 20 bp, Homo sapiens
tatttatccaaaatgtgtat

SEQ ID NO: 1279132 - DNA, 17 bp, Homo sapiens
tatttatccctttcctg

SEQ ID NO: 1279133 - DNA, 15 bp, Homo sapiens
tatttatctgattaa

SEQ ID NO: 1279134 - DNA, 16 bp, Homo sapiens
tatttatctgattaag

SEQ ID NO: 1279135 - DNA, 19 bp, Homo sapiens
tatttatgcactgtgggat

SEQ ID NO: 1279136 - DNA, 22 bp, Homo sapiens
tatttatggaattaaccattta

SEQ ID NO: 1279137 - DNA, 18 bp, Homo sapiens
tatttatggattaaaaac

SEQ ID NO: 1279138 - DNA, 15 bp, Homo sapiens
tatttatgtaatttg

SEQ ID NO: 1279139 - DNA, 18 bp, Homo sapiens
tatttatgtaatttgtac

SEQ ID NO: 1279140 - DNA, 14 bp, Homo sapiens
tatttatgtgtgag

SEQ ID NO: 1279141 - DNA, 19 bp, Homo sapiens
tatttattaaaaatgttct

SEQ ID NO: 1279142 - DNA, 14 bp, Homo sapiens
tatttattactatg

SEQ ID NO: 1279143 - DNA, 13 bp, Homo sapiens
tatttattattaa

SEQ ID NO: 1279144 - DNA, 21 bp, Homo sapiens
tatttattcagcttcatttgt

SEQ ID NO: 1279145 - DNA, 12 bp, Homo sapiens
tatttattcatt

SEQ ID NO: 1279146 - DNA, 13 bp, Homo sapiens
tatttattgcatt

SEQ ID NO: 1279147 - DNA, 15 bp, Homo sapiens
tatttattgtattag

SEQ ID NO: 1279148 - DNA, 16 bp, Homo sapiens
tatttattgttaaatt

SEQ ID NO: 1279149 - DNA, 16 bp, Homo sapiens
tatttattgttagaaa

SEQ ID NO: 1279150 - DNA, 20 bp, Homo sapiens
tatttattgttagaaaatga

SEQ ID NO: 1279151 - DNA, 20 bp, Homo sapiens
tatttattgttgccttttca

SEQ ID NO: 1279152 - DNA, 11 bp, Homo sapiens
tatttatttaa

SEQ ID NO: 1279153 - DNA, 17 bp, Homo sapiens
tatttatttaaaactct

SEQ ID NO: 1279154 - DNA, 23 bp, Homo sapiens
tatttatttaaaactctggtgat

SEQ ID NO: 1279155 - DNA, 16 bp, Homo sapiens
tatttatttaagctta

SEQ ID NO: 1279156 - DNA, 15 bp, Homo sapiens
tatttgtctttgaat

SEQ ID NO: 1279157 - DNA, 15 bp, Homo sapiens
tatttgtgactcttt

SEQ ID NO: 1279158 - DNA, 15 bp, Homo sapiens
tatttgtgcatttta

SEQ ID NO: 1279159 - DNA, 17 bp, Homo sapiens
tatttgtgcattttatt

SEQ ID NO: 1279160 - DNA, 18 bp, Homo sapiens
tatttgtgctatagtatt

SEQ ID NO: 1279161 - DNA, 17 bp, Homo sapiens
tatttgtgtaatagaaa

SEQ ID NO: 1279162 - DNA, 18 bp, Homo sapiens
tatttgtgtatttaacag

SEQ ID NO: 1279163 - DNA, 21 bp, Homo sapiens
tatttgtgttttaatttaaac

SEQ ID NO: 1279164 - DNA, 19 bp, Homo sapiens
tatttgttaaaatatttgc

SEQ ID NO: 1279165 - DNA, 17 bp, Homo sapiens
tatttgttattttcagt

SEQ ID NO: 1279166 - DNA, 18 bp, Homo sapiens
tatttgttattttcagta

SEQ ID NO: 1279167 - DNA, 18 bp, Homo sapiens
tatttgttctttttctga

SEQ ID NO: 1279168 - DNA, 19 bp, Homo sapiens
tatttgtttagttcagcaa

SEQ ID NO: 1279169 - DNA, 21 bp, Homo sapiens
tatttgtttagttcagcaaaa

SEQ ID NO: 1279170 - DNA, 21 bp, Homo sapiens
tatttgtttatggtaaaaaat

SEQ ID NO: 1279171 - DNA, 13 bp, Homo sapiens
tatttgttttcat

SEQ ID NO: 1279172 - DNA, 18 bp, Homo sapiens
tattttaaaatctgtcac

SEQ ID NO: 1279173 - DNA, 13 bp, Homo sapiens
tattttaaaatga

SEQ ID NO: 1279174 - DNA, 13 bp, Homo sapiens
tattttaaaattt

SEQ ID NO: 1279175 - DNA, 17 bp, Homo sapiens
tattttaaaatttgttc

SEQ ID NO: 1279176 - DNA, 12 bp, Homo sapiens
tattttaaagaa

SEQ ID NO: 1279177 - DNA, 20 bp, Homo sapiens
tattttaaagtaaaagtcta

SEQ ID NO: 1279178 - DNA, 20 bp, Homo sapiens
tattttaaatatccacagta

SEQ ID NO: 1279179 - DNA, 22 bp, Homo sapiens
tattttaaatatccacagtact

SEQ ID NO: 1279180 - DNA, 12 bp, Homo sapiens
tattttaaatct

SEQ ID NO: 1279181 - DNA, 23 bp, Homo sapiens
tattttaagactgattttaatag

SEQ ID NO: 1279182 - DNA, 14 bp, Homo sapiens
tattttaagtattg

SEQ ID NO: 1279183 - DNA, 13 bp, Homo sapiens
tattttaatagaa

SEQ ID NO: 1279184 - DNA, 12 bp, Homo sapiens
tattttaatgta

SEQ ID NO: 1279185 - DNA, 19 bp, Homo sapiens
tattttaatttatgagttt

SEQ ID NO: 1279186 - DNA, 18 bp, Homo sapiens
tattttacagctcattaa

SEQ ID NO: 1279187 - DNA, 17 bp, Homo sapiens
tattttactattggaat

SEQ ID NO: 1279188 - DNA, 14 bp, Homo sapiens
tattttactttgta

SEQ ID NO: 1279189 - DNA, 13 bp, Homo sapiens
tattttactttta

SEQ ID NO: 1279190 - DNA, 16 bp, Homo sapiens
tattttagatgttatt

SEQ ID NO: 1279191 - DNA, 22 bp, Homo sapiens
tattttataatgttgtatttaa

SEQ ID NO: 1279192 - DNA, 23 bp, Homo sapiens
tattttataatgttgtatttaat

SEQ ID NO: 1279193 - DNA, 20 bp, Homo sapiens
tattttatataataaagtat

SEQ ID NO: 1279194 - DNA, 18 bp, Homo sapiens
tattttatatcatacagt

SEQ ID NO: 1279195 - DNA, 21 bp, Homo sapiens
tattttatatgttcatattgg

SEQ ID NO: 1279196 - DNA, 14 bp, Homo sapiens
tattttatcctgta

SEQ ID NO: 1279197 - DNA, 20 bp, Homo sapiens
tattttatcctgtattcttg

SEQ ID NO: 1279198 - DNA, 20 bp, Homo sapiens
tattttatctattggcctgt

SEQ ID NO: 1279199 - DNA, 14 bp, Homo sapiens
tattttatgaacat

SEQ ID NO: 1279200 - DNA, 15 bp, Homo sapiens
tattttatgaacatt

SEQ ID NO: 1279201 - DNA, 18 bp, Homo sapiens
tattttatgaacattgta

SEQ ID NO: 1279202 - DNA, 20 bp, Homo sapiens
tattttatgaacattgtact

SEQ ID NO: 1279203 - DNA, 13 bp, Homo sapiens
tattttatggtta

SEQ ID NO: 1279204 - DNA, 19 bp, Homo sapiens
tattttatggttatgtttt

SEQ ID NO: 1279205 - DNA, 13 bp, Homo sapiens
tattttattactg

SEQ ID NO: 1279206 - DNA, 15 bp, Homo sapiens
tattttattactgtt

SEQ ID NO: 1279207 - DNA, 17 bp, Homo sapiens
tattttattatgcatga

SEQ ID NO: 1279208 - DNA, 18 bp, Homo sapiens
tattttattgaaatgtat

SEQ ID NO: 1279209 - DNA, 17 bp, Homo sapiens
tattttatttagacaag

SEQ ID NO: 1279210 - DNA, 16 bp, Homo sapiens
tattttatttcaatgt

SEQ ID NO: 1279211 - DNA, 14 bp, Homo sapiens
tattttatttgctt

SEQ ID NO: 1279212 - DNA, 16 bp, Homo sapiens
tattttatttgcttat

SEQ ID NO: 1279213 - DNA, 20 bp, Homo sapiens
tattttcaaccataaaagaa

SEQ ID NO: 1279214 - DNA, 22 bp, Homo sapiens
tattttcaaccataaaagaagt

SEQ ID NO: 1279215 - DNA, 21 bp, Homo sapiens
tattttcaacgcagccctgct

SEQ ID NO: 1279216 - DNA, 12 bp, Homo sapiens
tattttcaagag

SEQ ID NO: 1279217 - DNA, 18 bp, Homo sapiens
tattttcaatagccacta

SEQ ID NO: 1279218 - DNA, 13 bp, Homo sapiens
tattttcaccatt

SEQ ID NO: 1279219 - DNA, 23 bp, Homo sapiens
tattttcagctcaattgttaatg

SEQ ID NO: 1279220 - DNA, 17 bp, Homo sapiens
tattttcagtattttgg

SEQ ID NO: 1279221 - DNA, 13 bp, Homo sapiens
tattttcagtccc

SEQ ID NO: 1279222 - DNA, 22 bp, Homo sapiens
tattttcagtcccctctctctg

SEQ ID NO: 1279223 - DNA, 23 bp, Homo sapiens
tattttcagtcccctctctctgg

SEQ ID NO: 1279224 - DNA, 17 bp, Homo sapiens
tattttcatagtgacct

SEQ ID NO: 1279225 - DNA, 14 bp, Homo sapiens
tattttcattgtga

SEQ ID NO: 1279226 - DNA, 18 bp, Homo sapiens
tattttcatttgtacaag

SEQ ID NO: 1279227 - DNA, 20 bp, Homo sapiens
tattttccagccttatgtgt

SEQ ID NO: 1279228 - DNA, 20 bp, Homo sapiens
tattttccctttttaaaaaa

SEQ ID NO: 1279229 - DNA, 12 bp, Homo sapiens
tattttcctccc

SEQ ID NO: 1279230 - DNA, 15 bp, Homo sapiens
tattttctacagtgg

SEQ ID NO: 1279231 - DNA, 20 bp, Homo sapiens
tattttctctgtacttttca

SEQ ID NO: 1279232 - DNA, 23 bp, Homo sapiens
tattttctgcagaaatttgcaac

SEQ ID NO: 1279233 - DNA, 17 bp, Homo sapiens
tattttctgtcagatga

SEQ ID NO: 1279234 - DNA, 20 bp, Homo sapiens
tattttctgtcagatgagaa

SEQ ID NO: 1279235 - DNA, 12 bp, Homo sapiens
tattttcttcat

SEQ ID NO: 1279236 - DNA, 13 bp, Homo sapiens
tattttcttggat

SEQ ID NO: 1279237 - DNA, 14 bp, Homo sapiens
tattttctttaatg

SEQ ID NO: 1279238 - DNA, 16 bp, Homo sapiens
tattttcttttgtaaa

SEQ ID NO: 1279239 - DNA, 19 bp, Homo sapiens
tattttgaaaaagagaaca

SEQ ID NO: 1279240 - DNA, 15 bp, Homo sapiens
tattttgaatcaata

SEQ ID NO: 1279241 - DNA, 11 bp, Homo sapiens
tattttgaatg

SEQ ID NO: 1279242 - DNA, 13 bp, Homo sapiens
tattttgaatgtc

SEQ ID NO: 1279243 - DNA, 16 bp, Homo sapiens
tattttgaatgtgaag

SEQ ID NO: 1279244 - DNA, 18 bp, Homo sapiens
tattttgacataaagttg

SEQ ID NO: 1279245 - DNA, 21 bp, Homo sapiens
tattttgagtcctaggactta

SEQ ID NO: 1279246 - DNA, 13 bp, Homo sapiens
tattttgataaaa

SEQ ID NO: 1279247 - DNA, 15 bp, Homo sapiens
tattttgatgagctt

SEQ ID NO: 1279248 - DNA, 16 bp, Homo sapiens
tattttgattttacat

SEQ ID NO: 1279249 - DNA, 18 bp, Homo sapiens
tattttgcattccagaat

SEQ ID NO: 1279250 - DNA, 13 bp, Homo sapiens
tattttgccactg

SEQ ID NO: 1279251 - DNA, 14 bp, Homo sapiens
tattttgctccctc

SEQ ID NO: 1279252 - DNA, 15 bp, Homo sapiens
tattttgctccctct

SEQ ID NO: 1279253 - DNA, 17 bp, Homo sapiens
tattttgctccctctgt

SEQ ID NO: 1279254 - DNA, 19 bp, Homo sapiens
tattttgctccctctgtta

SEQ ID NO: 1279255 - DNA, 19 bp, Homo sapiens
tattttgctgagttgttct

SEQ ID NO: 1279256 - DNA, 21 bp, Homo sapiens
tattttgctgcttgatgatga

SEQ ID NO: 1279257 - DNA, 15 bp, Homo sapiens
tattttgctttgtga

SEQ ID NO: 1279258 - DNA, 20 bp, Homo sapiens
tattttgctttgtgattttt

SEQ ID NO: 1279259 - DNA, 15 bp, Homo sapiens
tattttggaaactgc

SEQ ID NO: 1279260 - DNA, 22 bp, Homo sapiens
tattttggaataagcattgttt

SEQ ID NO: 1279261 - DNA, 16 bp, Homo sapiens
tattttggctttctcc

SEQ ID NO: 1279262 - DNA, 17 bp, Homo sapiens
tattttggctttctccc

SEQ ID NO: 1279263 - DNA, 19 bp, Homo sapiens
tattttggctttctccctg

SEQ ID NO: 1279264 - DNA, 16 bp, Homo sapiens
tattttgtaatattct

SEQ ID NO: 1279265 - DNA, 16 bp, Homo sapiens
tattttgtagatgtga

SEQ ID NO: 1279266 - DNA, 14 bp, Homo sapiens
tattttgtctaaaa

SEQ ID NO: 1279267 - DNA, 15 bp, Homo sapiens
tattttgtctcctac

SEQ ID NO: 1279268 - DNA, 17 bp, Homo sapiens
tattttgtcttattctt

SEQ ID NO: 1279269 - DNA, 20 bp, Homo sapiens
tattttgtcttattcttaag

SEQ ID NO: 1279270 - DNA, 17 bp, Homo sapiens
tattttgtgtgaccaac

SEQ ID NO: 1279271 - DNA, 22 bp, Homo sapiens
tattttgtgtgaccaactgtgt

SEQ ID NO: 1279272 - DNA, 15 bp, Homo sapiens
tattttgttaaagct

SEQ ID NO: 1279273 - DNA, 16 bp, Homo sapiens
tattttgttaaagctg

SEQ ID NO: 1279274 - DNA, 18 bp, Homo sapiens
tattttgttaacttttgt

SEQ ID NO: 1279275 - DNA, 15 bp, Homo sapiens
tatttttaaaaagaa

SEQ ID NO: 1279276 - DNA, 12 bp, Homo sapiens
tatttttaacac

SEQ ID NO: 1279277 - DNA, 18 bp, Homo sapiens
tatttttaacacttaaat

SEQ ID NO: 1279278 - DNA, 23 bp, Homo sapiens
tatttttaactctggattttgaa

SEQ ID NO: 1279279 - DNA, 22 bp, Homo sapiens
tcaacaaatattcactggcccc

SEQ ID NO: 1279280 - DNA, 19 bp, Homo sapiens
tcaacaacatcagaaagaa

SEQ ID NO: 1279281 - DNA, 16 bp, Homo sapiens
tcaacaagaagaattt

SEQ ID NO: 1279282 - DNA, 20 bp, Homo sapiens
tcaacaagaatattgtatgt

SEQ ID NO: 1279283 - DNA, 20 bp, Homo sapiens
tcaacaagggagagacctca

SEQ ID NO: 1279284 - DNA, 22 bp, Homo sapiens
tcaacaagggagagacctcatc

SEQ ID NO: 1279285 - DNA, 14 bp, Homo sapiens
tcaacaccctgctt

SEQ ID NO: 1279286 - DNA, 15 bp, Homo sapiens
tcaacaccctgcttc

SEQ ID NO: 1279287 - DNA, 16 bp, Homo sapiens
tcaacaccctgcttct

SEQ ID NO: 1279288 - DNA, 19 bp, Homo sapiens
tcaacaccctgcttctccc

SEQ ID NO: 1279289 - DNA, 20 bp, Homo sapiens
tcaacaccctgcttctcccg

SEQ ID NO: 1279290 - DNA, 22 bp, Homo sapiens
tcaacaccctgcttctcccggg

SEQ ID NO: 1279291 - DNA, 18 bp, Homo sapiens
tcaacaccttaatatgct

SEQ ID NO: 1279292 - DNA, 22 bp, Homo sapiens
tcaacaccttaatatgctgcaa

SEQ ID NO: 1279293 - DNA, 19 bp, Homo sapiens
tcaacactatataaataag

SEQ ID NO: 1279294 - DNA, 21 bp, Homo sapiens
tcaacactcttcttgagcaga

SEQ ID NO: 1279295 - DNA, 23 bp, Homo sapiens
tcaacacttaagggttttagaaa

SEQ ID NO: 1279296 - DNA, 18 bp, Homo sapiens
tcaacagaagcatttgta

SEQ ID NO: 1279297 - DNA, 20 bp, Homo sapiens
tcaacagaagcatttgtatt

SEQ ID NO: 1279298 - DNA, 22 bp, Homo sapiens
tcaacagaagcatttgtatttt

SEQ ID NO: 1279299 - DNA, 17 bp, Homo sapiens
tcaacagagggagttta

SEQ ID NO: 1279300 - DNA, 23 bp, Homo sapiens
tcaacagatgaccgtgtacaata

SEQ ID NO: 1279301 - DNA, 19 bp, Homo sapiens
tcaacagatgatagtccaa

SEQ ID NO: 1279302 - DNA, 16 bp, Homo sapiens
tcaacagctatgctgg

SEQ ID NO: 1279303 - DNA, 14 bp, Homo sapiens
tcaacatcaaaact

SEQ ID NO: 1279304 - DNA, 15 bp, Homo sapiens
tcaacatcaaaactt

SEQ ID NO: 1279305 - DNA, 19 bp, Homo sapiens
tcaacatcaaaacttaaga

SEQ ID NO: 1279306 - DNA, 14 bp, Homo sapiens
tcaacatcaatgtt

SEQ ID NO: 1279307 - DNA, 15 bp, Homo sapiens
tcaacatcaatgttc

SEQ ID NO: 1279308 - DNA, 16 bp, Homo sapiens
tcaacatcaatgttca

SEQ ID NO: 1279309 - DNA, 23 bp, Homo sapiens
tcaacatcaatgttcattgtaat

SEQ ID NO: 1279310 - DNA, 15 bp, Homo sapiens
tcaacatcttttaca

SEQ ID NO: 1279311 - DNA, 18 bp, Homo sapiens
tcaacatgtgtttctgac

SEQ ID NO: 1279312 - DNA, 20 bp, Homo sapiens
tcaacatgttactgaccagc

SEQ ID NO: 1279313 - DNA, 16 bp, Homo sapiens
tcaacatttatgacct

SEQ ID NO: 1279314 - DNA, 20 bp, Homo sapiens
tcaacatttttttttctcca

SEQ ID NO: 1279315 - DNA, 18 bp, Homo sapiens
tcaaccacttttaaacat

SEQ ID NO: 1279316 - DNA, 19 bp, Homo sapiens
tcaacccaagctctgggga

SEQ ID NO: 1279317 - DNA, 20 bp, Homo sapiens
tcaacccaagctctggggat

SEQ ID NO: 1279318 - DNA, 13 bp, Homo sapiens
tcaacccccctcc

SEQ ID NO: 1279319 - DNA, 16 bp, Homo sapiens
tcaacccccctcccag

SEQ ID NO: 1279320 - DNA, 14 bp, Homo sapiens
tcaaccctccctca

SEQ ID NO: 1279321 - DNA, 23 bp, Homo sapiens
tcaaccctccctcagcccctctt

SEQ ID NO: 1279322 - DNA, 17 bp, Homo sapiens
tcaaccggaaggaggcc

SEQ ID NO: 1279323 - DNA, 23 bp, Homo sapiens
tcaaccggaaggaggccaaccag

SEQ ID NO: 1279324 - DNA, 15 bp, Homo sapiens
tcaacctaccacccc

SEQ ID NO: 1279325 - DNA, 22 bp, Homo sapiens
tcaacctaccaccccttcctgt

SEQ ID NO: 1279326 - DNA, 23 bp, Homo sapiens
tcaacctaccaccccttcctgtc

SEQ ID NO: 1279327 - DNA, 15 bp, Homo sapiens
tcaacctcctgggtt

SEQ ID NO: 1279328 - DNA, 17 bp, Homo sapiens
tcaacctcttctggctc

SEQ ID NO: 1279329 - DNA, 18 bp, Homo sapiens
tcaacctcttctggctca

SEQ ID NO: 1279330 - DNA, 19 bp, Homo sapiens
tcaacctcttctggctcaa

SEQ ID NO: 1279331 - DNA, 21 bp, Homo sapiens
tcaacctggtggcaccagatg

SEQ ID NO: 1279332 - DNA, 22 bp, Homo sapiens
tcaacggaagccccctcttcct

SEQ ID NO: 1279333 - DNA, 19 bp, Homo sapiens
tcaactcacagcttctcca

SEQ ID NO: 1279334 - DNA, 16 bp, Homo sapiens
tcaactcacctaatgt

SEQ ID NO: 1279335 - DNA, 14 bp, Homo sapiens
tcaactcatcattt

SEQ ID NO: 1279336 - DNA, 21 bp, Homo sapiens
tcaactccaaggcacactgtt

SEQ ID NO: 1279337 - DNA, 22 bp, Homo sapiens
tcaactccctgccccccagccc

SEQ ID NO: 1279338 - DNA, 13 bp, Homo sapiens
tcaactcctggct

SEQ ID NO: 1279339 - DNA, 14 bp, Homo sapiens
tcaactcctggctc

SEQ ID NO: 1279340 - DNA, 20 bp, Homo sapiens
tcaactcgggggcgcctgga

SEQ ID NO: 1279341 - DNA, 20 bp, Homo sapiens
tcaactctccaatgttctat

SEQ ID NO: 1279342 - DNA, 20 bp, Homo sapiens
tcaactctgaagctaattgt

SEQ ID NO: 1279343 - DNA, 14 bp, Homo sapiens
tcaactctgagccc

SEQ ID NO: 1279344 - DNA, 17 bp, Homo sapiens
tcaactctgagcccata

SEQ ID NO: 1279345 - DNA, 16 bp, Homo sapiens
tcaactcttcgaagcc

SEQ ID NO: 1279346 - DNA, 23 bp, Homo sapiens
tcaactgaaaagactcagtgttc

SEQ ID NO: 1279347 - DNA, 21 bp, Homo sapiens
tcaactgaaggggtgcaccca

SEQ ID NO: 1279348 - DNA, 20 bp, Homo sapiens
tcaactgccaaaatgctcta

SEQ ID NO: 1279349 - DNA, 13 bp, Homo sapiens
tcaactgcctcag

SEQ ID NO: 1279350 - DNA, 12 bp, Homo sapiens
tcaactgctttg

SEQ ID NO: 1279351 - DNA, 20 bp, Homo sapiens
tcaactggagtctatgctta

SEQ ID NO: 1279352 - DNA, 17 bp, Homo sapiens
tcaactggttagtgtga

SEQ ID NO: 1279353 - DNA, 16 bp, Homo sapiens
tcaactgtcttcctca

SEQ ID NO: 1279354 - DNA, 16 bp, Homo sapiens
tcaacttctggctcct

SEQ ID NO: 1279355 - DNA, 18 bp, Homo sapiens
tcaacttctggctcctca

SEQ ID NO: 1279356 - DNA, 21 bp, Homo sapiens
tcaactttagtatttttacta

SEQ ID NO: 1279357 - DNA, 16 bp, Homo sapiens
tcaagaaaaaaaggga

SEQ ID NO: 1279358 - DNA, 17 bp, Homo sapiens
tcaagaaactgaggaat

SEQ ID NO: 1279359 - DNA, 18 bp, Homo sapiens
tcaagaaactgaggaatt

SEQ ID NO: 1279360 - DNA, 21 bp, Homo sapiens
tcaagaaataaaaggaagcca

SEQ ID NO: 1279361 - DNA, 16 bp, Homo sapiens
tcaagaaatgtctctg

SEQ ID NO: 1279362 - DNA, 21 bp, Homo sapiens
tcaagaaatgtctctgctcct

SEQ ID NO: 1279363 - DNA, 19 bp, Homo sapiens
tcaagaagacatggagact

SEQ ID NO: 1279364 - DNA, 18 bp, Homo sapiens
tcaagaagggctgcatga

SEQ ID NO: 1279365 - DNA, 20 bp, Homo sapiens
tcaagaagggctgcatgatg

SEQ ID NO: 1279366 - DNA, 21 bp, Homo sapiens
tcaagaataatcacgctttcc

SEQ ID NO: 1279367 - DNA, 17 bp, Homo sapiens
tcaagaatctagaagat

SEQ ID NO: 1279368 - DNA, 19 bp, Homo sapiens
tcaagaatctagaagatgt

SEQ ID NO: 1279369 - DNA, 21 bp, Homo sapiens
tcaagaatctagaagatgtgt

SEQ ID NO: 1279370 - DNA, 23 bp, Homo sapiens
tcaagaatctagaagatgtgtaa

SEQ ID NO: 1279371 - DNA, 21 bp, Homo sapiens
tcaagaatgaaaaatataatg

SEQ ID NO: 1279372 - DNA, 15 bp, Homo sapiens
tcaagaatgcaatat

SEQ ID NO: 1279373 - DNA, 11 bp, Homo sapiens
tcaagacattt

SEQ ID NO: 1279374 - DNA, 17 bp, Homo sapiens
tcaagacatttgctgaa

SEQ ID NO: 1279375 - DNA, 18 bp, Homo sapiens
tcaagactatctacaaaa

SEQ ID NO: 1279376 - DNA, 19 bp, Homo sapiens
tcaagactatctacaaaaa

SEQ ID NO: 1279377 - DNA, 14 bp, Homo sapiens
tcaagactttagct

SEQ ID NO: 1279378 - DNA, 21 bp, Homo sapiens
tcaagactttagcttttcctt

SEQ ID NO: 1279379 - DNA, 12 bp, Homo sapiens
tcaagactttga

SEQ ID NO: 1279380 - DNA, 20 bp, Homo sapiens
tcaagactttgatccttgga

SEQ ID NO: 1279381 - DNA, 21 bp, Homo sapiens
tcaagactttgatccttggaa

SEQ ID NO: 1279382 - DNA, 20 bp, Homo sapiens
tcaagaggaaaggcgccccc

SEQ ID NO: 1279383 - DNA, 22 bp, Homo sapiens
tcaagaggaatctgtttctctg

SEQ ID NO: 1279384 - DNA, 22 bp, Homo sapiens
tcaagaggcaggttagaagaac

SEQ ID NO: 1279385 - DNA, 22 bp, Homo sapiens
tcaagaggcgtgtgcaggccga

SEQ ID NO: 1279386 - DNA, 16 bp, Homo sapiens
tcaagagtggggggag

SEQ ID NO: 1279387 - DNA, 19 bp, Homo sapiens
tcaagatactgctactgta

SEQ ID NO: 1279388 - DNA, 21 bp, Homo sapiens
tcaagatactgctactgtaat

SEQ ID NO: 1279389 - DNA, 21 bp, Homo sapiens
tcaagatatatgtgtatacat

SEQ ID NO: 1279390 - DNA, 14 bp, Homo sapiens
tcaagattctaaag

SEQ ID NO: 1279391 - DNA, 17 bp, Homo sapiens
tcaagattctaaagctc

SEQ ID NO: 1279392 - DNA, 20 bp, Homo sapiens
tcaagattctaaagctcaat

SEQ ID NO: 1279393 - DNA, 13 bp, Homo sapiens
tcaagattttgaa

SEQ ID NO: 1279394 - DNA, 22 bp, Homo sapiens
tcaagcaaaaaaggtaactaac

SEQ ID NO: 1279395 - DNA, 14 bp, Homo sapiens
tcaagcaaacatca

SEQ ID NO: 1279396 - DNA, 21 bp, Homo sapiens
tcaagcaaacatcaaataaat

SEQ ID NO: 1279397 - DNA, 19 bp, Homo sapiens
tcaagcaatccacctgcct

SEQ ID NO: 1279398 - DNA, 19 bp, Homo sapiens
tcaagcaatcctcctacct

SEQ ID NO: 1279399 - DNA, 20 bp, Homo sapiens
tcacaaaaatttgaacactg

SEQ ID NO: 1279400 - DNA, 21 bp, Homo sapiens
tcacaaaaatttgaacactgg

SEQ ID NO: 1279401 - DNA, 21 bp, Homo sapiens
tcacaaaacctggcacaatgg

SEQ ID NO: 1279402 - DNA, 18 bp, Homo sapiens
tcacaaactgtgaaaata

SEQ ID NO: 1279403 - DNA, 19 bp, Homo sapiens
tcacaaactgtgaaaatag

SEQ ID NO: 1279404 - DNA, 12 bp, Homo sapiens
tcacaaagccca

SEQ ID NO: 1279405 - DNA, 19 bp, Homo sapiens
tcacaaaggctgatgtctt

SEQ ID NO: 1279406 - DNA, 15 bp, Homo sapiens
tcacaaatgtcattg

SEQ ID NO: 1279407 - DNA, 20 bp, Homo sapiens
tcacaaatgtcattgtctac

SEQ ID NO: 1279408 - DNA, 18 bp, Homo sapiens
tcacaaattgatcaagat

SEQ ID NO: 1279409 - DNA, 22 bp, Homo sapiens
tcacaacagcctgacaacattt

SEQ ID NO: 1279410 - DNA, 17 bp, Homo sapiens
tcacaacctcaccaaac

SEQ ID NO: 1279411 - DNA, 21 bp, Homo sapiens
tcacaacctcaccaaactagt

SEQ ID NO: 1279412 - DNA, 22 bp, Homo sapiens
tcacaacctcaccaaactagta

SEQ ID NO: 1279413 - DNA, 16 bp, Homo sapiens
tcacaacctgaaccta

SEQ ID NO: 1279414 - DNA, 19 bp, Homo sapiens
tcacaacctgaacctagga

SEQ ID NO: 1279415 - DNA, 14 bp, Homo sapiens
tcacaaccttctgt

SEQ ID NO: 1279416 - DNA, 16 bp, Homo sapiens
tcacaagcctcctgta

SEQ ID NO: 1279417 - DNA, 17 bp, Homo sapiens
tcacaagcctcttctga

SEQ ID NO: 1279418 - DNA, 22 bp, Homo sapiens
tcacaagggcaaactttttcct

SEQ ID NO: 1279419 - DNA, 19 bp, Homo sapiens
tcacaagggctctcaaagt

SEQ ID NO: 1279420 - DNA, 21 bp, Homo sapiens
tcacaagtctcctagacactc

SEQ ID NO: 1279421 - DNA, 16 bp, Homo sapiens
tcacaagtgaaaaaca

SEQ ID NO: 1279422 - DNA, 18 bp, Homo sapiens
tcacaagttctatttctt

SEQ ID NO: 1279423 - DNA, 21 bp, Homo sapiens
tcacaagttctatttcttgaa

SEQ ID NO: 1279424 - DNA, 22 bp, Homo sapiens
tcacaataaatggccagtgctg

SEQ ID NO: 1279425 - DNA, 14 bp, Homo sapiens
tcacaatagaaact

SEQ ID NO: 1279426 - DNA, 21 bp, Homo sapiens
tcacaatagccgatatcagaa

SEQ ID NO: 1279427 - DNA, 18 bp, Homo sapiens
tcacaatgagtttgggca

SEQ ID NO: 1279428 - DNA, 14 bp, Homo sapiens
tcacacaactactt

SEQ ID NO: 1279429 - DNA, 13 bp, Homo sapiens
tcacacacacagc

SEQ ID NO: 1279430 - DNA, 18 bp, Homo sapiens
tcacacacacagctgggc

SEQ ID NO: 1279431 - DNA, 20 bp, Homo sapiens
tcacacacaggcaactgagg

SEQ ID NO: 1279432 - DNA, 15 bp, Homo sapiens
tcacacaccagcact

SEQ ID NO: 1279433 - DNA, 17 bp, Homo sapiens
tcacacactcacaattt

SEQ ID NO: 1279434 - DNA, 12 bp, Homo sapiens
tcacacactgat

SEQ ID NO: 1279435 - DNA, 11 bp, Homo sapiens
tcacacactgg

SEQ ID NO: 1279436 - DNA, 12 bp, Homo sapiens
tcacacactgga

SEQ ID NO: 1279437 - DNA, 20 bp, Homo sapiens
tcacacactggaccccactg

SEQ ID NO: 1279438 - DNA, 22 bp, Homo sapiens
tcacacactggaccccactggc

SEQ ID NO: 1279439 - DNA, 15 bp, Homo sapiens
tcacacactttctct

SEQ ID NO: 1279440 - DNA, 18 bp, Homo sapiens
tcacacactttctcttca

SEQ ID NO: 1279441 - DNA, 14 bp, Homo sapiens
tcacacagacacta

SEQ ID NO: 1279442 - DNA, 19 bp, Homo sapiens
tcacacaggacccccttcc

SEQ ID NO: 1279443 - DNA, 11 bp, Homo sapiens
tcacacagtgt

SEQ ID NO: 1279444 - DNA, 20 bp, Homo sapiens
tcacacatccagctgcccct

SEQ ID NO: 1279445 - DNA, 18 bp, Homo sapiens
tcacacatctgggtgccc

SEQ ID NO: 1279446 - DNA, 20 bp, Homo sapiens
tcacacatctgggtgccctg

SEQ ID NO: 1279447 - DNA, 23 bp, Homo sapiens
tcacacatgcacttttgggcctt

SEQ ID NO: 1279448 - DNA, 18 bp, Homo sapiens
tcacaccaacagtgtgaa

SEQ ID NO: 1279449 - DNA, 19 bp, Homo sapiens
tcacaccatcttaaatgac

SEQ ID NO: 1279450 - DNA, 20 bp, Homo sapiens
tcacaccatcttaaatgaca

SEQ ID NO: 1279451 - DNA, 22 bp, Homo sapiens
tcacacccaacttggttttgct

SEQ ID NO: 1279452 - DNA, 15 bp, Homo sapiens
tcacacccaccgtcc

SEQ ID NO: 1279453 - DNA, 13 bp, Homo sapiens
tcacacccctgtc

SEQ ID NO: 1279454 - DNA, 15 bp, Homo sapiens
tcacacctctgggct

SEQ ID NO: 1279455 - DNA, 19 bp, Homo sapiens
tcacacctgactctgaaat

SEQ ID NO: 1279456 - DNA, 19 bp, Homo sapiens
tcacacctgtaatcccaac

SEQ ID NO: 1279457 - DNA, 18 bp, Homo sapiens
tcacactaagagggcaga

SEQ ID NO: 1279458 - DNA, 18 bp, Homo sapiens
tcacactcaaggacagga

SEQ ID NO: 1279459 - DNA, 17 bp, Homo sapiens
tcacactccccgcggtt

SEQ ID NO: 1279460 - DNA, 14 bp, Homo sapiens
tcacactcctgggc

SEQ ID NO: 1279461 - DNA, 15 bp, Homo sapiens
tcacactcctgggct

SEQ ID NO: 1279462 - DNA, 20 bp, Homo sapiens
tcacactcctgggctctgaa

SEQ ID NO: 1279463 - DNA, 16 bp, Homo sapiens
tcacactctaactgta

SEQ ID NO: 1279464 - DNA, 21 bp, Homo sapiens
tcacactctaactgtatattt

SEQ ID NO: 1279465 - DNA, 15 bp, Homo sapiens
tcacactctctgcag

SEQ ID NO: 1279466 - DNA, 23 bp, Homo sapiens
tcacactctctgcagcccagcct

SEQ ID NO: 1279467 - DNA, 20 bp, Homo sapiens
tcacactgatacataaaaat

SEQ ID NO: 1279468 - DNA, 23 bp, Homo sapiens
tcacactgatacataaaaattaa

SEQ ID NO: 1279469 - DNA, 17 bp, Homo sapiens
tcacactgatgggctgg

SEQ ID NO: 1279470 - DNA, 23 bp, Homo sapiens
tcacactgatgggctggggcagg

SEQ ID NO: 1279471 - DNA, 16 bp, Homo sapiens
tcacactggtaaatgt

SEQ ID NO: 1279472 - DNA, 17 bp, Homo sapiens
tcacactggttctcaat

SEQ ID NO: 1279473 - DNA, 19 bp, Homo sapiens
tcacactggttctcaatga

SEQ ID NO: 1279474 - DNA, 21 bp, Homo sapiens
tcacactgtgtgaggctgtgt

SEQ ID NO: 1279475 - DNA, 16 bp, Homo sapiens
tcacacttctgtgaga

SEQ ID NO: 1279476 - DNA, 16 bp, Homo sapiens
tcacagaaaaagcatg

SEQ ID NO: 1279477 - DNA, 23 bp, Homo sapiens
tcacagaaaaagcatgatgggaa

SEQ ID NO: 1279478 - DNA, 16 bp, Homo sapiens
tcacagaaaatttaac

SEQ ID NO: 1279479 - DNA, 21 bp, Homo sapiens
tcacagaacccttggagccaa

SEQ ID NO: 1279480 - DNA, 14 bp, Homo sapiens
tcacagaaggatcg

SEQ ID NO: 1279481 - DNA, 17 bp, Homo sapiens
tcacagacctggagccc

SEQ ID NO: 1279482 - DNA, 19 bp, Homo sapiens
tcacagacctggagcccct

SEQ ID NO: 1279483 - DNA, 22 bp, Homo sapiens
tcacagacctggagcccctggg

SEQ ID NO: 1279484 - DNA, 23 bp, Homo sapiens
tcacagacctggagcccctgggt

SEQ ID NO: 1279485 - DNA, 16 bp, Homo sapiens
tcacagagcacgcctg

SEQ ID NO: 1279486 - DNA, 17 bp, Homo sapiens
tcacagagcacgcctgc

SEQ ID NO: 1279487 - DNA, 15 bp, Homo sapiens
tcacagagcagagtc

SEQ ID NO: 1279488 - DNA, 22 bp, Homo sapiens
tcacagattgaggtaataatga

SEQ ID NO: 1279489 - DNA, 21 bp, Homo sapiens
tcacagcatggaggaggaggg

SEQ ID NO: 1279490 - DNA, 15 bp, Homo sapiens
tcacagcccagcccg

SEQ ID NO: 1279491 - DNA, 12 bp, Homo sapiens
tcacagcctcca

SEQ ID NO: 1279492 - DNA, 15 bp, Homo sapiens
tcacagcgtttcagg

SEQ ID NO: 1279493 - DNA, 15 bp, Homo sapiens
tcacagctcactgca

SEQ ID NO: 1279494 - DNA, 16 bp, Homo sapiens
tcacagctcctcccac

SEQ ID NO: 1279495 - DNA, 11 bp, Homo sapiens
tcacagctgca

SEQ ID NO: 1279496 - DNA, 22 bp, Homo sapiens
tcacagctgcagctgggcccca

SEQ ID NO: 1279497 - DNA, 11 bp, Homo sapiens
tcacagctgct

SEQ ID NO: 1279498 - DNA, 19 bp, Homo sapiens
tcacagcttattatccaat

SEQ ID NO: 1279499 - DNA, 14 bp, Homo sapiens
tcacagcttctcca

SEQ ID NO: 1279500 - DNA, 15 bp, Homo sapiens
tcacagcttctccaa

SEQ ID NO: 1279501 - DNA, 19 bp, Homo sapiens
tcacagcttctccaagcat

SEQ ID NO: 1279502 - DNA, 20 bp, Homo sapiens
tcacagcttctccaagcatc

SEQ ID NO: 1279503 - DNA, 19 bp, Homo sapiens
tcacaggagcaatcacagg

SEQ ID NO: 1279504 - DNA, 13 bp, Homo sapiens
tcacaggcagtgc

SEQ ID NO: 1279505 - DNA, 14 bp, Homo sapiens
tcacaggctgggtc

SEQ ID NO: 1279506 - DNA, 22 bp, Homo sapiens
tcacaggcttctgagcacagct

SEQ ID NO: 1279507 - DNA, 15 bp, Homo sapiens
tcacagggcagagcc

SEQ ID NO: 1279508 - DNA, 19 bp, Homo sapiens
tcacaggggcggggcagga

SEQ ID NO: 1279509 - DNA, 14 bp, Homo sapiens
tcacaggggtacag

SEQ ID NO: 1279510 - DNA, 19 bp, Homo sapiens
tcacagggttgggcccaga

SEQ ID NO: 1279511 - DNA, 23 bp, Homo sapiens
tcacagggttgggcccagatctg

SEQ ID NO: 1279512 - DNA, 15 bp, Homo sapiens
tcacagtaaaaataa

SEQ ID NO: 1279513 - DNA, 18 bp, Homo sapiens
tcacagtacagcatgtgc

SEQ ID NO: 1279514 - DNA, 14 bp, Homo sapiens
tcacagtcaatgga

SEQ ID NO: 1279515 - DNA, 16 bp, Homo sapiens
tcacagtccaaccaga

SEQ ID NO: 1279516 - DNA, 17 bp, Homo sapiens
tcacagtcctatgtaca

SEQ ID NO: 1279517 - DNA, 21 bp, Homo sapiens
tcacagtcctatgtacagagc

SEQ ID NO: 1279518 - DNA, 23 bp, Homo sapiens
tcacagtcctatgtacagagctt

SEQ ID NO: 1279519 - DNA, 20 bp, Homo sapiens
tcacagtctcagttctcttg

SEQ ID NO: 1279520 - DNA, 22 bp, Homo sapiens
tcacgatttgcaggattccctt

SEQ ID NO: 1279521 - DNA, 23 bp, Homo sapiens
tcacgatttgcaggattcccttc

SEQ ID NO: 1279522 - DNA, 20 bp, Homo sapiens
tcacgcaagtgccagggctg

SEQ ID NO: 1279523 - DNA, 15 bp, Homo sapiens
tcacgcaggctgagt

SEQ ID NO: 1279524 - DNA, 20 bp, Homo sapiens
tcacgcaggctgagtccaga

SEQ ID NO: 1279525 - DNA, 12 bp, Homo sapiens
tcacgccacccc

SEQ ID NO: 1279526 - DNA, 13 bp, Homo sapiens
tcacgccaccccc

SEQ ID NO: 1279527 - DNA, 17 bp, Homo sapiens
tcacgccactgcactcc

SEQ ID NO: 1279528 - DNA, 17 bp, Homo sapiens
tcacgccccgctgtgtc

SEQ ID NO: 1279529 - DNA, 15 bp, Homo sapiens
tcacgccctcttgtt

SEQ ID NO: 1279530 - DNA, 14 bp, Homo sapiens
tcacgcctgtaatc

SEQ ID NO: 1279531 - DNA, 16 bp, Homo sapiens
tcacgcctgtaatccc

SEQ ID NO: 1279532 - DNA, 21 bp, Homo sapiens
tcacgcctgtaatcccagcag

SEQ ID NO: 1279533 - DNA, 20 bp, Homo sapiens
tcacgcctgtaatcctagca

SEQ ID NO: 1279534 - DNA, 18 bp, Homo sapiens
tcacgccttggcctccca

SEQ ID NO: 1279535 - DNA, 20 bp, Homo sapiens
tcacgctcccccgcagtccc

SEQ ID NO: 1279536 - DNA, 22 bp, Homo sapiens
tcacgctccctgacttctcccc

SEQ ID NO: 1279537 - DNA, 20 bp, Homo sapiens
tcacgcttgcctggtcaccc

SEQ ID NO: 1279538 - DNA, 12 bp, Homo sapiens
tcacgctttcat

SEQ ID NO: 1279539 - DNA, 16 bp, Homo sapiens
tcacgctttcctgaat

SEQ ID NO: 1279540 - DNA, 18 bp, Homo sapiens
tcacggctgcgcactgtg

SEQ ID NO: 1279541 - DNA, 19 bp, Homo sapiens
tcacggctgcgcactgtgt

SEQ ID NO: 1279542 - DNA, 19 bp, Homo sapiens
tcacgggcatgggcactcc

SEQ ID NO: 1279543 - DNA, 14 bp, Homo sapiens
tcacgggccctgcc

SEQ ID NO: 1279544 - DNA, 17 bp, Homo sapiens
tcacgggccctgcccca

SEQ ID NO: 1279545 - DNA, 22 bp, Homo sapiens
tcacgggccctgccccagcccc

SEQ ID NO: 1279546 - DNA, 13 bp, Homo sapiens
tcacggggcctcc

SEQ ID NO: 1279547 - DNA, 21 bp, Homo sapiens
tcacggggttccctcctagct

SEQ ID NO: 1279548 - DNA, 22 bp, Homo sapiens
tcacggggttggctgttccaga

SEQ ID NO: 1279549 - DNA, 23 bp, Homo sapiens
tcacggggttggctgttccagac

SEQ ID NO: 1279550 - DNA, 21 bp, Homo sapiens
tcacggtgacacaggtcaggg

SEQ ID NO: 1279551 - DNA, 17 bp, Homo sapiens
tcacggtggtaaagaaa

SEQ ID NO: 1279552 - DNA, 13 bp, Homo sapiens
tcacgtaaatatt

SEQ ID NO: 1279553 - DNA, 17 bp, Homo sapiens
tcacgtaccccactggg

SEQ ID NO: 1279554 - DNA, 18 bp, Homo sapiens
tcacgtaccccactgggc

SEQ ID NO: 1279555 - DNA, 18 bp, Homo sapiens
tcacgtatttcacagagc

SEQ ID NO: 1279556 - DNA, 19 bp, Homo sapiens
tcacgtatttcacagagca

SEQ ID NO: 1279557 - DNA, 12 bp, Homo sapiens
tcacgtcatttg

SEQ ID NO: 1279558 - DNA, 23 bp, Homo sapiens
tcacgtgcaggacagctcttgat

SEQ ID NO: 1279559 - DNA, 16 bp, Homo sapiens
tcacgtgtgtgactca

SEQ ID NO: 1279560 - DNA, 20 bp, Homo sapiens
tcacgttaccttgacacata

SEQ ID NO: 1279561 - DNA, 18 bp, Homo sapiens
tcacgttagaggaaaaat

SEQ ID NO: 1279562 - DNA, 21 bp, Homo sapiens
tcacgtttggtgcttctcaga

SEQ ID NO: 1279563 - DNA, 16 bp, Homo sapiens
tcacgttttctttaca

SEQ ID NO: 1279564 - DNA, 21 bp, Homo sapiens
tcactaaataaacacgatttt

SEQ ID NO: 1279565 - DNA, 17 bp, Homo sapiens
tcactaaatcttttata

SEQ ID NO: 1279566 - DNA, 14 bp, Homo sapiens
tcactaaatgtaaa

SEQ ID NO: 1279567 - DNA, 17 bp, Homo sapiens
tcactaacagggagaag

SEQ ID NO: 1279568 - DNA, 19 bp, Homo sapiens
tcactaacagggagaagta

SEQ ID NO: 1279569 - DNA, 15 bp, Homo sapiens
tcactaatacacagt

SEQ ID NO: 1279570 - DNA, 13 bp, Homo sapiens
tcactacaactga

SEQ ID NO: 1279571 - DNA, 23 bp, Homo sapiens
tcactaccctaatagactaaatg

SEQ ID NO: 1279572 - DNA, 16 bp, Homo sapiens
tcactaccctgattct

SEQ ID NO: 1279573 - DNA, 21 bp, Homo sapiens
tcactaccgtggaccacctag

SEQ ID NO: 1279574 - DNA, 19 bp, Homo sapiens
tcactactcacagtctctt

SEQ ID NO: 1279575 - DNA, 22 bp, Homo sapiens
tcactactcacagtctctttaa

SEQ ID NO: 1279576 - DNA, 20 bp, Homo sapiens
tcactactgaacacatgtgt

SEQ ID NO: 1279577 - DNA, 11 bp, Homo sapiens
tcactactgta

SEQ ID NO: 1279578 - DNA, 21 bp, Homo sapiens
tcactagaagaaaagcccatt

SEQ ID NO: 1279579 - DNA, 19 bp, Homo sapiens
tcactaggcccccacttgc

SEQ ID NO: 1279580 - DNA, 18 bp, Homo sapiens
tcactaggctaaactcaa

SEQ ID NO: 1279581 - DNA, 22 bp, Homo sapiens
tcactaggctaaactcaagatt

SEQ ID NO: 1279582 - DNA, 16 bp, Homo sapiens
tcactagtgaacaatt

SEQ ID NO: 1279583 - DNA, 13 bp, Homo sapiens
tcactataaatgg

SEQ ID NO: 1279584 - DNA, 19 bp, Homo sapiens
tcactataatgtgaaatgt

SEQ ID NO: 1279585 - DNA, 20 bp, Homo sapiens
tcactatggtatgctggcca

SEQ ID NO: 1279586 - DNA, 12 bp, Homo sapiens
tcactattctta

SEQ ID NO: 1279587 - DNA, 14 bp, Homo sapiens
tcactattgaaaaa

SEQ ID NO: 1279588 - DNA, 15 bp, Homo sapiens
tcactatttccttta

SEQ ID NO: 1279589 - DNA, 17 bp, Homo sapiens
tcactatttcctttata

SEQ ID NO: 1279590 - DNA, 21 bp, Homo sapiens
tcactcaaccataacacttga

SEQ ID NO: 1279591 - DNA, 13 bp, Homo sapiens
tcactcactcact

SEQ ID NO: 1279592 - DNA, 16 bp, Homo sapiens
tcactcactcactcca

SEQ ID NO: 1279593 - DNA, 16 bp, Homo sapiens
tcactcactcattcct

SEQ ID NO: 1279594 - DNA, 11 bp, Homo sapiens
tcactcactcc

SEQ ID NO: 1279595 - DNA, 14 bp, Homo sapiens
tcactcactccaag

SEQ ID NO: 1279596 - DNA, 19 bp, Homo sapiens
tcactcactccccactccc

SEQ ID NO: 1279597 - DNA, 18 bp, Homo sapiens
tcactcactgaggccatc

SEQ ID NO: 1279598 - DNA, 16 bp, Homo sapiens
tcactcagcccctacc

SEQ ID NO: 1279599 - DNA, 22 bp, Homo sapiens
tcactcagcttaattctccttc

SEQ ID NO: 1279600 - DNA, 20 bp, Homo sapiens
tcactcatgcaaactgcttt

SEQ ID NO: 1279601 - DNA, 18 bp, Homo sapiens
tcactcattaatgaatca

SEQ ID NO: 1279602 - DNA, 15 bp, Homo sapiens
tcactccaagaccac

SEQ ID NO: 1279603 - DNA, 14 bp, Homo sapiens
tcactccaccatcc

SEQ ID NO: 1279604 - DNA, 17 bp, Homo sapiens
tcactccagccaaagaa

SEQ ID NO: 1279605 - DNA, 14 bp, Homo sapiens
tcactcccagtcca

SEQ ID NO: 1279606 - DNA, 18 bp, Homo sapiens
tcactcccataagctaag

SEQ ID NO: 1279607 - DNA, 11 bp, Homo sapiens
tcactccccac

SEQ ID NO: 1279608 - DNA, 12 bp, Homo sapiens
tcactccccact

SEQ ID NO: 1279609 - DNA, 15 bp, Homo sapiens
tcactccccactccc

SEQ ID NO: 1279610 - DNA, 19 bp, Homo sapiens
tcactccccagcctgggcc

SEQ ID NO: 1279611 - DNA, 21 bp, Homo sapiens
tcactccccatgccacgttcc

SEQ ID NO: 1279612 - DNA, 14 bp, Homo sapiens
tcactccctctgca

SEQ ID NO: 1279613 - DNA, 16 bp, Homo sapiens
tcactccctcttggtt

SEQ ID NO: 1279614 - DNA, 20 bp, Homo sapiens
tcactccggtgtgcctgcag

SEQ ID NO: 1279615 - DNA, 21 bp, Homo sapiens
tcactccggtgtgcctgcagc

SEQ ID NO: 1279616 - DNA, 18 bp, Homo sapiens
tcactcctaggagagcca

SEQ ID NO: 1279617 - DNA, 17 bp, Homo sapiens
tcactcctgaattcagt

SEQ ID NO: 1279618 - DNA, 18 bp, Homo sapiens
tcactcctgaattcagtt

SEQ ID NO: 1279619 - DNA, 17 bp, Homo sapiens
tcactcctgactgcccg

SEQ ID NO: 1279620 - DNA, 13 bp, Homo sapiens
tcactcctgcttc

SEQ ID NO: 1279621 - DNA, 11 bp, Homo sapiens
tcactcctgga

SEQ ID NO: 1279622 - DNA, 13 bp, Homo sapiens
tcactcctggggc

SEQ ID NO: 1279623 - DNA, 20 bp, Homo sapiens
tcactcctggggcctcttgg

SEQ ID NO: 1279624 - DNA, 15 bp, Homo sapiens
tcactccttttaaag

SEQ ID NO: 1279625 - DNA, 16 bp, Homo sapiens
tcactctaagtcatgt

SEQ ID NO: 1279626 - DNA, 16 bp, Homo sapiens
tcactctgccctctgc

SEQ ID NO: 1279627 - DNA, 13 bp, Homo sapiens
tcactctggcctc

SEQ ID NO: 1279628 - DNA, 14 bp, Homo sapiens
tcactctggcctca

SEQ ID NO: 1279629 - DNA, 13 bp, Homo sapiens
tcactctgtcagc

SEQ ID NO: 1279630 - DNA, 15 bp, Homo sapiens
tcactctgtcagcca

SEQ ID NO: 1279631 - DNA, 18 bp, Homo sapiens
tcactctgtcagccagcc

SEQ ID NO: 1279632 - DNA, 21 bp, Homo sapiens
tcactctgtccctgtccttcc

SEQ ID NO: 1279633 - DNA, 23 bp, Homo sapiens
tcactctgtccctgtccttccct

SEQ ID NO: 1279634 - DNA, 24 bp, Homo sapiens
tcactctgtccctgtccttccctg

SEQ ID NO: 1279635 - DNA, 14 bp, Homo sapiens
tcactctgtcgctc

SEQ ID NO: 1279636 - DNA, 21 bp, Homo sapiens
tcactctgtcgctcaggctgg

SEQ ID NO: 1279637 - DNA, 16 bp, Homo sapiens
tcactcttcacttgag

SEQ ID NO: 1279638 - DNA, 17 bp, Homo sapiens
tcactcttccagaatcc

SEQ ID NO: 1279639 - DNA, 13 bp, Homo sapiens
tcactcttcctca

SEQ ID NO: 1279640 - DNA, 22 bp, Homo sapiens
tcactcttggtccctggaagct

SEQ ID NO: 1279641 - DNA, 15 bp, Homo sapiens
tcactctttacatgg

SEQ ID NO: 1279642 - DNA, 22 bp, Homo sapiens
tcagaattggcataatttgtct

SEQ ID NO: 1279643 - DNA, 23 bp, Homo sapiens
tcagaatttctttgtcattcaag

SEQ ID NO: 1279644 - DNA, 14 bp, Homo sapiens
tcagacaaaatgga

SEQ ID NO: 1279645 - DNA, 20 bp, Homo sapiens
tcagacaataccactggtta

SEQ ID NO: 1279646 - DNA, 15 bp, Homo sapiens
tcagacacagctctt

SEQ ID NO: 1279647 - DNA, 21 bp, Homo sapiens
tcagacacagctcttccaggg

SEQ ID NO: 1279648 - DNA, 19 bp, Homo sapiens
tcagacacctgttcacaga

SEQ ID NO: 1279649 - DNA, 20 bp, Homo sapiens
tcagacacctgttcacagaa

SEQ ID NO: 1279650 - DNA, 22 bp, Homo sapiens
tcagacactgccgacatcagca

SEQ ID NO: 1279651 - DNA, 22 bp, Homo sapiens
tcagacatccatgtttgtaaaa

SEQ ID NO: 1279652 - DNA, 23 bp, Homo sapiens
tcagacatctccagtgtgccaga

SEQ ID NO: 1279653 - DNA, 19 bp, Homo sapiens
tcagacatctgaggtttta

SEQ ID NO: 1279654 - DNA, 14 bp, Homo sapiens
tcagacatgttttc

SEQ ID NO: 1279655 - DNA, 14 bp, Homo sapiens
tcagaccagctctt

SEQ ID NO: 1279656 - DNA, 18 bp, Homo sapiens
tcagaccagtactgggaa

SEQ ID NO: 1279657 - DNA, 23 bp, Homo sapiens
tcagaccataatgttacattatt

SEQ ID NO: 1279658 - DNA, 13 bp, Homo sapiens
tcagacccagaga

SEQ ID NO: 1279659 - DNA, 13 bp, Homo sapiens
tcagacccagatg

SEQ ID NO: 1279660 - DNA, 15 bp, Homo sapiens
tcagaccccacccta

SEQ ID NO: 1279661 - DNA, 13 bp, Homo sapiens
tcagaccccagcg

SEQ ID NO: 1279662 - DNA, 22 bp, Homo sapiens
tcagaccccagttctaggggag

SEQ ID NO: 1279663 - DNA, 18 bp, Homo sapiens
tcagacccccactctcat

SEQ ID NO: 1279664 - DNA, 22 bp, Homo sapiens
tcagacccccactctcattccc

SEQ ID NO: 1279665 - DNA, 16 bp, Homo sapiens
tcagacccctgcctgg

SEQ ID NO: 1279666 - DNA, 23 bp, Homo sapiens
tcagacccctttgagagacgcca

SEQ ID NO: 1279667 - DNA, 13 bp, Homo sapiens
tcagaccctaccc

SEQ ID NO: 1279668 - DNA, 14 bp, Homo sapiens
tcagaccctacccc

SEQ ID NO: 1279669 - DNA, 13 bp, Homo sapiens
tcagaccctttag

SEQ ID NO: 1279670 - DNA, 18 bp, Homo sapiens
tcagacctgtcttccaag

SEQ ID NO: 1279671 - DNA, 18 bp, Homo sapiens
tcagacgttgcctgagaa

SEQ ID NO: 1279672 - DNA, 17 bp, Homo sapiens
tcagactctagaaaaaa

SEQ ID NO: 1279673 - DNA, 18 bp, Homo sapiens
tcagactgacactactaa

SEQ ID NO: 1279674 - DNA, 14 bp, Homo sapiens
tcagactgcatgta

SEQ ID NO: 1279675 - DNA, 13 bp, Homo sapiens
tcagactgctggg

SEQ ID NO: 1279676 - DNA, 21 bp, Homo sapiens
tcagactgctgggactggcca

SEQ ID NO: 1279677 - DNA, 14 bp, Homo sapiens
tcagactggctggc

SEQ ID NO: 1279678 - DNA, 19 bp, Homo sapiens
tcagacttccaaatcctgg

SEQ ID NO: 1279679 - DNA, 16 bp, Homo sapiens
tcagactttaaagaat

SEQ ID NO: 1279680 - DNA, 21 bp, Homo sapiens
tcagagaaggaaaagactgaa

SEQ ID NO: 1279681 - DNA, 22 bp, Homo sapiens
tcagagacaaaatatttcccat

SEQ ID NO: 1279682 - DNA, 18 bp, Homo sapiens
tcagagaccagcactcag

SEQ ID NO: 1279683 - DNA, 20 bp, Homo sapiens
tcagagaccagcactcagcc

SEQ ID NO: 1279684 - DNA, 12 bp, Homo sapiens
tcagagaccagg

SEQ ID NO: 1279685 - DNA, 15 bp, Homo sapiens
tcagagaccagggct

SEQ ID NO: 1279686 - DNA, 17 bp, Homo sapiens
tcagagactcagggccc

SEQ ID NO: 1279687 - DNA, 19 bp, Homo sapiens
tcagagactcagggcccca

SEQ ID NO: 1279688 - DNA, 20 bp, Homo sapiens
tcagagagacctcatcctgc

SEQ ID NO: 1279689 - DNA, 12 bp, Homo sapiens
tcagagagccta

SEQ ID NO: 1279690 - DNA, 13 bp, Homo sapiens
tcagagagctggt

SEQ ID NO: 1279691 - DNA, 14 bp, Homo sapiens
tcagagaggcaagg

SEQ ID NO: 1279692 - DNA, 16 bp, Homo sapiens
tcagagaggccttttg

SEQ ID NO: 1279693 - DNA, 11 bp, Homo sapiens
tcagagagggt

SEQ ID NO: 1279694 - DNA, 17 bp, Homo sapiens
tcagagaggtctcaggt

SEQ ID NO: 1279695 - DNA, 14 bp, Homo sapiens
tcagagagtcaatg

SEQ ID NO: 1279696 - DNA, 16 bp, Homo sapiens
tcagagagtgtacatc

SEQ ID NO: 1279697 - DNA, 21 bp, Homo sapiens
tcagagagtgtacatcatgtt

SEQ ID NO: 1279698 - DNA, 21 bp, Homo sapiens
tcagagcaagttcctgagtgc

SEQ ID NO: 1279699 - DNA, 13 bp, Homo sapiens
tcagagcactccc

SEQ ID NO: 1279700 - DNA, 15 bp, Homo sapiens
tcagagcagagcaaa

SEQ ID NO: 1279701 - DNA, 13 bp, Homo sapiens
tcagagcaggacc

SEQ ID NO: 1279702 - DNA, 13 bp, Homo sapiens
tcagagcaggagg

SEQ ID NO: 1279703 - DNA, 14 bp, Homo sapiens
tcagagcaggctca

SEQ ID NO: 1279704 - DNA, 12 bp, Homo sapiens
tcagagccaagt

SEQ ID NO: 1279705 - DNA, 21 bp, Homo sapiens
tcagagccagtgaaggagcca

SEQ ID NO: 1279706 - DNA, 12 bp, Homo sapiens
tcagagcccagg

SEQ ID NO: 1279707 - DNA, 13 bp, Homo sapiens
tcagagcccaggg

SEQ ID NO: 1279708 - DNA, 14 bp, Homo sapiens
tcagagcccagggg

SEQ ID NO: 1279709 - DNA, 16 bp, Homo sapiens
tcagagcccaggggag

SEQ ID NO: 1279710 - DNA, 17 bp, Homo sapiens
tcagagcccaggggaga

SEQ ID NO: 1279711 - DNA, 18 bp, Homo sapiens
tcagagcccaggggagaa

SEQ ID NO: 1279712 - DNA, 17 bp, Homo sapiens
tcagagcccccagccct

SEQ ID NO: 1279713 - DNA, 11 bp, Homo sapiens
tcagagccctg

SEQ ID NO: 1279714 - DNA, 12 bp, Homo sapiens
tcagagccctgc

SEQ ID NO: 1279715 - DNA, 19 bp, Homo sapiens
tcagagccctggctgggtt

SEQ ID NO: 1279716 - DNA, 11 bp, Homo sapiens
tcagagcctga

SEQ ID NO: 1279717 - DNA, 15 bp, Homo sapiens
tcagagcctgacctg

SEQ ID NO: 1279718 - DNA, 13 bp, Homo sapiens
tcagagccttcca

SEQ ID NO: 1279719 - DNA, 21 bp, Homo sapiens
tcagagccttccatgacctcc

SEQ ID NO: 1279720 - DNA, 14 bp, Homo sapiens
tcagagcgcacagg

SEQ ID NO: 1279721 - DNA, 16 bp, Homo sapiens
tcagagcgcacaggga

SEQ ID NO: 1279722 - DNA, 17 bp, Homo sapiens
tcagagcgccaggaagc

SEQ ID NO: 1279723 - DNA, 21 bp, Homo sapiens
tcagagcgccaggaagccaga

SEQ ID NO: 1279724 - DNA, 18 bp, Homo sapiens
tcagagctaaactccttc

SEQ ID NO: 1279725 - DNA, 15 bp, Homo sapiens
tcagagctctcgagg

SEQ ID NO: 1279726 - DNA, 20 bp, Homo sapiens
tcagagctctcgaggaaagt

SEQ ID NO: 1279727 - DNA, 13 bp, Homo sapiens
tcagagctcttaa

SEQ ID NO: 1279728 - DNA, 19 bp, Homo sapiens
tcagagctcttcaagctgt

SEQ ID NO: 1279729 - DNA, 23 bp, Homo sapiens
tcagagctcttcaagctgtcccc

SEQ ID NO: 1279730 - DNA, 15 bp, Homo sapiens
tcagagctgggaggg

SEQ ID NO: 1279731 - DNA, 14 bp, Homo sapiens
tcagagcttgaaga

SEQ ID NO: 1279732 - DNA, 19 bp, Homo sapiens
tcagagctttgtcacttgc

SEQ ID NO: 1279733 - DNA, 22 bp, Homo sapiens
tcagagctttgtcacttgccac

SEQ ID NO: 1279734 - DNA, 12 bp, Homo sapiens
tcagaggaagac

SEQ ID NO: 1279735 - DNA, 18 bp, Homo sapiens
tcagaggcacaaaagggt

SEQ ID NO: 1279736 - DNA, 13 bp, Homo sapiens
tcagaggccccca

SEQ ID NO: 1279737 - DNA, 23 bp, Homo sapiens
tcagaggcccccagtggggacag

SEQ ID NO: 1279738 - DNA, 18 bp, Homo sapiens
tcagaggccctcgctgcc

SEQ ID NO: 1279739 - DNA, 15 bp, Homo sapiens
tcagaggctgagccc

SEQ ID NO: 1279740 - DNA, 17 bp, Homo sapiens
tcagaggctgagccctg

SEQ ID NO: 1279741 - DNA, 21 bp, Homo sapiens
tcagagggaaagtaaatattt

SEQ ID NO: 1279742 - DNA, 19 bp, Homo sapiens
tcagaggtttgcttcctca

SEQ ID NO: 1279743 - DNA, 20 bp, Homo sapiens
tcagagtaggtgggtaggag

SEQ ID NO: 1279744 - DNA, 19 bp, Homo sapiens
tcagagtccactgtggcac

SEQ ID NO: 1279745 - DNA, 16 bp, Homo sapiens
tcagagtccaggcccc

SEQ ID NO: 1279746 - DNA, 12 bp, Homo sapiens
tcagagtccagt

SEQ ID NO: 1279747 - DNA, 19 bp, Homo sapiens
tcagagtcctcattataaa

SEQ ID NO: 1279748 - DNA, 16 bp, Homo sapiens
tcagagtgaagaatct

SEQ ID NO: 1279749 - DNA, 18 bp, Homo sapiens
tcagagtgaccctcagct

SEQ ID NO: 1279750 - DNA, 21 bp, Homo sapiens
tcagagtgaccctcagctgtc

SEQ ID NO: 1279751 - DNA, 14 bp, Homo sapiens
tcagagtggctcac

SEQ ID NO: 1279752 - DNA, 20 bp, Homo sapiens
tcagagtggctcactggctg

SEQ ID NO: 1279753 - DNA, 15 bp, Homo sapiens
tcagagtttgtgtgt

SEQ ID NO: 1279754 - DNA, 23 bp, Homo sapiens
tcagagtttgtgtgtatttgtat

SEQ ID NO: 1279755 - DNA, 19 bp, Homo sapiens
tcagatacatcactgcttg

SEQ ID NO: 1279756 - DNA, 21 bp, Homo sapiens
tcagatacatcactgcttgat

SEQ ID NO: 1279757 - DNA, 14 bp, Homo sapiens
tcagatacccagtg

SEQ ID NO: 1279758 - DNA, 15 bp, Homo sapiens
tcagatacttatgaa

SEQ ID NO: 1279759 - DNA, 23 bp, Homo sapiens
tcagatagaaaacagcccccact

SEQ ID NO: 1279760 - DNA, 18 bp, Homo sapiens
tcagatatatatcatatt

SEQ ID NO: 1279761 - DNA, 23 bp, Homo sapiens
tcagatcagtgtaccatttgcct

SEQ ID NO: 1279762 - DNA, 16 bp, Homo sapiens
tcagatccccagcttt

SEQ ID NO: 1279763 - DNA, 18 bp, Homo sapiens
tcagatccccagctttct

SEQ ID NO: 1279764 - DNA, 23 bp, Homo sapiens
tcagctgcctgaaacagccatgt

SEQ ID NO: 1279765 - DNA, 21 bp, Homo sapiens
tcagctgcttctgctgcctag

SEQ ID NO: 1279766 - DNA, 14 bp, Homo sapiens
tcagctgcttttaa

SEQ ID NO: 1279767 - DNA, 13 bp, Homo sapiens
tcagctggacata

SEQ ID NO: 1279768 - DNA, 21 bp, Homo sapiens
tcagctggacatactgctgga

SEQ ID NO: 1279769 - DNA, 20 bp, Homo sapiens
tcagctggcagtgcaatgct

SEQ ID NO: 1279770 - DNA, 15 bp, Homo sapiens
tcagctgggagccag

SEQ ID NO: 1279771 - DNA, 22 bp, Homo sapiens
tcagctgggagccagtgtgccc

SEQ ID NO: 1279772 - DNA, 23 bp, Homo sapiens
tcagctgggcagtgccagccaat

SEQ ID NO: 1279773 - DNA, 16 bp, Homo sapiens
tcagctgtagtcctca

SEQ ID NO: 1279774 - DNA, 17 bp, Homo sapiens
tcagctgtcacctgctc

SEQ ID NO: 1279775 - DNA, 19 bp, Homo sapiens
tcagctgtcacctgctcac

SEQ ID NO: 1279776 - DNA, 15 bp, Homo sapiens
tcagctgtttgtcat

SEQ ID NO: 1279777 - DNA, 17 bp, Homo sapiens
tcagcttaattctcctt

SEQ ID NO: 1279778 - DNA, 23 bp, Homo sapiens
tcagcttaattctccttcccaga

SEQ ID NO: 1279779 - DNA, 13 bp, Homo sapiens
tcagcttatctct

SEQ ID NO: 1279780 - DNA, 19 bp, Homo sapiens
tcagcttcctgctgctggg

SEQ ID NO: 1279781 - DNA, 16 bp, Homo sapiens
tcagcttcttcctagg

SEQ ID NO: 1279782 - DNA, 17 bp, Homo sapiens
tcagcttcttcctaggt

SEQ ID NO: 1279783 - DNA, 21 bp, Homo sapiens
tcagcttcttgcactccttcc

SEQ ID NO: 1279784 - DNA, 18 bp, Homo sapiens
tcagcttgaacctgcttc

SEQ ID NO: 1279785 - DNA, 19 bp, Homo sapiens
tcagcttgaacctgcttcc

SEQ ID NO: 1279786 - DNA, 14 bp, Homo sapiens
tcagctttcagagc

SEQ ID NO: 1279787 - DNA, 17 bp, Homo sapiens
tcagctttcagagccag

SEQ ID NO: 1279788 - DNA, 16 bp, Homo sapiens
tcagctttccctgcca

SEQ ID NO: 1279789 - DNA, 21 bp, Homo sapiens
tcagctttctcgcgccctccc

SEQ ID NO: 1279790 - DNA, 23 bp, Homo sapiens
tcagctttgactttatctcctgc

SEQ ID NO: 1279791 - DNA, 16 bp, Homo sapiens
tcagcttttgttctag

SEQ ID NO: 1279792 - DNA, 22 bp, Homo sapiens
tcaggaaaatgtattgattcaa

SEQ ID NO: 1279793 - DNA, 12 bp, Homo sapiens
tcaggaaaattg

SEQ ID NO: 1279794 - DNA, 14 bp, Homo sapiens
tcaggaaagacgga

SEQ ID NO: 1279795 - DNA, 22 bp, Homo sapiens
tcaggaaaggaatcatttctat

SEQ ID NO: 1279796 - DNA, 14 bp, Homo sapiens
tcaggaaaggctgt

SEQ ID NO: 1279797 - DNA, 13 bp, Homo sapiens
tcaggaacagaag

SEQ ID NO: 1279798 - DNA, 18 bp, Homo sapiens
tcaggaacagtggctggg

SEQ ID NO: 1279799 - DNA, 12 bp, Homo sapiens
tcaggaagaaat

SEQ ID NO: 1279800 - DNA, 15 bp, Homo sapiens
tcaggaagaaatcac

SEQ ID NO: 1279801 - DNA, 23 bp, Homo sapiens
tcaggaagaaatcacagaatcat

SEQ ID NO: 1279802 - DNA, 16 bp, Homo sapiens
tcaggaagaagagatg

SEQ ID NO: 1279803 - DNA, 20 bp, Homo sapiens
tcaggaagaagagatgcact

SEQ ID NO: 1279804 - DNA, 22 bp, Homo sapiens
tcaggaagactggacccccagc

SEQ ID NO: 1279805 - DNA, 20 bp, Homo sapiens
tcaggaagggtcggagtctg

SEQ ID NO: 1279806 - DNA, 22 bp, Homo sapiens
tcaggaaggtaaaaacccagcg

SEQ ID NO: 1279807 - DNA, 18 bp, Homo sapiens
tcaggaagtaaaataaat

SEQ ID NO: 1279808 - DNA, 19 bp, Homo sapiens
tcaggaatcggaatcctgt

SEQ ID NO: 1279809 - DNA, 14 bp, Homo sapiens
tcaggaatgagtca

SEQ ID NO: 1279810 - DNA, 23 bp, Homo sapiens
tcaggaatgagtcaatcagcctt

SEQ ID NO: 1279811 - DNA, 23 bp, Homo sapiens
tcaggaatggggggcgggccagg

SEQ ID NO: 1279812 - DNA, 16 bp, Homo sapiens
tcaggaattcttggag

SEQ ID NO: 1279813 - DNA, 18 bp, Homo sapiens
tcaggaattcttggagaa

SEQ ID NO: 1279814 - DNA, 13 bp, Homo sapiens
tcaggaatttaaa

SEQ ID NO: 1279815 - DNA, 20 bp, Homo sapiens
tcaggacagcatcccttccc

SEQ ID NO: 1279816 - DNA, 22 bp, Homo sapiens
tcaggacagcatcccttcccac

SEQ ID NO: 1279817 - DNA, 16 bp, Homo sapiens
tcaggacccaggccct

SEQ ID NO: 1279818 - DNA, 22 bp, Homo sapiens
tcaggacccaggccctccatgg

SEQ ID NO: 1279819 - DNA, 17 bp, Homo sapiens
tcaggaccctcagccct

SEQ ID NO: 1279820 - DNA, 21 bp, Homo sapiens
tcaggacctctgtaggcagca

SEQ ID NO: 1279821 - DNA, 14 bp, Homo sapiens
tcaggaccttttga

SEQ ID NO: 1279822 - DNA, 14 bp, Homo sapiens
tcaggacggctcct

SEQ ID NO: 1279823 - DNA, 22 bp, Homo sapiens
tcaggacggctcctcagagcgc

SEQ ID NO: 1279824 - DNA, 14 bp, Homo sapiens
tcaggactcctctc

SEQ ID NO: 1279825 - DNA, 20 bp, Homo sapiens
tcaggacttaacggctccag

SEQ ID NO: 1279826 - DNA, 16 bp, Homo sapiens
tcaggacttgaaagaa

SEQ ID NO: 1279827 - DNA, 17 bp, Homo sapiens
tcaggagaggggcagaa

SEQ ID NO: 1279828 - DNA, 20 bp, Homo sapiens
tcaggagaggggcagaacag

SEQ ID NO: 1279829 - DNA, 22 bp, Homo sapiens
tcaggagatcgagaccatcctg

SEQ ID NO: 1279830 - DNA, 18 bp, Homo sapiens
tcaggagatggagggctt

SEQ ID NO: 1279831 - DNA, 11 bp, Homo sapiens
tcaggagcaca

SEQ ID NO: 1279832 - DNA, 12 bp, Homo sapiens
tcaggagcaggg

SEQ ID NO: 1279833 - DNA, 19 bp, Homo sapiens
tcaggaggaatactgaaca

SEQ ID NO: 1279834 - DNA, 14 bp, Homo sapiens
tcaggaggaggctg

SEQ ID NO: 1279835 - DNA, 17 bp, Homo sapiens
tcaggaggcaggacctt

SEQ ID NO: 1279836 - DNA, 21 bp, Homo sapiens
tcaggaggccctggtgtcagg

SEQ ID NO: 1279837 - DNA, 22 bp, Homo sapiens
tcaggaggctgaggcagaagaa

SEQ ID NO: 1279838 - DNA, 19 bp, Homo sapiens
tcaggaggctgaggcagga

SEQ ID NO: 1279839 - DNA, 15 bp, Homo sapiens
tcaggaggctgaggg

SEQ ID NO: 1279840 - DNA, 18 bp, Homo sapiens
tcaggaggctgaggggag

SEQ ID NO: 1279841 - DNA, 13 bp, Homo sapiens
tcaggagggattg

SEQ ID NO: 1279842 - DNA, 16 bp, Homo sapiens
tcaggagggcaggctg

SEQ ID NO: 1279843 - DNA, 23 bp, Homo sapiens
tcaggagggcaggctgaggtggg

SEQ ID NO: 1279844 - DNA, 21 bp, Homo sapiens
tcaggagggtgacgcccagct

SEQ ID NO: 1279845 - DNA, 20 bp, Homo sapiens
tcaggagtcccaaggaaagc

SEQ ID NO: 1279846 - DNA, 16 bp, Homo sapiens
tcaggagtctgccact

SEQ ID NO: 1279847 - DNA, 17 bp, Homo sapiens
tcaggagttgtttctga

SEQ ID NO: 1279848 - DNA, 20 bp, Homo sapiens
tcaggagttttactgcctgt

SEQ ID NO: 1279849 - DNA, 20 bp, Homo sapiens
tcaggatactctgtcagatg

SEQ ID NO: 1279850 - DNA, 22 bp, Homo sapiens
tcaggatatccttatcagagct

SEQ ID NO: 1279851 - DNA, 23 bp, Homo sapiens
tcaggatatccttatcagagcta

SEQ ID NO: 1279852 - DNA, 22 bp, Homo sapiens
tcaggatatggcttaggaatga

SEQ ID NO: 1279853 - DNA, 15 bp, Homo sapiens
tcaggatccagtctg

SEQ ID NO: 1279854 - DNA, 13 bp, Homo sapiens
tcaggatccagtg

SEQ ID NO: 1279855 - DNA, 19 bp, Homo sapiens
tcaggatccagtgacatga

SEQ ID NO: 1279856 - DNA, 16 bp, Homo sapiens
tcaggatgaacccagg

SEQ ID NO: 1279857 - DNA, 20 bp, Homo sapiens
tcaggatgatacactatgaa

SEQ ID NO: 1279858 - DNA, 21 bp, Homo sapiens
tcaggatgcacatttctggat

SEQ ID NO: 1279859 - DNA, 21 bp, Homo sapiens
tcaggatttaaaaactggaac

SEQ ID NO: 1279860 - DNA, 16 bp, Homo sapiens
tcaggcaaagaaaatg

SEQ ID NO: 1279861 - DNA, 14 bp, Homo sapiens
tcaggcaattgatt

SEQ ID NO: 1279862 - DNA, 19 bp, Homo sapiens
tcaggcaattgattgtgaa

SEQ ID NO: 1279863 - DNA, 14 bp, Homo sapiens
tcaggcacacagct

SEQ ID NO: 1279864 - DNA, 15 bp, Homo sapiens
tcaggcactctcctg

SEQ ID NO: 1279865 - DNA, 17 bp, Homo sapiens
tcaggcactctcctgtc

SEQ ID NO: 1279866 - DNA, 15 bp, Homo sapiens
tcaggcactgagaat

SEQ ID NO: 1279867 - DNA, 15 bp, Homo sapiens
tcaggcactggtggc

SEQ ID NO: 1279868 - DNA, 17 bp, Homo sapiens
tcaggcactggtggcat

SEQ ID NO: 1279869 - DNA, 20 bp, Homo sapiens
tcaggcagcaccacactggg

SEQ ID NO: 1279870 - DNA, 14 bp, Homo sapiens
tcaggcagcactga

SEQ ID NO: 1279871 - DNA, 16 bp, Homo sapiens
tcaggcagccttcata

SEQ ID NO: 1279872 - DNA, 17 bp, Homo sapiens
tcaggcaggtgggatgg

SEQ ID NO: 1279873 - DNA, 16 bp, Homo sapiens
tcaggcataggcctgg

SEQ ID NO: 1279874 - DNA, 18 bp, Homo sapiens
tcaggcataggcctgggt

SEQ ID NO: 1279875 - DNA, 17 bp, Homo sapiens
tcaggcatgcctgtgtg

SEQ ID NO: 1279876 - DNA, 19 bp, Homo sapiens
tcaggcatggctcagagct

SEQ ID NO: 1279877 - DNA, 20 bp, Homo sapiens
tcaggcattggatatttttt

SEQ ID NO: 1279878 - DNA, 13 bp, Homo sapiens
tcaggcattttgt

SEQ ID NO: 1279879 - DNA, 15 bp, Homo sapiens
tcaggccaccctcca

SEQ ID NO: 1279880 - DNA, 16 bp, Homo sapiens
tcaggccaccctccac

SEQ ID NO: 1279881 - DNA, 19 bp, Homo sapiens
tcaggccacctgccccctt

SEQ ID NO: 1279882 - DNA, 14 bp, Homo sapiens
tcaggccagcccag

SEQ ID NO: 1279883 - DNA, 17 bp, Homo sapiens
tcaggccagcccagcca

SEQ ID NO: 1279884 - DNA, 18 bp, Homo sapiens
tcaggccagcctgtccct

SEQ ID NO: 1279885 - DNA, 12 bp, Homo sapiens
tcagtgcttctt

SEQ ID NO: 1279886 - DNA, 20 bp, Homo sapiens
tcagtgctttttccttttca

SEQ ID NO: 1279887 - DNA, 18 bp, Homo sapiens
tcagtggaacacaaatga

SEQ ID NO: 1279888 - DNA, 17 bp, Homo sapiens
tcagtggaccctgtggc

SEQ ID NO: 1279889 - DNA, 21 bp, Homo sapiens
tcagtggactttccaccccct

SEQ ID NO: 1279890 - DNA, 23 bp, Homo sapiens
tcagtggactttccaccccctcc

SEQ ID NO: 1279891 - DNA, 15 bp, Homo sapiens
tcagtggctttgcat

SEQ ID NO: 1279892 - DNA, 23 bp, Homo sapiens
tcagtgggaacgtgactgcccca

SEQ ID NO: 1279893 - DNA, 13 bp, Homo sapiens
tcagtgggagaaa

SEQ ID NO: 1279894 - DNA, 16 bp, Homo sapiens
tcagtgggagaaaaca

SEQ ID NO: 1279895 - DNA, 14 bp, Homo sapiens
tcagtggggcagtc

SEQ ID NO: 1279896 - DNA, 17 bp, Homo sapiens
tcagtggtagctctggc

SEQ ID NO: 1279897 - DNA, 19 bp, Homo sapiens
tcagtggtagctctggctt

SEQ ID NO: 1279898 - DNA, 15 bp, Homo sapiens
tcagtggtttctact

SEQ ID NO: 1279899 - DNA, 19 bp, Homo sapiens
tcagtggtttctacttccc

SEQ ID NO: 1279900 - DNA, 20 bp, Homo sapiens
tcagtggtttctacttcccc

SEQ ID NO: 1279901 - DNA, 21 bp, Homo sapiens
tcagtggtttctacttcccct

SEQ ID NO: 1279902 - DNA, 22 bp, Homo sapiens
tcagtgtaaaaaggaaaaccca

SEQ ID NO: 1279903 - DNA, 20 bp, Homo sapiens
tcagtgtacatggaataaca

SEQ ID NO: 1279904 - DNA, 18 bp, Homo sapiens
tcagtgtagcgggaggaa

SEQ ID NO: 1279905 - DNA, 16 bp, Homo sapiens
tcagtgtccagcttcc

SEQ ID NO: 1279906 - DNA, 19 bp, Homo sapiens
tcagtgtccagcttccaaa

SEQ ID NO: 1279907 - DNA, 20 bp, Homo sapiens
tcagtgtccagcttccaaag

SEQ ID NO: 1279908 - DNA, 23 bp, Homo sapiens
tcagtgttaaaaaatttttgaaa

SEQ ID NO: 1279909 - DNA, 17 bp, Homo sapiens
tcagtgttaaatgtgat

SEQ ID NO: 1279910 - DNA, 15 bp, Homo sapiens
tcagtgttaaattca

SEQ ID NO: 1279911 - DNA, 17 bp, Homo sapiens
tcagtgttaaattcatt

SEQ ID NO: 1279912 - DNA, 15 bp, Homo sapiens
tcagtgttacctgtg

SEQ ID NO: 1279913 - DNA, 18 bp, Homo sapiens
tcagtgttacctgtgtgc

SEQ ID NO: 1279914 - DNA, 16 bp, Homo sapiens
tcagtgtttaaataaa

SEQ ID NO: 1279915 - DNA, 14 bp, Homo sapiens
tcagtgtttatgtg

SEQ ID NO: 1279916 - DNA, 17 bp, Homo sapiens
tcagtgtttcttttaag

SEQ ID NO: 1279917 - DNA, 14 bp, Homo sapiens
tcagttaaacacac

SEQ ID NO: 1279918 - DNA, 20 bp, Homo sapiens
tcagttaactattgcattta

SEQ ID NO: 1279919 - DNA, 21 bp, Homo sapiens
tcagttacaaagtaatttctt

SEQ ID NO: 1279920 - DNA, 16 bp, Homo sapiens
tcagttacccactcgg

SEQ ID NO: 1279921 - DNA, 17 bp, Homo sapiens
tcagttactcagccctg

SEQ ID NO: 1279922 - DNA, 17 bp, Homo sapiens
tcagttactctgaaggg

SEQ ID NO: 1279923 - DNA, 15 bp, Homo sapiens
tcagttataaagtca

SEQ ID NO: 1279924 - DNA, 17 bp, Homo sapiens
tcagttataaagtcaag

SEQ ID NO: 1279925 - DNA, 22 bp, Homo sapiens
tcagttcaaaagcctgaaagtt

SEQ ID NO: 1279926 - DNA, 17 bp, Homo sapiens
tcagttcaacctggtgg

SEQ ID NO: 1279927 - DNA, 17 bp, Homo sapiens
tcagttcccaccatctg

SEQ ID NO: 1279928 - DNA, 19 bp, Homo sapiens
tcagttcccagacagcttt

SEQ ID NO: 1279929 - DNA, 19 bp, Homo sapiens
tcagttcccagctcccccc

SEQ ID NO: 1279930 - DNA, 20 bp, Homo sapiens
tcagttccctcctgcccagg

SEQ ID NO: 1279931 - DNA, 21 bp, Homo sapiens
tcagttccctcctgcccagga

SEQ ID NO: 1279932 - DNA, 22 bp, Homo sapiens
tcagttccctcctgcccaggac

SEQ ID NO: 1279933 - DNA, 22 bp, Homo sapiens
tcagttcccttggcctcagaat

SEQ ID NO: 1279934 - DNA, 12 bp, Homo sapiens
tcagttccttca

SEQ ID NO: 1279935 - DNA, 16 bp, Homo sapiens
tcagttcctttgtgtg

SEQ ID NO: 1279936 - DNA, 20 bp, Homo sapiens
tcagttcctttgtgtgtact

SEQ ID NO: 1279937 - DNA, 22 bp, Homo sapiens
tcagttcctttgtgtgtactca

SEQ ID NO: 1279938 - DNA, 20 bp, Homo sapiens
tcagttctagtctctctggg

SEQ ID NO: 1279939 - DNA, 15 bp, Homo sapiens
tcagttctctgggaa

SEQ ID NO: 1279940 - DNA, 20 bp, Homo sapiens
tcagttgctcaaaaagaaat

SEQ ID NO: 1279941 - DNA, 16 bp, Homo sapiens
tcagttgtacttctgc

SEQ ID NO: 1279942 - DNA, 21 bp, Homo sapiens
tcagttgtccttaaatttgta

SEQ ID NO: 1279943 - DNA, 14 bp, Homo sapiens
tcagttgttcttta

SEQ ID NO: 1279944 - DNA, 15 bp, Homo sapiens
tcagttgttcttttt

SEQ ID NO: 1279945 - DNA, 16 bp, Homo sapiens
tcagttgtttgcttct

SEQ ID NO: 1279946 - DNA, 19 bp, Homo sapiens
tcagtttaatccttctagt

SEQ ID NO: 1279947 - DNA, 16 bp, Homo sapiens
tcagtttatcctgaca

SEQ ID NO: 1279948 - DNA, 22 bp, Homo sapiens
tcagtttatcctgacatattca

SEQ ID NO: 1279949 - DNA, 17 bp, Homo sapiens
tcagtttcacagaaaat

SEQ ID NO: 1279950 - DNA, 22 bp, Homo sapiens
tcagtttcactccctcttggtt

SEQ ID NO: 1279951 - DNA, 14 bp, Homo sapiens
tcagtttcataaaa

SEQ ID NO: 1279952 - DNA, 17 bp, Homo sapiens
tcagtttcatgaaatga

SEQ ID NO: 1279953 - DNA, 20 bp, Homo sapiens
tcagtttcccctctcggcca

SEQ ID NO: 1279954 - DNA, 18 bp, Homo sapiens
tcagtttctccatcagct

SEQ ID NO: 1279955 - DNA, 21 bp, Homo sapiens
tcagtttgaaaatattttgtt

SEQ ID NO: 1279956 - DNA, 18 bp, Homo sapiens
tcagtttgtcctgtagag

SEQ ID NO: 1279957 - DNA, 16 bp, Homo sapiens
tcagttttatcatttt

SEQ ID NO: 1279958 - DNA, 19 bp, Homo sapiens
tcagttttatcattttcaa

SEQ ID NO: 1279959 - DNA, 16 bp, Homo sapiens
tcagttttcaggagtg

SEQ ID NO: 1279960 - DNA, 16 bp, Homo sapiens
tcagttttccttctgt

SEQ ID NO: 1279961 - DNA, 14 bp, Homo sapiens
tcagttttgttcac

SEQ ID NO: 1279962 - DNA, 21 bp, Homo sapiens
tcagttttgttcacttgttat

SEQ ID NO: 1279963 - DNA, 14 bp, Homo sapiens
tcagtttttgtatc

SEQ ID NO: 1279964 - DNA, 16 bp, Homo sapiens
tcagtttttgtatctt

SEQ ID NO: 1279965 - DNA, 19 bp, Homo sapiens
tcagtttttttttttccag

SEQ ID NO: 1279966 - DNA, 16 bp, Homo sapiens
tcataaaataaagtat

SEQ ID NO: 1279967 - DNA, 21 bp, Homo sapiens
tcataaaataaagtatatata

SEQ ID NO: 1279968 - DNA, 21 bp, Homo sapiens
tcataaacaacttaatgttct

SEQ ID NO: 1279969 - DNA, 20 bp, Homo sapiens
tcataaagatgttaaatgga

SEQ ID NO: 1279970 - DNA, 11 bp, Homo sapiens
tcataaagtaa

SEQ ID NO: 1279971 - DNA, 17 bp, Homo sapiens
tcataaatcagaaagtt

SEQ ID NO: 1279972 - DNA, 14 bp, Homo sapiens
tcataaattacaca

SEQ ID NO: 1279973 - DNA, 15 bp, Homo sapiens
tcataacatttaaag

SEQ ID NO: 1279974 - DNA, 21 bp, Homo sapiens
tcataacatttaaagagattt

SEQ ID NO: 1279975 - DNA, 17 bp, Homo sapiens
tcataacttcctgtact

SEQ ID NO: 1279976 - DNA, 17 bp, Homo sapiens
tcataaggagttggtgt

SEQ ID NO: 1279977 - DNA, 17 bp, Homo sapiens
tcataaggcctgccctc

SEQ ID NO: 1279978 - DNA, 20 bp, Homo sapiens
tcataataggtagtttggat

SEQ ID NO: 1279979 - DNA, 15 bp, Homo sapiens
tcataattacattcc

SEQ ID NO: 1279980 - DNA, 17 bp, Homo sapiens
tcataattacattccta

SEQ ID NO: 1279981 - DNA, 19 bp, Homo sapiens
tcataattacattcctaac

SEQ ID NO: 1279982 - DNA, 12 bp, Homo sapiens
tcataattcaga

SEQ ID NO: 1279983 - DNA, 22 bp, Homo sapiens
tcataattcagaactaaatttt

SEQ ID NO: 1279984 - DNA, 18 bp, Homo sapiens
tcataattcctacagcac

SEQ ID NO: 1279985 - DNA, 13 bp, Homo sapiens
tcataattctgaa

SEQ ID NO: 1279986 - DNA, 23 bp, Homo sapiens
tcataatttaaaaatctccatta

SEQ ID NO: 1279987 - DNA, 16 bp, Homo sapiens
tcataatttgtttcca

SEQ ID NO: 1279988 - DNA, 16 bp, Homo sapiens
tcatacaaactctcac

SEQ ID NO: 1279989 - DNA, 18 bp, Homo sapiens
tcatacaaactctcacca

SEQ ID NO: 1279990 - DNA, 16 bp, Homo sapiens
tcatacaaagtactgt

SEQ ID NO: 1279991 - DNA, 13 bp, Homo sapiens
tcatacacagaaa

SEQ ID NO: 1279992 - DNA, 13 bp, Homo sapiens
tcatacacagtta

SEQ ID NO: 1279993 - DNA, 17 bp, Homo sapiens
tcatacacagttaaata

SEQ ID NO: 1279994 - DNA, 16 bp, Homo sapiens
tcatacagttttcatt

SEQ ID NO: 1279995 - DNA, 23 bp, Homo sapiens
tcataccgcctcgtgccagcagc

SEQ ID NO: 1279996 - DNA, 19 bp, Homo sapiens
tcatacgcatcccatctct

SEQ ID NO: 1279997 - DNA, 18 bp, Homo sapiens
tcatactatttagatttt

SEQ ID NO: 1279998 - DNA, 13 bp, Homo sapiens
tcatactgtctgg

SEQ ID NO: 1279999 - DNA, 16 bp, Homo sapiens
tcatacttaaaaattt

SEQ ID NO: 1280000 - DNA, 14 bp, Homo sapiens
tcatacttaacatt

SEQ ID NO: 1280001 - DNA, 19 bp, Homo sapiens
tcatacttttcttactata

SEQ ID NO: 1280002 - DNA, 13 bp, Homo sapiens
tcatagaaattct

SEQ ID NO: 1280003 - DNA, 14 bp, Homo sapiens
tcatagaattttga

SEQ ID NO: 1280004 - DNA, 18 bp, Homo sapiens
tcatagactcctttgcta

SEQ ID NO: 1280005 - DNA, 18 bp, Homo sapiens
tcatagattattataaac

SEQ ID NO: 1280006 - DNA, 20 bp, Homo sapiens
tcatagattattataaacta

SEQ ID NO: 1280007 - DNA, 17 bp, Homo sapiens
tcatgttttgtgactat

SEQ ID NO: 1280008 - DNA, 17 bp, Homo sapiens
tcattaaaatatatgtt

SEQ ID NO: 1280009 - DNA, 20 bp, Homo sapiens
tcattaaaatatatgttctg

SEQ ID NO: 1280010 - DNA, 22 bp, Homo sapiens
tcattaaaatatatgttctgca

SEQ ID NO: 1280011 - DNA, 15 bp, Homo sapiens
tcattaaaatccagt

SEQ ID NO: 1280012 - DNA, 16 bp, Homo sapiens
tcattaaaatccagta

SEQ ID NO: 1280013 - DNA, 15 bp, Homo sapiens
tcattaaacaaataa

SEQ ID NO: 1280014 - DNA, 13 bp, Homo sapiens
tcattaaactcta

SEQ ID NO: 1280015 - DNA, 16 bp, Homo sapiens
tcattaaacttgaagc

SEQ ID NO: 1280016 - DNA, 16 bp, Homo sapiens
tcattaaactttttta

SEQ ID NO: 1280017 - DNA, 15 bp, Homo sapiens
tcattaagtaatctt

SEQ ID NO: 1280018 - DNA, 13 bp, Homo sapiens
tcattaattctat

SEQ ID NO: 1280019 - DNA, 17 bp, Homo sapiens
tcattacagttctttcc

SEQ ID NO: 1280020 - DNA, 19 bp, Homo sapiens
tcattacagttctttcctc

SEQ ID NO: 1280021 - DNA, 19 bp, Homo sapiens
tcattacccttccctgcac

SEQ ID NO: 1280022 - DNA, 15 bp, Homo sapiens
tcattactacactgg

SEQ ID NO: 1280023 - DNA, 20 bp, Homo sapiens
tcattactacactggtgtgt

SEQ ID NO: 1280024 - DNA, 17 bp, Homo sapiens
tcattactggctgtgga

SEQ ID NO: 1280025 - DNA, 13 bp, Homo sapiens
tcattactggtaa

SEQ ID NO: 1280026 - DNA, 10 bp, Homo sapiens
tcattagaac

SEQ ID NO: 1280027 - DNA, 20 bp, Homo sapiens
tcattagactggaacttgaa

SEQ ID NO: 1280028 - DNA, 14 bp, Homo sapiens
tcattaggcaaagt

SEQ ID NO: 1280029 - DNA, 17 bp, Homo sapiens
tcattaggcaaagtaca

SEQ ID NO: 1280030 - DNA, 18 bp, Homo sapiens
tcattaggcaaagtacaa

SEQ ID NO: 1280031 - DNA, 19 bp, Homo sapiens
tcattaggcaaagtacaaa

SEQ ID NO: 1280032 - DNA, 16 bp, Homo sapiens
tcattaggtgtgactg

SEQ ID NO: 1280033 - DNA, 22 bp, Homo sapiens
tcattataatgtcattaaacat

SEQ ID NO: 1280034 - DNA, 13 bp, Homo sapiens
tcattatgaaaaa

SEQ ID NO: 1280035 - DNA, 15 bp, Homo sapiens
tcattatgaaaaaca

SEQ ID NO: 1280036 - DNA, 18 bp, Homo sapiens
tcattatgtcaaccaggt

SEQ ID NO: 1280037 - DNA, 13 bp, Homo sapiens
tcattatgttcat

SEQ ID NO: 1280038 - DNA, 20 bp, Homo sapiens
tcattatgttcatgtaagaa

SEQ ID NO: 1280039 - DNA, 21 bp, Homo sapiens
tcattattcctcagattgctg

SEQ ID NO: 1280040 - DNA, 23 bp, Homo sapiens
tcattattcctcagattgctgaa

SEQ ID NO: 1280041 - DNA, 18 bp, Homo sapiens
tcattattggaattaacc

SEQ ID NO: 1280042 - DNA, 19 bp, Homo sapiens
tcattattggaattaacct

SEQ ID NO: 1280043 - DNA, 14 bp, Homo sapiens
tcattatttgtcaa

SEQ ID NO: 1280044 - DNA, 23 bp, Homo sapiens
tcattattttgtggttctatttt

SEQ ID NO: 1280045 - DNA, 17 bp, Homo sapiens
tcattatttttccactt

SEQ ID NO: 1280046 - DNA, 20 bp, Homo sapiens
tcattatttttgttagcaaa

SEQ ID NO: 1280047 - DNA, 17 bp, Homo sapiens
tcattcaagcctgtgaa

SEQ ID NO: 1280048 - DNA, 18 bp, Homo sapiens
tcattcaagcctgtgaat

SEQ ID NO: 1280049 - DNA, 16 bp, Homo sapiens
tcattcaatacaagtg

SEQ ID NO: 1280050 - DNA, 16 bp, Homo sapiens
tcattcaatattgaca

SEQ ID NO: 1280051 - DNA, 19 bp, Homo sapiens
tcattcagagactgccctt

SEQ ID NO: 1280052 - DNA, 23 bp, Homo sapiens
tcattcagagactgcccttctca

SEQ ID NO: 1280053 - DNA, 13 bp, Homo sapiens
tcattcaggaaaa

SEQ ID NO: 1280054 - DNA, 19 bp, Homo sapiens
tcattcatacttaaaaatt

SEQ ID NO: 1280055 - DNA, 11 bp, Homo sapiens
tcattcatatt

SEQ ID NO: 1280056 - DNA, 13 bp, Homo sapiens
tcattcatcctga

SEQ ID NO: 1280057 - DNA, 18 bp, Homo sapiens
tcattcattagtcatgtt

SEQ ID NO: 1280058 - DNA, 15 bp, Homo sapiens
tcattccaattctaa

SEQ ID NO: 1280059 - DNA, 20 bp, Homo sapiens
tcattccagcagctgcaccc

SEQ ID NO: 1280060 - DNA, 15 bp, Homo sapiens
tcattcccagagtca

SEQ ID NO: 1280061 - DNA, 23 bp, Homo sapiens
tcattccccaggtggctgaccca

SEQ ID NO: 1280062 - DNA, 13 bp, Homo sapiens
tcattcccctcgt

SEQ ID NO: 1280063 - DNA, 17 bp, Homo sapiens
tcattccctctcatctc

SEQ ID NO: 1280064 - DNA, 18 bp, Homo sapiens
tcattccctctcatctca

SEQ ID NO: 1280065 - DNA, 15 bp, Homo sapiens
tcattccctgtagtt

SEQ ID NO: 1280066 - DNA, 16 bp, Homo sapiens
tcattccgttgtctgt

SEQ ID NO: 1280067 - DNA, 17 bp, Homo sapiens
tcattccgttgtctgtg

SEQ ID NO: 1280068 - DNA, 14 bp, Homo sapiens
tcattcctgaaaga

SEQ ID NO: 1280069 - DNA, 16 bp, Homo sapiens
tcattcctgaaagaaa

SEQ ID NO: 1280070 - DNA, 13 bp, Homo sapiens
tcattcctttcca

SEQ ID NO: 1280071 - DNA, 22 bp, Homo sapiens
tcattcgcctttgtcttgtact

SEQ ID NO: 1280072 - DNA, 17 bp, Homo sapiens
tcattcgggctgggcgc

SEQ ID NO: 1280073 - DNA, 15 bp, Homo sapiens
tcattcgttctgtgg

SEQ ID NO: 1280074 - DNA, 19 bp, Homo sapiens
tcattctaaaccaaaacag

SEQ ID NO: 1280075 - DNA, 14 bp, Homo sapiens
tcattctacagaat

SEQ ID NO: 1280076 - DNA, 21 bp, Homo sapiens
tcattctcataattcctacag

SEQ ID NO: 1280077 - DNA, 12 bp, Homo sapiens
tcattctcctgc

SEQ ID NO: 1280078 - DNA, 15 bp, Homo sapiens
tcattctcctgcctg

SEQ ID NO: 1280079 - DNA, 19 bp, Homo sapiens
tcattctctgtctcatcca

SEQ ID NO: 1280080 - DNA, 18 bp, Homo sapiens
tcattctgatcctcagcc

SEQ ID NO: 1280081 - DNA, 19 bp, Homo sapiens
tcattctgcattgctagat

SEQ ID NO: 1280082 - DNA, 16 bp, Homo sapiens
tcattctgctacttca

SEQ ID NO: 1280083 - DNA, 13 bp, Homo sapiens
tcattctggaaac

SEQ ID NO: 1280084 - DNA, 22 bp, Homo sapiens
tcattcttacaattgcactgct

SEQ ID NO: 1280085 - DNA, 23 bp, Homo sapiens
tcattcttacaattgcactgctg

SEQ ID NO: 1280086 - DNA, 17 bp, Homo sapiens
tcattcttctcacatcc

SEQ ID NO: 1280087 - DNA, 14 bp, Homo sapiens
tcattcttgtggga

SEQ ID NO: 1280088 - DNA, 21 bp, Homo sapiens
tcattcttgtgggagacagca

SEQ ID NO: 1280089 - DNA, 14 bp, Homo sapiens
tcattctttgcagg

SEQ ID NO: 1280090 - DNA, 13 bp, Homo sapiens
tcattgaagcaga

SEQ ID NO: 1280091 - DNA, 18 bp, Homo sapiens
tcattgaagtatattctt

SEQ ID NO: 1280092 - DNA, 21 bp, Homo sapiens
tcattgactatcaaactgaag

SEQ ID NO: 1280093 - DNA, 18 bp, Homo sapiens
tcattgagagttttgtct

SEQ ID NO: 1280094 - DNA, 19 bp, Homo sapiens
tcattgatggatgtcttct

SEQ ID NO: 1280095 - DNA, 24 bp, Homo sapiens
tcattgcacctatctcagccatag

SEQ ID NO: 1280096 - DNA, 17 bp, Homo sapiens
tcattgcctcctgttct

SEQ ID NO: 1280097 - DNA, 21 bp, Homo sapiens
tcattgcctcttctacttgta

SEQ ID NO: 1280098 - DNA, 16 bp, Homo sapiens
tcattgcctgtgtatg

SEQ ID NO: 1280099 - DNA, 15 bp, Homo sapiens
tcattgcctttccag

SEQ ID NO: 1280100 - DNA, 23 bp, Homo sapiens
tcattgctaaaaaataaataaaa

SEQ ID NO: 1280101 - DNA, 16 bp, Homo sapiens
tcattgctaaactgat

SEQ ID NO: 1280102 - DNA, 17 bp, Homo sapiens
tcattgctaaactgatg

SEQ ID NO: 1280103 - DNA, 14 bp, Homo sapiens
tcattgctgaaaat

SEQ ID NO: 1280104 - DNA, 17 bp, Homo sapiens
tcattgctgaaaatggt

SEQ ID NO: 1280105 - DNA, 15 bp, Homo sapiens
tcattgctgagcctc

SEQ ID NO: 1280106 - DNA, 17 bp, Homo sapiens
tcattgctgagcctctg

SEQ ID NO: 1280107 - DNA, 14 bp, Homo sapiens
tcattgctgtcttg

SEQ ID NO: 1280108 - DNA, 17 bp, Homo sapiens
tcattgctgtcttgccc

SEQ ID NO: 1280109 - DNA, 13 bp, Homo sapiens
tcattgcttacaa

SEQ ID NO: 1280110 - DNA, 16 bp, Homo sapiens
tcattgcttatgacat

SEQ ID NO: 1280111 - DNA, 18 bp, Homo sapiens
tcattggaacaactgata

SEQ ID NO: 1280112 - DNA, 14 bp, Homo sapiens
tcattggcagctca

SEQ ID NO: 1280113 - DNA, 20 bp, Homo sapiens
tcattgggtttttcctctgt

SEQ ID NO: 1280114 - DNA, 16 bp, Homo sapiens
tcattgtaaacaaact

SEQ ID NO: 1280115 - DNA, 19 bp, Homo sapiens
tcattgtaaacaaactctt

SEQ ID NO: 1280116 - DNA, 24 bp, Homo sapiens
tcattgtaacactgtttattgaaa

SEQ ID NO: 1280117 - DNA, 15 bp, Homo sapiens
tcattgtatatatgt

SEQ ID NO: 1280118 - DNA, 21 bp, Homo sapiens
tcattgtatatatgtgtgttt

SEQ ID NO: 1280119 - DNA, 14 bp, Homo sapiens
tcattgtatgatgt

SEQ ID NO: 1280120 - DNA, 17 bp, Homo sapiens
tcattgtatgatgtgtt

SEQ ID NO: 1280121 - DNA, 18 bp, Homo sapiens
tcattgtatgatgtgttg

SEQ ID NO: 1280122 - DNA, 14 bp, Homo sapiens
tcattgtattcaga

SEQ ID NO: 1280123 - DNA, 12 bp, Homo sapiens
tcattgtccagc

SEQ ID NO: 1280124 - DNA, 14 bp, Homo sapiens
tcattgtccagctg

SEQ ID NO: 1280125 - DNA, 16 bp, Homo sapiens
tcattgtccctcttca

SEQ ID NO: 1280126 - DNA, 22 bp, Homo sapiens
tcattgtctactcctagaagaa

SEQ ID NO: 1280127 - DNA, 23 bp, Homo sapiens
tcattgtctactcctagaagaac

SEQ ID NO: 1280128 - DNA, 22 bp, Homo sapiens
tcattgtctctcacagatgtga

SEQ ID NO: 1280129 - DNA, 20 bp, Homo sapiens
tcccaggttcccccagcaag

SEQ ID NO: 1280130 - DNA, 11 bp, Homo sapiens
tcccagtattt

SEQ ID NO: 1280131 - DNA, 15 bp, Homo sapiens
tcccagtatttttat

SEQ ID NO: 1280132 - DNA, 14 bp, Homo sapiens
tcccagtcactcct

SEQ ID NO: 1280133 - DNA, 22 bp, Homo sapiens
tcccagtcagaaataaaatttg

SEQ ID NO: 1280134 - DNA, 20 bp, Homo sapiens
tcccagtccaaatgtcctcc

SEQ ID NO: 1280135 - DNA, 23 bp, Homo sapiens
tcccagtccacctgaggaactgt

SEQ ID NO: 1280136 - DNA, 16 bp, Homo sapiens
tcccagtcctccagac

SEQ ID NO: 1280137 - DNA, 16 bp, Homo sapiens
tcccagtctcatctcc

SEQ ID NO: 1280138 - DNA, 23 bp, Homo sapiens
tcccagtctcatctcctgaccct

SEQ ID NO: 1280139 - DNA, 13 bp, Homo sapiens
tcccagtctctgt

SEQ ID NO: 1280140 - DNA, 21 bp, Homo sapiens
tcccagtgaatccctgggagc

SEQ ID NO: 1280141 - DNA, 22 bp, Homo sapiens
tcccagtgccgagaaggaagcc

SEQ ID NO: 1280142 - DNA, 15 bp, Homo sapiens
tcccagtgggagggg

SEQ ID NO: 1280143 - DNA, 14 bp, Homo sapiens
tcccagtgggctgt

SEQ ID NO: 1280144 - DNA, 22 bp, Homo sapiens
tcccagtgggtgatgcttttgc

SEQ ID NO: 1280145 - DNA, 13 bp, Homo sapiens
tcccagttttgtt

SEQ ID NO: 1280146 - DNA, 22 bp, Homo sapiens
tcccataagctaagccttatgt

SEQ ID NO: 1280147 - DNA, 21 bp, Homo sapiens
tcccatatatttaatatgtca

SEQ ID NO: 1280148 - DNA, 15 bp, Homo sapiens
tcccatatcctgcct

SEQ ID NO: 1280149 - DNA, 17 bp, Homo sapiens
tcccatatcttgccttc

SEQ ID NO: 1280150 - DNA, 22 bp, Homo sapiens
tcccatcactggagcaccaggc

SEQ ID NO: 1280151 - DNA, 20 bp, Homo sapiens
tcccatcaggctgttattat

SEQ ID NO: 1280152 - DNA, 15 bp, Homo sapiens
tcccatcatcctttg

SEQ ID NO: 1280153 - DNA, 17 bp, Homo sapiens
tcccatccagctaccac

SEQ ID NO: 1280154 - DNA, 13 bp, Homo sapiens
tcccatccccctg

SEQ ID NO: 1280155 - DNA, 16 bp, Homo sapiens
tcccatccccctgccc

SEQ ID NO: 1280156 - DNA, 16 bp, Homo sapiens
tcccatcctccagccc

SEQ ID NO: 1280157 - DNA, 13 bp, Homo sapiens
tcccatcctgggg

SEQ ID NO: 1280158 - DNA, 14 bp, Homo sapiens
tcccatcctggggc

SEQ ID NO: 1280159 - DNA, 13 bp, Homo sapiens
tcccatcgctgtc

SEQ ID NO: 1280160 - DNA, 20 bp, Homo sapiens
tcccatcgtctcggccttca

SEQ ID NO: 1280161 - DNA, 13 bp, Homo sapiens
tcccatctcctta

SEQ ID NO: 1280162 - DNA, 14 bp, Homo sapiens
tcccatctcttcct

SEQ ID NO: 1280163 - DNA, 14 bp, Homo sapiens
tcccatctgggagt

SEQ ID NO: 1280164 - DNA, 17 bp, Homo sapiens
tcccatctgggagtccc

SEQ ID NO: 1280165 - DNA, 16 bp, Homo sapiens
tcccatgactcttgga

SEQ ID NO: 1280166 - DNA, 20 bp, Homo sapiens
tcccatgactgcacccagct

SEQ ID NO: 1280167 - DNA, 16 bp, Homo sapiens
tcccatgcctggtccc

SEQ ID NO: 1280168 - DNA, 17 bp, Homo sapiens
tcccatgcctgtctctg

SEQ ID NO: 1280169 - DNA, 22 bp, Homo sapiens
tcccatggacactccagtgcca

SEQ ID NO: 1280170 - DNA, 12 bp, Homo sapiens
tcccatggggaa

SEQ ID NO: 1280171 - DNA, 16 bp, Homo sapiens
tcccatggtggcctca

SEQ ID NO: 1280172 - DNA, 13 bp, Homo sapiens
tcccatgtagccc

SEQ ID NO: 1280173 - DNA, 16 bp, Homo sapiens
tcccatgtcacctcag

SEQ ID NO: 1280174 - DNA, 10 bp, Homo sapiens
tcccatgtgg

SEQ ID NO: 1280175 - DNA, 15 bp, Homo sapiens
tcccattattatttc

SEQ ID NO: 1280176 - DNA, 17 bp, Homo sapiens
tcccattattatttctg

SEQ ID NO: 1280177 - DNA, 21 bp, Homo sapiens
tcccattattatttctgttct

SEQ ID NO: 1280178 - DNA, 21 bp, Homo sapiens
tcccattcatattaagacagt

SEQ ID NO: 1280179 - DNA, 13 bp, Homo sapiens
tcccattccctgg

SEQ ID NO: 1280180 - DNA, 12 bp, Homo sapiens
tcccattctaga

SEQ ID NO: 1280181 - DNA, 16 bp, Homo sapiens
tcccattgtccctctg

SEQ ID NO: 1280182 - DNA, 19 bp, Homo sapiens
tcccattgtccctctgccc

SEQ ID NO: 1280183 - DNA, 21 bp, Homo sapiens
tcccattgtccctctgcccca

SEQ ID NO: 1280184 - DNA, 18 bp, Homo sapiens
tcccatttagtgtgaata

SEQ ID NO: 1280185 - DNA, 13 bp, Homo sapiens
tcccatttcagga

SEQ ID NO: 1280186 - DNA, 20 bp, Homo sapiens
tcccatttctgttgctggag

SEQ ID NO: 1280187 - DNA, 23 bp, Homo sapiens
tcccatttctgttgctggagggg

SEQ ID NO: 1280188 - DNA, 15 bp, Homo sapiens
tcccattttcatcct

SEQ ID NO: 1280189 - DNA, 16 bp, Homo sapiens
tcccattttccccttc

SEQ ID NO: 1280190 - DNA, 20 bp, Homo sapiens
tcccattttggaagttttca

SEQ ID NO: 1280191 - DNA, 14 bp, Homo sapiens
tccccaaaagaaac

SEQ ID NO: 1280192 - DNA, 23 bp, Homo sapiens
tccccaaaagaaaccatgacaaa

SEQ ID NO: 1280193 - DNA, 11 bp, Homo sapiens
tccccaaactt

SEQ ID NO: 1280194 - DNA, 14 bp, Homo sapiens
tccccaaaggcatc

SEQ ID NO: 1280195 - DNA, 15 bp, Homo sapiens
tccccaaaggcatcc

SEQ ID NO: 1280196 - DNA, 18 bp, Homo sapiens
tccccaaatcaatacact

SEQ ID NO: 1280197 - DNA, 15 bp, Homo sapiens
tccccaaatggctgc

SEQ ID NO: 1280198 - DNA, 17 bp, Homo sapiens
tccccaaccctgcccct

SEQ ID NO: 1280199 - DNA, 22 bp, Homo sapiens
tccccaaccgtgtctgtctggc

SEQ ID NO: 1280200 - DNA, 15 bp, Homo sapiens
tccccaacgtcccct

SEQ ID NO: 1280201 - DNA, 19 bp, Homo sapiens
tccccaacgtcccctccgc

SEQ ID NO: 1280202 - DNA, 20 bp, Homo sapiens
tccccaacgtcccctccgcc

SEQ ID NO: 1280203 - DNA, 20 bp, Homo sapiens
tccccaagacacttcccctt

SEQ ID NO: 1280204 - DNA, 18 bp, Homo sapiens
tccccaagaccccctggg

SEQ ID NO: 1280205 - DNA, 23 bp, Homo sapiens
tccccaagattcacacctgactc

SEQ ID NO: 1280206 - DNA, 15 bp, Homo sapiens
tccccaagcctggca

SEQ ID NO: 1280207 - DNA, 12 bp, Homo sapiens
tccccaagctgg

SEQ ID NO: 1280208 - DNA, 21 bp, Homo sapiens
tccccaaggatgaccacaccc

SEQ ID NO: 1280209 - DNA, 19 bp, Homo sapiens
tccccaagggccaaaccca

SEQ ID NO: 1280210 - DNA, 21 bp, Homo sapiens
tccccaatcccggtcatgctt

SEQ ID NO: 1280211 - DNA, 21 bp, Homo sapiens
tccccaattctgcctgcctcc

SEQ ID NO: 1280212 - DNA, 15 bp, Homo sapiens
tccccacacacaggc

SEQ ID NO: 1280213 - DNA, 23 bp, Homo sapiens
tccccacacacaggccttctgtg

SEQ ID NO: 1280214 - DNA, 14 bp, Homo sapiens
tccccacacagggc

SEQ ID NO: 1280215 - DNA, 10 bp, Homo sapiens
tccccacact

SEQ ID NO: 1280216 - DNA, 22 bp, Homo sapiens
tccccacactccactctgattc

SEQ ID NO: 1280217 - DNA, 13 bp, Homo sapiens
tccccacagactg

SEQ ID NO: 1280218 - DNA, 17 bp, Homo sapiens
tccccacagactgcccc

SEQ ID NO: 1280219 - DNA, 17 bp, Homo sapiens
tccccacagcgtccctg

SEQ ID NO: 1280220 - DNA, 13 bp, Homo sapiens
tccccaccagctc

SEQ ID NO: 1280221 - DNA, 17 bp, Homo sapiens
tccccacccaagagagg

SEQ ID NO: 1280222 - DNA, 13 bp, Homo sapiens
tccccacccctgc

SEQ ID NO: 1280223 - DNA, 22 bp, Homo sapiens
tccccacccctgcccccagccc

SEQ ID NO: 1280224 - DNA, 17 bp, Homo sapiens
tccccaccctcctcttg

SEQ ID NO: 1280225 - DNA, 14 bp, Homo sapiens
tccccacctgggac

SEQ ID NO: 1280226 - DNA, 20 bp, Homo sapiens
tccccaccttcaattcctgg

SEQ ID NO: 1280227 - DNA, 16 bp, Homo sapiens
tccccaccttccccag

SEQ ID NO: 1280228 - DNA, 16 bp, Homo sapiens
tccccacgagggctgg

SEQ ID NO: 1280229 - DNA, 20 bp, Homo sapiens
tccccacgaggggacccatg

SEQ ID NO: 1280230 - DNA, 23 bp, Homo sapiens
tccccacgagtcacctgcaagcc

SEQ ID NO: 1280231 - DNA, 19 bp, Homo sapiens
tccccacgatgatatctat

SEQ ID NO: 1280232 - DNA, 22 bp, Homo sapiens
tccccacggggcctcgggacct

SEQ ID NO: 1280233 - DNA, 19 bp, Homo sapiens
tccccactaggttcttttc

SEQ ID NO: 1280234 - DNA, 18 bp, Homo sapiens
tccccactccaccctgtt

SEQ ID NO: 1280235 - DNA, 18 bp, Homo sapiens
tccccactcccccaccca

SEQ ID NO: 1280236 - DNA, 22 bp, Homo sapiens
tccccactccctggctctcaga

SEQ ID NO: 1280237 - DNA, 20 bp, Homo sapiens
tccccactcctctcccacag

SEQ ID NO: 1280238 - DNA, 16 bp, Homo sapiens
tccccactgacagcct

SEQ ID NO: 1280239 - DNA, 14 bp, Homo sapiens
tccccactgcctgc

SEQ ID NO: 1280240 - DNA, 18 bp, Homo sapiens
tccccactgcctgcccac

SEQ ID NO: 1280241 - DNA, 17 bp, Homo sapiens
tccccactgctgagctg

SEQ ID NO: 1280242 - DNA, 21 bp, Homo sapiens
tccccagaactggctgggccc

SEQ ID NO: 1280243 - DNA, 23 bp, Homo sapiens
tccccagaactggctgggcccct

SEQ ID NO: 1280244 - DNA, 15 bp, Homo sapiens
tccccagaccaaccc

SEQ ID NO: 1280245 - DNA, 16 bp, Homo sapiens
tccccagactcagctc

SEQ ID NO: 1280246 - DNA, 11 bp, Homo sapiens
tccccagagag

SEQ ID NO: 1280247 - DNA, 18 bp, Homo sapiens
tccccagagagcaggcag

SEQ ID NO: 1280248 - DNA, 12 bp, Homo sapiens
tccccagagcac

SEQ ID NO: 1280249 - DNA, 14 bp, Homo sapiens
tccccagagcccag

SEQ ID NO: 1280250 - DNA, 20 bp, Homo sapiens
tccccagagctgtgccagca

SEQ ID NO: 1280251 - DNA, 23 bp, Homo sapiens
tcccctccttgcctcctgtgtaa

SEQ ID NO: 1280252 - DNA, 13 bp, Homo sapiens
tcccctctcagaa

SEQ ID NO: 1280253 - DNA, 16 bp, Homo sapiens
tcccctctcagaacat

SEQ ID NO: 1280254 - DNA, 13 bp, Homo sapiens
tcccctctcagga

SEQ ID NO: 1280255 - DNA, 15 bp, Homo sapiens
tcccctctcatcccc

SEQ ID NO: 1280256 - DNA, 20 bp, Homo sapiens
tcccctctcatccccctgtg

SEQ ID NO: 1280257 - DNA, 22 bp, Homo sapiens
tcccctctcccagggatgctct

SEQ ID NO: 1280258 - DNA, 13 bp, Homo sapiens
tcccctctcccct

SEQ ID NO: 1280259 - DNA, 15 bp, Homo sapiens
tcccctctcccttcc

SEQ ID NO: 1280260 - DNA, 17 bp, Homo sapiens
tcccctctcctccgcca

SEQ ID NO: 1280261 - DNA, 19 bp, Homo sapiens
tcccctctcgccccatccc

SEQ ID NO: 1280262 - DNA, 14 bp, Homo sapiens
tcccctctcggcca

SEQ ID NO: 1280263 - DNA, 14 bp, Homo sapiens
tcccctctctctgg

SEQ ID NO: 1280264 - DNA, 14 bp, Homo sapiens
tcccctctctgcac

SEQ ID NO: 1280265 - DNA, 17 bp, Homo sapiens
tcccctctcttgcaccc

SEQ ID NO: 1280266 - DNA, 13 bp, Homo sapiens
tcccctctgctgc

SEQ ID NO: 1280267 - DNA, 14 bp, Homo sapiens
tcccctctgctgct

SEQ ID NO: 1280268 - DNA, 17 bp, Homo sapiens
tcccctctgctgctgtc

SEQ ID NO: 1280269 - DNA, 13 bp, Homo sapiens
tcccctctgtgct

SEQ ID NO: 1280270 - DNA, 15 bp, Homo sapiens
tcccctgacagggcc

SEQ ID NO: 1280271 - DNA, 19 bp, Homo sapiens
tcccctgagaccaccccca

SEQ ID NO: 1280272 - DNA, 22 bp, Homo sapiens
tcccctgagaccacccccaaac

SEQ ID NO: 1280273 - DNA, 20 bp, Homo sapiens
tcccctgagagtttcctcag

SEQ ID NO: 1280274 - DNA, 21 bp, Homo sapiens
tcccctgagagtttcctcaga

SEQ ID NO: 1280275 - DNA, 18 bp, Homo sapiens
tcccctgcacctggcctg

SEQ ID NO: 1280276 - DNA, 16 bp, Homo sapiens
tcccctgcagcctggg

SEQ ID NO: 1280277 - DNA, 22 bp, Homo sapiens
tcccctgcagcctgggtctgga

SEQ ID NO: 1280278 - DNA, 16 bp, Homo sapiens
tcccctgccacactga

SEQ ID NO: 1280279 - DNA, 12 bp, Homo sapiens
tcccctgccacc

SEQ ID NO: 1280280 - DNA, 13 bp, Homo sapiens
tcccctgccacca

SEQ ID NO: 1280281 - DNA, 15 bp, Homo sapiens
tcccctgccaccgac

SEQ ID NO: 1280282 - DNA, 12 bp, Homo sapiens
tcccctgccagg

SEQ ID NO: 1280283 - DNA, 15 bp, Homo sapiens
tcccctgccagggca

SEQ ID NO: 1280284 - DNA, 19 bp, Homo sapiens
tcccctgccccttccttta

SEQ ID NO: 1280285 - DNA, 22 bp, Homo sapiens
tcccctgcccctttacggacac

SEQ ID NO: 1280286 - DNA, 16 bp, Homo sapiens
tcccctgccctgctgc

SEQ ID NO: 1280287 - DNA, 24 bp, Homo sapiens
tcccctgccctggtccagggaagc

SEQ ID NO: 1280288 - DNA, 20 bp, Homo sapiens
tcccctgcccttcctcctga

SEQ ID NO: 1280289 - DNA, 11 bp, Homo sapiens
tcccctgcctc

SEQ ID NO: 1280290 - DNA, 18 bp, Homo sapiens
tcccctgcctcctgccac

SEQ ID NO: 1280291 - DNA, 19 bp, Homo sapiens
tcccctgcctcctgccacc

SEQ ID NO: 1280292 - DNA, 15 bp, Homo sapiens
tcccctgcctggaac

SEQ ID NO: 1280293 - DNA, 15 bp, Homo sapiens
tcccctgccttgctg

SEQ ID NO: 1280294 - DNA, 16 bp, Homo sapiens
tcccctggagtgtgtc

SEQ ID NO: 1280295 - DNA, 23 bp, Homo sapiens
tcccctggagtgtgtcagagccc

SEQ ID NO: 1280296 - DNA, 18 bp, Homo sapiens
tcccctgggatgctgacc

SEQ ID NO: 1280297 - DNA, 22 bp, Homo sapiens
tcccctgggatgctgacccagg

SEQ ID NO: 1280298 - DNA, 21 bp, Homo sapiens
tcccctgtcagtttcccctct

SEQ ID NO: 1280299 - DNA, 12 bp, Homo sapiens
tcccctgtccca

SEQ ID NO: 1280300 - DNA, 14 bp, Homo sapiens
tcccctgtcccacc

SEQ ID NO: 1280301 - DNA, 18 bp, Homo sapiens
tcccctgtcccaccaact

SEQ ID NO: 1280302 - DNA, 20 bp, Homo sapiens
tcccctgtcccaccaactct

SEQ ID NO: 1280303 - DNA, 20 bp, Homo sapiens
tcccctgtggggatctcagg

SEQ ID NO: 1280304 - DNA, 21 bp, Homo sapiens
tcccctgtggtgatgtgcctg

SEQ ID NO: 1280305 - DNA, 22 bp, Homo sapiens
tcccctgtggtgatgtgcctgt

SEQ ID NO: 1280306 - DNA, 17 bp, Homo sapiens
tcccctgttcccctctc

SEQ ID NO: 1280307 - DNA, 20 bp, Homo sapiens
tcccctgttgattatcttca

SEQ ID NO: 1280308 - DNA, 18 bp, Homo sapiens
tccccttccactgagggc

SEQ ID NO: 1280309 - DNA, 23 bp, Homo sapiens
tccccttccccgtcccctgcagc

SEQ ID NO: 1280310 - DNA, 15 bp, Homo sapiens
tccccttccctgcaa

SEQ ID NO: 1280311 - DNA, 14 bp, Homo sapiens
tccccttccctggg

SEQ ID NO: 1280312 - DNA, 16 bp, Homo sapiens
tccccttccctgggga

SEQ ID NO: 1280313 - DNA, 18 bp, Homo sapiens
tccccttccctggggagc

SEQ ID NO: 1280314 - DNA, 13 bp, Homo sapiens
tccccttcctaag

SEQ ID NO: 1280315 - DNA, 21 bp, Homo sapiens
tccccttcctaattccacagc

SEQ ID NO: 1280316 - DNA, 11 bp, Homo sapiens
tccccttcctg

SEQ ID NO: 1280317 - DNA, 14 bp, Homo sapiens
tccccttcctggac

SEQ ID NO: 1280318 - DNA, 16 bp, Homo sapiens
tccccttcctgtttca

SEQ ID NO: 1280319 - DNA, 18 bp, Homo sapiens
tccccttcgctgaaattg

SEQ ID NO: 1280320 - DNA, 16 bp, Homo sapiens
tccccttgagctgaga

SEQ ID NO: 1280321 - DNA, 15 bp, Homo sapiens
tccccttgcagcctg

SEQ ID NO: 1280322 - DNA, 16 bp, Homo sapiens
tccccttgcagcctgg

SEQ ID NO: 1280323 - DNA, 16 bp, Homo sapiens
tccccttgcccagggc

SEQ ID NO: 1280324 - DNA, 20 bp, Homo sapiens
tccccttgcccagggctcag

SEQ ID NO: 1280325 - DNA, 22 bp, Homo sapiens
tccccttgcccagggctcagcc

SEQ ID NO: 1280326 - DNA, 21 bp, Homo sapiens
tccccttgcccttgccctgac

SEQ ID NO: 1280327 - DNA, 19 bp, Homo sapiens
tccccttggacctccaggg

SEQ ID NO: 1280328 - DNA, 14 bp, Homo sapiens
tccccttgggcggc

SEQ ID NO: 1280329 - DNA, 14 bp, Homo sapiens
tcccctttcctcta

SEQ ID NO: 1280330 - DNA, 14 bp, Homo sapiens
tcccctttcctgtc

SEQ ID NO: 1280331 - DNA, 21 bp, Homo sapiens
tcccctttgtattccttaaat

SEQ ID NO: 1280332 - DNA, 17 bp, Homo sapiens
tccccttttgcctggct

SEQ ID NO: 1280333 - DNA, 18 bp, Homo sapiens
tccccttttgcctggctg

SEQ ID NO: 1280334 - DNA, 19 bp, Homo sapiens
tccccttttgcctggctgt

SEQ ID NO: 1280335 - DNA, 20 bp, Homo sapiens
tccccttttgcctggctgtg

SEQ ID NO: 1280336 - DNA, 24 bp, Homo sapiens
tccccttttgcctggctgtggagg

SEQ ID NO: 1280337 - DNA, 22 bp, Homo sapiens
tccccttttttttctgattctt

SEQ ID NO: 1280338 - DNA, 13 bp, Homo sapiens
tcccgaaaaatgt

SEQ ID NO: 1280339 - DNA, 17 bp, Homo sapiens
tcccgacccagccagct

SEQ ID NO: 1280340 - DNA, 18 bp, Homo sapiens
tcccgacccagccagctg

SEQ ID NO: 1280341 - DNA, 18 bp, Homo sapiens
tcccgagggagctgctgg

SEQ ID NO: 1280342 - DNA, 15 bp, Homo sapiens
tcccgagtacagtct

SEQ ID NO: 1280343 - DNA, 18 bp, Homo sapiens
tcccgagtacagtctgta

SEQ ID NO: 1280344 - DNA, 21 bp, Homo sapiens
tcccgagtagctgggattaca

SEQ ID NO: 1280345 - DNA, 15 bp, Homo sapiens
tcccgagtctgggac

SEQ ID NO: 1280346 - DNA, 16 bp, Homo sapiens
tcccgagtctgggaca

SEQ ID NO: 1280347 - DNA, 23 bp, Homo sapiens
tcccgatggtctctctccctctg

SEQ ID NO: 1280348 - DNA, 23 bp, Homo sapiens
tcccgcatcaaggtcagcatgag

SEQ ID NO: 1280349 - DNA, 15 bp, Homo sapiens
tcccgccccacctcc

SEQ ID NO: 1280350 - DNA, 18 bp, Homo sapiens
tcccgccccacctcccat

SEQ ID NO: 1280351 - DNA, 23 bp, Homo sapiens
tcccgccccccacacttccctgg

SEQ ID NO: 1280352 - DNA, 23 bp, Homo sapiens
tcccgccccgggctggccctgtg

SEQ ID NO: 1280353 - DNA, 13 bp, Homo sapiens
tcccgccttccaa

SEQ ID NO: 1280354 - DNA, 18 bp, Homo sapiens
tcccgccttcctcctcca

SEQ ID NO: 1280355 - DNA, 16 bp, Homo sapiens
tcccgctcagccctcc

SEQ ID NO: 1280356 - DNA, 13 bp, Homo sapiens
tcccgctcccagg

SEQ ID NO: 1280357 - DNA, 15 bp, Homo sapiens
tcccgctgcacacag

SEQ ID NO: 1280358 - DNA, 13 bp, Homo sapiens
tcccgctgcctcc

SEQ ID NO: 1280359 - DNA, 20 bp, Homo sapiens
tcccgctgcctcctgctctc

SEQ ID NO: 1280360 - DNA, 14 bp, Homo sapiens
tcccgcttagcctg

SEQ ID NO: 1280361 - DNA, 17 bp, Homo sapiens
tcccgcttagcctgcct

SEQ ID NO: 1280362 - DNA, 17 bp, Homo sapiens
tcccggagcacagccct

SEQ ID NO: 1280363 - DNA, 18 bp, Homo sapiens
tcccggagcacagccctg

SEQ ID NO: 1280364 - DNA, 15 bp, Homo sapiens
tcccggaggaaatct

SEQ ID NO: 1280365 - DNA, 18 bp, Homo sapiens
tcccggccaggcgggaga

SEQ ID NO: 1280366 - DNA, 17 bp, Homo sapiens
tcccggcccgcctgccc

SEQ ID NO: 1280367 - DNA, 21 bp, Homo sapiens
tcccggcccgcctgcccagac

SEQ ID NO: 1280368 - DNA, 14 bp, Homo sapiens
tcccggctgcctgc

SEQ ID NO: 1280369 - DNA, 16 bp, Homo sapiens
tcccggctgcctgccg

SEQ ID NO: 1280370 - DNA, 23 bp, Homo sapiens
tcccgggaatgaccgctctccct

SEQ ID NO: 1280371 - DNA, 16 bp, Homo sapiens
tcccgggccacgcccc

SEQ ID NO: 1280372 - DNA, 21 bp, Homo sapiens
tcccgggccacgccccagccc

SEQ ID NO: 1280373 - DNA, 23 bp, Homo sapiens
tcccttcggagccaacaagaccg

SEQ ID NO: 1280374 - DNA, 20 bp, Homo sapiens
tcccttctacaaggactcca

SEQ ID NO: 1280375 - DNA, 13 bp, Homo sapiens
tcccttctccccc

SEQ ID NO: 1280376 - DNA, 16 bp, Homo sapiens
tcccttctcccccttg

SEQ ID NO: 1280377 - DNA, 20 bp, Homo sapiens
tcccttctcccccttgtctt

SEQ ID NO: 1280378 - DNA, 23 bp, Homo sapiens
tcccttctcccccttgtcttccc

SEQ ID NO: 1280379 - DNA, 14 bp, Homo sapiens
tcccttctccctgg

SEQ ID NO: 1280380 - DNA, 16 bp, Homo sapiens
tcccttctccctggat

SEQ ID NO: 1280381 - DNA, 20 bp, Homo sapiens
tcccttctctgtagggaact

SEQ ID NO: 1280382 - DNA, 18 bp, Homo sapiens
tcccttcttgggtctgcc

SEQ ID NO: 1280383 - DNA, 14 bp, Homo sapiens
tcccttgaagcaag

SEQ ID NO: 1280384 - DNA, 20 bp, Homo sapiens
tcccttgactttgctcctca

SEQ ID NO: 1280385 - DNA, 13 bp, Homo sapiens
tcccttgagacct

SEQ ID NO: 1280386 - DNA, 17 bp, Homo sapiens
tcccttgagacctcagc

SEQ ID NO: 1280387 - DNA, 16 bp, Homo sapiens
tcccttgagatgagtt

SEQ ID NO: 1280388 - DNA, 21 bp, Homo sapiens
tcccttgagatgagtttctgg

SEQ ID NO: 1280389 - DNA, 22 bp, Homo sapiens
tcccttgagatgagtttctggg

SEQ ID NO: 1280390 - DNA, 17 bp, Homo sapiens
tcccttgagggctgcag

SEQ ID NO: 1280391 - DNA, 15 bp, Homo sapiens
tcccttgatgcacag

SEQ ID NO: 1280392 - DNA, 16 bp, Homo sapiens
tcccttgatgcacaga

SEQ ID NO: 1280393 - DNA, 18 bp, Homo sapiens
tcccttgatgggtgctgc

SEQ ID NO: 1280394 - DNA, 20 bp, Homo sapiens
tcccttgcaggggtcccccc

SEQ ID NO: 1280395 - DNA, 21 bp, Homo sapiens
tcccttgccatcctaaaagcc

SEQ ID NO: 1280396 - DNA, 20 bp, Homo sapiens
tcccttgccccaggccaggt

SEQ ID NO: 1280397 - DNA, 22 bp, Homo sapiens
tcccttgcctttcgaggcctga

SEQ ID NO: 1280398 - DNA, 16 bp, Homo sapiens
tcccttgctggcccca

SEQ ID NO: 1280399 - DNA, 17 bp, Homo sapiens
tcccttgctggccccag

SEQ ID NO: 1280400 - DNA, 23 bp, Homo sapiens
tcccttgctggccccagccctgc

SEQ ID NO: 1280401 - DNA, 18 bp, Homo sapiens
tcccttgcttagcctgtg

SEQ ID NO: 1280402 - DNA, 21 bp, Homo sapiens
tcccttgctttgttttaataa

SEQ ID NO: 1280403 - DNA, 15 bp, Homo sapiens
tcccttgcttttccc

SEQ ID NO: 1280404 - DNA, 23 bp, Homo sapiens
tcccttgcttttccctcttttct

SEQ ID NO: 1280405 - DNA, 20 bp, Homo sapiens
tcccttggaaacctgccctg

SEQ ID NO: 1280406 - DNA, 23 bp, Homo sapiens
tcccttggaaacctgccctgcct

SEQ ID NO: 1280407 - DNA, 11 bp, Homo sapiens
tcccttggagg

SEQ ID NO: 1280408 - DNA, 13 bp, Homo sapiens
tcccttggcctca

SEQ ID NO: 1280409 - DNA, 23 bp, Homo sapiens
tcccttgggaaggacacagcagt

SEQ ID NO: 1280410 - DNA, 12 bp, Homo sapiens
tcccttgggctc

SEQ ID NO: 1280411 - DNA, 19 bp, Homo sapiens
tcccttggtggcaagagcc

SEQ ID NO: 1280412 - DNA, 12 bp, Homo sapiens
tcccttgtattt

SEQ ID NO: 1280413 - DNA, 13 bp, Homo sapiens
tcccttgtgtgtg

SEQ ID NO: 1280414 - DNA, 17 bp, Homo sapiens
tccctttaaagcctttt

SEQ ID NO: 1280415 - DNA, 22 bp, Homo sapiens
tccctttccaaatgcccagctt

SEQ ID NO: 1280416 - DNA, 23 bp, Homo sapiens
tccctttccttccatccctaccc

SEQ ID NO: 1280417 - DNA, 17 bp, Homo sapiens
tccctttctctctcctc

SEQ ID NO: 1280418 - DNA, 18 bp, Homo sapiens
tccctttctctctcctct

SEQ ID NO: 1280419 - DNA, 13 bp, Homo sapiens
tccctttcttggc

SEQ ID NO: 1280420 - DNA, 20 bp, Homo sapiens
tccctttgccttaaacctga

SEQ ID NO: 1280421 - DNA, 22 bp, Homo sapiens
tccctttgtctgtcaatcacag

SEQ ID NO: 1280422 - DNA, 19 bp, Homo sapiens
tcccttttacatactgctg

SEQ ID NO: 1280423 - DNA, 18 bp, Homo sapiens
tcccttttacattctgtg

SEQ ID NO: 1280424 - DNA, 19 bp, Homo sapiens
tcccttttacattctgtgt

SEQ ID NO: 1280425 - DNA, 14 bp, Homo sapiens
tcccttttccatga

SEQ ID NO: 1280426 - DNA, 21 bp, Homo sapiens
tcccttttcctttctggcccc

SEQ ID NO: 1280427 - DNA, 14 bp, Homo sapiens
tcccttttctcctc

SEQ ID NO: 1280428 - DNA, 14 bp, Homo sapiens
tcccttttctttga

SEQ ID NO: 1280429 - DNA, 21 bp, Homo sapiens
tcccttttgactcttccgtgc

SEQ ID NO: 1280430 - DNA, 12 bp, Homo sapiens
tcccttttgcta

SEQ ID NO: 1280431 - DNA, 15 bp, Homo sapiens
tccctttttaaaaaa

SEQ ID NO: 1280432 - DNA, 16 bp, Homo sapiens
tccctttttaaaaaat

SEQ ID NO: 1280433 - DNA, 14 bp, Homo sapiens
tccgaagaaaagaa

SEQ ID NO: 1280434 - DNA, 18 bp, Homo sapiens
tccgaagctacttctcca

SEQ ID NO: 1280435 - DNA, 19 bp, Homo sapiens
tccgaatctctttcccttc

SEQ ID NO: 1280436 - DNA, 20 bp, Homo sapiens
tccgaccactaattgccaag

SEQ ID NO: 1280437 - DNA, 15 bp, Homo sapiens
tccgaccctctggga

SEQ ID NO: 1280438 - DNA, 14 bp, Homo sapiens
tccgacctctctca

SEQ ID NO: 1280439 - DNA, 19 bp, Homo sapiens
tccgacctctctcagcccc

SEQ ID NO: 1280440 - DNA, 20 bp, Homo sapiens
tccgacctctctcagcccca

SEQ ID NO: 1280441 - DNA, 18 bp, Homo sapiens
tccgacctctctcggccc

SEQ ID NO: 1280442 - DNA, 23 bp, Homo sapiens
tccgacgctgcctctcattggca

SEQ ID NO: 1280443 - DNA, 12 bp, Homo sapiens
tccgagaactaa

SEQ ID NO: 1280444 - DNA, 17 bp, Homo sapiens
tccgagagagcacccct

SEQ ID NO: 1280445 - DNA, 14 bp, Homo sapiens
tccgagagcagtgg

SEQ ID NO: 1280446 - DNA, 15 bp, Homo sapiens
tccgagaggcagcca

SEQ ID NO: 1280447 - DNA, 13 bp, Homo sapiens
tccgagaggctgg

SEQ ID NO: 1280448 - DNA, 15 bp, Homo sapiens
tccgagagggagaga

SEQ ID NO: 1280449 - DNA, 14 bp, Homo sapiens
tccgagatccccag

SEQ ID NO: 1280450 - DNA, 17 bp, Homo sapiens
tccgagcattccagtaa

SEQ ID NO: 1280451 - DNA, 21 bp, Homo sapiens
tccgagcattccagtaacttt

SEQ ID NO: 1280452 - DNA, 15 bp, Homo sapiens
tccgaggctccccgc

SEQ ID NO: 1280453 - DNA, 14 bp, Homo sapiens
tccgagggcggcca

SEQ ID NO: 1280454 - DNA, 17 bp, Homo sapiens
tccgagggcggccaggg

SEQ ID NO: 1280455 - DNA, 21 bp, Homo sapiens
tccgagggcggccagggacag

SEQ ID NO: 1280456 - DNA, 17 bp, Homo sapiens
tccgaggggctggagcg

SEQ ID NO: 1280457 - DNA, 13 bp, Homo sapiens
tccgatcaacatt

SEQ ID NO: 1280458 - DNA, 15 bp, Homo sapiens
tccgatcaacattta

SEQ ID NO: 1280459 - DNA, 18 bp, Homo sapiens
tccgatcaacatttatga

SEQ ID NO: 1280460 - DNA, 14 bp, Homo sapiens
tccgcaccagctgc

SEQ ID NO: 1280461 - DNA, 16 bp, Homo sapiens
tccgcactttccactt

SEQ ID NO: 1280462 - DNA, 22 bp, Homo sapiens
tccgcactttccacttcttcct

SEQ ID NO: 1280463 - DNA, 20 bp, Homo sapiens
tccgcagactgcttggccag

SEQ ID NO: 1280464 - DNA, 23 bp, Homo sapiens
tccgcagcccccacccccaaggt

SEQ ID NO: 1280465 - DNA, 16 bp, Homo sapiens
tccgcagcccctttcc

SEQ ID NO: 1280466 - DNA, 19 bp, Homo sapiens
tccgcaggctatttgttca

SEQ ID NO: 1280467 - DNA, 16 bp, Homo sapiens
tccgcaggtgctggtc

SEQ ID NO: 1280468 - DNA, 21 bp, Homo sapiens
tccgccactcagccatttccc

SEQ ID NO: 1280469 - DNA, 12 bp, Homo sapiens
tccgccagaccc

SEQ ID NO: 1280470 - DNA, 13 bp, Homo sapiens
tccgccagacccc

SEQ ID NO: 1280471 - DNA, 18 bp, Homo sapiens
tccgccagaccccgtggc

SEQ ID NO: 1280472 - DNA, 20 bp, Homo sapiens
tccgccagaccccgtggctc

SEQ ID NO: 1280473 - DNA, 23 bp, Homo sapiens
tccgccagaccccgtggctctgg

SEQ ID NO: 1280474 - DNA, 17 bp, Homo sapiens
tccgccagcctcctctg

SEQ ID NO: 1280475 - DNA, 20 bp, Homo sapiens
tccgccagcctcctctggac

SEQ ID NO: 1280476 - DNA, 22 bp, Homo sapiens
tccgccatggggtcggctcctg

SEQ ID NO: 1280477 - DNA, 15 bp, Homo sapiens
tccgccatggtgtcc

SEQ ID NO: 1280478 - DNA, 16 bp, Homo sapiens
tccgcccagcctctcc

SEQ ID NO: 1280479 - DNA, 19 bp, Homo sapiens
tccgcccagcctctccccg

SEQ ID NO: 1280480 - DNA, 11 bp, Homo sapiens
tccgcccccag

SEQ ID NO: 1280481 - DNA, 12 bp, Homo sapiens
tccgcccccagc

SEQ ID NO: 1280482 - DNA, 14 bp, Homo sapiens
tccgcccccagcct

SEQ ID NO: 1280483 - DNA, 21 bp, Homo sapiens
tccgcccgccgccctggacag

SEQ ID NO: 1280484 - DNA, 22 bp, Homo sapiens
tccgcccgccgccctggacaga

SEQ ID NO: 1280485 - DNA, 14 bp, Homo sapiens
tccgccctgccact

SEQ ID NO: 1280486 - DNA, 16 bp, Homo sapiens
tccgccctgccactca

SEQ ID NO: 1280487 - DNA, 12 bp, Homo sapiens
tccgccctgctc

SEQ ID NO: 1280488 - DNA, 15 bp, Homo sapiens
tccgccctgctcctc

SEQ ID NO: 1280489 - DNA, 13 bp, Homo sapiens
tccgcctgtgggc

SEQ ID NO: 1280490 - DNA, 19 bp, Homo sapiens
tccgccttaccaggagaag

SEQ ID NO: 1280491 - DNA, 16 bp, Homo sapiens
tccgccttctcccaca

SEQ ID NO: 1280492 - DNA, 17 bp, Homo sapiens
tccgcgccgatgccacc

SEQ ID NO: 1280493 - DNA, 19 bp, Homo sapiens
tccgcgccgatgccaccgg

SEQ ID NO: 1280494 - DNA, 23 bp, Homo sapiens
tccgcgcggagacctcctgacaa

SEQ ID NO: 1280495 - DNA, 13 bp, Homo sapiens
tcctcactaaaaa

SEQ ID NO: 1280496 - DNA, 14 bp, Homo sapiens
tcctcactcccagt

SEQ ID NO: 1280497 - DNA, 21 bp, Homo sapiens
tcctcactctgtccctgtcct

SEQ ID NO: 1280498 - DNA, 12 bp, Homo sapiens
tcctcactgcct

SEQ ID NO: 1280499 - DNA, 18 bp, Homo sapiens
tcctcactggaggagcag

SEQ ID NO: 1280500 - DNA, 20 bp, Homo sapiens
tcctcactggaggagcagct

SEQ ID NO: 1280501 - DNA, 13 bp, Homo sapiens
tcctcactgggtg

SEQ ID NO: 1280502 - DNA, 21 bp, Homo sapiens
tcctcacttccatacagctct

SEQ ID NO: 1280503 - DNA, 15 bp, Homo sapiens
tcctcacttggggga

SEQ ID NO: 1280504 - DNA, 13 bp, Homo sapiens
tcctcagagcagg

SEQ ID NO: 1280505 - DNA, 23 bp, Homo sapiens
tcctcagagcaggggccagatga

SEQ ID NO: 1280506 - DNA, 18 bp, Homo sapiens
tcctcagagcgccaggaa

SEQ ID NO: 1280507 - DNA, 21 bp, Homo sapiens
tcctcagaggctgagccctgt

SEQ ID NO: 1280508 - DNA, 18 bp, Homo sapiens
tcctcagatggggcacca

SEQ ID NO: 1280509 - DNA, 20 bp, Homo sapiens
tcctcagcccccaggccagg

SEQ ID NO: 1280510 - DNA, 22 bp, Homo sapiens
tcctcagcccccaggccaggtg

SEQ ID NO: 1280511 - DNA, 24 bp, Homo sapiens
tcctcagcccccaggccaggtgag

SEQ ID NO: 1280512 - DNA, 18 bp, Homo sapiens
tcctcagccgagaaattg

SEQ ID NO: 1280513 - DNA, 12 bp, Homo sapiens
tcctcagcctcc

SEQ ID NO: 1280514 - DNA, 22 bp, Homo sapiens
tcctcagcctcccaagtagctg

SEQ ID NO: 1280515 - DNA, 22 bp, Homo sapiens
tcctcagctgcatggagcctgg

SEQ ID NO: 1280516 - DNA, 12 bp, Homo sapiens
tcctcagctgcc

SEQ ID NO: 1280517 - DNA, 20 bp, Homo sapiens
tcctcagctgccaagcactc

SEQ ID NO: 1280518 - DNA, 14 bp, Homo sapiens
tcctcagcttatct

SEQ ID NO: 1280519 - DNA, 22 bp, Homo sapiens
tcctcagcttcttcacaggcac

SEQ ID NO: 1280520 - DNA, 22 bp, Homo sapiens
tcctcagcttgggcttcttcct

SEQ ID NO: 1280521 - DNA, 15 bp, Homo sapiens
tcctcaggaaggaca

SEQ ID NO: 1280522 - DNA, 12 bp, Homo sapiens
tcctcaggacaa

SEQ ID NO: 1280523 - DNA, 16 bp, Homo sapiens
tcctcaggaccctcag

SEQ ID NO: 1280524 - DNA, 17 bp, Homo sapiens
tcctcaggcacacagct

SEQ ID NO: 1280525 - DNA, 18 bp, Homo sapiens
tcctcagggacagagaca

SEQ ID NO: 1280526 - DNA, 22 bp, Homo sapiens
tcctcagggacagagacacctg

SEQ ID NO: 1280527 - DNA, 12 bp, Homo sapiens
tcctcagggggt

SEQ ID NO: 1280528 - DNA, 23 bp, Homo sapiens
tcctcagggggtaggagagcact

SEQ ID NO: 1280529 - DNA, 19 bp, Homo sapiens
tcctcaggggtggagaagt

SEQ ID NO: 1280530 - DNA, 16 bp, Homo sapiens
tcctcagggtgggggg

SEQ ID NO: 1280531 - DNA, 12 bp, Homo sapiens
tcctcaggtcag

SEQ ID NO: 1280532 - DNA, 16 bp, Homo sapiens
tcctcaggtcagctgg

SEQ ID NO: 1280533 - DNA, 22 bp, Homo sapiens
tcctcaggtggccatgcctcag

SEQ ID NO: 1280534 - DNA, 23 bp, Homo sapiens
tcctcaggtggccatgcctcagc

SEQ ID NO: 1280535 - DNA, 22 bp, Homo sapiens
tcctcagtaagtgttagaggga

SEQ ID NO: 1280536 - DNA, 19 bp, Homo sapiens
tcctcagtgcatttgtgct

SEQ ID NO: 1280537 - DNA, 23 bp, Homo sapiens
tcctcataaaaagcaaaacaaaa

SEQ ID NO: 1280538 - DNA, 23 bp, Homo sapiens
tcctcatcaccatcgtgtttgca

SEQ ID NO: 1280539 - DNA, 14 bp, Homo sapiens
tcctcatccacccc

SEQ ID NO: 1280540 - DNA, 17 bp, Homo sapiens
tcctcatccaccccatc

SEQ ID NO: 1280541 - DNA, 18 bp, Homo sapiens
tcctcatccaccccatcc

SEQ ID NO: 1280542 - DNA, 23 bp, Homo sapiens
tcctcatcccctcgtcctgtccc

SEQ ID NO: 1280543 - DNA, 17 bp, Homo sapiens
tcctcatcctgcttctc

SEQ ID NO: 1280544 - DNA, 19 bp, Homo sapiens
tcctcatcctttccctctc

SEQ ID NO: 1280545 - DNA, 23 bp, Homo sapiens
tcctcatgggaagatgtctcaga

SEQ ID NO: 1280546 - DNA, 15 bp, Homo sapiens
tcctcatgtaacatt

SEQ ID NO: 1280547 - DNA, 18 bp, Homo sapiens
tcctcatgtaacattggt

SEQ ID NO: 1280548 - DNA, 19 bp, Homo sapiens
tcctcatgtaacattggtg

SEQ ID NO: 1280549 - DNA, 20 bp, Homo sapiens
tcctcatgtaacattggtga

SEQ ID NO: 1280550 - DNA, 18 bp, Homo sapiens
tcctcatgttactcagtg

SEQ ID NO: 1280551 - DNA, 17 bp, Homo sapiens
tcctcatgttctgcttt

SEQ ID NO: 1280552 - DNA, 19 bp, Homo sapiens
tcctcatgttgctgaattt

SEQ ID NO: 1280553 - DNA, 16 bp, Homo sapiens
tcctcattataaaatg

SEQ ID NO: 1280554 - DNA, 14 bp, Homo sapiens
tcctcattcctgaa

SEQ ID NO: 1280555 - DNA, 16 bp, Homo sapiens
tcctcattgcctcctg

SEQ ID NO: 1280556 - DNA, 20 bp, Homo sapiens
tcctcattgcctcctgttct

SEQ ID NO: 1280557 - DNA, 19 bp, Homo sapiens
tcctccaatgtcctgaaac

SEQ ID NO: 1280558 - DNA, 11 bp, Homo sapiens
tcctccacaga

SEQ ID NO: 1280559 - DNA, 18 bp, Homo sapiens
tcctccacagtcccccac

SEQ ID NO: 1280560 - DNA, 22 bp, Homo sapiens
tcctccacagtcccccacccac

SEQ ID NO: 1280561 - DNA, 23 bp, Homo sapiens
tcctccacagtcccccacccacc

SEQ ID NO: 1280562 - DNA, 15 bp, Homo sapiens
tcctccacagtgctg

SEQ ID NO: 1280563 - DNA, 23 bp, Homo sapiens
tcctccacatcctttctaaacaa

SEQ ID NO: 1280564 - DNA, 12 bp, Homo sapiens
tcctccacccca

SEQ ID NO: 1280565 - DNA, 21 bp, Homo sapiens
tcctccacgttctgctcatca

SEQ ID NO: 1280566 - DNA, 22 bp, Homo sapiens
tcctccacgttctgctcatcat

SEQ ID NO: 1280567 - DNA, 23 bp, Homo sapiens
tcctccacgttctgctcatcatt

SEQ ID NO: 1280568 - DNA, 17 bp, Homo sapiens
tcctccactcactccag

SEQ ID NO: 1280569 - DNA, 13 bp, Homo sapiens
tcctccactccac

SEQ ID NO: 1280570 - DNA, 15 bp, Homo sapiens
tcctccactttgctg

SEQ ID NO: 1280571 - DNA, 14 bp, Homo sapiens
tcctccagaagcct

SEQ ID NO: 1280572 - DNA, 19 bp, Homo sapiens
tcctccagaagcctctggc

SEQ ID NO: 1280573 - DNA, 20 bp, Homo sapiens
tcctccagaagcctctggct

SEQ ID NO: 1280574 - DNA, 21 bp, Homo sapiens
tcctccagaagcctctggcta

SEQ ID NO: 1280575 - DNA, 13 bp, Homo sapiens
tcctccagaccac

SEQ ID NO: 1280576 - DNA, 16 bp, Homo sapiens
tcctccagaccaccag

SEQ ID NO: 1280577 - DNA, 14 bp, Homo sapiens
tcctccagcaggga

SEQ ID NO: 1280578 - DNA, 12 bp, Homo sapiens
tcctccagcccc

SEQ ID NO: 1280579 - DNA, 18 bp, Homo sapiens
tcctccagcccctgtccc

SEQ ID NO: 1280580 - DNA, 23 bp, Homo sapiens
tcctccagcctcccctcccctgg

SEQ ID NO: 1280581 - DNA, 21 bp, Homo sapiens
tcctccagctgcaccagagca

SEQ ID NO: 1280582 - DNA, 13 bp, Homo sapiens
tcctccagcttct

SEQ ID NO: 1280583 - DNA, 13 bp, Homo sapiens
tcctccaggagct

SEQ ID NO: 1280584 - DNA, 17 bp, Homo sapiens
tcctccaggagcttctt

SEQ ID NO: 1280585 - DNA, 13 bp, Homo sapiens
tcctccaggcctg

SEQ ID NO: 1280586 - DNA, 21 bp, Homo sapiens
tcctccagggatgatcaacag

SEQ ID NO: 1280587 - DNA, 18 bp, Homo sapiens
tcctccagtaccttgctt

SEQ ID NO: 1280588 - DNA, 22 bp, Homo sapiens
tcctccagtgtgggcttgacca

SEQ ID NO: 1280589 - DNA, 21 bp, Homo sapiens
tcctccatcacctgaaacact

SEQ ID NO: 1280590 - DNA, 20 bp, Homo sapiens
tcctccatcccaacagccat

SEQ ID NO: 1280591 - DNA, 12 bp, Homo sapiens
tcctccatggga

SEQ ID NO: 1280592 - DNA, 13 bp, Homo sapiens
tcctcccacaatc

SEQ ID NO: 1280593 - DNA, 15 bp, Homo sapiens
tcctcccacagacct

SEQ ID NO: 1280594 - DNA, 23 bp, Homo sapiens
tcctcccacagacctgcagtgag

SEQ ID NO: 1280595 - DNA, 10 bp, Homo sapiens
tcctcccagc

SEQ ID NO: 1280596 - DNA, 13 bp, Homo sapiens
tcctcccagcggc

SEQ ID NO: 1280597 - DNA, 11 bp, Homo sapiens
tcctcccagct

SEQ ID NO: 1280598 - DNA, 14 bp, Homo sapiens
tcctcccagctgct

SEQ ID NO: 1280599 - DNA, 22 bp, Homo sapiens
tcctcccagcttgtaggagctg

SEQ ID NO: 1280600 - DNA, 19 bp, Homo sapiens
tcctcccagggcctcctgg

SEQ ID NO: 1280601 - DNA, 22 bp, Homo sapiens
tcctcccagggcctcctggggg

SEQ ID NO: 1280602 - DNA, 14 bp, Homo sapiens
tcctcccagtgaga

SEQ ID NO: 1280603 - DNA, 22 bp, Homo sapiens
tcctcccagtgagactgcccca

SEQ ID NO: 1280604 - DNA, 19 bp, Homo sapiens
tcctcccatcccctcaaca

SEQ ID NO: 1280605 - DNA, 15 bp, Homo sapiens
tcctcccatcccctg

SEQ ID NO: 1280606 - DNA, 18 bp, Homo sapiens
tcctcccatcccctggac

SEQ ID NO: 1280607 - DNA, 13 bp, Homo sapiens
tcctcccatgtca

SEQ ID NO: 1280608 - DNA, 14 bp, Homo sapiens
tcctccccacactc

SEQ ID NO: 1280609 - DNA, 18 bp, Homo sapiens
tcctccccacactccact

SEQ ID NO: 1280610 - DNA, 19 bp, Homo sapiens
tcctccccaccttccccag

SEQ ID NO: 1280611 - DNA, 23 bp, Homo sapiens
tcctccccaccttccccagactc

SEQ ID NO: 1280612 - DNA, 21 bp, Homo sapiens
tcctccccacttgtccgctgg

SEQ ID NO: 1280613 - DNA, 13 bp, Homo sapiens
tcctccccataca

SEQ ID NO: 1280614 - DNA, 17 bp, Homo sapiens
tcctccccatacacaca

SEQ ID NO: 1280615 - DNA, 19 bp, Homo sapiens
tcctcccccggctgggcct

SEQ ID NO: 1280616 - DNA, 17 bp, Homo sapiens
tcctgacagaaggtgcc

SEQ ID NO: 1280617 - DNA, 14 bp, Homo sapiens
tcctgacattgtct

SEQ ID NO: 1280618 - DNA, 15 bp, Homo sapiens
tcctgacattgtctc

SEQ ID NO: 1280619 - DNA, 15 bp, Homo sapiens
tcctgaccaagactg

SEQ ID NO: 1280620 - DNA, 17 bp, Homo sapiens
tcctgaccaagactgag

SEQ ID NO: 1280621 - DNA, 11 bp, Homo sapiens
tcctgaccagc

SEQ ID NO: 1280622 - DNA, 14 bp, Homo sapiens
tcctgacccaggcc

SEQ ID NO: 1280623 - DNA, 15 bp, Homo sapiens
tcctgacccagtccc

SEQ ID NO: 1280624 - DNA, 21 bp, Homo sapiens
tcctgacccctccctgcaggg

SEQ ID NO: 1280625 - DNA, 16 bp, Homo sapiens
tcctgacccctctcct

SEQ ID NO: 1280626 - DNA, 13 bp, Homo sapiens
tcctgaccctccc

SEQ ID NO: 1280627 - DNA, 18 bp, Homo sapiens
tcctgaccctcccactcc

SEQ ID NO: 1280628 - DNA, 22 bp, Homo sapiens
tcctgaccctcccactcccatc

SEQ ID NO: 1280629 - DNA, 21 bp, Homo sapiens
tcctgacctccatatgctgta

SEQ ID NO: 1280630 - DNA, 21 bp, Homo sapiens
tcctgacgaaactggccccgg

SEQ ID NO: 1280631 - DNA, 14 bp, Homo sapiens
tcctgacgccctgc

SEQ ID NO: 1280632 - DNA, 23 bp, Homo sapiens
tcctgacgccctgcgttggagcc

SEQ ID NO: 1280633 - DNA, 21 bp, Homo sapiens
tcctgacggcgcccccagtgt

SEQ ID NO: 1280634 - DNA, 22 bp, Homo sapiens
tcctgagaaagcccacctgggc

SEQ ID NO: 1280635 - DNA, 18 bp, Homo sapiens
tcctgagaaagctcaaag

SEQ ID NO: 1280636 - DNA, 20 bp, Homo sapiens
tcctgagaaggcgaggagag

SEQ ID NO: 1280637 - DNA, 23 bp, Homo sapiens
tcctgagaaggcgaggagagtgg

SEQ ID NO: 1280638 - DNA, 13 bp, Homo sapiens
tcctgagagctgc

SEQ ID NO: 1280639 - DNA, 17 bp, Homo sapiens
tcctgagcataactcca

SEQ ID NO: 1280640 - DNA, 21 bp, Homo sapiens
tcctgagcccaaccaggccct

SEQ ID NO: 1280641 - DNA, 12 bp, Homo sapiens
tcctgagccccg

SEQ ID NO: 1280642 - DNA, 12 bp, Homo sapiens
tcctgagcctcc

SEQ ID NO: 1280643 - DNA, 15 bp, Homo sapiens
tcctgagctggcctg

SEQ ID NO: 1280644 - DNA, 20 bp, Homo sapiens
tcctgagctggcctgtctgc

SEQ ID NO: 1280645 - DNA, 20 bp, Homo sapiens
tcctgagcttggccagaagg

SEQ ID NO: 1280646 - DNA, 14 bp, Homo sapiens
tcctgaggaataaa

SEQ ID NO: 1280647 - DNA, 18 bp, Homo sapiens
tcctgaggacagctgtcc

SEQ ID NO: 1280648 - DNA, 19 bp, Homo sapiens
tcctgaggacagctgtcct

SEQ ID NO: 1280649 - DNA, 20 bp, Homo sapiens
tcctgaggagccctgaggac

SEQ ID NO: 1280650 - DNA, 12 bp, Homo sapiens
tcctgagggcta

SEQ ID NO: 1280651 - DNA, 20 bp, Homo sapiens
tcctgaggggcatctgcccc

SEQ ID NO: 1280652 - DNA, 17 bp, Homo sapiens
tcctgagggtccccacc

SEQ ID NO: 1280653 - DNA, 22 bp, Homo sapiens
tcctgagggtccccacctggga

SEQ ID NO: 1280654 - DNA, 17 bp, Homo sapiens
tcctgagggttttctca

SEQ ID NO: 1280655 - DNA, 13 bp, Homo sapiens
tcctgagtagctg

SEQ ID NO: 1280656 - DNA, 19 bp, Homo sapiens
tcctgagtagctggattac

SEQ ID NO: 1280657 - DNA, 19 bp, Homo sapiens
tcctgagtagctgggcctg

SEQ ID NO: 1280658 - DNA, 21 bp, Homo sapiens
tcctgagtagctgggcctgtg

SEQ ID NO: 1280659 - DNA, 17 bp, Homo sapiens
tcctgagtgtggacttg

SEQ ID NO: 1280660 - DNA, 18 bp, Homo sapiens
tcctgataaacattaaac

SEQ ID NO: 1280661 - DNA, 17 bp, Homo sapiens
tcctgataataattgat

SEQ ID NO: 1280662 - DNA, 14 bp, Homo sapiens
tcctgatcagagcc

SEQ ID NO: 1280663 - DNA, 18 bp, Homo sapiens
tcctgatcccagacccat

SEQ ID NO: 1280664 - DNA, 13 bp, Homo sapiens
tcctgatcttccc

SEQ ID NO: 1280665 - DNA, 20 bp, Homo sapiens
tcctgatgccctcttctcct

SEQ ID NO: 1280666 - DNA, 22 bp, Homo sapiens
tcctgatgccctcttctccttg

SEQ ID NO: 1280667 - DNA, 21 bp, Homo sapiens
tcctgatggagtgtgcagaca

SEQ ID NO: 1280668 - DNA, 15 bp, Homo sapiens
tcctgatggccaaga

SEQ ID NO: 1280669 - DNA, 16 bp, Homo sapiens
tcctgatggccaagag

SEQ ID NO: 1280670 - DNA, 18 bp, Homo sapiens
tcctgatggtacaggaaa

SEQ ID NO: 1280671 - DNA, 23 bp, Homo sapiens
tcctgatggtacaggaaagctca

SEQ ID NO: 1280672 - DNA, 17 bp, Homo sapiens
tcctgatggtcagctcc

SEQ ID NO: 1280673 - DNA, 23 bp, Homo sapiens
tcctgatggtgtcattctgcctg

SEQ ID NO: 1280674 - DNA, 20 bp, Homo sapiens
tcctgattatttatcacata

SEQ ID NO: 1280675 - DNA, 13 bp, Homo sapiens
tcctgattccaaa

SEQ ID NO: 1280676 - DNA, 15 bp, Homo sapiens
tcctgattccaaata

SEQ ID NO: 1280677 - DNA, 17 bp, Homo sapiens
tcctgattgtttacagt

SEQ ID NO: 1280678 - DNA, 18 bp, Homo sapiens
tcctgatttctctgaaca

SEQ ID NO: 1280679 - DNA, 19 bp, Homo sapiens
tcctgatttcttattgaat

SEQ ID NO: 1280680 - DNA, 19 bp, Homo sapiens
tcctgcaaaattttatagc

SEQ ID NO: 1280681 - DNA, 13 bp, Homo sapiens
tcctgcaaaggcc

SEQ ID NO: 1280682 - DNA, 18 bp, Homo sapiens
tcctgcaaaggcccttgt

SEQ ID NO: 1280683 - DNA, 15 bp, Homo sapiens
tcctgcaaggtgaaa

SEQ ID NO: 1280684 - DNA, 21 bp, Homo sapiens
tcctgcacacagaatgctcag

SEQ ID NO: 1280685 - DNA, 14 bp, Homo sapiens
tcctgcacacaggg

SEQ ID NO: 1280686 - DNA, 21 bp, Homo sapiens
tcctgcacagttttctggctg

SEQ ID NO: 1280687 - DNA, 14 bp, Homo sapiens
tcctgcaccccagc

SEQ ID NO: 1280688 - DNA, 15 bp, Homo sapiens
tcctgcaccccagca

SEQ ID NO: 1280689 - DNA, 16 bp, Homo sapiens
tcctgcaccccagcat

SEQ ID NO: 1280690 - DNA, 18 bp, Homo sapiens
tcctgcaccccagcattc

SEQ ID NO: 1280691 - DNA, 19 bp, Homo sapiens
tcctgcagacacctggact

SEQ ID NO: 1280692 - DNA, 20 bp, Homo sapiens
tcctgcagacacctggactg

SEQ ID NO: 1280693 - DNA, 17 bp, Homo sapiens
tcctgcagaccacgccc

SEQ ID NO: 1280694 - DNA, 20 bp, Homo sapiens
tcctgcagaggaccacagtg

SEQ ID NO: 1280695 - DNA, 13 bp, Homo sapiens
tcctgcagcaaac

SEQ ID NO: 1280696 - DNA, 19 bp, Homo sapiens
tcctgcagcaaacactcca

SEQ ID NO: 1280697 - DNA, 20 bp, Homo sapiens
tcctgcagcaaacactccac

SEQ ID NO: 1280698 - DNA, 17 bp, Homo sapiens
tcctgcagccccagaag

SEQ ID NO: 1280699 - DNA, 18 bp, Homo sapiens
tcctgcagccccagaaga

SEQ ID NO: 1280700 - DNA, 20 bp, Homo sapiens
tcctgcagccccagaagaaa

SEQ ID NO: 1280701 - DNA, 19 bp, Homo sapiens
tcctgcagcctcctcctga

SEQ ID NO: 1280702 - DNA, 9 bp, Homo sapiens
tcctgcagg

SEQ ID NO: 1280703 - DNA, 22 bp, Homo sapiens
tcctgcaggcaggaacaaacag

SEQ ID NO: 1280704 - DNA, 19 bp, Homo sapiens
tcctgcagggcttctcctc

SEQ ID NO: 1280705 - DNA, 24 bp, Homo sapiens
tcctgcagtcccacactgtgcaga

SEQ ID NO: 1280706 - DNA, 21 bp, Homo sapiens
tcctgcagtttgggagacatg

SEQ ID NO: 1280707 - DNA, 14 bp, Homo sapiens
tcctgcatctctgt

SEQ ID NO: 1280708 - DNA, 17 bp, Homo sapiens
tcctgcatttctcttct

SEQ ID NO: 1280709 - DNA, 20 bp, Homo sapiens
tcctgccacatggagccccc

SEQ ID NO: 1280710 - DNA, 16 bp, Homo sapiens
tcctgccaccagtcac

SEQ ID NO: 1280711 - DNA, 16 bp, Homo sapiens
tcctgccaccccttcc

SEQ ID NO: 1280712 - DNA, 11 bp, Homo sapiens
tcctgccagct

SEQ ID NO: 1280713 - DNA, 13 bp, Homo sapiens
tcctgccagctgc

SEQ ID NO: 1280714 - DNA, 17 bp, Homo sapiens
tcctgccagtgtggaac

SEQ ID NO: 1280715 - DNA, 22 bp, Homo sapiens
tcctgccatgggtgcagaccct

SEQ ID NO: 1280716 - DNA, 23 bp, Homo sapiens
tcctgcccacgcagacctgcagc

SEQ ID NO: 1280717 - DNA, 13 bp, Homo sapiens
tcctgcccacggg

SEQ ID NO: 1280718 - DNA, 17 bp, Homo sapiens
tcctgcccacgggagga

SEQ ID NO: 1280719 - DNA, 20 bp, Homo sapiens
tcctgcccactgctgcagta

SEQ ID NO: 1280720 - DNA, 13 bp, Homo sapiens
tcctgcccaggac

SEQ ID NO: 1280721 - DNA, 16 bp, Homo sapiens
tcctgcccaggagagc

SEQ ID NO: 1280722 - DNA, 22 bp, Homo sapiens
tcctgcccaggagagccagccc

SEQ ID NO: 1280723 - DNA, 14 bp, Homo sapiens
tcctgcccagtgtt

SEQ ID NO: 1280724 - DNA, 17 bp, Homo sapiens
tcctgcccagtgttgtt

SEQ ID NO: 1280725 - DNA, 22 bp, Homo sapiens
tcctgcccagtgttgtttgtaa

SEQ ID NO: 1280726 - DNA, 17 bp, Homo sapiens
tcctgcccatgtgtccc

SEQ ID NO: 1280727 - DNA, 20 bp, Homo sapiens
tcctgcccatgtgtcccctc

SEQ ID NO: 1280728 - DNA, 10 bp, Homo sapiens
tcctgccccc

SEQ ID NO: 1280729 - DNA, 11 bp, Homo sapiens
tcctgccccca

SEQ ID NO: 1280730 - DNA, 15 bp, Homo sapiens
tcctgcccccaagtc

SEQ ID NO: 1280731 - DNA, 14 bp, Homo sapiens
tcctgccccctgcc

SEQ ID NO: 1280732 - DNA, 17 bp, Homo sapiens
tcctgcccctctttctc

SEQ ID NO: 1280733 - DNA, 23 bp, Homo sapiens
tcctgccctaactctgcccaccc

SEQ ID NO: 1280734 - DNA, 12 bp, Homo sapiens
tcctgccctaca

SEQ ID NO: 1280735 - DNA, 16 bp, Homo sapiens
tcctgccctccggagg

SEQ ID NO: 1280736 - DNA, 20 bp, Homo sapiens
tcctgccctccggaggagca

SEQ ID NO: 1280737 - DNA, 24 bp, Homo sapiens
tcctgccctccggaggagcagcct

SEQ ID NO: 1280738 - DNA, 20 bp, Homo sapiens
tccttcctgattgtttacag

SEQ ID NO: 1280739 - DNA, 14 bp, Homo sapiens
tccttccttcagga

SEQ ID NO: 1280740 - DNA, 16 bp, Homo sapiens
tccttccttcaggact

SEQ ID NO: 1280741 - DNA, 15 bp, Homo sapiens
tccttccttcagggt

SEQ ID NO: 1280742 - DNA, 16 bp, Homo sapiens
tccttcgaaaggcctt

SEQ ID NO: 1280743 - DNA, 17 bp, Homo sapiens
tccttcgtatcccgagt

SEQ ID NO: 1280744 - DNA, 19 bp, Homo sapiens
tccttcgtgtctctcccac

SEQ ID NO: 1280745 - DNA, 15 bp, Homo sapiens
tccttctattctagc

SEQ ID NO: 1280746 - DNA, 19 bp, Homo sapiens
tccttctccaccgcacaga

SEQ ID NO: 1280747 - DNA, 13 bp, Homo sapiens
tccttctcctcct

SEQ ID NO: 1280748 - DNA, 12 bp, Homo sapiens
tccttctccttc

SEQ ID NO: 1280749 - DNA, 21 bp, Homo sapiens
tccttctctgggtctgatttt

SEQ ID NO: 1280750 - DNA, 22 bp, Homo sapiens
tccttctgaagtgtgtccatcc

SEQ ID NO: 1280751 - DNA, 17 bp, Homo sapiens
tccttctgaccacagca

SEQ ID NO: 1280752 - DNA, 14 bp, Homo sapiens
tccttctgacccca

SEQ ID NO: 1280753 - DNA, 17 bp, Homo sapiens
tccttctgagctccacc

SEQ ID NO: 1280754 - DNA, 19 bp, Homo sapiens
tccttctgagctccacctc

SEQ ID NO: 1280755 - DNA, 17 bp, Homo sapiens
tccttctgctcccaccc

SEQ ID NO: 1280756 - DNA, 13 bp, Homo sapiens
tccttctgtagtg

SEQ ID NO: 1280757 - DNA, 16 bp, Homo sapiens
tccttctgttaagaaa

SEQ ID NO: 1280758 - DNA, 13 bp, Homo sapiens
tccttcttcagca

SEQ ID NO: 1280759 - DNA, 14 bp, Homo sapiens
tccttcttccactt

SEQ ID NO: 1280760 - DNA, 19 bp, Homo sapiens
tccttcttccacttctcca

SEQ ID NO: 1280761 - DNA, 15 bp, Homo sapiens
tccttctttgggata

SEQ ID NO: 1280762 - DNA, 23 bp, Homo sapiens
tccttctttttcatatttctacc

SEQ ID NO: 1280763 - DNA, 15 bp, Homo sapiens
tccttgaaaaacaaa

SEQ ID NO: 1280764 - DNA, 20 bp, Homo sapiens
tccttgaaatgagtaaaaac

SEQ ID NO: 1280765 - DNA, 19 bp, Homo sapiens
tccttgaagaactgcaggc

SEQ ID NO: 1280766 - DNA, 22 bp, Homo sapiens
tccttgacctgcattgtaaata

SEQ ID NO: 1280767 - DNA, 23 bp, Homo sapiens
tccttgagacacggagcccagcc

SEQ ID NO: 1280768 - DNA, 16 bp, Homo sapiens
tccttgagtgctcttg

SEQ ID NO: 1280769 - DNA, 16 bp, Homo sapiens
tccttgatgccagagg

SEQ ID NO: 1280770 - DNA, 19 bp, Homo sapiens
tccttgatgccagagggcc

SEQ ID NO: 1280771 - DNA, 21 bp, Homo sapiens
tccttgatgccagagggccag

SEQ ID NO: 1280772 - DNA, 18 bp, Homo sapiens
tccttgcaaccaggcagc

SEQ ID NO: 1280773 - DNA, 19 bp, Homo sapiens
tccttgcaaccaggcagct

SEQ ID NO: 1280774 - DNA, 14 bp, Homo sapiens
tccttgcacccctc

SEQ ID NO: 1280775 - DNA, 23 bp, Homo sapiens
tccttgcacctcagcctcccaag

SEQ ID NO: 1280776 - DNA, 14 bp, Homo sapiens
tccttgcacctgca

SEQ ID NO: 1280777 - DNA, 16 bp, Homo sapiens
tccttgcctcctggaa

SEQ ID NO: 1280778 - DNA, 17 bp, Homo sapiens
tccttgcctcctggaag

SEQ ID NO: 1280779 - DNA, 21 bp, Homo sapiens
tccttgcctgaactccagagg

SEQ ID NO: 1280780 - DNA, 22 bp, Homo sapiens
tccttgcctgtgacttggactt

SEQ ID NO: 1280781 - DNA, 13 bp, Homo sapiens
tccttgccttgct

SEQ ID NO: 1280782 - DNA, 14 bp, Homo sapiens
tccttgccttgctt

SEQ ID NO: 1280783 - DNA, 18 bp, Homo sapiens
tccttgccttgcttctcc

SEQ ID NO: 1280784 - DNA, 17 bp, Homo sapiens
tccttgcgcctcagccc

SEQ ID NO: 1280785 - DNA, 18 bp, Homo sapiens
tccttgcgcctcagccct

SEQ ID NO: 1280786 - DNA, 15 bp, Homo sapiens
tccttgctatttcaa

SEQ ID NO: 1280787 - DNA, 13 bp, Homo sapiens
tccttgctctccc

SEQ ID NO: 1280788 - DNA, 21 bp, Homo sapiens
tccttgctctccctcttctca

SEQ ID NO: 1280789 - DNA, 14 bp, Homo sapiens
tccttgctgacccc

SEQ ID NO: 1280790 - DNA, 13 bp, Homo sapiens
tccttgctgcagc

SEQ ID NO: 1280791 - DNA, 17 bp, Homo sapiens
tccttgctgcagcttct

SEQ ID NO: 1280792 - DNA, 19 bp, Homo sapiens
tccttgctgtcctaggcca

SEQ ID NO: 1280793 - DNA, 21 bp, Homo sapiens
tccttgctgtcctaggccaca

SEQ ID NO: 1280794 - DNA, 22 bp, Homo sapiens
tccttgcttatgacatcacttg

SEQ ID NO: 1280795 - DNA, 16 bp, Homo sapiens
tccttggaagtttcat

SEQ ID NO: 1280796 - DNA, 20 bp, Homo sapiens
tccttggagagcagctggct

SEQ ID NO: 1280797 - DNA, 17 bp, Homo sapiens
tccttggcacccccatg

SEQ ID NO: 1280798 - DNA, 20 bp, Homo sapiens
tccttggcacccccatgctg

SEQ ID NO: 1280799 - DNA, 20 bp, Homo sapiens
tccttggccccctttcccgg

SEQ ID NO: 1280800 - DNA, 21 bp, Homo sapiens
tccttggccccctttcccggg

SEQ ID NO: 1280801 - DNA, 15 bp, Homo sapiens
tccttggctgaatta

SEQ ID NO: 1280802 - DNA, 17 bp, Homo sapiens
tccttggctgaattaaa

SEQ ID NO: 1280803 - DNA, 19 bp, Homo sapiens
tccttggctgaattaaaat

SEQ ID NO: 1280804 - DNA, 13 bp, Homo sapiens
tccttgggcactt

SEQ ID NO: 1280805 - DNA, 17 bp, Homo sapiens
tccttgggcacttttta

SEQ ID NO: 1280806 - DNA, 13 bp, Homo sapiens
tccttgggccctt

SEQ ID NO: 1280807 - DNA, 14 bp, Homo sapiens
tccttgggcccttt

SEQ ID NO: 1280808 - DNA, 12 bp, Homo sapiens
tccttgggctcc

SEQ ID NO: 1280809 - DNA, 17 bp, Homo sapiens
tccttgggctcctggct

SEQ ID NO: 1280810 - DNA, 19 bp, Homo sapiens
tccttgggctcctggctgc

SEQ ID NO: 1280811 - DNA, 21 bp, Homo sapiens
tccttgggctcctggctgcca

SEQ ID NO: 1280812 - DNA, 22 bp, Homo sapiens
tccttgggctcctggctgccag

SEQ ID NO: 1280813 - DNA, 15 bp, Homo sapiens
tccttgggctgggac

SEQ ID NO: 1280814 - DNA, 21 bp, Homo sapiens
tccttggttatatttttttaa

SEQ ID NO: 1280815 - DNA, 15 bp, Homo sapiens
tccttggttgggtca

SEQ ID NO: 1280816 - DNA, 12 bp, Homo sapiens
tccttgtaatac

SEQ ID NO: 1280817 - DNA, 14 bp, Homo sapiens
tccttgtcaccagc

SEQ ID NO: 1280818 - DNA, 15 bp, Homo sapiens
tccttgtcaccagca

SEQ ID NO: 1280819 - DNA, 22 bp, Homo sapiens
tccttgtgacttacaatttgca

SEQ ID NO: 1280820 - DNA, 23 bp, Homo sapiens
tccttgtgcctgctcctgtactt

SEQ ID NO: 1280821 - DNA, 20 bp, Homo sapiens
tccttgtggactggctgtgc

SEQ ID NO: 1280822 - DNA, 22 bp, Homo sapiens
tccttgtggactggctgtgccc

SEQ ID NO: 1280823 - DNA, 23 bp, Homo sapiens
tccttgtggactggctgtgcccc

SEQ ID NO: 1280824 - DNA, 16 bp, Homo sapiens
tccttgtggccttttt

SEQ ID NO: 1280825 - DNA, 21 bp, Homo sapiens
tccttgtggtctttgctgctg

SEQ ID NO: 1280826 - DNA, 22 bp, Homo sapiens
tccttgtgttgcactgaacagg

SEQ ID NO: 1280827 - DNA, 21 bp, Homo sapiens
tccttgtgttttgtcctgcct

SEQ ID NO: 1280828 - DNA, 22 bp, Homo sapiens
tccttgtgttttgtcctgcctc

SEQ ID NO: 1280829 - DNA, 18 bp, Homo sapiens
tccttgttcatggagagc

SEQ ID NO: 1280830 - DNA, 21 bp, Homo sapiens
tccttgttgtttcttgcctga

SEQ ID NO: 1280831 - DNA, 21 bp, Homo sapiens
tccttgtttatcagatacatc

SEQ ID NO: 1280832 - DNA, 13 bp, Homo sapiens
tccttgttttcag

SEQ ID NO: 1280833 - DNA, 18 bp, Homo sapiens
tcctttaaaaaagaaaag

SEQ ID NO: 1280834 - DNA, 21 bp, Homo sapiens
tcctttaattaagactgaaaa

SEQ ID NO: 1280835 - DNA, 15 bp, Homo sapiens
tcctttaattgtaaa

SEQ ID NO: 1280836 - DNA, 21 bp, Homo sapiens
tcctttaattttttactattt

SEQ ID NO: 1280837 - DNA, 19 bp, Homo sapiens
tcctttacactcaggcttt

SEQ ID NO: 1280838 - DNA, 15 bp, Homo sapiens
tcctttacctttcag

SEQ ID NO: 1280839 - DNA, 16 bp, Homo sapiens
tcctttaccttttcta

SEQ ID NO: 1280840 - DNA, 23 bp, Homo sapiens
tcctttaccttttctataagttg

SEQ ID NO: 1280841 - DNA, 14 bp, Homo sapiens
tcctttacgtgttt

SEQ ID NO: 1280842 - DNA, 16 bp, Homo sapiens
tcctttacgtgtttaa

SEQ ID NO: 1280843 - DNA, 14 bp, Homo sapiens
tcctttactcctgg

SEQ ID NO: 1280844 - DNA, 17 bp, Homo sapiens
tcctttactttcccttg

SEQ ID NO: 1280845 - DNA, 23 bp, Homo sapiens
tcctttaggagggagttatctaa

SEQ ID NO: 1280846 - DNA, 14 bp, Homo sapiens
tcctttaggcagcc

SEQ ID NO: 1280847 - DNA, 16 bp, Homo sapiens
tcctttaggcagcctg

SEQ ID NO: 1280848 - DNA, 19 bp, Homo sapiens
tcctttagggttctgcctc

SEQ ID NO: 1280849 - DNA, 20 bp, Homo sapiens
tcctttagggttctgcctct

SEQ ID NO: 1280850 - DNA, 16 bp, Homo sapiens
tcctttatatttagtg

SEQ ID NO: 1280851 - DNA, 19 bp, Homo sapiens
tcctttatccacttttctt

SEQ ID NO: 1280852 - DNA, 14 bp, Homo sapiens
tcctttatctgtaa

SEQ ID NO: 1280853 - DNA, 14 bp, Homo sapiens
tcctttatgtgaat

SEQ ID NO: 1280854 - DNA, 17 bp, Homo sapiens
tcctttatgtgaatttt

SEQ ID NO: 1280855 - DNA, 18 bp, Homo sapiens
tcctttattttattgaaa

SEQ ID NO: 1280856 - DNA, 19 bp, Homo sapiens
tcctttattttattgaaat

SEQ ID NO: 1280857 - DNA, 18 bp, Homo sapiens
tcctttcacaaccttctg

SEQ ID NO: 1280858 - DNA, 19 bp, Homo sapiens
tcctttcaggttttcaggt

SEQ ID NO: 1280859 - DNA, 18 bp, Homo sapiens
tcgtcattttatatttag

SEQ ID NO: 1280860 - DNA, 19 bp, Homo sapiens
tcgtccacaggggcaggcc

SEQ ID NO: 1280861 - DNA, 13 bp, Homo sapiens
tcgtccagccctc

SEQ ID NO: 1280862 - DNA, 14 bp, Homo sapiens
tcgtccagccctcc

SEQ ID NO: 1280863 - DNA, 17 bp, Homo sapiens
tcgtcccatccagctac

SEQ ID NO: 1280864 - DNA, 11 bp, Homo sapiens
tcgtccccctc

SEQ ID NO: 1280865 - DNA, 20 bp, Homo sapiens
tcgtccccctccctgcccaa

SEQ ID NO: 1280866 - DNA, 21 bp, Homo sapiens
tcgtccccctccctgcccaaa

SEQ ID NO: 1280867 - DNA, 15 bp, Homo sapiens
tcgtccgtctgtctc

SEQ ID NO: 1280868 - DNA, 21 bp, Homo sapiens
tcgtcctgtagcacgctgcct

SEQ ID NO: 1280869 - DNA, 22 bp, Homo sapiens
tcgtcctgtagcacgctgcctg

SEQ ID NO: 1280870 - DNA, 13 bp, Homo sapiens
tcgtcctgtccca

SEQ ID NO: 1280871 - DNA, 16 bp, Homo sapiens
tcgtcctgtcccagag

SEQ ID NO: 1280872 - DNA, 16 bp, Homo sapiens
tcgtccttttggttta

SEQ ID NO: 1280873 - DNA, 18 bp, Homo sapiens
tcgtctatatatacatat

SEQ ID NO: 1280874 - DNA, 19 bp, Homo sapiens
tcgtctccaattcgaaaac

SEQ ID NO: 1280875 - DNA, 15 bp, Homo sapiens
tcgtctcggcccctc

SEQ ID NO: 1280876 - DNA, 15 bp, Homo sapiens
tcgtcttccgtctcc

SEQ ID NO: 1280877 - DNA, 22 bp, Homo sapiens
tcgtcttccgtctcccccgtgt

SEQ ID NO: 1280878 - DNA, 16 bp, Homo sapiens
tcgtcttgtgtttgct

SEQ ID NO: 1280879 - DNA, 18 bp, Homo sapiens
tcgtctttcccatgggga

SEQ ID NO: 1280880 - DNA, 20 bp, Homo sapiens
tcgtctttcccatggggagg

SEQ ID NO: 1280881 - DNA, 12 bp, Homo sapiens
tcgtgaaatcct

SEQ ID NO: 1280882 - DNA, 20 bp, Homo sapiens
tcgtgacccttcagggccag

SEQ ID NO: 1280883 - DNA, 13 bp, Homo sapiens
tcgtgagctgggg

SEQ ID NO: 1280884 - DNA, 14 bp, Homo sapiens
tcgtgagtcattta

SEQ ID NO: 1280885 - DNA, 17 bp, Homo sapiens
tcgtgatcactgagcca

SEQ ID NO: 1280886 - DNA, 13 bp, Homo sapiens
tcgtgatggggca

SEQ ID NO: 1280887 - DNA, 12 bp, Homo sapiens
tcgtgatgtgga

SEQ ID NO: 1280888 - DNA, 15 bp, Homo sapiens
tcgtgcactctgcta

SEQ ID NO: 1280889 - DNA, 12 bp, Homo sapiens
tcgtgcagagct

SEQ ID NO: 1280890 - DNA, 13 bp, Homo sapiens
tcgtgcagagctg

SEQ ID NO: 1280891 - DNA, 15 bp, Homo sapiens
tcgtgcagagctggg

SEQ ID NO: 1280892 - DNA, 22 bp, Homo sapiens
tcgtgcattggaagaccccacc

SEQ ID NO: 1280893 - DNA, 11 bp, Homo sapiens
tcgtgccagca

SEQ ID NO: 1280894 - DNA, 17 bp, Homo sapiens
tcgtgccagcagcctcg

SEQ ID NO: 1280895 - DNA, 18 bp, Homo sapiens
tcgtgcctgggggagaga

SEQ ID NO: 1280896 - DNA, 12 bp, Homo sapiens
tcgtgcctgtgt

SEQ ID NO: 1280897 - DNA, 14 bp, Homo sapiens
tcgtgctggaggaa

SEQ ID NO: 1280898 - DNA, 23 bp, Homo sapiens
tcgtggaaagggtgctgcttccc

SEQ ID NO: 1280899 - DNA, 24 bp, Homo sapiens
tcgtggaaagggtgctgcttccct

SEQ ID NO: 1280900 - DNA, 22 bp, Homo sapiens
tcgtggactgagtgggaagccc

SEQ ID NO: 1280901 - DNA, 19 bp, Homo sapiens
tcgtggagctcgcccctcc

SEQ ID NO: 1280902 - DNA, 22 bp, Homo sapiens
tcgtggagctcgcccctcccct

SEQ ID NO: 1280903 - DNA, 19 bp, Homo sapiens
tcgtggcacgtattgctgt

SEQ ID NO: 1280904 - DNA, 22 bp, Homo sapiens
tcgtggcacgtattgctgtgtc

SEQ ID NO: 1280905 - DNA, 20 bp, Homo sapiens
tcgtggcagataatcagcct

SEQ ID NO: 1280906 - DNA, 23 bp, Homo sapiens
tcgtggcagataatcagcctctt

SEQ ID NO: 1280907 - DNA, 15 bp, Homo sapiens
tcgtggggtgtgctg

SEQ ID NO: 1280908 - DNA, 15 bp, Homo sapiens
tcgtggtaggactgt

SEQ ID NO: 1280909 - DNA, 14 bp, Homo sapiens
tcgtggtgggggag

SEQ ID NO: 1280910 - DNA, 22 bp, Homo sapiens
tcgtgtagtggaagagcagcct

SEQ ID NO: 1280911 - DNA, 15 bp, Homo sapiens
tcgtgtatcctgggg

SEQ ID NO: 1280912 - DNA, 18 bp, Homo sapiens
tcgtgtatcctggggctc

SEQ ID NO: 1280913 - DNA, 16 bp, Homo sapiens
tcgtgtcagtaattta

SEQ ID NO: 1280914 - DNA, 16 bp, Homo sapiens
tcgtgtggctcctggt

SEQ ID NO: 1280915 - DNA, 16 bp, Homo sapiens
tcgtgtttgcaaaggt

SEQ ID NO: 1280916 - DNA, 18 bp, Homo sapiens
tcgtgtttgcttaaaata

SEQ ID NO: 1280917 - DNA, 14 bp, Homo sapiens
tcgtgttttcaagg

SEQ ID NO: 1280918 - DNA, 22 bp, Homo sapiens
tcgttaactgtgtatgtacata

SEQ ID NO: 1280919 - DNA, 19 bp, Homo sapiens
tcgttaatagattatttca

SEQ ID NO: 1280920 - DNA, 12 bp, Homo sapiens
tcgttactggca

SEQ ID NO: 1280921 - DNA, 15 bp, Homo sapiens
tcgttcaaagcatga

SEQ ID NO: 1280922 - DNA, 18 bp, Homo sapiens
tcgttctgctgaccaaat

SEQ ID NO: 1280923 - DNA, 20 bp, Homo sapiens
tcgttctgctgaccaaatgg

SEQ ID NO: 1280924 - DNA, 18 bp, Homo sapiens
tcgttggagagcagcagg

SEQ ID NO: 1280925 - DNA, 15 bp, Homo sapiens
tcgtttactttttaa

SEQ ID NO: 1280926 - DNA, 14 bp, Homo sapiens
tcgtttccatcatg

SEQ ID NO: 1280927 - DNA, 12 bp, Homo sapiens
tcgtttctgtat

SEQ ID NO: 1280928 - DNA, 20 bp, Homo sapiens
tcgtttgtttgtttgtttaa

SEQ ID NO: 1280929 - DNA, 21 bp, Homo sapiens
tctaaaaaaggagaattgaat

SEQ ID NO: 1280930 - DNA, 13 bp, Homo sapiens
tctaaaaacttct

SEQ ID NO: 1280931 - DNA, 18 bp, Homo sapiens
tctaaaacaaaatctgaa

SEQ ID NO: 1280932 - DNA, 14 bp, Homo sapiens
tctaaaacaattcc

SEQ ID NO: 1280933 - DNA, 17 bp, Homo sapiens
tctaaaaccttagtcat

SEQ ID NO: 1280934 - DNA, 17 bp, Homo sapiens
tctaaaagcagaaaata

SEQ ID NO: 1280935 - DNA, 12 bp, Homo sapiens
tctaaaagccat

SEQ ID NO: 1280936 - DNA, 19 bp, Homo sapiens
tctaaacaagattttaaag

SEQ ID NO: 1280937 - DNA, 17 bp, Homo sapiens
tctaaacattaatcaat

SEQ ID NO: 1280938 - DNA, 23 bp, Homo sapiens
tctaaaccaagattatgtgactt

SEQ ID NO: 1280939 - DNA, 17 bp, Homo sapiens
tctaaacttccccatct

SEQ ID NO: 1280940 - DNA, 20 bp, Homo sapiens
tctaaagaaacttggctgga

SEQ ID NO: 1280941 - DNA, 13 bp, Homo sapiens
tctaaagagcatc

SEQ ID NO: 1280942 - DNA, 20 bp, Homo sapiens
tctaaagagtttattttaag

SEQ ID NO: 1280943 - DNA, 21 bp, Homo sapiens
tctaaagctggtttaatgttt

SEQ ID NO: 1280944 - DNA, 15 bp, Homo sapiens
tctaaagctttatct

SEQ ID NO: 1280945 - DNA, 19 bp, Homo sapiens
tctaaagctttatctttgt

SEQ ID NO: 1280946 - DNA, 23 bp, Homo sapiens
tctaaagctttatctttgtgtaa

SEQ ID NO: 1280947 - DNA, 15 bp, Homo sapiens
tctaaaggatggaaa

SEQ ID NO: 1280948 - DNA, 18 bp, Homo sapiens
tctaaaggctacctttgt

SEQ ID NO: 1280949 - DNA, 23 bp, Homo sapiens
tctaaaggggttttttgggaaga

SEQ ID NO: 1280950 - DNA, 19 bp, Homo sapiens
tctaaagtaaaattgaagc

SEQ ID NO: 1280951 - DNA, 22 bp, Homo sapiens
tctaaagtaaaattgaagcaac

SEQ ID NO: 1280952 - DNA, 12 bp, Homo sapiens
tctaaagtgttt

SEQ ID NO: 1280953 - DNA, 19 bp, Homo sapiens
tctaaagtgtttagctgtc

SEQ ID NO: 1280954 - DNA, 19 bp, Homo sapiens
tctaaagttactactgatt

SEQ ID NO: 1280955 - DNA, 17 bp, Homo sapiens
tctaaagttatatttca

SEQ ID NO: 1280956 - DNA, 18 bp, Homo sapiens
tctaaataaaaatatgta

SEQ ID NO: 1280957 - DNA, 18 bp, Homo sapiens
tctaaataggatcctgga

SEQ ID NO: 1280958 - DNA, 17 bp, Homo sapiens
tctaaatattcagaatc

SEQ ID NO: 1280959 - DNA, 17 bp, Homo sapiens
tctaaatcatatataat

SEQ ID NO: 1280960 - DNA, 21 bp, Homo sapiens
tctaaatccgacttgaatatt

SEQ ID NO: 1280961 - DNA, 14 bp, Homo sapiens
tctaaatctattta

SEQ ID NO: 1280962 - DNA, 17 bp, Homo sapiens
tctaaatctatttatta

SEQ ID NO: 1280963 - DNA, 21 bp, Homo sapiens
tctaaatctatttattaatat

SEQ ID NO: 1280964 - DNA, 14 bp, Homo sapiens
tctaaatgcccagt

SEQ ID NO: 1280965 - DNA, 15 bp, Homo sapiens
tctaaatgcccagtt

SEQ ID NO: 1280966 - DNA, 18 bp, Homo sapiens
tctaaattaagacagcat

SEQ ID NO: 1280967 - DNA, 15 bp, Homo sapiens
tctaaattaagtccc

SEQ ID NO: 1280968 - DNA, 19 bp, Homo sapiens
tctaacactggcatgttca

SEQ ID NO: 1280969 - DNA, 13 bp, Homo sapiens
tctaacagccctc

SEQ ID NO: 1280970 - DNA, 23 bp, Homo sapiens
tctaacagccctcctctgcactc

SEQ ID NO: 1280971 - DNA, 13 bp, Homo sapiens
tctaacatatgta

SEQ ID NO: 1280972 - DNA, 16 bp, Homo sapiens
tctaacatatgtatta

SEQ ID NO: 1280973 - DNA, 17 bp, Homo sapiens
tctaaccaagaggctgg

SEQ ID NO: 1280974 - DNA, 15 bp, Homo sapiens
tctaacccaagacat

SEQ ID NO: 1280975 - DNA, 14 bp, Homo sapiens
tctaaccctcccat

SEQ ID NO: 1280976 - DNA, 15 bp, Homo sapiens
tctaaccctcccatg

SEQ ID NO: 1280977 - DNA, 20 bp, Homo sapiens
tctaaccctcccatggcacc

SEQ ID NO: 1280978 - DNA, 14 bp, Homo sapiens
tctaaccctgtgga

SEQ ID NO: 1280979 - DNA, 15 bp, Homo sapiens
tctaaccctgtggaa

SEQ ID NO: 1280980 - DNA, 13 bp, Homo sapiens
tctaacctcatct

SEQ ID NO: 1280981 - DNA, 17 bp, Homo sapiens
tctagctgttctttttt

SEQ ID NO: 1280982 - DNA, 12 bp, Homo sapiens
tctagcttttct

SEQ ID NO: 1280983 - DNA, 13 bp, Homo sapiens
tctagcttttcta

SEQ ID NO: 1280984 - DNA, 22 bp, Homo sapiens
tctagcttttctatttttgatt

SEQ ID NO: 1280985 - DNA, 22 bp, Homo sapiens
tctaggaaatatacttttacaa

SEQ ID NO: 1280986 - DNA, 23 bp, Homo sapiens
tctaggacacagttcctgggaac

SEQ ID NO: 1280987 - DNA, 14 bp, Homo sapiens
tctaggactgcagt

SEQ ID NO: 1280988 - DNA, 13 bp, Homo sapiens
tctaggagaggag

SEQ ID NO: 1280989 - DNA, 20 bp, Homo sapiens
tctaggagctgggaggaaaa

SEQ ID NO: 1280990 - DNA, 19 bp, Homo sapiens
tctaggagggagacactgg

SEQ ID NO: 1280991 - DNA, 20 bp, Homo sapiens
tctaggagggagccttgtga

SEQ ID NO: 1280992 - DNA, 18 bp, Homo sapiens
tctaggagtcaactggct

SEQ ID NO: 1280993 - DNA, 20 bp, Homo sapiens
tctaggagtcaactggctgg

SEQ ID NO: 1280994 - DNA, 14 bp, Homo sapiens
tctaggatagctaa

SEQ ID NO: 1280995 - DNA, 16 bp, Homo sapiens
tctaggatgtgatgat

SEQ ID NO: 1280996 - DNA, 21 bp, Homo sapiens
tctaggcatttcattatgctt

SEQ ID NO: 1280997 - DNA, 15 bp, Homo sapiens
tctaggccccccaga

SEQ ID NO: 1280998 - DNA, 14 bp, Homo sapiens
tctaggcctctcca

SEQ ID NO: 1280999 - DNA, 21 bp, Homo sapiens
tctagggatataaaaacagat

SEQ ID NO: 1281000 - DNA, 15 bp, Homo sapiens
tctagggcagggtgg

SEQ ID NO: 1281001 - DNA, 16 bp, Homo sapiens
tctagggcctctccag

SEQ ID NO: 1281002 - DNA, 16 bp, Homo sapiens
tctaggggcagcctcc

SEQ ID NO: 1281003 - DNA, 18 bp, Homo sapiens
tctagggttattgcattt

SEQ ID NO: 1281004 - DNA, 14 bp, Homo sapiens
tctaggtaggaaga

SEQ ID NO: 1281005 - DNA, 17 bp, Homo sapiens
tctaggtcagtctaaca

SEQ ID NO: 1281006 - DNA, 22 bp, Homo sapiens
tctaggtcagtctaacagtttg

SEQ ID NO: 1281007 - DNA, 16 bp, Homo sapiens
tctaggtctcctcagg

SEQ ID NO: 1281008 - DNA, 15 bp, Homo sapiens
tctaggtggcaggac

SEQ ID NO: 1281009 - DNA, 17 bp, Homo sapiens
tctaggtggcaggacaa

SEQ ID NO: 1281010 - DNA, 17 bp, Homo sapiens
tctaggtgtggctgtga

SEQ ID NO: 1281011 - DNA, 15 bp, Homo sapiens
tctaggttaaagcta

SEQ ID NO: 1281012 - DNA, 18 bp, Homo sapiens
tctaggttatacaataac

SEQ ID NO: 1281013 - DNA, 23 bp, Homo sapiens
tctaggttctaaaaattgtgatc

SEQ ID NO: 1281014 - DNA, 16 bp, Homo sapiens
tctaggtttcagcaac

SEQ ID NO: 1281015 - DNA, 19 bp, Homo sapiens
tctagtaagatgcactgaa

SEQ ID NO: 1281016 - DNA, 16 bp, Homo sapiens
tctagtagctgaaatg

SEQ ID NO: 1281017 - DNA, 18 bp, Homo sapiens
tctagtagctgaaatgca

SEQ ID NO: 1281018 - DNA, 19 bp, Homo sapiens
tctagtagctgaaatgcaa

SEQ ID NO: 1281019 - DNA, 22 bp, Homo sapiens
tctagtatttatgggtggattt

SEQ ID NO: 1281020 - DNA, 22 bp, Homo sapiens
tctagtattttatctggaacaa

SEQ ID NO: 1281021 - DNA, 18 bp, Homo sapiens
tctagtctctctggggcc

SEQ ID NO: 1281022 - DNA, 22 bp, Homo sapiens
tctagtgcagctgattttaaca

SEQ ID NO: 1281023 - DNA, 14 bp, Homo sapiens
tctagtgccctcca

SEQ ID NO: 1281024 - DNA, 14 bp, Homo sapiens
tctagtgccttcta

SEQ ID NO: 1281025 - DNA, 13 bp, Homo sapiens
tctagtgctgtga

SEQ ID NO: 1281026 - DNA, 18 bp, Homo sapiens
tctagtgcttttcagtga

SEQ ID NO: 1281027 - DNA, 11 bp, Homo sapiens
tctagtggctg

SEQ ID NO: 1281028 - DNA, 14 bp, Homo sapiens
tctagtggctgttc

SEQ ID NO: 1281029 - DNA, 17 bp, Homo sapiens
tctagtggctgttcatg

SEQ ID NO: 1281030 - DNA, 22 bp, Homo sapiens
tctagtgtagctgccacattga

SEQ ID NO: 1281031 - DNA, 17 bp, Homo sapiens
tctagtgtccataaata

SEQ ID NO: 1281032 - DNA, 18 bp, Homo sapiens
tctagtgtccataaataa

SEQ ID NO: 1281033 - DNA, 14 bp, Homo sapiens
tctagttcaatgcc

SEQ ID NO: 1281034 - DNA, 12 bp, Homo sapiens
tctagttctaga

SEQ ID NO: 1281035 - DNA, 14 bp, Homo sapiens
tctagttctagatg

SEQ ID NO: 1281036 - DNA, 20 bp, Homo sapiens
tctagttctcaatcactgct

SEQ ID NO: 1281037 - DNA, 16 bp, Homo sapiens
tctagttctttcctcc

SEQ ID NO: 1281038 - DNA, 19 bp, Homo sapiens
tctagttgaaaataaagtg

SEQ ID NO: 1281039 - DNA, 15 bp, Homo sapiens
tctagtttacagaaa

SEQ ID NO: 1281040 - DNA, 14 bp, Homo sapiens
tctagtttattcta

SEQ ID NO: 1281041 - DNA, 15 bp, Homo sapiens
tctagtttattctaa

SEQ ID NO: 1281042 - DNA, 14 bp, Homo sapiens
tctagtttcccaca

SEQ ID NO: 1281043 - DNA, 11 bp, Homo sapiens
tctagttttca

SEQ ID NO: 1281044 - DNA, 12 bp, Homo sapiens
tctagttttcag

SEQ ID NO: 1281045 - DNA, 18 bp, Homo sapiens
tctagttttcagtttgta

SEQ ID NO: 1281046 - DNA, 18 bp, Homo sapiens
tctagttttttttgtaaa

SEQ ID NO: 1281047 - DNA, 17 bp, Homo sapiens
tctataaaataaacttc

SEQ ID NO: 1281048 - DNA, 19 bp, Homo sapiens
tctataaaataaacttctt

SEQ ID NO: 1281049 - DNA, 14 bp, Homo sapiens
tctataaactataa

SEQ ID NO: 1281050 - DNA, 19 bp, Homo sapiens
tctataaagcatttaaccc

SEQ ID NO: 1281051 - DNA, 19 bp, Homo sapiens
tctataaatatatattttt

SEQ ID NO: 1281052 - DNA, 13 bp, Homo sapiens
tctataaatcagt

SEQ ID NO: 1281053 - DNA, 17 bp, Homo sapiens
tctataaatttaagaaa

SEQ ID NO: 1281054 - DNA, 21 bp, Homo sapiens
tctataaatttaagaaaacaa

SEQ ID NO: 1281055 - DNA, 21 bp, Homo sapiens
tctataagcaaattgcttttt

SEQ ID NO: 1281056 - DNA, 13 bp, Homo sapiens
tctataaggccat

SEQ ID NO: 1281057 - DNA, 16 bp, Homo sapiens
tctataaggccataaa

SEQ ID NO: 1281058 - DNA, 19 bp, Homo sapiens
tctataagtagtaaatcag

SEQ ID NO: 1281059 - DNA, 22 bp, Homo sapiens
tctataagtgaggaagagttta

SEQ ID NO: 1281060 - DNA, 18 bp, Homo sapiens
tctataagttgtaccaaa

SEQ ID NO: 1281061 - DNA, 20 bp, Homo sapiens
tctataagttgtaccaaaac

SEQ ID NO: 1281062 - DNA, 21 bp, Homo sapiens
tctataagttgtaccaaaaca

SEQ ID NO: 1281063 - DNA, 22 bp, Homo sapiens
tctataagttgtaccaaaacat

SEQ ID NO: 1281064 - DNA, 23 bp, Homo sapiens
tctataagttgtaccaaaacatc

SEQ ID NO: 1281065 - DNA, 21 bp, Homo sapiens
tctataatcccagcactttgg

SEQ ID NO: 1281066 - DNA, 23 bp, Homo sapiens
tctataatgaacatgaaggcttt

SEQ ID NO: 1281067 - DNA, 15 bp, Homo sapiens
tctataatggaaaca

SEQ ID NO: 1281068 - DNA, 19 bp, Homo sapiens
tctataatttccatttact

SEQ ID NO: 1281069 - DNA, 15 bp, Homo sapiens
tctataattttgcct

SEQ ID NO: 1281070 - DNA, 15 bp, Homo sapiens
tctatacatatcttt

SEQ ID NO: 1281071 - DNA, 18 bp, Homo sapiens
tctatacatatctttatt

SEQ ID NO: 1281072 - DNA, 14 bp, Homo sapiens
tctatacctgcctt

SEQ ID NO: 1281073 - DNA, 21 bp, Homo sapiens
tctatagaaatattgtgctta

SEQ ID NO: 1281074 - DNA, 16 bp, Homo sapiens
tctatagactctagga

SEQ ID NO: 1281075 - DNA, 19 bp, Homo sapiens
tctatagccataaacctga

SEQ ID NO: 1281076 - DNA, 20 bp, Homo sapiens
tctataggaacatatgaaaa

SEQ ID NO: 1281077 - DNA, 16 bp, Homo sapiens
tctataggcagcttct

SEQ ID NO: 1281078 - DNA, 18 bp, Homo sapiens
tctataggtgtcttcaga

SEQ ID NO: 1281079 - DNA, 12 bp, Homo sapiens
tctatataaaat

SEQ ID NO: 1281080 - DNA, 23 bp, Homo sapiens
tctatataaaataactaaaatgt

SEQ ID NO: 1281081 - DNA, 17 bp, Homo sapiens
tctatataaaatgtatt

SEQ ID NO: 1281082 - DNA, 20 bp, Homo sapiens
tctatataaaatgtattcaa

SEQ ID NO: 1281083 - DNA, 20 bp, Homo sapiens
tctatatagttccttgcctt

SEQ ID NO: 1281084 - DNA, 21 bp, Homo sapiens
tctatatagttccttgcctta

SEQ ID NO: 1281085 - DNA, 12 bp, Homo sapiens
tctatatctgaa

SEQ ID NO: 1281086 - DNA, 19 bp, Homo sapiens
tctatatggttctccaaga

SEQ ID NO: 1281087 - DNA, 13 bp, Homo sapiens
tctatatgtactt

SEQ ID NO: 1281088 - DNA, 20 bp, Homo sapiens
tctatatgtacttgtcaaag

SEQ ID NO: 1281089 - DNA, 21 bp, Homo sapiens
tctatatgtacttgtcaaaga

SEQ ID NO: 1281090 - DNA, 21 bp, Homo sapiens
tctatatgtagtgcattttta

SEQ ID NO: 1281091 - DNA, 16 bp, Homo sapiens
tctatatttattttca

SEQ ID NO: 1281092 - DNA, 14 bp, Homo sapiens
tctatatttgtctt

SEQ ID NO: 1281093 - DNA, 18 bp, Homo sapiens
tctatattttaatagaaa

SEQ ID NO: 1281094 - DNA, 13 bp, Homo sapiens
tctatcaaatgaa

SEQ ID NO: 1281095 - DNA, 15 bp, Homo sapiens
tctatcaaatgaaac

SEQ ID NO: 1281096 - DNA, 17 bp, Homo sapiens
tctatcaaatgaaactc

SEQ ID NO: 1281097 - DNA, 21 bp, Homo sapiens
tctatcaagtattataccttt

SEQ ID NO: 1281098 - DNA, 20 bp, Homo sapiens
tctatcaggaaaacaaatca

SEQ ID NO: 1281099 - DNA, 13 bp, Homo sapiens
tctatcagttatc

SEQ ID NO: 1281100 - DNA, 14 bp, Homo sapiens
tctatcagttatcc

SEQ ID NO: 1281101 - DNA, 21 bp, Homo sapiens
tctatcattccaattctaaat

SEQ ID NO: 1281102 - DNA, 17 bp, Homo sapiens
tctatccatctcctggt

SEQ ID NO: 1281103 - DNA, 19 bp, Homo sapiens
tctccatatctccatggcc

SEQ ID NO: 1281104 - DNA, 15 bp, Homo sapiens
tctccatatgttaca

SEQ ID NO: 1281105 - DNA, 13 bp, Homo sapiens
tctccatcagctg

SEQ ID NO: 1281106 - DNA, 17 bp, Homo sapiens
tctccatcagctgtaag

SEQ ID NO: 1281107 - DNA, 12 bp, Homo sapiens
tctccatcccct

SEQ ID NO: 1281108 - DNA, 23 bp, Homo sapiens
tctccatcccctccctgcctgct

SEQ ID NO: 1281109 - DNA, 17 bp, Homo sapiens
tctccatctggcagggt

SEQ ID NO: 1281110 - DNA, 21 bp, Homo sapiens
tctccatgaggtactggtccc

SEQ ID NO: 1281111 - DNA, 13 bp, Homo sapiens
tctccatgctgca

SEQ ID NO: 1281112 - DNA, 13 bp, Homo sapiens
tctccatgctgga

SEQ ID NO: 1281113 - DNA, 18 bp, Homo sapiens
tctccatggccctgcaaa

SEQ ID NO: 1281114 - DNA, 18 bp, Homo sapiens
tctccatggccctgtccc

SEQ ID NO: 1281115 - DNA, 19 bp, Homo sapiens
tctccatggccctgtccca

SEQ ID NO: 1281116 - DNA, 14 bp, Homo sapiens
tctccatgggccac

SEQ ID NO: 1281117 - DNA, 23 bp, Homo sapiens
tctccatgggccaccgcccagct

SEQ ID NO: 1281118 - DNA, 22 bp, Homo sapiens
tctccatgtagaataaatgaag

SEQ ID NO: 1281119 - DNA, 19 bp, Homo sapiens
tctccattgtgcctaagtc

SEQ ID NO: 1281120 - DNA, 21 bp, Homo sapiens
tctccattgtgtgatccagcc

SEQ ID NO: 1281121 - DNA, 22 bp, Homo sapiens
tctccattgtgtgatccagccc

SEQ ID NO: 1281122 - DNA, 16 bp, Homo sapiens
tctccatttaagacac

SEQ ID NO: 1281123 - DNA, 17 bp, Homo sapiens
tctccatttaagacaca

SEQ ID NO: 1281124 - DNA, 22 bp, Homo sapiens
tctcccaaagtaccttgaactc

SEQ ID NO: 1281125 - DNA, 22 bp, Homo sapiens
tctcccaagctatctaaagttt

SEQ ID NO: 1281126 - DNA, 14 bp, Homo sapiens
tctcccacacccac

SEQ ID NO: 1281127 - DNA, 17 bp, Homo sapiens
tctcccacatcccactg

SEQ ID NO: 1281128 - DNA, 18 bp, Homo sapiens
tctcccacatcccactgg

SEQ ID NO: 1281129 - DNA, 17 bp, Homo sapiens
tctcccacatgaggcca

SEQ ID NO: 1281130 - DNA, 23 bp, Homo sapiens
tctcccaccccgccgttccctgc

SEQ ID NO: 1281131 - DNA, 21 bp, Homo sapiens
tctcccaccccggcctccact

SEQ ID NO: 1281132 - DNA, 16 bp, Homo sapiens
tctcccaccccttggc

SEQ ID NO: 1281133 - DNA, 19 bp, Homo sapiens
tctcccaccccttggcccc

SEQ ID NO: 1281134 - DNA, 21 bp, Homo sapiens
tctcccaccctaagggcagcc

SEQ ID NO: 1281135 - DNA, 23 bp, Homo sapiens
tctcccaccctaagggcagccct

SEQ ID NO: 1281136 - DNA, 14 bp, Homo sapiens
tctcccacctagca

SEQ ID NO: 1281137 - DNA, 15 bp, Homo sapiens
tctcccacgtgggag

SEQ ID NO: 1281138 - DNA, 12 bp, Homo sapiens
tctcccacttcc

SEQ ID NO: 1281139 - DNA, 13 bp, Homo sapiens
tctcccacttcct

SEQ ID NO: 1281140 - DNA, 14 bp, Homo sapiens
tctcccacttcctc

SEQ ID NO: 1281141 - DNA, 19 bp, Homo sapiens
tctcccacttcctcctacc

SEQ ID NO: 1281142 - DNA, 21 bp, Homo sapiens
tctcccacttcctcctacctg

SEQ ID NO: 1281143 - DNA, 17 bp, Homo sapiens
tctcccagaatcccagc

SEQ ID NO: 1281144 - DNA, 16 bp, Homo sapiens
tctcccagataatgtg

SEQ ID NO: 1281145 - DNA, 21 bp, Homo sapiens
tctcccagataatgtgaaaat

SEQ ID NO: 1281146 - DNA, 18 bp, Homo sapiens
tctcccagcccacctcaa

SEQ ID NO: 1281147 - DNA, 13 bp, Homo sapiens
tctcccaggaagc

SEQ ID NO: 1281148 - DNA, 12 bp, Homo sapiens
tctcccaggaca

SEQ ID NO: 1281149 - DNA, 15 bp, Homo sapiens
tctcccaggccccct

SEQ ID NO: 1281150 - DNA, 19 bp, Homo sapiens
tctcccaggctgctggagt

SEQ ID NO: 1281151 - DNA, 16 bp, Homo sapiens
tctcccaggctggagt

SEQ ID NO: 1281152 - DNA, 19 bp, Homo sapiens
tctcccaggctggagtgca

SEQ ID NO: 1281153 - DNA, 15 bp, Homo sapiens
tctcccaggctgtcc

SEQ ID NO: 1281154 - DNA, 17 bp, Homo sapiens
tctcccagggagtgagc

SEQ ID NO: 1281155 - DNA, 17 bp, Homo sapiens
tctcccaggtaccagct

SEQ ID NO: 1281156 - DNA, 18 bp, Homo sapiens
tctcccaggtaccagctg

SEQ ID NO: 1281157 - DNA, 19 bp, Homo sapiens
tctcccaggtaccagctgc

SEQ ID NO: 1281158 - DNA, 21 bp, Homo sapiens
tctcccaggtggattttgtgg

SEQ ID NO: 1281159 - DNA, 21 bp, Homo sapiens
tctcccagtgaactcctgcca

SEQ ID NO: 1281160 - DNA, 12 bp, Homo sapiens
tctcccatcccc

SEQ ID NO: 1281161 - DNA, 20 bp, Homo sapiens
tctcccatccccctgccctc

SEQ ID NO: 1281162 - DNA, 20 bp, Homo sapiens
tctcccatcctgatcccaga

SEQ ID NO: 1281163 - DNA, 22 bp, Homo sapiens
tctcccatcctgatcccagacc

SEQ ID NO: 1281164 - DNA, 18 bp, Homo sapiens
tctcccatctcttccttg

SEQ ID NO: 1281165 - DNA, 19 bp, Homo sapiens
tctcccattgtccctctgc

SEQ ID NO: 1281166 - DNA, 14 bp, Homo sapiens
tctcccatttcagg

SEQ ID NO: 1281167 - DNA, 18 bp, Homo sapiens
tctccccaatccatgctt

SEQ ID NO: 1281168 - DNA, 22 bp, Homo sapiens
tctccccaatccatgcttcact

SEQ ID NO: 1281169 - DNA, 10 bp, Homo sapiens
tctccccaca

SEQ ID NO: 1281170 - DNA, 11 bp, Homo sapiens
tctccccacac

SEQ ID NO: 1281171 - DNA, 22 bp, Homo sapiens
tctccccacactaacctgggtt

SEQ ID NO: 1281172 - DNA, 14 bp, Homo sapiens
tctccccaggcctc

SEQ ID NO: 1281173 - DNA, 19 bp, Homo sapiens
tctccccaggcctccagcc

SEQ ID NO: 1281174 - DNA, 15 bp, Homo sapiens
tctccccaggtccag

SEQ ID NO: 1281175 - DNA, 11 bp, Homo sapiens
tctccccagtg

SEQ ID NO: 1281176 - DNA, 12 bp, Homo sapiens
tctccccagtgc

SEQ ID NO: 1281177 - DNA, 16 bp, Homo sapiens
tctccccagtgcctgc

SEQ ID NO: 1281178 - DNA, 23 bp, Homo sapiens
tctccccagtgcctgccactctc

SEQ ID NO: 1281179 - DNA, 19 bp, Homo sapiens
tctccccatccccttccta

SEQ ID NO: 1281180 - DNA, 13 bp, Homo sapiens
tctcccccagagt

SEQ ID NO: 1281181 - DNA, 22 bp, Homo sapiens
tctcccccagagtgctgtcggg

SEQ ID NO: 1281182 - DNA, 13 bp, Homo sapiens
tctccccccatcc

SEQ ID NO: 1281183 - DNA, 16 bp, Homo sapiens
tctcccccgacactgc

SEQ ID NO: 1281184 - DNA, 18 bp, Homo sapiens
tctcccccgacactgctg

SEQ ID NO: 1281185 - DNA, 21 bp, Homo sapiens
tctcccccgacactgctgcac

SEQ ID NO: 1281186 - DNA, 15 bp, Homo sapiens
tctccccctcctcca

SEQ ID NO: 1281187 - DNA, 23 bp, Homo sapiens
tctccccctcctccagggaaggt

SEQ ID NO: 1281188 - DNA, 13 bp, Homo sapiens
tctccccctctgt

SEQ ID NO: 1281189 - DNA, 16 bp, Homo sapiens
tctccccctctgtctt

SEQ ID NO: 1281190 - DNA, 20 bp, Homo sapiens
tctccccctctgtcttctct

SEQ ID NO: 1281191 - DNA, 20 bp, Homo sapiens
tctccccctgggctctgccc

SEQ ID NO: 1281192 - DNA, 13 bp, Homo sapiens
tctcccccttcag

SEQ ID NO: 1281193 - DNA, 18 bp, Homo sapiens
tctcccccttcagctcct

SEQ ID NO: 1281194 - DNA, 22 bp, Homo sapiens
tctcccccttcagctcctgagt

SEQ ID NO: 1281195 - DNA, 19 bp, Homo sapiens
tctccccgaggctgcccca

SEQ ID NO: 1281196 - DNA, 22 bp, Homo sapiens
tctccccgaggctgccccaggc

SEQ ID NO: 1281197 - DNA, 22 bp, Homo sapiens
tctccccgctctggatcctgca

SEQ ID NO: 1281198 - DNA, 18 bp, Homo sapiens
tctccccggcaggcctga

SEQ ID NO: 1281199 - DNA, 13 bp, Homo sapiens
tctcccctcctgc

SEQ ID NO: 1281200 - DNA, 15 bp, Homo sapiens
tctcccctcctgcac

SEQ ID NO: 1281201 - DNA, 20 bp, Homo sapiens
tctcccctcctgcacacagg

SEQ ID NO: 1281202 - DNA, 16 bp, Homo sapiens
tctcccctctcccagg

SEQ ID NO: 1281203 - DNA, 19 bp, Homo sapiens
tctcccctctcccagggat

SEQ ID NO: 1281204 - DNA, 14 bp, Homo sapiens
tctcccctctcgcc

SEQ ID NO: 1281205 - DNA, 15 bp, Homo sapiens
tctcccctctctgct

SEQ ID NO: 1281206 - DNA, 13 bp, Homo sapiens
tctcccctgccct

SEQ ID NO: 1281207 - DNA, 21 bp, Homo sapiens
tctccccttcctggacacact

SEQ ID NO: 1281208 - DNA, 22 bp, Homo sapiens
tctccccttcctggacacactc

SEQ ID NO: 1281209 - DNA, 17 bp, Homo sapiens
tctccccttggttctgc

SEQ ID NO: 1281210 - DNA, 14 bp, Homo sapiens
tctcccgctgctgc

SEQ ID NO: 1281211 - DNA, 20 bp, Homo sapiens
tctcccggaggttgggtggg

SEQ ID NO: 1281212 - DNA, 14 bp, Homo sapiens
tctcccggctgcct

SEQ ID NO: 1281213 - DNA, 19 bp, Homo sapiens
tctccctaaggaatctgaa

SEQ ID NO: 1281214 - DNA, 23 bp, Homo sapiens
tctccctcaacaagggagagacc

SEQ ID NO: 1281215 - DNA, 19 bp, Homo sapiens
tctccctccccagaaacag

SEQ ID NO: 1281216 - DNA, 18 bp, Homo sapiens
tctccctcccctctcaga

SEQ ID NO: 1281217 - DNA, 22 bp, Homo sapiens
tctccctctcatgtccctccag

SEQ ID NO: 1281218 - DNA, 16 bp, Homo sapiens
tctccctctggatcaa

SEQ ID NO: 1281219 - DNA, 14 bp, Homo sapiens
tctccctctggccc

SEQ ID NO: 1281220 - DNA, 18 bp, Homo sapiens
tctccctctggccctgcc

SEQ ID NO: 1281221 - DNA, 21 bp, Homo sapiens
tctccctcttctcaagtgcct

SEQ ID NO: 1281222 - DNA, 22 bp, Homo sapiens
tctccctcttctcaagtgcctt

SEQ ID NO: 1281223 - DNA, 15 bp, Homo sapiens
tctccctgaccctgt

SEQ ID NO: 1281224 - DNA, 12 bp, Homo sapiens
tctctctcctct

SEQ ID NO: 1281225 - DNA, 13 bp, Homo sapiens
tctctctcctctc

SEQ ID NO: 1281226 - DNA, 13 bp, Homo sapiens
tctctctcctggt

SEQ ID NO: 1281227 - DNA, 22 bp, Homo sapiens
tctctctcctggtgtgggtaaa

SEQ ID NO: 1281228 - DNA, 11 bp, Homo sapiens
tctctctctct

SEQ ID NO: 1281229 - DNA, 15 bp, Homo sapiens
tctctctgcagctgc

SEQ ID NO: 1281230 - DNA, 15 bp, Homo sapiens
tctctctgccctctc

SEQ ID NO: 1281231 - DNA, 11 bp, Homo sapiens
tctctctgctc

SEQ ID NO: 1281232 - DNA, 19 bp, Homo sapiens
tctctctgctgagctgggc

SEQ ID NO: 1281233 - DNA, 17 bp, Homo sapiens
tctctctggagcccctc

SEQ ID NO: 1281234 - DNA, 15 bp, Homo sapiens
tctctctggggccct

SEQ ID NO: 1281235 - DNA, 18 bp, Homo sapiens
tctctctggggccctggg

SEQ ID NO: 1281236 - DNA, 21 bp, Homo sapiens
tctctctggggccctgggcct

SEQ ID NO: 1281237 - DNA, 23 bp, Homo sapiens
tctctctgtgaatacaattaaag

SEQ ID NO: 1281238 - DNA, 16 bp, Homo sapiens
tctctcttaaagttgg

SEQ ID NO: 1281239 - DNA, 12 bp, Homo sapiens
tctctcttctct

SEQ ID NO: 1281240 - DNA, 19 bp, Homo sapiens
tctctcttctgctccaccc

SEQ ID NO: 1281241 - DNA, 13 bp, Homo sapiens
tctctgaagcatg

SEQ ID NO: 1281242 - DNA, 19 bp, Homo sapiens
tctctgaagcatgtttcat

SEQ ID NO: 1281243 - DNA, 22 bp, Homo sapiens
tctctgaagcatgtttcatgtt

SEQ ID NO: 1281244 - DNA, 19 bp, Homo sapiens
tctctgaagcgactctcct

SEQ ID NO: 1281245 - DNA, 21 bp, Homo sapiens
tctctgaagcgactctcctgt

SEQ ID NO: 1281246 - DNA, 18 bp, Homo sapiens
tctctgaagggacccccc

SEQ ID NO: 1281247 - DNA, 16 bp, Homo sapiens
tctctgaatacacagt

SEQ ID NO: 1281248 - DNA, 19 bp, Homo sapiens
tctctgacccggttgcagt

SEQ ID NO: 1281249 - DNA, 18 bp, Homo sapiens
tctctgacgcttgtgaca

SEQ ID NO: 1281250 - DNA, 20 bp, Homo sapiens
tctctgacgcttgtgacagt

SEQ ID NO: 1281251 - DNA, 13 bp, Homo sapiens
tctctgagaagag

SEQ ID NO: 1281252 - DNA, 18 bp, Homo sapiens
tctctgagctggggaggt

SEQ ID NO: 1281253 - DNA, 12 bp, Homo sapiens
tctctgaggcta

SEQ ID NO: 1281254 - DNA, 21 bp, Homo sapiens
tctctgagtggaggaagccca

SEQ ID NO: 1281255 - DNA, 23 bp, Homo sapiens
tctctgatcttgtgctcagcatg

SEQ ID NO: 1281256 - DNA, 15 bp, Homo sapiens
tctctgatgcagaaa

SEQ ID NO: 1281257 - DNA, 14 bp, Homo sapiens
tctctgcaatttgt

SEQ ID NO: 1281258 - DNA, 21 bp, Homo sapiens
tctctgcaatttgtttaaaga

SEQ ID NO: 1281259 - DNA, 12 bp, Homo sapiens
tctctgcacaga

SEQ ID NO: 1281260 - DNA, 18 bp, Homo sapiens
tctctgcaccgtactgtg

SEQ ID NO: 1281261 - DNA, 16 bp, Homo sapiens
tctctgcagccagccc

SEQ ID NO: 1281262 - DNA, 14 bp, Homo sapiens
tctctgcagctgcc

SEQ ID NO: 1281263 - DNA, 15 bp, Homo sapiens
tctctgcagctgccg

SEQ ID NO: 1281264 - DNA, 16 bp, Homo sapiens
tctctgcagctgccgg

SEQ ID NO: 1281265 - DNA, 14 bp, Homo sapiens
tctctgcagtaaaa

SEQ ID NO: 1281266 - DNA, 20 bp, Homo sapiens
tctctgcagtaaaacacatt

SEQ ID NO: 1281267 - DNA, 19 bp, Homo sapiens
tctctgcagtttttcccaa

SEQ ID NO: 1281268 - DNA, 20 bp, Homo sapiens
tctctgcatccatttgaaca

SEQ ID NO: 1281269 - DNA, 23 bp, Homo sapiens
tctctgcatccatttgaacacat

SEQ ID NO: 1281270 - DNA, 19 bp, Homo sapiens
tctctgccatccaaaaggg

SEQ ID NO: 1281271 - DNA, 16 bp, Homo sapiens
tctctgccctctccct

SEQ ID NO: 1281272 - DNA, 14 bp, Homo sapiens
tctctgccctgtgt

SEQ ID NO: 1281273 - DNA, 16 bp, Homo sapiens
tctctgccgctacctc

SEQ ID NO: 1281274 - DNA, 22 bp, Homo sapiens
tctctgccgctacctccctccc

SEQ ID NO: 1281275 - DNA, 21 bp, Homo sapiens
tctctgccgtctctcctgctc

SEQ ID NO: 1281276 - DNA, 21 bp, Homo sapiens
tctctgcctccctcaccctga

SEQ ID NO: 1281277 - DNA, 12 bp, Homo sapiens
tctctgcctctc

SEQ ID NO: 1281278 - DNA, 15 bp, Homo sapiens
tctctgcctctgggc

SEQ ID NO: 1281279 - DNA, 21 bp, Homo sapiens
tctctgcctctgggcagcctg

SEQ ID NO: 1281280 - DNA, 12 bp, Homo sapiens
tctctgctccac

SEQ ID NO: 1281281 - DNA, 15 bp, Homo sapiens
tctctgctccaccac

SEQ ID NO: 1281282 - DNA, 15 bp, Homo sapiens
tctctgctcctacat

SEQ ID NO: 1281283 - DNA, 14 bp, Homo sapiens
tctctgctccttca

SEQ ID NO: 1281284 - DNA, 20 bp, Homo sapiens
tctctgctctagccaggagt

SEQ ID NO: 1281285 - DNA, 22 bp, Homo sapiens
tctctgctctgcgtgtcacctg

SEQ ID NO: 1281286 - DNA, 16 bp, Homo sapiens
tctctgctgagctggg

SEQ ID NO: 1281287 - DNA, 22 bp, Homo sapiens
tctctgctgagctgggcccagc

SEQ ID NO: 1281288 - DNA, 13 bp, Homo sapiens
tctctgctgcctc

SEQ ID NO: 1281289 - DNA, 15 bp, Homo sapiens
tctctgctgcctctg

SEQ ID NO: 1281290 - DNA, 20 bp, Homo sapiens
tctctgctgcctctgtggaa

SEQ ID NO: 1281291 - DNA, 10 bp, Homo sapiens
tctctgctgg

SEQ ID NO: 1281292 - DNA, 12 bp, Homo sapiens
tctctgctggcc

SEQ ID NO: 1281293 - DNA, 14 bp, Homo sapiens
tctctgctggccca

SEQ ID NO: 1281294 - DNA, 16 bp, Homo sapiens
tctctgctggcccagc

SEQ ID NO: 1281295 - DNA, 11 bp, Homo sapiens
tctctgctggg

SEQ ID NO: 1281296 - DNA, 11 bp, Homo sapiens
tctctgcttcc

SEQ ID NO: 1281297 - DNA, 12 bp, Homo sapiens
tctctgcttcca

SEQ ID NO: 1281298 - DNA, 13 bp, Homo sapiens
tctctgcttgcct

SEQ ID NO: 1281299 - DNA, 22 bp, Homo sapiens
tctctggaaggggcagccctga

SEQ ID NO: 1281300 - DNA, 23 bp, Homo sapiens
tctctggaaggggcagccctgag

SEQ ID NO: 1281301 - DNA, 13 bp, Homo sapiens
tctctggagccag

SEQ ID NO: 1281302 - DNA, 15 bp, Homo sapiens
tctctggagccagag

SEQ ID NO: 1281303 - DNA, 17 bp, Homo sapiens
tctctggagccagagag

SEQ ID NO: 1281304 - DNA, 14 bp, Homo sapiens
tctctggagcccct

SEQ ID NO: 1281305 - DNA, 22 bp, Homo sapiens
tctctggaggtactgagacagg

SEQ ID NO: 1281306 - DNA, 22 bp, Homo sapiens
tctctggatggaacgggcatgg

SEQ ID NO: 1281307 - DNA, 17 bp, Homo sapiens
tctctggcaccacacta

SEQ ID NO: 1281308 - DNA, 15 bp, Homo sapiens
tctctggcactttga

SEQ ID NO: 1281309 - DNA, 17 bp, Homo sapiens
tctctggcagctggcct

SEQ ID NO: 1281310 - DNA, 15 bp, Homo sapiens
tctctggcccagaaa

SEQ ID NO: 1281311 - DNA, 17 bp, Homo sapiens
tctctggcccagaaagc

SEQ ID NO: 1281312 - DNA, 19 bp, Homo sapiens
tctctggcccttcttgcct

SEQ ID NO: 1281313 - DNA, 11 bp, Homo sapiens
tctctggcctc

SEQ ID NO: 1281314 - DNA, 16 bp, Homo sapiens
tctctggcgacagttt

SEQ ID NO: 1281315 - DNA, 23 bp, Homo sapiens
tctctggctgtctgtctgcagtg

SEQ ID NO: 1281316 - DNA, 16 bp, Homo sapiens
tctctggcttctgaag

SEQ ID NO: 1281317 - DNA, 17 bp, Homo sapiens
tctctgggacctcctta

SEQ ID NO: 1281318 - DNA, 21 bp, Homo sapiens
tctctgggactctcctcctcc

SEQ ID NO: 1281319 - DNA, 14 bp, Homo sapiens
tctctgggcctgtg

SEQ ID NO: 1281320 - DNA, 16 bp, Homo sapiens
tctctgggctgaggaa

SEQ ID NO: 1281321 - DNA, 10 bp, Homo sapiens
tctctgggga

SEQ ID NO: 1281322 - DNA, 11 bp, Homo sapiens
tctctggggac

SEQ ID NO: 1281323 - DNA, 17 bp, Homo sapiens
tctctggggcagatccc

SEQ ID NO: 1281324 - DNA, 20 bp, Homo sapiens
tctctggggccctgggcctc

SEQ ID NO: 1281325 - DNA, 23 bp, Homo sapiens
tctctggggccctgggcctcagt

SEQ ID NO: 1281326 - DNA, 13 bp, Homo sapiens
tctctgggggagg

SEQ ID NO: 1281327 - DNA, 18 bp, Homo sapiens
tctctgggggaggcaggg

SEQ ID NO: 1281328 - DNA, 14 bp, Homo sapiens
tctctgggtcccgg

SEQ ID NO: 1281329 - DNA, 16 bp, Homo sapiens
tctctgggtcccgggg

SEQ ID NO: 1281330 - DNA, 19 bp, Homo sapiens
tctctgggtctgattttct

SEQ ID NO: 1281331 - DNA, 17 bp, Homo sapiens
tctctggtaatattgac

SEQ ID NO: 1281332 - DNA, 14 bp, Homo sapiens
tctctggttgtcta

SEQ ID NO: 1281333 - DNA, 18 bp, Homo sapiens
tctctggtttcaccagcg

SEQ ID NO: 1281334 - DNA, 13 bp, Homo sapiens
tctctggttttct

SEQ ID NO: 1281335 - DNA, 18 bp, Homo sapiens
tctctggttttcttgcca

SEQ ID NO: 1281336 - DNA, 13 bp, Homo sapiens
tctctgtaagtgt

SEQ ID NO: 1281337 - DNA, 21 bp, Homo sapiens
tctctgtacgggccagtttct

SEQ ID NO: 1281338 - DNA, 16 bp, Homo sapiens
tctctgtacttttcat

SEQ ID NO: 1281339 - DNA, 19 bp, Homo sapiens
tctctgtagggaactctgg

SEQ ID NO: 1281340 - DNA, 21 bp, Homo sapiens
tctctgtcccattccctggga

SEQ ID NO: 1281341 - DNA, 18 bp, Homo sapiens
tctctgtccccaggtcct

SEQ ID NO: 1281342 - DNA, 16 bp, Homo sapiens
tctctgtcccttgctg

SEQ ID NO: 1281343 - DNA, 18 bp, Homo sapiens
tctctgtcccttgctgta

SEQ ID NO: 1281344 - DNA, 11 bp, Homo sapiens
tctctgtcctc

SEQ ID NO: 1281345 - DNA, 15 bp, Homo sapiens
tctctgtcgtgcttc

SEQ ID NO: 1281346 - DNA, 16 bp, Homo sapiens
tctctgtcgtggacac

SEQ ID NO: 1281347 - DNA, 19 bp, Homo sapiens
tctgagcagtgaatgattc

SEQ ID NO: 1281348 - DNA, 16 bp, Homo sapiens
tctgagcataatgctc

SEQ ID NO: 1281349 - DNA, 16 bp, Homo sapiens
tctgagccaagggagg

SEQ ID NO: 1281350 - DNA, 17 bp, Homo sapiens
tctgagccaagggaggg

SEQ ID NO: 1281351 - DNA, 20 bp, Homo sapiens
tctgagccaagggagggaag

SEQ ID NO: 1281352 - DNA, 20 bp, Homo sapiens
tctgagccagtgctttaatg

SEQ ID NO: 1281353 - DNA, 14 bp, Homo sapiens
tctgagcccaggcc

SEQ ID NO: 1281354 - DNA, 15 bp, Homo sapiens
tctgagcccaggccg

SEQ ID NO: 1281355 - DNA, 12 bp, Homo sapiens
tctgagcccatg

SEQ ID NO: 1281356 - DNA, 23 bp, Homo sapiens
tctgagcccccggctagtaccct

SEQ ID NO: 1281357 - DNA, 24 bp, Homo sapiens
tctgagcccgggctgcctgggctg

SEQ ID NO: 1281358 - DNA, 23 bp, Homo sapiens
tctgagcccggtaagagcaaaag

SEQ ID NO: 1281359 - DNA, 19 bp, Homo sapiens
tctgagctagctagcgcac

SEQ ID NO: 1281360 - DNA, 20 bp, Homo sapiens
tctgagctatttcatctatt

SEQ ID NO: 1281361 - DNA, 22 bp, Homo sapiens
tctgagctatttcatctatttt

SEQ ID NO: 1281362 - DNA, 17 bp, Homo sapiens
tctgagctccacctctg

SEQ ID NO: 1281363 - DNA, 22 bp, Homo sapiens
tctgagctcccacctcccttcc

SEQ ID NO: 1281364 - DNA, 12 bp, Homo sapiens
tctgagctggac

SEQ ID NO: 1281365 - DNA, 14 bp, Homo sapiens
tctgagctggggag

SEQ ID NO: 1281366 - DNA, 15 bp, Homo sapiens
tctgagctgtaattt

SEQ ID NO: 1281367 - DNA, 21 bp, Homo sapiens
tctgagcttttcatggaagtg

SEQ ID NO: 1281368 - DNA, 22 bp, Homo sapiens
tctgagcttttcatggaagtgg

SEQ ID NO: 1281369 - DNA, 22 bp, Homo sapiens
tctgaggaagcagttggggccc

SEQ ID NO: 1281370 - DNA, 18 bp, Homo sapiens
tctgaggacaagagaaaa

SEQ ID NO: 1281371 - DNA, 23 bp, Homo sapiens
tctgaggacaggctctagagaga

SEQ ID NO: 1281372 - DNA, 15 bp, Homo sapiens
tctgaggactgtcct

SEQ ID NO: 1281373 - DNA, 21 bp, Homo sapiens
tctgaggagtaagtgtacaat

SEQ ID NO: 1281374 - DNA, 22 bp, Homo sapiens
tctgaggagtaagtgtacaatt

SEQ ID NO: 1281375 - DNA, 22 bp, Homo sapiens
tctgaggatagtagttaaataa

SEQ ID NO: 1281376 - DNA, 19 bp, Homo sapiens
tctgaggatgtagagagaa

SEQ ID NO: 1281377 - DNA, 18 bp, Homo sapiens
tctgaggcaaccccctcg

SEQ ID NO: 1281378 - DNA, 21 bp, Homo sapiens
tctgaggccccttaactcatc

SEQ ID NO: 1281379 - DNA, 21 bp, Homo sapiens
tctgaggcctcatccctcgga

SEQ ID NO: 1281380 - DNA, 23 bp, Homo sapiens
tctgaggcctcctctctcagttt

SEQ ID NO: 1281381 - DNA, 21 bp, Homo sapiens
tctgaggctggatcctagcct

SEQ ID NO: 1281382 - DNA, 16 bp, Homo sapiens
tctgaggcttccagag

SEQ ID NO: 1281383 - DNA, 17 bp, Homo sapiens
tctgagggaggaggcca

SEQ ID NO: 1281384 - DNA, 20 bp, Homo sapiens
tctgagggaggaggccacct

SEQ ID NO: 1281385 - DNA, 21 bp, Homo sapiens
tctgagggaggaggccacctc

SEQ ID NO: 1281386 - DNA, 17 bp, Homo sapiens
tctgaggggaggcacct

SEQ ID NO: 1281387 - DNA, 23 bp, Homo sapiens
tctgaggggaggcacctccaggc

SEQ ID NO: 1281388 - DNA, 12 bp, Homo sapiens
tctgagggggag

SEQ ID NO: 1281389 - DNA, 17 bp, Homo sapiens
tctgaggggtgtccgag

SEQ ID NO: 1281390 - DNA, 13 bp, Homo sapiens
tctgaggtcaata

SEQ ID NO: 1281391 - DNA, 15 bp, Homo sapiens
tctgaggtcaataaa

SEQ ID NO: 1281392 - DNA, 20 bp, Homo sapiens
tctgaggtcaataaagcaga

SEQ ID NO: 1281393 - DNA, 21 bp, Homo sapiens
tctgaggtcaataaagcagag

SEQ ID NO: 1281394 - DNA, 20 bp, Homo sapiens
tctgaggtcccttcaaggcc

SEQ ID NO: 1281395 - DNA, 18 bp, Homo sapiens
tctgaggttggatttgct

SEQ ID NO: 1281396 - DNA, 21 bp, Homo sapiens
tctgaggttggatttgctcat

SEQ ID NO: 1281397 - DNA, 19 bp, Homo sapiens
tctgagtaagtgtgttcat

SEQ ID NO: 1281398 - DNA, 15 bp, Homo sapiens
tctgagtaattaata

SEQ ID NO: 1281399 - DNA, 20 bp, Homo sapiens
tctgagtaattaataaagaa

SEQ ID NO: 1281400 - DNA, 16 bp, Homo sapiens
tctgagtaggtctggg

SEQ ID NO: 1281401 - DNA, 15 bp, Homo sapiens
tctgagtcacaggtg

SEQ ID NO: 1281402 - DNA, 24 bp, Homo sapiens
tctgagtcccaggagctgcccaga

SEQ ID NO: 1281403 - DNA, 13 bp, Homo sapiens
tctgagtcctgga

SEQ ID NO: 1281404 - DNA, 16 bp, Homo sapiens
tctgagtcctgtctct

SEQ ID NO: 1281405 - DNA, 17 bp, Homo sapiens
tctgagtctagatacag

SEQ ID NO: 1281406 - DNA, 21 bp, Homo sapiens
tctgagtttaccatttgtaat

SEQ ID NO: 1281407 - DNA, 15 bp, Homo sapiens
tctgagtttcattct

SEQ ID NO: 1281408 - DNA, 17 bp, Homo sapiens
tctgataaagttcctta

SEQ ID NO: 1281409 - DNA, 19 bp, Homo sapiens
tctgataaagttccttaag

SEQ ID NO: 1281410 - DNA, 13 bp, Homo sapiens
tctgataatatat

SEQ ID NO: 1281411 - DNA, 20 bp, Homo sapiens
tctgataatatattttcaag

SEQ ID NO: 1281412 - DNA, 13 bp, Homo sapiens
tctgatacacagt

SEQ ID NO: 1281413 - DNA, 16 bp, Homo sapiens
tctgatacccagagca

SEQ ID NO: 1281414 - DNA, 19 bp, Homo sapiens
tctgatattaaagatttct

SEQ ID NO: 1281415 - DNA, 21 bp, Homo sapiens
tctgatattaaagatttcttt

SEQ ID NO: 1281416 - DNA, 12 bp, Homo sapiens
tctgatattaat

SEQ ID NO: 1281417 - DNA, 13 bp, Homo sapiens
tctgatattaatc

SEQ ID NO: 1281418 - DNA, 17 bp, Homo sapiens
tctgatattaatcaaaa

SEQ ID NO: 1281419 - DNA, 19 bp, Homo sapiens
tctgatattaatcaaaatt

SEQ ID NO: 1281420 - DNA, 22 bp, Homo sapiens
tctgatattccatgaatgtatc

SEQ ID NO: 1281421 - DNA, 13 bp, Homo sapiens
tctgatcaagagt

SEQ ID NO: 1281422 - DNA, 14 bp, Homo sapiens
tctgatcaagagtc

SEQ ID NO: 1281423 - DNA, 17 bp, Homo sapiens
tctgatcccatattctt

SEQ ID NO: 1281424 - DNA, 21 bp, Homo sapiens
tctgatccctctacagagctt

SEQ ID NO: 1281425 - DNA, 14 bp, Homo sapiens
tctgatcctcagcc

SEQ ID NO: 1281426 - DNA, 16 bp, Homo sapiens
tctgatcgtctcggcc

SEQ ID NO: 1281427 - DNA, 15 bp, Homo sapiens
tctgatctccatggc

SEQ ID NO: 1281428 - DNA, 15 bp, Homo sapiens
tctgatcttgtgctc

SEQ ID NO: 1281429 - DNA, 14 bp, Homo sapiens
tctgatgacgcctg

SEQ ID NO: 1281430 - DNA, 16 bp, Homo sapiens
tctgatggaactgtgt

SEQ ID NO: 1281431 - DNA, 21 bp, Homo sapiens
tctgatggaactgtgtattta

SEQ ID NO: 1281432 - DNA, 22 bp, Homo sapiens
tctgatggaactgtgtatttat

SEQ ID NO: 1281433 - DNA, 16 bp, Homo sapiens
tctgatggccaaaata

SEQ ID NO: 1281434 - DNA, 15 bp, Homo sapiens
tctgatggccttaat

SEQ ID NO: 1281435 - DNA, 14 bp, Homo sapiens
tctgatgtattaca

SEQ ID NO: 1281436 - DNA, 13 bp, Homo sapiens
tctgatgtggaat

SEQ ID NO: 1281437 - DNA, 16 bp, Homo sapiens
tctgatgtttcatatt

SEQ ID NO: 1281438 - DNA, 23 bp, Homo sapiens
tctgatgtttcctacaactaaaa

SEQ ID NO: 1281439 - DNA, 15 bp, Homo sapiens
tctgattaatatatt

SEQ ID NO: 1281440 - DNA, 21 bp, Homo sapiens
tctgattagagtgcaaaagtg

SEQ ID NO: 1281441 - DNA, 11 bp, Homo sapiens
tctgattccac

SEQ ID NO: 1281442 - DNA, 13 bp, Homo sapiens
tctgattccatat

SEQ ID NO: 1281443 - DNA, 13 bp, Homo sapiens
tctgattccttta

SEQ ID NO: 1281444 - DNA, 20 bp, Homo sapiens
tctgattcgaatgacactgt

SEQ ID NO: 1281445 - DNA, 20 bp, Homo sapiens
tctgattggacattttcttc

SEQ ID NO: 1281446 - DNA, 21 bp, Homo sapiens
tctgattggacattttcttca

SEQ ID NO: 1281447 - DNA, 14 bp, Homo sapiens
tctgattggctgga

SEQ ID NO: 1281448 - DNA, 19 bp, Homo sapiens
tctgatttaatgttttctg

SEQ ID NO: 1281449 - DNA, 20 bp, Homo sapiens
tctgatttaatgttttctgc

SEQ ID NO: 1281450 - DNA, 16 bp, Homo sapiens
tctgatttattttgta

SEQ ID NO: 1281451 - DNA, 21 bp, Homo sapiens
tctgatttcagtttttcattt

SEQ ID NO: 1281452 - DNA, 12 bp, Homo sapiens
tctgatttcata

SEQ ID NO: 1281453 - DNA, 18 bp, Homo sapiens
tctgatttctgcccttgt

SEQ ID NO: 1281454 - DNA, 21 bp, Homo sapiens
tctgatttctgcccttgttcc

SEQ ID NO: 1281455 - DNA, 13 bp, Homo sapiens
tctgattttctca

SEQ ID NO: 1281456 - DNA, 14 bp, Homo sapiens
tctgatttttaatt

SEQ ID NO: 1281457 - DNA, 14 bp, Homo sapiens
tctgcaaaatacac

SEQ ID NO: 1281458 - DNA, 21 bp, Homo sapiens
tctgcaaaatgaggaatgtat

SEQ ID NO: 1281459 - DNA, 22 bp, Homo sapiens
tctgcaaaatgaggaatgtata

SEQ ID NO: 1281460 - DNA, 24 bp, Homo sapiens
tctgcaaacaccaacatgttggga

SEQ ID NO: 1281461 - DNA, 18 bp, Homo sapiens
tctgcaaagaatgagaag

SEQ ID NO: 1281462 - DNA, 18 bp, Homo sapiens
tctgcaaaggcctgggct

SEQ ID NO: 1281463 - DNA, 19 bp, Homo sapiens
tctgcaaaggtggcaatgc

SEQ ID NO: 1281464 - DNA, 14 bp, Homo sapiens
tctgcaaatagaaa

SEQ ID NO: 1281465 - DNA, 16 bp, Homo sapiens
tctgcaaatagaaaac

SEQ ID NO: 1281466 - DNA, 13 bp, Homo sapiens
tctgcaacaaaaa

SEQ ID NO: 1281467 - DNA, 16 bp, Homo sapiens
tctgcaactagccaag

SEQ ID NO: 1281468 - DNA, 18 bp, Homo sapiens
tctgctctgctgctctga

SEQ ID NO: 1281469 - DNA, 14 bp, Homo sapiens
tctgctctttctct

SEQ ID NO: 1281470 - DNA, 15 bp, Homo sapiens
tctgctctttctctg

SEQ ID NO: 1281471 - DNA, 19 bp, Homo sapiens
tctgctctttctctgccag

SEQ ID NO: 1281472 - DNA, 15 bp, Homo sapiens
tctgctgaccaaatg

SEQ ID NO: 1281473 - DNA, 19 bp, Homo sapiens
tctgctgagctgggcccag

SEQ ID NO: 1281474 - DNA, 23 bp, Homo sapiens
tctgctgagctgggcccagcccc

SEQ ID NO: 1281475 - DNA, 15 bp, Homo sapiens
tctgctgcccccttc

SEQ ID NO: 1281476 - DNA, 13 bp, Homo sapiens
tctgctgccctcc

SEQ ID NO: 1281477 - DNA, 23 bp, Homo sapiens
tctgctggaagctgtcaggctgg

SEQ ID NO: 1281478 - DNA, 18 bp, Homo sapiens
tctgctggaaggggcagc

SEQ ID NO: 1281479 - DNA, 19 bp, Homo sapiens
tctgctggaaggggcagca

SEQ ID NO: 1281480 - DNA, 13 bp, Homo sapiens
tctgctggaggag

SEQ ID NO: 1281481 - DNA, 21 bp, Homo sapiens
tctgctggaggaggggaagct

SEQ ID NO: 1281482 - DNA, 13 bp, Homo sapiens
tctgctggagttt

SEQ ID NO: 1281483 - DNA, 18 bp, Homo sapiens
tctgctggataaaatgag

SEQ ID NO: 1281484 - DNA, 12 bp, Homo sapiens
tctgctgggact

SEQ ID NO: 1281485 - DNA, 15 bp, Homo sapiens
tctgctggtatttct

SEQ ID NO: 1281486 - DNA, 16 bp, Homo sapiens
tctgctggtatttcta

SEQ ID NO: 1281487 - DNA, 17 bp, Homo sapiens
tctgctggtcttcaatt

SEQ ID NO: 1281488 - DNA, 15 bp, Homo sapiens
tctgctgtctctcct

SEQ ID NO: 1281489 - DNA, 21 bp, Homo sapiens
tctgctgtggtctataaaata

SEQ ID NO: 1281490 - DNA, 11 bp, Homo sapiens
tctgctgtgtg

SEQ ID NO: 1281491 - DNA, 16 bp, Homo sapiens
tctgctgttcttcact

SEQ ID NO: 1281492 - DNA, 19 bp, Homo sapiens
tctgctgttcttcacttct

SEQ ID NO: 1281493 - DNA, 15 bp, Homo sapiens
tctgcttaaacaaag

SEQ ID NO: 1281494 - DNA, 19 bp, Homo sapiens
tctgcttaaagttgtaaca

SEQ ID NO: 1281495 - DNA, 21 bp, Homo sapiens
tctgcttacaattccctgctg

SEQ ID NO: 1281496 - DNA, 23 bp, Homo sapiens
tctgcttacaattccctgctgtc

SEQ ID NO: 1281497 - DNA, 13 bp, Homo sapiens
tctgcttaccctt

SEQ ID NO: 1281498 - DNA, 16 bp, Homo sapiens
tctgcttacccttcac

SEQ ID NO: 1281499 - DNA, 18 bp, Homo sapiens
tctgcttaccgttcaaga

SEQ ID NO: 1281500 - DNA, 16 bp, Homo sapiens
tctgcttagaaataac

SEQ ID NO: 1281501 - DNA, 19 bp, Homo sapiens
tctgcttcaataaatcttt

SEQ ID NO: 1281502 - DNA, 23 bp, Homo sapiens
tctgcttctcggggtccagtgca

SEQ ID NO: 1281503 - DNA, 16 bp, Homo sapiens
tctgcttctctcttct

SEQ ID NO: 1281504 - DNA, 14 bp, Homo sapiens
tctgcttctctgac

SEQ ID NO: 1281505 - DNA, 18 bp, Homo sapiens
tctgcttgatttttgcct

SEQ ID NO: 1281506 - DNA, 18 bp, Homo sapiens
tctgcttgctcttgtcct

SEQ ID NO: 1281507 - DNA, 11 bp, Homo sapiens
tctgcttggag

SEQ ID NO: 1281508 - DNA, 18 bp, Homo sapiens
tctgctttaaagggcctg

SEQ ID NO: 1281509 - DNA, 22 bp, Homo sapiens
tctgctttaaagggcctgcctg

SEQ ID NO: 1281510 - DNA, 15 bp, Homo sapiens
tctgctttatctttt

SEQ ID NO: 1281511 - DNA, 17 bp, Homo sapiens
tctgctttcacttaagt

SEQ ID NO: 1281512 - DNA, 16 bp, Homo sapiens
tctgctttccttttct

SEQ ID NO: 1281513 - DNA, 17 bp, Homo sapiens
tctgctttccttttctc

SEQ ID NO: 1281514 - DNA, 22 bp, Homo sapiens
tctgctttggggtttatcagaa

SEQ ID NO: 1281515 - DNA, 13 bp, Homo sapiens
tctgcttttacca

SEQ ID NO: 1281516 - DNA, 22 bp, Homo sapiens
tctgcttttatctcagatgtta

SEQ ID NO: 1281517 - DNA, 16 bp, Homo sapiens
tctgcttttctgccct

SEQ ID NO: 1281518 - DNA, 21 bp, Homo sapiens
tctgcttttctgccctggctg

SEQ ID NO: 1281519 - DNA, 22 bp, Homo sapiens
tctgcttttctgccctggctgc

SEQ ID NO: 1281520 - DNA, 15 bp, Homo sapiens
tctggaaaaaaaata

SEQ ID NO: 1281521 - DNA, 15 bp, Homo sapiens
tctggaaaactcagg

SEQ ID NO: 1281522 - DNA, 20 bp, Homo sapiens
tctggaaaactcaggattct

SEQ ID NO: 1281523 - DNA, 13 bp, Homo sapiens
tctggaaacagct

SEQ ID NO: 1281524 - DNA, 19 bp, Homo sapiens
tctggaaaggggggagctg

SEQ ID NO: 1281525 - DNA, 21 bp, Homo sapiens
tctggaaagtgatgtcagaat

SEQ ID NO: 1281526 - DNA, 14 bp, Homo sapiens
tctggaaataaaga

SEQ ID NO: 1281527 - DNA, 19 bp, Homo sapiens
tctggaaatttagagttct

SEQ ID NO: 1281528 - DNA, 13 bp, Homo sapiens
tctggaaattttg

SEQ ID NO: 1281529 - DNA, 14 bp, Homo sapiens
tctggaaattttgt

SEQ ID NO: 1281530 - DNA, 15 bp, Homo sapiens
tctggaagacgtggc

SEQ ID NO: 1281531 - DNA, 17 bp, Homo sapiens
tctggaagacgtggctc

SEQ ID NO: 1281532 - DNA, 18 bp, Homo sapiens
tctggaagactgctcccg

SEQ ID NO: 1281533 - DNA, 18 bp, Homo sapiens
tctggaagaggccttccc

SEQ ID NO: 1281534 - DNA, 17 bp, Homo sapiens
tctggaagcccctgggc

SEQ ID NO: 1281535 - DNA, 18 bp, Homo sapiens
tctggaagccctggagac

SEQ ID NO: 1281536 - DNA, 15 bp, Homo sapiens
tctggaaggctggct

SEQ ID NO: 1281537 - DNA, 18 bp, Homo sapiens
tctggaaggctggctgag

SEQ ID NO: 1281538 - DNA, 19 bp, Homo sapiens
tctggaaggctggctgagt

SEQ ID NO: 1281539 - DNA, 19 bp, Homo sapiens
tctggaaggggcagccctg

SEQ ID NO: 1281540 - DNA, 23 bp, Homo sapiens
tctggaaggggcagccctgagtg

SEQ ID NO: 1281541 - DNA, 13 bp, Homo sapiens
tctggaatattgt

SEQ ID NO: 1281542 - DNA, 17 bp, Homo sapiens
tctggaatcttccccaa

SEQ ID NO: 1281543 - DNA, 16 bp, Homo sapiens
tctggaatgtaatcaa

SEQ ID NO: 1281544 - DNA, 19 bp, Homo sapiens
tctggaatttaaggcccaa

SEQ ID NO: 1281545 - DNA, 16 bp, Homo sapiens
tctggacaaatgtata

SEQ ID NO: 1281546 - DNA, 21 bp, Homo sapiens
tctggacaagccaacttgtaa

SEQ ID NO: 1281547 - DNA, 18 bp, Homo sapiens
tctggacagatggacgca

SEQ ID NO: 1281548 - DNA, 13 bp, Homo sapiens
tctggacagcaga

SEQ ID NO: 1281549 - DNA, 13 bp, Homo sapiens
tctggacagccag

SEQ ID NO: 1281550 - DNA, 14 bp, Homo sapiens
tctggacaggctct

SEQ ID NO: 1281551 - DNA, 20 bp, Homo sapiens
tctggacaggctctgcttct

SEQ ID NO: 1281552 - DNA, 18 bp, Homo sapiens
tctggaccccatctgtga

SEQ ID NO: 1281553 - DNA, 21 bp, Homo sapiens
tctggaccccatctgtgaata

SEQ ID NO: 1281554 - DNA, 16 bp, Homo sapiens
tctggacccttggcct

SEQ ID NO: 1281555 - DNA, 13 bp, Homo sapiens
tctggacctcagg

SEQ ID NO: 1281556 - DNA, 19 bp, Homo sapiens
tctggacctccatccctgc

SEQ ID NO: 1281557 - DNA, 21 bp, Homo sapiens
tctggacctccatccctgctc

SEQ ID NO: 1281558 - DNA, 22 bp, Homo sapiens
tctggacctccatccctgctct

SEQ ID NO: 1281559 - DNA, 15 bp, Homo sapiens
tctggacggcaggct

SEQ ID NO: 1281560 - DNA, 19 bp, Homo sapiens
tctggactaaccctgtggt

SEQ ID NO: 1281561 - DNA, 20 bp, Homo sapiens
tctggactaaccctgtggtt

SEQ ID NO: 1281562 - DNA, 15 bp, Homo sapiens
tctggactcctctgt

SEQ ID NO: 1281563 - DNA, 22 bp, Homo sapiens
tctggactcctctgtccaggca

SEQ ID NO: 1281564 - DNA, 19 bp, Homo sapiens
tctggactctgccccaatc

SEQ ID NO: 1281565 - DNA, 14 bp, Homo sapiens
tctggactctggac

SEQ ID NO: 1281566 - DNA, 15 bp, Homo sapiens
tctggactctggact

SEQ ID NO: 1281567 - DNA, 16 bp, Homo sapiens
tctggagaagcagtga

SEQ ID NO: 1281568 - DNA, 20 bp, Homo sapiens
tctggagaagctcccaggaa

SEQ ID NO: 1281569 - DNA, 12 bp, Homo sapiens
tctggagagctg

SEQ ID NO: 1281570 - DNA, 21 bp, Homo sapiens
tctggagaggaagccagtgga

SEQ ID NO: 1281571 - DNA, 14 bp, Homo sapiens
tctggagccagaga

SEQ ID NO: 1281572 - DNA, 15 bp, Homo sapiens
tctggagccagagag

SEQ ID NO: 1281573 - DNA, 18 bp, Homo sapiens
tctggagcccctcctccc

SEQ ID NO: 1281574 - DNA, 16 bp, Homo sapiens
tctggagccctaaccc

SEQ ID NO: 1281575 - DNA, 12 bp, Homo sapiens
tctggagccctt

SEQ ID NO: 1281576 - DNA, 18 bp, Homo sapiens
tctggagctgggagacaa

SEQ ID NO: 1281577 - DNA, 18 bp, Homo sapiens
tctggaggaagttctcca

SEQ ID NO: 1281578 - DNA, 19 bp, Homo sapiens
tctggaggaagttctccag

SEQ ID NO: 1281579 - DNA, 22 bp, Homo sapiens
tctggaggccttccagctgctg

SEQ ID NO: 1281580 - DNA, 17 bp, Homo sapiens
tctggaggggagagctt

SEQ ID NO: 1281581 - DNA, 21 bp, Homo sapiens
tctggaggggagagctttgtg

SEQ ID NO: 1281582 - DNA, 21 bp, Homo sapiens
tctggaggggagggggatccg

SEQ ID NO: 1281583 - DNA, 21 bp, Homo sapiens
tctggaggtactgagacaggg

SEQ ID NO: 1281584 - DNA, 21 bp, Homo sapiens
tctggagtctcacttgtctca

SEQ ID NO: 1281585 - DNA, 19 bp, Homo sapiens
tctggagtctccagtggtt

SEQ ID NO: 1281586 - DNA, 15 bp, Homo sapiens
tctggagtggccact

SEQ ID NO: 1281587 - DNA, 13 bp, Homo sapiens
tctggagttccca

SEQ ID NO: 1281588 - DNA, 13 bp, Homo sapiens
tctggagtttctc

SEQ ID NO: 1281589 - DNA, 16 bp, Homo sapiens
tctggagtttctctaa

SEQ ID NO: 1281590 - DNA, 14 bp, Homo sapiens
tctgtacttttcat

SEQ ID NO: 1281591 - DNA, 20 bp, Homo sapiens
tctgtacttttcattctctt

SEQ ID NO: 1281592 - DNA, 15 bp, Homo sapiens
tctgtagacttctgg

SEQ ID NO: 1281593 - DNA, 16 bp, Homo sapiens
tctgtagatgttgtct

SEQ ID NO: 1281594 - DNA, 19 bp, Homo sapiens
tctgtagcctcctttgtaa

SEQ ID NO: 1281595 - DNA, 18 bp, Homo sapiens
tctgtaggcacagagctg

SEQ ID NO: 1281596 - DNA, 19 bp, Homo sapiens
tctgtaggcagcagagaga

SEQ ID NO: 1281597 - DNA, 21 bp, Homo sapiens
tctgtagggaattcttctgtt

SEQ ID NO: 1281598 - DNA, 23 bp, Homo sapiens
tctgtagggagtgaagccacaga

SEQ ID NO: 1281599 - DNA, 15 bp, Homo sapiens
tctgtagggctggac

SEQ ID NO: 1281600 - DNA, 21 bp, Homo sapiens
tctgtaggtgtctctgggcct

SEQ ID NO: 1281601 - DNA, 19 bp, Homo sapiens
tctgtagtattttttaaat

SEQ ID NO: 1281602 - DNA, 23 bp, Homo sapiens
tctgtataaagcctgtattctca

SEQ ID NO: 1281603 - DNA, 15 bp, Homo sapiens
tctgtataatagaga

SEQ ID NO: 1281604 - DNA, 21 bp, Homo sapiens
tctgtatactgtaaaagttat

SEQ ID NO: 1281605 - DNA, 16 bp, Homo sapiens
tctgtatagaaatcta

SEQ ID NO: 1281606 - DNA, 22 bp, Homo sapiens
tctgtatagaaatctaaaagaa

SEQ ID NO: 1281607 - DNA, 21 bp, Homo sapiens
tctgtatataagttgctgtgt

SEQ ID NO: 1281608 - DNA, 15 bp, Homo sapiens
tctgtatatacaata

SEQ ID NO: 1281609 - DNA, 19 bp, Homo sapiens
tctgtatatttgtcatgac

SEQ ID NO: 1281610 - DNA, 20 bp, Homo sapiens
tctgtatcctggaacaatat

SEQ ID NO: 1281611 - DNA, 14 bp, Homo sapiens
tctgtatgaatgtg

SEQ ID NO: 1281612 - DNA, 19 bp, Homo sapiens
tctgtattgaaaatggctt

SEQ ID NO: 1281613 - DNA, 18 bp, Homo sapiens
tctgtatttaatggtttt

SEQ ID NO: 1281614 - DNA, 18 bp, Homo sapiens
tctgtatttcatgtggct

SEQ ID NO: 1281615 - DNA, 23 bp, Homo sapiens
tctgtattttatttagacaagag

SEQ ID NO: 1281616 - DNA, 18 bp, Homo sapiens
tctgtcaaaacactgtgg

SEQ ID NO: 1281617 - DNA, 20 bp, Homo sapiens
tctgtcaaaacactgtggaa

SEQ ID NO: 1281618 - DNA, 20 bp, Homo sapiens
tctgtcaaatgtttccttaa

SEQ ID NO: 1281619 - DNA, 21 bp, Homo sapiens
tctgtcaaatgtttccttaaa

SEQ ID NO: 1281620 - DNA, 13 bp, Homo sapiens
tctgtcaagaaga

SEQ ID NO: 1281621 - DNA, 17 bp, Homo sapiens
tctgtcaagagtagtta

SEQ ID NO: 1281622 - DNA, 20 bp, Homo sapiens
tctgtcaagagtagttatat

SEQ ID NO: 1281623 - DNA, 22 bp, Homo sapiens
tctgtcaagagtagttatataa

SEQ ID NO: 1281624 - DNA, 21 bp, Homo sapiens
tctgtcaagcatattggaaag

SEQ ID NO: 1281625 - DNA, 20 bp, Homo sapiens
tctgtcaatcacagtctcag

SEQ ID NO: 1281626 - DNA, 17 bp, Homo sapiens
tctgtcacaataaatgg

SEQ ID NO: 1281627 - DNA, 21 bp, Homo sapiens
tctgtcacaataaatggccag

SEQ ID NO: 1281628 - DNA, 14 bp, Homo sapiens
tctgtcacaggctg

SEQ ID NO: 1281629 - DNA, 17 bp, Homo sapiens
tctgtcacaggctgggt

SEQ ID NO: 1281630 - DNA, 18 bp, Homo sapiens
tctgtcacagtaaaaata

SEQ ID NO: 1281631 - DNA, 19 bp, Homo sapiens
tctgtcacagtaaaaataa

SEQ ID NO: 1281632 - DNA, 19 bp, Homo sapiens
tctgtcaccagctatctgt

SEQ ID NO: 1281633 - DNA, 15 bp, Homo sapiens
tctgtcactccaggc

SEQ ID NO: 1281634 - DNA, 11 bp, Homo sapiens
tctgtcactga

SEQ ID NO: 1281635 - DNA, 14 bp, Homo sapiens
tctgtcactgagca

SEQ ID NO: 1281636 - DNA, 15 bp, Homo sapiens
tctgtcagatgagaa

SEQ ID NO: 1281637 - DNA, 19 bp, Homo sapiens
tctgtcagatgggaagaca

SEQ ID NO: 1281638 - DNA, 17 bp, Homo sapiens
tctgtcagccagccgcc

SEQ ID NO: 1281639 - DNA, 20 bp, Homo sapiens
tctgtcagccagccgccctg

SEQ ID NO: 1281640 - DNA, 23 bp, Homo sapiens
tctgtcagggccttggcccaggg

SEQ ID NO: 1281641 - DNA, 20 bp, Homo sapiens
tctgtcagtaaaactctcaa

SEQ ID NO: 1281642 - DNA, 13 bp, Homo sapiens
tctgtcagtcaca

SEQ ID NO: 1281643 - DNA, 19 bp, Homo sapiens
tctgtcagtcacagccacc

SEQ ID NO: 1281644 - DNA, 18 bp, Homo sapiens
tctgtcatctctctgggg

SEQ ID NO: 1281645 - DNA, 17 bp, Homo sapiens
tctgtccaaaggaggct

SEQ ID NO: 1281646 - DNA, 23 bp, Homo sapiens
tctgtccaaaggaggctggcagg

SEQ ID NO: 1281647 - DNA, 17 bp, Homo sapiens
tctgtccacctcggcct

SEQ ID NO: 1281648 - DNA, 20 bp, Homo sapiens
tctgtccagctggggccaga

SEQ ID NO: 1281649 - DNA, 23 bp, Homo sapiens
tctgtccaggacatgatactgat

SEQ ID NO: 1281650 - DNA, 14 bp, Homo sapiens
tctgtccaggccac

SEQ ID NO: 1281651 - DNA, 18 bp, Homo sapiens
tctgtccaggccactgtg

SEQ ID NO: 1281652 - DNA, 18 bp, Homo sapiens
tctgtccaggcccttagg

SEQ ID NO: 1281653 - DNA, 17 bp, Homo sapiens
tctgtccagggccctga

SEQ ID NO: 1281654 - DNA, 20 bp, Homo sapiens
tctgtccagggccctgagct

SEQ ID NO: 1281655 - DNA, 17 bp, Homo sapiens
tctgtccatctgtctgt

SEQ ID NO: 1281656 - DNA, 19 bp, Homo sapiens
tctgtccatttatccacag

SEQ ID NO: 1281657 - DNA, 14 bp, Homo sapiens
tctgtcccattccc

SEQ ID NO: 1281658 - DNA, 19 bp, Homo sapiens
tctgtcccattccctggga

SEQ ID NO: 1281659 - DNA, 22 bp, Homo sapiens
tctgtccccagccctgtcctgg

SEQ ID NO: 1281660 - DNA, 12 bp, Homo sapiens
tctgtccctgtc

SEQ ID NO: 1281661 - DNA, 15 bp, Homo sapiens
tctgtccctgtccct

SEQ ID NO: 1281662 - DNA, 18 bp, Homo sapiens
tctgtccctgtccctgcc

SEQ ID NO: 1281663 - DNA, 20 bp, Homo sapiens
tctgtccctgtccttccctg

SEQ ID NO: 1281664 - DNA, 18 bp, Homo sapiens
tctgtcccttccccttca

SEQ ID NO: 1281665 - DNA, 18 bp, Homo sapiens
tctgtcccttttctttga

SEQ ID NO: 1281666 - DNA, 16 bp, Homo sapiens
tctgtccgtccagagc

SEQ ID NO: 1281667 - DNA, 17 bp, Homo sapiens
tctgtccgtccagagcc

SEQ ID NO: 1281668 - DNA, 11 bp, Homo sapiens
tctgtcctact

SEQ ID NO: 1281669 - DNA, 17 bp, Homo sapiens
tctgtcctacttctgac

SEQ ID NO: 1281670 - DNA, 14 bp, Homo sapiens
tctgtcctcaccct

SEQ ID NO: 1281671 - DNA, 15 bp, Homo sapiens
tctgtcctcaccctg

SEQ ID NO: 1281672 - DNA, 19 bp, Homo sapiens
tctgtcctcaccctgtggg

SEQ ID NO: 1281673 - DNA, 21 bp, Homo sapiens
tctgtcctcaccctgtgggac

SEQ ID NO: 1281674 - DNA, 14 bp, Homo sapiens
tctgtcctcacgcc

SEQ ID NO: 1281675 - DNA, 20 bp, Homo sapiens
tctgtcctcacgccccctgt

SEQ ID NO: 1281676 - DNA, 16 bp, Homo sapiens
tctgtcctcagagcag

SEQ ID NO: 1281677 - DNA, 13 bp, Homo sapiens
tctgtcctgtgac

SEQ ID NO: 1281678 - DNA, 14 bp, Homo sapiens
tctgtccttctgaa

SEQ ID NO: 1281679 - DNA, 14 bp, Homo sapiens
tctgtcgcccttct

SEQ ID NO: 1281680 - DNA, 12 bp, Homo sapiens
tctgtctcatcc

SEQ ID NO: 1281681 - DNA, 17 bp, Homo sapiens
tctgtctcatccatcat

SEQ ID NO: 1281682 - DNA, 21 bp, Homo sapiens
tctgtctcatccatcatcatg

SEQ ID NO: 1281683 - DNA, 18 bp, Homo sapiens
tctgtctcatcctcctgg

SEQ ID NO: 1281684 - DNA, 20 bp, Homo sapiens
tctgtctcatcctcctggaa

SEQ ID NO: 1281685 - DNA, 15 bp, Homo sapiens
tctgtctcgatgcct

SEQ ID NO: 1281686 - DNA, 19 bp, Homo sapiens
tctgtctcgatgcctgatt

SEQ ID NO: 1281687 - DNA, 21 bp, Homo sapiens
tctgtctctaaccattcaaat

SEQ ID NO: 1281688 - DNA, 23 bp, Homo sapiens
tctgtctctccccctctgtcttc

SEQ ID NO: 1281689 - DNA, 18 bp, Homo sapiens
tctgtctgaatgatcttg

SEQ ID NO: 1281690 - DNA, 18 bp, Homo sapiens
tctgtctgccaacctaaa

SEQ ID NO: 1281691 - DNA, 21 bp, Homo sapiens
tctgtctgccaacctaaaact

SEQ ID NO: 1281692 - DNA, 12 bp, Homo sapiens
tctgtctggcac

SEQ ID NO: 1281693 - DNA, 16 bp, Homo sapiens
tctgtctggtggcccc

SEQ ID NO: 1281694 - DNA, 13 bp, Homo sapiens
tctgtctgtccta

SEQ ID NO: 1281695 - DNA, 17 bp, Homo sapiens
tctgtctgtcgcccttc

SEQ ID NO: 1281696 - DNA, 15 bp, Homo sapiens
tctgtctgtctgtgg

SEQ ID NO: 1281697 - DNA, 19 bp, Homo sapiens
tctgtctgtgggcttcagc

SEQ ID NO: 1281698 - DNA, 23 bp, Homo sapiens
tctgtctgtgggcttcagcactt

SEQ ID NO: 1281699 - DNA, 14 bp, Homo sapiens
tctgtcttaaatga

SEQ ID NO: 1281700 - DNA, 14 bp, Homo sapiens
tctgtcttcaagga

SEQ ID NO: 1281701 - DNA, 17 bp, Homo sapiens
tctgtcttcaagggctt

SEQ ID NO: 1281702 - DNA, 13 bp, Homo sapiens
tctgtcttctcct

SEQ ID NO: 1281703 - DNA, 16 bp, Homo sapiens
tctgtcttctctccac

SEQ ID NO: 1281704 - DNA, 17 bp, Homo sapiens
tctgtcttggcattaaa

SEQ ID NO: 1281705 - DNA, 19 bp, Homo sapiens
tctgtcttggctttcatgt

SEQ ID NO: 1281706 - DNA, 19 bp, Homo sapiens
tctgtctttcactggaatg

SEQ ID NO: 1281707 - DNA, 20 bp, Homo sapiens
tctgtctttcactggaatga

SEQ ID NO: 1281708 - DNA, 17 bp, Homo sapiens
tctgtctttccactctg

SEQ ID NO: 1281709 - DNA, 14 bp, Homo sapiens
tctgtctttcctga

SEQ ID NO: 1281710 - DNA, 20 bp, Homo sapiens
tctgtcttttctcctccgcc

SEQ ID NO: 1281711 - DNA, 15 bp, Homo sapiens
tcttactctgaaaca

SEQ ID NO: 1281712 - DNA, 23 bp, Homo sapiens
tcttactctgtctcccaggctgc

SEQ ID NO: 1281713 - DNA, 14 bp, Homo sapiens
tcttactgataatt

SEQ ID NO: 1281714 - DNA, 12 bp, Homo sapiens
tcttacttttat

SEQ ID NO: 1281715 - DNA, 22 bp, Homo sapiens
tcttacttttcctggacttaaa

SEQ ID NO: 1281716 - DNA, 13 bp, Homo sapiens
tcttagaaatact

SEQ ID NO: 1281717 - DNA, 13 bp, Homo sapiens
tcttagaaatgaa

SEQ ID NO: 1281718 - DNA, 18 bp, Homo sapiens
tcttagaagaatattgta

SEQ ID NO: 1281719 - DNA, 20 bp, Homo sapiens
tcttagaagccatgggacct

SEQ ID NO: 1281720 - DNA, 21 bp, Homo sapiens
tcttagaagtggaccaggaca

SEQ ID NO: 1281721 - DNA, 18 bp, Homo sapiens
tcttagagccaagtgtct

SEQ ID NO: 1281722 - DNA, 23 bp, Homo sapiens
tcttagagccaagtgtcttttaa

SEQ ID NO: 1281723 - DNA, 13 bp, Homo sapiens
tcttagagccttt

SEQ ID NO: 1281724 - DNA, 22 bp, Homo sapiens
tcttagagccttttatctgcag

SEQ ID NO: 1281725 - DNA, 16 bp, Homo sapiens
tcttagagtttacagt

SEQ ID NO: 1281726 - DNA, 17 bp, Homo sapiens
tcttagagtttacagtt

SEQ ID NO: 1281727 - DNA, 20 bp, Homo sapiens
tcttagagtttacagtttgt

SEQ ID NO: 1281728 - DNA, 13 bp, Homo sapiens
tcttagataactt

SEQ ID NO: 1281729 - DNA, 19 bp, Homo sapiens
tcttagattgggccatggc

SEQ ID NO: 1281730 - DNA, 15 bp, Homo sapiens
tcttagctactgtat

SEQ ID NO: 1281731 - DNA, 20 bp, Homo sapiens
tcttagctactgtatgcaaa

SEQ ID NO: 1281732 - DNA, 23 bp, Homo sapiens
tcttagctgtctgctcagacaga

SEQ ID NO: 1281733 - DNA, 19 bp, Homo sapiens
tcttaggaagagaaaccag

SEQ ID NO: 1281734 - DNA, 21 bp, Homo sapiens
tcttaggagcaagaagaaaat

SEQ ID NO: 1281735 - DNA, 16 bp, Homo sapiens
tcttaggcacatcaat

SEQ ID NO: 1281736 - DNA, 23 bp, Homo sapiens
tcttagggcacatgaaaaatttt

SEQ ID NO: 1281737 - DNA, 14 bp, Homo sapiens
tcttagtaatagca

SEQ ID NO: 1281738 - DNA, 19 bp, Homo sapiens
tcttagtatagtagaaaga

SEQ ID NO: 1281739 - DNA, 15 bp, Homo sapiens
tcttagtgcccgcct

SEQ ID NO: 1281740 - DNA, 18 bp, Homo sapiens
tcttagtgcctgagagta

SEQ ID NO: 1281741 - DNA, 20 bp, Homo sapiens
tcttagtgcttcagagtttg

SEQ ID NO: 1281742 - DNA, 15 bp, Homo sapiens
tcttagttctcactg

SEQ ID NO: 1281743 - DNA, 16 bp, Homo sapiens
tcttagttctcactgt

SEQ ID NO: 1281744 - DNA, 20 bp, Homo sapiens
tcttagttgacaacctagaa

SEQ ID NO: 1281745 - DNA, 16 bp, Homo sapiens
tcttagtttggattct

SEQ ID NO: 1281746 - DNA, 16 bp, Homo sapiens
tcttataactgtttta

SEQ ID NO: 1281747 - DNA, 23 bp, Homo sapiens
tcttataactgttttagaaattg

SEQ ID NO: 1281748 - DNA, 22 bp, Homo sapiens
tcttatacaacagcaaaccctg

SEQ ID NO: 1281749 - DNA, 23 bp, Homo sapiens
tcttatacaacagcaaaccctga

SEQ ID NO: 1281750 - DNA, 18 bp, Homo sapiens
tcttataccttctgacag

SEQ ID NO: 1281751 - DNA, 16 bp, Homo sapiens
tcttatactgtacaat

SEQ ID NO: 1281752 - DNA, 23 bp, Homo sapiens
tcttatcaccacagtaagttcct

SEQ ID NO: 1281753 - DNA, 22 bp, Homo sapiens
tcttatccaacatcaacatctt

SEQ ID NO: 1281754 - DNA, 14 bp, Homo sapiens
tcttatccacaaag

SEQ ID NO: 1281755 - DNA, 16 bp, Homo sapiens
tcttatccacaaagta

SEQ ID NO: 1281756 - DNA, 15 bp, Homo sapiens
tcttatcccccccag

SEQ ID NO: 1281757 - DNA, 16 bp, Homo sapiens
tcttatcctctctctc

SEQ ID NO: 1281758 - DNA, 19 bp, Homo sapiens
tcttatcctctctctcttc

SEQ ID NO: 1281759 - DNA, 16 bp, Homo sapiens
tcttatgaggagggga

SEQ ID NO: 1281760 - DNA, 18 bp, Homo sapiens
tcttatggaattgatttg

SEQ ID NO: 1281761 - DNA, 22 bp, Homo sapiens
tcttatggaattgatttgcatt

SEQ ID NO: 1281762 - DNA, 14 bp, Homo sapiens
tcttatggcacaaa

SEQ ID NO: 1281763 - DNA, 16 bp, Homo sapiens
tcttatggcacaaaaa

SEQ ID NO: 1281764 - DNA, 19 bp, Homo sapiens
tcttatgtaaagtatgttt

SEQ ID NO: 1281765 - DNA, 19 bp, Homo sapiens
tcttatgtgacattaacaa

SEQ ID NO: 1281766 - DNA, 21 bp, Homo sapiens
tcttatgtgacattaacaaat

SEQ ID NO: 1281767 - DNA, 22 bp, Homo sapiens
tcttattaatcatacaaactct

SEQ ID NO: 1281768 - DNA, 21 bp, Homo sapiens
tcttattataaaatggacaca

SEQ ID NO: 1281769 - DNA, 17 bp, Homo sapiens
tcttattccaggagaag

SEQ ID NO: 1281770 - DNA, 21 bp, Homo sapiens
tcttattcccaaactacagaa

SEQ ID NO: 1281771 - DNA, 24 bp, Homo sapiens
tcttattcccaaactacagaataa

SEQ ID NO: 1281772 - DNA, 17 bp, Homo sapiens
tcttattgaataaagag

SEQ ID NO: 1281773 - DNA, 19 bp, Homo sapiens
tcttattgaatttgttaga

SEQ ID NO: 1281774 - DNA, 17 bp, Homo sapiens
tcttattgcaaggcagt

SEQ ID NO: 1281775 - DNA, 14 bp, Homo sapiens
tcttatttaactta

SEQ ID NO: 1281776 - DNA, 17 bp, Homo sapiens
tcttatttaatgaaaga

SEQ ID NO: 1281777 - DNA, 13 bp, Homo sapiens
tcttattttagta

SEQ ID NO: 1281778 - DNA, 16 bp, Homo sapiens
tcttattttagtatac

SEQ ID NO: 1281779 - DNA, 20 bp, Homo sapiens
tcttattttgcattccagaa

SEQ ID NO: 1281780 - DNA, 15 bp, Homo sapiens
tcttcaaagcagagt

SEQ ID NO: 1281781 - DNA, 14 bp, Homo sapiens
tcttcaaatgggag

SEQ ID NO: 1281782 - DNA, 16 bp, Homo sapiens
tcttcaaattagaaga

SEQ ID NO: 1281783 - DNA, 19 bp, Homo sapiens
tcttcaacatcaatgttca

SEQ ID NO: 1281784 - DNA, 20 bp, Homo sapiens
tcttcaacatcaatgttcat

SEQ ID NO: 1281785 - DNA, 23 bp, Homo sapiens
tcttcaacatcaatgttcattgt

SEQ ID NO: 1281786 - DNA, 13 bp, Homo sapiens
tcttcaacatgac

SEQ ID NO: 1281787 - DNA, 19 bp, Homo sapiens
tcttcaactgaccagcctc

SEQ ID NO: 1281788 - DNA, 17 bp, Homo sapiens
tcttcaagcctgggcgt

SEQ ID NO: 1281789 - DNA, 22 bp, Homo sapiens
tcttcaagctgtcccctctgtc

SEQ ID NO: 1281790 - DNA, 17 bp, Homo sapiens
tcttcaatatgaatcta

SEQ ID NO: 1281791 - DNA, 18 bp, Homo sapiens
tcttcaatatgaatctat

SEQ ID NO: 1281792 - DNA, 18 bp, Homo sapiens
tcttcaatttgtataaaa

SEQ ID NO: 1281793 - DNA, 13 bp, Homo sapiens
tcttcaccactgt

SEQ ID NO: 1281794 - DNA, 19 bp, Homo sapiens
tcttcacccagctaatctg

SEQ ID NO: 1281795 - DNA, 16 bp, Homo sapiens
tcttcaccctcccctt

SEQ ID NO: 1281796 - DNA, 23 bp, Homo sapiens
tcttcacctaagtctctgtgaat

SEQ ID NO: 1281797 - DNA, 18 bp, Homo sapiens
tcttcacctcctgccagc

SEQ ID NO: 1281798 - DNA, 15 bp, Homo sapiens
tcttcacctcttcca

SEQ ID NO: 1281799 - DNA, 15 bp, Homo sapiens
tcttcacctgttatg

SEQ ID NO: 1281800 - DNA, 16 bp, Homo sapiens
tcttcacctgttatgt

SEQ ID NO: 1281801 - DNA, 23 bp, Homo sapiens
tcttcacgacaatgttgagaagt

SEQ ID NO: 1281802 - DNA, 22 bp, Homo sapiens
tcttcactaccctgattcttga

SEQ ID NO: 1281803 - DNA, 14 bp, Homo sapiens
tcttcactccccct

SEQ ID NO: 1281804 - DNA, 14 bp, Homo sapiens
tcttcactcgcccc

SEQ ID NO: 1281805 - DNA, 15 bp, Homo sapiens
tcttcactgcaattt

SEQ ID NO: 1281806 - DNA, 20 bp, Homo sapiens
tcttcactgtggccacagcc

SEQ ID NO: 1281807 - DNA, 22 bp, Homo sapiens
tcttcactgtggccacagcccc

SEQ ID NO: 1281808 - DNA, 16 bp, Homo sapiens
tcttcacttaatccat

SEQ ID NO: 1281809 - DNA, 22 bp, Homo sapiens
tcttcacttgagttggctgtgt

SEQ ID NO: 1281810 - DNA, 22 bp, Homo sapiens
tcttcagaacacacagactttc

SEQ ID NO: 1281811 - DNA, 23 bp, Homo sapiens
tcttcagaacacacagactttct

SEQ ID NO: 1281812 - DNA, 19 bp, Homo sapiens
tcttcagaactgcccttgc

SEQ ID NO: 1281813 - DNA, 12 bp, Homo sapiens
tcttcagaactt

SEQ ID NO: 1281814 - DNA, 19 bp, Homo sapiens
tcttcagaattatccatta

SEQ ID NO: 1281815 - DNA, 15 bp, Homo sapiens
tcttcagacccagag

SEQ ID NO: 1281816 - DNA, 15 bp, Homo sapiens
tcttcagaggccctc

SEQ ID NO: 1281817 - DNA, 16 bp, Homo sapiens
tcttcagagtgaagaa

SEQ ID NO: 1281818 - DNA, 19 bp, Homo sapiens
tcttcagagtgaagaatct

SEQ ID NO: 1281819 - DNA, 20 bp, Homo sapiens
tcttcagagtgaagaatctt

SEQ ID NO: 1281820 - DNA, 22 bp, Homo sapiens
tcttcagatttaagttaaataa

SEQ ID NO: 1281821 - DNA, 13 bp, Homo sapiens
tcttcagcccagg

SEQ ID NO: 1281822 - DNA, 22 bp, Homo sapiens
tcttcagcctagccgacctcag

SEQ ID NO: 1281823 - DNA, 22 bp, Homo sapiens
tcttcaggatattggttcttcc

SEQ ID NO: 1281824 - DNA, 14 bp, Homo sapiens
tcttcaggcctccc

SEQ ID NO: 1281825 - DNA, 19 bp, Homo sapiens
tcttcaggtcgtagcattt

SEQ ID NO: 1281826 - DNA, 17 bp, Homo sapiens
tcttcaggtgaacactt

SEQ ID NO: 1281827 - DNA, 23 bp, Homo sapiens
tcttcaggtggaaaaacatctga

SEQ ID NO: 1281828 - DNA, 16 bp, Homo sapiens
tcttcaggttctcatg

SEQ ID NO: 1281829 - DNA, 15 bp, Homo sapiens
tcttcagtgtctctg

SEQ ID NO: 1281830 - DNA, 15 bp, Homo sapiens
tcttcagttgtctct

SEQ ID NO: 1281831 - DNA, 17 bp, Homo sapiens
tcttcagttgtctctga

SEQ ID NO: 1281832 - DNA, 13 bp, Homo sapiens
tcttgatgtgaag

SEQ ID NO: 1281833 - DNA, 21 bp, Homo sapiens
tcttgatgtgaagataatttg

SEQ ID NO: 1281834 - DNA, 18 bp, Homo sapiens
tcttgattataaatgttt

SEQ ID NO: 1281835 - DNA, 13 bp, Homo sapiens
tcttgattcctgg

SEQ ID NO: 1281836 - DNA, 14 bp, Homo sapiens
tcttgattcctggc

SEQ ID NO: 1281837 - DNA, 13 bp, Homo sapiens
tcttgatttggat

SEQ ID NO: 1281838 - DNA, 14 bp, Homo sapiens
tcttgatttttcgg

SEQ ID NO: 1281839 - DNA, 19 bp, Homo sapiens
tcttgcaaagcgacagatt

SEQ ID NO: 1281840 - DNA, 20 bp, Homo sapiens
tcttgcaagttaaggcttcc

SEQ ID NO: 1281841 - DNA, 22 bp, Homo sapiens
tcttgcaccaaattatcttgat

SEQ ID NO: 1281842 - DNA, 23 bp, Homo sapiens
tcttgcaccccaaagctttcctg

SEQ ID NO: 1281843 - DNA, 15 bp, Homo sapiens
tcttgcacccgcctc

SEQ ID NO: 1281844 - DNA, 19 bp, Homo sapiens
tcttgcacccgcctctccc

SEQ ID NO: 1281845 - DNA, 15 bp, Homo sapiens
tcttgcactccttcc

SEQ ID NO: 1281846 - DNA, 13 bp, Homo sapiens
tcttgcaggctga

SEQ ID NO: 1281847 - DNA, 23 bp, Homo sapiens
tcttgcagttttgtaagccctct

SEQ ID NO: 1281848 - DNA, 21 bp, Homo sapiens
tcttgcataggctcttaagca

SEQ ID NO: 1281849 - DNA, 20 bp, Homo sapiens
tcttgcatctaatgaaaaac

SEQ ID NO: 1281850 - DNA, 18 bp, Homo sapiens
tcttgccaccctctggga

SEQ ID NO: 1281851 - DNA, 11 bp, Homo sapiens
tcttgccagcc

SEQ ID NO: 1281852 - DNA, 18 bp, Homo sapiens
tcttgccagcctcaggct

SEQ ID NO: 1281853 - DNA, 20 bp, Homo sapiens
tcttgccagcctcaggcttg

SEQ ID NO: 1281854 - DNA, 19 bp, Homo sapiens
tcttgccagcctccttgct

SEQ ID NO: 1281855 - DNA, 16 bp, Homo sapiens
tcttgccatcctgatg

SEQ ID NO: 1281856 - DNA, 18 bp, Homo sapiens
tcttgccatcctgatgga

SEQ ID NO: 1281857 - DNA, 13 bp, Homo sapiens
tcttgcccatcct

SEQ ID NO: 1281858 - DNA, 20 bp, Homo sapiens
tcttgccccagtttggggtg

SEQ ID NO: 1281859 - DNA, 21 bp, Homo sapiens
tcttgccccccaccccagcct

SEQ ID NO: 1281860 - DNA, 13 bp, Homo sapiens
tcttgccccttgt

SEQ ID NO: 1281861 - DNA, 18 bp, Homo sapiens
tcttgcccttccctgtcc

SEQ ID NO: 1281862 - DNA, 15 bp, Homo sapiens
tcttgcctctgtgct

SEQ ID NO: 1281863 - DNA, 16 bp, Homo sapiens
tcttgcctctgtgctg

SEQ ID NO: 1281864 - DNA, 19 bp, Homo sapiens
tcttgcctctgtgctgtgt

SEQ ID NO: 1281865 - DNA, 23 bp, Homo sapiens
tcttgcctgtttcccaggcccac

SEQ ID NO: 1281866 - DNA, 23 bp, Homo sapiens
tcttgccttaaccagtctctcaa

SEQ ID NO: 1281867 - DNA, 17 bp, Homo sapiens
tcttgcgaatccaagct

SEQ ID NO: 1281868 - DNA, 21 bp, Homo sapiens
tcttgcgaatccaagctccct

SEQ ID NO: 1281869 - DNA, 17 bp, Homo sapiens
tcttgcgggcctggaca

SEQ ID NO: 1281870 - DNA, 16 bp, Homo sapiens
tcttgctcctggggag

SEQ ID NO: 1281871 - DNA, 14 bp, Homo sapiens
tcttgctctctctc

SEQ ID NO: 1281872 - DNA, 14 bp, Homo sapiens
tcttgctctgtccc

SEQ ID NO: 1281873 - DNA, 21 bp, Homo sapiens
tcttgctcttagattgggcca

SEQ ID NO: 1281874 - DNA, 21 bp, Homo sapiens
tcttgctctttctactctgaa

SEQ ID NO: 1281875 - DNA, 17 bp, Homo sapiens
tcttgctgaaagccaag

SEQ ID NO: 1281876 - DNA, 21 bp, Homo sapiens
tcttgctgatggctgctagat

SEQ ID NO: 1281877 - DNA, 15 bp, Homo sapiens
tcttgctgcaggccc

SEQ ID NO: 1281878 - DNA, 11 bp, Homo sapiens
tcttgctgggc

SEQ ID NO: 1281879 - DNA, 22 bp, Homo sapiens
tcttgctgtaactcagacattc

SEQ ID NO: 1281880 - DNA, 14 bp, Homo sapiens
tcttgctgtctctg

SEQ ID NO: 1281881 - DNA, 19 bp, Homo sapiens
tcttgctgtctctgctcgc

SEQ ID NO: 1281882 - DNA, 15 bp, Homo sapiens
tcttgctgttgacat

SEQ ID NO: 1281883 - DNA, 18 bp, Homo sapiens
tcttgcttccctaatcta

SEQ ID NO: 1281884 - DNA, 23 bp, Homo sapiens
tcttgcttccctaatctatggtc

SEQ ID NO: 1281885 - DNA, 20 bp, Homo sapiens
tcttgcttggggaacttgtg

SEQ ID NO: 1281886 - DNA, 14 bp, Homo sapiens
tcttgctttcttta

SEQ ID NO: 1281887 - DNA, 14 bp, Homo sapiens
tcttggaattacaa

SEQ ID NO: 1281888 - DNA, 16 bp, Homo sapiens
tcttggaccagtttgc

SEQ ID NO: 1281889 - DNA, 17 bp, Homo sapiens
tcttggaccagtttgca

SEQ ID NO: 1281890 - DNA, 20 bp, Homo sapiens
tcttggaccatgccagattc

SEQ ID NO: 1281891 - DNA, 18 bp, Homo sapiens
tcttggacctctgctctg

SEQ ID NO: 1281892 - DNA, 17 bp, Homo sapiens
tcttggagaagtctcag

SEQ ID NO: 1281893 - DNA, 17 bp, Homo sapiens
tcttggagcctaaagag

SEQ ID NO: 1281894 - DNA, 16 bp, Homo sapiens
tcttggataccagctc

SEQ ID NO: 1281895 - DNA, 22 bp, Homo sapiens
tcttggatggtgacattgaaac

SEQ ID NO: 1281896 - DNA, 15 bp, Homo sapiens
tcttggcaagatgtt

SEQ ID NO: 1281897 - DNA, 23 bp, Homo sapiens
tcttggcagcttaacattgactt

SEQ ID NO: 1281898 - DNA, 19 bp, Homo sapiens
tcttggcattaaaccacat

SEQ ID NO: 1281899 - DNA, 19 bp, Homo sapiens
tcttggcattggaattcta

SEQ ID NO: 1281900 - DNA, 19 bp, Homo sapiens
tcttggcattttcctcgcc

SEQ ID NO: 1281901 - DNA, 18 bp, Homo sapiens
tcttggcggcagcagcca

SEQ ID NO: 1281902 - DNA, 16 bp, Homo sapiens
tcttggctgacccctc

SEQ ID NO: 1281903 - DNA, 18 bp, Homo sapiens
tcttggcttaatcatttt

SEQ ID NO: 1281904 - DNA, 14 bp, Homo sapiens
tcttggcttccaga

SEQ ID NO: 1281905 - DNA, 16 bp, Homo sapiens
tcttggcttcccacca

SEQ ID NO: 1281906 - DNA, 20 bp, Homo sapiens
tcttggcttctcagcccctt

SEQ ID NO: 1281907 - DNA, 13 bp, Homo sapiens
tcttggcttctta

SEQ ID NO: 1281908 - DNA, 18 bp, Homo sapiens
tcttggcttcttaaaaac

SEQ ID NO: 1281909 - DNA, 15 bp, Homo sapiens
tcttggctttcatgt

SEQ ID NO: 1281910 - DNA, 16 bp, Homo sapiens
tcttgggaaagagaca

SEQ ID NO: 1281911 - DNA, 18 bp, Homo sapiens
tcttgggaaagagacaga

SEQ ID NO: 1281912 - DNA, 16 bp, Homo sapiens
tcttgggaactccact

SEQ ID NO: 1281913 - DNA, 18 bp, Homo sapiens
tcttgggaagtgtgttta

SEQ ID NO: 1281914 - DNA, 17 bp, Homo sapiens
tcttgggagtatgttgt

SEQ ID NO: 1281915 - DNA, 23 bp, Homo sapiens
tcttgggatagtgttctgctcct

SEQ ID NO: 1281916 - DNA, 20 bp, Homo sapiens
tcttgggcagagctggctct

SEQ ID NO: 1281917 - DNA, 13 bp, Homo sapiens
tcttgggcaggca

SEQ ID NO: 1281918 - DNA, 14 bp, Homo sapiens
tcttgggcaggcag

SEQ ID NO: 1281919 - DNA, 18 bp, Homo sapiens
tcttgggcaggcagagag

SEQ ID NO: 1281920 - DNA, 16 bp, Homo sapiens
tcttgggccccagacc

SEQ ID NO: 1281921 - DNA, 18 bp, Homo sapiens
tcttgggctgagtgcagc

SEQ ID NO: 1281922 - DNA, 23 bp, Homo sapiens
tcttgggctgagtgcagccaaag

SEQ ID NO: 1281923 - DNA, 17 bp, Homo sapiens
tcttggggaccctgcct

SEQ ID NO: 1281924 - DNA, 21 bp, Homo sapiens
tcttggggccactttcagagc

SEQ ID NO: 1281925 - DNA, 23 bp, Homo sapiens
tcttggggccactttcagagccc

SEQ ID NO: 1281926 - DNA, 13 bp, Homo sapiens
tcttgggggaggc

SEQ ID NO: 1281927 - DNA, 11 bp, Homo sapiens
tcttgggggtc

SEQ ID NO: 1281928 - DNA, 17 bp, Homo sapiens
tcttggggtcccaggga

SEQ ID NO: 1281929 - DNA, 19 bp, Homo sapiens
tcttggggtcccagggaag

SEQ ID NO: 1281930 - DNA, 17 bp, Homo sapiens
tcttgggtagggcagac

SEQ ID NO: 1281931 - DNA, 21 bp, Homo sapiens
tcttgggtctgccctgcccat

SEQ ID NO: 1281932 - DNA, 18 bp, Homo sapiens
tcttgggtggcgctggtg

SEQ ID NO: 1281933 - DNA, 18 bp, Homo sapiens
tcttgggtggttcctaag

SEQ ID NO: 1281934 - DNA, 19 bp, Homo sapiens
tcttgggtgtattctctgt

SEQ ID NO: 1281935 - DNA, 20 bp, Homo sapiens
tcttgggtgtattctctgta

SEQ ID NO: 1281936 - DNA, 14 bp, Homo sapiens
tcttggtagagatt

SEQ ID NO: 1281937 - DNA, 13 bp, Homo sapiens
tcttggtcagctt

SEQ ID NO: 1281938 - DNA, 17 bp, Homo sapiens
tcttggtgaaataataa

SEQ ID NO: 1281939 - DNA, 23 bp, Homo sapiens
tcttggtgaaataataaaatgca

SEQ ID NO: 1281940 - DNA, 20 bp, Homo sapiens
tcttggtgccttttgtgtga

SEQ ID NO: 1281941 - DNA, 20 bp, Homo sapiens
tcttggtgggtgtggccagc

SEQ ID NO: 1281942 - DNA, 14 bp, Homo sapiens
tcttggttcctgtt

SEQ ID NO: 1281943 - DNA, 15 bp, Homo sapiens
tcttggttcctgttt

SEQ ID NO: 1281944 - DNA, 17 bp, Homo sapiens
tcttggttcctgtttga

SEQ ID NO: 1281945 - DNA, 17 bp, Homo sapiens
tcttggtttcagccaag

SEQ ID NO: 1281946 - DNA, 22 bp, Homo sapiens
tcttggtttctctctacagtgc

SEQ ID NO: 1281947 - DNA, 18 bp, Homo sapiens
tcttggtttctggataaa

SEQ ID NO: 1281948 - DNA, 17 bp, Homo sapiens
tcttggtttggggagaa

SEQ ID NO: 1281949 - DNA, 18 bp, Homo sapiens
tcttggtttggggagaaa

SEQ ID NO: 1281950 - DNA, 16 bp, Homo sapiens
tcttggtttgtaaatt

SEQ ID NO: 1281951 - DNA, 20 bp, Homo sapiens
tcttggttttctctctggat

SEQ ID NO: 1281952 - DNA, 13 bp, Homo sapiens
tcttgtaaagact

SEQ ID NO: 1281953 - DNA, 17 bp, Homo sapiens
tcttgtaaataaagccc

SEQ ID NO: 1281954 - DNA, 17 bp, Homo sapiens
tctttgtaaaatcttgc

SEQ ID NO: 1281955 - DNA, 19 bp, Homo sapiens
tctttgtaaaatcttgcag

SEQ ID NO: 1281956 - DNA, 15 bp, Homo sapiens
tctttgtaagagcaa

SEQ ID NO: 1281957 - DNA, 17 bp, Homo sapiens
tctttgtaagagcaaaa

SEQ ID NO: 1281958 - DNA, 17 bp, Homo sapiens
tctttgtaccaaaattt

SEQ ID NO: 1281959 - DNA, 16 bp, Homo sapiens
tctttgtagaataaat

SEQ ID NO: 1281960 - DNA, 19 bp, Homo sapiens
tctttgtagaataaatggt

SEQ ID NO: 1281961 - DNA, 17 bp, Homo sapiens
tctttgtcccctgggtc

SEQ ID NO: 1281962 - DNA, 14 bp, Homo sapiens
tctttgtctttttc

SEQ ID NO: 1281963 - DNA, 21 bp, Homo sapiens
tctttgtgggagggtaagaca

SEQ ID NO: 1281964 - DNA, 13 bp, Homo sapiens
tctttgtgtaatc

SEQ ID NO: 1281965 - DNA, 13 bp, Homo sapiens
tctttgtgtagct

SEQ ID NO: 1281966 - DNA, 18 bp, Homo sapiens
tctttgtgtagctttgct

SEQ ID NO: 1281967 - DNA, 12 bp, Homo sapiens
tctttgtgtatg

SEQ ID NO: 1281968 - DNA, 13 bp, Homo sapiens
tctttgtgtgtta

SEQ ID NO: 1281969 - DNA, 14 bp, Homo sapiens
tctttgtgtgttat

SEQ ID NO: 1281970 - DNA, 15 bp, Homo sapiens
tctttgttataccat

SEQ ID NO: 1281971 - DNA, 15 bp, Homo sapiens
tctttgtttaaatgc

SEQ ID NO: 1281972 - DNA, 19 bp, Homo sapiens
tctttgtttaacaaaagat

SEQ ID NO: 1281973 - DNA, 19 bp, Homo sapiens
tctttgtttcctggcaata

SEQ ID NO: 1281974 - DNA, 20 bp, Homo sapiens
tctttgtttctttttacagc

SEQ ID NO: 1281975 - DNA, 23 bp, Homo sapiens
tctttgtttctttttacagcatt

SEQ ID NO: 1281976 - DNA, 21 bp, Homo sapiens
tcttttaaaaaattcttgtat

SEQ ID NO: 1281977 - DNA, 13 bp, Homo sapiens
tcttttaaaagac

SEQ ID NO: 1281978 - DNA, 14 bp, Homo sapiens
tcttttaaaagaca

SEQ ID NO: 1281979 - DNA, 16 bp, Homo sapiens
tcttttaaaagacaag

SEQ ID NO: 1281980 - DNA, 13 bp, Homo sapiens
tcttttaaaatat

SEQ ID NO: 1281981 - DNA, 22 bp, Homo sapiens
tcttttaaaatatcctgtaact

SEQ ID NO: 1281982 - DNA, 20 bp, Homo sapiens
tcttttaaagtatttataaa

SEQ ID NO: 1281983 - DNA, 18 bp, Homo sapiens
tcttttaaagtgttactt

SEQ ID NO: 1281984 - DNA, 23 bp, Homo sapiens
tcttttaaagtgttactttttgt

SEQ ID NO: 1281985 - DNA, 17 bp, Homo sapiens
tcttttaaattagaaaa

SEQ ID NO: 1281986 - DNA, 12 bp, Homo sapiens
tcttttaagcag

SEQ ID NO: 1281987 - DNA, 20 bp, Homo sapiens
tcttttaattgtttcagaat

SEQ ID NO: 1281988 - DNA, 12 bp, Homo sapiens
tcttttacaact

SEQ ID NO: 1281989 - DNA, 13 bp, Homo sapiens
tcttttacagact

SEQ ID NO: 1281990 - DNA, 15 bp, Homo sapiens
tcttttaccctgtgt

SEQ ID NO: 1281991 - DNA, 18 bp, Homo sapiens
tcttttagacaactagat

SEQ ID NO: 1281992 - DNA, 22 bp, Homo sapiens
tcttttagacaactagatttgt

SEQ ID NO: 1281993 - DNA, 17 bp, Homo sapiens
tcttttataatgattca

SEQ ID NO: 1281994 - DNA, 22 bp, Homo sapiens
tcttttataattctcattaaaa

SEQ ID NO: 1281995 - DNA, 14 bp, Homo sapiens
tcttttataggatt

SEQ ID NO: 1281996 - DNA, 15 bp, Homo sapiens
tcttttatgttcagc

SEQ ID NO: 1281997 - DNA, 16 bp, Homo sapiens
tcttttattatcagtt

SEQ ID NO: 1281998 - DNA, 13 bp, Homo sapiens
tcttttattctgt

SEQ ID NO: 1281999 - DNA, 21 bp, Homo sapiens
tcttttattctgttatatagt

SEQ ID NO: 1282000 - DNA, 15 bp, Homo sapiens
tcttttatttaacaa

SEQ ID NO: 1282001 - DNA, 22 bp, Homo sapiens
tcttttatttagggccttttct

SEQ ID NO: 1282002 - DNA, 13 bp, Homo sapiens
tcttttcacatta

SEQ ID NO: 1282003 - DNA, 19 bp, Homo sapiens
tcttttcagaagcaagcca

SEQ ID NO: 1282004 - DNA, 21 bp, Homo sapiens
tcttttcagaagcaagccaga

SEQ ID NO: 1282005 - DNA, 21 bp, Homo sapiens
tcttttcatatctcttgccct

SEQ ID NO: 1282006 - DNA, 19 bp, Homo sapiens
tcttttcccatttatctaa

SEQ ID NO: 1282007 - DNA, 19 bp, Homo sapiens
tcttttcccccattaatca

SEQ ID NO: 1282008 - DNA, 24 bp, Homo sapiens
tcttttccccctttgtgcacattt

SEQ ID NO: 1282009 - DNA, 19 bp, Homo sapiens
tcttttcccttaaatacag

SEQ ID NO: 1282010 - DNA, 11 bp, Homo sapiens
tcttttcctcg

SEQ ID NO: 1282011 - DNA, 22 bp, Homo sapiens
tcttttcctcgcagatgataaa

SEQ ID NO: 1282012 - DNA, 22 bp, Homo sapiens
tcttttctaagtggcgtgtgca

SEQ ID NO: 1282013 - DNA, 13 bp, Homo sapiens
tcttttctcctcc

SEQ ID NO: 1282014 - DNA, 17 bp, Homo sapiens
tcttttctcctttacca

SEQ ID NO: 1282015 - DNA, 13 bp, Homo sapiens
tcttttctctgtg

SEQ ID NO: 1282016 - DNA, 22 bp, Homo sapiens
tcttttctgtcaccaaatttgt

SEQ ID NO: 1282017 - DNA, 12 bp, Homo sapiens
tcttttctttaa

SEQ ID NO: 1282018 - DNA, 19 bp, Homo sapiens
tcttttgaatccatgcttg

SEQ ID NO: 1282019 - DNA, 18 bp, Homo sapiens
tcttttgaattgttacat

SEQ ID NO: 1282020 - DNA, 15 bp, Homo sapiens
tcttttgacatgtgg

SEQ ID NO: 1282021 - DNA, 22 bp, Homo sapiens
tcttttgaggatgggatgtatt

SEQ ID NO: 1282022 - DNA, 17 bp, Homo sapiens
tcttttgatcacattgt

SEQ ID NO: 1282023 - DNA, 19 bp, Homo sapiens
tcttttgctactaagttca

SEQ ID NO: 1282024 - DNA, 20 bp, Homo sapiens
tcttttgcttgccaaagtac

SEQ ID NO: 1282025 - DNA, 18 bp, Homo sapiens
tcttttgcttttggcaaa

SEQ ID NO: 1282026 - DNA, 14 bp, Homo sapiens
tcttttggccttgt

SEQ ID NO: 1282027 - DNA, 15 bp, Homo sapiens
tcttttggccttgtg

SEQ ID NO: 1282028 - DNA, 20 bp, Homo sapiens
tcttttggggaagtgaggaa

SEQ ID NO: 1282029 - DNA, 10 bp, Homo sapiens
tcttttgtat

SEQ ID NO: 1282030 - DNA, 20 bp, Homo sapiens
tcttttgtatgtaaatgtgc

SEQ ID NO: 1282031 - DNA, 22 bp, Homo sapiens
tcttttgtatgtaaatgtgcat

SEQ ID NO: 1282032 - DNA, 20 bp, Homo sapiens
tcttttgtgatgaacatatt

SEQ ID NO: 1282033 - DNA, 23 bp, Homo sapiens
tcttttgttctctgaattttcag

SEQ ID NO: 1282034 - DNA, 14 bp, Homo sapiens
tcttttgtttcctt

SEQ ID NO: 1282035 - DNA, 12 bp, Homo sapiens
tctttttaaagt

SEQ ID NO: 1282036 - DNA, 23 bp, Homo sapiens
tctttttaaagtgtttctgttat

SEQ ID NO: 1282037 - DNA, 14 bp, Homo sapiens
tctttttaagagat

SEQ ID NO: 1282038 - DNA, 19 bp, Homo sapiens
tctttttacagcattgtct

SEQ ID NO: 1282039 - DNA, 14 bp, Homo sapiens
tctttttatacaca

SEQ ID NO: 1282040 - DNA, 12 bp, Homo sapiens
tctttttatctc

SEQ ID NO: 1282041 - DNA, 14 bp, Homo sapiens
tctttttatgcatt

SEQ ID NO: 1282042 - DNA, 15 bp, Homo sapiens
tctttttattgaatc

SEQ ID NO: 1282043 - DNA, 20 bp, Homo sapiens
tctttttatttctgatagtt

SEQ ID NO: 1282044 - DNA, 11 bp, Homo sapiens
tctttttcatc

SEQ ID NO: 1282045 - DNA, 18 bp, Homo sapiens
tctttttcgtctatatat

SEQ ID NO: 1282046 - DNA, 12 bp, Homo sapiens
tctttttctacc

SEQ ID NO: 1282047 - DNA, 11 bp, Homo sapiens
tctttttctcc

SEQ ID NO: 1282048 - DNA, 20 bp, Homo sapiens
tctttttctgaactccattt

SEQ ID NO: 1282049 - DNA, 13 bp, Homo sapiens
tctttttctggaa

SEQ ID NO: 1282050 - DNA, 14 bp, Homo sapiens
tctttttctggact

SEQ ID NO: 1282051 - DNA, 23 bp, Homo sapiens
tctttttcttaccagtctcctcc

SEQ ID NO: 1282052 - DNA, 15 bp, Homo sapiens
tctttttcttcttcc

SEQ ID NO: 1282053 - DNA, 13 bp, Homo sapiens
tctttttgccctt

SEQ ID NO: 1282054 - DNA, 13 bp, Homo sapiens
tcttttttaaagt

SEQ ID NO: 1282055 - DNA, 15 bp, Homo sapiens
tcttttttatgtgat

SEQ ID NO: 1282056 - DNA, 13 bp, Homo sapiens
tcttttttatgtt

SEQ ID NO: 1282057 - DNA, 13 bp, Homo sapiens
tcttttttcaaaa

SEQ ID NO: 1282058 - DNA, 23 bp, Homo sapiens
tcttttttcatggacactttgaa

SEQ ID NO: 1282059 - DNA, 14 bp, Homo sapiens
tctttttttaaaag

SEQ ID NO: 1282060 - DNA, 22 bp, Homo sapiens
tctttttttggtaaatttttga

SEQ ID NO: 1282061 - DNA, 23 bp, Homo sapiens
tctttttttgtatagttaacaca

SEQ ID NO: 1282062 - DNA, 13 bp, Homo sapiens
tctttttttttcc

SEQ ID NO: 1282063 - DNA, 23 bp, Homo sapiens
tctttttttttttttaaagacag

SEQ ID NO: 1282064 - DNA, 21 bp, Homo sapiens
tctttttttttttttttgaaa

SEQ ID NO: 1282065 - DNA, 22 bp, Homo sapiens
tgaaaaaaaaaatgttgagaag

SEQ ID NO: 1282066 - DNA, 16 bp, Homo sapiens
tgaaaaaaaagtttca

SEQ ID NO: 1282067 - DNA, 13 bp, Homo sapiens
tgaaaaaaagaaa

SEQ ID NO: 1282068 - DNA, 16 bp, Homo sapiens
tgaaaaaaagaaacga

SEQ ID NO: 1282069 - DNA, 20 bp, Homo sapiens
tgaaaaaagaaaatggctaa

SEQ ID NO: 1282070 - DNA, 18 bp, Homo sapiens
tgaaaaacacggcagctg

SEQ ID NO: 1282071 - DNA, 9 bp, Homo sapiens
tgaaaaaga

SEQ ID NO: 1282072 - DNA, 13 bp, Homo sapiens
tgaaaaagaagaa

SEQ ID NO: 1282073 - DNA, 23 bp, Homo sapiens
tgaaaaagagaacagaaaacaac

SEQ ID NO: 1282074 - DNA, 21 bp, Homo sapiens
tgaaaaagcagctaccaggtg

SEQ ID NO: 1282075 - DNA, 22 bp, Homo sapiens
tgaaaaagctgcttcttattaa

SEQ ID NO: 1282076 - DNA, 15 bp, Homo sapiens
tgaaatgcttttata

SEQ ID NO: 1282077 - DNA, 18 bp, Homo sapiens
tgaaatgcttttatattc

SEQ ID NO: 1282078 - DNA, 16 bp, Homo sapiens
tgaaatggaggtcctt

SEQ ID NO: 1282079 - DNA, 14 bp, Homo sapiens
tgaaatggcattta

SEQ ID NO: 1282080 - DNA, 19 bp, Homo sapiens
tgaaatgggagatggtcag

SEQ ID NO: 1282081 - DNA, 16 bp, Homo sapiens
tgaaatgggcatttat

SEQ ID NO: 1282082 - DNA, 19 bp, Homo sapiens
tgaaatgtaacatgaagca

SEQ ID NO: 1282083 - DNA, 15 bp, Homo sapiens
tgaaatgtaaggctg

SEQ ID NO: 1282084 - DNA, 19 bp, Homo sapiens
tgaaatgtaaggctgtgta

SEQ ID NO: 1282085 - DNA, 20 bp, Homo sapiens
tgaaatgtagaattgaaaat

SEQ ID NO: 1282086 - DNA, 10 bp, Homo sapiens
tgaaatgtat

SEQ ID NO: 1282087 - DNA, 22 bp, Homo sapiens
tgaaatgtataattaacttaac

SEQ ID NO: 1282088 - DNA, 23 bp, Homo sapiens
tgaaatgtcgatcaagagaatca

SEQ ID NO: 1282089 - DNA, 11 bp, Homo sapiens
tgaaatgtgaa

SEQ ID NO: 1282090 - DNA, 21 bp, Homo sapiens
tgaaatgtgaacgtccttcct

SEQ ID NO: 1282091 - DNA, 15 bp, Homo sapiens
tgaaatgtgtttctg

SEQ ID NO: 1282092 - DNA, 21 bp, Homo sapiens
tgaaatgttaacaatgcctat

SEQ ID NO: 1282093 - DNA, 20 bp, Homo sapiens
tgaaatgtttggattctctt

SEQ ID NO: 1282094 - DNA, 20 bp, Homo sapiens
tgaaattaaagaaatgaaaa

SEQ ID NO: 1282095 - DNA, 17 bp, Homo sapiens
tgaaattaacctctcac

SEQ ID NO: 1282096 - DNA, 19 bp, Homo sapiens
tgaaattaagaaggcaaaa

SEQ ID NO: 1282097 - DNA, 21 bp, Homo sapiens
tgaaattaagaaggcaaaaat

SEQ ID NO: 1282098 - DNA, 24 bp, Homo sapiens
tgaaattaagcattttgaaacaaa

SEQ ID NO: 1282099 - DNA, 14 bp, Homo sapiens
tgaaattaatttgt

SEQ ID NO: 1282100 - DNA, 20 bp, Homo sapiens
tgaaattactacaaaatttg

SEQ ID NO: 1282101 - DNA, 14 bp, Homo sapiens
tgaaattactgtgt

SEQ ID NO: 1282102 - DNA, 18 bp, Homo sapiens
tgaaattactgtgtaaat

SEQ ID NO: 1282103 - DNA, 23 bp, Homo sapiens
tgaaattactgtgtaaatatatg

SEQ ID NO: 1282104 - DNA, 19 bp, Homo sapiens
tgaaattatgtatgtttac

SEQ ID NO: 1282105 - DNA, 23 bp, Homo sapiens
tgaaattatgtatgtttacatat

SEQ ID NO: 1282106 - DNA, 22 bp, Homo sapiens
tgaaattccagcaataagaaat

SEQ ID NO: 1282107 - DNA, 15 bp, Homo sapiens
tgaaattcctccttc

SEQ ID NO: 1282108 - DNA, 13 bp, Homo sapiens
tgaaattctttta

SEQ ID NO: 1282109 - DNA, 14 bp, Homo sapiens
tgaaattgtacata

SEQ ID NO: 1282110 - DNA, 17 bp, Homo sapiens
tgaaattgtagtgcaaa

SEQ ID NO: 1282111 - DNA, 23 bp, Homo sapiens
tgaaattgtatagtgttgatttg

SEQ ID NO: 1282112 - DNA, 19 bp, Homo sapiens
tgaaattgtatctcagtct

SEQ ID NO: 1282113 - DNA, 21 bp, Homo sapiens
tgaaatttagtacactatgtt

SEQ ID NO: 1282114 - DNA, 21 bp, Homo sapiens
tgaaatttattagttaatata

SEQ ID NO: 1282115 - DNA, 14 bp, Homo sapiens
tgaaatttcatgat

SEQ ID NO: 1282116 - DNA, 17 bp, Homo sapiens
tgaaatttcatgattgg

SEQ ID NO: 1282117 - DNA, 16 bp, Homo sapiens
tgaaatttgcctctgt

SEQ ID NO: 1282118 - DNA, 18 bp, Homo sapiens
tgaaatttgcctctgtcc

SEQ ID NO: 1282119 - DNA, 14 bp, Homo sapiens
tgaaattttaacct

SEQ ID NO: 1282120 - DNA, 20 bp, Homo sapiens
tgaaattttaacctatgata

SEQ ID NO: 1282121 - DNA, 22 bp, Homo sapiens
tgaaattttaacctatgatatt

SEQ ID NO: 1282122 - DNA, 16 bp, Homo sapiens
tgaaattttatatgct

SEQ ID NO: 1282123 - DNA, 22 bp, Homo sapiens
tgaaattttatatgcttactga

SEQ ID NO: 1282124 - DNA, 12 bp, Homo sapiens
tgaaattttcag

SEQ ID NO: 1282125 - DNA, 18 bp, Homo sapiens
tgaaattttcaggtagtc

SEQ ID NO: 1282126 - DNA, 17 bp, Homo sapiens
tgaaattttctagactt

SEQ ID NO: 1282127 - DNA, 15 bp, Homo sapiens
tgaaatttttattaa

SEQ ID NO: 1282128 - DNA, 13 bp, Homo sapiens
tgaaatttttctt

SEQ ID NO: 1282129 - DNA, 15 bp, Homo sapiens
tgaaatttttcttct

SEQ ID NO: 1282130 - DNA, 20 bp, Homo sapiens
tgaacaaaaatgtttccact

SEQ ID NO: 1282131 - DNA, 14 bp, Homo sapiens
tgaacaaaagattg

SEQ ID NO: 1282132 - DNA, 13 bp, Homo sapiens
tgaacaaactaaa

SEQ ID NO: 1282133 - DNA, 17 bp, Homo sapiens
tgaacaaagcagccacg

SEQ ID NO: 1282134 - DNA, 16 bp, Homo sapiens
tgaacaaatatgcttt

SEQ ID NO: 1282135 - DNA, 18 bp, Homo sapiens
tgaacaagaattggaagc

SEQ ID NO: 1282136 - DNA, 18 bp, Homo sapiens
tgaacaagttttaatgta

SEQ ID NO: 1282137 - DNA, 19 bp, Homo sapiens
tgaacaagttttaatgtat

SEQ ID NO: 1282138 - DNA, 23 bp, Homo sapiens
tgaacacacacgccagctcctct

SEQ ID NO: 1282139 - DNA, 14 bp, Homo sapiens
tgaacacagtgtct

SEQ ID NO: 1282140 - DNA, 19 bp, Homo sapiens
tgaacacagtgtctgttca

SEQ ID NO: 1282141 - DNA, 20 bp, Homo sapiens
tgaacacagtgtctgttcag

SEQ ID NO: 1282142 - DNA, 19 bp, Homo sapiens
tgaacacatgtgtatgata

SEQ ID NO: 1282143 - DNA, 17 bp, Homo sapiens
tgaacacatttgcccaa

SEQ ID NO: 1282144 - DNA, 20 bp, Homo sapiens
tgaacaccattgaaggctta

SEQ ID NO: 1282145 - DNA, 17 bp, Homo sapiens
tgaacactagtctgtgt

SEQ ID NO: 1282146 - DNA, 14 bp, Homo sapiens
tgaacactggggga

SEQ ID NO: 1282147 - DNA, 13 bp, Homo sapiens
tgaacactgtgac

SEQ ID NO: 1282148 - DNA, 16 bp, Homo sapiens
tgaacactgtgaccag

SEQ ID NO: 1282149 - DNA, 14 bp, Homo sapiens
tgaacacttagtga

SEQ ID NO: 1282150 - DNA, 18 bp, Homo sapiens
tgaacacttagtgatcat

SEQ ID NO: 1282151 - DNA, 13 bp, Homo sapiens
tgaacagaacata

SEQ ID NO: 1282152 - DNA, 21 bp, Homo sapiens
tgaacagactagaagtatttg

SEQ ID NO: 1282153 - DNA, 19 bp, Homo sapiens
tgaacagctctgagatcct

SEQ ID NO: 1282154 - DNA, 24 bp, Homo sapiens
tgaacagctgtgagccatgcctcc

SEQ ID NO: 1282155 - DNA, 20 bp, Homo sapiens
tgaacagctgtgtctgccaa

SEQ ID NO: 1282156 - DNA, 14 bp, Homo sapiens
tgaacagcttgctg

SEQ ID NO: 1282157 - DNA, 14 bp, Homo sapiens
tgaacaggctgggg

SEQ ID NO: 1282158 - DNA, 14 bp, Homo sapiens
tgaacagggcccag

SEQ ID NO: 1282159 - DNA, 19 bp, Homo sapiens
tgaacagggcccaggcctg

SEQ ID NO: 1282160 - DNA, 22 bp, Homo sapiens
tgaacagggcccaggcctggag

SEQ ID NO: 1282161 - DNA, 23 bp, Homo sapiens
tgaacagggcccaggcctggagc

SEQ ID NO: 1282162 - DNA, 21 bp, Homo sapiens
tgaacatacttcaaaaataat

SEQ ID NO: 1282163 - DNA, 22 bp, Homo sapiens
tgaacatacttcaaaaataatg

SEQ ID NO: 1282164 - DNA, 17 bp, Homo sapiens
tgaacatcccctcccat

SEQ ID NO: 1282165 - DNA, 16 bp, Homo sapiens
tgaacatctcttgaaa

SEQ ID NO: 1282166 - DNA, 20 bp, Homo sapiens
tgaacatctgagtcctggat

SEQ ID NO: 1282167 - DNA, 15 bp, Homo sapiens
tgaacatgcctgcca

SEQ ID NO: 1282168 - DNA, 18 bp, Homo sapiens
tgaacatgggagctcttg

SEQ ID NO: 1282169 - DNA, 15 bp, Homo sapiens
tgaacatgtacacaa

SEQ ID NO: 1282170 - DNA, 18 bp, Homo sapiens
tgaacatgtgccttttct

SEQ ID NO: 1282171 - DNA, 17 bp, Homo sapiens
tgaacatgtttacaggt

SEQ ID NO: 1282172 - DNA, 13 bp, Homo sapiens
tgaacattccaga

SEQ ID NO: 1282173 - DNA, 14 bp, Homo sapiens
tgaacattccagag

SEQ ID NO: 1282174 - DNA, 18 bp, Homo sapiens
tgaacattcccagcccag

SEQ ID NO: 1282175 - DNA, 23 bp, Homo sapiens
tgaacattgtactgttgctttaa

SEQ ID NO: 1282176 - DNA, 23 bp, Homo sapiens
tgaacatttgggttactatttct

SEQ ID NO: 1282177 - DNA, 14 bp, Homo sapiens
tgaaccaaagcctc

SEQ ID NO: 1282178 - DNA, 16 bp, Homo sapiens
tgaaccaacagaagca

SEQ ID NO: 1282179 - DNA, 17 bp, Homo sapiens
tgaaccaacagaagcag

SEQ ID NO: 1282180 - DNA, 13 bp, Homo sapiens
tgaaccaatgcaa

SEQ ID NO: 1282181 - DNA, 14 bp, Homo sapiens
tgaaccaatgcaag

SEQ ID NO: 1282182 - DNA, 14 bp, Homo sapiens
tgaaccacagaaat

SEQ ID NO: 1282183 - DNA, 16 bp, Homo sapiens
tgaaccacgaggctgc

SEQ ID NO: 1282184 - DNA, 17 bp, Homo sapiens
tgaaccacgaggctgcc

SEQ ID NO: 1282185 - DNA, 13 bp, Homo sapiens
tgaaccactgctt

SEQ ID NO: 1282186 - DNA, 15 bp, Homo sapiens
tgaaccactgcttct

SEQ ID NO: 1282187 - DNA, 20 bp, Homo sapiens
tgaaccactgcttctctttt

SEQ ID NO: 1282188 - DNA, 23 bp, Homo sapiens
tgaaccactgcttctcttttgaa

SEQ ID NO: 1282189 - DNA, 14 bp, Homo sapiens
tgaaccacttccct

SEQ ID NO: 1282190 - DNA, 15 bp, Homo sapiens
tgaaccacttccctc

SEQ ID NO: 1282191 - DNA, 16 bp, Homo sapiens
tgaaccacttccctca

SEQ ID NO: 1282192 - DNA, 21 bp, Homo sapiens
tgaaccatcattataaacgtg

SEQ ID NO: 1282193 - DNA, 19 bp, Homo sapiens
tgaaccatctcagaccttt

SEQ ID NO: 1282194 - DNA, 20 bp, Homo sapiens
tgaaccatggtgaagtgctt

SEQ ID NO: 1282195 - DNA, 16 bp, Homo sapiens
tgaacccacacctggg

SEQ ID NO: 1282196 - DNA, 20 bp, Homo sapiens
tgaacccaggacgcttctga

SEQ ID NO: 1282197 - DNA, 21 bp, Homo sapiens
tgaacccaggacgcttctgaa

SEQ ID NO: 1282198 - DNA, 16 bp, Homo sapiens
tgaaggaagagaagac

SEQ ID NO: 1282199 - DNA, 21 bp, Homo sapiens
tgaaggaatagccagagagga

SEQ ID NO: 1282200 - DNA, 20 bp, Homo sapiens
tgaaggaatatatggcagag

SEQ ID NO: 1282201 - DNA, 21 bp, Homo sapiens
tgaaggaatatatggcagagt

SEQ ID NO: 1282202 - DNA, 21 bp, Homo sapiens
tgaaggaatcattccagtgct

SEQ ID NO: 1282203 - DNA, 20 bp, Homo sapiens
tgaaggactggattggccaa

SEQ ID NO: 1282204 - DNA, 20 bp, Homo sapiens
tgaaggagagcccttcattt

SEQ ID NO: 1282205 - DNA, 18 bp, Homo sapiens
tgaaggagccacgtgaat

SEQ ID NO: 1282206 - DNA, 11 bp, Homo sapiens
tgaaggagccc

SEQ ID NO: 1282207 - DNA, 20 bp, Homo sapiens
tgaaggattgcatcctgctg

SEQ ID NO: 1282208 - DNA, 21 bp, Homo sapiens
tgaaggcaaaaactgtactgt

SEQ ID NO: 1282209 - DNA, 22 bp, Homo sapiens
tgaaggcaaaaactgtactgtg

SEQ ID NO: 1282210 - DNA, 17 bp, Homo sapiens
tgaaggcaaaattgcaa

SEQ ID NO: 1282211 - DNA, 23 bp, Homo sapiens
tgaaggcccaagagcagagtctg

SEQ ID NO: 1282212 - DNA, 19 bp, Homo sapiens
tgaaggccttattctacat

SEQ ID NO: 1282213 - DNA, 19 bp, Homo sapiens
tgaaggcttctctctgtgg

SEQ ID NO: 1282214 - DNA, 21 bp, Homo sapiens
tgaagggaaggcaaaggcaga

SEQ ID NO: 1282215 - DNA, 19 bp, Homo sapiens
tgaagggagagccagctcc

SEQ ID NO: 1282216 - DNA, 13 bp, Homo sapiens
tgaagggatgggg

SEQ ID NO: 1282217 - DNA, 17 bp, Homo sapiens
tgaagggatgggggaag

SEQ ID NO: 1282218 - DNA, 19 bp, Homo sapiens
tgaagggcaagaaatggcg

SEQ ID NO: 1282219 - DNA, 17 bp, Homo sapiens
tgaaggggaaacacaca

SEQ ID NO: 1282220 - DNA, 21 bp, Homo sapiens
tgaaggggtgcacccacctgt

SEQ ID NO: 1282221 - DNA, 21 bp, Homo sapiens
tgaaggtaaaattgaaaggca

SEQ ID NO: 1282222 - DNA, 18 bp, Homo sapiens
tgaaggtaaataaaaaga

SEQ ID NO: 1282223 - DNA, 20 bp, Homo sapiens
tgaaggtaaataaaaagaaa

SEQ ID NO: 1282224 - DNA, 16 bp, Homo sapiens
tgaaggtattggcctg

SEQ ID NO: 1282225 - DNA, 22 bp, Homo sapiens
tgaaggtattttgtagatgtga

SEQ ID NO: 1282226 - DNA, 15 bp, Homo sapiens
tgaaggtggggagaa

SEQ ID NO: 1282227 - DNA, 20 bp, Homo sapiens
tgaaggttaggatttaacag

SEQ ID NO: 1282228 - DNA, 18 bp, Homo sapiens
tgaaggttcccaaggaca

SEQ ID NO: 1282229 - DNA, 14 bp, Homo sapiens
tgaaggtttacaat

SEQ ID NO: 1282230 - DNA, 23 bp, Homo sapiens
tgaaggtttacaatttacaaagt

SEQ ID NO: 1282231 - DNA, 18 bp, Homo sapiens
tgaaggtttcagatgagg

SEQ ID NO: 1282232 - DNA, 23 bp, Homo sapiens
tgaaggttttttttttaagtgca

SEQ ID NO: 1282233 - DNA, 14 bp, Homo sapiens
tgaagtaaacagct

SEQ ID NO: 1282234 - DNA, 16 bp, Homo sapiens
tgaagtaaacagctgt

SEQ ID NO: 1282235 - DNA, 17 bp, Homo sapiens
tgaagtaaacagctgtg

SEQ ID NO: 1282236 - DNA, 14 bp, Homo sapiens
tgaagtaaactttt

SEQ ID NO: 1282237 - DNA, 16 bp, Homo sapiens
tgaagtaaactttttg

SEQ ID NO: 1282238 - DNA, 23 bp, Homo sapiens
tgaagtaacatgcatactttatt

SEQ ID NO: 1282239 - DNA, 14 bp, Homo sapiens
tgaagtaatgaatt

SEQ ID NO: 1282240 - DNA, 20 bp, Homo sapiens
tgaagtaatgaatttttatg

SEQ ID NO: 1282241 - DNA, 18 bp, Homo sapiens
tgaagtacaaacatgaaa

SEQ ID NO: 1282242 - DNA, 20 bp, Homo sapiens
tgaagtacttaaacttccac

SEQ ID NO: 1282243 - DNA, 14 bp, Homo sapiens
tgaagtagtttgta

SEQ ID NO: 1282244 - DNA, 13 bp, Homo sapiens
tgaagtataaatc

SEQ ID NO: 1282245 - DNA, 15 bp, Homo sapiens
tgaagtatactgtat

SEQ ID NO: 1282246 - DNA, 21 bp, Homo sapiens
tgaagtatacttttcccctgt

SEQ ID NO: 1282247 - DNA, 19 bp, Homo sapiens
tgaagtcaccgggatgaac

SEQ ID NO: 1282248 - DNA, 18 bp, Homo sapiens
tgaagtcagccacactgg

SEQ ID NO: 1282249 - DNA, 21 bp, Homo sapiens
tgaagtcattgtcgctcagca

SEQ ID NO: 1282250 - DNA, 17 bp, Homo sapiens
tgaagtccaaattgttt

SEQ ID NO: 1282251 - DNA, 13 bp, Homo sapiens
tgaagtcttccct

SEQ ID NO: 1282252 - DNA, 17 bp, Homo sapiens
tgaagtcttttctgtca

SEQ ID NO: 1282253 - DNA, 18 bp, Homo sapiens
tgaagtgcatccaaaggt

SEQ ID NO: 1282254 - DNA, 18 bp, Homo sapiens
tgaagtgctgtttattaa

SEQ ID NO: 1282255 - DNA, 22 bp, Homo sapiens
tgaagtgctgtttattaatctt

SEQ ID NO: 1282256 - DNA, 16 bp, Homo sapiens
tgaagtggccctccct

SEQ ID NO: 1282257 - DNA, 17 bp, Homo sapiens
tgaagtggccctccctc

SEQ ID NO: 1282258 - DNA, 16 bp, Homo sapiens
tgaagtggctggtaga

SEQ ID NO: 1282259 - DNA, 19 bp, Homo sapiens
tgaagtgggaaaaaataga

SEQ ID NO: 1282260 - DNA, 17 bp, Homo sapiens
tgaagtgtaggcagaca

SEQ ID NO: 1282261 - DNA, 19 bp, Homo sapiens
tgaagtgtaggcagacaca

SEQ ID NO: 1282262 - DNA, 12 bp, Homo sapiens
tgaagtgtcttc

SEQ ID NO: 1282263 - DNA, 15 bp, Homo sapiens
tgaagtgtggctggt

SEQ ID NO: 1282264 - DNA, 21 bp, Homo sapiens
tgaagtgtggctggtgtcccc

SEQ ID NO: 1282265 - DNA, 18 bp, Homo sapiens
tgaagtgtgtccatcctg

SEQ ID NO: 1282266 - DNA, 16 bp, Homo sapiens
tgaagttactttatgt

SEQ ID NO: 1282267 - DNA, 16 bp, Homo sapiens
tgaagttagtggaaat

SEQ ID NO: 1282268 - DNA, 21 bp, Homo sapiens
tgaagttagtggaaatctgaa

SEQ ID NO: 1282269 - DNA, 14 bp, Homo sapiens
tgaagttctgagcc

SEQ ID NO: 1282270 - DNA, 12 bp, Homo sapiens
tgaagttgctgt

SEQ ID NO: 1282271 - DNA, 17 bp, Homo sapiens
tgaagttgctgtttatt

SEQ ID NO: 1282272 - DNA, 14 bp, Homo sapiens
tgaagttggacagc

SEQ ID NO: 1282273 - DNA, 16 bp, Homo sapiens
tgaagttggcacattt

SEQ ID NO: 1282274 - DNA, 22 bp, Homo sapiens
tgaagttggcacatttcatgag

SEQ ID NO: 1282275 - DNA, 20 bp, Homo sapiens
tgaagttgttactaactaaa

SEQ ID NO: 1282276 - DNA, 16 bp, Homo sapiens
tgaagttgtttatcaa

SEQ ID NO: 1282277 - DNA, 20 bp, Homo sapiens
tgaagttgtttatcaacttc

SEQ ID NO: 1282278 - DNA, 14 bp, Homo sapiens
tgaagtttcacatg

SEQ ID NO: 1282279 - DNA, 15 bp, Homo sapiens
tgaagtttcatttat

SEQ ID NO: 1282280 - DNA, 18 bp, Homo sapiens
tgaagtttccgcccccgc

SEQ ID NO: 1282281 - DNA, 14 bp, Homo sapiens
tgaagtttgaacca

SEQ ID NO: 1282282 - DNA, 14 bp, Homo sapiens
tgaagttttacatt

SEQ ID NO: 1282283 - DNA, 17 bp, Homo sapiens
tgaagttttacattgtt

SEQ ID NO: 1282284 - DNA, 20 bp, Homo sapiens
tgaagttttggagagggaag

SEQ ID NO: 1282285 - DNA, 22 bp, Homo sapiens
tgaagtttttttgctgctgcct

SEQ ID NO: 1282286 - DNA, 14 bp, Homo sapiens
tgaataaaaaagat

SEQ ID NO: 1282287 - DNA, 21 bp, Homo sapiens
tgaataaaaaagattctacta

SEQ ID NO: 1282288 - DNA, 22 bp, Homo sapiens
tgaataaaaaagattctactaa

SEQ ID NO: 1282289 - DNA, 11 bp, Homo sapiens
tgaataaaaag

SEQ ID NO: 1282290 - DNA, 19 bp, Homo sapiens
tgaataaaaagtgaacttt

SEQ ID NO: 1282291 - DNA, 14 bp, Homo sapiens
tgaataaaaatgca

SEQ ID NO: 1282292 - DNA, 19 bp, Homo sapiens
tgaataaaacactcatccc

SEQ ID NO: 1282293 - DNA, 14 bp, Homo sapiens
tgaataaaagtgca

SEQ ID NO: 1282294 - DNA, 15 bp, Homo sapiens
tgaataaaagtgcac

SEQ ID NO: 1282295 - DNA, 15 bp, Homo sapiens
tgaataaactgaata

SEQ ID NO: 1282296 - DNA, 17 bp, Homo sapiens
tgaataaactgaatatt

SEQ ID NO: 1282297 - DNA, 23 bp, Homo sapiens
tgaataaagaatgccatttctca

SEQ ID NO: 1282298 - DNA, 14 bp, Homo sapiens
tgaataaagacacc

SEQ ID NO: 1282299 - DNA, 13 bp, Homo sapiens
tgaataaagagcc

SEQ ID NO: 1282300 - DNA, 17 bp, Homo sapiens
tgaataaagttgaagct

SEQ ID NO: 1282301 - DNA, 16 bp, Homo sapiens
tgaataaataaatgta

SEQ ID NO: 1282302 - DNA, 17 bp, Homo sapiens
tgaataaatacctctta

SEQ ID NO: 1282303 - DNA, 14 bp, Homo sapiens
tgaataaatgagaa

SEQ ID NO: 1282304 - DNA, 15 bp, Homo sapiens
tgaataaatgagaaa

SEQ ID NO: 1282305 - DNA, 12 bp, Homo sapiens
tgaataaatgtg

SEQ ID NO: 1282306 - DNA, 13 bp, Homo sapiens
tgaataaatgtgt

SEQ ID NO: 1282307 - DNA, 16 bp, Homo sapiens
tgaataaattttcaaa

SEQ ID NO: 1282308 - DNA, 23 bp, Homo sapiens
tgaataacagtagtcctttgata

SEQ ID NO: 1282309 - DNA, 15 bp, Homo sapiens
tgaataacatttaaa

SEQ ID NO: 1282310 - DNA, 17 bp, Homo sapiens
tgaataataaatacaca

SEQ ID NO: 1282311 - DNA, 16 bp, Homo sapiens
tgaataatatcaaata

SEQ ID NO: 1282312 - DNA, 21 bp, Homo sapiens
tgaataatgcctttgtaacca

SEQ ID NO: 1282313 - DNA, 16 bp, Homo sapiens
tgaataatttattatt

SEQ ID NO: 1282314 - DNA, 15 bp, Homo sapiens
tgaataatttcccaa

SEQ ID NO: 1282315 - DNA, 12 bp, Homo sapiens
tgaatacaatta

SEQ ID NO: 1282316 - DNA, 15 bp, Homo sapiens
tgaatacaattaaag

SEQ ID NO: 1282317 - DNA, 15 bp, Homo sapiens
tgaatacacagtatt

SEQ ID NO: 1282318 - DNA, 13 bp, Homo sapiens
tgaatacattaac

SEQ ID NO: 1282319 - DNA, 20 bp, Homo sapiens
tgaatacattaacggtgcta

SEQ ID NO: 1282320 - DNA, 11 bp, Homo sapiens
tgacaagagcc

SEQ ID NO: 1282321 - DNA, 14 bp, Homo sapiens
tgacaagagcctga

SEQ ID NO: 1282322 - DNA, 22 bp, Homo sapiens
tgacaagagcctgatctcttcc

SEQ ID NO: 1282323 - DNA, 16 bp, Homo sapiens
tgacaagatggtccat

SEQ ID NO: 1282324 - DNA, 19 bp, Homo sapiens
tgacaagatggtccatttg

SEQ ID NO: 1282325 - DNA, 13 bp, Homo sapiens
tgacaagccccag

SEQ ID NO: 1282326 - DNA, 21 bp, Homo sapiens
tgacaagccccaggcaggctg

SEQ ID NO: 1282327 - DNA, 18 bp, Homo sapiens
tgacaagctgacttggca

SEQ ID NO: 1282328 - DNA, 11 bp, Homo sapiens
tgacaaggaaa

SEQ ID NO: 1282329 - DNA, 16 bp, Homo sapiens
tgacaaggaaaatcta

SEQ ID NO: 1282330 - DNA, 14 bp, Homo sapiens
tgacaaggccccag

SEQ ID NO: 1282331 - DNA, 16 bp, Homo sapiens
tgacaaggccccagag

SEQ ID NO: 1282332 - DNA, 20 bp, Homo sapiens
tgacaagtcattttaacttt

SEQ ID NO: 1282333 - DNA, 12 bp, Homo sapiens
tgacaataaaac

SEQ ID NO: 1282334 - DNA, 17 bp, Homo sapiens
tgacaataaaacattaa

SEQ ID NO: 1282335 - DNA, 16 bp, Homo sapiens
tgacaataactaaagc

SEQ ID NO: 1282336 - DNA, 17 bp, Homo sapiens
tgacaatactgctgcct

SEQ ID NO: 1282337 - DNA, 19 bp, Homo sapiens
tgacaatagggctaaatgt

SEQ ID NO: 1282338 - DNA, 17 bp, Homo sapiens
tgacaatagttatgcct

SEQ ID NO: 1282339 - DNA, 21 bp, Homo sapiens
tgacaatcaaagaaaagactt

SEQ ID NO: 1282340 - DNA, 12 bp, Homo sapiens
tgacaatgcaat

SEQ ID NO: 1282341 - DNA, 14 bp, Homo sapiens
tgacaatggcagct

SEQ ID NO: 1282342 - DNA, 16 bp, Homo sapiens
tgacaatggcagctag

SEQ ID NO: 1282343 - DNA, 18 bp, Homo sapiens
tgacaattactcaggttt

SEQ ID NO: 1282344 - DNA, 23 bp, Homo sapiens
tgacaattcctagataaaaagat

SEQ ID NO: 1282345 - DNA, 20 bp, Homo sapiens
tgacaattctgcatgtacta

SEQ ID NO: 1282346 - DNA, 14 bp, Homo sapiens
tgacaattctgggt

SEQ ID NO: 1282347 - DNA, 17 bp, Homo sapiens
tgacacaaaaaaagttg

SEQ ID NO: 1282348 - DNA, 14 bp, Homo sapiens
tgacacaaagcttc

SEQ ID NO: 1282349 - DNA, 14 bp, Homo sapiens
tgacacaaaggtgg

SEQ ID NO: 1282350 - DNA, 16 bp, Homo sapiens
tgacacaactgtgtga

SEQ ID NO: 1282351 - DNA, 15 bp, Homo sapiens
tgacacaagcacttt

SEQ ID NO: 1282352 - DNA, 16 bp, Homo sapiens
tgacacaccaggcgct

SEQ ID NO: 1282353 - DNA, 22 bp, Homo sapiens
tgacacaccaggcgctaattca

SEQ ID NO: 1282354 - DNA, 19 bp, Homo sapiens
tgacacagaaaatgttgag

SEQ ID NO: 1282355 - DNA, 19 bp, Homo sapiens
tgacacagaggctggcact

SEQ ID NO: 1282356 - DNA, 22 bp, Homo sapiens
tgacacagcagcttcaccagag

SEQ ID NO: 1282357 - DNA, 17 bp, Homo sapiens
tgacacaggtcagggct

SEQ ID NO: 1282358 - DNA, 18 bp, Homo sapiens
tgacacaggtcagggctc

SEQ ID NO: 1282359 - DNA, 21 bp, Homo sapiens
tgacacaggtcagggctcaga

SEQ ID NO: 1282360 - DNA, 17 bp, Homo sapiens
tgacacaggtctttcct

SEQ ID NO: 1282361 - DNA, 23 bp, Homo sapiens
tgacacagtcttggctcactgca

SEQ ID NO: 1282362 - DNA, 17 bp, Homo sapiens
tgacacatatgaacaca

SEQ ID NO: 1282363 - DNA, 18 bp, Homo sapiens
tgacacatatgaacacag

SEQ ID NO: 1282364 - DNA, 12 bp, Homo sapiens
tgacacatgcaa

SEQ ID NO: 1282365 - DNA, 19 bp, Homo sapiens
tgacaccaataaatgtttg

SEQ ID NO: 1282366 - DNA, 12 bp, Homo sapiens
tgacaccccctc

SEQ ID NO: 1282367 - DNA, 16 bp, Homo sapiens
tgacaccccctccccg

SEQ ID NO: 1282368 - DNA, 23 bp, Homo sapiens
tgacaccccctccccgcccctgt

SEQ ID NO: 1282369 - DNA, 14 bp, Homo sapiens
tgacaccctggcct

SEQ ID NO: 1282370 - DNA, 21 bp, Homo sapiens
tgacaccgtccctcagtgata

SEQ ID NO: 1282371 - DNA, 20 bp, Homo sapiens
tgacaccgtcgaccaggaaa

SEQ ID NO: 1282372 - DNA, 20 bp, Homo sapiens
tgacacctaccatgctgctt

SEQ ID NO: 1282373 - DNA, 14 bp, Homo sapiens
tgacacctcagtca

SEQ ID NO: 1282374 - DNA, 15 bp, Homo sapiens
tgacacctgctgaga

SEQ ID NO: 1282375 - DNA, 19 bp, Homo sapiens
tgacaccttagagaagcta

SEQ ID NO: 1282376 - DNA, 19 bp, Homo sapiens
tgacacgcagcctgctctg

SEQ ID NO: 1282377 - DNA, 16 bp, Homo sapiens
tgacacgcgctctcca

SEQ ID NO: 1282378 - DNA, 19 bp, Homo sapiens
tgacactagcccaatgaaa

SEQ ID NO: 1282379 - DNA, 22 bp, Homo sapiens
tgacactagcccaatgaaatga

SEQ ID NO: 1282380 - DNA, 19 bp, Homo sapiens
tgacactctagtgacttcc

SEQ ID NO: 1282381 - DNA, 21 bp, Homo sapiens
tgacactctcgtggtatgtat

SEQ ID NO: 1282382 - DNA, 18 bp, Homo sapiens
tgacactgaaagttttgt

SEQ ID NO: 1282383 - DNA, 22 bp, Homo sapiens
tgacactgaacttaataactgt

SEQ ID NO: 1282384 - DNA, 17 bp, Homo sapiens
tgacactgagccccacc

SEQ ID NO: 1282385 - DNA, 16 bp, Homo sapiens
tgacactgctctaaca

SEQ ID NO: 1282386 - DNA, 22 bp, Homo sapiens
tgacactgctctaacagccctc

SEQ ID NO: 1282387 - DNA, 15 bp, Homo sapiens
tgacacttcctgtcc

SEQ ID NO: 1282388 - DNA, 14 bp, Homo sapiens
tgacactttttgta

SEQ ID NO: 1282389 - DNA, 15 bp, Homo sapiens
tgacagacaggctct

SEQ ID NO: 1282390 - DNA, 19 bp, Homo sapiens
tgacagacaggctcttagc

SEQ ID NO: 1282391 - DNA, 21 bp, Homo sapiens
tgacagactttggacagtggc

SEQ ID NO: 1282392 - DNA, 22 bp, Homo sapiens
tgacagagcagctaactccgag

SEQ ID NO: 1282393 - DNA, 21 bp, Homo sapiens
tgacagagcgagattccgtct

SEQ ID NO: 1282394 - DNA, 14 bp, Homo sapiens
tgacagaggctgca

SEQ ID NO: 1282395 - DNA, 16 bp, Homo sapiens
tgacagaggctgcacc

SEQ ID NO: 1282396 - DNA, 23 bp, Homo sapiens
tgacagatcataggaagtggctg

SEQ ID NO: 1282397 - DNA, 19 bp, Homo sapiens
tgacagatgccaacttccc

SEQ ID NO: 1282398 - DNA, 22 bp, Homo sapiens
tgacagatgccaacttcccaca

SEQ ID NO: 1282399 - DNA, 18 bp, Homo sapiens
tgacagatggtgaagtaa

SEQ ID NO: 1282400 - DNA, 19 bp, Homo sapiens
tgacagatgtcagccgagc

SEQ ID NO: 1282401 - DNA, 13 bp, Homo sapiens
tgacagattctga

SEQ ID NO: 1282402 - DNA, 22 bp, Homo sapiens
tgacagattctgacatttatat

SEQ ID NO: 1282403 - DNA, 17 bp, Homo sapiens
tgacagcaaaatgttga

SEQ ID NO: 1282404 - DNA, 22 bp, Homo sapiens
tgacagcaaaatgttgaagaaa

SEQ ID NO: 1282405 - DNA, 14 bp, Homo sapiens
tgacagcagcctgt

SEQ ID NO: 1282406 - DNA, 16 bp, Homo sapiens
tgacagcagcctgtga

SEQ ID NO: 1282407 - DNA, 20 bp, Homo sapiens
tgacagcagtcggttggagc

SEQ ID NO: 1282408 - DNA, 12 bp, Homo sapiens
tgacagcctccc

SEQ ID NO: 1282409 - DNA, 14 bp, Homo sapiens
tgacagcctgcagc

SEQ ID NO: 1282410 - DNA, 13 bp, Homo sapiens
tgacagcgatggc

SEQ ID NO: 1282411 - DNA, 20 bp, Homo sapiens
tgacagctaggatgtgcatt

SEQ ID NO: 1282412 - DNA, 22 bp, Homo sapiens
tgacagctaggatgtgcattct

SEQ ID NO: 1282413 - DNA, 15 bp, Homo sapiens
tgacagctgctccta

SEQ ID NO: 1282414 - DNA, 12 bp, Homo sapiens
tgacagctgtcc

SEQ ID NO: 1282415 - DNA, 14 bp, Homo sapiens
tgacagctgtccct

SEQ ID NO: 1282416 - DNA, 16 bp, Homo sapiens
tgacagctttctggga

SEQ ID NO: 1282417 - DNA, 16 bp, Homo sapiens
tgacagctttgctgct

SEQ ID NO: 1282418 - DNA, 21 bp, Homo sapiens
tgacagctttgctgctgaagg

SEQ ID NO: 1282419 - DNA, 11 bp, Homo sapiens
tgacagggcca

SEQ ID NO: 1282420 - DNA, 12 bp, Homo sapiens
tgacagggccag

SEQ ID NO: 1282421 - DNA, 13 bp, Homo sapiens
tgacagggccagt

SEQ ID NO: 1282422 - DNA, 19 bp, Homo sapiens
tgacagggccagtgcagtt

SEQ ID NO: 1282423 - DNA, 17 bp, Homo sapiens
tgacagggccagtgggg

SEQ ID NO: 1282424 - DNA, 20 bp, Homo sapiens
tgacagggccagtggggcct

SEQ ID NO: 1282425 - DNA, 22 bp, Homo sapiens
tgacagggccagtggggcctgt

SEQ ID NO: 1282426 - DNA, 23 bp, Homo sapiens
tgacagggccagtggggcctgtg

SEQ ID NO: 1282427 - DNA, 17 bp, Homo sapiens
tgacaggtaaattaaga

SEQ ID NO: 1282428 - DNA, 17 bp, Homo sapiens
tgacaggtaatgaagct

SEQ ID NO: 1282429 - DNA, 20 bp, Homo sapiens
tgacaggtgatgctctggct

SEQ ID NO: 1282430 - DNA, 20 bp, Homo sapiens
tgacagtatatttgaaactg

SEQ ID NO: 1282431 - DNA, 17 bp, Homo sapiens
tgacagtattaagggta

SEQ ID NO: 1282432 - DNA, 21 bp, Homo sapiens
tgacagtattatacgctggca

SEQ ID NO: 1282433 - DNA, 21 bp, Homo sapiens
tgacagtcataaatactgtca

SEQ ID NO: 1282434 - DNA, 14 bp, Homo sapiens
tgacagtcatcatc

SEQ ID NO: 1282435 - DNA, 17 bp, Homo sapiens
tgacagtcatcatcagg

SEQ ID NO: 1282436 - DNA, 14 bp, Homo sapiens
tgacagtccacagg

SEQ ID NO: 1282437 - DNA, 18 bp, Homo sapiens
tgacagtccgtcaaaaca

SEQ ID NO: 1282438 - DNA, 20 bp, Homo sapiens
tgacagtcctccatccacgt

SEQ ID NO: 1282439 - DNA, 13 bp, Homo sapiens
tgacagtgaaata

SEQ ID NO: 1282440 - DNA, 14 bp, Homo sapiens
tgacagtgcctctt

SEQ ID NO: 1282441 - DNA, 17 bp, Homo sapiens
tgacagtgcctgggaat

SEQ ID NO: 1282442 - DNA, 17 bp, Homo sapiens
tgaccttctgcggctcc

SEQ ID NO: 1282443 - DNA, 16 bp, Homo sapiens
tgaccttgcaacttca

SEQ ID NO: 1282444 - DNA, 21 bp, Homo sapiens
tgaccttgggaccaaaggggg

SEQ ID NO: 1282445 - DNA, 23 bp, Homo sapiens
tgacctttaagaaaaatgaaaac

SEQ ID NO: 1282446 - DNA, 14 bp, Homo sapiens
tgacctttaattca

SEQ ID NO: 1282447 - DNA, 18 bp, Homo sapiens
tgacctttaattcaggta

SEQ ID NO: 1282448 - DNA, 19 bp, Homo sapiens
tgacgatcccatgttagct

SEQ ID NO: 1282449 - DNA, 19 bp, Homo sapiens
tgacgcaacccacgtgtaa

SEQ ID NO: 1282450 - DNA, 15 bp, Homo sapiens
tgacgcagacagagg

SEQ ID NO: 1282451 - DNA, 18 bp, Homo sapiens
tgacgcagacagagggga

SEQ ID NO: 1282452 - DNA, 20 bp, Homo sapiens
tgacgcagacagaggggatg

SEQ ID NO: 1282453 - DNA, 22 bp, Homo sapiens
tgacgcagccggagggaggcac

SEQ ID NO: 1282454 - DNA, 12 bp, Homo sapiens
tgacgcccacct

SEQ ID NO: 1282455 - DNA, 13 bp, Homo sapiens
tgacgcccacctt

SEQ ID NO: 1282456 - DNA, 23 bp, Homo sapiens
tgacgccctgcgttggagccact

SEQ ID NO: 1282457 - DNA, 23 bp, Homo sapiens
tgacgcctgatggtgctgctcag

SEQ ID NO: 1282458 - DNA, 16 bp, Homo sapiens
tgacgcttgtgacagt

SEQ ID NO: 1282459 - DNA, 20 bp, Homo sapiens
tgacgcttgtgacagtgcct

SEQ ID NO: 1282460 - DNA, 18 bp, Homo sapiens
tgacggaagaacatagaa

SEQ ID NO: 1282461 - DNA, 19 bp, Homo sapiens
tgacggatgattggattat

SEQ ID NO: 1282462 - DNA, 14 bp, Homo sapiens
tgacggccctcatc

SEQ ID NO: 1282463 - DNA, 15 bp, Homo sapiens
tgacggcgcccccag

SEQ ID NO: 1282464 - DNA, 18 bp, Homo sapiens
tgacggcgcccccagtgt

SEQ ID NO: 1282465 - DNA, 16 bp, Homo sapiens
tgacggctgccattgg

SEQ ID NO: 1282466 - DNA, 14 bp, Homo sapiens
tgacggctggggac

SEQ ID NO: 1282467 - DNA, 23 bp, Homo sapiens
tgacggctggggacccacccagc

SEQ ID NO: 1282468 - DNA, 21 bp, Homo sapiens
tgacggctgggtgtttcagtt

SEQ ID NO: 1282469 - DNA, 17 bp, Homo sapiens
tgacggtaagtgttctc

SEQ ID NO: 1282470 - DNA, 19 bp, Homo sapiens
tgacggtcccacactggtg

SEQ ID NO: 1282471 - DNA, 17 bp, Homo sapiens
tgacgtgaccggacttt

SEQ ID NO: 1282472 - DNA, 24 bp, Homo sapiens
tgacgtgaccggacttttctgcaa

SEQ ID NO: 1282473 - DNA, 15 bp, Homo sapiens
tgacgtgcactgtga

SEQ ID NO: 1282474 - DNA, 22 bp, Homo sapiens
tgacgtgccttttgcacccctc

SEQ ID NO: 1282475 - DNA, 23 bp, Homo sapiens
tgacgtggagcggggtatgaaga

SEQ ID NO: 1282476 - DNA, 20 bp, Homo sapiens
tgacgtgtaaatgctggtat

SEQ ID NO: 1282477 - DNA, 14 bp, Homo sapiens
tgactaaaaatatt

SEQ ID NO: 1282478 - DNA, 14 bp, Homo sapiens
tgactaaaatattt

SEQ ID NO: 1282479 - DNA, 21 bp, Homo sapiens
tgactaaactttttttctgta

SEQ ID NO: 1282480 - DNA, 12 bp, Homo sapiens
tgactaaatttt

SEQ ID NO: 1282481 - DNA, 19 bp, Homo sapiens
tgactaaattttcttttaa

SEQ ID NO: 1282482 - DNA, 21 bp, Homo sapiens
tgactaacaggccaaagagtc

SEQ ID NO: 1282483 - DNA, 18 bp, Homo sapiens
tgactaattttacatgtt

SEQ ID NO: 1282484 - DNA, 16 bp, Homo sapiens
tgactacagtcaggaa

SEQ ID NO: 1282485 - DNA, 17 bp, Homo sapiens
tgactacagtcaggaaa

SEQ ID NO: 1282486 - DNA, 20 bp, Homo sapiens
tgactactactctgccaatc

SEQ ID NO: 1282487 - DNA, 15 bp, Homo sapiens
tgactactttgcctt

SEQ ID NO: 1282488 - DNA, 21 bp, Homo sapiens
tgactagaggcagggagggga

SEQ ID NO: 1282489 - DNA, 18 bp, Homo sapiens
tgactagggattcaggct

SEQ ID NO: 1282490 - DNA, 19 bp, Homo sapiens
tgactagggattcaggctg

SEQ ID NO: 1282491 - DNA, 20 bp, Homo sapiens
tgactagggattcaggctgc

SEQ ID NO: 1282492 - DNA, 21 bp, Homo sapiens
tgactagtagatttctatgat

SEQ ID NO: 1282493 - DNA, 18 bp, Homo sapiens
tgactatataatttattt

SEQ ID NO: 1282494 - DNA, 17 bp, Homo sapiens
tgactatatagagatgt

SEQ ID NO: 1282495 - DNA, 19 bp, Homo sapiens
tgactatatagagatgttt

SEQ ID NO: 1282496 - DNA, 16 bp, Homo sapiens
tgactatcaaactgaa

SEQ ID NO: 1282497 - DNA, 21 bp, Homo sapiens
tgactatcacacactttctct

SEQ ID NO: 1282498 - DNA, 23 bp, Homo sapiens
tgactatcacacactttctcttc

SEQ ID NO: 1282499 - DNA, 24 bp, Homo sapiens
tgactatgcagaggcctgggggac

SEQ ID NO: 1282500 - DNA, 20 bp, Homo sapiens
tgactatgcgtggctggaac

SEQ ID NO: 1282501 - DNA, 22 bp, Homo sapiens
tgactattacttttctgtttag

SEQ ID NO: 1282502 - DNA, 15 bp, Homo sapiens
tgactcaagaagtga

SEQ ID NO: 1282503 - DNA, 22 bp, Homo sapiens
tgactcaagaagtgaagaatgc

SEQ ID NO: 1282504 - DNA, 19 bp, Homo sapiens
tgactcacacctgaactga

SEQ ID NO: 1282505 - DNA, 13 bp, Homo sapiens
tgactcacaggcc

SEQ ID NO: 1282506 - DNA, 20 bp, Homo sapiens
tgactcacaggccctggaga

SEQ ID NO: 1282507 - DNA, 15 bp, Homo sapiens
tgactcacccaagca

SEQ ID NO: 1282508 - DNA, 23 bp, Homo sapiens
tgactcaggatttaaaaactgga

SEQ ID NO: 1282509 - DNA, 19 bp, Homo sapiens
tgactcagggctcctgggt

SEQ ID NO: 1282510 - DNA, 23 bp, Homo sapiens
tgactcagtgtctgcctttaaat

SEQ ID NO: 1282511 - DNA, 13 bp, Homo sapiens
tgactcagttcca

SEQ ID NO: 1282512 - DNA, 20 bp, Homo sapiens
tgactcagttccaggcctga

SEQ ID NO: 1282513 - DNA, 22 bp, Homo sapiens
tgactcataggtccctgacatt

SEQ ID NO: 1282514 - DNA, 15 bp, Homo sapiens
tgactcatcatttgt

SEQ ID NO: 1282515 - DNA, 20 bp, Homo sapiens
tgactcatggcagctgtttc

SEQ ID NO: 1282516 - DNA, 22 bp, Homo sapiens
tgactcatttaaagctaaattt

SEQ ID NO: 1282517 - DNA, 16 bp, Homo sapiens
tgactccaaccattca

SEQ ID NO: 1282518 - DNA, 19 bp, Homo sapiens
tgactccaccttctcacct

SEQ ID NO: 1282519 - DNA, 14 bp, Homo sapiens
tgactccagagtct

SEQ ID NO: 1282520 - DNA, 19 bp, Homo sapiens
tgactccagagtctgagcc

SEQ ID NO: 1282521 - DNA, 20 bp, Homo sapiens
tgactccagagtctgagccc

SEQ ID NO: 1282522 - DNA, 14 bp, Homo sapiens
tgactccctcccca

SEQ ID NO: 1282523 - DNA, 21 bp, Homo sapiens
tgactccctccccacccaaga

SEQ ID NO: 1282524 - DNA, 15 bp, Homo sapiens
tgactccctgggagc

SEQ ID NO: 1282525 - DNA, 16 bp, Homo sapiens
tgactccctgtggggg

SEQ ID NO: 1282526 - DNA, 23 bp, Homo sapiens
tgactccctgtgggggtggccat

SEQ ID NO: 1282527 - DNA, 17 bp, Homo sapiens
tgactcctctaagccac

SEQ ID NO: 1282528 - DNA, 14 bp, Homo sapiens
tgactcctgggtgg

SEQ ID NO: 1282529 - DNA, 20 bp, Homo sapiens
tgactcctttccaatagaaa

SEQ ID NO: 1282530 - DNA, 21 bp, Homo sapiens
tgactcgagggttgggttcat

SEQ ID NO: 1282531 - DNA, 18 bp, Homo sapiens
tgactcgggagctgcaca

SEQ ID NO: 1282532 - DNA, 19 bp, Homo sapiens
tgactcgggagctgcacac

SEQ ID NO: 1282533 - DNA, 16 bp, Homo sapiens
tgactcgggggtgggg

SEQ ID NO: 1282534 - DNA, 21 bp, Homo sapiens
tgactcgtatatgtctcaggt

SEQ ID NO: 1282535 - DNA, 16 bp, Homo sapiens
tgactctataagcaaa

SEQ ID NO: 1282536 - DNA, 21 bp, Homo sapiens
tgactctataagcaaattgct

SEQ ID NO: 1282537 - DNA, 14 bp, Homo sapiens
tgactctccactcc

SEQ ID NO: 1282538 - DNA, 19 bp, Homo sapiens
tgactctccactcctcctc

SEQ ID NO: 1282539 - DNA, 13 bp, Homo sapiens
tgactctcctgcc

SEQ ID NO: 1282540 - DNA, 20 bp, Homo sapiens
tgactctcctgcctcagcct

SEQ ID NO: 1282541 - DNA, 15 bp, Homo sapiens
tgactctctgagctg

SEQ ID NO: 1282542 - DNA, 19 bp, Homo sapiens
tgactctctgagctgggga

SEQ ID NO: 1282543 - DNA, 15 bp, Homo sapiens
tgactctctgtgacc

SEQ ID NO: 1282544 - DNA, 14 bp, Homo sapiens
tgactctgaaatct

SEQ ID NO: 1282545 - DNA, 15 bp, Homo sapiens
tgactctgaaatctg

SEQ ID NO: 1282546 - DNA, 20 bp, Homo sapiens
tgactctgagtccactgctc

SEQ ID NO: 1282547 - DNA, 15 bp, Homo sapiens
tgactctgggcaggg

SEQ ID NO: 1282548 - DNA, 17 bp, Homo sapiens
tgactctgggcagggac

SEQ ID NO: 1282549 - DNA, 24 bp, Homo sapiens
tgactctgttgatctacccgtgcc

SEQ ID NO: 1282550 - DNA, 20 bp, Homo sapiens
tgactcttccgtgcatccca

SEQ ID NO: 1282551 - DNA, 19 bp, Homo sapiens
tgactcttggagcctcttt

SEQ ID NO: 1282552 - DNA, 18 bp, Homo sapiens
tgactctttattgtctgt

SEQ ID NO: 1282553 - DNA, 18 bp, Homo sapiens
tgactctttcaaagaaat

SEQ ID NO: 1282554 - DNA, 20 bp, Homo sapiens
tgactctttcaaagaaatcc

SEQ ID NO: 1282555 - DNA, 14 bp, Homo sapiens
tgactctttctgaa

SEQ ID NO: 1282556 - DNA, 21 bp, Homo sapiens
tgactgaacgatccttcaaag

SEQ ID NO: 1282557 - DNA, 18 bp, Homo sapiens
tgactgaagaagatgagc

SEQ ID NO: 1282558 - DNA, 20 bp, Homo sapiens
tgactgaagaagatgagcct

SEQ ID NO: 1282559 - DNA, 19 bp, Homo sapiens
tgactgaaggggcacacca

SEQ ID NO: 1282560 - DNA, 14 bp, Homo sapiens
tgactgaatttctt

SEQ ID NO: 1282561 - DNA, 18 bp, Homo sapiens
tgactgaatttgggcctc

SEQ ID NO: 1282562 - DNA, 16 bp, Homo sapiens
tgagagctgctctgga

SEQ ID NO: 1282563 - DNA, 19 bp, Homo sapiens
tgagagctttctgccttag

SEQ ID NO: 1282564 - DNA, 22 bp, Homo sapiens
tgagagctttctgccttagcct

SEQ ID NO: 1282565 - DNA, 14 bp, Homo sapiens
tgagagctttgctt

SEQ ID NO: 1282566 - DNA, 18 bp, Homo sapiens
tgagaggcagacttccct

SEQ ID NO: 1282567 - DNA, 20 bp, Homo sapiens
tgagaggcaggaatgggggt

SEQ ID NO: 1282568 - DNA, 13 bp, Homo sapiens
tgagaggcaggca

SEQ ID NO: 1282569 - DNA, 14 bp, Homo sapiens
tgagaggcaggcat

SEQ ID NO: 1282570 - DNA, 16 bp, Homo sapiens
tgagaggcaggcatag

SEQ ID NO: 1282571 - DNA, 14 bp, Homo sapiens
tgagaggcctggag

SEQ ID NO: 1282572 - DNA, 16 bp, Homo sapiens
tgagaggcctggagcc

SEQ ID NO: 1282573 - DNA, 21 bp, Homo sapiens
tgagaggcctggagcccacaa

SEQ ID NO: 1282574 - DNA, 19 bp, Homo sapiens
tgagaggcgagctccttga

SEQ ID NO: 1282575 - DNA, 21 bp, Homo sapiens
tgagagggcagtgtttccttt

SEQ ID NO: 1282576 - DNA, 19 bp, Homo sapiens
tgagaggggagggctcctg

SEQ ID NO: 1282577 - DNA, 22 bp, Homo sapiens
tgagaggggagggctcctgggg

SEQ ID NO: 1282578 - DNA, 22 bp, Homo sapiens
tgagaggtttgactagatgatg

SEQ ID NO: 1282579 - DNA, 19 bp, Homo sapiens
tgagagtcagctctctgcc

SEQ ID NO: 1282580 - DNA, 20 bp, Homo sapiens
tgagagtctgaaagacagaa

SEQ ID NO: 1282581 - DNA, 13 bp, Homo sapiens
tgagagtgtgacc

SEQ ID NO: 1282582 - DNA, 14 bp, Homo sapiens
tgagagttcacaga

SEQ ID NO: 1282583 - DNA, 16 bp, Homo sapiens
tgagagttccttctca

SEQ ID NO: 1282584 - DNA, 17 bp, Homo sapiens
tgagagttccttctcac

SEQ ID NO: 1282585 - DNA, 22 bp, Homo sapiens
tgagagttccttctcacttaga

SEQ ID NO: 1282586 - DNA, 18 bp, Homo sapiens
tgagagttgtctctgttg

SEQ ID NO: 1282587 - DNA, 12 bp, Homo sapiens
tgagagtttcct

SEQ ID NO: 1282588 - DNA, 21 bp, Homo sapiens
tgagataaagtcaaatgccaa

SEQ ID NO: 1282589 - DNA, 17 bp, Homo sapiens
tgagataatgatactta

SEQ ID NO: 1282590 - DNA, 13 bp, Homo sapiens
tgagatacactga

SEQ ID NO: 1282591 - DNA, 16 bp, Homo sapiens
tgagatactatcatta

SEQ ID NO: 1282592 - DNA, 15 bp, Homo sapiens
tgagatactttgcat

SEQ ID NO: 1282593 - DNA, 16 bp, Homo sapiens
tgagatagcattgtga

SEQ ID NO: 1282594 - DNA, 16 bp, Homo sapiens
tgagatagttttcatc

SEQ ID NO: 1282595 - DNA, 21 bp, Homo sapiens
tgagatagttttcatccataa

SEQ ID NO: 1282596 - DNA, 14 bp, Homo sapiens
tgagatcacagcct

SEQ ID NO: 1282597 - DNA, 16 bp, Homo sapiens
tgagatcacagcctcc

SEQ ID NO: 1282598 - DNA, 17 bp, Homo sapiens
tgagatcctctttactc

SEQ ID NO: 1282599 - DNA, 22 bp, Homo sapiens
tgagatccttcacaggcagtgc

SEQ ID NO: 1282600 - DNA, 21 bp, Homo sapiens
tgagatcgtgctactgcactc

SEQ ID NO: 1282601 - DNA, 21 bp, Homo sapiens
tgagatctaagcctttccata

SEQ ID NO: 1282602 - DNA, 23 bp, Homo sapiens
tgagatctaatgtgaaaatcatc

SEQ ID NO: 1282603 - DNA, 13 bp, Homo sapiens
tgagatctgggga

SEQ ID NO: 1282604 - DNA, 15 bp, Homo sapiens
tgagatctgtataaa

SEQ ID NO: 1282605 - DNA, 19 bp, Homo sapiens
tgagatctgtataaataag

SEQ ID NO: 1282606 - DNA, 20 bp, Homo sapiens
tgagatgagtttctggggaa

SEQ ID NO: 1282607 - DNA, 21 bp, Homo sapiens
tgagatgataaagtcccctta

SEQ ID NO: 1282608 - DNA, 21 bp, Homo sapiens
tgagatgcctgttgaaggtac

SEQ ID NO: 1282609 - DNA, 22 bp, Homo sapiens
tgagatgcgttgttacaggaag

SEQ ID NO: 1282610 - DNA, 13 bp, Homo sapiens
tgagatgctggtt

SEQ ID NO: 1282611 - DNA, 17 bp, Homo sapiens
tgagatgctggttttct

SEQ ID NO: 1282612 - DNA, 19 bp, Homo sapiens
tgagatgcttcactttcct

SEQ ID NO: 1282613 - DNA, 15 bp, Homo sapiens
tgagatggccatgct

SEQ ID NO: 1282614 - DNA, 17 bp, Homo sapiens
tgagatgggtgtacaaa

SEQ ID NO: 1282615 - DNA, 17 bp, Homo sapiens
tgagatgtatgaaggct

SEQ ID NO: 1282616 - DNA, 18 bp, Homo sapiens
tgagatgttgtgtggcaa

SEQ ID NO: 1282617 - DNA, 15 bp, Homo sapiens
tgagattacagagga

SEQ ID NO: 1282618 - DNA, 17 bp, Homo sapiens
tgagattcaatattgaa

SEQ ID NO: 1282619 - DNA, 23 bp, Homo sapiens
tgagattcaatattgaatttttc

SEQ ID NO: 1282620 - DNA, 15 bp, Homo sapiens
tgagattctcaaagg

SEQ ID NO: 1282621 - DNA, 13 bp, Homo sapiens
tgagattgtgttt

SEQ ID NO: 1282622 - DNA, 18 bp, Homo sapiens
tgagattgtgtttgttca

SEQ ID NO: 1282623 - DNA, 17 bp, Homo sapiens
tgagatttcttaaataa

SEQ ID NO: 1282624 - DNA, 22 bp, Homo sapiens
tgagatttgccagcacaggggc

SEQ ID NO: 1282625 - DNA, 14 bp, Homo sapiens
tgagattttggtat

SEQ ID NO: 1282626 - DNA, 17 bp, Homo sapiens
tgagatttttaagaact

SEQ ID NO: 1282627 - DNA, 17 bp, Homo sapiens
tgagatttttgatatct

SEQ ID NO: 1282628 - DNA, 20 bp, Homo sapiens
tgagatttttgttttccact

SEQ ID NO: 1282629 - DNA, 16 bp, Homo sapiens
tgagcaactcttgatt

SEQ ID NO: 1282630 - DNA, 21 bp, Homo sapiens
tgagcaaggagcacaagccac

SEQ ID NO: 1282631 - DNA, 17 bp, Homo sapiens
tgagcaagggggcccaa

SEQ ID NO: 1282632 - DNA, 21 bp, Homo sapiens
tgagcacaactttaagaggac

SEQ ID NO: 1282633 - DNA, 22 bp, Homo sapiens
tgagcacaactttaagaggaca

SEQ ID NO: 1282634 - DNA, 13 bp, Homo sapiens
tgagcacacttta

SEQ ID NO: 1282635 - DNA, 14 bp, Homo sapiens
tgagcacaggtgac

SEQ ID NO: 1282636 - DNA, 21 bp, Homo sapiens
tgagcacagtcaggggctggg

SEQ ID NO: 1282637 - DNA, 23 bp, Homo sapiens
tgagcacatagtgtcctgcccac

SEQ ID NO: 1282638 - DNA, 16 bp, Homo sapiens
tgagcaccctctggat

SEQ ID NO: 1282639 - DNA, 14 bp, Homo sapiens
tgagcacctccagc

SEQ ID NO: 1282640 - DNA, 12 bp, Homo sapiens
tgagcacctgct

SEQ ID NO: 1282641 - DNA, 15 bp, Homo sapiens
tgagcactgtttata

SEQ ID NO: 1282642 - DNA, 22 bp, Homo sapiens
tgagcactgtttatacactgtg

SEQ ID NO: 1282643 - DNA, 15 bp, Homo sapiens
tgagcacttagcagg

SEQ ID NO: 1282644 - DNA, 18 bp, Homo sapiens
tgagcagaatactggtct

SEQ ID NO: 1282645 - DNA, 22 bp, Homo sapiens
tgagcagaatgttgtacttgaa

SEQ ID NO: 1282646 - DNA, 23 bp, Homo sapiens
tgagcagaatgttgtacttgaaa

SEQ ID NO: 1282647 - DNA, 19 bp, Homo sapiens
tgagcagccgccagctggg

SEQ ID NO: 1282648 - DNA, 15 bp, Homo sapiens
tgagcagcctctgga

SEQ ID NO: 1282649 - DNA, 23 bp, Homo sapiens
tgagcagcctctggacagccagt

SEQ ID NO: 1282650 - DNA, 14 bp, Homo sapiens
tgagcaggacagcc

SEQ ID NO: 1282651 - DNA, 17 bp, Homo sapiens
tgagcaggacagccagc

SEQ ID NO: 1282652 - DNA, 18 bp, Homo sapiens
tgagcaggctgtggggtg

SEQ ID NO: 1282653 - DNA, 21 bp, Homo sapiens
tgagcagggcttgctcctgcc

SEQ ID NO: 1282654 - DNA, 15 bp, Homo sapiens
tgagcaggggcaggc

SEQ ID NO: 1282655 - DNA, 17 bp, Homo sapiens
tgagcaggggcaggcgc

SEQ ID NO: 1282656 - DNA, 19 bp, Homo sapiens
tgagcagggtcaagcctct

SEQ ID NO: 1282657 - DNA, 20 bp, Homo sapiens
tgagcagggtcaagcctctt

SEQ ID NO: 1282658 - DNA, 15 bp, Homo sapiens
tgagcagggtggggt

SEQ ID NO: 1282659 - DNA, 16 bp, Homo sapiens
tgagcagggtggggtc

SEQ ID NO: 1282660 - DNA, 19 bp, Homo sapiens
tgagcagggtggggtctgg

SEQ ID NO: 1282661 - DNA, 23 bp, Homo sapiens
tgagcagggtggggtctgggagg

SEQ ID NO: 1282662 - DNA, 13 bp, Homo sapiens
tgagcagtggctg

SEQ ID NO: 1282663 - DNA, 22 bp, Homo sapiens
tgagcatacatcttaaatcttt

SEQ ID NO: 1282664 - DNA, 17 bp, Homo sapiens
tgagcatatctggtata

SEQ ID NO: 1282665 - DNA, 19 bp, Homo sapiens
tgagcatatctggtatatg

SEQ ID NO: 1282666 - DNA, 19 bp, Homo sapiens
tgagcatcaatcttgttac

SEQ ID NO: 1282667 - DNA, 18 bp, Homo sapiens
tgagcatcctgagccccg

SEQ ID NO: 1282668 - DNA, 17 bp, Homo sapiens
tgagcatcctgcaaggt

SEQ ID NO: 1282669 - DNA, 18 bp, Homo sapiens
tgagcatcctgcaaggtg

SEQ ID NO: 1282670 - DNA, 15 bp, Homo sapiens
tgagcatcttgccag

SEQ ID NO: 1282671 - DNA, 17 bp, Homo sapiens
tgagcatgcacagctgc

SEQ ID NO: 1282672 - DNA, 19 bp, Homo sapiens
tgagcatggaacacttcga

SEQ ID NO: 1282673 - DNA, 18 bp, Homo sapiens
tgagcatgggtgtgccct

SEQ ID NO: 1282674 - DNA, 18 bp, Homo sapiens
tgagcatgtaaaagcgga

SEQ ID NO: 1282675 - DNA, 11 bp, Homo sapiens
tgagcattcag

SEQ ID NO: 1282676 - DNA, 15 bp, Homo sapiens
tgagcattcaggcag

SEQ ID NO: 1282677 - DNA, 21 bp, Homo sapiens
tgagccaaaatgactttgaac

SEQ ID NO: 1282678 - DNA, 18 bp, Homo sapiens
tgagccaaggaggcctgg

SEQ ID NO: 1282679 - DNA, 15 bp, Homo sapiens
tgagccaagggaggg

SEQ ID NO: 1282680 - DNA, 18 bp, Homo sapiens
tgagccaagggagggaag

SEQ ID NO: 1282681 - DNA, 20 bp, Homo sapiens
tgagccaagggagggaaggg

SEQ ID NO: 1282682 - DNA, 23 bp, Homo sapiens
tgagccaatctgcaatttctact

SEQ ID NO: 1282683 - DNA, 14 bp, Homo sapiens
tgaggcccagcctg

SEQ ID NO: 1282684 - DNA, 15 bp, Homo sapiens
tgaggcccagcctgt

SEQ ID NO: 1282685 - DNA, 17 bp, Homo sapiens
tgaggcccagcctgtcc

SEQ ID NO: 1282686 - DNA, 13 bp, Homo sapiens
tgaggcccaggga

SEQ ID NO: 1282687 - DNA, 14 bp, Homo sapiens
tgaggcccagggag

SEQ ID NO: 1282688 - DNA, 15 bp, Homo sapiens
tgaggcccagtgcat

SEQ ID NO: 1282689 - DNA, 16 bp, Homo sapiens
tgaggccctgggctgg

SEQ ID NO: 1282690 - DNA, 16 bp, Homo sapiens
tgaggccgcggcctcc

SEQ ID NO: 1282691 - DNA, 18 bp, Homo sapiens
tgaggccgctagaggcct

SEQ ID NO: 1282692 - DNA, 17 bp, Homo sapiens
tgaggcctatgcagaca

SEQ ID NO: 1282693 - DNA, 17 bp, Homo sapiens
tgaggcctgccctcagg

SEQ ID NO: 1282694 - DNA, 19 bp, Homo sapiens
tgaggcctgccctcaggga

SEQ ID NO: 1282695 - DNA, 12 bp, Homo sapiens
tgaggcctggac

SEQ ID NO: 1282696 - DNA, 16 bp, Homo sapiens
tgaggcctggccaggc

SEQ ID NO: 1282697 - DNA, 17 bp, Homo sapiens
tgaggcctggccaggca

SEQ ID NO: 1282698 - DNA, 12 bp, Homo sapiens
tgaggcctgggc

SEQ ID NO: 1282699 - DNA, 15 bp, Homo sapiens
tgaggcctgtgctct

SEQ ID NO: 1282700 - DNA, 18 bp, Homo sapiens
tgaggccttgtgtgtcag

SEQ ID NO: 1282701 - DNA, 22 bp, Homo sapiens
tgaggccttgtgtgtcaggccc

SEQ ID NO: 1282702 - DNA, 23 bp, Homo sapiens
tgaggccttgtgtgtcaggccct

SEQ ID NO: 1282703 - DNA, 16 bp, Homo sapiens
tgaggcggaggctgtg

SEQ ID NO: 1282704 - DNA, 19 bp, Homo sapiens
tgaggcggaggctgtgctc

SEQ ID NO: 1282705 - DNA, 16 bp, Homo sapiens
tgaggcgttctcctgc

SEQ ID NO: 1282706 - DNA, 21 bp, Homo sapiens
tgaggctcaggggtgtgcctg

SEQ ID NO: 1282707 - DNA, 13 bp, Homo sapiens
tgaggctgagact

SEQ ID NO: 1282708 - DNA, 18 bp, Homo sapiens
tgaggctgagactgcggg

SEQ ID NO: 1282709 - DNA, 12 bp, Homo sapiens
tgaggctgcagc

SEQ ID NO: 1282710 - DNA, 22 bp, Homo sapiens
tgaggctgcagcaggtgctggg

SEQ ID NO: 1282711 - DNA, 11 bp, Homo sapiens
tgaggctggca

SEQ ID NO: 1282712 - DNA, 19 bp, Homo sapiens
tgaggctgggggagagccg

SEQ ID NO: 1282713 - DNA, 22 bp, Homo sapiens
tgaggctgtaactgagagaaag

SEQ ID NO: 1282714 - DNA, 21 bp, Homo sapiens
tgaggctgtggtcacagcgga

SEQ ID NO: 1282715 - DNA, 13 bp, Homo sapiens
tgaggcttagaga

SEQ ID NO: 1282716 - DNA, 18 bp, Homo sapiens
tgaggcttaggcctctct

SEQ ID NO: 1282717 - DNA, 16 bp, Homo sapiens
tgaggcttccaggctc

SEQ ID NO: 1282718 - DNA, 17 bp, Homo sapiens
tgaggcttccaggctct

SEQ ID NO: 1282719 - DNA, 21 bp, Homo sapiens
tgaggcttccaggctcttcct

SEQ ID NO: 1282720 - DNA, 20 bp, Homo sapiens
tgaggctttggtacccccaa

SEQ ID NO: 1282721 - DNA, 21 bp, Homo sapiens
tgagggaaagtgcatatgaaa

SEQ ID NO: 1282722 - DNA, 16 bp, Homo sapiens
tgagggaaatgttttg

SEQ ID NO: 1282723 - DNA, 24 bp, Homo sapiens
tgagggaaggagcccagccagaaa

SEQ ID NO: 1282724 - DNA, 20 bp, Homo sapiens
tgagggacatgctcacctct

SEQ ID NO: 1282725 - DNA, 13 bp, Homo sapiens
tgagggacgtggt

SEQ ID NO: 1282726 - DNA, 14 bp, Homo sapiens
tgagggagcctggc

SEQ ID NO: 1282727 - DNA, 23 bp, Homo sapiens
tgagggaggacaggcgggaggag

SEQ ID NO: 1282728 - DNA, 22 bp, Homo sapiens
tgagggaggacctggggcacag

SEQ ID NO: 1282729 - DNA, 14 bp, Homo sapiens
tgagggaggaggcc

SEQ ID NO: 1282730 - DNA, 20 bp, Homo sapiens
tgagggaggaggccacctct

SEQ ID NO: 1282731 - DNA, 14 bp, Homo sapiens
tgagggaggggaaa

SEQ ID NO: 1282732 - DNA, 23 bp, Homo sapiens
tgagggagtgcagaacacctggc

SEQ ID NO: 1282733 - DNA, 18 bp, Homo sapiens
tgagggatcacagggccc

SEQ ID NO: 1282734 - DNA, 15 bp, Homo sapiens
tgagggatgacttac

SEQ ID NO: 1282735 - DNA, 14 bp, Homo sapiens
tgagggatgctgga

SEQ ID NO: 1282736 - DNA, 17 bp, Homo sapiens
tgagggatgggcctggc

SEQ ID NO: 1282737 - DNA, 13 bp, Homo sapiens
tgagggcaaagat

SEQ ID NO: 1282738 - DNA, 17 bp, Homo sapiens
tgagggcaagccaccaa

SEQ ID NO: 1282739 - DNA, 11 bp, Homo sapiens
tgagggcagtc

SEQ ID NO: 1282740 - DNA, 18 bp, Homo sapiens
tgagggccaagaaagagt

SEQ ID NO: 1282741 - DNA, 21 bp, Homo sapiens
tgagggccactttttttttat

SEQ ID NO: 1282742 - DNA, 17 bp, Homo sapiens
tgagggcccagagcagg

SEQ ID NO: 1282743 - DNA, 18 bp, Homo sapiens
tgagggcccagagcagga

SEQ ID NO: 1282744 - DNA, 21 bp, Homo sapiens
tgagggcccagccaggagcag

SEQ ID NO: 1282745 - DNA, 17 bp, Homo sapiens
tgagggcccctctgccc

SEQ ID NO: 1282746 - DNA, 15 bp, Homo sapiens
tgagggccctgtgga

SEQ ID NO: 1282747 - DNA, 16 bp, Homo sapiens
tgagggcctcagagcc

SEQ ID NO: 1282748 - DNA, 13 bp, Homo sapiens
tgagggcctgctg

SEQ ID NO: 1282749 - DNA, 17 bp, Homo sapiens
tgagggcgaggggaggg

SEQ ID NO: 1282750 - DNA, 21 bp, Homo sapiens
tgagggctctgtttgtgggac

SEQ ID NO: 1282751 - DNA, 11 bp, Homo sapiens
tgagggctggg

SEQ ID NO: 1282752 - DNA, 14 bp, Homo sapiens
tgagggctgggccc

SEQ ID NO: 1282753 - DNA, 21 bp, Homo sapiens
tgaggggattctctactgcca

SEQ ID NO: 1282754 - DNA, 17 bp, Homo sapiens
tgaggggcaacgaagaa

SEQ ID NO: 1282755 - DNA, 20 bp, Homo sapiens
tgaggggccaggggcaggca

SEQ ID NO: 1282756 - DNA, 23 bp, Homo sapiens
tgaggggccccagcgtctgcagg

SEQ ID NO: 1282757 - DNA, 17 bp, Homo sapiens
tgaggggccctggccag

SEQ ID NO: 1282758 - DNA, 16 bp, Homo sapiens
tgaggggcctgcgccc

SEQ ID NO: 1282759 - DNA, 14 bp, Homo sapiens
tgaggggcctggag

SEQ ID NO: 1282760 - DNA, 17 bp, Homo sapiens
tgaggggctaccaggaa

SEQ ID NO: 1282761 - DNA, 22 bp, Homo sapiens
tgaggggctggccttcctgccc

SEQ ID NO: 1282762 - DNA, 14 bp, Homo sapiens
tgaggggctgggct

SEQ ID NO: 1282763 - DNA, 15 bp, Homo sapiens
tgaggggctttctct

SEQ ID NO: 1282764 - DNA, 20 bp, Homo sapiens
tgaggggggccgtgcccagg

SEQ ID NO: 1282765 - DNA, 22 bp, Homo sapiens
tgaggggggccgtgcccagggg

SEQ ID NO: 1282766 - DNA, 18 bp, Homo sapiens
tgaggggtgtccgagagg

SEQ ID NO: 1282767 - DNA, 18 bp, Homo sapiens
tgaggggttacctccctc

SEQ ID NO: 1282768 - DNA, 22 bp, Homo sapiens
tgagggtatgaagagctgtctt

SEQ ID NO: 1282769 - DNA, 20 bp, Homo sapiens
tgagggtcattctttattct

SEQ ID NO: 1282770 - DNA, 19 bp, Homo sapiens
tgagggtccccacctggga

SEQ ID NO: 1282771 - DNA, 22 bp, Homo sapiens
tgagggtcctgcagcctgcagg

SEQ ID NO: 1282772 - DNA, 23 bp, Homo sapiens
tgagggtcctgcagcctgcagga

SEQ ID NO: 1282773 - DNA, 12 bp, Homo sapiens
tgagggtcttct

SEQ ID NO: 1282774 - DNA, 20 bp, Homo sapiens
tgagggtgccccgcctgagt

SEQ ID NO: 1282775 - DNA, 14 bp, Homo sapiens
tgagggtgggccag

SEQ ID NO: 1282776 - DNA, 14 bp, Homo sapiens
tgaggtaagtggaa

SEQ ID NO: 1282777 - DNA, 21 bp, Homo sapiens
tgaggtagaggggaaggaaat

SEQ ID NO: 1282778 - DNA, 24 bp, Homo sapiens
tgaggtatggccatgccctagacc

SEQ ID NO: 1282779 - DNA, 16 bp, Homo sapiens
tgaggtcccgggctta

SEQ ID NO: 1282780 - DNA, 15 bp, Homo sapiens
tgaggtcccttcaag

SEQ ID NO: 1282781 - DNA, 19 bp, Homo sapiens
tgaggtcccttcaaggcct

SEQ ID NO: 1282782 - DNA, 21 bp, Homo sapiens
tgaggtcccttcaaggcctcc

SEQ ID NO: 1282783 - DNA, 23 bp, Homo sapiens
tgaggtcccttcaaggcctcccc

SEQ ID NO: 1282784 - DNA, 18 bp, Homo sapiens
tgaggtcctcaggtcagc

SEQ ID NO: 1282785 - DNA, 20 bp, Homo sapiens
tgaggtcctcaggtcagctg

SEQ ID NO: 1282786 - DNA, 23 bp, Homo sapiens
tgaggtcctcaggtcagctggga

SEQ ID NO: 1282787 - DNA, 15 bp, Homo sapiens
tgaggtcgggtttta

SEQ ID NO: 1282788 - DNA, 17 bp, Homo sapiens
tgaggtctaaacaaata

SEQ ID NO: 1282789 - DNA, 17 bp, Homo sapiens
tgaggtctcttgaggga

SEQ ID NO: 1282790 - DNA, 15 bp, Homo sapiens
tgaggtctgaaatgg

SEQ ID NO: 1282791 - DNA, 15 bp, Homo sapiens
tgaggtctgctcggc

SEQ ID NO: 1282792 - DNA, 16 bp, Homo sapiens
tgaggtctttctcctc

SEQ ID NO: 1282793 - DNA, 17 bp, Homo sapiens
tgaggtcttttgacatg

SEQ ID NO: 1282794 - DNA, 21 bp, Homo sapiens
tgaggtcttttgacatgtgga

SEQ ID NO: 1282795 - DNA, 22 bp, Homo sapiens
tgaggtcttttgacatgtggaa

SEQ ID NO: 1282796 - DNA, 16 bp, Homo sapiens
tgaggtgaaagggagc

SEQ ID NO: 1282797 - DNA, 22 bp, Homo sapiens
tgaggtgatatttttatgtgca

SEQ ID NO: 1282798 - DNA, 15 bp, Homo sapiens
tgaggtgcctgctca

SEQ ID NO: 1282799 - DNA, 19 bp, Homo sapiens
tgaggtgcctgctcaggtg

SEQ ID NO: 1282800 - DNA, 15 bp, Homo sapiens
tgaggtgctatgttc

SEQ ID NO: 1282801 - DNA, 15 bp, Homo sapiens
tgaggtggaagccct

SEQ ID NO: 1282802 - DNA, 17 bp, Homo sapiens
tgaggtggaagccctcc

SEQ ID NO: 1282803 - DNA, 20 bp, Homo sapiens
tgaggtggaagccctccttc

SEQ ID NO: 1282804 - DNA, 22 bp, Homo sapiens
tgaggtggaagccctccttcca

SEQ ID NO: 1282805 - DNA, 18 bp, Homo sapiens
tgatagacaattgaggta

SEQ ID NO: 1282806 - DNA, 19 bp, Homo sapiens
tgatagacacatatgaggg

SEQ ID NO: 1282807 - DNA, 21 bp, Homo sapiens
tgatagacacatatgaggggg

SEQ ID NO: 1282808 - DNA, 16 bp, Homo sapiens
tgatagactttgtgaa

SEQ ID NO: 1282809 - DNA, 14 bp, Homo sapiens
tgatagattttctg

SEQ ID NO: 1282810 - DNA, 13 bp, Homo sapiens
tgatagcattgct

SEQ ID NO: 1282811 - DNA, 18 bp, Homo sapiens
tgatagctaacattttaa

SEQ ID NO: 1282812 - DNA, 15 bp, Homo sapiens
tgatagctggggctt

SEQ ID NO: 1282813 - DNA, 14 bp, Homo sapiens
tgatagctgtttca

SEQ ID NO: 1282814 - DNA, 16 bp, Homo sapiens
tgatagcttacactga

SEQ ID NO: 1282815 - DNA, 21 bp, Homo sapiens
tgatagcttacactgaggact

SEQ ID NO: 1282816 - DNA, 11 bp, Homo sapiens
tgatagcttta

SEQ ID NO: 1282817 - DNA, 23 bp, Homo sapiens
tgatagctttattttttaagtat

SEQ ID NO: 1282818 - DNA, 13 bp, Homo sapiens
tgataggaggggg

SEQ ID NO: 1282819 - DNA, 15 bp, Homo sapiens
tgataggagggggcg

SEQ ID NO: 1282820 - DNA, 16 bp, Homo sapiens
tgatagtcttttgctt

SEQ ID NO: 1282821 - DNA, 17 bp, Homo sapiens
tgatagttgaatgttgc

SEQ ID NO: 1282822 - DNA, 14 bp, Homo sapiens
tgatagttgtgtgt

SEQ ID NO: 1282823 - DNA, 23 bp, Homo sapiens
tgatataaaggaccctgtttctg

SEQ ID NO: 1282824 - DNA, 17 bp, Homo sapiens
tgatataactttagaaa

SEQ ID NO: 1282825 - DNA, 22 bp, Homo sapiens
tgatataatcttggcttcttaa

SEQ ID NO: 1282826 - DNA, 16 bp, Homo sapiens
tgatataatctttcaa

SEQ ID NO: 1282827 - DNA, 18 bp, Homo sapiens
tgatataatttccatagt

SEQ ID NO: 1282828 - DNA, 15 bp, Homo sapiens
tgatatacattgtgt

SEQ ID NO: 1282829 - DNA, 17 bp, Homo sapiens
tgatatacattgtgtga

SEQ ID NO: 1282830 - DNA, 17 bp, Homo sapiens
tgatatagaaagctgtt

SEQ ID NO: 1282831 - DNA, 23 bp, Homo sapiens
tgatatagcagaggtttaaatgt

SEQ ID NO: 1282832 - DNA, 20 bp, Homo sapiens
tgatatagtcagctgccttt

SEQ ID NO: 1282833 - DNA, 21 bp, Homo sapiens
tgatatagtcagctgcctttt

SEQ ID NO: 1282834 - DNA, 12 bp, Homo sapiens
tgatatagtgct

SEQ ID NO: 1282835 - DNA, 14 bp, Homo sapiens
tgatatagtgctgt

SEQ ID NO: 1282836 - DNA, 15 bp, Homo sapiens
tgatatagtgctgtt

SEQ ID NO: 1282837 - DNA, 18 bp, Homo sapiens
tgatatagtgctgtttaa

SEQ ID NO: 1282838 - DNA, 18 bp, Homo sapiens
tgatatataagtgtacat

SEQ ID NO: 1282839 - DNA, 19 bp, Homo sapiens
tgatatataatttcctcac

SEQ ID NO: 1282840 - DNA, 14 bp, Homo sapiens
tgatatattttaca

SEQ ID NO: 1282841 - DNA, 14 bp, Homo sapiens
tgatatcacctctc

SEQ ID NO: 1282842 - DNA, 20 bp, Homo sapiens
tgatatcacctctcttcagc

SEQ ID NO: 1282843 - DNA, 17 bp, Homo sapiens
tgatatcgtgaaatcct

SEQ ID NO: 1282844 - DNA, 19 bp, Homo sapiens
tgatatcgtgaaatcctca

SEQ ID NO: 1282845 - DNA, 16 bp, Homo sapiens
tgatatgcatttcctg

SEQ ID NO: 1282846 - DNA, 21 bp, Homo sapiens
tgatattaatcaaaattgtct

SEQ ID NO: 1282847 - DNA, 16 bp, Homo sapiens
tgatattatttcttct

SEQ ID NO: 1282848 - DNA, 19 bp, Homo sapiens
tgatattatttcttctctt

SEQ ID NO: 1282849 - DNA, 20 bp, Homo sapiens
tgatattatttcttctctta

SEQ ID NO: 1282850 - DNA, 13 bp, Homo sapiens
tgatattcaataa

SEQ ID NO: 1282851 - DNA, 20 bp, Homo sapiens
tgatattccatgaatgtatc

SEQ ID NO: 1282852 - DNA, 22 bp, Homo sapiens
tgatattccatgaatgtatcag

SEQ ID NO: 1282853 - DNA, 16 bp, Homo sapiens
tgatattgaaggaatt

SEQ ID NO: 1282854 - DNA, 14 bp, Homo sapiens
tgatattgtttgct

SEQ ID NO: 1282855 - DNA, 21 bp, Homo sapiens
tgatattgtttgctgttgggt

SEQ ID NO: 1282856 - DNA, 23 bp, Homo sapiens
tgatattgtttgctgttgggttt

SEQ ID NO: 1282857 - DNA, 15 bp, Homo sapiens
tgatatttatttcct

SEQ ID NO: 1282858 - DNA, 21 bp, Homo sapiens
tgatatttatttcctgctact

SEQ ID NO: 1282859 - DNA, 19 bp, Homo sapiens
tgatattttcaacgcagcc

SEQ ID NO: 1282860 - DNA, 16 bp, Homo sapiens
tgatattttccctttt

SEQ ID NO: 1282861 - DNA, 21 bp, Homo sapiens
tgatattttccctttttaaaa

SEQ ID NO: 1282862 - DNA, 15 bp, Homo sapiens
tgatattttctctag

SEQ ID NO: 1282863 - DNA, 16 bp, Homo sapiens
tgatatttttatgtgc

SEQ ID NO: 1282864 - DNA, 16 bp, Homo sapiens
tgatattttttctctc

SEQ ID NO: 1282865 - DNA, 19 bp, Homo sapiens
tgatcaaaatcaattaaaa

SEQ ID NO: 1282866 - DNA, 15 bp, Homo sapiens
tgatcaaattcattt

SEQ ID NO: 1282867 - DNA, 22 bp, Homo sapiens
tgatcaaattcatttttttcac

SEQ ID NO: 1282868 - DNA, 14 bp, Homo sapiens
tgatcaactgttca

SEQ ID NO: 1282869 - DNA, 14 bp, Homo sapiens
tgatcaagagtccg

SEQ ID NO: 1282870 - DNA, 23 bp, Homo sapiens
tgatcaagagtccggatttctaa

SEQ ID NO: 1282871 - DNA, 23 bp, Homo sapiens
tgatcaagatatatgtgtataca

SEQ ID NO: 1282872 - DNA, 17 bp, Homo sapiens
tgatcaattaaatgtag

SEQ ID NO: 1282873 - DNA, 22 bp, Homo sapiens
tgatcacacagtgttagtgctg

SEQ ID NO: 1282874 - DNA, 14 bp, Homo sapiens
tgatcacaggagca

SEQ ID NO: 1282875 - DNA, 12 bp, Homo sapiens
tgatcacagtga

SEQ ID NO: 1282876 - DNA, 14 bp, Homo sapiens
tgatcacagtgact

SEQ ID NO: 1282877 - DNA, 20 bp, Homo sapiens
tgatcaccatgttagcctta

SEQ ID NO: 1282878 - DNA, 17 bp, Homo sapiens
tgatcaccgactgaaaa

SEQ ID NO: 1282879 - DNA, 15 bp, Homo sapiens
tgatcacgcctggct

SEQ ID NO: 1282880 - DNA, 14 bp, Homo sapiens
tgatcactgagcca

SEQ ID NO: 1282881 - DNA, 18 bp, Homo sapiens
tgatcactggcaatgaaa

SEQ ID NO: 1282882 - DNA, 20 bp, Homo sapiens
tgatcagacatacagctgcc

SEQ ID NO: 1282883 - DNA, 21 bp, Homo sapiens
tgatcagaccaaacagtgctg

SEQ ID NO: 1282884 - DNA, 23 bp, Homo sapiens
tgatcagagccgtggtcctttgg

SEQ ID NO: 1282885 - DNA, 15 bp, Homo sapiens
tgatcagcaaattta

SEQ ID NO: 1282886 - DNA, 16 bp, Homo sapiens
tgatcagcaaatttaa

SEQ ID NO: 1282887 - DNA, 15 bp, Homo sapiens
tgatcagcattgtga

SEQ ID NO: 1282888 - DNA, 16 bp, Homo sapiens
tgatcagctgtttgtc

SEQ ID NO: 1282889 - DNA, 16 bp, Homo sapiens
tgatcaggtaactttc

SEQ ID NO: 1282890 - DNA, 11 bp, Homo sapiens
tgatcagtgtt

SEQ ID NO: 1282891 - DNA, 21 bp, Homo sapiens
tgatcataagtctaaataaat

SEQ ID NO: 1282892 - DNA, 15 bp, Homo sapiens
tgatcatccaggcct

SEQ ID NO: 1282893 - DNA, 13 bp, Homo sapiens
tgatcatgcattg

SEQ ID NO: 1282894 - DNA, 23 bp, Homo sapiens
tgatcatgcattgttgaggtggt

SEQ ID NO: 1282895 - DNA, 13 bp, Homo sapiens
tgatcatgggaat

SEQ ID NO: 1282896 - DNA, 15 bp, Homo sapiens
tgatcatgtactttt

SEQ ID NO: 1282897 - DNA, 21 bp, Homo sapiens
tgatcattacatggctgtggt

SEQ ID NO: 1282898 - DNA, 16 bp, Homo sapiens
tgatcattagagaaat

SEQ ID NO: 1282899 - DNA, 18 bp, Homo sapiens
tgatcattgaaatacttt

SEQ ID NO: 1282900 - DNA, 14 bp, Homo sapiens
tgatccaactaatg

SEQ ID NO: 1282901 - DNA, 12 bp, Homo sapiens
tgatccacactt

SEQ ID NO: 1282902 - DNA, 15 bp, Homo sapiens
tgatccacccaaccc

SEQ ID NO: 1282903 - DNA, 19 bp, Homo sapiens
tgatccacccagttacagg

SEQ ID NO: 1282904 - DNA, 23 bp, Homo sapiens
tgatccactttgggggaggagaa

SEQ ID NO: 1282905 - DNA, 15 bp, Homo sapiens
tgatccagaacagtg

SEQ ID NO: 1282906 - DNA, 12 bp, Homo sapiens
tgatccagccct

SEQ ID NO: 1282907 - DNA, 16 bp, Homo sapiens
tgatccagccctggtt

SEQ ID NO: 1282908 - DNA, 19 bp, Homo sapiens
tgatcccaccccctcctcc

SEQ ID NO: 1282909 - DNA, 22 bp, Homo sapiens
tgatcccaccccctcctccccc

SEQ ID NO: 1282910 - DNA, 19 bp, Homo sapiens
tgatcccacttcactgtga

SEQ ID NO: 1282911 - DNA, 17 bp, Homo sapiens
tgatcccagacccattc

SEQ ID NO: 1282912 - DNA, 20 bp, Homo sapiens
tgatcccagacccattcctt

SEQ ID NO: 1282913 - DNA, 15 bp, Homo sapiens
tgatccctaatgtgt

SEQ ID NO: 1282914 - DNA, 20 bp, Homo sapiens
tgatccctgaacccctggcc

SEQ ID NO: 1282915 - DNA, 21 bp, Homo sapiens
tgatccctgaacccctggcca

SEQ ID NO: 1282916 - DNA, 23 bp, Homo sapiens
tgatccctgaacccctggccagc

SEQ ID NO: 1282917 - DNA, 19 bp, Homo sapiens
tgatccctgtgttgtctct

SEQ ID NO: 1282918 - DNA, 21 bp, Homo sapiens
tgatccctgttacccagagaa

SEQ ID NO: 1282919 - DNA, 19 bp, Homo sapiens
tgatcccttctcctgccct

SEQ ID NO: 1282920 - DNA, 21 bp, Homo sapiens
tgatccggctgctcctccagc

SEQ ID NO: 1282921 - DNA, 22 bp, Homo sapiens
tgatccggctgctcctccagcc

SEQ ID NO: 1282922 - DNA, 19 bp, Homo sapiens
tgatccgtccgaggctgct

SEQ ID NO: 1282923 - DNA, 22 bp, Homo sapiens
tgatccgttccattgcaagctt

SEQ ID NO: 1282924 - DNA, 15 bp, Homo sapiens
tgatcctaagaattt

SEQ ID NO: 1282925 - DNA, 21 bp, Homo sapiens
tgatcctcagcccctccagtc

SEQ ID NO: 1282926 - DNA, 16 bp, Homo sapiens
tgatcctccaatgtct

SEQ ID NO: 1282927 - DNA, 14 bp, Homo sapiens
tgattattatgttt

SEQ ID NO: 1282928 - DNA, 16 bp, Homo sapiens
tgattattatgtttat

SEQ ID NO: 1282929 - DNA, 22 bp, Homo sapiens
tgattatttaaaaagagaaagt

SEQ ID NO: 1282930 - DNA, 19 bp, Homo sapiens
tgattattttcttcatcca

SEQ ID NO: 1282931 - DNA, 21 bp, Homo sapiens
tgattcaaaccaaagctgcct

SEQ ID NO: 1282932 - DNA, 22 bp, Homo sapiens
tgattcaaagtgttgtgttcct

SEQ ID NO: 1282933 - DNA, 17 bp, Homo sapiens
tgattcaatctgtaaac

SEQ ID NO: 1282934 - DNA, 21 bp, Homo sapiens
tgattcaatctgtaaactgtg

SEQ ID NO: 1282935 - DNA, 19 bp, Homo sapiens
tgattcaattttttaatgt

SEQ ID NO: 1282936 - DNA, 24 bp, Homo sapiens
tgattcaccaaaatagtcttctca

SEQ ID NO: 1282937 - DNA, 21 bp, Homo sapiens
tgattcacctcttcctctggt

SEQ ID NO: 1282938 - DNA, 16 bp, Homo sapiens
tgattcacctcttctt

SEQ ID NO: 1282939 - DNA, 17 bp, Homo sapiens
tgattcactgcatggct

SEQ ID NO: 1282940 - DNA, 20 bp, Homo sapiens
tgattcagaaaatgttctgt

SEQ ID NO: 1282941 - DNA, 22 bp, Homo sapiens
tgattcagaaaatgttctgttt

SEQ ID NO: 1282942 - DNA, 14 bp, Homo sapiens
tgattcagaaattg

SEQ ID NO: 1282943 - DNA, 20 bp, Homo sapiens
tgattcagactttcacacca

SEQ ID NO: 1282944 - DNA, 22 bp, Homo sapiens
tgattcagctcattatgaaaaa

SEQ ID NO: 1282945 - DNA, 22 bp, Homo sapiens
tgattcagtatcttagagttta

SEQ ID NO: 1282946 - DNA, 16 bp, Homo sapiens
tgattcatagtaactt

SEQ ID NO: 1282947 - DNA, 19 bp, Homo sapiens
tgattcatagtaacttctt

SEQ ID NO: 1282948 - DNA, 14 bp, Homo sapiens
tgattcatctctgg

SEQ ID NO: 1282949 - DNA, 15 bp, Homo sapiens
tgattcatctctggt

SEQ ID NO: 1282950 - DNA, 16 bp, Homo sapiens
tgattcatctctggtt

SEQ ID NO: 1282951 - DNA, 15 bp, Homo sapiens
tgattcattttcctg

SEQ ID NO: 1282952 - DNA, 17 bp, Homo sapiens
tgattccaaatatgtat

SEQ ID NO: 1282953 - DNA, 21 bp, Homo sapiens
tgattccactacacctggctg

SEQ ID NO: 1282954 - DNA, 15 bp, Homo sapiens
tgattccagaacaaa

SEQ ID NO: 1282955 - DNA, 18 bp, Homo sapiens
tgattccatccacctttc

SEQ ID NO: 1282956 - DNA, 13 bp, Homo sapiens
tgattccattcca

SEQ ID NO: 1282957 - DNA, 16 bp, Homo sapiens
tgattcctacccctct

SEQ ID NO: 1282958 - DNA, 11 bp, Homo sapiens
tgattcctggc

SEQ ID NO: 1282959 - DNA, 14 bp, Homo sapiens
tgattcctttaaaa

SEQ ID NO: 1282960 - DNA, 19 bp, Homo sapiens
tgattcctttaaaatatat

SEQ ID NO: 1282961 - DNA, 22 bp, Homo sapiens
tgattcgaagggtcttaaagaa

SEQ ID NO: 1282962 - DNA, 23 bp, Homo sapiens
tgattcgaagggtcttaaagaat

SEQ ID NO: 1282963 - DNA, 21 bp, Homo sapiens
tgattcgcccaaagccagaca

SEQ ID NO: 1282964 - DNA, 17 bp, Homo sapiens
tgattctaatgtcttca

SEQ ID NO: 1282965 - DNA, 15 bp, Homo sapiens
tgattctcctgcctc

SEQ ID NO: 1282966 - DNA, 21 bp, Homo sapiens
tgattctctaccaacaataaa

SEQ ID NO: 1282967 - DNA, 21 bp, Homo sapiens
tgattctctttaactgtgtga

SEQ ID NO: 1282968 - DNA, 17 bp, Homo sapiens
tgattctgatttcagtt

SEQ ID NO: 1282969 - DNA, 12 bp, Homo sapiens
tgattctgcctt

SEQ ID NO: 1282970 - DNA, 13 bp, Homo sapiens
tgattctgccttt

SEQ ID NO: 1282971 - DNA, 18 bp, Homo sapiens
tgattcttaactaaaatt

SEQ ID NO: 1282972 - DNA, 13 bp, Homo sapiens
tgattcttacata

SEQ ID NO: 1282973 - DNA, 14 bp, Homo sapiens
tgattctttgttac

SEQ ID NO: 1282974 - DNA, 23 bp, Homo sapiens
tgattctttttaaagtgtttctg

SEQ ID NO: 1282975 - DNA, 22 bp, Homo sapiens
tgattgaaaatagtaaatgctt

SEQ ID NO: 1282976 - DNA, 20 bp, Homo sapiens
tgattgaaccagctcatctc

SEQ ID NO: 1282977 - DNA, 19 bp, Homo sapiens
tgattgacagctttgctgc

SEQ ID NO: 1282978 - DNA, 21 bp, Homo sapiens
tgattgacagctttgctgctg

SEQ ID NO: 1282979 - DNA, 15 bp, Homo sapiens
tgattgaggtgggtc

SEQ ID NO: 1282980 - DNA, 18 bp, Homo sapiens
tgattgatcacacagtgt

SEQ ID NO: 1282981 - DNA, 19 bp, Homo sapiens
tgattgatcacacagtgtt

SEQ ID NO: 1282982 - DNA, 20 bp, Homo sapiens
tgattgatgtacagaacaca

SEQ ID NO: 1282983 - DNA, 14 bp, Homo sapiens
tgattgattcagta

SEQ ID NO: 1282984 - DNA, 22 bp, Homo sapiens
tgattgattcagtatcttagag

SEQ ID NO: 1282985 - DNA, 20 bp, Homo sapiens
tgattgcacagaatttgtat

SEQ ID NO: 1282986 - DNA, 20 bp, Homo sapiens
tgattgctgccataattcta

SEQ ID NO: 1282987 - DNA, 16 bp, Homo sapiens
tgattgctttgctgca

SEQ ID NO: 1282988 - DNA, 17 bp, Homo sapiens
tgattgctttgctgcac

SEQ ID NO: 1282989 - DNA, 22 bp, Homo sapiens
tgattggaatttctggcctcct

SEQ ID NO: 1282990 - DNA, 23 bp, Homo sapiens
tgattggacattttcttcagaga

SEQ ID NO: 1282991 - DNA, 17 bp, Homo sapiens
tgattggaccaggccat

SEQ ID NO: 1282992 - DNA, 16 bp, Homo sapiens
tgattggattattcat

SEQ ID NO: 1282993 - DNA, 18 bp, Homo sapiens
tgattgggaggtgcgtgt

SEQ ID NO: 1282994 - DNA, 21 bp, Homo sapiens
tgattggtgcaacccttaccc

SEQ ID NO: 1282995 - DNA, 12 bp, Homo sapiens
tgattgtaaaat

SEQ ID NO: 1282996 - DNA, 23 bp, Homo sapiens
tgattgtaaaatagcttgtatag

SEQ ID NO: 1282997 - DNA, 19 bp, Homo sapiens
tgattgtacagaatcattg

SEQ ID NO: 1282998 - DNA, 23 bp, Homo sapiens
tgattgtacagaatcattgctta

SEQ ID NO: 1282999 - DNA, 17 bp, Homo sapiens
tgattgtcagccacctc

SEQ ID NO: 1283000 - DNA, 14 bp, Homo sapiens
tgattgtcagctac

SEQ ID NO: 1283001 - DNA, 13 bp, Homo sapiens
tgattgtcttaat

SEQ ID NO: 1283002 - DNA, 18 bp, Homo sapiens
tgattgtcttaatattgt

SEQ ID NO: 1283003 - DNA, 18 bp, Homo sapiens
tgattgttcgggtgtgca

SEQ ID NO: 1283004 - DNA, 23 bp, Homo sapiens
tgatttaaaagtgtattttattc

SEQ ID NO: 1283005 - DNA, 16 bp, Homo sapiens
tgatttaaacacacag

SEQ ID NO: 1283006 - DNA, 17 bp, Homo sapiens
tgatttaatatgcaaag

SEQ ID NO: 1283007 - DNA, 16 bp, Homo sapiens
tgatttaatgttttct

SEQ ID NO: 1283008 - DNA, 19 bp, Homo sapiens
tgatttacagcaagtagat

SEQ ID NO: 1283009 - DNA, 18 bp, Homo sapiens
tgatttagaagcaaagat

SEQ ID NO: 1283010 - DNA, 23 bp, Homo sapiens
tgatttagaagcaaagatttcag

SEQ ID NO: 1283011 - DNA, 19 bp, Homo sapiens
tgatttagggaagcaggga

SEQ ID NO: 1283012 - DNA, 22 bp, Homo sapiens
tgatttagtgtttttacctctg

SEQ ID NO: 1283013 - DNA, 15 bp, Homo sapiens
tgatttataaacaga

SEQ ID NO: 1283014 - DNA, 15 bp, Homo sapiens
tgatttatactgtga

SEQ ID NO: 1283015 - DNA, 16 bp, Homo sapiens
tgatttatagtttgta

SEQ ID NO: 1283016 - DNA, 17 bp, Homo sapiens
tgatttatatatggcat

SEQ ID NO: 1283017 - DNA, 18 bp, Homo sapiens
tgatttatatatggcata

SEQ ID NO: 1283018 - DNA, 20 bp, Homo sapiens
tgatttatcctcacataaaa

SEQ ID NO: 1283019 - DNA, 16 bp, Homo sapiens
tgatttatctttcaag

SEQ ID NO: 1283020 - DNA, 13 bp, Homo sapiens
tgatttatgcatg

SEQ ID NO: 1283021 - DNA, 15 bp, Homo sapiens
tgatttcaaaatcag

SEQ ID NO: 1283022 - DNA, 17 bp, Homo sapiens
tgatttcactttgggat

SEQ ID NO: 1283023 - DNA, 20 bp, Homo sapiens
tgatttcagcacctacagtg

SEQ ID NO: 1283024 - DNA, 21 bp, Homo sapiens
tgatttcagcacctacagtgt

SEQ ID NO: 1283025 - DNA, 18 bp, Homo sapiens
tgatttcaggatactctg

SEQ ID NO: 1283026 - DNA, 23 bp, Homo sapiens
tgatttcaggatactctgtcaga

SEQ ID NO: 1283027 - DNA, 19 bp, Homo sapiens
tgatttcagtaagtctcat

SEQ ID NO: 1283028 - DNA, 22 bp, Homo sapiens
tgatttcagtagcacaagttat

SEQ ID NO: 1283029 - DNA, 22 bp, Homo sapiens
tgatttcagtttttcatttgtt

SEQ ID NO: 1283030 - DNA, 23 bp, Homo sapiens
tgatttcagtttttcatttgttt

SEQ ID NO: 1283031 - DNA, 20 bp, Homo sapiens
tgatttcataattcagaact

SEQ ID NO: 1283032 - DNA, 19 bp, Homo sapiens
tgatttcatcttctggaat

SEQ ID NO: 1283033 - DNA, 17 bp, Homo sapiens
tgatttcatttcaactg

SEQ ID NO: 1283034 - DNA, 14 bp, Homo sapiens
tgatttccaggccc

SEQ ID NO: 1283035 - DNA, 16 bp, Homo sapiens
tgatttcctaaacata

SEQ ID NO: 1283036 - DNA, 15 bp, Homo sapiens
tgatttcctccctct

SEQ ID NO: 1283037 - DNA, 17 bp, Homo sapiens
tgatttccttgaatgtg

SEQ ID NO: 1283038 - DNA, 12 bp, Homo sapiens
tgatttctaatt

SEQ ID NO: 1283039 - DNA, 17 bp, Homo sapiens
tgatttctagaaagcct

SEQ ID NO: 1283040 - DNA, 13 bp, Homo sapiens
tgatttctattca

SEQ ID NO: 1283041 - DNA, 20 bp, Homo sapiens
tgatttctcagtgatttcct

SEQ ID NO: 1283042 - DNA, 13 bp, Homo sapiens
tgatttctctgaa

SEQ ID NO: 1283043 - DNA, 15 bp, Homo sapiens
tgatttctctgaaca

SEQ ID NO: 1283044 - DNA, 21 bp, Homo sapiens
tgatttctttaaaagaatgac

SEQ ID NO: 1283045 - DNA, 18 bp, Homo sapiens
tgatttgaaaaaaagcat

SEQ ID NO: 1283046 - DNA, 17 bp, Homo sapiens
tgatttgaagaacatgt

SEQ ID NO: 1283047 - DNA, 15 bp, Homo sapiens
tgatttgatctttgt

SEQ ID NO: 1283048 - DNA, 22 bp, Homo sapiens
tgcaccgccgccaccctgcccc

SEQ ID NO: 1283049 - DNA, 23 bp, Homo sapiens
tgcaccgccgccaccctgcccct

SEQ ID NO: 1283050 - DNA, 13 bp, Homo sapiens
tgcaccgtcctca

SEQ ID NO: 1283051 - DNA, 13 bp, Homo sapiens
tgcacctaaagaa

SEQ ID NO: 1283052 - DNA, 15 bp, Homo sapiens
tgcacctaaagaaaa

SEQ ID NO: 1283053 - DNA, 19 bp, Homo sapiens
tgcacctaaagaaaaacaa

SEQ ID NO: 1283054 - DNA, 17 bp, Homo sapiens
tgcacctagctgtgcaa

SEQ ID NO: 1283055 - DNA, 14 bp, Homo sapiens
tgcacctatctcag

SEQ ID NO: 1283056 - DNA, 18 bp, Homo sapiens
tgcacctatctcagccat

SEQ ID NO: 1283057 - DNA, 15 bp, Homo sapiens
tgcacctccccaaag

SEQ ID NO: 1283058 - DNA, 15 bp, Homo sapiens
tgcacctccccccac

SEQ ID NO: 1283059 - DNA, 23 bp, Homo sapiens
tgcacctccgcgggctgactggg

SEQ ID NO: 1283060 - DNA, 17 bp, Homo sapiens
tgcacctccgcttgcca

SEQ ID NO: 1283061 - DNA, 18 bp, Homo sapiens
tgcacctcctaccctccc

SEQ ID NO: 1283062 - DNA, 20 bp, Homo sapiens
tgcacctctgttcatttcac

SEQ ID NO: 1283063 - DNA, 13 bp, Homo sapiens
tgcacctgagacc

SEQ ID NO: 1283064 - DNA, 16 bp, Homo sapiens
tgcacctgccagcctg

SEQ ID NO: 1283065 - DNA, 22 bp, Homo sapiens
tgcacctgccagcctggcttct

SEQ ID NO: 1283066 - DNA, 19 bp, Homo sapiens
tgcacctgcccagctcccc

SEQ ID NO: 1283067 - DNA, 12 bp, Homo sapiens
tgcacctgcctc

SEQ ID NO: 1283068 - DNA, 12 bp, Homo sapiens
tgcacctgcctg

SEQ ID NO: 1283069 - DNA, 18 bp, Homo sapiens
tgcacctgcctgccgctg

SEQ ID NO: 1283070 - DNA, 21 bp, Homo sapiens
tgcacctgcctgccgctgcag

SEQ ID NO: 1283071 - DNA, 15 bp, Homo sapiens
tgcacctgctgcgtc

SEQ ID NO: 1283072 - DNA, 20 bp, Homo sapiens
tgcacctgctgcgtccccac

SEQ ID NO: 1283073 - DNA, 22 bp, Homo sapiens
tgcacctgctgcgtccccactc

SEQ ID NO: 1283074 - DNA, 20 bp, Homo sapiens
tgcacctggaatatataacc

SEQ ID NO: 1283075 - DNA, 14 bp, Homo sapiens
tgcacctggcctgg

SEQ ID NO: 1283076 - DNA, 19 bp, Homo sapiens
tgcacctggcctgggccac

SEQ ID NO: 1283077 - DNA, 22 bp, Homo sapiens
tgcacctgggcagctcctccct

SEQ ID NO: 1283078 - DNA, 17 bp, Homo sapiens
tgcacctgtactcagga

SEQ ID NO: 1283079 - DNA, 13 bp, Homo sapiens
tgcacctgtcccc

SEQ ID NO: 1283080 - DNA, 19 bp, Homo sapiens
tgcaccttaccaactttct

SEQ ID NO: 1283081 - DNA, 20 bp, Homo sapiens
tgcaccttaccaactttctg

SEQ ID NO: 1283082 - DNA, 21 bp, Homo sapiens
tgcaccttaccaactttctgt

SEQ ID NO: 1283083 - DNA, 21 bp, Homo sapiens
tgcaccttatatttctgtgta

SEQ ID NO: 1283084 - DNA, 18 bp, Homo sapiens
tgcacctttctagttgaa

SEQ ID NO: 1283085 - DNA, 20 bp, Homo sapiens
tgcacgacgccctctcccca

SEQ ID NO: 1283086 - DNA, 15 bp, Homo sapiens
tgcacgcctgagcgt

SEQ ID NO: 1283087 - DNA, 23 bp, Homo sapiens
tgcacgcgtatgttcgttgcagc

SEQ ID NO: 1283088 - DNA, 17 bp, Homo sapiens
tgcacgctcccctccat

SEQ ID NO: 1283089 - DNA, 22 bp, Homo sapiens
tgcacgctcccctccatcccca

SEQ ID NO: 1283090 - DNA, 15 bp, Homo sapiens
tgcacgctgcccagg

SEQ ID NO: 1283091 - DNA, 17 bp, Homo sapiens
tgcacgctgcccagggg

SEQ ID NO: 1283092 - DNA, 15 bp, Homo sapiens
tgcacgggcatgcac

SEQ ID NO: 1283093 - DNA, 21 bp, Homo sapiens
tgcacgtaggttccccagaga

SEQ ID NO: 1283094 - DNA, 12 bp, Homo sapiens
tgcacgtggaga

SEQ ID NO: 1283095 - DNA, 17 bp, Homo sapiens
tgcacgtggagagctgg

SEQ ID NO: 1283096 - DNA, 18 bp, Homo sapiens
tgcacgtggagagctggt

SEQ ID NO: 1283097 - DNA, 16 bp, Homo sapiens
tgcacgtggcctcttg

SEQ ID NO: 1283098 - DNA, 17 bp, Homo sapiens
tgcacgtggcctcttga

SEQ ID NO: 1283099 - DNA, 22 bp, Homo sapiens
tgcacgtggcctcttgagcagt

SEQ ID NO: 1283100 - DNA, 12 bp, Homo sapiens
tgcacgtgtgca

SEQ ID NO: 1283101 - DNA, 19 bp, Homo sapiens
tgcactaaagccagcctga

SEQ ID NO: 1283102 - DNA, 15 bp, Homo sapiens
tgcactaaggggccc

SEQ ID NO: 1283103 - DNA, 16 bp, Homo sapiens
tgcactactcctctgc

SEQ ID NO: 1283104 - DNA, 21 bp, Homo sapiens
tgcactaggaattctttgcat

SEQ ID NO: 1283105 - DNA, 15 bp, Homo sapiens
tgcactaggacttgg

SEQ ID NO: 1283106 - DNA, 14 bp, Homo sapiens
tgcactagtgcaat

SEQ ID NO: 1283107 - DNA, 15 bp, Homo sapiens
tgcactatgaggaat

SEQ ID NO: 1283108 - DNA, 17 bp, Homo sapiens
tgcactcatagggtgct

SEQ ID NO: 1283109 - DNA, 18 bp, Homo sapiens
tgcactcatgtggactgg

SEQ ID NO: 1283110 - DNA, 14 bp, Homo sapiens
tgcactccaatctg

SEQ ID NO: 1283111 - DNA, 15 bp, Homo sapiens
tgcactccagcctgg

SEQ ID NO: 1283112 - DNA, 16 bp, Homo sapiens
tgcactccagcctggg

SEQ ID NO: 1283113 - DNA, 17 bp, Homo sapiens
tgcactccagcctgggc

SEQ ID NO: 1283114 - DNA, 18 bp, Homo sapiens
tgcactccagcctgggcg

SEQ ID NO: 1283115 - DNA, 19 bp, Homo sapiens
tgcactccagcctgggtga

SEQ ID NO: 1283116 - DNA, 14 bp, Homo sapiens
tgcactcccacctg

SEQ ID NO: 1283117 - DNA, 17 bp, Homo sapiens
tgcactcccacctgaca

SEQ ID NO: 1283118 - DNA, 19 bp, Homo sapiens
tgcactcccgaccttagct

SEQ ID NO: 1283119 - DNA, 15 bp, Homo sapiens
tgcactcccgcctgg

SEQ ID NO: 1283120 - DNA, 13 bp, Homo sapiens
tgcactccctggc

SEQ ID NO: 1283121 - DNA, 21 bp, Homo sapiens
tgcactcctttatctgtaatt

SEQ ID NO: 1283122 - DNA, 19 bp, Homo sapiens
tgcactcgccatttcctca

SEQ ID NO: 1283123 - DNA, 18 bp, Homo sapiens
tgcactctaaactgcaaa

SEQ ID NO: 1283124 - DNA, 16 bp, Homo sapiens
tgcactctaacactcg

SEQ ID NO: 1283125 - DNA, 12 bp, Homo sapiens
tgcactcttgaa

SEQ ID NO: 1283126 - DNA, 18 bp, Homo sapiens
tgcactcttgaactgggc

SEQ ID NO: 1283127 - DNA, 19 bp, Homo sapiens
tgcactcttgaactgggcg

SEQ ID NO: 1283128 - DNA, 21 bp, Homo sapiens
tgcactgaaaacttagccaga

SEQ ID NO: 1283129 - DNA, 19 bp, Homo sapiens
tgcactgaaacctgagatg

SEQ ID NO: 1283130 - DNA, 18 bp, Homo sapiens
tgcactgaacagaattaa

SEQ ID NO: 1283131 - DNA, 14 bp, Homo sapiens
tgcactgaatatat

SEQ ID NO: 1283132 - DNA, 16 bp, Homo sapiens
tgcactgaatatataa

SEQ ID NO: 1283133 - DNA, 12 bp, Homo sapiens
tgcactgacagc

SEQ ID NO: 1283134 - DNA, 13 bp, Homo sapiens
tgcactgacctgc

SEQ ID NO: 1283135 - DNA, 12 bp, Homo sapiens
tgcactgactgt

SEQ ID NO: 1283136 - DNA, 12 bp, Homo sapiens
tgcactgagggc

SEQ ID NO: 1283137 - DNA, 14 bp, Homo sapiens
tgcactgagggcca

SEQ ID NO: 1283138 - DNA, 15 bp, Homo sapiens
tgcactgagggccac

SEQ ID NO: 1283139 - DNA, 22 bp, Homo sapiens
tgcactgatatatcatgagtga

SEQ ID NO: 1283140 - DNA, 21 bp, Homo sapiens
tgcactgcccatggacaggct

SEQ ID NO: 1283141 - DNA, 14 bp, Homo sapiens
tgcactgccccctg

SEQ ID NO: 1283142 - DNA, 23 bp, Homo sapiens
tgcactgccccctgcttggccag

SEQ ID NO: 1283143 - DNA, 18 bp, Homo sapiens
tgcactgctgttcctgct

SEQ ID NO: 1283144 - DNA, 14 bp, Homo sapiens
tgcactggagccac

SEQ ID NO: 1283145 - DNA, 18 bp, Homo sapiens
tgcactggagccacaggc

SEQ ID NO: 1283146 - DNA, 20 bp, Homo sapiens
tgcactggagccacaggcag

SEQ ID NO: 1283147 - DNA, 17 bp, Homo sapiens
tgcactgggaaggaaac

SEQ ID NO: 1283148 - DNA, 14 bp, Homo sapiens
tgcactgggcaggt

SEQ ID NO: 1283149 - DNA, 21 bp, Homo sapiens
tgcactgggcaggttcctggg

SEQ ID NO: 1283150 - DNA, 23 bp, Homo sapiens
tgcactgggcaggttcctggggc

SEQ ID NO: 1283151 - DNA, 16 bp, Homo sapiens
tgcactggggagcccg

SEQ ID NO: 1283152 - DNA, 13 bp, Homo sapiens
tgcactgtaaata

SEQ ID NO: 1283153 - DNA, 14 bp, Homo sapiens
tgcactgtaaatat

SEQ ID NO: 1283154 - DNA, 21 bp, Homo sapiens
tgcactgtcactttgctctgg

SEQ ID NO: 1283155 - DNA, 22 bp, Homo sapiens
tgcactgtgccccgcgggcttt

SEQ ID NO: 1283156 - DNA, 22 bp, Homo sapiens
tgcactgttactcttaatttta

SEQ ID NO: 1283157 - DNA, 15 bp, Homo sapiens
tgcacttacttgctt

SEQ ID NO: 1283158 - DNA, 16 bp, Homo sapiens
tgcacttacttgctta

SEQ ID NO: 1283159 - DNA, 21 bp, Homo sapiens
tgcacttcaaataattaaatc

SEQ ID NO: 1283160 - DNA, 15 bp, Homo sapiens
tgcacttcaaattca

SEQ ID NO: 1283161 - DNA, 18 bp, Homo sapiens
tgcacttgattcaggagg

SEQ ID NO: 1283162 - DNA, 15 bp, Homo sapiens
tgcactttaattgaa

SEQ ID NO: 1283163 - DNA, 18 bp, Homo sapiens
tgcactttaattgaagaa

SEQ ID NO: 1283164 - DNA, 18 bp, Homo sapiens
tgcactttataaacactg

SEQ ID NO: 1283165 - DNA, 16 bp, Homo sapiens
tgcactttccctagaa

SEQ ID NO: 1283166 - DNA, 22 bp, Homo sapiens
tgcactttctcatgatttacag

SEQ ID NO: 1283167 - DNA, 12 bp, Homo sapiens
tgcactttgtaa

SEQ ID NO: 1283168 - DNA, 16 bp, Homo sapiens
tgcactttgtttagaa

SEQ ID NO: 1283169 - DNA, 21 bp, Homo sapiens
tgcacttttagaaatgcatat

SEQ ID NO: 1283170 - DNA, 19 bp, Homo sapiens
tgcatcgggaaagaagaaa

SEQ ID NO: 1283171 - DNA, 20 bp, Homo sapiens
tgcatcgggaaagaagaaac

SEQ ID NO: 1283172 - DNA, 14 bp, Homo sapiens
tgcatctaatgaaa

SEQ ID NO: 1283173 - DNA, 18 bp, Homo sapiens
tgcatctaatgaaaaaca

SEQ ID NO: 1283174 - DNA, 19 bp, Homo sapiens
tgcatctactcccaagtat

SEQ ID NO: 1283175 - DNA, 18 bp, Homo sapiens
tgcatctagattatggag

SEQ ID NO: 1283176 - DNA, 19 bp, Homo sapiens
tgcatctcaaaattattct

SEQ ID NO: 1283177 - DNA, 15 bp, Homo sapiens
tgcatctcagcccac

SEQ ID NO: 1283178 - DNA, 12 bp, Homo sapiens
tgcatctctgtg

SEQ ID NO: 1283179 - DNA, 22 bp, Homo sapiens
tgcatctgaccagcagcgcctt

SEQ ID NO: 1283180 - DNA, 21 bp, Homo sapiens
tgcatctgcaggcaccgggct

SEQ ID NO: 1283181 - DNA, 19 bp, Homo sapiens
tgcatctgggattcccacc

SEQ ID NO: 1283182 - DNA, 20 bp, Homo sapiens
tgcatctgggattcccacca

SEQ ID NO: 1283183 - DNA, 18 bp, Homo sapiens
tgcatctgggtagctgta

SEQ ID NO: 1283184 - DNA, 20 bp, Homo sapiens
tgcatctgtataagtaagaa

SEQ ID NO: 1283185 - DNA, 23 bp, Homo sapiens
tgcatctgtataagtaagaaaat

SEQ ID NO: 1283186 - DNA, 22 bp, Homo sapiens
tgcatcttacagaagagtaaac

SEQ ID NO: 1283187 - DNA, 13 bp, Homo sapiens
tgcatctttccct

SEQ ID NO: 1283188 - DNA, 21 bp, Homo sapiens
tgcatctttccctgccctccc

SEQ ID NO: 1283189 - DNA, 18 bp, Homo sapiens
tgcatctttttttcattt

SEQ ID NO: 1283190 - DNA, 20 bp, Homo sapiens
tgcatgaaaaatcatgggcc

SEQ ID NO: 1283191 - DNA, 14 bp, Homo sapiens
tgcatgaaaaggat

SEQ ID NO: 1283192 - DNA, 18 bp, Homo sapiens
tgcatgaaaagtgcatgg

SEQ ID NO: 1283193 - DNA, 11 bp, Homo sapiens
tgcatgaaaat

SEQ ID NO: 1283194 - DNA, 10 bp, Homo sapiens
tgcatgaaat

SEQ ID NO: 1283195 - DNA, 18 bp, Homo sapiens
tgcatgaagagaagcaat

SEQ ID NO: 1283196 - DNA, 22 bp, Homo sapiens
tgcatgaagagaagcaattttg

SEQ ID NO: 1283197 - DNA, 22 bp, Homo sapiens
tgcatgaagtaatatgcacaca

SEQ ID NO: 1283198 - DNA, 20 bp, Homo sapiens
tgcatgaattactgtatata

SEQ ID NO: 1283199 - DNA, 24 bp, Homo sapiens
tgcatgaccacatagaacatgtgt

SEQ ID NO: 1283200 - DNA, 18 bp, Homo sapiens
tgcatgatgccctcccct

SEQ ID NO: 1283201 - DNA, 15 bp, Homo sapiens
tgcatgatgtttgcc

SEQ ID NO: 1283202 - DNA, 21 bp, Homo sapiens
tgcatgattcttctcttgtga

SEQ ID NO: 1283203 - DNA, 14 bp, Homo sapiens
tgcatgattttgta

SEQ ID NO: 1283204 - DNA, 13 bp, Homo sapiens
tgcatgcaactaa

SEQ ID NO: 1283205 - DNA, 18 bp, Homo sapiens
tgcatgcagccactgtgc

SEQ ID NO: 1283206 - DNA, 22 bp, Homo sapiens
tgcatgcagccactgtgctgaa

SEQ ID NO: 1283207 - DNA, 11 bp, Homo sapiens
tgcatgccagg

SEQ ID NO: 1283208 - DNA, 13 bp, Homo sapiens
tgcatgccaggct

SEQ ID NO: 1283209 - DNA, 17 bp, Homo sapiens
tgcatgccaggctgggc

SEQ ID NO: 1283210 - DNA, 15 bp, Homo sapiens
tgcatgcgcaggctc

SEQ ID NO: 1283211 - DNA, 16 bp, Homo sapiens
tgcatgcgcaggctca

SEQ ID NO: 1283212 - DNA, 21 bp, Homo sapiens
tgcatgctattcacaattatt

SEQ ID NO: 1283213 - DNA, 17 bp, Homo sapiens
tgcatgctctggaagcc

SEQ ID NO: 1283214 - DNA, 17 bp, Homo sapiens
tgcatgctgataatcat

SEQ ID NO: 1283215 - DNA, 18 bp, Homo sapiens
tgcatgctgataatcatt

SEQ ID NO: 1283216 - DNA, 16 bp, Homo sapiens
tgcatgcttagagcat

SEQ ID NO: 1283217 - DNA, 15 bp, Homo sapiens
tgcatggaaacctga

SEQ ID NO: 1283218 - DNA, 19 bp, Homo sapiens
tgcatggaaacctgaaaaa

SEQ ID NO: 1283219 - DNA, 12 bp, Homo sapiens
tgcatggaaatc

SEQ ID NO: 1283220 - DNA, 15 bp, Homo sapiens
tgcatggaaatcagc

SEQ ID NO: 1283221 - DNA, 16 bp, Homo sapiens
tgcatggaagttgggg

SEQ ID NO: 1283222 - DNA, 12 bp, Homo sapiens
tgcatggagaag

SEQ ID NO: 1283223 - DNA, 13 bp, Homo sapiens
tgcatggagcagg

SEQ ID NO: 1283224 - DNA, 16 bp, Homo sapiens
tgcatggaggccctcc

SEQ ID NO: 1283225 - DNA, 20 bp, Homo sapiens
tgcatggatttctttgaaaa

SEQ ID NO: 1283226 - DNA, 15 bp, Homo sapiens
tgcatggcagggcct

SEQ ID NO: 1283227 - DNA, 21 bp, Homo sapiens
tgcatggcagggcctcatctc

SEQ ID NO: 1283228 - DNA, 16 bp, Homo sapiens
tgcatggctccagaaa

SEQ ID NO: 1283229 - DNA, 20 bp, Homo sapiens
tgcatggctccagaaatgtc

SEQ ID NO: 1283230 - DNA, 16 bp, Homo sapiens
tgcatggctcctgtct

SEQ ID NO: 1283231 - DNA, 21 bp, Homo sapiens
tgcatggctcctgtctggctc

SEQ ID NO: 1283232 - DNA, 19 bp, Homo sapiens
tgcatgggctaatgaagat

SEQ ID NO: 1283233 - DNA, 15 bp, Homo sapiens
tgcatggggaggcag

SEQ ID NO: 1283234 - DNA, 16 bp, Homo sapiens
tgcatgggggcaccgg

SEQ ID NO: 1283235 - DNA, 22 bp, Homo sapiens
tgcatgggggcaccgggctcca

SEQ ID NO: 1283236 - DNA, 17 bp, Homo sapiens
tgcatgggtgaagggag

SEQ ID NO: 1283237 - DNA, 23 bp, Homo sapiens
tgcatggtgcagttgacagcagg

SEQ ID NO: 1283238 - DNA, 14 bp, Homo sapiens
tgcatgtacttgaa

SEQ ID NO: 1283239 - DNA, 22 bp, Homo sapiens
tgcatgtacttgaaggatggat

SEQ ID NO: 1283240 - DNA, 12 bp, Homo sapiens
tgcatgtagtaa

SEQ ID NO: 1283241 - DNA, 16 bp, Homo sapiens
tgcatgtatgtataca

SEQ ID NO: 1283242 - DNA, 12 bp, Homo sapiens
tgcatgtattag

SEQ ID NO: 1283243 - DNA, 23 bp, Homo sapiens
tgcatgtcctttgcgcctgtgac

SEQ ID NO: 1283244 - DNA, 16 bp, Homo sapiens
tgcatgtcgcacaatg

SEQ ID NO: 1283245 - DNA, 17 bp, Homo sapiens
tgcatgtcgcacaatgt

SEQ ID NO: 1283246 - DNA, 18 bp, Homo sapiens
tgcatgtcgcacaatgtt

SEQ ID NO: 1283247 - DNA, 15 bp, Homo sapiens
tgcatgtctgttctt

SEQ ID NO: 1283248 - DNA, 13 bp, Homo sapiens
tgcatgtcttaaa

SEQ ID NO: 1283249 - DNA, 17 bp, Homo sapiens
tgcatgtcttaaatgct

SEQ ID NO: 1283250 - DNA, 20 bp, Homo sapiens
tgcatgtcttaaatgctcat

SEQ ID NO: 1283251 - DNA, 16 bp, Homo sapiens
tgcatgtgaagaaagg

SEQ ID NO: 1283252 - DNA, 23 bp, Homo sapiens
tgcatgtgaagcatgctttgctg

SEQ ID NO: 1283253 - DNA, 18 bp, Homo sapiens
tgcatgtgagcacatgcg

SEQ ID NO: 1283254 - DNA, 19 bp, Homo sapiens
tgcatgtgagcacatgcgt

SEQ ID NO: 1283255 - DNA, 13 bp, Homo sapiens
tgcatgtgctgtc

SEQ ID NO: 1283256 - DNA, 21 bp, Homo sapiens
tgcatgtgctgtctccatgct

SEQ ID NO: 1283257 - DNA, 23 bp, Homo sapiens
tgcatgtgctgtctccatgctgg

SEQ ID NO: 1283258 - DNA, 23 bp, Homo sapiens
tgcatgtggcttctctgtctctg

SEQ ID NO: 1283259 - DNA, 11 bp, Homo sapiens
tgcatgtgtgt

SEQ ID NO: 1283260 - DNA, 14 bp, Homo sapiens
tgcatgttatgttt

SEQ ID NO: 1283261 - DNA, 15 bp, Homo sapiens
tgcatgttatgttta

SEQ ID NO: 1283262 - DNA, 23 bp, Homo sapiens
tgcatgttggggtttcctttacc

SEQ ID NO: 1283263 - DNA, 15 bp, Homo sapiens
tgcattaaaagaaaa

SEQ ID NO: 1283264 - DNA, 16 bp, Homo sapiens
tgcattaaaagaaaat

SEQ ID NO: 1283265 - DNA, 17 bp, Homo sapiens
tgcattaaaagaaaata

SEQ ID NO: 1283266 - DNA, 14 bp, Homo sapiens
tgcattaaacctgt

SEQ ID NO: 1283267 - DNA, 14 bp, Homo sapiens
tgcattaaattcac

SEQ ID NO: 1283268 - DNA, 16 bp, Homo sapiens
tgcattaataaaaatc

SEQ ID NO: 1283269 - DNA, 22 bp, Homo sapiens
tgcattacagagaggagaaaca

SEQ ID NO: 1283270 - DNA, 14 bp, Homo sapiens
tgcattactctggt

SEQ ID NO: 1283271 - DNA, 14 bp, Homo sapiens
tgcattagaaatta

SEQ ID NO: 1283272 - DNA, 12 bp, Homo sapiens
tgcattatctag

SEQ ID NO: 1283273 - DNA, 21 bp, Homo sapiens
tgcattatctagatactgtat

SEQ ID NO: 1283274 - DNA, 15 bp, Homo sapiens
tgcattatgtacaca

SEQ ID NO: 1283275 - DNA, 15 bp, Homo sapiens
tgcattatgtattta

SEQ ID NO: 1283276 - DNA, 19 bp, Homo sapiens
tgcattatgtatttataat

SEQ ID NO: 1283277 - DNA, 20 bp, Homo sapiens
tgcattcaccttagtgcaac

SEQ ID NO: 1283278 - DNA, 14 bp, Homo sapiens
tgcattcattttta

SEQ ID NO: 1283279 - DNA, 19 bp, Homo sapiens
tgcattcctgtgccctaga

SEQ ID NO: 1283280 - DNA, 23 bp, Homo sapiens
tgcattcctgtgccctagatgca

SEQ ID NO: 1283281 - DNA, 13 bp, Homo sapiens
tgcattccttact

SEQ ID NO: 1283282 - DNA, 17 bp, Homo sapiens
tgcattccttacttgca

SEQ ID NO: 1283283 - DNA, 18 bp, Homo sapiens
tgcattccttacttgcac

SEQ ID NO: 1283284 - DNA, 15 bp, Homo sapiens
tgcattcctttgtct

SEQ ID NO: 1283285 - DNA, 18 bp, Homo sapiens
tgcattcgttgtgttttt

SEQ ID NO: 1283286 - DNA, 12 bp, Homo sapiens
tgcattctagta

SEQ ID NO: 1283287 - DNA, 20 bp, Homo sapiens
tgcattctctcccatcctgg

SEQ ID NO: 1283288 - DNA, 18 bp, Homo sapiens
tgcattctggccaagggg

SEQ ID NO: 1283289 - DNA, 17 bp, Homo sapiens
tgcattctgtttcctct

SEQ ID NO: 1283290 - DNA, 20 bp, Homo sapiens
tgcattctgtttcctcttga

SEQ ID NO: 1283291 - DNA, 22 bp, Homo sapiens
tgcattcttaacaaactcttca

SEQ ID NO: 1283292 - DNA, 14 bp, Homo sapiens
tgccatggcaatgg

SEQ ID NO: 1283293 - DNA, 14 bp, Homo sapiens
tgccatggcccccc

SEQ ID NO: 1283294 - DNA, 19 bp, Homo sapiens
tgccatggccccccactcc

SEQ ID NO: 1283295 - DNA, 17 bp, Homo sapiens
tgccatggcgtgtccct

SEQ ID NO: 1283296 - DNA, 23 bp, Homo sapiens
tgccatgtaaaggcctttaataa

SEQ ID NO: 1283297 - DNA, 19 bp, Homo sapiens
tgccatgtacctcccctgc

SEQ ID NO: 1283298 - DNA, 23 bp, Homo sapiens
tgccatgtacctcccctgccttg

SEQ ID NO: 1283299 - DNA, 17 bp, Homo sapiens
tgccatgtcaaacaaat

SEQ ID NO: 1283300 - DNA, 15 bp, Homo sapiens
tgccatgtgcacctt

SEQ ID NO: 1283301 - DNA, 15 bp, Homo sapiens
tgccatgttgcccct

SEQ ID NO: 1283302 - DNA, 18 bp, Homo sapiens
tgccatgttttgccaccc

SEQ ID NO: 1283303 - DNA, 17 bp, Homo sapiens
tgccattacagaaccaa

SEQ ID NO: 1283304 - DNA, 17 bp, Homo sapiens
tgccattactactgtac

SEQ ID NO: 1283305 - DNA, 16 bp, Homo sapiens
tgccattagccaagga

SEQ ID NO: 1283306 - DNA, 18 bp, Homo sapiens
tgccattatatttgcatt

SEQ ID NO: 1283307 - DNA, 22 bp, Homo sapiens
tgccattatatttgcattatgt

SEQ ID NO: 1283308 - DNA, 21 bp, Homo sapiens
tgccattattttctgtcagat

SEQ ID NO: 1283309 - DNA, 18 bp, Homo sapiens
tgccattccactccactc

SEQ ID NO: 1283310 - DNA, 14 bp, Homo sapiens
tgccattcccagcg

SEQ ID NO: 1283311 - DNA, 15 bp, Homo sapiens
tgccattgccaggag

SEQ ID NO: 1283312 - DNA, 20 bp, Homo sapiens
tgccattgccaggagatggc

SEQ ID NO: 1283313 - DNA, 14 bp, Homo sapiens
tgccattggcctct

SEQ ID NO: 1283314 - DNA, 19 bp, Homo sapiens
tgccattggggtagttgtg

SEQ ID NO: 1283315 - DNA, 18 bp, Homo sapiens
tgccattgtactccagcc

SEQ ID NO: 1283316 - DNA, 18 bp, Homo sapiens
tgccatttcagtggcttc

SEQ ID NO: 1283317 - DNA, 16 bp, Homo sapiens
tgccatttctcacgcc

SEQ ID NO: 1283318 - DNA, 14 bp, Homo sapiens
tgccatttctctgc

SEQ ID NO: 1283319 - DNA, 16 bp, Homo sapiens
tgccatttctctgctt

SEQ ID NO: 1283320 - DNA, 21 bp, Homo sapiens
tgccatttcttctctctgttc

SEQ ID NO: 1283321 - DNA, 19 bp, Homo sapiens
tgccatttgcaccctccgc

SEQ ID NO: 1283322 - DNA, 23 bp, Homo sapiens
tgccatttggtgtggattttcta

SEQ ID NO: 1283323 - DNA, 23 bp, Homo sapiens
tgccattttaaattttattttta

SEQ ID NO: 1283324 - DNA, 18 bp, Homo sapiens
tgccatttttattagaaa

SEQ ID NO: 1283325 - DNA, 23 bp, Homo sapiens
tgccatttttctataaatcagta

SEQ ID NO: 1283326 - DNA, 20 bp, Homo sapiens
tgccattttttaagagacag

SEQ ID NO: 1283327 - DNA, 21 bp, Homo sapiens
tgcccaaaagaggtgtcatgc

SEQ ID NO: 1283328 - DNA, 13 bp, Homo sapiens
tgcccaaaccctt

SEQ ID NO: 1283329 - DNA, 21 bp, Homo sapiens
tgcccaaacccttaactgaca

SEQ ID NO: 1283330 - DNA, 15 bp, Homo sapiens
tgcccaaactcccct

SEQ ID NO: 1283331 - DNA, 18 bp, Homo sapiens
tgcccaaactccccttcc

SEQ ID NO: 1283332 - DNA, 16 bp, Homo sapiens
tgcccaaataggagga

SEQ ID NO: 1283333 - DNA, 18 bp, Homo sapiens
tgcccaacctgctctcct

SEQ ID NO: 1283334 - DNA, 22 bp, Homo sapiens
tgcccaacctgctctcctcttg

SEQ ID NO: 1283335 - DNA, 23 bp, Homo sapiens
tgcccaacctgctctcctcttgc

SEQ ID NO: 1283336 - DNA, 21 bp, Homo sapiens
tgcccaagaatagatgctgac

SEQ ID NO: 1283337 - DNA, 13 bp, Homo sapiens
tgcccaagccaga

SEQ ID NO: 1283338 - DNA, 18 bp, Homo sapiens
tgcccaagccagaggctg

SEQ ID NO: 1283339 - DNA, 20 bp, Homo sapiens
tgcccaagccagaggctggg

SEQ ID NO: 1283340 - DNA, 17 bp, Homo sapiens
tgcccaagctggtctta

SEQ ID NO: 1283341 - DNA, 15 bp, Homo sapiens
tgcccaaggatgcct

SEQ ID NO: 1283342 - DNA, 13 bp, Homo sapiens
tgcccaaggccac

SEQ ID NO: 1283343 - DNA, 18 bp, Homo sapiens
tgcccaagggcctcccac

SEQ ID NO: 1283344 - DNA, 21 bp, Homo sapiens
tgcccaagggcctcccaccag

SEQ ID NO: 1283345 - DNA, 9 bp, Homo sapiens
tgcccaagt

SEQ ID NO: 1283346 - DNA, 17 bp, Homo sapiens
tgcccaagtgaccaggg

SEQ ID NO: 1283347 - DNA, 17 bp, Homo sapiens
tgcccaagtgggcagtc

SEQ ID NO: 1283348 - DNA, 20 bp, Homo sapiens
tgcccaatgagactctaggg

SEQ ID NO: 1283349 - DNA, 16 bp, Homo sapiens
tgcccaatgctttggg

SEQ ID NO: 1283350 - DNA, 19 bp, Homo sapiens
tgcccaattccaggtgtgc

SEQ ID NO: 1283351 - DNA, 23 bp, Homo sapiens
tgcccacatcccaggcttcaccc

SEQ ID NO: 1283352 - DNA, 17 bp, Homo sapiens
tgcccacatgggacctg

SEQ ID NO: 1283353 - DNA, 18 bp, Homo sapiens
tgcccacatgggacctgg

SEQ ID NO: 1283354 - DNA, 16 bp, Homo sapiens
tgcccacatttgggct

SEQ ID NO: 1283355 - DNA, 18 bp, Homo sapiens
tgcccacatttgggctca

SEQ ID NO: 1283356 - DNA, 12 bp, Homo sapiens
tgcccacccccg

SEQ ID NO: 1283357 - DNA, 14 bp, Homo sapiens
tgcccacccccggg

SEQ ID NO: 1283358 - DNA, 22 bp, Homo sapiens
tgcccacccccgggatcctgcc

SEQ ID NO: 1283359 - DNA, 15 bp, Homo sapiens
tgcccaccccctcaa

SEQ ID NO: 1283360 - DNA, 20 bp, Homo sapiens
tgcccaccccctgccctgca

SEQ ID NO: 1283361 - DNA, 13 bp, Homo sapiens
tgcccacccctca

SEQ ID NO: 1283362 - DNA, 17 bp, Homo sapiens
tgcccacccctcactcc

SEQ ID NO: 1283363 - DNA, 13 bp, Homo sapiens
tgcccaccctacc

SEQ ID NO: 1283364 - DNA, 17 bp, Homo sapiens
tgcccaccctaccagct

SEQ ID NO: 1283365 - DNA, 22 bp, Homo sapiens
tgcccaccctaccagctcctcc

SEQ ID NO: 1283366 - DNA, 18 bp, Homo sapiens
tgcccaccgccctcctcc

SEQ ID NO: 1283367 - DNA, 19 bp, Homo sapiens
tgcccaccgccctcctcca

SEQ ID NO: 1283368 - DNA, 11 bp, Homo sapiens
tgcccacctct

SEQ ID NO: 1283369 - DNA, 17 bp, Homo sapiens
tgcccacctctccctgc

SEQ ID NO: 1283370 - DNA, 21 bp, Homo sapiens
tgcccacctctccctgcatcc

SEQ ID NO: 1283371 - DNA, 14 bp, Homo sapiens
tgcccacctctctt

SEQ ID NO: 1283372 - DNA, 16 bp, Homo sapiens
tgcccacctcttctgc

SEQ ID NO: 1283373 - DNA, 15 bp, Homo sapiens
tgcccacctgcccat

SEQ ID NO: 1283374 - DNA, 17 bp, Homo sapiens
tgcccacctgcccatca

SEQ ID NO: 1283375 - DNA, 19 bp, Homo sapiens
tgcccacctgcccatcaca

SEQ ID NO: 1283376 - DNA, 13 bp, Homo sapiens
tgcccacctgggg

SEQ ID NO: 1283377 - DNA, 14 bp, Homo sapiens
tgcccacctggggt

SEQ ID NO: 1283378 - DNA, 20 bp, Homo sapiens
tgcccacgatcccctccccc

SEQ ID NO: 1283379 - DNA, 22 bp, Homo sapiens
tgcccacgatcccctcccccaa

SEQ ID NO: 1283380 - DNA, 15 bp, Homo sapiens
tgcccacgcagagga

SEQ ID NO: 1283381 - DNA, 19 bp, Homo sapiens
tgcccacgctcctgccctc

SEQ ID NO: 1283382 - DNA, 19 bp, Homo sapiens
tgcccacggagtcgtgggg

SEQ ID NO: 1283383 - DNA, 19 bp, Homo sapiens
tgcccacggtctgagctag

SEQ ID NO: 1283384 - DNA, 22 bp, Homo sapiens
tgcccactgctgcagtagggga

SEQ ID NO: 1283385 - DNA, 17 bp, Homo sapiens
tgcccactggccgctga

SEQ ID NO: 1283386 - DNA, 11 bp, Homo sapiens
tgcccagaact

SEQ ID NO: 1283387 - DNA, 16 bp, Homo sapiens
tgcccagaacttccct

SEQ ID NO: 1283388 - DNA, 18 bp, Homo sapiens
tgcccagaacttccctga

SEQ ID NO: 1283389 - DNA, 17 bp, Homo sapiens
tgcccagacacagactg

SEQ ID NO: 1283390 - DNA, 15 bp, Homo sapiens
tgcccagaccacacg

SEQ ID NO: 1283391 - DNA, 22 bp, Homo sapiens
tgcccagacccctctggccagg

SEQ ID NO: 1283392 - DNA, 16 bp, Homo sapiens
tgcccagagatgcctc

SEQ ID NO: 1283393 - DNA, 19 bp, Homo sapiens
tgcccagagatgcctccac

SEQ ID NO: 1283394 - DNA, 18 bp, Homo sapiens
tgcccagagggcccaggc

SEQ ID NO: 1283395 - DNA, 19 bp, Homo sapiens
tgcccagagggcccaggca

SEQ ID NO: 1283396 - DNA, 21 bp, Homo sapiens
tgcccagagggcccaggcagg

SEQ ID NO: 1283397 - DNA, 23 bp, Homo sapiens
tgcccagagggcccaggcaggcc

SEQ ID NO: 1283398 - DNA, 18 bp, Homo sapiens
tgcccagcagctcaagaa

SEQ ID NO: 1283399 - DNA, 17 bp, Homo sapiens
tgcccagcaggcccagc

SEQ ID NO: 1283400 - DNA, 18 bp, Homo sapiens
tgcccagcaggcccagca

SEQ ID NO: 1283401 - DNA, 17 bp, Homo sapiens
tgcccagccacccctca

SEQ ID NO: 1283402 - DNA, 19 bp, Homo sapiens
tgcccagccacccctcaga

SEQ ID NO: 1283403 - DNA, 17 bp, Homo sapiens
tgcccagccactccagg

SEQ ID NO: 1283404 - DNA, 18 bp, Homo sapiens
tgcccagccagccacccc

SEQ ID NO: 1283405 - DNA, 21 bp, Homo sapiens
tgcccagccagccacccctgc

SEQ ID NO: 1283406 - DNA, 21 bp, Homo sapiens
tgcccagccccttttctctgc

SEQ ID NO: 1283407 - DNA, 12 bp, Homo sapiens
tgcccagctcct

SEQ ID NO: 1283408 - DNA, 15 bp, Homo sapiens
tgcccagctcctcac

SEQ ID NO: 1283409 - DNA, 14 bp, Homo sapiens
tgcccagcttgggc

SEQ ID NO: 1283410 - DNA, 16 bp, Homo sapiens
tgcccagcttgggccc

SEQ ID NO: 1283411 - DNA, 21 bp, Homo sapiens
tgcccagcttgggcccagctg

SEQ ID NO: 1283412 - DNA, 17 bp, Homo sapiens
tgcccaggagagccagc

SEQ ID NO: 1283413 - DNA, 14 bp, Homo sapiens
tgcctcactttctt

SEQ ID NO: 1283414 - DNA, 16 bp, Homo sapiens
tgcctcactttcttct

SEQ ID NO: 1283415 - DNA, 22 bp, Homo sapiens
tgcctcagacgttgcctgagaa

SEQ ID NO: 1283416 - DNA, 14 bp, Homo sapiens
tgcctcagagacca

SEQ ID NO: 1283417 - DNA, 15 bp, Homo sapiens
tgcctcagagaccag

SEQ ID NO: 1283418 - DNA, 16 bp, Homo sapiens
tgcctcagagaccagg

SEQ ID NO: 1283419 - DNA, 12 bp, Homo sapiens
tgcctcagcccg

SEQ ID NO: 1283420 - DNA, 18 bp, Homo sapiens
tgcctcagcctcccgagt

SEQ ID NO: 1283421 - DNA, 14 bp, Homo sapiens
tgcctcagcctccg

SEQ ID NO: 1283422 - DNA, 18 bp, Homo sapiens
tgcctcagccttctgagt

SEQ ID NO: 1283423 - DNA, 18 bp, Homo sapiens
tgcctcaggaccttttgg

SEQ ID NO: 1283424 - DNA, 21 bp, Homo sapiens
tgcctcaggaggcaggacctt

SEQ ID NO: 1283425 - DNA, 16 bp, Homo sapiens
tgcctcaggcactctc

SEQ ID NO: 1283426 - DNA, 20 bp, Homo sapiens
tgcctcaggcactctcctgt

SEQ ID NO: 1283427 - DNA, 12 bp, Homo sapiens
tgcctcaggcca

SEQ ID NO: 1283428 - DNA, 16 bp, Homo sapiens
tgcctcagttttcctt

SEQ ID NO: 1283429 - DNA, 18 bp, Homo sapiens
tgcctcagttttccttct

SEQ ID NO: 1283430 - DNA, 21 bp, Homo sapiens
tgcctcatagcatagccagca

SEQ ID NO: 1283431 - DNA, 20 bp, Homo sapiens
tgcctcatttcttcctctgc

SEQ ID NO: 1283432 - DNA, 22 bp, Homo sapiens
tgcctcatttcttcctctgcat

SEQ ID NO: 1283433 - DNA, 22 bp, Homo sapiens
tgcctccaagaggaacctctga

SEQ ID NO: 1283434 - DNA, 22 bp, Homo sapiens
tgcctccaagcggccctgtgtg

SEQ ID NO: 1283435 - DNA, 21 bp, Homo sapiens
tgcctccaattggtgcttcag

SEQ ID NO: 1283436 - DNA, 19 bp, Homo sapiens
tgcctccaccaccactggc

SEQ ID NO: 1283437 - DNA, 20 bp, Homo sapiens
tgcctccaccaccactggcc

SEQ ID NO: 1283438 - DNA, 21 bp, Homo sapiens
tgcctccaccaccactggcca

SEQ ID NO: 1283439 - DNA, 19 bp, Homo sapiens
tgcctccacccgtcctccc

SEQ ID NO: 1283440 - DNA, 23 bp, Homo sapiens
tgcctccacccgtcctccctcag

SEQ ID NO: 1283441 - DNA, 11 bp, Homo sapiens
tgcctccaccg

SEQ ID NO: 1283442 - DNA, 20 bp, Homo sapiens
tgcctccaggaaccacacca

SEQ ID NO: 1283443 - DNA, 11 bp, Homo sapiens
tgcctccaggt

SEQ ID NO: 1283444 - DNA, 22 bp, Homo sapiens
tgcctcccaaggtcctctcagt

SEQ ID NO: 1283445 - DNA, 22 bp, Homo sapiens
tgcctcccacacttgctggggc

SEQ ID NO: 1283446 - DNA, 23 bp, Homo sapiens
tgcctcccacacttgctggggct

SEQ ID NO: 1283447 - DNA, 16 bp, Homo sapiens
tgcctcccacttcact

SEQ ID NO: 1283448 - DNA, 17 bp, Homo sapiens
tgcctcccacttcactg

SEQ ID NO: 1283449 - DNA, 15 bp, Homo sapiens
tgcctcccaggcaag

SEQ ID NO: 1283450 - DNA, 23 bp, Homo sapiens
tgcctcccaggcaagcagctggt

SEQ ID NO: 1283451 - DNA, 15 bp, Homo sapiens
tgcctcccatgcctg

SEQ ID NO: 1283452 - DNA, 16 bp, Homo sapiens
tgcctccccaaccctg

SEQ ID NO: 1283453 - DNA, 14 bp, Homo sapiens
tgcctccccccaga

SEQ ID NO: 1283454 - DNA, 15 bp, Homo sapiens
tgcctccccccagac

SEQ ID NO: 1283455 - DNA, 17 bp, Homo sapiens
tgcctccccccagaccc

SEQ ID NO: 1283456 - DNA, 21 bp, Homo sapiens
tgcctccccccagaccccgcc

SEQ ID NO: 1283457 - DNA, 18 bp, Homo sapiens
tgcctccccggctcgagc

SEQ ID NO: 1283458 - DNA, 17 bp, Homo sapiens
tgcctcccctctccttc

SEQ ID NO: 1283459 - DNA, 17 bp, Homo sapiens
tgcctccctcaccctga

SEQ ID NO: 1283460 - DNA, 22 bp, Homo sapiens
tgcctccctcaccctgagcccc

SEQ ID NO: 1283461 - DNA, 16 bp, Homo sapiens
tgcctccctctcttcc

SEQ ID NO: 1283462 - DNA, 19 bp, Homo sapiens
tgcctccctgggccacctc

SEQ ID NO: 1283463 - DNA, 12 bp, Homo sapiens
tgcctcccttcc

SEQ ID NO: 1283464 - DNA, 13 bp, Homo sapiens
tgcctcccttccc

SEQ ID NO: 1283465 - DNA, 20 bp, Homo sapiens
tgcctcccttcccagtgggc

SEQ ID NO: 1283466 - DNA, 15 bp, Homo sapiens
tgcctccctttctgg

SEQ ID NO: 1283467 - DNA, 22 bp, Homo sapiens
tgcctccgcgtgatcaaagcca

SEQ ID NO: 1283468 - DNA, 23 bp, Homo sapiens
tgcctcctaggctggaagccatg

SEQ ID NO: 1283469 - DNA, 20 bp, Homo sapiens
tgcctcctcaaacccagtct

SEQ ID NO: 1283470 - DNA, 19 bp, Homo sapiens
tgcctcctcacccccagct

SEQ ID NO: 1283471 - DNA, 24 bp, Homo sapiens
tgcctcctcacccccagctttgct

SEQ ID NO: 1283472 - DNA, 13 bp, Homo sapiens
tgcctcctcagcc

SEQ ID NO: 1283473 - DNA, 14 bp, Homo sapiens
tgcctcctccctcc

SEQ ID NO: 1283474 - DNA, 19 bp, Homo sapiens
tgcctcctctcctcctcag

SEQ ID NO: 1283475 - DNA, 20 bp, Homo sapiens
tgcctcctctcctcctcagc

SEQ ID NO: 1283476 - DNA, 14 bp, Homo sapiens
tgcctcctgcagtt

SEQ ID NO: 1283477 - DNA, 23 bp, Homo sapiens
tgcctcctgccaccccttcctcc

SEQ ID NO: 1283478 - DNA, 18 bp, Homo sapiens
tgcctcctgcctgcccct

SEQ ID NO: 1283479 - DNA, 13 bp, Homo sapiens
tgcctcctgctct

SEQ ID NO: 1283480 - DNA, 13 bp, Homo sapiens
tgcctcctggccg

SEQ ID NO: 1283481 - DNA, 18 bp, Homo sapiens
tgcctcctgtggggaaag

SEQ ID NO: 1283482 - DNA, 18 bp, Homo sapiens
tgcctcctgttctgccca

SEQ ID NO: 1283483 - DNA, 19 bp, Homo sapiens
tgcctcctgttctgcccac

SEQ ID NO: 1283484 - DNA, 21 bp, Homo sapiens
tgcctcgaggcaccggcgctg

SEQ ID NO: 1283485 - DNA, 22 bp, Homo sapiens
tgcctcgaggcaccggcgctgc

SEQ ID NO: 1283486 - DNA, 21 bp, Homo sapiens
tgcctcgagggccgcctgcct

SEQ ID NO: 1283487 - DNA, 23 bp, Homo sapiens
tgcctcgagggccgcctgcctta

SEQ ID NO: 1283488 - DNA, 14 bp, Homo sapiens
tgcctcgcatccta

SEQ ID NO: 1283489 - DNA, 19 bp, Homo sapiens
tgcctcgctcaccgctggc

SEQ ID NO: 1283490 - DNA, 22 bp, Homo sapiens
tgcctcggtggccctgactgtc

SEQ ID NO: 1283491 - DNA, 20 bp, Homo sapiens
tgcctctaagctgctctaaa

SEQ ID NO: 1283492 - DNA, 20 bp, Homo sapiens
tgcctctactttgattctga

SEQ ID NO: 1283493 - DNA, 18 bp, Homo sapiens
tgcctctatgccctgcag

SEQ ID NO: 1283494 - DNA, 21 bp, Homo sapiens
tgcctctatgccctgcagagc

SEQ ID NO: 1283495 - DNA, 18 bp, Homo sapiens
tgcctctcatcaactgaa

SEQ ID NO: 1283496 - DNA, 21 bp, Homo sapiens
tgcctctcatcaactgaatga

SEQ ID NO: 1283497 - DNA, 13 bp, Homo sapiens
tgcctctccaggc

SEQ ID NO: 1283498 - DNA, 14 bp, Homo sapiens
tgcctctccctggg

SEQ ID NO: 1283499 - DNA, 18 bp, Homo sapiens
tgcctctcttgccccttg

SEQ ID NO: 1283500 - DNA, 16 bp, Homo sapiens
tgcctctgacagcagc

SEQ ID NO: 1283501 - DNA, 21 bp, Homo sapiens
tgcctctgacagcagcctgtg

SEQ ID NO: 1283502 - DNA, 19 bp, Homo sapiens
tgcctctgacagtccacag

SEQ ID NO: 1283503 - DNA, 11 bp, Homo sapiens
tgcctctgacc

SEQ ID NO: 1283504 - DNA, 10 bp, Homo sapiens
tgcctctgag

SEQ ID NO: 1283505 - DNA, 13 bp, Homo sapiens
tgcctctgcctgt

SEQ ID NO: 1283506 - DNA, 17 bp, Homo sapiens
tgcctctgctccctctg

SEQ ID NO: 1283507 - DNA, 20 bp, Homo sapiens
tgcctctggaggcctctggc

SEQ ID NO: 1283508 - DNA, 21 bp, Homo sapiens
tgcctctggaggcctctggcc

SEQ ID NO: 1283509 - DNA, 13 bp, Homo sapiens
tgcctctgggact

SEQ ID NO: 1283510 - DNA, 11 bp, Homo sapiens
tgcctctgtcc

SEQ ID NO: 1283511 - DNA, 12 bp, Homo sapiens
tgcctctgtcct

SEQ ID NO: 1283512 - DNA, 15 bp, Homo sapiens
tgcctctgtcctccc

SEQ ID NO: 1283513 - DNA, 13 bp, Homo sapiens
tgcctctgtgcac

SEQ ID NO: 1283514 - DNA, 19 bp, Homo sapiens
tgcctctgtgcacagtggc

SEQ ID NO: 1283515 - DNA, 20 bp, Homo sapiens
tgcctctgtgcacagtggct

SEQ ID NO: 1283516 - DNA, 15 bp, Homo sapiens
tgcctctgtggaaga

SEQ ID NO: 1283517 - DNA, 13 bp, Homo sapiens
tgcctcttcctcc

SEQ ID NO: 1283518 - DNA, 17 bp, Homo sapiens
tgcctcttccttgaaga

SEQ ID NO: 1283519 - DNA, 20 bp, Homo sapiens
tgcctcttctcttgacagtc

SEQ ID NO: 1283520 - DNA, 23 bp, Homo sapiens
tgcctcttctcttgacagtctga

SEQ ID NO: 1283521 - DNA, 15 bp, Homo sapiens
tgcctcttctgggag

SEQ ID NO: 1283522 - DNA, 19 bp, Homo sapiens
tgcctcttctgggagggca

SEQ ID NO: 1283523 - DNA, 20 bp, Homo sapiens
tgcctcttggcttctcagcc

SEQ ID NO: 1283524 - DNA, 18 bp, Homo sapiens
tgcctcttgttgcagaga

SEQ ID NO: 1283525 - DNA, 16 bp, Homo sapiens
tgcctcttgtttctgt

SEQ ID NO: 1283526 - DNA, 19 bp, Homo sapiens
tgcctcttgtttctgtgcc

SEQ ID NO: 1283527 - DNA, 17 bp, Homo sapiens
tgcctctttcatccact

SEQ ID NO: 1283528 - DNA, 12 bp, Homo sapiens
tgcctctttccc

SEQ ID NO: 1283529 - DNA, 17 bp, Homo sapiens
tgcctctttccctagga

SEQ ID NO: 1283530 - DNA, 22 bp, Homo sapiens
tgcctgaaacagccatgtccaa

SEQ ID NO: 1283531 - DNA, 14 bp, Homo sapiens
tgcctgaacatcct

SEQ ID NO: 1283532 - DNA, 17 bp, Homo sapiens
tgcctgaacatccttcc

SEQ ID NO: 1283533 - DNA, 20 bp, Homo sapiens
tgcctgaacatccttccttc

SEQ ID NO: 1283534 - DNA, 23 bp, Homo sapiens
tgcctgtgcatgacctgatcatt

SEQ ID NO: 1283535 - DNA, 11 bp, Homo sapiens
tgcctgtgcca

SEQ ID NO: 1283536 - DNA, 16 bp, Homo sapiens
tgcctgtgccaataaa

SEQ ID NO: 1283537 - DNA, 19 bp, Homo sapiens
tgcctgtgccacccaccag

SEQ ID NO: 1283538 - DNA, 13 bp, Homo sapiens
tgcctgtgcttct

SEQ ID NO: 1283539 - DNA, 18 bp, Homo sapiens
tgcctgtggcagaaaaga

SEQ ID NO: 1283540 - DNA, 21 bp, Homo sapiens
tgcctgtggcgccgtctccag

SEQ ID NO: 1283541 - DNA, 16 bp, Homo sapiens
tgcctgtgggaggggg

SEQ ID NO: 1283542 - DNA, 23 bp, Homo sapiens
tgcctgtggtgaagtgtggctgg

SEQ ID NO: 1283543 - DNA, 19 bp, Homo sapiens
tgcctgtgtccatgcgctc

SEQ ID NO: 1283544 - DNA, 23 bp, Homo sapiens
tgcctgttaatttataatgtatt

SEQ ID NO: 1283545 - DNA, 18 bp, Homo sapiens
tgcctgttataactctgc

SEQ ID NO: 1283546 - DNA, 20 bp, Homo sapiens
tgcctgttataactctgcac

SEQ ID NO: 1283547 - DNA, 14 bp, Homo sapiens
tgcctgttctgctt

SEQ ID NO: 1283548 - DNA, 15 bp, Homo sapiens
tgcctgttctgcttc

SEQ ID NO: 1283549 - DNA, 16 bp, Homo sapiens
tgccttaaaaccaaag

SEQ ID NO: 1283550 - DNA, 20 bp, Homo sapiens
tgccttaaaaggagagaaga

SEQ ID NO: 1283551 - DNA, 17 bp, Homo sapiens
tgccttaaacacacatt

SEQ ID NO: 1283552 - DNA, 13 bp, Homo sapiens
tgccttaaagaaa

SEQ ID NO: 1283553 - DNA, 15 bp, Homo sapiens
tgccttaaagaaagt

SEQ ID NO: 1283554 - DNA, 13 bp, Homo sapiens
tgccttaagcaga

SEQ ID NO: 1283555 - DNA, 21 bp, Homo sapiens
tgccttaagcagaacaaatgt

SEQ ID NO: 1283556 - DNA, 21 bp, Homo sapiens
tgccttaataaatatgtaata

SEQ ID NO: 1283557 - DNA, 23 bp, Homo sapiens
tgccttaataaatatgtaatata

SEQ ID NO: 1283558 - DNA, 21 bp, Homo sapiens
tgccttaccctcatgttctta

SEQ ID NO: 1283559 - DNA, 21 bp, Homo sapiens
tgccttacctcctgcccagga

SEQ ID NO: 1283560 - DNA, 15 bp, Homo sapiens
tgccttactcttctt

SEQ ID NO: 1283561 - DNA, 19 bp, Homo sapiens
tgccttactcttcttgaaa

SEQ ID NO: 1283562 - DNA, 21 bp, Homo sapiens
tgccttagaacctttcttaca

SEQ ID NO: 1283563 - DNA, 20 bp, Homo sapiens
tgccttagcaatgggggcct

SEQ ID NO: 1283564 - DNA, 19 bp, Homo sapiens
tgccttagcatgtgactcc

SEQ ID NO: 1283565 - DNA, 17 bp, Homo sapiens
tgccttagcctcttgga

SEQ ID NO: 1283566 - DNA, 16 bp, Homo sapiens
tgccttagtctcagtt

SEQ ID NO: 1283567 - DNA, 23 bp, Homo sapiens
tgccttattagagtgtctttcca

SEQ ID NO: 1283568 - DNA, 15 bp, Homo sapiens
tgccttatttctcat

SEQ ID NO: 1283569 - DNA, 17 bp, Homo sapiens
tgccttatttgtctgta

SEQ ID NO: 1283570 - DNA, 18 bp, Homo sapiens
tgccttatttgtctgtaa

SEQ ID NO: 1283571 - DNA, 17 bp, Homo sapiens
tgccttcagctctacag

SEQ ID NO: 1283572 - DNA, 17 bp, Homo sapiens
tgccttcagtaggaaca

SEQ ID NO: 1283573 - DNA, 22 bp, Homo sapiens
tgccttccacgctgtctccaga

SEQ ID NO: 1283574 - DNA, 23 bp, Homo sapiens
tgccttccacgctgtctccagac

SEQ ID NO: 1283575 - DNA, 17 bp, Homo sapiens
tgccttccataattatg

SEQ ID NO: 1283576 - DNA, 15 bp, Homo sapiens
tgccttcctcctggg

SEQ ID NO: 1283577 - DNA, 12 bp, Homo sapiens
tgccttcctctg

SEQ ID NO: 1283578 - DNA, 13 bp, Homo sapiens
tgccttcctctga

SEQ ID NO: 1283579 - DNA, 21 bp, Homo sapiens
tgccttcctttctccaggacc

SEQ ID NO: 1283580 - DNA, 14 bp, Homo sapiens
tgccttcgcttctt

SEQ ID NO: 1283581 - DNA, 20 bp, Homo sapiens
tgccttcgcttcttgcctct

SEQ ID NO: 1283582 - DNA, 22 bp, Homo sapiens
tgccttcgcttcttgcctctgt

SEQ ID NO: 1283583 - DNA, 22 bp, Homo sapiens
tgccttcgttaactgtgtatgt

SEQ ID NO: 1283584 - DNA, 17 bp, Homo sapiens
tgccttctaccctctgg

SEQ ID NO: 1283585 - DNA, 19 bp, Homo sapiens
tgccttctcctctctgggc

SEQ ID NO: 1283586 - DNA, 21 bp, Homo sapiens
tgccttctcctctctgggcct

SEQ ID NO: 1283587 - DNA, 22 bp, Homo sapiens
tgccttctcctctctgggcctt

SEQ ID NO: 1283588 - DNA, 15 bp, Homo sapiens
tgccttctggagctg

SEQ ID NO: 1283589 - DNA, 14 bp, Homo sapiens
tgccttctgggctt

SEQ ID NO: 1283590 - DNA, 20 bp, Homo sapiens
tgccttctggttatttatgg

SEQ ID NO: 1283591 - DNA, 13 bp, Homo sapiens
tgccttcttcacc

SEQ ID NO: 1283592 - DNA, 14 bp, Homo sapiens
tgccttcttcaccc

SEQ ID NO: 1283593 - DNA, 22 bp, Homo sapiens
tgccttctttagaccctcgggc

SEQ ID NO: 1283594 - DNA, 15 bp, Homo sapiens
tgccttgaaccactt

SEQ ID NO: 1283595 - DNA, 21 bp, Homo sapiens
tgccttgaaccacttccctca

SEQ ID NO: 1283596 - DNA, 17 bp, Homo sapiens
tgccttgataaatatat

SEQ ID NO: 1283597 - DNA, 18 bp, Homo sapiens
tgccttgataaatatata

SEQ ID NO: 1283598 - DNA, 15 bp, Homo sapiens
tgccttgcagaactg

SEQ ID NO: 1283599 - DNA, 14 bp, Homo sapiens
tgccttgctgttct

SEQ ID NO: 1283600 - DNA, 20 bp, Homo sapiens
tgccttgctgtttgtcctga

SEQ ID NO: 1283601 - DNA, 15 bp, Homo sapiens
tgccttgcttctccc

SEQ ID NO: 1283602 - DNA, 23 bp, Homo sapiens
tgccttgcttctcccatttcctg

SEQ ID NO: 1283603 - DNA, 24 bp, Homo sapiens
tgccttgcttctcccatttcctga

SEQ ID NO: 1283604 - DNA, 23 bp, Homo sapiens
tgccttggaaatagaaagaagcc

SEQ ID NO: 1283605 - DNA, 23 bp, Homo sapiens
tgccttggccccccaaagtgctg

SEQ ID NO: 1283606 - DNA, 13 bp, Homo sapiens
tgccttggcccct

SEQ ID NO: 1283607 - DNA, 19 bp, Homo sapiens
tgccttggcctcccaaagt

SEQ ID NO: 1283608 - DNA, 16 bp, Homo sapiens
tgccttggctcagaca

SEQ ID NO: 1283609 - DNA, 11 bp, Homo sapiens
tgccttgggct

SEQ ID NO: 1283610 - DNA, 15 bp, Homo sapiens
tgccttgggctgctc

SEQ ID NO: 1283611 - DNA, 17 bp, Homo sapiens
tgccttgggctgctcct

SEQ ID NO: 1283612 - DNA, 15 bp, Homo sapiens
tgccttggtgccggt

SEQ ID NO: 1283613 - DNA, 13 bp, Homo sapiens
tgccttggttttt

SEQ ID NO: 1283614 - DNA, 11 bp, Homo sapiens
tgccttgtata

SEQ ID NO: 1283615 - DNA, 16 bp, Homo sapiens
tgccttgtataatatt

SEQ ID NO: 1283616 - DNA, 19 bp, Homo sapiens
tgccttgtatgcaaatgag

SEQ ID NO: 1283617 - DNA, 17 bp, Homo sapiens
tgccttgtccaggaact

SEQ ID NO: 1283618 - DNA, 19 bp, Homo sapiens
tgccttgtccaggaactgc

SEQ ID NO: 1283619 - DNA, 20 bp, Homo sapiens
tgccttgtttgagtttttcc

SEQ ID NO: 1283620 - DNA, 18 bp, Homo sapiens
tgcctttaaagtatgaat

SEQ ID NO: 1283621 - DNA, 15 bp, Homo sapiens
tgcctttaaatctgt

SEQ ID NO: 1283622 - DNA, 18 bp, Homo sapiens
tgcctttaaatctgtgat

SEQ ID NO: 1283623 - DNA, 19 bp, Homo sapiens
tgcctttaaatctgtgatg

SEQ ID NO: 1283624 - DNA, 22 bp, Homo sapiens
tgcctttaacagaaactttcaa

SEQ ID NO: 1283625 - DNA, 23 bp, Homo sapiens
tgcctttaacagaaactttcaaa

SEQ ID NO: 1283626 - DNA, 14 bp, Homo sapiens
tgcctttaagccaa

SEQ ID NO: 1283627 - DNA, 18 bp, Homo sapiens
tgcctttaatattttgta

SEQ ID NO: 1283628 - DNA, 19 bp, Homo sapiens
tgcctttaatattttgtaa

SEQ ID NO: 1283629 - DNA, 17 bp, Homo sapiens
tgcctttaatgttgccc

SEQ ID NO: 1283630 - DNA, 16 bp, Homo sapiens
tgcctttagaaaatat

SEQ ID NO: 1283631 - DNA, 21 bp, Homo sapiens
tgcctttaggggtgtgtattc

SEQ ID NO: 1283632 - DNA, 22 bp, Homo sapiens
tgcctttatctcagccatccgc

SEQ ID NO: 1283633 - DNA, 11 bp, Homo sapiens
tgcctttccag

SEQ ID NO: 1283634 - DNA, 23 bp, Homo sapiens
tgcctttctcgtggtagaagcca

SEQ ID NO: 1283635 - DNA, 20 bp, Homo sapiens
tgcctttctgcagtttttca

SEQ ID NO: 1283636 - DNA, 17 bp, Homo sapiens
tgcctttcttctgccct

SEQ ID NO: 1283637 - DNA, 13 bp, Homo sapiens
tgcctttgtaagt

SEQ ID NO: 1283638 - DNA, 16 bp, Homo sapiens
tgcctttgtaagttat

SEQ ID NO: 1283639 - DNA, 14 bp, Homo sapiens
tgcctttgtatgtg

SEQ ID NO: 1283640 - DNA, 23 bp, Homo sapiens
tgcctttgtggtgggcgctgggg

SEQ ID NO: 1283641 - DNA, 22 bp, Homo sapiens
tgccttttatagctattactgt

SEQ ID NO: 1283642 - DNA, 15 bp, Homo sapiens
tgccttttctggagt

SEQ ID NO: 1283643 - DNA, 14 bp, Homo sapiens
tgccttttctgtga

SEQ ID NO: 1283644 - DNA, 19 bp, Homo sapiens
tgccttttgcaaccaggaa

SEQ ID NO: 1283645 - DNA, 19 bp, Homo sapiens
tgccttttgcacccctccc

SEQ ID NO: 1283646 - DNA, 13 bp, Homo sapiens
tgccttttggttt

SEQ ID NO: 1283647 - DNA, 18 bp, Homo sapiens
tgccttttggtttcacct

SEQ ID NO: 1283648 - DNA, 23 bp, Homo sapiens
tgccttttggtttcaccttccct

SEQ ID NO: 1283649 - DNA, 18 bp, Homo sapiens
tgccttttgtaggctgtt

SEQ ID NO: 1283650 - DNA, 21 bp, Homo sapiens
tgccttttgtaggctgttccc

SEQ ID NO: 1283651 - DNA, 23 bp, Homo sapiens
tgccttttgtaggctgttccctt

SEQ ID NO: 1283652 - DNA, 16 bp, Homo sapiens
tgccttttttcacagc

SEQ ID NO: 1283653 - DNA, 23 bp, Homo sapiens
tgccttttttcacagcccgggtg

SEQ ID NO: 1283654 - DNA, 22 bp, Homo sapiens
tgccttttttctatatcaaaaa

SEQ ID NO: 1283655 - DNA, 14 bp, Homo sapiens
tgctcctccctggc

SEQ ID NO: 1283656 - DNA, 17 bp, Homo sapiens
tgctcctccctggctgc

SEQ ID NO: 1283657 - DNA, 13 bp, Homo sapiens
tgctcctcctgcc

SEQ ID NO: 1283658 - DNA, 13 bp, Homo sapiens
tgctcctctccag

SEQ ID NO: 1283659 - DNA, 16 bp, Homo sapiens
tgctcctctccaggca

SEQ ID NO: 1283660 - DNA, 15 bp, Homo sapiens
tgctcctctcgcaca

SEQ ID NO: 1283661 - DNA, 11 bp, Homo sapiens
tgctcctgctt

SEQ ID NO: 1283662 - DNA, 15 bp, Homo sapiens
tgctcctgcttttct

SEQ ID NO: 1283663 - DNA, 12 bp, Homo sapiens
tgctcctgggga

SEQ ID NO: 1283664 - DNA, 20 bp, Homo sapiens
tgctcctggggagaaagagg

SEQ ID NO: 1283665 - DNA, 21 bp, Homo sapiens
tgctcctgtacttgtcctcag

SEQ ID NO: 1283666 - DNA, 19 bp, Homo sapiens
tgctcctgtggcaggaggc

SEQ ID NO: 1283667 - DNA, 12 bp, Homo sapiens
tgctccttggct

SEQ ID NO: 1283668 - DNA, 12 bp, Homo sapiens
tgctccttgggc

SEQ ID NO: 1283669 - DNA, 16 bp, Homo sapiens
tgctccttgggccctt

SEQ ID NO: 1283670 - DNA, 14 bp, Homo sapiens
tgctcctttaccct

SEQ ID NO: 1283671 - DNA, 20 bp, Homo sapiens
tgctccttttgtatcttcct

SEQ ID NO: 1283672 - DNA, 20 bp, Homo sapiens
tgctcgagtcacattctgct

SEQ ID NO: 1283673 - DNA, 16 bp, Homo sapiens
tgctcgcccagacacc

SEQ ID NO: 1283674 - DNA, 19 bp, Homo sapiens
tgctcgcccagacaccatg

SEQ ID NO: 1283675 - DNA, 16 bp, Homo sapiens
tgctcgccccagcagg

SEQ ID NO: 1283676 - DNA, 16 bp, Homo sapiens
tgctcgtgtgatttcc

SEQ ID NO: 1283677 - DNA, 15 bp, Homo sapiens
tgctctaacagccct

SEQ ID NO: 1283678 - DNA, 13 bp, Homo sapiens
tgctctactttga

SEQ ID NO: 1283679 - DNA, 12 bp, Homo sapiens
tgctctagctgg

SEQ ID NO: 1283680 - DNA, 13 bp, Homo sapiens
tgctctagctggc

SEQ ID NO: 1283681 - DNA, 16 bp, Homo sapiens
tgctctagctggcagg

SEQ ID NO: 1283682 - DNA, 19 bp, Homo sapiens
tgctctaggaagacatttt

SEQ ID NO: 1283683 - DNA, 14 bp, Homo sapiens
tgctctagggaatc

SEQ ID NO: 1283684 - DNA, 19 bp, Homo sapiens
tgctctagggaatctggat

SEQ ID NO: 1283685 - DNA, 16 bp, Homo sapiens
tgctctagtgccttct

SEQ ID NO: 1283686 - DNA, 14 bp, Homo sapiens
tgctctagtgggac

SEQ ID NO: 1283687 - DNA, 16 bp, Homo sapiens
tgctctagtgggacag

SEQ ID NO: 1283688 - DNA, 15 bp, Homo sapiens
tgctctcagcctccc

SEQ ID NO: 1283689 - DNA, 16 bp, Homo sapiens
tgctctcagctggcag

SEQ ID NO: 1283690 - DNA, 17 bp, Homo sapiens
tgctctcagctggcagt

SEQ ID NO: 1283691 - DNA, 12 bp, Homo sapiens
tgctctcccctg

SEQ ID NO: 1283692 - DNA, 13 bp, Homo sapiens
tgctctcccctgc

SEQ ID NO: 1283693 - DNA, 14 bp, Homo sapiens
tgctctcccctgcc

SEQ ID NO: 1283694 - DNA, 16 bp, Homo sapiens
tgctctcctcttgcca

SEQ ID NO: 1283695 - DNA, 22 bp, Homo sapiens
tgctctcgcacctttccaaagt

SEQ ID NO: 1283696 - DNA, 14 bp, Homo sapiens
tgctctctctccct

SEQ ID NO: 1283697 - DNA, 17 bp, Homo sapiens
tgctctctctccctgcc

SEQ ID NO: 1283698 - DNA, 15 bp, Homo sapiens
tgctctctgcagcca

SEQ ID NO: 1283699 - DNA, 20 bp, Homo sapiens
tgctctctgtggtgcctctc

SEQ ID NO: 1283700 - DNA, 12 bp, Homo sapiens
tgctctgaccct

SEQ ID NO: 1283701 - DNA, 21 bp, Homo sapiens
tgctctgaccttccagagccc

SEQ ID NO: 1283702 - DNA, 19 bp, Homo sapiens
tgctctgacgtagaaagat

SEQ ID NO: 1283703 - DNA, 20 bp, Homo sapiens
tgctctgagaattgttgaga

SEQ ID NO: 1283704 - DNA, 19 bp, Homo sapiens
tgctctgagcacaggtgac

SEQ ID NO: 1283705 - DNA, 21 bp, Homo sapiens
tgctctgagcacaggtgacag

SEQ ID NO: 1283706 - DNA, 20 bp, Homo sapiens
tgctctgaggcttccagaga

SEQ ID NO: 1283707 - DNA, 19 bp, Homo sapiens
tgctctgaggtcaataaag

SEQ ID NO: 1283708 - DNA, 14 bp, Homo sapiens
tgctctgaggtccc

SEQ ID NO: 1283709 - DNA, 15 bp, Homo sapiens
tgctctgaggtccct

SEQ ID NO: 1283710 - DNA, 16 bp, Homo sapiens
tgctctgaggtccctt

SEQ ID NO: 1283711 - DNA, 14 bp, Homo sapiens
tgctctgatccctc

SEQ ID NO: 1283712 - DNA, 17 bp, Homo sapiens
tgctctgatttccttcc

SEQ ID NO: 1283713 - DNA, 11 bp, Homo sapiens
tgctctgccat

SEQ ID NO: 1283714 - DNA, 13 bp, Homo sapiens
tgctctgcccctt

SEQ ID NO: 1283715 - DNA, 12 bp, Homo sapiens
tgctctgcctca

SEQ ID NO: 1283716 - DNA, 17 bp, Homo sapiens
tgctctgcctggagtgt

SEQ ID NO: 1283717 - DNA, 19 bp, Homo sapiens
tgctctggaaaatgtgacc

SEQ ID NO: 1283718 - DNA, 23 bp, Homo sapiens
tgctctggaaaatgtgacccaga

SEQ ID NO: 1283719 - DNA, 16 bp, Homo sapiens
tgctctggagcagcca

SEQ ID NO: 1283720 - DNA, 22 bp, Homo sapiens
tgctctggaggaagttctccag

SEQ ID NO: 1283721 - DNA, 22 bp, Homo sapiens
tgctctggcttgccccaggact

SEQ ID NO: 1283722 - DNA, 21 bp, Homo sapiens
tgctctggggatttctgggat

SEQ ID NO: 1283723 - DNA, 18 bp, Homo sapiens
tgctctggttgtttctgt

SEQ ID NO: 1283724 - DNA, 21 bp, Homo sapiens
tgctctggttgtttctgttcc

SEQ ID NO: 1283725 - DNA, 11 bp, Homo sapiens
tgctctgtccc

SEQ ID NO: 1283726 - DNA, 12 bp, Homo sapiens
tgctctgtgaca

SEQ ID NO: 1283727 - DNA, 18 bp, Homo sapiens
tgctctgtgttcccagag

SEQ ID NO: 1283728 - DNA, 19 bp, Homo sapiens
tgctctgtgttcccagagg

SEQ ID NO: 1283729 - DNA, 17 bp, Homo sapiens
tgctctgttacccaggc

SEQ ID NO: 1283730 - DNA, 23 bp, Homo sapiens
tgctcttaagaaactatgaagat

SEQ ID NO: 1283731 - DNA, 19 bp, Homo sapiens
tgctcttactacactgagg

SEQ ID NO: 1283732 - DNA, 20 bp, Homo sapiens
tgctcttactacactgagga

SEQ ID NO: 1283733 - DNA, 20 bp, Homo sapiens
tgctcttagattgggccatg

SEQ ID NO: 1283734 - DNA, 12 bp, Homo sapiens
tgctcttagctg

SEQ ID NO: 1283735 - DNA, 18 bp, Homo sapiens
tgctcttagctgtctgct

SEQ ID NO: 1283736 - DNA, 15 bp, Homo sapiens
tgctcttccaaagct

SEQ ID NO: 1283737 - DNA, 13 bp, Homo sapiens
tgctcttctgtgg

SEQ ID NO: 1283738 - DNA, 15 bp, Homo sapiens
tgctcttctttctga

SEQ ID NO: 1283739 - DNA, 20 bp, Homo sapiens
tgctcttgaaatattcagaa

SEQ ID NO: 1283740 - DNA, 16 bp, Homo sapiens
tgctcttgaacctgtg

SEQ ID NO: 1283741 - DNA, 19 bp, Homo sapiens
tgctcttgaacctgtgctc

SEQ ID NO: 1283742 - DNA, 21 bp, Homo sapiens
tgctcttggctgacccctctg

SEQ ID NO: 1283743 - DNA, 21 bp, Homo sapiens
tgctcttgtcccacgtgtctt

SEQ ID NO: 1283744 - DNA, 22 bp, Homo sapiens
tgctcttgtcccacgtgtcttc

SEQ ID NO: 1283745 - DNA, 23 bp, Homo sapiens
tgctcttgtcccacgtgtcttcc

SEQ ID NO: 1283746 - DNA, 19 bp, Homo sapiens
tgctcttgtcctagcttgg

SEQ ID NO: 1283747 - DNA, 16 bp, Homo sapiens
tgctcttgtttcactc

SEQ ID NO: 1283748 - DNA, 17 bp, Homo sapiens
tgctcttgtttcactcc

SEQ ID NO: 1283749 - DNA, 22 bp, Homo sapiens
tgctcttgtttcactccaccat

SEQ ID NO: 1283750 - DNA, 16 bp, Homo sapiens
tgctctttattgcaga

SEQ ID NO: 1283751 - DNA, 17 bp, Homo sapiens
tgctctttattgcagaa

SEQ ID NO: 1283752 - DNA, 23 bp, Homo sapiens
tgctctttcccccttccatctct

SEQ ID NO: 1283753 - DNA, 17 bp, Homo sapiens
tgctctttctctgccag

SEQ ID NO: 1283754 - DNA, 18 bp, Homo sapiens
tgctctttgacaactaaa

SEQ ID NO: 1283755 - DNA, 21 bp, Homo sapiens
tgctcttttctcctcactgta

SEQ ID NO: 1283756 - DNA, 14 bp, Homo sapiens
tgctcttttgtgat

SEQ ID NO: 1283757 - DNA, 16 bp, Homo sapiens
tgctgaaaacattaca

SEQ ID NO: 1283758 - DNA, 15 bp, Homo sapiens
tgctgaaagccaagg

SEQ ID NO: 1283759 - DNA, 21 bp, Homo sapiens
tgctgaaagtcctgctttcct

SEQ ID NO: 1283760 - DNA, 15 bp, Homo sapiens
tgctgaacacagtgt

SEQ ID NO: 1283761 - DNA, 19 bp, Homo sapiens
tgctgaacacagtgtctgt

SEQ ID NO: 1283762 - DNA, 22 bp, Homo sapiens
tgctgaacacagtgtctgttca

SEQ ID NO: 1283763 - DNA, 23 bp, Homo sapiens
tgctgaacacagtgtctgttcag

SEQ ID NO: 1283764 - DNA, 21 bp, Homo sapiens
tgctgaacattgcatataact

SEQ ID NO: 1283765 - DNA, 22 bp, Homo sapiens
tgctgaactaagttttgtgtgt

SEQ ID NO: 1283766 - DNA, 13 bp, Homo sapiens
tgctgaactcagc

SEQ ID NO: 1283767 - DNA, 17 bp, Homo sapiens
tgctgaactcagcacat

SEQ ID NO: 1283768 - DNA, 20 bp, Homo sapiens
tgctgaactcagcacattcg

SEQ ID NO: 1283769 - DNA, 11 bp, Homo sapiens
tgctgaactcc

SEQ ID NO: 1283770 - DNA, 16 bp, Homo sapiens
tgctgaactccttgtt

SEQ ID NO: 1283771 - DNA, 16 bp, Homo sapiens
tgctgaagaatctact

SEQ ID NO: 1283772 - DNA, 22 bp, Homo sapiens
tgctgaagatgcccctgctccc

SEQ ID NO: 1283773 - DNA, 14 bp, Homo sapiens
tgctgaagatgcct

SEQ ID NO: 1283774 - DNA, 15 bp, Homo sapiens
tgctgaagttctgag

SEQ ID NO: 1283775 - DNA, 18 bp, Homo sapiens
tgctgaatacagaggcaa

SEQ ID NO: 1283776 - DNA, 14 bp, Homo sapiens
tgctgaatatctgt

SEQ ID NO: 1283777 - DNA, 19 bp, Homo sapiens
tgctgaatatctgttcact

SEQ ID NO: 1283778 - DNA, 17 bp, Homo sapiens
tgctgggccactgggga

SEQ ID NO: 1283779 - DNA, 20 bp, Homo sapiens
tgctgggccactggggactt

SEQ ID NO: 1283780 - DNA, 18 bp, Homo sapiens
tgctgggccagggaaaca

SEQ ID NO: 1283781 - DNA, 20 bp, Homo sapiens
tgctgggcccccagcctggc

SEQ ID NO: 1283782 - DNA, 19 bp, Homo sapiens
tgctgggcgtctgttcttt

SEQ ID NO: 1283783 - DNA, 17 bp, Homo sapiens
tgctgggctctccacct

SEQ ID NO: 1283784 - DNA, 21 bp, Homo sapiens
tgctgggctgacggtgcagtc

SEQ ID NO: 1283785 - DNA, 18 bp, Homo sapiens
tgctgggctggactggcc

SEQ ID NO: 1283786 - DNA, 20 bp, Homo sapiens
tgctgggctggactggccat

SEQ ID NO: 1283787 - DNA, 12 bp, Homo sapiens
tgctgggctggg

SEQ ID NO: 1283788 - DNA, 15 bp, Homo sapiens
tgctgggctgggccc

SEQ ID NO: 1283789 - DNA, 23 bp, Homo sapiens
tgctggggaagggttttcttttc

SEQ ID NO: 1283790 - DNA, 15 bp, Homo sapiens
tgctggggagtccct

SEQ ID NO: 1283791 - DNA, 12 bp, Homo sapiens
tgctggggcatg

SEQ ID NO: 1283792 - DNA, 20 bp, Homo sapiens
tgctggggcatgtgtgcctg

SEQ ID NO: 1283793 - DNA, 17 bp, Homo sapiens
tgctggggccagggcag

SEQ ID NO: 1283794 - DNA, 15 bp, Homo sapiens
tgctggggcctcaga

SEQ ID NO: 1283795 - DNA, 16 bp, Homo sapiens
tgctggggctgaacat

SEQ ID NO: 1283796 - DNA, 21 bp, Homo sapiens
tgctgggggaatgagcccaga

SEQ ID NO: 1283797 - DNA, 13 bp, Homo sapiens
tgctgggggagcc

SEQ ID NO: 1283798 - DNA, 19 bp, Homo sapiens
tgctgggggcaactggcca

SEQ ID NO: 1283799 - DNA, 19 bp, Homo sapiens
tgctgggtatgctctgtga

SEQ ID NO: 1283800 - DNA, 16 bp, Homo sapiens
tgctgggtcccagcct

SEQ ID NO: 1283801 - DNA, 14 bp, Homo sapiens
tgctgggtgcctcc

SEQ ID NO: 1283802 - DNA, 19 bp, Homo sapiens
tgctggtaacagtggctgc

SEQ ID NO: 1283803 - DNA, 14 bp, Homo sapiens
tgctggtagagacc

SEQ ID NO: 1283804 - DNA, 18 bp, Homo sapiens
tgctggtagagaccccca

SEQ ID NO: 1283805 - DNA, 16 bp, Homo sapiens
tgctggtagctgaggg

SEQ ID NO: 1283806 - DNA, 17 bp, Homo sapiens
tgctggtagctgagggg

SEQ ID NO: 1283807 - DNA, 19 bp, Homo sapiens
tgctggtagctgaggggac

SEQ ID NO: 1283808 - DNA, 20 bp, Homo sapiens
tgctggtcagagagacctca

SEQ ID NO: 1283809 - DNA, 13 bp, Homo sapiens
tgctggtcaggtc

SEQ ID NO: 1283810 - DNA, 22 bp, Homo sapiens
tgctggtcaggtccccatggct

SEQ ID NO: 1283811 - DNA, 23 bp, Homo sapiens
tgctggtcaggtccccatggctt

SEQ ID NO: 1283812 - DNA, 19 bp, Homo sapiens
tgctggtcccggggccagc

SEQ ID NO: 1283813 - DNA, 14 bp, Homo sapiens
tgctggtcctaggt

SEQ ID NO: 1283814 - DNA, 22 bp, Homo sapiens
tgctggtcctaggtcctctgag

SEQ ID NO: 1283815 - DNA, 18 bp, Homo sapiens
tgctggtgaacactgtga

SEQ ID NO: 1283816 - DNA, 20 bp, Homo sapiens
tgctggtgaacactgtgacc

SEQ ID NO: 1283817 - DNA, 14 bp, Homo sapiens
tgctggtgcaaaga

SEQ ID NO: 1283818 - DNA, 15 bp, Homo sapiens
tgctggtggctggtg

SEQ ID NO: 1283819 - DNA, 23 bp, Homo sapiens
tgctggtggctggtgagaccccg

SEQ ID NO: 1283820 - DNA, 18 bp, Homo sapiens
tgctggtgggtctgagct

SEQ ID NO: 1283821 - DNA, 19 bp, Homo sapiens
tgctggtgggtctgagctg

SEQ ID NO: 1283822 - DNA, 23 bp, Homo sapiens
tgctggtgggttagctaaaccaa

SEQ ID NO: 1283823 - DNA, 19 bp, Homo sapiens
tgctggtggttaaggccag

SEQ ID NO: 1283824 - DNA, 13 bp, Homo sapiens
tgctggtggtttt

SEQ ID NO: 1283825 - DNA, 17 bp, Homo sapiens
tgctggtttgaaagatt

SEQ ID NO: 1283826 - DNA, 15 bp, Homo sapiens
tgctggttttaacaa

SEQ ID NO: 1283827 - DNA, 16 bp, Homo sapiens
tgctggttttaacaac

SEQ ID NO: 1283828 - DNA, 15 bp, Homo sapiens
tgctggttttcctaa

SEQ ID NO: 1283829 - DNA, 22 bp, Homo sapiens
tgctggttttcctaaatgcagt

SEQ ID NO: 1283830 - DNA, 13 bp, Homo sapiens
tgctggttttcta

SEQ ID NO: 1283831 - DNA, 15 bp, Homo sapiens
tgctggtttttcagt

SEQ ID NO: 1283832 - DNA, 15 bp, Homo sapiens
tgctgtaaatacagg

SEQ ID NO: 1283833 - DNA, 19 bp, Homo sapiens
tgctgtaactgctgagcca

SEQ ID NO: 1283834 - DNA, 21 bp, Homo sapiens
tgctgtacatctattttggat

SEQ ID NO: 1283835 - DNA, 22 bp, Homo sapiens
tgctgtaccacatctgctctag

SEQ ID NO: 1283836 - DNA, 23 bp, Homo sapiens
tgctgtactcttgctgatggctg

SEQ ID NO: 1283837 - DNA, 22 bp, Homo sapiens
tgctgtatgctgatcatcgcca

SEQ ID NO: 1283838 - DNA, 16 bp, Homo sapiens
tgctgtatggcccagg

SEQ ID NO: 1283839 - DNA, 21 bp, Homo sapiens
tgctgtatttatagtaaccat

SEQ ID NO: 1283840 - DNA, 16 bp, Homo sapiens
tgctgtatttctttgt

SEQ ID NO: 1283841 - DNA, 21 bp, Homo sapiens
tgctgtattttaacactttgt

SEQ ID NO: 1283842 - DNA, 15 bp, Homo sapiens
tgctgtcatgtggaa

SEQ ID NO: 1283843 - DNA, 17 bp, Homo sapiens
tgctgtcatgtggaaac

SEQ ID NO: 1283844 - DNA, 19 bp, Homo sapiens
tgctgtccacatgacctcc

SEQ ID NO: 1283845 - DNA, 15 bp, Homo sapiens
tgctgtccaggcagc

SEQ ID NO: 1283846 - DNA, 16 bp, Homo sapiens
tgctgtccaggcagct

SEQ ID NO: 1283847 - DNA, 17 bp, Homo sapiens
tgctgtccctccccctt

SEQ ID NO: 1283848 - DNA, 11 bp, Homo sapiens
tgctgtccctg

SEQ ID NO: 1283849 - DNA, 15 bp, Homo sapiens
tgctgtccctgcact

SEQ ID NO: 1283850 - DNA, 16 bp, Homo sapiens
tgctgtccctgcactg

SEQ ID NO: 1283851 - DNA, 20 bp, Homo sapiens
tgctgtccctgtcaggacac

SEQ ID NO: 1283852 - DNA, 23 bp, Homo sapiens
tgctgtcctaggccacaccatct

SEQ ID NO: 1283853 - DNA, 12 bp, Homo sapiens
tgctgtcctcag

SEQ ID NO: 1283854 - DNA, 19 bp, Homo sapiens
tgctgtcctcaggtggcca

SEQ ID NO: 1283855 - DNA, 21 bp, Homo sapiens
tgctgtcctcaggtggccatg

SEQ ID NO: 1283856 - DNA, 14 bp, Homo sapiens
tgctgtcctgatct

SEQ ID NO: 1283857 - DNA, 20 bp, Homo sapiens
tgctgtctacagtagctgct

SEQ ID NO: 1283858 - DNA, 18 bp, Homo sapiens
tgctgtctccatgctgga

SEQ ID NO: 1283859 - DNA, 15 bp, Homo sapiens
tgctgtcttgcccca

SEQ ID NO: 1283860 - DNA, 16 bp, Homo sapiens
tgctgtcttgccccag

SEQ ID NO: 1283861 - DNA, 21 bp, Homo sapiens
tgctgtcttgccccagtttgg

SEQ ID NO: 1283862 - DNA, 13 bp, Homo sapiens
tgctgtctttgtg

SEQ ID NO: 1283863 - DNA, 13 bp, Homo sapiens
tgctgtgaaaaaa

SEQ ID NO: 1283864 - DNA, 14 bp, Homo sapiens
tgctgtgaaaaaaa

SEQ ID NO: 1283865 - DNA, 22 bp, Homo sapiens
tgctgtgaaaaaaaaaatgctg

SEQ ID NO: 1283866 - DNA, 13 bp, Homo sapiens
tgctgtgaggctg

SEQ ID NO: 1283867 - DNA, 14 bp, Homo sapiens
tgctgtgaggctgt

SEQ ID NO: 1283868 - DNA, 19 bp, Homo sapiens
tgctgtgaggctgtcctgt

SEQ ID NO: 1283869 - DNA, 23 bp, Homo sapiens
tgctgtgagggaggggaaaagca

SEQ ID NO: 1283870 - DNA, 20 bp, Homo sapiens
tgctgtgatacgatgcttca

SEQ ID NO: 1283871 - DNA, 14 bp, Homo sapiens
tgctgtgcagctct

SEQ ID NO: 1283872 - DNA, 16 bp, Homo sapiens
tgctgtgcagctctct

SEQ ID NO: 1283873 - DNA, 19 bp, Homo sapiens
tgctgtgccatgctgggcc

SEQ ID NO: 1283874 - DNA, 23 bp, Homo sapiens
tgctgtgccatgctgggccactg

SEQ ID NO: 1283875 - DNA, 12 bp, Homo sapiens
tgctgtgcccag

SEQ ID NO: 1283876 - DNA, 13 bp, Homo sapiens
tgctgtgcccagc

SEQ ID NO: 1283877 - DNA, 12 bp, Homo sapiens
tgctgtgcctgc

SEQ ID NO: 1283878 - DNA, 18 bp, Homo sapiens
tgctgtgcctgctagagc

SEQ ID NO: 1283879 - DNA, 19 bp, Homo sapiens
tgctgtgcctgctagagca

SEQ ID NO: 1283880 - DNA, 17 bp, Homo sapiens
tgctgtgcgcccagggc

SEQ ID NO: 1283881 - DNA, 18 bp, Homo sapiens
tgctgtgctctttgaaga

SEQ ID NO: 1283882 - DNA, 15 bp, Homo sapiens
tgctgtgctgctcaa

SEQ ID NO: 1283883 - DNA, 21 bp, Homo sapiens
tgctgtgcttttgatctctgc

SEQ ID NO: 1283884 - DNA, 15 bp, Homo sapiens
tgctgtggccccctg

SEQ ID NO: 1283885 - DNA, 14 bp, Homo sapiens
tgctgtgggcagca

SEQ ID NO: 1283886 - DNA, 17 bp, Homo sapiens
tgctgtgggcagcaccc

SEQ ID NO: 1283887 - DNA, 18 bp, Homo sapiens
tgctgtgggcagcaccct

SEQ ID NO: 1283888 - DNA, 16 bp, Homo sapiens
tgctgtggtctataaa

SEQ ID NO: 1283889 - DNA, 15 bp, Homo sapiens
tgctgtggtgtgtcc

SEQ ID NO: 1283890 - DNA, 12 bp, Homo sapiens
tgctgtgtcctt

SEQ ID NO: 1283891 - DNA, 19 bp, Homo sapiens
tgctgtgtccttcctccac

SEQ ID NO: 1283892 - DNA, 20 bp, Homo sapiens
tgctgtgtgaccctgggcaa

SEQ ID NO: 1283893 - DNA, 20 bp, Homo sapiens
tgctgtgtggacggcgctgc

SEQ ID NO: 1283894 - DNA, 18 bp, Homo sapiens
tgctgttagttataaaac

SEQ ID NO: 1283895 - DNA, 18 bp, Homo sapiens
tgctgttcagtgcttttt

SEQ ID NO: 1283896 - DNA, 23 bp, Homo sapiens
tgctgttcccccaggtgttgtaa

SEQ ID NO: 1283897 - DNA, 13 bp, Homo sapiens
tgctgttctcagg

SEQ ID NO: 1283898 - DNA, 15 bp, Homo sapiens
tgctgttgacatatt

SEQ ID NO: 1283899 - DNA, 18 bp, Homo sapiens
tgctgttgacatatttaa

SEQ ID NO: 1283900 - DNA, 14 bp, Homo sapiens
tgcttctctttgtg

SEQ ID NO: 1283901 - DNA, 13 bp, Homo sapiens
tgcttctgaatca

SEQ ID NO: 1283902 - DNA, 16 bp, Homo sapiens
tgcttctgaatcactg

SEQ ID NO: 1283903 - DNA, 17 bp, Homo sapiens
tgcttctgaatcactgt

SEQ ID NO: 1283904 - DNA, 13 bp, Homo sapiens
tgcttctggaaac

SEQ ID NO: 1283905 - DNA, 14 bp, Homo sapiens
tgcttctgtccagg

SEQ ID NO: 1283906 - DNA, 21 bp, Homo sapiens
tgcttctgtccaggacatgat

SEQ ID NO: 1283907 - DNA, 21 bp, Homo sapiens
tgcttcttctcctatgtgtaa

SEQ ID NO: 1283908 - DNA, 12 bp, Homo sapiens
tgcttcttgctt

SEQ ID NO: 1283909 - DNA, 14 bp, Homo sapiens
tgcttctttctaga

SEQ ID NO: 1283910 - DNA, 18 bp, Homo sapiens
tgcttgaaattactgtgt

SEQ ID NO: 1283911 - DNA, 20 bp, Homo sapiens
tgcttgaaattactgtgtaa

SEQ ID NO: 1283912 - DNA, 19 bp, Homo sapiens
tgcttgaaggccctgctga

SEQ ID NO: 1283913 - DNA, 15 bp, Homo sapiens
tgcttgacataccta

SEQ ID NO: 1283914 - DNA, 22 bp, Homo sapiens
tgcttgacatacctaccagtat

SEQ ID NO: 1283915 - DNA, 20 bp, Homo sapiens
tgcttgaccgtactctcaca

SEQ ID NO: 1283916 - DNA, 14 bp, Homo sapiens
tgcttgactctcac

SEQ ID NO: 1283917 - DNA, 14 bp, Homo sapiens
tgcttgagaatcct

SEQ ID NO: 1283918 - DNA, 18 bp, Homo sapiens
tgcttgagaatcctctcc

SEQ ID NO: 1283919 - DNA, 16 bp, Homo sapiens
tgcttgagcaataaag

SEQ ID NO: 1283920 - DNA, 14 bp, Homo sapiens
tgcttgagcccagg

SEQ ID NO: 1283921 - DNA, 16 bp, Homo sapiens
tgcttgagcccaggag

SEQ ID NO: 1283922 - DNA, 13 bp, Homo sapiens
tgcttgaggaaaa

SEQ ID NO: 1283923 - DNA, 15 bp, Homo sapiens
tgcttgatccagaag

SEQ ID NO: 1283924 - DNA, 19 bp, Homo sapiens
tgcttgatgaagcaaggaa

SEQ ID NO: 1283925 - DNA, 22 bp, Homo sapiens
tgcttgcagccaggagaaggtc

SEQ ID NO: 1283926 - DNA, 14 bp, Homo sapiens
tgcttgccaaagta

SEQ ID NO: 1283927 - DNA, 22 bp, Homo sapiens
tgcttgccaaggcagaggcctg

SEQ ID NO: 1283928 - DNA, 23 bp, Homo sapiens
tgcttgccaaggcagaggcctgg

SEQ ID NO: 1283929 - DNA, 13 bp, Homo sapiens
tgcttgcccgctc

SEQ ID NO: 1283930 - DNA, 19 bp, Homo sapiens
tgcttgcctgcgttttgga

SEQ ID NO: 1283931 - DNA, 14 bp, Homo sapiens
tgcttgcttagagt

SEQ ID NO: 1283932 - DNA, 23 bp, Homo sapiens
tgcttgcttagagtgcccagcag

SEQ ID NO: 1283933 - DNA, 14 bp, Homo sapiens
tgcttgcttttgcc

SEQ ID NO: 1283934 - DNA, 17 bp, Homo sapiens
tgcttggaacatactgt

SEQ ID NO: 1283935 - DNA, 15 bp, Homo sapiens
tgcttggaagccagg

SEQ ID NO: 1283936 - DNA, 20 bp, Homo sapiens
tgcttggattctctgagaaa

SEQ ID NO: 1283937 - DNA, 17 bp, Homo sapiens
tgcttgggaccagaagt

SEQ ID NO: 1283938 - DNA, 21 bp, Homo sapiens
tgcttgggcctccctggcact

SEQ ID NO: 1283939 - DNA, 15 bp, Homo sapiens
tgcttgggctccacg

SEQ ID NO: 1283940 - DNA, 19 bp, Homo sapiens
tgcttggtggggctcgtgg

SEQ ID NO: 1283941 - DNA, 21 bp, Homo sapiens
tgcttgtaacaagaaaacata

SEQ ID NO: 1283942 - DNA, 16 bp, Homo sapiens
tgcttgtacataatgc

SEQ ID NO: 1283943 - DNA, 16 bp, Homo sapiens
tgcttgtactaagcca

SEQ ID NO: 1283944 - DNA, 18 bp, Homo sapiens
tgcttgtactaagccagg

SEQ ID NO: 1283945 - DNA, 13 bp, Homo sapiens
tgcttgtcatctg

SEQ ID NO: 1283946 - DNA, 17 bp, Homo sapiens
tgcttgtcctgctctct

SEQ ID NO: 1283947 - DNA, 20 bp, Homo sapiens
tgcttgtcctgctctcttca

SEQ ID NO: 1283948 - DNA, 22 bp, Homo sapiens
tgcttgtcctgctctcttcagg

SEQ ID NO: 1283949 - DNA, 23 bp, Homo sapiens
tgcttgtcctgctctcttcagga

SEQ ID NO: 1283950 - DNA, 12 bp, Homo sapiens
tgcttgtgggcc

SEQ ID NO: 1283951 - DNA, 19 bp, Homo sapiens
tgcttgttagagagaaaga

SEQ ID NO: 1283952 - DNA, 16 bp, Homo sapiens
tgcttgttccctctcc

SEQ ID NO: 1283953 - DNA, 19 bp, Homo sapiens
tgcttgttccctctccctg

SEQ ID NO: 1283954 - DNA, 23 bp, Homo sapiens
tgcttgttgggattcctgaccca

SEQ ID NO: 1283955 - DNA, 12 bp, Homo sapiens
tgcttgttttat

SEQ ID NO: 1283956 - DNA, 12 bp, Homo sapiens
tgctttaaaaaa

SEQ ID NO: 1283957 - DNA, 15 bp, Homo sapiens
tgctttaaaaaattc

SEQ ID NO: 1283958 - DNA, 21 bp, Homo sapiens
tgctttaaaaaattctcttaa

SEQ ID NO: 1283959 - DNA, 21 bp, Homo sapiens
tgctttaaagtacctgtagtg

SEQ ID NO: 1283960 - DNA, 14 bp, Homo sapiens
tgctttaccacaat

SEQ ID NO: 1283961 - DNA, 16 bp, Homo sapiens
tgctttagaaaacatt

SEQ ID NO: 1283962 - DNA, 13 bp, Homo sapiens
tgctttatttgta

SEQ ID NO: 1283963 - DNA, 15 bp, Homo sapiens
tgctttatttgtaaa

SEQ ID NO: 1283964 - DNA, 23 bp, Homo sapiens
tgctttcaagatctaaatcatat

SEQ ID NO: 1283965 - DNA, 14 bp, Homo sapiens
tgctttcaattgac

SEQ ID NO: 1283966 - DNA, 17 bp, Homo sapiens
tgctttcactctttaga

SEQ ID NO: 1283967 - DNA, 13 bp, Homo sapiens
tgctttcccctgt

SEQ ID NO: 1283968 - DNA, 15 bp, Homo sapiens
tgctttcccctgtgg

SEQ ID NO: 1283969 - DNA, 15 bp, Homo sapiens
tgctttccctgagga

SEQ ID NO: 1283970 - DNA, 18 bp, Homo sapiens
tgctttccctgaggaatg

SEQ ID NO: 1283971 - DNA, 19 bp, Homo sapiens
tgctttccctgaggaatga

SEQ ID NO: 1283972 - DNA, 14 bp, Homo sapiens
tgctttcctgggcc

SEQ ID NO: 1283973 - DNA, 15 bp, Homo sapiens
tgctttcctgggcct

SEQ ID NO: 1283974 - DNA, 15 bp, Homo sapiens
tgctttccttttctc

SEQ ID NO: 1283975 - DNA, 18 bp, Homo sapiens
tgctttcgaactgctagt

SEQ ID NO: 1283976 - DNA, 21 bp, Homo sapiens
tgctttctatgctgtttgtag

SEQ ID NO: 1283977 - DNA, 21 bp, Homo sapiens
tgctttctattatcatggtat

SEQ ID NO: 1283978 - DNA, 18 bp, Homo sapiens
tgctttctccattgtaaa

SEQ ID NO: 1283979 - DNA, 22 bp, Homo sapiens
tgctttctcctttaattgtaaa

SEQ ID NO: 1283980 - DNA, 12 bp, Homo sapiens
tgctttctgaaa

SEQ ID NO: 1283981 - DNA, 21 bp, Homo sapiens
tgctttctgaagctttaccag

SEQ ID NO: 1283982 - DNA, 13 bp, Homo sapiens
tgctttctgctca

SEQ ID NO: 1283983 - DNA, 16 bp, Homo sapiens
tgctttctgttccaaa

SEQ ID NO: 1283984 - DNA, 17 bp, Homo sapiens
tgctttctgttccaaat

SEQ ID NO: 1283985 - DNA, 22 bp, Homo sapiens
tgctttctgttccaaattcagt

SEQ ID NO: 1283986 - DNA, 14 bp, Homo sapiens
tgctttctgtttct

SEQ ID NO: 1283987 - DNA, 16 bp, Homo sapiens
tgctttcttctttcct

SEQ ID NO: 1283988 - DNA, 23 bp, Homo sapiens
tgctttctttggcctacattctt

SEQ ID NO: 1283989 - DNA, 15 bp, Homo sapiens
tgctttgaaaatatt

SEQ ID NO: 1283990 - DNA, 14 bp, Homo sapiens
tgctttgaagcagt

SEQ ID NO: 1283991 - DNA, 22 bp, Homo sapiens
tgctttgaagcagttgtgtcag

SEQ ID NO: 1283992 - DNA, 22 bp, Homo sapiens
tgctttgactcacctgttactt

SEQ ID NO: 1283993 - DNA, 13 bp, Homo sapiens
tgctttgagattt

SEQ ID NO: 1283994 - DNA, 14 bp, Homo sapiens
tgctttgcaaagac

SEQ ID NO: 1283995 - DNA, 18 bp, Homo sapiens
tgctttgcattactgtcc

SEQ ID NO: 1283996 - DNA, 20 bp, Homo sapiens
tgctttgccaagttgctgtc

SEQ ID NO: 1283997 - DNA, 23 bp, Homo sapiens
tgctttgccaagttgctgtcact

SEQ ID NO: 1283998 - DNA, 22 bp, Homo sapiens
tgctttgcgtgcccggggcagc

SEQ ID NO: 1283999 - DNA, 12 bp, Homo sapiens
tgctttgctgca

SEQ ID NO: 1284000 - DNA, 13 bp, Homo sapiens
tgctttgctgcac

SEQ ID NO: 1284001 - DNA, 15 bp, Homo sapiens
tgctttgctgcacag

SEQ ID NO: 1284002 - DNA, 16 bp, Homo sapiens
tgctttgctgctatga

SEQ ID NO: 1284003 - DNA, 14 bp, Homo sapiens
tgctttgctttctg

SEQ ID NO: 1284004 - DNA, 21 bp, Homo sapiens
tgctttggacctaaatggcct

SEQ ID NO: 1284005 - DNA, 23 bp, Homo sapiens
tgctttggacctaaatggcctca

SEQ ID NO: 1284006 - DNA, 13 bp, Homo sapiens
tgctttggccttt

SEQ ID NO: 1284007 - DNA, 17 bp, Homo sapiens
tgctttggcctttcctt

SEQ ID NO: 1284008 - DNA, 18 bp, Homo sapiens
tgctttgggctgccctgg

SEQ ID NO: 1284009 - DNA, 19 bp, Homo sapiens
tgctttgggctttgcaggc

SEQ ID NO: 1284010 - DNA, 21 bp, Homo sapiens
tgctttgggctttgcaggctc

SEQ ID NO: 1284011 - DNA, 19 bp, Homo sapiens
tgctttgtaggtgtctcat

SEQ ID NO: 1284012 - DNA, 16 bp, Homo sapiens
tgctttgtgatttttg

SEQ ID NO: 1284013 - DNA, 16 bp, Homo sapiens
tgctttgtgtgattga

SEQ ID NO: 1284014 - DNA, 13 bp, Homo sapiens
tgcttttaatgaa

SEQ ID NO: 1284015 - DNA, 14 bp, Homo sapiens
tgcttttaatgaat

SEQ ID NO: 1284016 - DNA, 13 bp, Homo sapiens
tgcttttaccatg

SEQ ID NO: 1284017 - DNA, 19 bp, Homo sapiens
tgcttttagtgtgtgcata

SEQ ID NO: 1284018 - DNA, 21 bp, Homo sapiens
tgcttttatatggcccagcct

SEQ ID NO: 1284019 - DNA, 14 bp, Homo sapiens
tgcttttatattct

SEQ ID NO: 1284020 - DNA, 17 bp, Homo sapiens
tgcttttatattctaat

SEQ ID NO: 1284021 - DNA, 19 bp, Homo sapiens
tgcttttatattctaatag

SEQ ID NO: 1284022 - DNA, 16 bp, Homo sapiens
tggaatctagccgatg

SEQ ID NO: 1284023 - DNA, 22 bp, Homo sapiens
tggaatcttcacctcagagtgg

SEQ ID NO: 1284024 - DNA, 21 bp, Homo sapiens
tggaatcttccatctgcatct

SEQ ID NO: 1284025 - DNA, 15 bp, Homo sapiens
tggaatcttccccaa

SEQ ID NO: 1284026 - DNA, 21 bp, Homo sapiens
tggaatcttctctttgacaat

SEQ ID NO: 1284027 - DNA, 19 bp, Homo sapiens
tggaatcttttataatgat

SEQ ID NO: 1284028 - DNA, 18 bp, Homo sapiens
tggaatgagtgtgcatgg

SEQ ID NO: 1284029 - DNA, 21 bp, Homo sapiens
tggaatgattggttaaaatgt

SEQ ID NO: 1284030 - DNA, 15 bp, Homo sapiens
tggaatgcagaggtc

SEQ ID NO: 1284031 - DNA, 18 bp, Homo sapiens
tggaatgcagggaagagg

SEQ ID NO: 1284032 - DNA, 13 bp, Homo sapiens
tggaatgccttgg

SEQ ID NO: 1284033 - DNA, 21 bp, Homo sapiens
tggaatggaaaagcaacttca

SEQ ID NO: 1284034 - DNA, 22 bp, Homo sapiens
tggaatggaactactgtacttt

SEQ ID NO: 1284035 - DNA, 13 bp, Homo sapiens
tggaatggtgttt

SEQ ID NO: 1284036 - DNA, 14 bp, Homo sapiens
tggaatgtaatcaa

SEQ ID NO: 1284037 - DNA, 16 bp, Homo sapiens
tggaatgtgccacctg

SEQ ID NO: 1284038 - DNA, 17 bp, Homo sapiens
tggaatgtttttccctc

SEQ ID NO: 1284039 - DNA, 22 bp, Homo sapiens
tggaatgtttttccctccccag

SEQ ID NO: 1284040 - DNA, 20 bp, Homo sapiens
tggaattaaccatttaataa

SEQ ID NO: 1284041 - DNA, 18 bp, Homo sapiens
tggaattaacctggtgct

SEQ ID NO: 1284042 - DNA, 21 bp, Homo sapiens
tggaattaacctggtgctgga

SEQ ID NO: 1284043 - DNA, 22 bp, Homo sapiens
tggaattacaaccattgtattt

SEQ ID NO: 1284044 - DNA, 11 bp, Homo sapiens
tggaattcagc

SEQ ID NO: 1284045 - DNA, 17 bp, Homo sapiens
tggaattcagcaccctg

SEQ ID NO: 1284046 - DNA, 20 bp, Homo sapiens
tggaattcagcaccctgggt

SEQ ID NO: 1284047 - DNA, 17 bp, Homo sapiens
tggaattccaacttgaa

SEQ ID NO: 1284048 - DNA, 19 bp, Homo sapiens
tggaattccaacttgaagg

SEQ ID NO: 1284049 - DNA, 22 bp, Homo sapiens
tggaattccctcctgagtgccc

SEQ ID NO: 1284050 - DNA, 16 bp, Homo sapiens
tggaattcgtgttatg

SEQ ID NO: 1284051 - DNA, 20 bp, Homo sapiens
tggaattcgtgttatgaatc

SEQ ID NO: 1284052 - DNA, 11 bp, Homo sapiens
tggaattgctt

SEQ ID NO: 1284053 - DNA, 17 bp, Homo sapiens
tggaattggtgtatatc

SEQ ID NO: 1284054 - DNA, 22 bp, Homo sapiens
tggaattgtggctatcctgatt

SEQ ID NO: 1284055 - DNA, 17 bp, Homo sapiens
tggaatttctggcctcc

SEQ ID NO: 1284056 - DNA, 17 bp, Homo sapiens
tggaatttgtaacctca

SEQ ID NO: 1284057 - DNA, 19 bp, Homo sapiens
tggaatttgtaacctcagc

SEQ ID NO: 1284058 - DNA, 13 bp, Homo sapiens
tggaatttgttca

SEQ ID NO: 1284059 - DNA, 15 bp, Homo sapiens
tggaatttgttcaag

SEQ ID NO: 1284060 - DNA, 18 bp, Homo sapiens
tggaattttgagaaaaat

SEQ ID NO: 1284061 - DNA, 22 bp, Homo sapiens
tggaattttgcaaagatttaat

SEQ ID NO: 1284062 - DNA, 21 bp, Homo sapiens
tggacaaaattaatacattct

SEQ ID NO: 1284063 - DNA, 21 bp, Homo sapiens
tggacaaacctagaattttct

SEQ ID NO: 1284064 - DNA, 15 bp, Homo sapiens
tggacaaatcacata

SEQ ID NO: 1284065 - DNA, 14 bp, Homo sapiens
tggacaaatgttgt

SEQ ID NO: 1284066 - DNA, 23 bp, Homo sapiens
tggacaacactgattcctggaga

SEQ ID NO: 1284067 - DNA, 14 bp, Homo sapiens
tggacaacagctct

SEQ ID NO: 1284068 - DNA, 15 bp, Homo sapiens
tggacaacagctctc

SEQ ID NO: 1284069 - DNA, 21 bp, Homo sapiens
tggacaacttatttaaaaata

SEQ ID NO: 1284070 - DNA, 23 bp, Homo sapiens
tggacaacttatttaaaaatatt

SEQ ID NO: 1284071 - DNA, 14 bp, Homo sapiens
tggacaagcagtgt

SEQ ID NO: 1284072 - DNA, 17 bp, Homo sapiens
tggacacacaaggtgca

SEQ ID NO: 1284073 - DNA, 11 bp, Homo sapiens
tggacacacac

SEQ ID NO: 1284074 - DNA, 16 bp, Homo sapiens
tggacacacacagact

SEQ ID NO: 1284075 - DNA, 24 bp, Homo sapiens
tggacacacactcaccagtggcct

SEQ ID NO: 1284076 - DNA, 19 bp, Homo sapiens
tggacacactaaactctgg

SEQ ID NO: 1284077 - DNA, 23 bp, Homo sapiens
tggacacactaaactctggggct

SEQ ID NO: 1284078 - DNA, 11 bp, Homo sapiens
tggacacactc

SEQ ID NO: 1284079 - DNA, 15 bp, Homo sapiens
tggacacagggtgac

SEQ ID NO: 1284080 - DNA, 20 bp, Homo sapiens
tggacaccaggagtccctgg

SEQ ID NO: 1284081 - DNA, 14 bp, Homo sapiens
tggacaccccagac

SEQ ID NO: 1284082 - DNA, 14 bp, Homo sapiens
tggacacccccagc

SEQ ID NO: 1284083 - DNA, 16 bp, Homo sapiens
tggacacccccagctg

SEQ ID NO: 1284084 - DNA, 22 bp, Homo sapiens
tggacaccgctcagtattactt

SEQ ID NO: 1284085 - DNA, 18 bp, Homo sapiens
tggacacctcccagggga

SEQ ID NO: 1284086 - DNA, 17 bp, Homo sapiens
tggacacgagccacaag

SEQ ID NO: 1284087 - DNA, 20 bp, Homo sapiens
tggacacgagccacaagctg

SEQ ID NO: 1284088 - DNA, 18 bp, Homo sapiens
tggacactaatgcagcca

SEQ ID NO: 1284089 - DNA, 16 bp, Homo sapiens
tggacactcagacctg

SEQ ID NO: 1284090 - DNA, 19 bp, Homo sapiens
tggacactccagggacaca

SEQ ID NO: 1284091 - DNA, 22 bp, Homo sapiens
tggacactccagggacacacag

SEQ ID NO: 1284092 - DNA, 17 bp, Homo sapiens
tggacactccagtgcca

SEQ ID NO: 1284093 - DNA, 23 bp, Homo sapiens
tggacacttaatactaccttgaa

SEQ ID NO: 1284094 - DNA, 21 bp, Homo sapiens
tggacactttgaaatgtgttt

SEQ ID NO: 1284095 - DNA, 13 bp, Homo sapiens
tggacagacacct

SEQ ID NO: 1284096 - DNA, 15 bp, Homo sapiens
tggacagacacctcc

SEQ ID NO: 1284097 - DNA, 19 bp, Homo sapiens
tggacagacacctccccct

SEQ ID NO: 1284098 - DNA, 14 bp, Homo sapiens
tggacagacactgt

SEQ ID NO: 1284099 - DNA, 17 bp, Homo sapiens
tggacagacactgttgc

SEQ ID NO: 1284100 - DNA, 12 bp, Homo sapiens
tggacagacaga

SEQ ID NO: 1284101 - DNA, 24 bp, Homo sapiens
tggacagacagatgttgggaggat

SEQ ID NO: 1284102 - DNA, 13 bp, Homo sapiens
tggacagagggga

SEQ ID NO: 1284103 - DNA, 18 bp, Homo sapiens
tggacagaggggactctg

SEQ ID NO: 1284104 - DNA, 19 bp, Homo sapiens
tggacagaggggactctgg

SEQ ID NO: 1284105 - DNA, 14 bp, Homo sapiens
tggacagatggccc

SEQ ID NO: 1284106 - DNA, 19 bp, Homo sapiens
tggacagatggcccaaggg

SEQ ID NO: 1284107 - DNA, 17 bp, Homo sapiens
tggacagcaaaaccatt

SEQ ID NO: 1284108 - DNA, 15 bp, Homo sapiens
tggacagcagaagcc

SEQ ID NO: 1284109 - DNA, 21 bp, Homo sapiens
tggacagcggcagtgggcctg

SEQ ID NO: 1284110 - DNA, 16 bp, Homo sapiens
tggacagctgcttgtg

SEQ ID NO: 1284111 - DNA, 13 bp, Homo sapiens
tggacagcttgtg

SEQ ID NO: 1284112 - DNA, 22 bp, Homo sapiens
tggacagctttgctccgctccc

SEQ ID NO: 1284113 - DNA, 21 bp, Homo sapiens
tggacaggagatcagcagcgt

SEQ ID NO: 1284114 - DNA, 14 bp, Homo sapiens
tggacaggctggct

SEQ ID NO: 1284115 - DNA, 12 bp, Homo sapiens
tggacagggcca

SEQ ID NO: 1284116 - DNA, 13 bp, Homo sapiens
tggacagggccag

SEQ ID NO: 1284117 - DNA, 17 bp, Homo sapiens
tggacagggccagggtt

SEQ ID NO: 1284118 - DNA, 19 bp, Homo sapiens
tggacagtacctgattgta

SEQ ID NO: 1284119 - DNA, 18 bp, Homo sapiens
tggacagtagaatttcaa

SEQ ID NO: 1284120 - DNA, 12 bp, Homo sapiens
tggacagtcctg

SEQ ID NO: 1284121 - DNA, 16 bp, Homo sapiens
tggacagtcctgggag

SEQ ID NO: 1284122 - DNA, 16 bp, Homo sapiens
tggacagtctccctga

SEQ ID NO: 1284123 - DNA, 16 bp, Homo sapiens
tggacatactgctgga

SEQ ID NO: 1284124 - DNA, 14 bp, Homo sapiens
tggacatagagagg

SEQ ID NO: 1284125 - DNA, 19 bp, Homo sapiens
tggacatagagagggagaa

SEQ ID NO: 1284126 - DNA, 14 bp, Homo sapiens
tggacatatgtata

SEQ ID NO: 1284127 - DNA, 23 bp, Homo sapiens
tggacatcctcctcccacccggc

SEQ ID NO: 1284128 - DNA, 15 bp, Homo sapiens
tggacatctctctgg

SEQ ID NO: 1284129 - DNA, 16 bp, Homo sapiens
tggacatctctctggc

SEQ ID NO: 1284130 - DNA, 22 bp, Homo sapiens
tggacatgaagattctttccca

SEQ ID NO: 1284131 - DNA, 22 bp, Homo sapiens
tggacatgagatggagaggctg

SEQ ID NO: 1284132 - DNA, 19 bp, Homo sapiens
tggacatttgccttgctgg

SEQ ID NO: 1284133 - DNA, 24 bp, Homo sapiens
tggacattttcttttattatcagt

SEQ ID NO: 1284134 - DNA, 16 bp, Homo sapiens
tggaccaaatgtgcca

SEQ ID NO: 1284135 - DNA, 21 bp, Homo sapiens
tggaccaaccctgtttcctga

SEQ ID NO: 1284136 - DNA, 18 bp, Homo sapiens
tggaccaacctgctctgt

SEQ ID NO: 1284137 - DNA, 21 bp, Homo sapiens
tggaccaatagggctgagctc

SEQ ID NO: 1284138 - DNA, 16 bp, Homo sapiens
tggaccaccagcccca

SEQ ID NO: 1284139 - DNA, 21 bp, Homo sapiens
tggaccaccagccccagcaag

SEQ ID NO: 1284140 - DNA, 21 bp, Homo sapiens
tggaccaccgttcagtcattt

SEQ ID NO: 1284141 - DNA, 23 bp, Homo sapiens
tggaccacgccgccctccatccg

SEQ ID NO: 1284142 - DNA, 15 bp, Homo sapiens
tggaccactgggcaa

SEQ ID NO: 1284143 - DNA, 15 bp, Homo sapiens
tggagctgaagacct

SEQ ID NO: 1284144 - DNA, 19 bp, Homo sapiens
tggagctgaatttgataaa

SEQ ID NO: 1284145 - DNA, 14 bp, Homo sapiens
tggagctgagaaga

SEQ ID NO: 1284146 - DNA, 14 bp, Homo sapiens
tggagctgccacag

SEQ ID NO: 1284147 - DNA, 18 bp, Homo sapiens
tggagctggcgtctgtct

SEQ ID NO: 1284148 - DNA, 18 bp, Homo sapiens
tggagctgggagacaaag

SEQ ID NO: 1284149 - DNA, 23 bp, Homo sapiens
tggagctgggagacaaaggagga

SEQ ID NO: 1284150 - DNA, 19 bp, Homo sapiens
tggagctggtctgccaggg

SEQ ID NO: 1284151 - DNA, 13 bp, Homo sapiens
tggaggaagagcc

SEQ ID NO: 1284152 - DNA, 18 bp, Homo sapiens
tggaggaagagccacctg

SEQ ID NO: 1284153 - DNA, 14 bp, Homo sapiens
tggaggaagcccac

SEQ ID NO: 1284154 - DNA, 18 bp, Homo sapiens
tggaggaaggctctgtca

SEQ ID NO: 1284155 - DNA, 19 bp, Homo sapiens
tggaggaaggctctgtcac

SEQ ID NO: 1284156 - DNA, 21 bp, Homo sapiens
tggaggaaggggggttgcagt

SEQ ID NO: 1284157 - DNA, 14 bp, Homo sapiens
tggaggaaggtgct

SEQ ID NO: 1284158 - DNA, 17 bp, Homo sapiens
tggaggaaggtgctgag

SEQ ID NO: 1284159 - DNA, 18 bp, Homo sapiens
tggaggaaggtgctgagc

SEQ ID NO: 1284160 - DNA, 19 bp, Homo sapiens
tggaggaaggtgctgagct

SEQ ID NO: 1284161 - DNA, 20 bp, Homo sapiens
tggaggaagtatgagtgctg

SEQ ID NO: 1284162 - DNA, 16 bp, Homo sapiens
tggaggaattcagctc

SEQ ID NO: 1284163 - DNA, 21 bp, Homo sapiens
tggaggacagagggagacagg

SEQ ID NO: 1284164 - DNA, 15 bp, Homo sapiens
tggaggaccagattg

SEQ ID NO: 1284165 - DNA, 23 bp, Homo sapiens
tggaggaccagattgctctgccc

SEQ ID NO: 1284166 - DNA, 17 bp, Homo sapiens
tggaggactgtgacaga

SEQ ID NO: 1284167 - DNA, 14 bp, Homo sapiens
tggaggagaaggac

SEQ ID NO: 1284168 - DNA, 15 bp, Homo sapiens
tggaggagagaagaa

SEQ ID NO: 1284169 - DNA, 16 bp, Homo sapiens
tggaggagcagcttcc

SEQ ID NO: 1284170 - DNA, 18 bp, Homo sapiens
tggaggagctgagggagg

SEQ ID NO: 1284171 - DNA, 16 bp, Homo sapiens
tggaggaggaaggcaa

SEQ ID NO: 1284172 - DNA, 17 bp, Homo sapiens
tggaggaggaaggcaag

SEQ ID NO: 1284173 - DNA, 21 bp, Homo sapiens
tggaggaggaggaggagcctt

SEQ ID NO: 1284174 - DNA, 21 bp, Homo sapiens
tggaggaggagggaggcgctg

SEQ ID NO: 1284175 - DNA, 22 bp, Homo sapiens
tggaggaggggaagctgggccc

SEQ ID NO: 1284176 - DNA, 18 bp, Homo sapiens
tggaggaggtggcttcat

SEQ ID NO: 1284177 - DNA, 21 bp, Homo sapiens
tggaggaggtggcttcatgtg

SEQ ID NO: 1284178 - DNA, 17 bp, Homo sapiens
tggaggaggttgggagg

SEQ ID NO: 1284179 - DNA, 16 bp, Homo sapiens
tggaggatgtgggcag

SEQ ID NO: 1284180 - DNA, 17 bp, Homo sapiens
tggaggatgtgggcagc

SEQ ID NO: 1284181 - DNA, 16 bp, Homo sapiens
tggaggattctttccc

SEQ ID NO: 1284182 - DNA, 18 bp, Homo sapiens
tggaggattctttcccca

SEQ ID NO: 1284183 - DNA, 21 bp, Homo sapiens
tggaggattctttccccagag

SEQ ID NO: 1284184 - DNA, 13 bp, Homo sapiens
tggaggattgcta

SEQ ID NO: 1284185 - DNA, 23 bp, Homo sapiens
tggaggatttcctacccccgtcc

SEQ ID NO: 1284186 - DNA, 14 bp, Homo sapiens
tggaggcaagaggg

SEQ ID NO: 1284187 - DNA, 17 bp, Homo sapiens
tggaggcaagagggagg

SEQ ID NO: 1284188 - DNA, 23 bp, Homo sapiens
tggaggcaagagggaggggacag

SEQ ID NO: 1284189 - DNA, 21 bp, Homo sapiens
tggaggcagagacctccaata

SEQ ID NO: 1284190 - DNA, 16 bp, Homo sapiens
tggaggcagatgtggg

SEQ ID NO: 1284191 - DNA, 12 bp, Homo sapiens
tggaggccagag

SEQ ID NO: 1284192 - DNA, 13 bp, Homo sapiens
tggaggccagagt

SEQ ID NO: 1284193 - DNA, 23 bp, Homo sapiens
tggaggccagagtctcccagtgg

SEQ ID NO: 1284194 - DNA, 18 bp, Homo sapiens
tggaggcccaggctggga

SEQ ID NO: 1284195 - DNA, 13 bp, Homo sapiens
tggaggcccctgg

SEQ ID NO: 1284196 - DNA, 20 bp, Homo sapiens
tggaggcccctggagccaga

SEQ ID NO: 1284197 - DNA, 21 bp, Homo sapiens
tggaggccctcctgtgctggg

SEQ ID NO: 1284198 - DNA, 24 bp, Homo sapiens
tggaggcctcaggtgctgtccatg

SEQ ID NO: 1284199 - DNA, 13 bp, Homo sapiens
tggaggcctctgg

SEQ ID NO: 1284200 - DNA, 14 bp, Homo sapiens
tggaggcctctggc

SEQ ID NO: 1284201 - DNA, 15 bp, Homo sapiens
tggaggcctgatgct

SEQ ID NO: 1284202 - DNA, 18 bp, Homo sapiens
tggaggcctgatgctgcc

SEQ ID NO: 1284203 - DNA, 17 bp, Homo sapiens
tggaggcgggcttggaa

SEQ ID NO: 1284204 - DNA, 18 bp, Homo sapiens
tggaggcggtgcggcagg

SEQ ID NO: 1284205 - DNA, 19 bp, Homo sapiens
tggaggctctgttctgcct

SEQ ID NO: 1284206 - DNA, 12 bp, Homo sapiens
tggaggctgagg

SEQ ID NO: 1284207 - DNA, 20 bp, Homo sapiens
tggaggcttcctgcgtcctc

SEQ ID NO: 1284208 - DNA, 15 bp, Homo sapiens
tggaggcttttcact

SEQ ID NO: 1284209 - DNA, 20 bp, Homo sapiens
tggagggaaacaccaaactc

SEQ ID NO: 1284210 - DNA, 22 bp, Homo sapiens
tggagggaaggataaagccact

SEQ ID NO: 1284211 - DNA, 24 bp, Homo sapiens
tggagggacttttaatcagtgaag

SEQ ID NO: 1284212 - DNA, 13 bp, Homo sapiens
tggagggaggctg

SEQ ID NO: 1284213 - DNA, 22 bp, Homo sapiens
tggagggcacttcctccacagt

SEQ ID NO: 1284214 - DNA, 15 bp, Homo sapiens
tggagggcttggccc

SEQ ID NO: 1284215 - DNA, 20 bp, Homo sapiens
tggaggggaaatggggaaag

SEQ ID NO: 1284216 - DNA, 16 bp, Homo sapiens
tggaggggagtgttgg

SEQ ID NO: 1284217 - DNA, 14 bp, Homo sapiens
tggaggggcagagc

SEQ ID NO: 1284218 - DNA, 16 bp, Homo sapiens
tggaggggcagagcca

SEQ ID NO: 1284219 - DNA, 17 bp, Homo sapiens
tggaggggcagcctgtg

SEQ ID NO: 1284220 - DNA, 19 bp, Homo sapiens
tggaggggcgcccagggtc

SEQ ID NO: 1284221 - DNA, 16 bp, Homo sapiens
tggaggggctggggac

SEQ ID NO: 1284222 - DNA, 13 bp, Homo sapiens
tggaggggtgtgg

SEQ ID NO: 1284223 - DNA, 14 bp, Homo sapiens
tggaggggtgtggc

SEQ ID NO: 1284224 - DNA, 17 bp, Homo sapiens
tggaggggtgtggcagt

SEQ ID NO: 1284225 - DNA, 22 bp, Homo sapiens
tggagggtaactggggggccac

SEQ ID NO: 1284226 - DNA, 19 bp, Homo sapiens
tggagggtctgggggcagc

SEQ ID NO: 1284227 - DNA, 17 bp, Homo sapiens
tggaggtactgagacag

SEQ ID NO: 1284228 - DNA, 20 bp, Homo sapiens
tggaggtcacattcaggaag

SEQ ID NO: 1284229 - DNA, 16 bp, Homo sapiens
tggaggtgctgctcta

SEQ ID NO: 1284230 - DNA, 22 bp, Homo sapiens
tggaggtgctgctctagggcag

SEQ ID NO: 1284231 - DNA, 13 bp, Homo sapiens
tggaggtgggcaa

SEQ ID NO: 1284232 - DNA, 18 bp, Homo sapiens
tggaggtgggcatgccac

SEQ ID NO: 1284233 - DNA, 15 bp, Homo sapiens
tggaggtgggctgat

SEQ ID NO: 1284234 - DNA, 16 bp, Homo sapiens
tggaggttctcagagc

SEQ ID NO: 1284235 - DNA, 21 bp, Homo sapiens
tggaggttctcagagccaagt

SEQ ID NO: 1284236 - DNA, 23 bp, Homo sapiens
tggaggttctcagagccaagtcc

SEQ ID NO: 1284237 - DNA, 22 bp, Homo sapiens
tggagtaaaaaaggagacagtt

SEQ ID NO: 1284238 - DNA, 22 bp, Homo sapiens
tggagtaaaccatgtattccct

SEQ ID NO: 1284239 - DNA, 18 bp, Homo sapiens
tggagtactatatttaca

SEQ ID NO: 1284240 - DNA, 21 bp, Homo sapiens
tggagtagacaaaaggaaagg

SEQ ID NO: 1284241 - DNA, 18 bp, Homo sapiens
tggagtatttattgtcag

SEQ ID NO: 1284242 - DNA, 13 bp, Homo sapiens
tggagtccagctc

SEQ ID NO: 1284243 - DNA, 15 bp, Homo sapiens
tggagtcccctcacc

SEQ ID NO: 1284244 - DNA, 20 bp, Homo sapiens
tggagtcccctcacctcctc

SEQ ID NO: 1284245 - DNA, 18 bp, Homo sapiens
tggagtcggagtggacac

SEQ ID NO: 1284246 - DNA, 20 bp, Homo sapiens
tggagtcggagtggacaccg

SEQ ID NO: 1284247 - DNA, 13 bp, Homo sapiens
tggagtctgagtc

SEQ ID NO: 1284248 - DNA, 16 bp, Homo sapiens
tggagtctgagtctga

SEQ ID NO: 1284249 - DNA, 16 bp, Homo sapiens
tggagtcttttctgtt

SEQ ID NO: 1284250 - DNA, 21 bp, Homo sapiens
tggagtgagagcctttgcctt

SEQ ID NO: 1284251 - DNA, 23 bp, Homo sapiens
tggagtgagtcacctgctccaga

SEQ ID NO: 1284252 - DNA, 22 bp, Homo sapiens
tggagtgatggtgtccttccct

SEQ ID NO: 1284253 - DNA, 18 bp, Homo sapiens
tggagtgcaccaaagaga

SEQ ID NO: 1284254 - DNA, 17 bp, Homo sapiens
tggagtgcagggaggag

SEQ ID NO: 1284255 - DNA, 16 bp, Homo sapiens
tggagtgcagtggcac

SEQ ID NO: 1284256 - DNA, 18 bp, Homo sapiens
tggagtgcagtggcacaa

SEQ ID NO: 1284257 - DNA, 18 bp, Homo sapiens
tggagtgccctgcaggca

SEQ ID NO: 1284258 - DNA, 22 bp, Homo sapiens
tggagtgcgctcttggtccctg

SEQ ID NO: 1284259 - DNA, 17 bp, Homo sapiens
tggagtgtcggatcctg

SEQ ID NO: 1284260 - DNA, 22 bp, Homo sapiens
tggagtgtcggatcctgtgagt

SEQ ID NO: 1284261 - DNA, 15 bp, Homo sapiens
tggagtgtgagccac

SEQ ID NO: 1284262 - DNA, 21 bp, Homo sapiens
tggagtgtgagggtcctgcag

SEQ ID NO: 1284263 - DNA, 17 bp, Homo sapiens
tggagtgtgcagacagc

SEQ ID NO: 1284264 - DNA, 15 bp, Homo sapiens
tggcagccacacgca

SEQ ID NO: 1284265 - DNA, 15 bp, Homo sapiens
tggcagccatgcctc

SEQ ID NO: 1284266 - DNA, 12 bp, Homo sapiens
tggcagcccaga

SEQ ID NO: 1284267 - DNA, 12 bp, Homo sapiens
tggcagcccatg

SEQ ID NO: 1284268 - DNA, 15 bp, Homo sapiens
tggcagccgtcccag

SEQ ID NO: 1284269 - DNA, 19 bp, Homo sapiens
tggcagccgtcccaggcca

SEQ ID NO: 1284270 - DNA, 16 bp, Homo sapiens
tggcagccgtgccttc

SEQ ID NO: 1284271 - DNA, 21 bp, Homo sapiens
tggcagcctcccatccagggc

SEQ ID NO: 1284272 - DNA, 16 bp, Homo sapiens
tggcagctagactgga

SEQ ID NO: 1284273 - DNA, 14 bp, Homo sapiens
tggcagctagtgcc

SEQ ID NO: 1284274 - DNA, 16 bp, Homo sapiens
tggcagctcctctcct

SEQ ID NO: 1284275 - DNA, 17 bp, Homo sapiens
tggcagctgagagccct

SEQ ID NO: 1284276 - DNA, 19 bp, Homo sapiens
tggcagctgagagccctgc

SEQ ID NO: 1284277 - DNA, 23 bp, Homo sapiens
tggcagctgagagccctgctgtg

SEQ ID NO: 1284278 - DNA, 13 bp, Homo sapiens
tggcagctgcccc

SEQ ID NO: 1284279 - DNA, 14 bp, Homo sapiens
tggcagctgcccct

SEQ ID NO: 1284280 - DNA, 15 bp, Homo sapiens
tggcagctgcccctc

SEQ ID NO: 1284281 - DNA, 17 bp, Homo sapiens
tggcagctgcccctcct

SEQ ID NO: 1284282 - DNA, 23 bp, Homo sapiens
tggcagctgtcccctctccctgg

SEQ ID NO: 1284283 - DNA, 15 bp, Homo sapiens
tggcagctgtttctc

SEQ ID NO: 1284284 - DNA, 19 bp, Homo sapiens
tggcagctttttctgtgga

SEQ ID NO: 1284285 - DNA, 17 bp, Homo sapiens
tggcaggacaaattgcg

SEQ ID NO: 1284286 - DNA, 18 bp, Homo sapiens
tggcaggactcctggcag

SEQ ID NO: 1284287 - DNA, 19 bp, Homo sapiens
tggcaggagaatcagcctg

SEQ ID NO: 1284288 - DNA, 14 bp, Homo sapiens
tggcaggagagctt

SEQ ID NO: 1284289 - DNA, 12 bp, Homo sapiens
tggcaggatcca

SEQ ID NO: 1284290 - DNA, 15 bp, Homo sapiens
tggcaggatccaagg

SEQ ID NO: 1284291 - DNA, 19 bp, Homo sapiens
tggcaggatccaaggggct

SEQ ID NO: 1284292 - DNA, 22 bp, Homo sapiens
tggcaggatgaccctgcgaagg

SEQ ID NO: 1284293 - DNA, 23 bp, Homo sapiens
tggcaggcacacagcagcccccc

SEQ ID NO: 1284294 - DNA, 14 bp, Homo sapiens
tggcaggcacctgt

SEQ ID NO: 1284295 - DNA, 11 bp, Homo sapiens
tggcaggcctg

SEQ ID NO: 1284296 - DNA, 14 bp, Homo sapiens
tggcaggcctgacc

SEQ ID NO: 1284297 - DNA, 12 bp, Homo sapiens
tggcaggctggc

SEQ ID NO: 1284298 - DNA, 13 bp, Homo sapiens
tggcaggctggcc

SEQ ID NO: 1284299 - DNA, 14 bp, Homo sapiens
tggcaggctggcca

SEQ ID NO: 1284300 - DNA, 15 bp, Homo sapiens
tggcaggcttccccc

SEQ ID NO: 1284301 - DNA, 24 bp, Homo sapiens
tggcagggccacctgcaggaccct

SEQ ID NO: 1284302 - DNA, 12 bp, Homo sapiens
tggcagggccag

SEQ ID NO: 1284303 - DNA, 14 bp, Homo sapiens
tggcagggccaggg

SEQ ID NO: 1284304 - DNA, 16 bp, Homo sapiens
tggcagggccagggca

SEQ ID NO: 1284305 - DNA, 19 bp, Homo sapiens
tggcagggccagggcaatg

SEQ ID NO: 1284306 - DNA, 15 bp, Homo sapiens
tggcagggcctcatc

SEQ ID NO: 1284307 - DNA, 20 bp, Homo sapiens
tggcagggcctcatctcacc

SEQ ID NO: 1284308 - DNA, 14 bp, Homo sapiens
tggcagggcggggg

SEQ ID NO: 1284309 - DNA, 16 bp, Homo sapiens
tggcagggctcacact

SEQ ID NO: 1284310 - DNA, 23 bp, Homo sapiens
tggcagggctcacactcctgggc

SEQ ID NO: 1284311 - DNA, 15 bp, Homo sapiens
tggcaggggacagga

SEQ ID NO: 1284312 - DNA, 18 bp, Homo sapiens
tggcaggggacaggagtc

SEQ ID NO: 1284313 - DNA, 21 bp, Homo sapiens
tggcagggggccccgccaggg

SEQ ID NO: 1284314 - DNA, 22 bp, Homo sapiens
tggcagggggccccgccagggc

SEQ ID NO: 1284315 - DNA, 23 bp, Homo sapiens
tggcagggggccccgccagggct

SEQ ID NO: 1284316 - DNA, 16 bp, Homo sapiens
tggcagggtgggatgg

SEQ ID NO: 1284317 - DNA, 19 bp, Homo sapiens
tggcaggtcactgtcactg

SEQ ID NO: 1284318 - DNA, 20 bp, Homo sapiens
tggcaggtgcagatgggctg

SEQ ID NO: 1284319 - DNA, 15 bp, Homo sapiens
tggcaggtgggctgc

SEQ ID NO: 1284320 - DNA, 15 bp, Homo sapiens
tggcaggtgtcatat

SEQ ID NO: 1284321 - DNA, 16 bp, Homo sapiens
tggcagtctgaatttt

SEQ ID NO: 1284322 - DNA, 22 bp, Homo sapiens
tggcagtctgaatttttaaaac

SEQ ID NO: 1284323 - DNA, 13 bp, Homo sapiens
tggcagttatatt

SEQ ID NO: 1284324 - DNA, 17 bp, Homo sapiens
tggcagttgaacagagg

SEQ ID NO: 1284325 - DNA, 17 bp, Homo sapiens
tggcataatttgtctta

SEQ ID NO: 1284326 - DNA, 14 bp, Homo sapiens
tggcatagacatgg

SEQ ID NO: 1284327 - DNA, 19 bp, Homo sapiens
tggcatagaggttttgtat

SEQ ID NO: 1284328 - DNA, 14 bp, Homo sapiens
tggcatagctctgg

SEQ ID NO: 1284329 - DNA, 23 bp, Homo sapiens
tggcatatatgtgatctgggcat

SEQ ID NO: 1284330 - DNA, 22 bp, Homo sapiens
tggcatcaagaggtgggagggc

SEQ ID NO: 1284331 - DNA, 21 bp, Homo sapiens
tggcatcaggtctgggcaagt

SEQ ID NO: 1284332 - DNA, 15 bp, Homo sapiens
tggcatcccagtggc

SEQ ID NO: 1284333 - DNA, 13 bp, Homo sapiens
tggcatcctgtga

SEQ ID NO: 1284334 - DNA, 23 bp, Homo sapiens
tggcatcgcaccattctgactcg

SEQ ID NO: 1284335 - DNA, 13 bp, Homo sapiens
tggcatcttgcca

SEQ ID NO: 1284336 - DNA, 20 bp, Homo sapiens
tggcatctttgccttgggct

SEQ ID NO: 1284337 - DNA, 23 bp, Homo sapiens
tggcatctttgccttgggctgct

SEQ ID NO: 1284338 - DNA, 14 bp, Homo sapiens
tggcatgacctcat

SEQ ID NO: 1284339 - DNA, 22 bp, Homo sapiens
tggcatgatcatagctcactgc

SEQ ID NO: 1284340 - DNA, 21 bp, Homo sapiens
tggcatgattagattgcaaag

SEQ ID NO: 1284341 - DNA, 18 bp, Homo sapiens
tggcatgatttatatatg

SEQ ID NO: 1284342 - DNA, 19 bp, Homo sapiens
tggcatgcgccaccatgcc

SEQ ID NO: 1284343 - DNA, 17 bp, Homo sapiens
tggcatgcttaaatttt

SEQ ID NO: 1284344 - DNA, 19 bp, Homo sapiens
tggcatggaaatttaaagc

SEQ ID NO: 1284345 - DNA, 20 bp, Homo sapiens
tggcatggaaatttaaagca

SEQ ID NO: 1284346 - DNA, 16 bp, Homo sapiens
tggcatggaaggggct

SEQ ID NO: 1284347 - DNA, 18 bp, Homo sapiens
tggcatggaaggggcttc

SEQ ID NO: 1284348 - DNA, 17 bp, Homo sapiens
tggcatggtgagtgttg

SEQ ID NO: 1284349 - DNA, 17 bp, Homo sapiens
tggcatgtggcctgtgg

SEQ ID NO: 1284350 - DNA, 17 bp, Homo sapiens
tggcatgtttcactcct

SEQ ID NO: 1284351 - DNA, 23 bp, Homo sapiens
tggcattaaaccacatcatggac

SEQ ID NO: 1284352 - DNA, 19 bp, Homo sapiens
tggcattacagctggagaa

SEQ ID NO: 1284353 - DNA, 22 bp, Homo sapiens
tggcattattaggtcttaaagt

SEQ ID NO: 1284354 - DNA, 18 bp, Homo sapiens
tggcattctacacctgga

SEQ ID NO: 1284355 - DNA, 19 bp, Homo sapiens
tggcattgtccctgtgcct

SEQ ID NO: 1284356 - DNA, 23 bp, Homo sapiens
tggcatttctctttaaactatgt

SEQ ID NO: 1284357 - DNA, 20 bp, Homo sapiens
tggcatttgctgatttctag

SEQ ID NO: 1284358 - DNA, 17 bp, Homo sapiens
tggcatttgctggttat

SEQ ID NO: 1284359 - DNA, 19 bp, Homo sapiens
tggcatttgttatcctctt

SEQ ID NO: 1284360 - DNA, 15 bp, Homo sapiens
tggccaaacaacagt

SEQ ID NO: 1284361 - DNA, 21 bp, Homo sapiens
tggccaaacatcagacctgtc

SEQ ID NO: 1284362 - DNA, 23 bp, Homo sapiens
tggccaaacatcagacctgtctt

SEQ ID NO: 1284363 - DNA, 15 bp, Homo sapiens
tggccaaagagcctt

SEQ ID NO: 1284364 - DNA, 21 bp, Homo sapiens
tggccaaataggagggagact

SEQ ID NO: 1284365 - DNA, 22 bp, Homo sapiens
tggccaaataggagggagactg

SEQ ID NO: 1284366 - DNA, 12 bp, Homo sapiens
tggccaaatatg

SEQ ID NO: 1284367 - DNA, 15 bp, Homo sapiens
tggccaacagggtag

SEQ ID NO: 1284368 - DNA, 15 bp, Homo sapiens
tggccaaccaggacc

SEQ ID NO: 1284369 - DNA, 18 bp, Homo sapiens
tggccaaccaggacccag

SEQ ID NO: 1284370 - DNA, 22 bp, Homo sapiens
tggccaactgcaaaaaaagcct

SEQ ID NO: 1284371 - DNA, 16 bp, Homo sapiens
tggccaagaagcagtg

SEQ ID NO: 1284372 - DNA, 22 bp, Homo sapiens
tggccaagaagcagtggcctta

SEQ ID NO: 1284373 - DNA, 14 bp, Homo sapiens
tggccaagcctgct

SEQ ID NO: 1284374 - DNA, 16 bp, Homo sapiens
tggccaagcctgctgt

SEQ ID NO: 1284375 - DNA, 16 bp, Homo sapiens
tggccaaggagctgct

SEQ ID NO: 1284376 - DNA, 16 bp, Homo sapiens
tggccaagttcttagt

SEQ ID NO: 1284377 - DNA, 12 bp, Homo sapiens
tggccacagact

SEQ ID NO: 1284378 - DNA, 16 bp, Homo sapiens
tggccacagcgtgctg

SEQ ID NO: 1284379 - DNA, 17 bp, Homo sapiens
tggccacagcgtgctgg

SEQ ID NO: 1284380 - DNA, 22 bp, Homo sapiens
tggccacatttaatatcttcag

SEQ ID NO: 1284381 - DNA, 16 bp, Homo sapiens
tggccaccaggctggc

SEQ ID NO: 1284382 - DNA, 19 bp, Homo sapiens
tggccaccaggctggcgca

SEQ ID NO: 1284383 - DNA, 18 bp, Homo sapiens
tggccaccccagagtggg

SEQ ID NO: 1284384 - DNA, 22 bp, Homo sapiens
tggccaccccagagtgggagag

SEQ ID NO: 1284385 - DNA, 17 bp, Homo sapiens
tggccaccccgtgccac

SEQ ID NO: 1284386 - DNA, 20 bp, Homo sapiens
tggcctctctctctctcctc

SEQ ID NO: 1284387 - DNA, 22 bp, Homo sapiens
tggcctctctctctctcctcag

SEQ ID NO: 1284388 - DNA, 14 bp, Homo sapiens
tggcctctgcctgg

SEQ ID NO: 1284389 - DNA, 15 bp, Homo sapiens
tggcctctgcctggg

SEQ ID NO: 1284390 - DNA, 17 bp, Homo sapiens
tggcctctgcctggggc

SEQ ID NO: 1284391 - DNA, 14 bp, Homo sapiens
tggcctctgctttc

SEQ ID NO: 1284392 - DNA, 20 bp, Homo sapiens
tggcctctgtgattacatag

SEQ ID NO: 1284393 - DNA, 21 bp, Homo sapiens
tggcctctgtgattacataga

SEQ ID NO: 1284394 - DNA, 22 bp, Homo sapiens
tggcctctgtgattacatagat

SEQ ID NO: 1284395 - DNA, 23 bp, Homo sapiens
tggcctctgtggagccccagcat

SEQ ID NO: 1284396 - DNA, 17 bp, Homo sapiens
tggcctcttgagcagtg

SEQ ID NO: 1284397 - DNA, 23 bp, Homo sapiens
tggcctcttgagttcctctgcag

SEQ ID NO: 1284398 - DNA, 19 bp, Homo sapiens
tggcctgactggttgtcag

SEQ ID NO: 1284399 - DNA, 17 bp, Homo sapiens
tggcctgacttggggga

SEQ ID NO: 1284400 - DNA, 15 bp, Homo sapiens
tggcctgagagggga

SEQ ID NO: 1284401 - DNA, 16 bp, Homo sapiens
tggcctgagctggggc

SEQ ID NO: 1284402 - DNA, 18 bp, Homo sapiens
tggcctgagctggggcca

SEQ ID NO: 1284403 - DNA, 16 bp, Homo sapiens
tggcctgcactaattt

SEQ ID NO: 1284404 - DNA, 17 bp, Homo sapiens
tggcctgccagtctgcc

SEQ ID NO: 1284405 - DNA, 12 bp, Homo sapiens
tggcctgcccag

SEQ ID NO: 1284406 - DNA, 11 bp, Homo sapiens
tggcctggaca

SEQ ID NO: 1284407 - DNA, 23 bp, Homo sapiens
tggcctggagaggacggccctgc

SEQ ID NO: 1284408 - DNA, 21 bp, Homo sapiens
tggcctggaggctcagcccac

SEQ ID NO: 1284409 - DNA, 18 bp, Homo sapiens
tggcctggaggtggggtt

SEQ ID NO: 1284410 - DNA, 12 bp, Homo sapiens
tggcctggatct

SEQ ID NO: 1284411 - DNA, 14 bp, Homo sapiens
tggcctggatctcc

SEQ ID NO: 1284412 - DNA, 12 bp, Homo sapiens
tggcctggcaca

SEQ ID NO: 1284413 - DNA, 13 bp, Homo sapiens
tggcctggccagg

SEQ ID NO: 1284414 - DNA, 17 bp, Homo sapiens
tggcctggccaggagct

SEQ ID NO: 1284415 - DNA, 11 bp, Homo sapiens
tggcctgggca

SEQ ID NO: 1284416 - DNA, 15 bp, Homo sapiens
tggcctgggccacac

SEQ ID NO: 1284417 - DNA, 18 bp, Homo sapiens
tggcctgggccacacctg

SEQ ID NO: 1284418 - DNA, 21 bp, Homo sapiens
tggcctgggccacacctgagc

SEQ ID NO: 1284419 - DNA, 16 bp, Homo sapiens
tggcctgggcttggcc

SEQ ID NO: 1284420 - DNA, 11 bp, Homo sapiens
tggcctggtgg

SEQ ID NO: 1284421 - DNA, 14 bp, Homo sapiens
tggcctgtctcatc

SEQ ID NO: 1284422 - DNA, 18 bp, Homo sapiens
tggcctgtctcatcccca

SEQ ID NO: 1284423 - DNA, 24 bp, Homo sapiens
tggcctgtctcatccccaggggtc

SEQ ID NO: 1284424 - DNA, 12 bp, Homo sapiens
tggcctgtgagc

SEQ ID NO: 1284425 - DNA, 21 bp, Homo sapiens
tggcctgtgccagcaccacag

SEQ ID NO: 1284426 - DNA, 15 bp, Homo sapiens
tggcctgtgggcctc

SEQ ID NO: 1284427 - DNA, 14 bp, Homo sapiens
tggcctgtgtccag

SEQ ID NO: 1284428 - DNA, 15 bp, Homo sapiens
tggcctgtgtccagc

SEQ ID NO: 1284429 - DNA, 17 bp, Homo sapiens
tggcctgtgtccagcag

SEQ ID NO: 1284430 - DNA, 12 bp, Homo sapiens
tggcctgttcaa

SEQ ID NO: 1284431 - DNA, 12 bp, Homo sapiens
tggcctgtttga

SEQ ID NO: 1284432 - DNA, 16 bp, Homo sapiens
tggcctgtttgatgta

SEQ ID NO: 1284433 - DNA, 16 bp, Homo sapiens
tggccttaaagaggga

SEQ ID NO: 1284434 - DNA, 15 bp, Homo sapiens
tggccttacactgaa

SEQ ID NO: 1284435 - DNA, 23 bp, Homo sapiens
tggccttctcctacttagggaag

SEQ ID NO: 1284436 - DNA, 21 bp, Homo sapiens
tggccttgcccgccagcctca

SEQ ID NO: 1284437 - DNA, 20 bp, Homo sapiens
tggccttggcatgggcgcag

SEQ ID NO: 1284438 - DNA, 14 bp, Homo sapiens
tggccttgggagga

SEQ ID NO: 1284439 - DNA, 16 bp, Homo sapiens
tggccttgggaggaca

SEQ ID NO: 1284440 - DNA, 15 bp, Homo sapiens
tggccttgggccggt

SEQ ID NO: 1284441 - DNA, 21 bp, Homo sapiens
tggccttggtatgtgccaggc

SEQ ID NO: 1284442 - DNA, 18 bp, Homo sapiens
tggccttgtaagaccctt

SEQ ID NO: 1284443 - DNA, 14 bp, Homo sapiens
tggccttgtacttg

SEQ ID NO: 1284444 - DNA, 22 bp, Homo sapiens
tggcctttaagcctgcattctt

SEQ ID NO: 1284445 - DNA, 23 bp, Homo sapiens
tggcctttaagcctgcattctta

SEQ ID NO: 1284446 - DNA, 22 bp, Homo sapiens
tggcctttattaaaaactgagt

SEQ ID NO: 1284447 - DNA, 19 bp, Homo sapiens
tggcctttcaggtccaggc

SEQ ID NO: 1284448 - DNA, 15 bp, Homo sapiens
tggcctttccttccc

SEQ ID NO: 1284449 - DNA, 13 bp, Homo sapiens
tggcctttccttg

SEQ ID NO: 1284450 - DNA, 15 bp, Homo sapiens
tggcctttggaccca

SEQ ID NO: 1284451 - DNA, 21 bp, Homo sapiens
tggcctttggacccagggcct

SEQ ID NO: 1284452 - DNA, 19 bp, Homo sapiens
tggcctttgtaagtgcagg

SEQ ID NO: 1284453 - DNA, 20 bp, Homo sapiens
tggcctttgtaagtgcagga

SEQ ID NO: 1284454 - DNA, 16 bp, Homo sapiens
tggcctttgtgctgcg

SEQ ID NO: 1284455 - DNA, 13 bp, Homo sapiens
tggccttttccta

SEQ ID NO: 1284456 - DNA, 16 bp, Homo sapiens
tggccttttcctattt

SEQ ID NO: 1284457 - DNA, 18 bp, Homo sapiens
tggcgaatctcaaaatta

SEQ ID NO: 1284458 - DNA, 14 bp, Homo sapiens
tggcgaccaccaaa

SEQ ID NO: 1284459 - DNA, 16 bp, Homo sapiens
tggcgaccaccaaagt

SEQ ID NO: 1284460 - DNA, 17 bp, Homo sapiens
tggcgaccaccaaagtc

SEQ ID NO: 1284461 - DNA, 15 bp, Homo sapiens
tggcgactctgcaga

SEQ ID NO: 1284462 - DNA, 18 bp, Homo sapiens
tggcgactctgcagagtc

SEQ ID NO: 1284463 - DNA, 17 bp, Homo sapiens
tggcgatggggactctg

SEQ ID NO: 1284464 - DNA, 16 bp, Homo sapiens
tggcgcaggtgggctg

SEQ ID NO: 1284465 - DNA, 15 bp, Homo sapiens
tggcgccctgcctcc

SEQ ID NO: 1284466 - DNA, 15 bp, Homo sapiens
tggcgccgtctccag

SEQ ID NO: 1284467 - DNA, 17 bp, Homo sapiens
tggcgccgtctccaggg

SEQ ID NO: 1284468 - DNA, 15 bp, Homo sapiens
tggcgcgggagctgg

SEQ ID NO: 1284469 - DNA, 19 bp, Homo sapiens
tggcgcgggaggcaccagc

SEQ ID NO: 1284470 - DNA, 23 bp, Homo sapiens
tggcgcgggaggcaccagctctg

SEQ ID NO: 1284471 - DNA, 12 bp, Homo sapiens
tggcgctggtgc

SEQ ID NO: 1284472 - DNA, 14 bp, Homo sapiens
tggcggcagcagcc

SEQ ID NO: 1284473 - DNA, 15 bp, Homo sapiens
tggcggcctgcagtg

SEQ ID NO: 1284474 - DNA, 16 bp, Homo sapiens
tggcggctactcagca

SEQ ID NO: 1284475 - DNA, 21 bp, Homo sapiens
tggcggctactcagcagccct

SEQ ID NO: 1284476 - DNA, 18 bp, Homo sapiens
tggcggcttcctgtccac

SEQ ID NO: 1284477 - DNA, 13 bp, Homo sapiens
tggcgggccaagg

SEQ ID NO: 1284478 - DNA, 17 bp, Homo sapiens
tggcgggccaaggactg

SEQ ID NO: 1284479 - DNA, 14 bp, Homo sapiens
tggcggggaaccct

SEQ ID NO: 1284480 - DNA, 14 bp, Homo sapiens
tggcggggtggggt

SEQ ID NO: 1284481 - DNA, 16 bp, Homo sapiens
tggcgtaatgggcctg

SEQ ID NO: 1284482 - DNA, 13 bp, Homo sapiens
tggcgtctgctct

SEQ ID NO: 1284483 - DNA, 19 bp, Homo sapiens
tggcgtctgctctggtggc

SEQ ID NO: 1284484 - DNA, 17 bp, Homo sapiens
tggcgtctgtcttcaag

SEQ ID NO: 1284485 - DNA, 12 bp, Homo sapiens
tggcgtgacccg

SEQ ID NO: 1284486 - DNA, 21 bp, Homo sapiens
tggcgtgacccgacctggccg

SEQ ID NO: 1284487 - DNA, 17 bp, Homo sapiens
tggcgtgccctggaggc

SEQ ID NO: 1284488 - DNA, 13 bp, Homo sapiens
tggcgtggaggag

SEQ ID NO: 1284489 - DNA, 11 bp, Homo sapiens
tggcgtggccc

SEQ ID NO: 1284490 - DNA, 13 bp, Homo sapiens
tggcgtggcctcc

SEQ ID NO: 1284491 - DNA, 18 bp, Homo sapiens
tggcgtgggagccagcct

SEQ ID NO: 1284492 - DNA, 18 bp, Homo sapiens
tggctaaagataattgct

SEQ ID NO: 1284493 - DNA, 22 bp, Homo sapiens
tggctaaagataattgctattt

SEQ ID NO: 1284494 - DNA, 16 bp, Homo sapiens
tggctaacagtctagt

SEQ ID NO: 1284495 - DNA, 14 bp, Homo sapiens
tggctaaccaagag

SEQ ID NO: 1284496 - DNA, 15 bp, Homo sapiens
tggctaataaactgt

SEQ ID NO: 1284497 - DNA, 19 bp, Homo sapiens
tggctaataaactgtatta

SEQ ID NO: 1284498 - DNA, 16 bp, Homo sapiens
tggctaataaggcttt

SEQ ID NO: 1284499 - DNA, 19 bp, Homo sapiens
tggctaatgtactgcatat

SEQ ID NO: 1284500 - DNA, 15 bp, Homo sapiens
tggctaattcccaga

SEQ ID NO: 1284501 - DNA, 22 bp, Homo sapiens
tggctacatcccagcctgtggt

SEQ ID NO: 1284502 - DNA, 15 bp, Homo sapiens
tggctacgcctcttc

SEQ ID NO: 1284503 - DNA, 19 bp, Homo sapiens
tggctagaggccagcccca

SEQ ID NO: 1284504 - DNA, 12 bp, Homo sapiens
tggctagagttt

SEQ ID NO: 1284505 - DNA, 15 bp, Homo sapiens
tggctagagtttcca

SEQ ID NO: 1284506 - DNA, 19 bp, Homo sapiens
tggctagtactgtattggc

SEQ ID NO: 1284507 - DNA, 15 bp, Homo sapiens
tggctagtcaagctc

SEQ ID NO: 1284508 - DNA, 20 bp, Homo sapiens
tggctagtcaagctcctcct

SEQ ID NO: 1284509 - DNA, 16 bp, Homo sapiens
tgggaaagccacctct

SEQ ID NO: 1284510 - DNA, 17 bp, Homo sapiens
tgggaaaggagtagaaa

SEQ ID NO: 1284511 - DNA, 17 bp, Homo sapiens
tgggaaataagagagaa

SEQ ID NO: 1284512 - DNA, 23 bp, Homo sapiens
tgggaaattgaagtgtcttctgt

SEQ ID NO: 1284513 - DNA, 18 bp, Homo sapiens
tgggaacaaattagagga

SEQ ID NO: 1284514 - DNA, 18 bp, Homo sapiens
tgggaacacgtgtgcaca

SEQ ID NO: 1284515 - DNA, 12 bp, Homo sapiens
tgggaacaggcc

SEQ ID NO: 1284516 - DNA, 13 bp, Homo sapiens
tgggaacaggccc

SEQ ID NO: 1284517 - DNA, 19 bp, Homo sapiens
tgggaacatgacccagcct

SEQ ID NO: 1284518 - DNA, 18 bp, Homo sapiens
tgggaaccactcccacca

SEQ ID NO: 1284519 - DNA, 20 bp, Homo sapiens
tgggaaccccttcatcctct

SEQ ID NO: 1284520 - DNA, 14 bp, Homo sapiens
tgggaacctcccag

SEQ ID NO: 1284521 - DNA, 19 bp, Homo sapiens
tgggaacctcccagaggtc

SEQ ID NO: 1284522 - DNA, 21 bp, Homo sapiens
tgggaacctcccagaggtcca

SEQ ID NO: 1284523 - DNA, 16 bp, Homo sapiens
tgggaacgtgactgcc

SEQ ID NO: 1284524 - DNA, 18 bp, Homo sapiens
tgggaacgtgactgcccc

SEQ ID NO: 1284525 - DNA, 19 bp, Homo sapiens
tgggaactccactctcctt

SEQ ID NO: 1284526 - DNA, 14 bp, Homo sapiens
tgggaactgtgcaa

SEQ ID NO: 1284527 - DNA, 14 bp, Homo sapiens
tgggaagaaacaaa

SEQ ID NO: 1284528 - DNA, 23 bp, Homo sapiens
tgggaagaaagaatgcaagagtg

SEQ ID NO: 1284529 - DNA, 18 bp, Homo sapiens
tgggaagaacagaattgc

SEQ ID NO: 1284530 - DNA, 14 bp, Homo sapiens
tgggaagaagcaag

SEQ ID NO: 1284531 - DNA, 13 bp, Homo sapiens
tgggaagacatga

SEQ ID NO: 1284532 - DNA, 19 bp, Homo sapiens
tgggaagacgcctgagctc

SEQ ID NO: 1284533 - DNA, 13 bp, Homo sapiens
tgggaagcaggac

SEQ ID NO: 1284534 - DNA, 21 bp, Homo sapiens
tgggaagctgtactcagagca

SEQ ID NO: 1284535 - DNA, 11 bp, Homo sapiens
tgggaaggaaa

SEQ ID NO: 1284536 - DNA, 22 bp, Homo sapiens
tgggaaggaaacaaatgtgtat

SEQ ID NO: 1284537 - DNA, 17 bp, Homo sapiens
tgggaaggaaaggcaga

SEQ ID NO: 1284538 - DNA, 14 bp, Homo sapiens
tgggaaggacacag

SEQ ID NO: 1284539 - DNA, 15 bp, Homo sapiens
tgggaaggacacagc

SEQ ID NO: 1284540 - DNA, 17 bp, Homo sapiens
tgggaaggacacagcag

SEQ ID NO: 1284541 - DNA, 21 bp, Homo sapiens
tgggaaggacacagcagtatt

SEQ ID NO: 1284542 - DNA, 14 bp, Homo sapiens
tgggaaggagggga

SEQ ID NO: 1284543 - DNA, 15 bp, Homo sapiens
tgggaaggaggggag

SEQ ID NO: 1284544 - DNA, 16 bp, Homo sapiens
tgggaaggccagctgc

SEQ ID NO: 1284545 - DNA, 19 bp, Homo sapiens
tgggaagggagagttcttt

SEQ ID NO: 1284546 - DNA, 15 bp, Homo sapiens
tgggaagggataatt

SEQ ID NO: 1284547 - DNA, 18 bp, Homo sapiens
tgggaagggataatttat

SEQ ID NO: 1284548 - DNA, 20 bp, Homo sapiens
tgggaaggggtcctgcaggg

SEQ ID NO: 1284549 - DNA, 17 bp, Homo sapiens
tgggaagtgtgtttaga

SEQ ID NO: 1284550 - DNA, 16 bp, Homo sapiens
tgggaataattgcttt

SEQ ID NO: 1284551 - DNA, 13 bp, Homo sapiens
tgggaatcaggca

SEQ ID NO: 1284552 - DNA, 20 bp, Homo sapiens
tgggaatgatagcccagaac

SEQ ID NO: 1284553 - DNA, 18 bp, Homo sapiens
tgggaatggaataactat

SEQ ID NO: 1284554 - DNA, 23 bp, Homo sapiens
tgggaatggaggggcagagccag

SEQ ID NO: 1284555 - DNA, 21 bp, Homo sapiens
tgggaatgtattattctgcag

SEQ ID NO: 1284556 - DNA, 13 bp, Homo sapiens
tgggaattgtgtg

SEQ ID NO: 1284557 - DNA, 14 bp, Homo sapiens
tgggaattgtgtgt

SEQ ID NO: 1284558 - DNA, 19 bp, Homo sapiens
tgggaatttgtcagcgttc

SEQ ID NO: 1284559 - DNA, 13 bp, Homo sapiens
tgggacaccaggg

SEQ ID NO: 1284560 - DNA, 15 bp, Homo sapiens
tgggacacctgggag

SEQ ID NO: 1284561 - DNA, 17 bp, Homo sapiens
tgggacacctgggagaa

SEQ ID NO: 1284562 - DNA, 20 bp, Homo sapiens
tgggacactgggcagcaagg

SEQ ID NO: 1284563 - DNA, 19 bp, Homo sapiens
tgggacacttccctgggcc

SEQ ID NO: 1284564 - DNA, 21 bp, Homo sapiens
tgggacagacggaaatgaaat

SEQ ID NO: 1284565 - DNA, 11 bp, Homo sapiens
tgggacagagg

SEQ ID NO: 1284566 - DNA, 15 bp, Homo sapiens
tgggacagccagagc

SEQ ID NO: 1284567 - DNA, 21 bp, Homo sapiens
tgggacagccagagctgggtg

SEQ ID NO: 1284568 - DNA, 14 bp, Homo sapiens
tgggacagcccaga

SEQ ID NO: 1284569 - DNA, 18 bp, Homo sapiens
tgggacagcccagagcct

SEQ ID NO: 1284570 - DNA, 20 bp, Homo sapiens
tgggacagcccagagcctgg

SEQ ID NO: 1284571 - DNA, 12 bp, Homo sapiens
tgggacagggag

SEQ ID NO: 1284572 - DNA, 13 bp, Homo sapiens
tgggacagggagg

SEQ ID NO: 1284573 - DNA, 23 bp, Homo sapiens
tgggacatcaggagactgggctc

SEQ ID NO: 1284574 - DNA, 15 bp, Homo sapiens
tgggaccaaaggggg

SEQ ID NO: 1284575 - DNA, 17 bp, Homo sapiens
tgggaccaaagggggag

SEQ ID NO: 1284576 - DNA, 23 bp, Homo sapiens
tgggaccaaccctggggaaggag

SEQ ID NO: 1284577 - DNA, 13 bp, Homo sapiens
tgggacccagcta

SEQ ID NO: 1284578 - DNA, 18 bp, Homo sapiens
tgggacccagctactctg

SEQ ID NO: 1284579 - DNA, 22 bp, Homo sapiens
tgggacccagctactctgtcca

SEQ ID NO: 1284580 - DNA, 12 bp, Homo sapiens
tgggaccccctc

SEQ ID NO: 1284581 - DNA, 20 bp, Homo sapiens
tgggaccccctcgccagctt

SEQ ID NO: 1284582 - DNA, 22 bp, Homo sapiens
tgggacccctcccaacctcaat

SEQ ID NO: 1284583 - DNA, 13 bp, Homo sapiens
tgggaccctttcc

SEQ ID NO: 1284584 - DNA, 19 bp, Homo sapiens
tgggaccgtgccccacctc

SEQ ID NO: 1284585 - DNA, 20 bp, Homo sapiens
tgggacctagggggacgggg

SEQ ID NO: 1284586 - DNA, 23 bp, Homo sapiens
tgggacctcagttttatcatttt

SEQ ID NO: 1284587 - DNA, 14 bp, Homo sapiens
tgggacctcctccc

SEQ ID NO: 1284588 - DNA, 17 bp, Homo sapiens
tgggacctcctccctca

SEQ ID NO: 1284589 - DNA, 18 bp, Homo sapiens
tgggacctgccaggcagg

SEQ ID NO: 1284590 - DNA, 19 bp, Homo sapiens
tgggacctgccaggcaggg

SEQ ID NO: 1284591 - DNA, 23 bp, Homo sapiens
tgggacctgccaggcaggggtgg

SEQ ID NO: 1284592 - DNA, 22 bp, Homo sapiens
tgggacgatcgcccaggctgga

SEQ ID NO: 1284593 - DNA, 13 bp, Homo sapiens
tgggacggaccag

SEQ ID NO: 1284594 - DNA, 18 bp, Homo sapiens
tgggacggaccagcatct

SEQ ID NO: 1284595 - DNA, 18 bp, Homo sapiens
tgggactcaggtctgtaa

SEQ ID NO: 1284596 - DNA, 15 bp, Homo sapiens
tgggactcccagcag

SEQ ID NO: 1284597 - DNA, 17 bp, Homo sapiens
tgggactcccagcagag

SEQ ID NO: 1284598 - DNA, 20 bp, Homo sapiens
tgggactctcctcctcccct

SEQ ID NO: 1284599 - DNA, 14 bp, Homo sapiens
tgggactgaaaggt

SEQ ID NO: 1284600 - DNA, 14 bp, Homo sapiens
tgggactgagccag

SEQ ID NO: 1284601 - DNA, 20 bp, Homo sapiens
tgggactgagccagtcccag

SEQ ID NO: 1284602 - DNA, 17 bp, Homo sapiens
tgggactgctaaataaa

SEQ ID NO: 1284603 - DNA, 13 bp, Homo sapiens
tgggactggacag

SEQ ID NO: 1284604 - DNA, 18 bp, Homo sapiens
tgggactggagtccctgt

SEQ ID NO: 1284605 - DNA, 20 bp, Homo sapiens
tgggacttccttgctctccc

SEQ ID NO: 1284606 - DNA, 14 bp, Homo sapiens
tgggacttcttacc

SEQ ID NO: 1284607 - DNA, 15 bp, Homo sapiens
tgggacttcttaccc

SEQ ID NO: 1284608 - DNA, 15 bp, Homo sapiens
tgggacttggagagc

SEQ ID NO: 1284609 - DNA, 17 bp, Homo sapiens
tgggacttggagagcaa

SEQ ID NO: 1284610 - DNA, 22 bp, Homo sapiens
tgggacttggagagcaaaggcc

SEQ ID NO: 1284611 - DNA, 13 bp, Homo sapiens
tgggagaaagacc

SEQ ID NO: 1284612 - DNA, 12 bp, Homo sapiens
tgggagaaatca

SEQ ID NO: 1284613 - DNA, 18 bp, Homo sapiens
tgggagaaattgacagat

SEQ ID NO: 1284614 - DNA, 14 bp, Homo sapiens
tgggagaacctcag

SEQ ID NO: 1284615 - DNA, 19 bp, Homo sapiens
tgggagaagtgggggcagc

SEQ ID NO: 1284616 - DNA, 22 bp, Homo sapiens
tgggagacaaaggaggaattta

SEQ ID NO: 1284617 - DNA, 22 bp, Homo sapiens
tgggagacaattagcagaatgg

SEQ ID NO: 1284618 - DNA, 18 bp, Homo sapiens
tgggagacagcagcctgt

SEQ ID NO: 1284619 - DNA, 18 bp, Homo sapiens
tgggagacagtctaggaa

SEQ ID NO: 1284620 - DNA, 13 bp, Homo sapiens
tgggagacatgga

SEQ ID NO: 1284621 - DNA, 20 bp, Homo sapiens
tgggagacctgttggcctgt

SEQ ID NO: 1284622 - DNA, 22 bp, Homo sapiens
tgggagacgaacggaagggttg

SEQ ID NO: 1284623 - DNA, 18 bp, Homo sapiens
tgggagagaagaggactt

SEQ ID NO: 1284624 - DNA, 20 bp, Homo sapiens
tgggagagcaggaatgaaaa

SEQ ID NO: 1284625 - DNA, 13 bp, Homo sapiens
tgggagagccagc

SEQ ID NO: 1284626 - DNA, 15 bp, Homo sapiens
tgggagagcctggca

SEQ ID NO: 1284627 - DNA, 13 bp, Homo sapiens
tgggagaggctgg

SEQ ID NO: 1284628 - DNA, 16 bp, Homo sapiens
tgggagaggctgggag

SEQ ID NO: 1284629 - DNA, 23 bp, Homo sapiens
tgggagagtggtgagtggaaggg

SEQ ID NO: 1284630 - DNA, 14 bp, Homo sapiens
tgggagatgttaga

SEQ ID NO: 1284631 - DNA, 14 bp, Homo sapiens
tgggcatttatatt

SEQ ID NO: 1284632 - DNA, 21 bp, Homo sapiens
tgggcatttcacgaactgttc

SEQ ID NO: 1284633 - DNA, 22 bp, Homo sapiens
tgggcatttcacgaactgttca

SEQ ID NO: 1284634 - DNA, 22 bp, Homo sapiens
tgggcattttcctcctctgcct

SEQ ID NO: 1284635 - DNA, 16 bp, Homo sapiens
tgggccaactcacctg

SEQ ID NO: 1284636 - DNA, 18 bp, Homo sapiens
tgggccacacccaggaag

SEQ ID NO: 1284637 - DNA, 20 bp, Homo sapiens
tgggccacacccaggaaggg

SEQ ID NO: 1284638 - DNA, 18 bp, Homo sapiens
tgggccacacctgagcgc

SEQ ID NO: 1284639 - DNA, 21 bp, Homo sapiens
tgggccaccgcccagctcatg

SEQ ID NO: 1284640 - DNA, 17 bp, Homo sapiens
tgggccaccggggcaag

SEQ ID NO: 1284641 - DNA, 18 bp, Homo sapiens
tgggccacctcctacccc

SEQ ID NO: 1284642 - DNA, 23 bp, Homo sapiens
tgggccacctcctaccccttcct

SEQ ID NO: 1284643 - DNA, 23 bp, Homo sapiens
tgggccactggggactttattta

SEQ ID NO: 1284644 - DNA, 20 bp, Homo sapiens
tgggccagaagtaccagact

SEQ ID NO: 1284645 - DNA, 12 bp, Homo sapiens
tgggccagagct

SEQ ID NO: 1284646 - DNA, 14 bp, Homo sapiens
tgggccagagctga

SEQ ID NO: 1284647 - DNA, 19 bp, Homo sapiens
tgggccagcatagggggga

SEQ ID NO: 1284648 - DNA, 16 bp, Homo sapiens
tgggccagcccctccc

SEQ ID NO: 1284649 - DNA, 20 bp, Homo sapiens
tgggccagcccctcccacca

SEQ ID NO: 1284650 - DNA, 22 bp, Homo sapiens
tgggccagcccctcccaccaca

SEQ ID NO: 1284651 - DNA, 14 bp, Homo sapiens
tgggccaggacagg

SEQ ID NO: 1284652 - DNA, 14 bp, Homo sapiens
tgggccaggcaggc

SEQ ID NO: 1284653 - DNA, 20 bp, Homo sapiens
tgggccagggctgccctgag

SEQ ID NO: 1284654 - DNA, 14 bp, Homo sapiens
tgggccagggtctg

SEQ ID NO: 1284655 - DNA, 17 bp, Homo sapiens
tgggccagtccccgagg

SEQ ID NO: 1284656 - DNA, 16 bp, Homo sapiens
tgggccagtctgtgga

SEQ ID NO: 1284657 - DNA, 20 bp, Homo sapiens
tgggccagtctgtggatcag

SEQ ID NO: 1284658 - DNA, 21 bp, Homo sapiens
tgggccatgaaccaaatggtt

SEQ ID NO: 1284659 - DNA, 21 bp, Homo sapiens
tgggccatggctttcatcctg

SEQ ID NO: 1284660 - DNA, 19 bp, Homo sapiens
tgggccattctccacagca

SEQ ID NO: 1284661 - DNA, 21 bp, Homo sapiens
tgggcccaaaggcccagggag

SEQ ID NO: 1284662 - DNA, 17 bp, Homo sapiens
tgggcccaagaactgca

SEQ ID NO: 1284663 - DNA, 18 bp, Homo sapiens
tgggcccaagaactgcag

SEQ ID NO: 1284664 - DNA, 13 bp, Homo sapiens
tgggcccacagag

SEQ ID NO: 1284665 - DNA, 19 bp, Homo sapiens
tgggcccacagagatgcat

SEQ ID NO: 1284666 - DNA, 14 bp, Homo sapiens
tgggcccacagagc

SEQ ID NO: 1284667 - DNA, 17 bp, Homo sapiens
tgggcccacagagcctg

SEQ ID NO: 1284668 - DNA, 19 bp, Homo sapiens
tgggcccacagagcctggc

SEQ ID NO: 1284669 - DNA, 14 bp, Homo sapiens
tgggcccagaactg

SEQ ID NO: 1284670 - DNA, 21 bp, Homo sapiens
tgggcccagaactgcccccac

SEQ ID NO: 1284671 - DNA, 14 bp, Homo sapiens
tgggcccagcccct

SEQ ID NO: 1284672 - DNA, 13 bp, Homo sapiens
tgggcccagctgg

SEQ ID NO: 1284673 - DNA, 15 bp, Homo sapiens
tgggcccagctgggc

SEQ ID NO: 1284674 - DNA, 17 bp, Homo sapiens
tgggcccagctgggctc

SEQ ID NO: 1284675 - DNA, 20 bp, Homo sapiens
tgggcccagctgggctctgc

SEQ ID NO: 1284676 - DNA, 14 bp, Homo sapiens
tgggcccaggacca

SEQ ID NO: 1284677 - DNA, 20 bp, Homo sapiens
tgggcccaggaccagctggg

SEQ ID NO: 1284678 - DNA, 16 bp, Homo sapiens
tgggcccaggcaggtc

SEQ ID NO: 1284679 - DNA, 18 bp, Homo sapiens
tgggcccaggcaggtctg

SEQ ID NO: 1284680 - DNA, 15 bp, Homo sapiens
tgggcccaggcctca

SEQ ID NO: 1284681 - DNA, 17 bp, Homo sapiens
tgggcccatctccctgc

SEQ ID NO: 1284682 - DNA, 14 bp, Homo sapiens
tgggccccacctac

SEQ ID NO: 1284683 - DNA, 13 bp, Homo sapiens
tgggccccactgg

SEQ ID NO: 1284684 - DNA, 16 bp, Homo sapiens
tgggccccactggaca

SEQ ID NO: 1284685 - DNA, 17 bp, Homo sapiens
tgggccccactggacaa

SEQ ID NO: 1284686 - DNA, 22 bp, Homo sapiens
tgggccccagaccccagggcag

SEQ ID NO: 1284687 - DNA, 19 bp, Homo sapiens
tgggccccatgctctgccc

SEQ ID NO: 1284688 - DNA, 21 bp, Homo sapiens
tgggccccatgctctgcccca

SEQ ID NO: 1284689 - DNA, 17 bp, Homo sapiens
tgggcccccagcctggc

SEQ ID NO: 1284690 - DNA, 16 bp, Homo sapiens
tgggcccctcagagcc

SEQ ID NO: 1284691 - DNA, 14 bp, Homo sapiens
tgggcccctcccct

SEQ ID NO: 1284692 - DNA, 15 bp, Homo sapiens
tgggcccctcccctc

SEQ ID NO: 1284693 - DNA, 16 bp, Homo sapiens
tgggcccctcccctca

SEQ ID NO: 1284694 - DNA, 14 bp, Homo sapiens
tgggcccctggccc

SEQ ID NO: 1284695 - DNA, 15 bp, Homo sapiens
tgggcccctggcccc

SEQ ID NO: 1284696 - DNA, 15 bp, Homo sapiens
tgggcccgctgcctc

SEQ ID NO: 1284697 - DNA, 16 bp, Homo sapiens
tgggcccgctgcctct

SEQ ID NO: 1284698 - DNA, 11 bp, Homo sapiens
tgggccctcct

SEQ ID NO: 1284699 - DNA, 16 bp, Homo sapiens
tgggccctctctctgg

SEQ ID NO: 1284700 - DNA, 13 bp, Homo sapiens
tgggccctctctg

SEQ ID NO: 1284701 - DNA, 13 bp, Homo sapiens
tgggccctctctt

SEQ ID NO: 1284702 - DNA, 18 bp, Homo sapiens
tgggccctgcccggggag

SEQ ID NO: 1284703 - DNA, 14 bp, Homo sapiens
tgggccgaaagaga

SEQ ID NO: 1284704 - DNA, 17 bp, Homo sapiens
tgggccgcaagggcctg

SEQ ID NO: 1284705 - DNA, 19 bp, Homo sapiens
tgggccgcaagggcctgga

SEQ ID NO: 1284706 - DNA, 17 bp, Homo sapiens
tgggccgggaggcagtg

SEQ ID NO: 1284707 - DNA, 19 bp, Homo sapiens
tgggccgggcctggggctc

SEQ ID NO: 1284708 - DNA, 15 bp, Homo sapiens
tgggccgggctgtag

SEQ ID NO: 1284709 - DNA, 14 bp, Homo sapiens
tgggccgtatctgt

SEQ ID NO: 1284710 - DNA, 17 bp, Homo sapiens
tgggccgtatctgtcac

SEQ ID NO: 1284711 - DNA, 18 bp, Homo sapiens
tgggccgtatctgtcaca

SEQ ID NO: 1284712 - DNA, 15 bp, Homo sapiens
tgggccgtcccctct

SEQ ID NO: 1284713 - DNA, 17 bp, Homo sapiens
tgggccgtggcacagct

SEQ ID NO: 1284714 - DNA, 22 bp, Homo sapiens
tgggcctcagtgtgcccatctg

SEQ ID NO: 1284715 - DNA, 15 bp, Homo sapiens
tgggcctccatgccc

SEQ ID NO: 1284716 - DNA, 14 bp, Homo sapiens
tgggcctcccctgg

SEQ ID NO: 1284717 - DNA, 18 bp, Homo sapiens
tgggcctcctctgtccag

SEQ ID NO: 1284718 - DNA, 17 bp, Homo sapiens
tgggcctctcctgccct

SEQ ID NO: 1284719 - DNA, 21 bp, Homo sapiens
tgggcctctctgggggaggca

SEQ ID NO: 1284720 - DNA, 19 bp, Homo sapiens
tgggcctctttttgccctt

SEQ ID NO: 1284721 - DNA, 19 bp, Homo sapiens
tgggcctgactgttgcccc

SEQ ID NO: 1284722 - DNA, 22 bp, Homo sapiens
tgggcctgactgttgcccccca

SEQ ID NO: 1284723 - DNA, 11 bp, Homo sapiens
tgggcctgcct

SEQ ID NO: 1284724 - DNA, 13 bp, Homo sapiens
tgggcctgcctgc

SEQ ID NO: 1284725 - DNA, 15 bp, Homo sapiens
tgggcctgcctgcct

SEQ ID NO: 1284726 - DNA, 16 bp, Homo sapiens
tgggcctgcctgcctc

SEQ ID NO: 1284727 - DNA, 17 bp, Homo sapiens
tgggcctgcctgcctcc

SEQ ID NO: 1284728 - DNA, 15 bp, Homo sapiens
tgggcctgctgaggc

SEQ ID NO: 1284729 - DNA, 12 bp, Homo sapiens
tgggcctgctgc

SEQ ID NO: 1284730 - DNA, 13 bp, Homo sapiens
tgggcctgctgcg

SEQ ID NO: 1284731 - DNA, 18 bp, Homo sapiens
tgggcctgcttttccagg

SEQ ID NO: 1284732 - DNA, 17 bp, Homo sapiens
tgggcctggagccctgg

SEQ ID NO: 1284733 - DNA, 15 bp, Homo sapiens
tgggcctggcctgag

SEQ ID NO: 1284734 - DNA, 13 bp, Homo sapiens
tgggcctgggcct

SEQ ID NO: 1284735 - DNA, 15 bp, Homo sapiens
tgggcctgggcctgc

SEQ ID NO: 1284736 - DNA, 13 bp, Homo sapiens
tgggcctgtatga

SEQ ID NO: 1284737 - DNA, 18 bp, Homo sapiens
tgggcctgtatgagacag

SEQ ID NO: 1284738 - DNA, 14 bp, Homo sapiens
tgggcctgtccccc

SEQ ID NO: 1284739 - DNA, 15 bp, Homo sapiens
tgggcctgtgcactg

SEQ ID NO: 1284740 - DNA, 23 bp, Homo sapiens
tgggcctgtgcagcagcccagct

SEQ ID NO: 1284741 - DNA, 13 bp, Homo sapiens
tgggcctgtgtgt

SEQ ID NO: 1284742 - DNA, 16 bp, Homo sapiens
tgggccttagtgggcc

SEQ ID NO: 1284743 - DNA, 23 bp, Homo sapiens
tgggccttagtgggccagggctg

SEQ ID NO: 1284744 - DNA, 13 bp, Homo sapiens
tgggccttgctac

SEQ ID NO: 1284745 - DNA, 16 bp, Homo sapiens
tgggccttgctttggg

SEQ ID NO: 1284746 - DNA, 18 bp, Homo sapiens
tgggccttgctttgggct

SEQ ID NO: 1284747 - DNA, 18 bp, Homo sapiens
tgggccttggctgggcct

SEQ ID NO: 1284748 - DNA, 17 bp, Homo sapiens
tgggccttgtgacaatc

SEQ ID NO: 1284749 - DNA, 13 bp, Homo sapiens
tgggcctttcctg

SEQ ID NO: 1284750 - DNA, 15 bp, Homo sapiens
tgggcctttcctgtg

SEQ ID NO: 1284751 - DNA, 19 bp, Homo sapiens
tgggcctttcctgtgccaa

SEQ ID NO: 1284752 - DNA, 13 bp, Homo sapiens
tgggcgcaggccc

SEQ ID NO: 1284753 - DNA, 20 bp, Homo sapiens
tgggcgcccccccctcccca

SEQ ID NO: 1284754 - DNA, 11 bp, Homo sapiens
tggggtgacag

SEQ ID NO: 1284755 - DNA, 12 bp, Homo sapiens
tggggtgacagt

SEQ ID NO: 1284756 - DNA, 21 bp, Homo sapiens
tggggtgacttccctggtcac

SEQ ID NO: 1284757 - DNA, 14 bp, Homo sapiens
tggggtgaggacca

SEQ ID NO: 1284758 - DNA, 17 bp, Homo sapiens
tggggtgataaggggcc

SEQ ID NO: 1284759 - DNA, 17 bp, Homo sapiens
tggggtgatggccagag

SEQ ID NO: 1284760 - DNA, 18 bp, Homo sapiens
tggggtgatggccagagg

SEQ ID NO: 1284761 - DNA, 22 bp, Homo sapiens
tggggtgcactcgccatttcct

SEQ ID NO: 1284762 - DNA, 15 bp, Homo sapiens
tggggtgcatcctcc

SEQ ID NO: 1284763 - DNA, 14 bp, Homo sapiens
tggggtgctgccct

SEQ ID NO: 1284764 - DNA, 19 bp, Homo sapiens
tggggtggagcactggact

SEQ ID NO: 1284765 - DNA, 20 bp, Homo sapiens
tggggtggagcactggactc

SEQ ID NO: 1284766 - DNA, 12 bp, Homo sapiens
tggggtggccag

SEQ ID NO: 1284767 - DNA, 13 bp, Homo sapiens
tggggtggccagg

SEQ ID NO: 1284768 - DNA, 14 bp, Homo sapiens
tggggtggccaggg

SEQ ID NO: 1284769 - DNA, 18 bp, Homo sapiens
tggggtggccagggcttc

SEQ ID NO: 1284770 - DNA, 14 bp, Homo sapiens
tggggtgggacagg

SEQ ID NO: 1284771 - DNA, 17 bp, Homo sapiens
tggggtgggagactttc

SEQ ID NO: 1284772 - DNA, 23 bp, Homo sapiens
tggggtgggagggcgtcaggcag

SEQ ID NO: 1284773 - DNA, 22 bp, Homo sapiens
tggggtgggagtaacagggcag

SEQ ID NO: 1284774 - DNA, 14 bp, Homo sapiens
tggggtgggctgga

SEQ ID NO: 1284775 - DNA, 15 bp, Homo sapiens
tggggtgggctggag

SEQ ID NO: 1284776 - DNA, 19 bp, Homo sapiens
tggggtgggggccaggcct

SEQ ID NO: 1284777 - DNA, 20 bp, Homo sapiens
tggggtgggggtgggcagca

SEQ ID NO: 1284778 - DNA, 13 bp, Homo sapiens
tggggtgtgctgg

SEQ ID NO: 1284779 - DNA, 15 bp, Homo sapiens
tggggtgtgctggga

SEQ ID NO: 1284780 - DNA, 15 bp, Homo sapiens
tggggttatgtgagg

SEQ ID NO: 1284781 - DNA, 18 bp, Homo sapiens
tggggttcataggggcag

SEQ ID NO: 1284782 - DNA, 11 bp, Homo sapiens
tggggttcctg

SEQ ID NO: 1284783 - DNA, 13 bp, Homo sapiens
tggggttcctgct

SEQ ID NO: 1284784 - DNA, 15 bp, Homo sapiens
tggggttcctgctgt

SEQ ID NO: 1284785 - DNA, 15 bp, Homo sapiens
tggggttctctacag

SEQ ID NO: 1284786 - DNA, 23 bp, Homo sapiens
tggggttgcgtctgaggcctgcc

SEQ ID NO: 1284787 - DNA, 21 bp, Homo sapiens
tggggttggctgggcccagaa

SEQ ID NO: 1284788 - DNA, 19 bp, Homo sapiens
tggggtttatcagaattct

SEQ ID NO: 1284789 - DNA, 16 bp, Homo sapiens
tggggtttcaccatgt

SEQ ID NO: 1284790 - DNA, 16 bp, Homo sapiens
tggggtttgaagctga

SEQ ID NO: 1284791 - DNA, 20 bp, Homo sapiens
tggggtttttattattttta

SEQ ID NO: 1284792 - DNA, 20 bp, Homo sapiens
tggggttttttttttctgaa

SEQ ID NO: 1284793 - DNA, 15 bp, Homo sapiens
tgggtaaaatacttt

SEQ ID NO: 1284794 - DNA, 16 bp, Homo sapiens
tgggtaaaatactttt

SEQ ID NO: 1284795 - DNA, 16 bp, Homo sapiens
tgggtaaagggacagt

SEQ ID NO: 1284796 - DNA, 20 bp, Homo sapiens
tgggtaaagggacagttaca

SEQ ID NO: 1284797 - DNA, 22 bp, Homo sapiens
tgggtaagaaagccaccttgtt

SEQ ID NO: 1284798 - DNA, 22 bp, Homo sapiens
tgggtaatccaggcacagctga

SEQ ID NO: 1284799 - DNA, 13 bp, Homo sapiens
tgggtacatcaag

SEQ ID NO: 1284800 - DNA, 14 bp, Homo sapiens
tgggtagaaaaatt

SEQ ID NO: 1284801 - DNA, 22 bp, Homo sapiens
tgggtagaaaaattattagaac

SEQ ID NO: 1284802 - DNA, 23 bp, Homo sapiens
tgggtaggaaagaggaagcaaat

SEQ ID NO: 1284803 - DNA, 14 bp, Homo sapiens
tgggtaggagccct

SEQ ID NO: 1284804 - DNA, 15 bp, Homo sapiens
tgggtagggcagaca

SEQ ID NO: 1284805 - DNA, 18 bp, Homo sapiens
tgggtagggtaaatcagt

SEQ ID NO: 1284806 - DNA, 13 bp, Homo sapiens
tgggtatcccctg

SEQ ID NO: 1284807 - DNA, 19 bp, Homo sapiens
tgggtatcctgcccagtgt

SEQ ID NO: 1284808 - DNA, 16 bp, Homo sapiens
tgggtatgttcctaag

SEQ ID NO: 1284809 - DNA, 14 bp, Homo sapiens
tgggtattgtaatc

SEQ ID NO: 1284810 - DNA, 15 bp, Homo sapiens
tgggtcaaaagagcc

SEQ ID NO: 1284811 - DNA, 18 bp, Homo sapiens
tgggtcaaaagagccctg

SEQ ID NO: 1284812 - DNA, 19 bp, Homo sapiens
tgggtcaaaagagccctgg

SEQ ID NO: 1284813 - DNA, 23 bp, Homo sapiens
tgggtcaaaagagccctggctct

SEQ ID NO: 1284814 - DNA, 24 bp, Homo sapiens
tgggtcaaaagagccctggctctg

SEQ ID NO: 1284815 - DNA, 23 bp, Homo sapiens
tgggtcaaagtggtacaggaagg

SEQ ID NO: 1284816 - DNA, 21 bp, Homo sapiens
tgggtcaacctttgtgtggct

SEQ ID NO: 1284817 - DNA, 14 bp, Homo sapiens
tgggtcaaggacag

SEQ ID NO: 1284818 - DNA, 15 bp, Homo sapiens
tgggtcaaggacagg

SEQ ID NO: 1284819 - DNA, 16 bp, Homo sapiens
tgggtcaaggacaggg

SEQ ID NO: 1284820 - DNA, 22 bp, Homo sapiens
tgggtcaaggacagggctgagc

SEQ ID NO: 1284821 - DNA, 15 bp, Homo sapiens
tgggtccaagagaca

SEQ ID NO: 1284822 - DNA, 14 bp, Homo sapiens
tgggtccaagtggc

SEQ ID NO: 1284823 - DNA, 15 bp, Homo sapiens
tgggtccaccatgca

SEQ ID NO: 1284824 - DNA, 16 bp, Homo sapiens
tgggtccaccatgcag

SEQ ID NO: 1284825 - DNA, 20 bp, Homo sapiens
tgggtccaggcctggccatg

SEQ ID NO: 1284826 - DNA, 16 bp, Homo sapiens
tgggtccattcagatg

SEQ ID NO: 1284827 - DNA, 18 bp, Homo sapiens
tgggtccccctcagcaag

SEQ ID NO: 1284828 - DNA, 22 bp, Homo sapiens
tgggtccgccttaatctggaag

SEQ ID NO: 1284829 - DNA, 15 bp, Homo sapiens
tgggtcctagccctt

SEQ ID NO: 1284830 - DNA, 17 bp, Homo sapiens
tgggtcctagcccttcc

SEQ ID NO: 1284831 - DNA, 19 bp, Homo sapiens
tgggtcctagcccttccct

SEQ ID NO: 1284832 - DNA, 11 bp, Homo sapiens
tgggtcctggg

SEQ ID NO: 1284833 - DNA, 18 bp, Homo sapiens
tgggtcggccctgcccaa

SEQ ID NO: 1284834 - DNA, 18 bp, Homo sapiens
tgggtctcaccggctctc

SEQ ID NO: 1284835 - DNA, 23 bp, Homo sapiens
tgggtctcaccggctctcacctg

SEQ ID NO: 1284836 - DNA, 19 bp, Homo sapiens
tgggtctcagctgctgaca

SEQ ID NO: 1284837 - DNA, 20 bp, Homo sapiens
tgggtctcgctttgttgccc

SEQ ID NO: 1284838 - DNA, 14 bp, Homo sapiens
tgggtctctgaagg

SEQ ID NO: 1284839 - DNA, 12 bp, Homo sapiens
tgggtctctgga

SEQ ID NO: 1284840 - DNA, 13 bp, Homo sapiens
tgggtctctgggg

SEQ ID NO: 1284841 - DNA, 12 bp, Homo sapiens
tgggtctgagct

SEQ ID NO: 1284842 - DNA, 19 bp, Homo sapiens
tgggtctgatattaatcaa

SEQ ID NO: 1284843 - DNA, 15 bp, Homo sapiens
tgggtctggctgagc

SEQ ID NO: 1284844 - DNA, 21 bp, Homo sapiens
tgggtctgggagtcacacagt

SEQ ID NO: 1284845 - DNA, 23 bp, Homo sapiens
tgggtctgggatatggctgccca

SEQ ID NO: 1284846 - DNA, 14 bp, Homo sapiens
tgggtctgtgtctc

SEQ ID NO: 1284847 - DNA, 20 bp, Homo sapiens
tgggtctgtgtctcttttct

SEQ ID NO: 1284848 - DNA, 17 bp, Homo sapiens
tgggtgacacctccgag

SEQ ID NO: 1284849 - DNA, 17 bp, Homo sapiens
tgggtgacagagcaaga

SEQ ID NO: 1284850 - DNA, 13 bp, Homo sapiens
tgggtgacggtcc

SEQ ID NO: 1284851 - DNA, 23 bp, Homo sapiens
tgggtgacggtcctttaggcagc

SEQ ID NO: 1284852 - DNA, 12 bp, Homo sapiens
tgggtgagagag

SEQ ID NO: 1284853 - DNA, 20 bp, Homo sapiens
tgggtgatgcttttgctgct

SEQ ID NO: 1284854 - DNA, 23 bp, Homo sapiens
tgggtgatgcttttgctgctgct

SEQ ID NO: 1284855 - DNA, 14 bp, Homo sapiens
tgggtgcagaccct

SEQ ID NO: 1284856 - DNA, 21 bp, Homo sapiens
tgggtgcagctgggcttggcc

SEQ ID NO: 1284857 - DNA, 22 bp, Homo sapiens
tgggtgcagctgggcttggcct

SEQ ID NO: 1284858 - DNA, 23 bp, Homo sapiens
tgggtgccccccttgccagacat

SEQ ID NO: 1284859 - DNA, 12 bp, Homo sapiens
tgggtgccctga

SEQ ID NO: 1284860 - DNA, 15 bp, Homo sapiens
tgggtgcctcctgca

SEQ ID NO: 1284861 - DNA, 17 bp, Homo sapiens
tgggtgcctcctgcagt

SEQ ID NO: 1284862 - DNA, 18 bp, Homo sapiens
tgggtgcctgcagcgcct

SEQ ID NO: 1284863 - DNA, 14 bp, Homo sapiens
tgggtgctcagaat

SEQ ID NO: 1284864 - DNA, 14 bp, Homo sapiens
tgggtgctgataat

SEQ ID NO: 1284865 - DNA, 15 bp, Homo sapiens
tgggtgctgccatga

SEQ ID NO: 1284866 - DNA, 16 bp, Homo sapiens
tgggtgctgccctgtg

SEQ ID NO: 1284867 - DNA, 17 bp, Homo sapiens
tgggtggcaccagcagc

SEQ ID NO: 1284868 - DNA, 21 bp, Homo sapiens
tgggtggcaccagcagcctgg

SEQ ID NO: 1284869 - DNA, 23 bp, Homo sapiens
tgggtggctcactactgaacaca

SEQ ID NO: 1284870 - DNA, 15 bp, Homo sapiens
tgggtggctttcaag

SEQ ID NO: 1284871 - DNA, 16 bp, Homo sapiens
tgggtgggcagggagg

SEQ ID NO: 1284872 - DNA, 17 bp, Homo sapiens
tgggtgggcagggaggg

SEQ ID NO: 1284873 - DNA, 21 bp, Homo sapiens
tgggtgggcagggaggggctg

SEQ ID NO: 1284874 - DNA, 14 bp, Homo sapiens
tgggtgggcctgac

SEQ ID NO: 1284875 - DNA, 15 bp, Homo sapiens
tgggtgggctctgtg

SEQ ID NO: 1284876 - DNA, 15 bp, Homo sapiens
tggtctgtgaagagc

SEQ ID NO: 1284877 - DNA, 14 bp, Homo sapiens
tggtctgttggcag

SEQ ID NO: 1284878 - DNA, 18 bp, Homo sapiens
tggtctgttggcaggctg

SEQ ID NO: 1284879 - DNA, 20 bp, Homo sapiens
tggtctgttttggtcccctc

SEQ ID NO: 1284880 - DNA, 16 bp, Homo sapiens
tggtcttcagcctccc

SEQ ID NO: 1284881 - DNA, 21 bp, Homo sapiens
tggtcttcagcctccctcagc

SEQ ID NO: 1284882 - DNA, 20 bp, Homo sapiens
tggtcttgtttccaggagca

SEQ ID NO: 1284883 - DNA, 15 bp, Homo sapiens
tggtctttcattgct

SEQ ID NO: 1284884 - DNA, 22 bp, Homo sapiens
tggtctttcctatcatggagtg

SEQ ID NO: 1284885 - DNA, 14 bp, Homo sapiens
tggtctttcctctg

SEQ ID NO: 1284886 - DNA, 15 bp, Homo sapiens
tggtctttctggaga

SEQ ID NO: 1284887 - DNA, 17 bp, Homo sapiens
tggtctttctggagagg

SEQ ID NO: 1284888 - DNA, 15 bp, Homo sapiens
tggtgaaaatgtact

SEQ ID NO: 1284889 - DNA, 18 bp, Homo sapiens
tggtgaaagggtttgata

SEQ ID NO: 1284890 - DNA, 17 bp, Homo sapiens
tggtgaaataataaaat

SEQ ID NO: 1284891 - DNA, 21 bp, Homo sapiens
tggtgaactgagctgggcagg

SEQ ID NO: 1284892 - DNA, 21 bp, Homo sapiens
tggtgaagtaacatgcatact

SEQ ID NO: 1284893 - DNA, 15 bp, Homo sapiens
tggtgaagtgtggct

SEQ ID NO: 1284894 - DNA, 18 bp, Homo sapiens
tggtgaagtgtggctggt

SEQ ID NO: 1284895 - DNA, 17 bp, Homo sapiens
tggtgacaaaattcatt

SEQ ID NO: 1284896 - DNA, 20 bp, Homo sapiens
tggtgacaaaattcatttgc

SEQ ID NO: 1284897 - DNA, 19 bp, Homo sapiens
tggtgacaggccaaaggcc

SEQ ID NO: 1284898 - DNA, 21 bp, Homo sapiens
tggtgaccaaaatttttaggt

SEQ ID NO: 1284899 - DNA, 18 bp, Homo sapiens
tggtgaccaccccctgtt

SEQ ID NO: 1284900 - DNA, 14 bp, Homo sapiens
tggtgacctcctgt

SEQ ID NO: 1284901 - DNA, 15 bp, Homo sapiens
tggtgacctgggtat

SEQ ID NO: 1284902 - DNA, 15 bp, Homo sapiens
tggtgactgtcccac

SEQ ID NO: 1284903 - DNA, 22 bp, Homo sapiens
tggtgagaccccgcactgcaga

SEQ ID NO: 1284904 - DNA, 19 bp, Homo sapiens
tggtgagagtcaaagctga

SEQ ID NO: 1284905 - DNA, 13 bp, Homo sapiens
tggtgagctggga

SEQ ID NO: 1284906 - DNA, 21 bp, Homo sapiens
tggtgagctgggaagctgtac

SEQ ID NO: 1284907 - DNA, 19 bp, Homo sapiens
tggtgaggcccagcctgtc

SEQ ID NO: 1284908 - DNA, 23 bp, Homo sapiens
tggtgaggcccagcctgtcctgg

SEQ ID NO: 1284909 - DNA, 15 bp, Homo sapiens
tggtgaggtggccca

SEQ ID NO: 1284910 - DNA, 19 bp, Homo sapiens
tggtgagtggaagggagga

SEQ ID NO: 1284911 - DNA, 15 bp, Homo sapiens
tggtgatcctctatt

SEQ ID NO: 1284912 - DNA, 18 bp, Homo sapiens
tggtgatcctctattttg

SEQ ID NO: 1284913 - DNA, 21 bp, Homo sapiens
tggtgatcctctattttgtga

SEQ ID NO: 1284914 - DNA, 13 bp, Homo sapiens
tggtgatgactta

SEQ ID NO: 1284915 - DNA, 20 bp, Homo sapiens
tggtgatgtaaaaatgcttc

SEQ ID NO: 1284916 - DNA, 16 bp, Homo sapiens
tggtgcaaaaaaaaac

SEQ ID NO: 1284917 - DNA, 11 bp, Homo sapiens
tggtgcaaaga

SEQ ID NO: 1284918 - DNA, 14 bp, Homo sapiens
tggtgcaaatccta

SEQ ID NO: 1284919 - DNA, 17 bp, Homo sapiens
tggtgcaaattcagaac

SEQ ID NO: 1284920 - DNA, 18 bp, Homo sapiens
tggtgcaaattcagaact

SEQ ID NO: 1284921 - DNA, 16 bp, Homo sapiens
tggtgcaagttgagga

SEQ ID NO: 1284922 - DNA, 21 bp, Homo sapiens
tggtgcaattacagcaaaaag

SEQ ID NO: 1284923 - DNA, 17 bp, Homo sapiens
tggtgcacagattgctg

SEQ ID NO: 1284924 - DNA, 15 bp, Homo sapiens
tggtgcagtgtgaaa

SEQ ID NO: 1284925 - DNA, 22 bp, Homo sapiens
tggtgccaaatagccccagact

SEQ ID NO: 1284926 - DNA, 23 bp, Homo sapiens
tggtgccaaatagccccagactg

SEQ ID NO: 1284927 - DNA, 23 bp, Homo sapiens
tggtgccacttcttaaaggcctg

SEQ ID NO: 1284928 - DNA, 23 bp, Homo sapiens
tggtgccccccacccctggaaga

SEQ ID NO: 1284929 - DNA, 17 bp, Homo sapiens
tggtgcccgtgcccgca

SEQ ID NO: 1284930 - DNA, 18 bp, Homo sapiens
tggtgccctggaacactc

SEQ ID NO: 1284931 - DNA, 14 bp, Homo sapiens
tggtgcctctgtgc

SEQ ID NO: 1284932 - DNA, 18 bp, Homo sapiens
tggtgcctctgtgcacag

SEQ ID NO: 1284933 - DNA, 17 bp, Homo sapiens
tggtgcctgagaggcag

SEQ ID NO: 1284934 - DNA, 20 bp, Homo sapiens
tggtgcctgagaggcaggca

SEQ ID NO: 1284935 - DNA, 14 bp, Homo sapiens
tggtgccttttgtg

SEQ ID NO: 1284936 - DNA, 22 bp, Homo sapiens
tggtgctataggctggagaagc

SEQ ID NO: 1284937 - DNA, 13 bp, Homo sapiens
tggtgctatttga

SEQ ID NO: 1284938 - DNA, 18 bp, Homo sapiens
tggtgctatttgaagaaa

SEQ ID NO: 1284939 - DNA, 20 bp, Homo sapiens
tggtgctatttgaagaaaaa

SEQ ID NO: 1284940 - DNA, 15 bp, Homo sapiens
tggtgctcctgccca

SEQ ID NO: 1284941 - DNA, 13 bp, Homo sapiens
tggtgctctgtgt

SEQ ID NO: 1284942 - DNA, 16 bp, Homo sapiens
tggtgctcttgctttt

SEQ ID NO: 1284943 - DNA, 17 bp, Homo sapiens
tggtgctggatattttc

SEQ ID NO: 1284944 - DNA, 15 bp, Homo sapiens
tggtgctgggactga

SEQ ID NO: 1284945 - DNA, 16 bp, Homo sapiens
tggtgctgggactgag

SEQ ID NO: 1284946 - DNA, 13 bp, Homo sapiens
tggtgctgtggcc

SEQ ID NO: 1284947 - DNA, 20 bp, Homo sapiens
tggtgctgtggccagggtga

SEQ ID NO: 1284948 - DNA, 13 bp, Homo sapiens
tggtgctgtttaa

SEQ ID NO: 1284949 - DNA, 21 bp, Homo sapiens
tggtgctgtttaaagtcacat

SEQ ID NO: 1284950 - DNA, 12 bp, Homo sapiens
tggtgcttccca

SEQ ID NO: 1284951 - DNA, 17 bp, Homo sapiens
tggtggacagtcctggg

SEQ ID NO: 1284952 - DNA, 15 bp, Homo sapiens
tggtggagcagccag

SEQ ID NO: 1284953 - DNA, 17 bp, Homo sapiens
tggtggagcagccagag

SEQ ID NO: 1284954 - DNA, 18 bp, Homo sapiens
tggtggagcagccagagc

SEQ ID NO: 1284955 - DNA, 13 bp, Homo sapiens
tggtggagccagg

SEQ ID NO: 1284956 - DNA, 14 bp, Homo sapiens
tggtggagccaggg

SEQ ID NO: 1284957 - DNA, 18 bp, Homo sapiens
tggtggagccagggcctc

SEQ ID NO: 1284958 - DNA, 18 bp, Homo sapiens
tggtggaggagctgaggg

SEQ ID NO: 1284959 - DNA, 20 bp, Homo sapiens
tggtggaggagctgagggag

SEQ ID NO: 1284960 - DNA, 14 bp, Homo sapiens
tggtggagggcact

SEQ ID NO: 1284961 - DNA, 20 bp, Homo sapiens
tggtggagggcacttcaggt

SEQ ID NO: 1284962 - DNA, 13 bp, Homo sapiens
tggtggagtgaga

SEQ ID NO: 1284963 - DNA, 20 bp, Homo sapiens
tggtggagtgagagcctttg

SEQ ID NO: 1284964 - DNA, 12 bp, Homo sapiens
tggtggatgtga

SEQ ID NO: 1284965 - DNA, 16 bp, Homo sapiens
tggtggcacaggcact

SEQ ID NO: 1284966 - DNA, 16 bp, Homo sapiens
tggtggcactgagccc

SEQ ID NO: 1284967 - DNA, 17 bp, Homo sapiens
tggtggcactgagcccc

SEQ ID NO: 1284968 - DNA, 19 bp, Homo sapiens
tggtggcagattttacaaa

SEQ ID NO: 1284969 - DNA, 19 bp, Homo sapiens
tggtggcagtggaggtggg

SEQ ID NO: 1284970 - DNA, 21 bp, Homo sapiens
tggtggcccgacagcctggca

SEQ ID NO: 1284971 - DNA, 21 bp, Homo sapiens
tggtggccctgtgcctgggcc

SEQ ID NO: 1284972 - DNA, 17 bp, Homo sapiens
tggtggccgtcacgctt

SEQ ID NO: 1284973 - DNA, 22 bp, Homo sapiens
tggtggccgtcacgctttcatg

SEQ ID NO: 1284974 - DNA, 11 bp, Homo sapiens
tggtggcctca

SEQ ID NO: 1284975 - DNA, 22 bp, Homo sapiens
tggtggcgctttctcctgtgcc

SEQ ID NO: 1284976 - DNA, 14 bp, Homo sapiens
tggtggctcatgcc

SEQ ID NO: 1284977 - DNA, 20 bp, Homo sapiens
tggtggctccccctctgctt

SEQ ID NO: 1284978 - DNA, 19 bp, Homo sapiens
tggtggcttaagtgagcag

SEQ ID NO: 1284979 - DNA, 22 bp, Homo sapiens
tggtggcttaagtgagcagaac

SEQ ID NO: 1284980 - DNA, 19 bp, Homo sapiens
tggtgggacactgggcagc

SEQ ID NO: 1284981 - DNA, 23 bp, Homo sapiens
tggtgggagacgaacggaagggt

SEQ ID NO: 1284982 - DNA, 12 bp, Homo sapiens
tggtgggctggc

SEQ ID NO: 1284983 - DNA, 18 bp, Homo sapiens
tggtgggctggcccagcc

SEQ ID NO: 1284984 - DNA, 13 bp, Homo sapiens
tggtgggcttctg

SEQ ID NO: 1284985 - DNA, 23 bp, Homo sapiens
tggtggggaggggcgctggccca

SEQ ID NO: 1284986 - DNA, 16 bp, Homo sapiens
tggtggggatattttt

SEQ ID NO: 1284987 - DNA, 23 bp, Homo sapiens
tggtgggggaggagcctctggct

SEQ ID NO: 1284988 - DNA, 20 bp, Homo sapiens
tggtgggggttctggcagga

SEQ ID NO: 1284989 - DNA, 16 bp, Homo sapiens
tggtgggtccatgggc

SEQ ID NO: 1284990 - DNA, 18 bp, Homo sapiens
tggtgggtccatgggcag

SEQ ID NO: 1284991 - DNA, 14 bp, Homo sapiens
tggtgggtctgagc

SEQ ID NO: 1284992 - DNA, 18 bp, Homo sapiens
tggtgggtctgagctgga

SEQ ID NO: 1284993 - DNA, 15 bp, Homo sapiens
tggtgggttagctaa

SEQ ID NO: 1284994 - DNA, 18 bp, Homo sapiens
tggtggtactttattctt

SEQ ID NO: 1284995 - DNA, 15 bp, Homo sapiens
tggtggtattctgtc

SEQ ID NO: 1284996 - DNA, 16 bp, Homo sapiens
tggtggtattttcaat

SEQ ID NO: 1284997 - DNA, 13 bp, Homo sapiens
tggtggtattttt

SEQ ID NO: 1284998 - DNA, 21 bp, Homo sapiens
tgtaagtaattgcatttctgc

SEQ ID NO: 1284999 - DNA, 22 bp, Homo sapiens
tgtaagtcatctacttaataaa

SEQ ID NO: 1285000 - DNA, 17 bp, Homo sapiens
tgtaagtgtgagtaaga

SEQ ID NO: 1285001 - DNA, 14 bp, Homo sapiens
tgtaagttcacaac

SEQ ID NO: 1285002 - DNA, 20 bp, Homo sapiens
tgtaagtttacctatgtaac

SEQ ID NO: 1285003 - DNA, 22 bp, Homo sapiens
tgtaagtttattttttctacac

SEQ ID NO: 1285004 - DNA, 16 bp, Homo sapiens
tgtaataaagtatata

SEQ ID NO: 1285005 - DNA, 23 bp, Homo sapiens
tgtaataaatctaggatgtgatg

SEQ ID NO: 1285006 - DNA, 15 bp, Homo sapiens
tgtaataaattcaaa

SEQ ID NO: 1285007 - DNA, 18 bp, Homo sapiens
tgtaataactttcttacc

SEQ ID NO: 1285008 - DNA, 15 bp, Homo sapiens
tgtaataagaaagta

SEQ ID NO: 1285009 - DNA, 21 bp, Homo sapiens
tgtaataagcacttgcctgga

SEQ ID NO: 1285010 - DNA, 23 bp, Homo sapiens
tgtaataagcacttgcctggaat

SEQ ID NO: 1285011 - DNA, 15 bp, Homo sapiens
tgtaataatgttatt

SEQ ID NO: 1285012 - DNA, 14 bp, Homo sapiens
tgtaataattgctc

SEQ ID NO: 1285013 - DNA, 21 bp, Homo sapiens
tgtaatacctgattgatcaca

SEQ ID NO: 1285014 - DNA, 17 bp, Homo sapiens
tgtaatactggaataat

SEQ ID NO: 1285015 - DNA, 16 bp, Homo sapiens
tgtaatacttaaataa

SEQ ID NO: 1285016 - DNA, 18 bp, Homo sapiens
tgtaatagaaaactgaaa

SEQ ID NO: 1285017 - DNA, 20 bp, Homo sapiens
tgtaatagaaaactgaaaat

SEQ ID NO: 1285018 - DNA, 23 bp, Homo sapiens
tgtaatagttctatccttttgcc

SEQ ID NO: 1285019 - DNA, 23 bp, Homo sapiens
tgtaatataaagtattcaacaat

SEQ ID NO: 1285020 - DNA, 18 bp, Homo sapiens
tgtaatatattgtacaaa

SEQ ID NO: 1285021 - DNA, 20 bp, Homo sapiens
tgtaatattgtaaatactgg

SEQ ID NO: 1285022 - DNA, 13 bp, Homo sapiens
tgtaatatttaca

SEQ ID NO: 1285023 - DNA, 17 bp, Homo sapiens
tgtaatatttcttcaaa

SEQ ID NO: 1285024 - DNA, 13 bp, Homo sapiens
tgtaatatttgaa

SEQ ID NO: 1285025 - DNA, 16 bp, Homo sapiens
tgtaatcagctctcct

SEQ ID NO: 1285026 - DNA, 18 bp, Homo sapiens
tgtaatcagctctcctgg

SEQ ID NO: 1285027 - DNA, 20 bp, Homo sapiens
tgtaatcagctctcctggct

SEQ ID NO: 1285028 - DNA, 12 bp, Homo sapiens
tgtaatcatttg

SEQ ID NO: 1285029 - DNA, 21 bp, Homo sapiens
tgtaatcattttaaattccac

SEQ ID NO: 1285030 - DNA, 19 bp, Homo sapiens
tgtaatcccagcactttgg

SEQ ID NO: 1285031 - DNA, 23 bp, Homo sapiens
tgtaatcccagctactcaggagg

SEQ ID NO: 1285032 - DNA, 20 bp, Homo sapiens
tgtaatcccagctactcggg

SEQ ID NO: 1285033 - DNA, 16 bp, Homo sapiens
tgtaatccgaatctct

SEQ ID NO: 1285034 - DNA, 15 bp, Homo sapiens
tgtaatcgtgtgcca

SEQ ID NO: 1285035 - DNA, 16 bp, Homo sapiens
tgtaatcgtgtgccat

SEQ ID NO: 1285036 - DNA, 20 bp, Homo sapiens
tgtaatctaagtatatgtga

SEQ ID NO: 1285037 - DNA, 21 bp, Homo sapiens
tgtaatctctctgcagctgcc

SEQ ID NO: 1285038 - DNA, 12 bp, Homo sapiens
tgtaatcttaaa

SEQ ID NO: 1285039 - DNA, 14 bp, Homo sapiens
tgtaatcttaaaag

SEQ ID NO: 1285040 - DNA, 14 bp, Homo sapiens
tgtaatcttcccca

SEQ ID NO: 1285041 - DNA, 21 bp, Homo sapiens
tgtaatcttgaattgtaactg

SEQ ID NO: 1285042 - DNA, 19 bp, Homo sapiens
tgtaatcttgttgataaaa

SEQ ID NO: 1285043 - DNA, 18 bp, Homo sapiens
tgtaatgaaaatgaatat

SEQ ID NO: 1285044 - DNA, 21 bp, Homo sapiens
tgtaatgaaaatgaatatcta

SEQ ID NO: 1285045 - DNA, 16 bp, Homo sapiens
tgtaatgaaacacctt

SEQ ID NO: 1285046 - DNA, 17 bp, Homo sapiens
tgtaatgaaacaccttc

SEQ ID NO: 1285047 - DNA, 20 bp, Homo sapiens
tgtaatgaaacaccttctct

SEQ ID NO: 1285048 - DNA, 13 bp, Homo sapiens
tgtaatgatcata

SEQ ID NO: 1285049 - DNA, 12 bp, Homo sapiens
tgtaatgcaaaa

SEQ ID NO: 1285050 - DNA, 13 bp, Homo sapiens
tgtaatgctgcac

SEQ ID NO: 1285051 - DNA, 18 bp, Homo sapiens
tgtaatgctgcacttcct

SEQ ID NO: 1285052 - DNA, 20 bp, Homo sapiens
tgtaatgctgcacttcctgt

SEQ ID NO: 1285053 - DNA, 13 bp, Homo sapiens
tgtaatgtcagac

SEQ ID NO: 1285054 - DNA, 19 bp, Homo sapiens
tgtaatgttactgatcatg

SEQ ID NO: 1285055 - DNA, 22 bp, Homo sapiens
tgtaatgttactgatcatgcat

SEQ ID NO: 1285056 - DNA, 18 bp, Homo sapiens
tgtaatgttttctttgca

SEQ ID NO: 1285057 - DNA, 21 bp, Homo sapiens
tgtaatgttttctttgcaaag

SEQ ID NO: 1285058 - DNA, 16 bp, Homo sapiens
tgtaattaaaagcaaa

SEQ ID NO: 1285059 - DNA, 18 bp, Homo sapiens
tgtaattaagtactatgt

SEQ ID NO: 1285060 - DNA, 15 bp, Homo sapiens
tgtaattaatatctt

SEQ ID NO: 1285061 - DNA, 17 bp, Homo sapiens
tgtaattacttattgta

SEQ ID NO: 1285062 - DNA, 23 bp, Homo sapiens
tgtaattcattgagcagttagct

SEQ ID NO: 1285063 - DNA, 21 bp, Homo sapiens
tgtaattcctacctccctgca

SEQ ID NO: 1285064 - DNA, 15 bp, Homo sapiens
tgtaattcttatgac

SEQ ID NO: 1285065 - DNA, 19 bp, Homo sapiens
tgtaattgaatattattcc

SEQ ID NO: 1285066 - DNA, 17 bp, Homo sapiens
tgtaattgatttataaa

SEQ ID NO: 1285067 - DNA, 14 bp, Homo sapiens
tgtaattgcttaca

SEQ ID NO: 1285068 - DNA, 15 bp, Homo sapiens
tgtaattgcttacat

SEQ ID NO: 1285069 - DNA, 18 bp, Homo sapiens
tgtaattgcttacatttt

SEQ ID NO: 1285070 - DNA, 23 bp, Homo sapiens
tgtaattgcttacatttttacaa

SEQ ID NO: 1285071 - DNA, 20 bp, Homo sapiens
tgtaattgtaattccaaaat

SEQ ID NO: 1285072 - DNA, 13 bp, Homo sapiens
tgtaattgtgtaa

SEQ ID NO: 1285073 - DNA, 19 bp, Homo sapiens
tgtaattgttccttttatt

SEQ ID NO: 1285074 - DNA, 16 bp, Homo sapiens
tgtaattgttgtttgt

SEQ ID NO: 1285075 - DNA, 16 bp, Homo sapiens
tgtaatttaaacaggc

SEQ ID NO: 1285076 - DNA, 19 bp, Homo sapiens
tgtaatttaaacaggccca

SEQ ID NO: 1285077 - DNA, 21 bp, Homo sapiens
tgtaatttaaacaggcccagc

SEQ ID NO: 1285078 - DNA, 22 bp, Homo sapiens
tgtaatttaaacaggcccagca

SEQ ID NO: 1285079 - DNA, 23 bp, Homo sapiens
tgtaatttaaacatttgttcctg

SEQ ID NO: 1285080 - DNA, 23 bp, Homo sapiens
tgtaatttcaggaggaatactga

SEQ ID NO: 1285081 - DNA, 21 bp, Homo sapiens
tgtaatttcgccttaaactct

SEQ ID NO: 1285082 - DNA, 13 bp, Homo sapiens
tgtaatttgaatt

SEQ ID NO: 1285083 - DNA, 18 bp, Homo sapiens
tgtaatttgcattactct

SEQ ID NO: 1285084 - DNA, 19 bp, Homo sapiens
tgtaatttgtacaggggcc

SEQ ID NO: 1285085 - DNA, 20 bp, Homo sapiens
tgtaatttgtacaggggcca

SEQ ID NO: 1285086 - DNA, 21 bp, Homo sapiens
tgtaatttgtacaggggccat

SEQ ID NO: 1285087 - DNA, 14 bp, Homo sapiens
tgtaatttgtgata

SEQ ID NO: 1285088 - DNA, 23 bp, Homo sapiens
tgtaattttacacgcttttgtga

SEQ ID NO: 1285089 - DNA, 15 bp, Homo sapiens
tgtaattttgtgtaa

SEQ ID NO: 1285090 - DNA, 20 bp, Homo sapiens
tgtaattttgtgtaagaaat

SEQ ID NO: 1285091 - DNA, 21 bp, Homo sapiens
tgtacaaaccaagagctttta

SEQ ID NO: 1285092 - DNA, 14 bp, Homo sapiens
tgtacaaactcatc

SEQ ID NO: 1285093 - DNA, 23 bp, Homo sapiens
tgtacaaagtagaagtcttagat

SEQ ID NO: 1285094 - DNA, 18 bp, Homo sapiens
tgtacaaatataagaata

SEQ ID NO: 1285095 - DNA, 19 bp, Homo sapiens
tgtacaaatgtaagcaaag

SEQ ID NO: 1285096 - DNA, 18 bp, Homo sapiens
tgtacaaccctgaccgtg

SEQ ID NO: 1285097 - DNA, 22 bp, Homo sapiens
tgtacaagttgttattgttgaa

SEQ ID NO: 1285098 - DNA, 23 bp, Homo sapiens
tgtacaagttgttattgttgaac

SEQ ID NO: 1285099 - DNA, 23 bp, Homo sapiens
tgtacaagttttgtataaataat

SEQ ID NO: 1285100 - DNA, 12 bp, Homo sapiens
tgtacaataaaa

SEQ ID NO: 1285101 - DNA, 17 bp, Homo sapiens
tgtacaatggtttattc

SEQ ID NO: 1285102 - DNA, 22 bp, Homo sapiens
tgtacaatggtttattcccaag

SEQ ID NO: 1285103 - DNA, 16 bp, Homo sapiens
tgtacaattaaaaacc

SEQ ID NO: 1285104 - DNA, 21 bp, Homo sapiens
tgtacaattatgtctcttgag

SEQ ID NO: 1285105 - DNA, 16 bp, Homo sapiens
tgtacaattgatcttt

SEQ ID NO: 1285106 - DNA, 16 bp, Homo sapiens
tgtacaattttaaagt

SEQ ID NO: 1285107 - DNA, 18 bp, Homo sapiens
tgtacaattttaaagttc

SEQ ID NO: 1285108 - DNA, 15 bp, Homo sapiens
tgtacacaactcact

SEQ ID NO: 1285109 - DNA, 21 bp, Homo sapiens
tgtacacaactcactcctttt

SEQ ID NO: 1285110 - DNA, 22 bp, Homo sapiens
tgtacacatgggagtttagtgt

SEQ ID NO: 1285111 - DNA, 20 bp, Homo sapiens
tgtacacattcctgcattca

SEQ ID NO: 1285112 - DNA, 15 bp, Homo sapiens
tgtacacgggactga

SEQ ID NO: 1285113 - DNA, 20 bp, Homo sapiens
tgtacacgggactgacgcaa

SEQ ID NO: 1285114 - DNA, 12 bp, Homo sapiens
tgtacactgaat

SEQ ID NO: 1285115 - DNA, 16 bp, Homo sapiens
tgtacactgaatattt

SEQ ID NO: 1285116 - DNA, 17 bp, Homo sapiens
tgtacactgaatattta

SEQ ID NO: 1285117 - DNA, 19 bp, Homo sapiens
tgtacactgaatatttata

SEQ ID NO: 1285118 - DNA, 19 bp, Homo sapiens
tgtagttgacaattctgca

SEQ ID NO: 1285119 - DNA, 22 bp, Homo sapiens
tgtagtttttaattaaaaactt

SEQ ID NO: 1285120 - DNA, 19 bp, Homo sapiens
tgtagtttttcttcaacat

SEQ ID NO: 1285121 - DNA, 16 bp, Homo sapiens
tgtagtttttgaaaat

SEQ ID NO: 1285122 - DNA, 24 bp, Homo sapiens
tgtagtttttgaaaattatgcaaa

SEQ ID NO: 1285123 - DNA, 14 bp, Homo sapiens
tgtataaaaaccat

SEQ ID NO: 1285124 - DNA, 17 bp, Homo sapiens
tgtataaaaattatcaa

SEQ ID NO: 1285125 - DNA, 18 bp, Homo sapiens
tgtataaaaattatcaaa

SEQ ID NO: 1285126 - DNA, 19 bp, Homo sapiens
tgtataaaaattatcaaaa

SEQ ID NO: 1285127 - DNA, 13 bp, Homo sapiens
tgtataaaagtgt

SEQ ID NO: 1285128 - DNA, 15 bp, Homo sapiens
tgtataaaatagaca

SEQ ID NO: 1285129 - DNA, 16 bp, Homo sapiens
tgtataaagattgtac

SEQ ID NO: 1285130 - DNA, 17 bp, Homo sapiens
tgtataaagattgtact

SEQ ID NO: 1285131 - DNA, 13 bp, Homo sapiens
tgtataaatgaca

SEQ ID NO: 1285132 - DNA, 11 bp, Homo sapiens
tgtataaatgt

SEQ ID NO: 1285133 - DNA, 22 bp, Homo sapiens
tgtataaattaaataaactgtt

SEQ ID NO: 1285134 - DNA, 18 bp, Homo sapiens
tgtataacttcttaaaag

SEQ ID NO: 1285135 - DNA, 19 bp, Homo sapiens
tgtataagacactttgcca

SEQ ID NO: 1285136 - DNA, 19 bp, Homo sapiens
tgtataagccacttgtctt

SEQ ID NO: 1285137 - DNA, 18 bp, Homo sapiens
tgtataagctactcactt

SEQ ID NO: 1285138 - DNA, 17 bp, Homo sapiens
tgtataagtaagaaaat

SEQ ID NO: 1285139 - DNA, 18 bp, Homo sapiens
tgtataagtcaagcacat

SEQ ID NO: 1285140 - DNA, 19 bp, Homo sapiens
tgtataagtggaggcactt

SEQ ID NO: 1285141 - DNA, 20 bp, Homo sapiens
tgtataagtggaggcacttt

SEQ ID NO: 1285142 - DNA, 18 bp, Homo sapiens
tgtataagtgtaaatata

SEQ ID NO: 1285143 - DNA, 22 bp, Homo sapiens
tgtataattaacttaactgaag

SEQ ID NO: 1285144 - DNA, 19 bp, Homo sapiens
tgtatacaagtactggtaa

SEQ ID NO: 1285145 - DNA, 14 bp, Homo sapiens
tgtatacacacata

SEQ ID NO: 1285146 - DNA, 17 bp, Homo sapiens
tgtatacacacatatac

SEQ ID NO: 1285147 - DNA, 22 bp, Homo sapiens
tgtatacagtgcagagccttct

SEQ ID NO: 1285148 - DNA, 23 bp, Homo sapiens
tgtatacagtgcagagccttctc

SEQ ID NO: 1285149 - DNA, 19 bp, Homo sapiens
tgtatacatgtgtgggtgc

SEQ ID NO: 1285150 - DNA, 18 bp, Homo sapiens
tgtataccacctgtacat

SEQ ID NO: 1285151 - DNA, 20 bp, Homo sapiens
tgtataccacctgtacatac

SEQ ID NO: 1285152 - DNA, 19 bp, Homo sapiens
tgtatactcctgtcaccta

SEQ ID NO: 1285153 - DNA, 12 bp, Homo sapiens
tgtatactctgt

SEQ ID NO: 1285154 - DNA, 13 bp, Homo sapiens
tgtatactgtaaa

SEQ ID NO: 1285155 - DNA, 14 bp, Homo sapiens
tgtatactgtaaaa

SEQ ID NO: 1285156 - DNA, 17 bp, Homo sapiens
tgtatagagaatttaag

SEQ ID NO: 1285157 - DNA, 18 bp, Homo sapiens
tgtatagatgcaagatat

SEQ ID NO: 1285158 - DNA, 16 bp, Homo sapiens
tgtataggccatctgt

SEQ ID NO: 1285159 - DNA, 19 bp, Homo sapiens
tgtataggccatctgtaaa

SEQ ID NO: 1285160 - DNA, 13 bp, Homo sapiens
tgtataggtagat

SEQ ID NO: 1285161 - DNA, 18 bp, Homo sapiens
tgtataggtagatccaga

SEQ ID NO: 1285162 - DNA, 23 bp, Homo sapiens
tgtatagtaaagtgataatttct

SEQ ID NO: 1285163 - DNA, 15 bp, Homo sapiens
tgtatagtaaatcac

SEQ ID NO: 1285164 - DNA, 15 bp, Homo sapiens
tgtatagtactggca

SEQ ID NO: 1285165 - DNA, 24 bp, Homo sapiens
tgtatagtgtaaaataagaatgat

SEQ ID NO: 1285166 - DNA, 15 bp, Homo sapiens
tgtatagtgttcaca

SEQ ID NO: 1285167 - DNA, 21 bp, Homo sapiens
tgtatagtgttcacaaactgt

SEQ ID NO: 1285168 - DNA, 15 bp, Homo sapiens
tgtatagttaacaca

SEQ ID NO: 1285169 - DNA, 16 bp, Homo sapiens
tgtatagttaacacac

SEQ ID NO: 1285170 - DNA, 13 bp, Homo sapiens
tgtatagttgctt

SEQ ID NO: 1285171 - DNA, 14 bp, Homo sapiens
tgtatagttgcttg

SEQ ID NO: 1285172 - DNA, 22 bp, Homo sapiens
tgtatagttgcttgcctgatat

SEQ ID NO: 1285173 - DNA, 23 bp, Homo sapiens
tgtatagttttataaaactcagt

SEQ ID NO: 1285174 - DNA, 19 bp, Homo sapiens
tgtatataaacatattttt

SEQ ID NO: 1285175 - DNA, 15 bp, Homo sapiens
tgtatatacatatat

SEQ ID NO: 1285176 - DNA, 14 bp, Homo sapiens
tgtatatacatttc

SEQ ID NO: 1285177 - DNA, 12 bp, Homo sapiens
tgtatatacttt

SEQ ID NO: 1285178 - DNA, 22 bp, Homo sapiens
tgtatatagagattgtacattt

SEQ ID NO: 1285179 - DNA, 15 bp, Homo sapiens
tgtatatatatatat

SEQ ID NO: 1285180 - DNA, 20 bp, Homo sapiens
tgtatatatatttatatata

SEQ ID NO: 1285181 - DNA, 21 bp, Homo sapiens
tgtatatatcttataactgtt

SEQ ID NO: 1285182 - DNA, 20 bp, Homo sapiens
tgtatatatggatcagagga

SEQ ID NO: 1285183 - DNA, 19 bp, Homo sapiens
tgtatatatgtgtgtttaa

SEQ ID NO: 1285184 - DNA, 17 bp, Homo sapiens
tgtatatattttatatg

SEQ ID NO: 1285185 - DNA, 17 bp, Homo sapiens
tgtatatcatgaagcct

SEQ ID NO: 1285186 - DNA, 15 bp, Homo sapiens
tgtatatccttccaa

SEQ ID NO: 1285187 - DNA, 22 bp, Homo sapiens
tgtatatccttccaaaaaatta

SEQ ID NO: 1285188 - DNA, 13 bp, Homo sapiens
tgtatatcgttat

SEQ ID NO: 1285189 - DNA, 18 bp, Homo sapiens
tgtatatgacatttaaat

SEQ ID NO: 1285190 - DNA, 23 bp, Homo sapiens
tgtatatgatctaatacaaagat

SEQ ID NO: 1285191 - DNA, 18 bp, Homo sapiens
tgtatatgtataaattaa

SEQ ID NO: 1285192 - DNA, 19 bp, Homo sapiens
tgtatatgtataaattaat

SEQ ID NO: 1285193 - DNA, 12 bp, Homo sapiens
tgtatatgtatt

SEQ ID NO: 1285194 - DNA, 23 bp, Homo sapiens
tgtatatgtattcccttgtattt

SEQ ID NO: 1285195 - DNA, 15 bp, Homo sapiens
tgtatattacaatga

SEQ ID NO: 1285196 - DNA, 21 bp, Homo sapiens
tgtatattatggaagatttta

SEQ ID NO: 1285197 - DNA, 23 bp, Homo sapiens
tgtatattatggaagattttaaa

SEQ ID NO: 1285198 - DNA, 18 bp, Homo sapiens
tgtatattccatgtataa

SEQ ID NO: 1285199 - DNA, 14 bp, Homo sapiens
tgtatattctggaa

SEQ ID NO: 1285200 - DNA, 16 bp, Homo sapiens
tgtatattctggaaaa

SEQ ID NO: 1285201 - DNA, 22 bp, Homo sapiens
tgtatattgggtgtagatttct

SEQ ID NO: 1285202 - DNA, 21 bp, Homo sapiens
tgtatattgtggatgtgttca

SEQ ID NO: 1285203 - DNA, 20 bp, Homo sapiens
tgtatattgtgtttgtgtat

SEQ ID NO: 1285204 - DNA, 13 bp, Homo sapiens
tgtatatttgcaa

SEQ ID NO: 1285205 - DNA, 13 bp, Homo sapiens
tgtatatttgcat

SEQ ID NO: 1285206 - DNA, 14 bp, Homo sapiens
tgtatatttgcata

SEQ ID NO: 1285207 - DNA, 13 bp, Homo sapiens
tgtatatttgctg

SEQ ID NO: 1285208 - DNA, 12 bp, Homo sapiens
tgtatatttgta

SEQ ID NO: 1285209 - DNA, 13 bp, Homo sapiens
tgtatatttgtat

SEQ ID NO: 1285210 - DNA, 19 bp, Homo sapiens
tgtatatttgtatgatatt

SEQ ID NO: 1285211 - DNA, 17 bp, Homo sapiens
tgtatatttgtcatgac

SEQ ID NO: 1285212 - DNA, 12 bp, Homo sapiens
tgtatattttaa

SEQ ID NO: 1285213 - DNA, 22 bp, Homo sapiens
tgtatattttaatagaattttt

SEQ ID NO: 1285214 - DNA, 19 bp, Homo sapiens
tgtatatttttgtatgtca

SEQ ID NO: 1285215 - DNA, 14 bp, Homo sapiens
tgtatcaaatacat

SEQ ID NO: 1285216 - DNA, 23 bp, Homo sapiens
tgtatcaaatacatttaaaacat

SEQ ID NO: 1285217 - DNA, 14 bp, Homo sapiens
tgtatcaaatctgt

SEQ ID NO: 1285218 - DNA, 17 bp, Homo sapiens
tgtatcaaatctgtata

SEQ ID NO: 1285219 - DNA, 17 bp, Homo sapiens
tgtatcaatgagtaaca

SEQ ID NO: 1285220 - DNA, 20 bp, Homo sapiens
tgtatcagctctctgctggg

SEQ ID NO: 1285221 - DNA, 15 bp, Homo sapiens
tgtatcagtgtttat

SEQ ID NO: 1285222 - DNA, 23 bp, Homo sapiens
tgtatcagtgtttatgtgctatt

SEQ ID NO: 1285223 - DNA, 22 bp, Homo sapiens
tgtatcagttttctaagaactt

SEQ ID NO: 1285224 - DNA, 16 bp, Homo sapiens
tgtatcatagaaatgt

SEQ ID NO: 1285225 - DNA, 17 bp, Homo sapiens
tgtatcattaaaatata

SEQ ID NO: 1285226 - DNA, 20 bp, Homo sapiens
tgtatcattaaaatatatgt

SEQ ID NO: 1285227 - DNA, 22 bp, Homo sapiens
tgtatccaaggaaacattttat

SEQ ID NO: 1285228 - DNA, 21 bp, Homo sapiens
tgtatcccccccctgtatagt

SEQ ID NO: 1285229 - DNA, 19 bp, Homo sapiens
tgtatcctccctggcagac

SEQ ID NO: 1285230 - DNA, 17 bp, Homo sapiens
tgtatcctggccctggg

SEQ ID NO: 1285231 - DNA, 13 bp, Homo sapiens
tgtatcctggggc

SEQ ID NO: 1285232 - DNA, 21 bp, Homo sapiens
tgtatcgcatattagttaatc

SEQ ID NO: 1285233 - DNA, 22 bp, Homo sapiens
tgtatcgcatattagttaatct

SEQ ID NO: 1285234 - DNA, 15 bp, Homo sapiens
tgtatcggatgcttt

SEQ ID NO: 1285235 - DNA, 12 bp, Homo sapiens
tgtatctaagaa

SEQ ID NO: 1285236 - DNA, 20 bp, Homo sapiens
tgtatctaagaataataaaa

SEQ ID NO: 1285237 - DNA, 21 bp, Homo sapiens
tgtatctacagtaatgaaatg

SEQ ID NO: 1285238 - DNA, 19 bp, Homo sapiens
tgtatctagcttcttcaga

SEQ ID NO: 1285239 - DNA, 22 bp, Homo sapiens
tgtcattttaaaatctgattta

SEQ ID NO: 1285240 - DNA, 15 bp, Homo sapiens
tgtcattttatgaat

SEQ ID NO: 1285241 - DNA, 22 bp, Homo sapiens
tgtcatttttaatattactgtc

SEQ ID NO: 1285242 - DNA, 16 bp, Homo sapiens
tgtccaaaactgcctc

SEQ ID NO: 1285243 - DNA, 20 bp, Homo sapiens
tgtccaaaagatacccaaat

SEQ ID NO: 1285244 - DNA, 11 bp, Homo sapiens
tgtccaaagag

SEQ ID NO: 1285245 - DNA, 19 bp, Homo sapiens
tgtccaaagaggctgcccc

SEQ ID NO: 1285246 - DNA, 19 bp, Homo sapiens
tgtccaaaggaggctggca

SEQ ID NO: 1285247 - DNA, 15 bp, Homo sapiens
tgtccaacctaaccc

SEQ ID NO: 1285248 - DNA, 18 bp, Homo sapiens
tgtccaagttcttcacct

SEQ ID NO: 1285249 - DNA, 19 bp, Homo sapiens
tgtccaagttcttcacctc

SEQ ID NO: 1285250 - DNA, 23 bp, Homo sapiens
tgtccaagttcttcacctctatc

SEQ ID NO: 1285251 - DNA, 16 bp, Homo sapiens
tgtccacatctgcctc

SEQ ID NO: 1285252 - DNA, 14 bp, Homo sapiens
tgtccacattctac

SEQ ID NO: 1285253 - DNA, 19 bp, Homo sapiens
tgtccacattctacttcag

SEQ ID NO: 1285254 - DNA, 16 bp, Homo sapiens
tgtccaccagacccac

SEQ ID NO: 1285255 - DNA, 20 bp, Homo sapiens
tgtccaccagtttatacaga

SEQ ID NO: 1285256 - DNA, 13 bp, Homo sapiens
tgtccacctggcc

SEQ ID NO: 1285257 - DNA, 15 bp, Homo sapiens
tgtccacctggcccc

SEQ ID NO: 1285258 - DNA, 13 bp, Homo sapiens
tgtccacctgtgc

SEQ ID NO: 1285259 - DNA, 14 bp, Homo sapiens
tgtccacctgtggg

SEQ ID NO: 1285260 - DNA, 16 bp, Homo sapiens
tgtccacgactgtctc

SEQ ID NO: 1285261 - DNA, 17 bp, Homo sapiens
tgtccacgactgtctcc

SEQ ID NO: 1285262 - DNA, 19 bp, Homo sapiens
tgtccacgactgtctccat

SEQ ID NO: 1285263 - DNA, 18 bp, Homo sapiens
tgtccactctcggggccc

SEQ ID NO: 1285264 - DNA, 23 bp, Homo sapiens
tgtccagagagagaagtgcccct

SEQ ID NO: 1285265 - DNA, 12 bp, Homo sapiens
tgtccagcagct

SEQ ID NO: 1285266 - DNA, 22 bp, Homo sapiens
tgtccagccacccccaggcatc

SEQ ID NO: 1285267 - DNA, 22 bp, Homo sapiens
tgtccagcctgggcagccaggc

SEQ ID NO: 1285268 - DNA, 12 bp, Homo sapiens
tgtccagcctta

SEQ ID NO: 1285269 - DNA, 21 bp, Homo sapiens
tgtccagctgagcgccaggat

SEQ ID NO: 1285270 - DNA, 14 bp, Homo sapiens
tgtccagctgggac

SEQ ID NO: 1285271 - DNA, 14 bp, Homo sapiens
tgtccagctggggc

SEQ ID NO: 1285272 - DNA, 23 bp, Homo sapiens
tgtccagctggggccagaggctg

SEQ ID NO: 1285273 - DNA, 15 bp, Homo sapiens
tgtccagcttccaaa

SEQ ID NO: 1285274 - DNA, 21 bp, Homo sapiens
tgtccaggaaaccctggcttg

SEQ ID NO: 1285275 - DNA, 15 bp, Homo sapiens
tgtccaggcagctcc

SEQ ID NO: 1285276 - DNA, 17 bp, Homo sapiens
tgtccaggcagctccct

SEQ ID NO: 1285277 - DNA, 20 bp, Homo sapiens
tgtccaggcagctccctcct

SEQ ID NO: 1285278 - DNA, 23 bp, Homo sapiens
tgtccaggcagctccctcctgca

SEQ ID NO: 1285279 - DNA, 22 bp, Homo sapiens
tgtccaggctctgggcacagtg

SEQ ID NO: 1285280 - DNA, 23 bp, Homo sapiens
tgtccaggctctgggcacagtgc

SEQ ID NO: 1285281 - DNA, 18 bp, Homo sapiens
tgtccaggctggagtgca

SEQ ID NO: 1285282 - DNA, 20 bp, Homo sapiens
tgtccaggctggtctgaaac

SEQ ID NO: 1285283 - DNA, 23 bp, Homo sapiens
tgtccaggctggtctgaaaccct

SEQ ID NO: 1285284 - DNA, 18 bp, Homo sapiens
tgtccagggtcctctagc

SEQ ID NO: 1285285 - DNA, 15 bp, Homo sapiens
tgtccataaataaag

SEQ ID NO: 1285286 - DNA, 14 bp, Homo sapiens
tgtccatactaaca

SEQ ID NO: 1285287 - DNA, 13 bp, Homo sapiens
tgtccatcagtgc

SEQ ID NO: 1285288 - DNA, 17 bp, Homo sapiens
tgtccatcctgacctgc

SEQ ID NO: 1285289 - DNA, 15 bp, Homo sapiens
tgtccatctgtctgt

SEQ ID NO: 1285290 - DNA, 22 bp, Homo sapiens
tgtccatgcgctcagggccatg

SEQ ID NO: 1285291 - DNA, 13 bp, Homo sapiens
tgtccatgtgtgt

SEQ ID NO: 1285292 - DNA, 16 bp, Homo sapiens
tgtccatgtgtgtgca

SEQ ID NO: 1285293 - DNA, 14 bp, Homo sapiens
tgtccattgtccaa

SEQ ID NO: 1285294 - DNA, 20 bp, Homo sapiens
tgtccatttatccacaggaa

SEQ ID NO: 1285295 - DNA, 22 bp, Homo sapiens
tgtccattttgcaaacccaact

SEQ ID NO: 1285296 - DNA, 15 bp, Homo sapiens
tgtcccaaggagctg

SEQ ID NO: 1285297 - DNA, 22 bp, Homo sapiens
tgtcccaatcttaccagatgct

SEQ ID NO: 1285298 - DNA, 13 bp, Homo sapiens
tgtcccaccagct

SEQ ID NO: 1285299 - DNA, 18 bp, Homo sapiens
tgtcccacccccaccccc

SEQ ID NO: 1285300 - DNA, 14 bp, Homo sapiens
tgtcccacctggct

SEQ ID NO: 1285301 - DNA, 22 bp, Homo sapiens
tgtcccacgtgtcttccacttt

SEQ ID NO: 1285302 - DNA, 18 bp, Homo sapiens
tgtcccagatcgtctcca

SEQ ID NO: 1285303 - DNA, 21 bp, Homo sapiens
tgtcccagatcgtctccaatt

SEQ ID NO: 1285304 - DNA, 16 bp, Homo sapiens
tgtcccagatgctgtc

SEQ ID NO: 1285305 - DNA, 18 bp, Homo sapiens
tgtcccagatgctgtcat

SEQ ID NO: 1285306 - DNA, 15 bp, Homo sapiens
tgtcccagcctgggg

SEQ ID NO: 1285307 - DNA, 23 bp, Homo sapiens
tgtcccagcctggggctccctct

SEQ ID NO: 1285308 - DNA, 20 bp, Homo sapiens
tgtcccaggactcaccctcc

SEQ ID NO: 1285309 - DNA, 12 bp, Homo sapiens
tgtcccaggcag

SEQ ID NO: 1285310 - DNA, 18 bp, Homo sapiens
tgtcccaggcatgcagct

SEQ ID NO: 1285311 - DNA, 21 bp, Homo sapiens
tgtcccaggcatgcagctgcc

SEQ ID NO: 1285312 - DNA, 24 bp, Homo sapiens
tgtcccaggcatgcagctgcctgg

SEQ ID NO: 1285313 - DNA, 18 bp, Homo sapiens
tgtcccaggccggcccag

SEQ ID NO: 1285314 - DNA, 23 bp, Homo sapiens
tgtcccagtgctcaccagccctg

SEQ ID NO: 1285315 - DNA, 19 bp, Homo sapiens
tgtcccatccccaggtccc

SEQ ID NO: 1285316 - DNA, 21 bp, Homo sapiens
tgtcccatcggagtgcggacc

SEQ ID NO: 1285317 - DNA, 14 bp, Homo sapiens
tgtcccatctgccc

SEQ ID NO: 1285318 - DNA, 20 bp, Homo sapiens
tgtcccatctggtcatttgg

SEQ ID NO: 1285319 - DNA, 19 bp, Homo sapiens
tgtcccatgacccacccct

SEQ ID NO: 1285320 - DNA, 18 bp, Homo sapiens
tgtcccatgatccctgtg

SEQ ID NO: 1285321 - DNA, 17 bp, Homo sapiens
tgtcccatggacactcc

SEQ ID NO: 1285322 - DNA, 13 bp, Homo sapiens
tgtcccatgggga

SEQ ID NO: 1285323 - DNA, 23 bp, Homo sapiens
tgtcccatggggaaaccctggag

SEQ ID NO: 1285324 - DNA, 16 bp, Homo sapiens
tgtcccattccctggg

SEQ ID NO: 1285325 - DNA, 14 bp, Homo sapiens
tgtcccattctaga

SEQ ID NO: 1285326 - DNA, 15 bp, Homo sapiens
tgtcccattctagat

SEQ ID NO: 1285327 - DNA, 21 bp, Homo sapiens
tgtcccattctagatcctgca

SEQ ID NO: 1285328 - DNA, 18 bp, Homo sapiens
tgtccccaacgtcccctc

SEQ ID NO: 1285329 - DNA, 21 bp, Homo sapiens
tgtccccaagacacttcccct

SEQ ID NO: 1285330 - DNA, 17 bp, Homo sapiens
tgtccccacacagcctc

SEQ ID NO: 1285331 - DNA, 17 bp, Homo sapiens
tgtccccaccctccact

SEQ ID NO: 1285332 - DNA, 18 bp, Homo sapiens
tgtccccaggcccagccc

SEQ ID NO: 1285333 - DNA, 19 bp, Homo sapiens
tgtccccaggcccagccct

SEQ ID NO: 1285334 - DNA, 20 bp, Homo sapiens
tgtccccaggcccagccctc

SEQ ID NO: 1285335 - DNA, 13 bp, Homo sapiens
tgtccccaggcct

SEQ ID NO: 1285336 - DNA, 14 bp, Homo sapiens
tgtccccagggccc

SEQ ID NO: 1285337 - DNA, 15 bp, Homo sapiens
tgtccccagggcccc

SEQ ID NO: 1285338 - DNA, 21 bp, Homo sapiens
tgtccccagtccccagccctg

SEQ ID NO: 1285339 - DNA, 22 bp, Homo sapiens
tgtccccagtccccagccctgg

SEQ ID NO: 1285340 - DNA, 14 bp, Homo sapiens
tgtcccccactgct

SEQ ID NO: 1285341 - DNA, 23 bp, Homo sapiens
tgtcccccagcatcgggggcctg

SEQ ID NO: 1285342 - DNA, 13 bp, Homo sapiens
tgtcccccagctc

SEQ ID NO: 1285343 - DNA, 15 bp, Homo sapiens
tgtccccccttgaag

SEQ ID NO: 1285344 - DNA, 17 bp, Homo sapiens
tgtccccccttgaagca

SEQ ID NO: 1285345 - DNA, 22 bp, Homo sapiens
tgtccccccttgaagcaataac

SEQ ID NO: 1285346 - DNA, 18 bp, Homo sapiens
tgtccccctcccctccca

SEQ ID NO: 1285347 - DNA, 18 bp, Homo sapiens
tgtccccctcctcccagg

SEQ ID NO: 1285348 - DNA, 18 bp, Homo sapiens
tgtccccctctgtccagg

SEQ ID NO: 1285349 - DNA, 16 bp, Homo sapiens
tgtcccctatcctccc

SEQ ID NO: 1285350 - DNA, 23 bp, Homo sapiens
tgtcccctatggggatggtccac

SEQ ID NO: 1285351 - DNA, 18 bp, Homo sapiens
tgtcccctccactgtcac

SEQ ID NO: 1285352 - DNA, 13 bp, Homo sapiens
tgtcccctgagtt

SEQ ID NO: 1285353 - DNA, 13 bp, Homo sapiens
tgtcccctgtccc

SEQ ID NO: 1285354 - DNA, 18 bp, Homo sapiens
tgtccccttcccctgctg

SEQ ID NO: 1285355 - DNA, 12 bp, Homo sapiens
tgtccccttcct

SEQ ID NO: 1285356 - DNA, 21 bp, Homo sapiens
tgtccccttcctgttcttcct

SEQ ID NO: 1285357 - DNA, 15 bp, Homo sapiens
tgtcccgccttcctc

SEQ ID NO: 1285358 - DNA, 22 bp, Homo sapiens
tgtcccgccttcctcctccaca

SEQ ID NO: 1285359 - DNA, 19 bp, Homo sapiens
tgtccctaagtaagtttct

SEQ ID NO: 1285360 - DNA, 14 bp, Homo sapiens
tgtcttctgcctgt

SEQ ID NO: 1285361 - DNA, 23 bp, Homo sapiens
tgtcttctggacaggctctgctt

SEQ ID NO: 1285362 - DNA, 13 bp, Homo sapiens
tgtcttcttttgt

SEQ ID NO: 1285363 - DNA, 14 bp, Homo sapiens
tgtcttcttttgtg

SEQ ID NO: 1285364 - DNA, 24 bp, Homo sapiens
tgtcttgaagcagccttgatatgt

SEQ ID NO: 1285365 - DNA, 20 bp, Homo sapiens
tgtcttgagagcttggcctt

SEQ ID NO: 1285366 - DNA, 17 bp, Homo sapiens
tgtcttgagaggagact

SEQ ID NO: 1285367 - DNA, 19 bp, Homo sapiens
tgtcttgagaggagacttg

SEQ ID NO: 1285368 - DNA, 19 bp, Homo sapiens
tgtcttgcactggccttct

SEQ ID NO: 1285369 - DNA, 14 bp, Homo sapiens
tgtcttgccccagt

SEQ ID NO: 1285370 - DNA, 15 bp, Homo sapiens
tgtcttgctcctggg

SEQ ID NO: 1285371 - DNA, 17 bp, Homo sapiens
tgtcttgctcctgggga

SEQ ID NO: 1285372 - DNA, 14 bp, Homo sapiens
tgtcttgctgtcat

SEQ ID NO: 1285373 - DNA, 19 bp, Homo sapiens
tgtcttggctttcatgtta

SEQ ID NO: 1285374 - DNA, 12 bp, Homo sapiens
tgtcttgggcag

SEQ ID NO: 1285375 - DNA, 18 bp, Homo sapiens
tgtcttgttatgtacaaa

SEQ ID NO: 1285376 - DNA, 15 bp, Homo sapiens
tgtcttgttcatttt

SEQ ID NO: 1285377 - DNA, 16 bp, Homo sapiens
tgtctttaaaagagag

SEQ ID NO: 1285378 - DNA, 16 bp, Homo sapiens
tgtctttatagatgta

SEQ ID NO: 1285379 - DNA, 16 bp, Homo sapiens
tgtctttatttgctca

SEQ ID NO: 1285380 - DNA, 20 bp, Homo sapiens
tgtctttccacttctctggg

SEQ ID NO: 1285381 - DNA, 13 bp, Homo sapiens
tgtctttcctgaa

SEQ ID NO: 1285382 - DNA, 15 bp, Homo sapiens
tgtctttctaagaaa

SEQ ID NO: 1285383 - DNA, 17 bp, Homo sapiens
tgtctttctaagaaatc

SEQ ID NO: 1285384 - DNA, 22 bp, Homo sapiens
tgtctttctggaaaggaaacat

SEQ ID NO: 1285385 - DNA, 16 bp, Homo sapiens
tgtctttggaggtgct

SEQ ID NO: 1285386 - DNA, 19 bp, Homo sapiens
tgtctttggataataggaa

SEQ ID NO: 1285387 - DNA, 13 bp, Homo sapiens
tgtctttgtaata

SEQ ID NO: 1285388 - DNA, 16 bp, Homo sapiens
tgtcttttaaaatgca

SEQ ID NO: 1285389 - DNA, 20 bp, Homo sapiens
tgtcttttaaaatgcaatgt

SEQ ID NO: 1285390 - DNA, 16 bp, Homo sapiens
tgtcttttaaactgga

SEQ ID NO: 1285391 - DNA, 13 bp, Homo sapiens
tgtcttttagaca

SEQ ID NO: 1285392 - DNA, 19 bp, Homo sapiens
tgtcttttatttaacaaaa

SEQ ID NO: 1285393 - DNA, 20 bp, Homo sapiens
tgtcttttcaagtaattttc

SEQ ID NO: 1285394 - DNA, 22 bp, Homo sapiens
tgtcttttcagaagcaagccag

SEQ ID NO: 1285395 - DNA, 19 bp, Homo sapiens
tgtcttttcccatttatct

SEQ ID NO: 1285396 - DNA, 14 bp, Homo sapiens
tgtcttttgacatt

SEQ ID NO: 1285397 - DNA, 17 bp, Homo sapiens
tgtcttttgacatttta

SEQ ID NO: 1285398 - DNA, 21 bp, Homo sapiens
tgtctttttattaaaatattt

SEQ ID NO: 1285399 - DNA, 13 bp, Homo sapiens
tgtctttttccta

SEQ ID NO: 1285400 - DNA, 15 bp, Homo sapiens
tgtctttttcctact

SEQ ID NO: 1285401 - DNA, 19 bp, Homo sapiens
tgtctttttcctactccgt

SEQ ID NO: 1285402 - DNA, 22 bp, Homo sapiens
tgtctttttttgtatagttaac

SEQ ID NO: 1285403 - DNA, 18 bp, Homo sapiens
tgtcttttttttcatcct

SEQ ID NO: 1285404 - DNA, 20 bp, Homo sapiens
tgtgaaaaaaaaaatgctga

SEQ ID NO: 1285405 - DNA, 18 bp, Homo sapiens
tgtgaaaaaagaaaatgg

SEQ ID NO: 1285406 - DNA, 12 bp, Homo sapiens
tgtgaaaaagga

SEQ ID NO: 1285407 - DNA, 18 bp, Homo sapiens
tgtgaaaaaggaataaaa

SEQ ID NO: 1285408 - DNA, 13 bp, Homo sapiens
tgtgaaaagaaaa

SEQ ID NO: 1285409 - DNA, 15 bp, Homo sapiens
tgtgaaaagaaaaat

SEQ ID NO: 1285410 - DNA, 15 bp, Homo sapiens
tgtgaaaatagtgta

SEQ ID NO: 1285411 - DNA, 18 bp, Homo sapiens
tgtgaaaatggtccagga

SEQ ID NO: 1285412 - DNA, 19 bp, Homo sapiens
tgtgaaacacacaatgtgg

SEQ ID NO: 1285413 - DNA, 19 bp, Homo sapiens
tgtgaaacagttgctgtga

SEQ ID NO: 1285414 - DNA, 21 bp, Homo sapiens
tgtgaaacagttgctgtgaac

SEQ ID NO: 1285415 - DNA, 19 bp, Homo sapiens
tgtgaaactggcactgaat

SEQ ID NO: 1285416 - DNA, 12 bp, Homo sapiens
tgtgaaagaatg

SEQ ID NO: 1285417 - DNA, 17 bp, Homo sapiens
tgtgaaaggaacatttt

SEQ ID NO: 1285418 - DNA, 21 bp, Homo sapiens
tgtgaaataaaactggctttg

SEQ ID NO: 1285419 - DNA, 12 bp, Homo sapiens
tgtgaaatataa

SEQ ID NO: 1285420 - DNA, 22 bp, Homo sapiens
tgtgaaatctcagaatttatct

SEQ ID NO: 1285421 - DNA, 14 bp, Homo sapiens
tgtgaaatgaaaac

SEQ ID NO: 1285422 - DNA, 12 bp, Homo sapiens
tgtgaaatgtaa

SEQ ID NO: 1285423 - DNA, 14 bp, Homo sapiens
tgtgaaatgtaaca

SEQ ID NO: 1285424 - DNA, 17 bp, Homo sapiens
tgtgaaatttaaataat

SEQ ID NO: 1285425 - DNA, 23 bp, Homo sapiens
tgtgaaatttaaataatagacat

SEQ ID NO: 1285426 - DNA, 12 bp, Homo sapiens
tgtgaaatttca

SEQ ID NO: 1285427 - DNA, 13 bp, Homo sapiens
tgtgaacagcata

SEQ ID NO: 1285428 - DNA, 19 bp, Homo sapiens
tgtgaacctgggcactccg

SEQ ID NO: 1285429 - DNA, 22 bp, Homo sapiens
tgtgaacgctgtgatgctgtgt

SEQ ID NO: 1285430 - DNA, 22 bp, Homo sapiens
tgtgaactcaccctgggagcca

SEQ ID NO: 1285431 - DNA, 15 bp, Homo sapiens
tgtgaactgctttca

SEQ ID NO: 1285432 - DNA, 19 bp, Homo sapiens
tgtgaactgggcacagatt

SEQ ID NO: 1285433 - DNA, 21 bp, Homo sapiens
tgtgaactgggcacagattga

SEQ ID NO: 1285434 - DNA, 20 bp, Homo sapiens
tgtgaacttggggaacaagg

SEQ ID NO: 1285435 - DNA, 10 bp, Homo sapiens
tgtgaagaaa

SEQ ID NO: 1285436 - DNA, 14 bp, Homo sapiens
tgtgaagagaacca

SEQ ID NO: 1285437 - DNA, 18 bp, Homo sapiens
tgtgaagataatttgcat

SEQ ID NO: 1285438 - DNA, 22 bp, Homo sapiens
tgtgaagccgccagttcatctt

SEQ ID NO: 1285439 - DNA, 15 bp, Homo sapiens
tgtgaagctaatgaa

SEQ ID NO: 1285440 - DNA, 22 bp, Homo sapiens
tgtgaaggattatggaaaaata

SEQ ID NO: 1285441 - DNA, 13 bp, Homo sapiens
tgtgaaggcccaa

SEQ ID NO: 1285442 - DNA, 15 bp, Homo sapiens
tgtgaatacaattaa

SEQ ID NO: 1285443 - DNA, 21 bp, Homo sapiens
tgtgaatacctgctcacgtca

SEQ ID NO: 1285444 - DNA, 16 bp, Homo sapiens
tgtgaatagcctggcc

SEQ ID NO: 1285445 - DNA, 21 bp, Homo sapiens
tgtgaatatccagaaataaaa

SEQ ID NO: 1285446 - DNA, 14 bp, Homo sapiens
tgtgaatcgcagct

SEQ ID NO: 1285447 - DNA, 21 bp, Homo sapiens
tgtgaatctgaactgctctac

SEQ ID NO: 1285448 - DNA, 19 bp, Homo sapiens
tgtgaatgattcatgttat

SEQ ID NO: 1285449 - DNA, 20 bp, Homo sapiens
tgtgaatgattcatgttata

SEQ ID NO: 1285450 - DNA, 14 bp, Homo sapiens
tgtgaatggaggca

SEQ ID NO: 1285451 - DNA, 15 bp, Homo sapiens
tgtgaatgtgggcac

SEQ ID NO: 1285452 - DNA, 16 bp, Homo sapiens
tgtgaattaagcccaa

SEQ ID NO: 1285453 - DNA, 19 bp, Homo sapiens
tgtgaattaggctgtaact

SEQ ID NO: 1285454 - DNA, 20 bp, Homo sapiens
tgtgaattcaatacaggcta

SEQ ID NO: 1285455 - DNA, 16 bp, Homo sapiens
tgtgaattcccagact

SEQ ID NO: 1285456 - DNA, 19 bp, Homo sapiens
tgtgaattgaaatgttcgt

SEQ ID NO: 1285457 - DNA, 15 bp, Homo sapiens
tgtgaattgactacc

SEQ ID NO: 1285458 - DNA, 18 bp, Homo sapiens
tgtgaattgagctgcaga

SEQ ID NO: 1285459 - DNA, 22 bp, Homo sapiens
tgtgaattgcctgcagagagaa

SEQ ID NO: 1285460 - DNA, 17 bp, Homo sapiens
tgtgaatttcaaaaaaa

SEQ ID NO: 1285461 - DNA, 14 bp, Homo sapiens
tgtgaatttcaact

SEQ ID NO: 1285462 - DNA, 22 bp, Homo sapiens
tgtgaattttctaaaagctttc

SEQ ID NO: 1285463 - DNA, 15 bp, Homo sapiens
tgtgaatttttaagc

SEQ ID NO: 1285464 - DNA, 19 bp, Homo sapiens
tgtgaatttttaagctgca

SEQ ID NO: 1285465 - DNA, 17 bp, Homo sapiens
tgtgaatttttgcctat

SEQ ID NO: 1285466 - DNA, 21 bp, Homo sapiens
tgtgaatttttgcctatcttt

SEQ ID NO: 1285467 - DNA, 12 bp, Homo sapiens
tgtgacaaaaaa

SEQ ID NO: 1285468 - DNA, 16 bp, Homo sapiens
tgtgacaaaaaattaa

SEQ ID NO: 1285469 - DNA, 13 bp, Homo sapiens
tgtgacaaaggat

SEQ ID NO: 1285470 - DNA, 20 bp, Homo sapiens
tgtgacaaaggatgaagaac

SEQ ID NO: 1285471 - DNA, 18 bp, Homo sapiens
tgtgacacatcaagcttt

SEQ ID NO: 1285472 - DNA, 14 bp, Homo sapiens
tgtgacactctcgt

SEQ ID NO: 1285473 - DNA, 13 bp, Homo sapiens
tgtgacactgatg

SEQ ID NO: 1285474 - DNA, 22 bp, Homo sapiens
tgtgacagaatcttgtatttgg

SEQ ID NO: 1285475 - DNA, 19 bp, Homo sapiens
tgtgacagcgatggcaggc

SEQ ID NO: 1285476 - DNA, 23 bp, Homo sapiens
tgtgacagcgatggcaggcctga

SEQ ID NO: 1285477 - DNA, 22 bp, Homo sapiens
tgtgacaggaaagccctccccc

SEQ ID NO: 1285478 - DNA, 18 bp, Homo sapiens
tgtgacagtttccaaatt

SEQ ID NO: 1285479 - DNA, 15 bp, Homo sapiens
tgtgacatcctgctt

SEQ ID NO: 1285480 - DNA, 12 bp, Homo sapiens
tgtgacatgtaa

SEQ ID NO: 1285481 - DNA, 11 bp, Homo sapiens
tgtgacattcc

SEQ ID NO: 1285482 - DNA, 15 bp, Homo sapiens
tgtgccgcactctgg

SEQ ID NO: 1285483 - DNA, 16 bp, Homo sapiens
tgtgcctaacaccagc

SEQ ID NO: 1285484 - DNA, 17 bp, Homo sapiens
tgtgcctatagtcccag

SEQ ID NO: 1285485 - DNA, 17 bp, Homo sapiens
tgtgcctcaggccaggg

SEQ ID NO: 1285486 - DNA, 14 bp, Homo sapiens
tgtgcctcccaaaa

SEQ ID NO: 1285487 - DNA, 16 bp, Homo sapiens
tgtgcctccccccaga

SEQ ID NO: 1285488 - DNA, 15 bp, Homo sapiens
tgtgcctcccttccc

SEQ ID NO: 1285489 - DNA, 16 bp, Homo sapiens
tgtgcctcccttccca

SEQ ID NO: 1285490 - DNA, 12 bp, Homo sapiens
tgtgcctcctca

SEQ ID NO: 1285491 - DNA, 14 bp, Homo sapiens
tgtgcctcctcacc

SEQ ID NO: 1285492 - DNA, 16 bp, Homo sapiens
tgtgcctcctcacccc

SEQ ID NO: 1285493 - DNA, 16 bp, Homo sapiens
tgtgcctcgcatccta

SEQ ID NO: 1285494 - DNA, 12 bp, Homo sapiens
tgtgcctctgcc

SEQ ID NO: 1285495 - DNA, 23 bp, Homo sapiens
tgtgcctctgcccaagcagcctg

SEQ ID NO: 1285496 - DNA, 15 bp, Homo sapiens
tgtgcctctgcctgt

SEQ ID NO: 1285497 - DNA, 15 bp, Homo sapiens
tgtgcctctgggact

SEQ ID NO: 1285498 - DNA, 14 bp, Homo sapiens
tgtgcctgcactga

SEQ ID NO: 1285499 - DNA, 12 bp, Homo sapiens
tgtgcctgccct

SEQ ID NO: 1285500 - DNA, 14 bp, Homo sapiens
tgtgcctgccctgg

SEQ ID NO: 1285501 - DNA, 17 bp, Homo sapiens
tgtgcctgctagagcaa

SEQ ID NO: 1285502 - DNA, 20 bp, Homo sapiens
tgtgcctgctagagcaaccc

SEQ ID NO: 1285503 - DNA, 19 bp, Homo sapiens
tgtgcctgctcagcagcca

SEQ ID NO: 1285504 - DNA, 20 bp, Homo sapiens
tgtgcctgctcagcagccag

SEQ ID NO: 1285505 - DNA, 21 bp, Homo sapiens
tgtgcctgctcagcagccagt

SEQ ID NO: 1285506 - DNA, 13 bp, Homo sapiens
tgtgcctgcttct

SEQ ID NO: 1285507 - DNA, 15 bp, Homo sapiens
tgtgcctgcttctgt

SEQ ID NO: 1285508 - DNA, 16 bp, Homo sapiens
tgtgcctggccccagc

SEQ ID NO: 1285509 - DNA, 22 bp, Homo sapiens
tgtgcctggccccagcctgggc

SEQ ID NO: 1285510 - DNA, 23 bp, Homo sapiens
tgtgcctggccccagcctgggcc

SEQ ID NO: 1285511 - DNA, 12 bp, Homo sapiens
tgtgcctgggat

SEQ ID NO: 1285512 - DNA, 13 bp, Homo sapiens
tgtgcctgggatc

SEQ ID NO: 1285513 - DNA, 13 bp, Homo sapiens
tgtgcctgggccc

SEQ ID NO: 1285514 - DNA, 15 bp, Homo sapiens
tgtgcctgggccctg

SEQ ID NO: 1285515 - DNA, 19 bp, Homo sapiens
tgtgcctgggccctgggct

SEQ ID NO: 1285516 - DNA, 21 bp, Homo sapiens
tgtgcctgggggagttttcct

SEQ ID NO: 1285517 - DNA, 13 bp, Homo sapiens
tgtgcctgtggca

SEQ ID NO: 1285518 - DNA, 14 bp, Homo sapiens
tgtgcctgtggcag

SEQ ID NO: 1285519 - DNA, 16 bp, Homo sapiens
tgtgcctgtgggaggg

SEQ ID NO: 1285520 - DNA, 23 bp, Homo sapiens
tgtgccttcgtctttcccatggg

SEQ ID NO: 1285521 - DNA, 13 bp, Homo sapiens
tgtgccttgtttt

SEQ ID NO: 1285522 - DNA, 18 bp, Homo sapiens
tgtgccttgttttttgtt

SEQ ID NO: 1285523 - DNA, 12 bp, Homo sapiens
tgtgcctttcct

SEQ ID NO: 1285524 - DNA, 14 bp, Homo sapiens
tgtgcctttcctat

SEQ ID NO: 1285525 - DNA, 17 bp, Homo sapiens
tgtgcctttcctatcac

SEQ ID NO: 1285526 - DNA, 24 bp, Homo sapiens
tgtgcgtctctctttctccctcac

SEQ ID NO: 1285527 - DNA, 14 bp, Homo sapiens
tgtgcgtgaaacac

SEQ ID NO: 1285528 - DNA, 15 bp, Homo sapiens
tgtgcgtgcatgtgc

SEQ ID NO: 1285529 - DNA, 16 bp, Homo sapiens
tgtgcgtggtccgtgt

SEQ ID NO: 1285530 - DNA, 21 bp, Homo sapiens
tgtgcgtgtgtccatgtgtgt

SEQ ID NO: 1285531 - DNA, 13 bp, Homo sapiens
tgtgctagatgtg

SEQ ID NO: 1285532 - DNA, 20 bp, Homo sapiens
tgtgctagggaaacttcccg

SEQ ID NO: 1285533 - DNA, 17 bp, Homo sapiens
tgtgctatacacacaca

SEQ ID NO: 1285534 - DNA, 18 bp, Homo sapiens
tgtgctatacacacacac

SEQ ID NO: 1285535 - DNA, 18 bp, Homo sapiens
tgtgctatactgcatact

SEQ ID NO: 1285536 - DNA, 17 bp, Homo sapiens
tgtgctatagtatttga

SEQ ID NO: 1285537 - DNA, 16 bp, Homo sapiens
tgtgctattaatattt

SEQ ID NO: 1285538 - DNA, 17 bp, Homo sapiens
tgtgctattaatatttg

SEQ ID NO: 1285539 - DNA, 17 bp, Homo sapiens
tgtgctcacgctccccc

SEQ ID NO: 1285540 - DNA, 22 bp, Homo sapiens
tgtgctcagagacctgaagtgt

SEQ ID NO: 1285541 - DNA, 20 bp, Homo sapiens
tgtgctcagccaaatttcct

SEQ ID NO: 1285542 - DNA, 20 bp, Homo sapiens
tgtgctcctcttgattcctg

SEQ ID NO: 1285543 - DNA, 12 bp, Homo sapiens
tgtgctctcccc

SEQ ID NO: 1285544 - DNA, 16 bp, Homo sapiens
tgtgctctgttccatt

SEQ ID NO: 1285545 - DNA, 19 bp, Homo sapiens
tgtgctgacaacttagctc

SEQ ID NO: 1285546 - DNA, 21 bp, Homo sapiens
tgtgctgaggccttatcattc

SEQ ID NO: 1285547 - DNA, 20 bp, Homo sapiens
tgtgctgcgcctgcaggcag

SEQ ID NO: 1285548 - DNA, 12 bp, Homo sapiens
tgtgctgctgct

SEQ ID NO: 1285549 - DNA, 15 bp, Homo sapiens
tgtgctgctgctgct

SEQ ID NO: 1285550 - DNA, 18 bp, Homo sapiens
tgtgctgctgctgctatt

SEQ ID NO: 1285551 - DNA, 18 bp, Homo sapiens
tgtgctggaattctaaca

SEQ ID NO: 1285552 - DNA, 17 bp, Homo sapiens
tgtgctggaccagctgg

SEQ ID NO: 1285553 - DNA, 18 bp, Homo sapiens
tgtgctgggaaatgcaga

SEQ ID NO: 1285554 - DNA, 22 bp, Homo sapiens
tgtgctgggaaatgcagaaatc

SEQ ID NO: 1285555 - DNA, 11 bp, Homo sapiens
tgtgctggggg

SEQ ID NO: 1285556 - DNA, 17 bp, Homo sapiens
tgtgctgggtcccagcc

SEQ ID NO: 1285557 - DNA, 18 bp, Homo sapiens
tgtgctgggtcccagcct

SEQ ID NO: 1285558 - DNA, 22 bp, Homo sapiens
tgtgctgggtgagctcttccag

SEQ ID NO: 1285559 - DNA, 17 bp, Homo sapiens
tgtgctgggtgcctccc

SEQ ID NO: 1285560 - DNA, 21 bp, Homo sapiens
tgtgctggtgaacactgtgac

SEQ ID NO: 1285561 - DNA, 14 bp, Homo sapiens
tgtgctgtatggcc

SEQ ID NO: 1285562 - DNA, 21 bp, Homo sapiens
tgtgctgtgcctgctagagca

SEQ ID NO: 1285563 - DNA, 21 bp, Homo sapiens
tgtgctgtggagagaagctga

SEQ ID NO: 1285564 - DNA, 16 bp, Homo sapiens
tgtgctgtggccaggc

SEQ ID NO: 1285565 - DNA, 18 bp, Homo sapiens
tgtgctgtggccaggcct

SEQ ID NO: 1285566 - DNA, 15 bp, Homo sapiens
tgtgctgtgggcagc

SEQ ID NO: 1285567 - DNA, 15 bp, Homo sapiens
tgtgctgtgtgtgac

SEQ ID NO: 1285568 - DNA, 13 bp, Homo sapiens
tgtgcttatgttt

SEQ ID NO: 1285569 - DNA, 13 bp, Homo sapiens
tgtgcttattttt

SEQ ID NO: 1285570 - DNA, 16 bp, Homo sapiens
tgtgcttcgactactg

SEQ ID NO: 1285571 - DNA, 24 bp, Homo sapiens
tgtgcttctcttctttattgcact

SEQ ID NO: 1285572 - DNA, 17 bp, Homo sapiens
tgtgcttgaaggccctg

SEQ ID NO: 1285573 - DNA, 19 bp, Homo sapiens
tgtgcttgagccaggaggc

SEQ ID NO: 1285574 - DNA, 22 bp, Homo sapiens
tgtgcttggatttgcatattta

SEQ ID NO: 1285575 - DNA, 22 bp, Homo sapiens
tgtgctttcccatatcttgcct

SEQ ID NO: 1285576 - DNA, 13 bp, Homo sapiens
tgtgctttctgca

SEQ ID NO: 1285577 - DNA, 12 bp, Homo sapiens
tgtgctttgaga

SEQ ID NO: 1285578 - DNA, 17 bp, Homo sapiens
tgtgctttgctcttgtc

SEQ ID NO: 1285579 - DNA, 19 bp, Homo sapiens
tgtgcttttgatctctgct

SEQ ID NO: 1285580 - DNA, 22 bp, Homo sapiens
tgtggaaaacacaataaaaaat

SEQ ID NO: 1285581 - DNA, 19 bp, Homo sapiens
tgtggaaaaccaggaaaag

SEQ ID NO: 1285582 - DNA, 17 bp, Homo sapiens
tgtggaaagcctctgct

SEQ ID NO: 1285583 - DNA, 19 bp, Homo sapiens
tgtggaaagcctctgctgc

SEQ ID NO: 1285584 - DNA, 20 bp, Homo sapiens
tgtggaagcatggctgtctg

SEQ ID NO: 1285585 - DNA, 18 bp, Homo sapiens
tgtggaatataaatagct

SEQ ID NO: 1285586 - DNA, 13 bp, Homo sapiens
tgtggaatgagtg

SEQ ID NO: 1285587 - DNA, 17 bp, Homo sapiens
tgtggaatgttggataa

SEQ ID NO: 1285588 - DNA, 21 bp, Homo sapiens
tgtggaattttgagaaaaata

SEQ ID NO: 1285589 - DNA, 13 bp, Homo sapiens
tgtggacatatgt

SEQ ID NO: 1285590 - DNA, 17 bp, Homo sapiens
tgtggaccactgcatga

SEQ ID NO: 1285591 - DNA, 19 bp, Homo sapiens
tgtggaccactgcatgagc

SEQ ID NO: 1285592 - DNA, 17 bp, Homo sapiens
tgtggaccatattttgt

SEQ ID NO: 1285593 - DNA, 19 bp, Homo sapiens
tgtggacgtgcactgacag

SEQ ID NO: 1285594 - DNA, 14 bp, Homo sapiens
tgtggactggctgt

SEQ ID NO: 1285595 - DNA, 14 bp, Homo sapiens
tgtggactgggacc

SEQ ID NO: 1285596 - DNA, 14 bp, Homo sapiens
tgtggactgtcctg

SEQ ID NO: 1285597 - DNA, 21 bp, Homo sapiens
tgtggactgtcctgaggagcc

SEQ ID NO: 1285598 - DNA, 11 bp, Homo sapiens
tgtggactgtg

SEQ ID NO: 1285599 - DNA, 15 bp, Homo sapiens
tgtggactgtgatgc

SEQ ID NO: 1285600 - DNA, 22 bp, Homo sapiens
tgtggactgtgcctcaggccag

SEQ ID NO: 1285601 - DNA, 24 bp, Homo sapiens
tgtggactgtgcctcaggccaggg

SEQ ID NO: 1285602 - DNA, 13 bp, Homo sapiens
tgtggagaaagga

SEQ ID NO: 1285603 - DNA, 23 bp, Homo sapiens
tgtggagaaataaaaatacctct

SEQ ID NO: 1285604 - DNA, 19 bp, Homo sapiens
tgtggagaccctgccacag

SEQ ID NO: 1285605 - DNA, 14 bp, Homo sapiens
tgtgttactgcttt

SEQ ID NO: 1285606 - DNA, 17 bp, Homo sapiens
tgtgttactgctttgca

SEQ ID NO: 1285607 - DNA, 20 bp, Homo sapiens
tgtgttactgctttgcaaag

SEQ ID NO: 1285608 - DNA, 14 bp, Homo sapiens
tgtgttagttccca

SEQ ID NO: 1285609 - DNA, 19 bp, Homo sapiens
tgtgttatattccaaggaa

SEQ ID NO: 1285610 - DNA, 23 bp, Homo sapiens
tgtgttatcacccagaagaaaat

SEQ ID NO: 1285611 - DNA, 16 bp, Homo sapiens
tgtgttatttaaatga

SEQ ID NO: 1285612 - DNA, 19 bp, Homo sapiens
tgtgttcaatatttagaaa

SEQ ID NO: 1285613 - DNA, 20 bp, Homo sapiens
tgtgttcaatgaaataaaag

SEQ ID NO: 1285614 - DNA, 21 bp, Homo sapiens
tgtgttcaccttcaaaatgtt

SEQ ID NO: 1285615 - DNA, 21 bp, Homo sapiens
tgtgttcagctctttccaaat

SEQ ID NO: 1285616 - DNA, 14 bp, Homo sapiens
tgtgttcattcaag

SEQ ID NO: 1285617 - DNA, 16 bp, Homo sapiens
tgtgttcattcaagct

SEQ ID NO: 1285618 - DNA, 18 bp, Homo sapiens
tgtgttcattcaagctat

SEQ ID NO: 1285619 - DNA, 12 bp, Homo sapiens
tgtgttcatttc

SEQ ID NO: 1285620 - DNA, 15 bp, Homo sapiens
tgtgttcatttcatt

SEQ ID NO: 1285621 - DNA, 20 bp, Homo sapiens
tgtgttcatttggtgttcct

SEQ ID NO: 1285622 - DNA, 15 bp, Homo sapiens
tgtgttcctatggaa

SEQ ID NO: 1285623 - DNA, 18 bp, Homo sapiens
tgtgttcctccattttct

SEQ ID NO: 1285624 - DNA, 10 bp, Homo sapiens
tgtgttcctg

SEQ ID NO: 1285625 - DNA, 13 bp, Homo sapiens
tgtgttcctggct

SEQ ID NO: 1285626 - DNA, 15 bp, Homo sapiens
tgtgttcctggctga

SEQ ID NO: 1285627 - DNA, 23 bp, Homo sapiens
tgtgttcgggggagcagagagag

SEQ ID NO: 1285628 - DNA, 19 bp, Homo sapiens
tgtgttctgtttgttaaaa

SEQ ID NO: 1285629 - DNA, 22 bp, Homo sapiens
tgtgttcttttctcctttacca

SEQ ID NO: 1285630 - DNA, 12 bp, Homo sapiens
tgtgttgacaca

SEQ ID NO: 1285631 - DNA, 12 bp, Homo sapiens
tgtgttgacact

SEQ ID NO: 1285632 - DNA, 14 bp, Homo sapiens
tgtgttgacactgt

SEQ ID NO: 1285633 - DNA, 15 bp, Homo sapiens
tgtgttgctatcctg

SEQ ID NO: 1285634 - DNA, 13 bp, Homo sapiens
tgtgttgcttcaa

SEQ ID NO: 1285635 - DNA, 18 bp, Homo sapiens
tgtgttgtcccatctgcc

SEQ ID NO: 1285636 - DNA, 19 bp, Homo sapiens
tgtgttgtctcttgagttt

SEQ ID NO: 1285637 - DNA, 14 bp, Homo sapiens
tgtgttgtcttgaa

SEQ ID NO: 1285638 - DNA, 13 bp, Homo sapiens
tgtgttgtgcttt

SEQ ID NO: 1285639 - DNA, 15 bp, Homo sapiens
tgtgttgtgtgagcg

SEQ ID NO: 1285640 - DNA, 14 bp, Homo sapiens
tgtgtttaaataaa

SEQ ID NO: 1285641 - DNA, 18 bp, Homo sapiens
tgtgtttaaataaagtat

SEQ ID NO: 1285642 - DNA, 21 bp, Homo sapiens
tgtgtttaacattcacagccc

SEQ ID NO: 1285643 - DNA, 17 bp, Homo sapiens
tgtgtttatgtgagctg

SEQ ID NO: 1285644 - DNA, 14 bp, Homo sapiens
tgtgtttatttcac

SEQ ID NO: 1285645 - DNA, 12 bp, Homo sapiens
tgtgtttccaca

SEQ ID NO: 1285646 - DNA, 20 bp, Homo sapiens
tgtgtttcgcattaagcaca

SEQ ID NO: 1285647 - DNA, 15 bp, Homo sapiens
tgtgtttctaaaact

SEQ ID NO: 1285648 - DNA, 21 bp, Homo sapiens
tgtgtttctcctgagctagga

SEQ ID NO: 1285649 - DNA, 13 bp, Homo sapiens
tgtgtttctgtaa

SEQ ID NO: 1285650 - DNA, 18 bp, Homo sapiens
tgtgtttctgtaacaaat

SEQ ID NO: 1285651 - DNA, 21 bp, Homo sapiens
tgtgtttctgtcctgtaactg

SEQ ID NO: 1285652 - DNA, 16 bp, Homo sapiens
tgtgtttgaaatcatc

SEQ ID NO: 1285653 - DNA, 20 bp, Homo sapiens
tgtgtttgacactaagaaaa

SEQ ID NO: 1285654 - DNA, 14 bp, Homo sapiens
tgtgtttgagcaag

SEQ ID NO: 1285655 - DNA, 16 bp, Homo sapiens
tgtgtttgcagcctgc

SEQ ID NO: 1285656 - DNA, 13 bp, Homo sapiens
tgtgtttgctgca

SEQ ID NO: 1285657 - DNA, 22 bp, Homo sapiens
tgtgtttggatacatctgctgt

SEQ ID NO: 1285658 - DNA, 15 bp, Homo sapiens
tgtgtttgtgtattt

SEQ ID NO: 1285659 - DNA, 10 bp, Homo sapiens
tgtgtttgtt

SEQ ID NO: 1285660 - DNA, 23 bp, Homo sapiens
tgtgtttgtttttcaagaaatga

SEQ ID NO: 1285661 - DNA, 9 bp, Homo sapiens
tgtgtttta

SEQ ID NO: 1285662 - DNA, 18 bp, Homo sapiens
tgtgttttaaaaaaactg

SEQ ID NO: 1285663 - DNA, 22 bp, Homo sapiens
tgtgttttaaaaaaactgaagg

SEQ ID NO: 1285664 - DNA, 20 bp, Homo sapiens
tgtgttttcatcatttcagc

SEQ ID NO: 1285665 - DNA, 22 bp, Homo sapiens
tgtgttttcccaaagcactttt

SEQ ID NO: 1285666 - DNA, 20 bp, Homo sapiens
tgtgttttcctttgtcttaa

SEQ ID NO: 1285667 - DNA, 17 bp, Homo sapiens
tgtgttttctctggaat

SEQ ID NO: 1285668 - DNA, 13 bp, Homo sapiens
tgtgttttctgaa

SEQ ID NO: 1285669 - DNA, 14 bp, Homo sapiens
tgtgttttctgaat

SEQ ID NO: 1285670 - DNA, 16 bp, Homo sapiens
tgtgttttcttgtaaa

SEQ ID NO: 1285671 - DNA, 13 bp, Homo sapiens
tgtgttttgtcct

SEQ ID NO: 1285672 - DNA, 15 bp, Homo sapiens
tgtgtttttaacatg

SEQ ID NO: 1285673 - DNA, 19 bp, Homo sapiens
tgttaaaaaaataagaaga

SEQ ID NO: 1285674 - DNA, 20 bp, Homo sapiens
tgttaaaaaaataagaagaa

SEQ ID NO: 1285675 - DNA, 23 bp, Homo sapiens
tgttaaaaaaataagaagaatgc

SEQ ID NO: 1285676 - DNA, 18 bp, Homo sapiens
tgttaaaaagaaatccag

SEQ ID NO: 1285677 - DNA, 12 bp, Homo sapiens
tgttaaaataac

SEQ ID NO: 1285678 - DNA, 14 bp, Homo sapiens
tgttaaaataacta

SEQ ID NO: 1285679 - DNA, 20 bp, Homo sapiens
tgttaaaatggggataataa

SEQ ID NO: 1285680 - DNA, 18 bp, Homo sapiens
tgttaaaatgtacactgg

SEQ ID NO: 1285681 - DNA, 23 bp, Homo sapiens
tgttaaaattatcaatatctaat

SEQ ID NO: 1285682 - DNA, 11 bp, Homo sapiens
tgttaaactgt

SEQ ID NO: 1285683 - DNA, 13 bp, Homo sapiens
tgttaaactgtta

SEQ ID NO: 1285684 - DNA, 20 bp, Homo sapiens
tgttaaactgttagcactgt

SEQ ID NO: 1285685 - DNA, 21 bp, Homo sapiens
tgttaaagctggaacatttga

SEQ ID NO: 1285686 - DNA, 15 bp, Homo sapiens
tgttaaagctgtaca

SEQ ID NO: 1285687 - DNA, 23 bp, Homo sapiens
tgttaaataatatggctatgctt

SEQ ID NO: 1285688 - DNA, 19 bp, Homo sapiens
tgttaaatgaaattgtaaa

SEQ ID NO: 1285689 - DNA, 22 bp, Homo sapiens
tgttaaatgacttgattgtact

SEQ ID NO: 1285690 - DNA, 13 bp, Homo sapiens
tgttaaatggaat

SEQ ID NO: 1285691 - DNA, 17 bp, Homo sapiens
tgttaaattacattttt

SEQ ID NO: 1285692 - DNA, 17 bp, Homo sapiens
tgttaaattcattttat

SEQ ID NO: 1285693 - DNA, 16 bp, Homo sapiens
tgttaaatttttctga

SEQ ID NO: 1285694 - DNA, 19 bp, Homo sapiens
tgttaacctctgcttttat

SEQ ID NO: 1285695 - DNA, 19 bp, Homo sapiens
tgttaactacatattgtct

SEQ ID NO: 1285696 - DNA, 12 bp, Homo sapiens
tgttaactgaat

SEQ ID NO: 1285697 - DNA, 15 bp, Homo sapiens
tgttaactgaatacc

SEQ ID NO: 1285698 - DNA, 14 bp, Homo sapiens
tgttaactgccaag

SEQ ID NO: 1285699 - DNA, 14 bp, Homo sapiens
tgttaacttattca

SEQ ID NO: 1285700 - DNA, 17 bp, Homo sapiens
tgttaacttattcaaag

SEQ ID NO: 1285701 - DNA, 18 bp, Homo sapiens
tgttaacttattcaaaga

SEQ ID NO: 1285702 - DNA, 13 bp, Homo sapiens
tgttaagaaagga

SEQ ID NO: 1285703 - DNA, 14 bp, Homo sapiens
tgttaagaaaggat

SEQ ID NO: 1285704 - DNA, 16 bp, Homo sapiens
tgttaagaaaggatat

SEQ ID NO: 1285705 - DNA, 20 bp, Homo sapiens
tgttaagaaaggatataaaa

SEQ ID NO: 1285706 - DNA, 21 bp, Homo sapiens
tgttaagaatgaagttctgct

SEQ ID NO: 1285707 - DNA, 22 bp, Homo sapiens
tgttaagaatgaagttctgcta

SEQ ID NO: 1285708 - DNA, 15 bp, Homo sapiens
tgttaagaattgacc

SEQ ID NO: 1285709 - DNA, 15 bp, Homo sapiens
tgttaagacttgaca

SEQ ID NO: 1285710 - DNA, 23 bp, Homo sapiens
tgttaagataacttactgtatat

SEQ ID NO: 1285711 - DNA, 23 bp, Homo sapiens
tgttaagatatgcacagtctatt

SEQ ID NO: 1285712 - DNA, 23 bp, Homo sapiens
tgttaagcttgcgtagaattgca

SEQ ID NO: 1285713 - DNA, 24 bp, Homo sapiens
tgttaaggtcctgaaagtaactca

SEQ ID NO: 1285714 - DNA, 13 bp, Homo sapiens
tgttaataaaagt

SEQ ID NO: 1285715 - DNA, 18 bp, Homo sapiens
tgttaataaaagtacatg

SEQ ID NO: 1285716 - DNA, 15 bp, Homo sapiens
tgttaataaaggtct

SEQ ID NO: 1285717 - DNA, 14 bp, Homo sapiens
tgttaatacacagt

SEQ ID NO: 1285718 - DNA, 13 bp, Homo sapiens
tgttaatatcact

SEQ ID NO: 1285719 - DNA, 17 bp, Homo sapiens
tgttaatatcactcatt

SEQ ID NO: 1285720 - DNA, 18 bp, Homo sapiens
tgttaatatcactcatta

SEQ ID NO: 1285721 - DNA, 22 bp, Homo sapiens
tgttaatatcactcattaatta

SEQ ID NO: 1285722 - DNA, 16 bp, Homo sapiens
tgttaatctcccagcc

SEQ ID NO: 1285723 - DNA, 14 bp, Homo sapiens
tgttaatgaaaatg

SEQ ID NO: 1285724 - DNA, 17 bp, Homo sapiens
tgttaatgaaaatgtca

SEQ ID NO: 1285725 - DNA, 13 bp, Homo sapiens
tgttaatgactct

SEQ ID NO: 1285726 - DNA, 21 bp, Homo sapiens
tgttaatgctctatgtttgta

SEQ ID NO: 1285727 - DNA, 15 bp, Homo sapiens
tgttaatgctttctg

SEQ ID NO: 1285728 - DNA, 16 bp, Homo sapiens
tgttgccttcatcttc

SEQ ID NO: 1285729 - DNA, 13 bp, Homo sapiens
tgttgccttttca

SEQ ID NO: 1285730 - DNA, 14 bp, Homo sapiens
tgttgccttttcac

SEQ ID NO: 1285731 - DNA, 14 bp, Homo sapiens
tgttgctagggaga

SEQ ID NO: 1285732 - DNA, 20 bp, Homo sapiens
tgttgctatacatgttggaa

SEQ ID NO: 1285733 - DNA, 17 bp, Homo sapiens
tgttgctatgtgcctta

SEQ ID NO: 1285734 - DNA, 18 bp, Homo sapiens
tgttgctcttggaaagct

SEQ ID NO: 1285735 - DNA, 15 bp, Homo sapiens
tgttgctgaatttgt

SEQ ID NO: 1285736 - DNA, 13 bp, Homo sapiens
tgttgctgccaac

SEQ ID NO: 1285737 - DNA, 22 bp, Homo sapiens
tgttgctgctactgtcttacta

SEQ ID NO: 1285738 - DNA, 16 bp, Homo sapiens
tgttgctggaggggct

SEQ ID NO: 1285739 - DNA, 16 bp, Homo sapiens
tgttgcttagtcactt

SEQ ID NO: 1285740 - DNA, 20 bp, Homo sapiens
tgttgcttctgaatcactgt

SEQ ID NO: 1285741 - DNA, 14 bp, Homo sapiens
tgttgcttggacta

SEQ ID NO: 1285742 - DNA, 19 bp, Homo sapiens
tgttgctttaatatgagct

SEQ ID NO: 1285743 - DNA, 14 bp, Homo sapiens
tgttgctttacagt

SEQ ID NO: 1285744 - DNA, 16 bp, Homo sapiens
tgttgctttacagtta

SEQ ID NO: 1285745 - DNA, 18 bp, Homo sapiens
tgttgctttcttcctgca

SEQ ID NO: 1285746 - DNA, 20 bp, Homo sapiens
tgttgctttcttcctgcata

SEQ ID NO: 1285747 - DNA, 17 bp, Homo sapiens
tgttgcttttcaaatgt

SEQ ID NO: 1285748 - DNA, 14 bp, Homo sapiens
tgttggaaaaaatt

SEQ ID NO: 1285749 - DNA, 13 bp, Homo sapiens
tgttggaaaagaa

SEQ ID NO: 1285750 - DNA, 15 bp, Homo sapiens
tgttggaaactgtaa

SEQ ID NO: 1285751 - DNA, 16 bp, Homo sapiens
tgttggaaactgtaaa

SEQ ID NO: 1285752 - DNA, 12 bp, Homo sapiens
tgttggaatgaa

SEQ ID NO: 1285753 - DNA, 23 bp, Homo sapiens
tgttggacagacactgttgcaaa

SEQ ID NO: 1285754 - DNA, 15 bp, Homo sapiens
tgttggacagctgct

SEQ ID NO: 1285755 - DNA, 20 bp, Homo sapiens
tgttggaggaccccgagggc

SEQ ID NO: 1285756 - DNA, 20 bp, Homo sapiens
tgttggataaatcagtggtt

SEQ ID NO: 1285757 - DNA, 11 bp, Homo sapiens
tgttggataag

SEQ ID NO: 1285758 - DNA, 15 bp, Homo sapiens
tgttggcaagctgca

SEQ ID NO: 1285759 - DNA, 16 bp, Homo sapiens
tgttggcaagctgcag

SEQ ID NO: 1285760 - DNA, 23 bp, Homo sapiens
tgttggcactcacagacctggag

SEQ ID NO: 1285761 - DNA, 22 bp, Homo sapiens
tgttggcacttataggtaacgt

SEQ ID NO: 1285762 - DNA, 22 bp, Homo sapiens
tgttggcagagcttttgcattt

SEQ ID NO: 1285763 - DNA, 13 bp, Homo sapiens
tgttggcaggccc

SEQ ID NO: 1285764 - DNA, 15 bp, Homo sapiens
tgttggcaggcccac

SEQ ID NO: 1285765 - DNA, 18 bp, Homo sapiens
tgttggcaggctggccag

SEQ ID NO: 1285766 - DNA, 16 bp, Homo sapiens
tgttggcctccggcct

SEQ ID NO: 1285767 - DNA, 18 bp, Homo sapiens
tgttggcctgtgggcctc

SEQ ID NO: 1285768 - DNA, 22 bp, Homo sapiens
tgttggctacacagacccctcc

SEQ ID NO: 1285769 - DNA, 11 bp, Homo sapiens
tgttggctgcg

SEQ ID NO: 1285770 - DNA, 19 bp, Homo sapiens
tgttgggaaacttggctcg

SEQ ID NO: 1285771 - DNA, 23 bp, Homo sapiens
tgttgggaaggggtcctgcaggg

SEQ ID NO: 1285772 - DNA, 14 bp, Homo sapiens
tgttgggactgcta

SEQ ID NO: 1285773 - DNA, 20 bp, Homo sapiens
tgttggggaagggcctgccc

SEQ ID NO: 1285774 - DNA, 20 bp, Homo sapiens
tgttggggagtgggtggcag

SEQ ID NO: 1285775 - DNA, 15 bp, Homo sapiens
tgttggggcagtggt

SEQ ID NO: 1285776 - DNA, 17 bp, Homo sapiens
tgttggggttgacattt

SEQ ID NO: 1285777 - DNA, 20 bp, Homo sapiens
tgttgggtgggtgggccctg

SEQ ID NO: 1285778 - DNA, 16 bp, Homo sapiens
tgttggtccactgtgt

SEQ ID NO: 1285779 - DNA, 23 bp, Homo sapiens
tgttggtgcgaaagtaaaaacac

SEQ ID NO: 1285780 - DNA, 22 bp, Homo sapiens
tgttggttaccctcctagcttt

SEQ ID NO: 1285781 - DNA, 19 bp, Homo sapiens
tgttggtttcactgagagc

SEQ ID NO: 1285782 - DNA, 21 bp, Homo sapiens
tgttgtaaactgttgttttgt

SEQ ID NO: 1285783 - DNA, 13 bp, Homo sapiens
tgttgtaaataaa

SEQ ID NO: 1285784 - DNA, 14 bp, Homo sapiens
tgttgtaacctgct

SEQ ID NO: 1285785 - DNA, 20 bp, Homo sapiens
tgttgtaagtaataatttgt

SEQ ID NO: 1285786 - DNA, 18 bp, Homo sapiens
tgttgtaataaaacttat

SEQ ID NO: 1285787 - DNA, 16 bp, Homo sapiens
tgttgtaatagtccat

SEQ ID NO: 1285788 - DNA, 15 bp, Homo sapiens
tgttgtaatgctgca

SEQ ID NO: 1285789 - DNA, 16 bp, Homo sapiens
tgttgtaatgctgcac

SEQ ID NO: 1285790 - DNA, 22 bp, Homo sapiens
tgttgtaatgctgcacttcctg

SEQ ID NO: 1285791 - DNA, 17 bp, Homo sapiens
tgttgtacgtaaagctt

SEQ ID NO: 1285792 - DNA, 15 bp, Homo sapiens
tgttgtagatgctaa

SEQ ID NO: 1285793 - DNA, 15 bp, Homo sapiens
tgttgtagcattttc

SEQ ID NO: 1285794 - DNA, 17 bp, Homo sapiens
tgttgtagcattttcct

SEQ ID NO: 1285795 - DNA, 11 bp, Homo sapiens
tgttgtataaa

SEQ ID NO: 1285796 - DNA, 15 bp, Homo sapiens
tgttgtatgccttta

SEQ ID NO: 1285797 - DNA, 14 bp, Homo sapiens
tgttgtattcattg

SEQ ID NO: 1285798 - DNA, 14 bp, Homo sapiens
tgttgtatttatgg

SEQ ID NO: 1285799 - DNA, 19 bp, Homo sapiens
tgttgtcaaggatggtttt

SEQ ID NO: 1285800 - DNA, 14 bp, Homo sapiens
tgttgtcagcaggc

SEQ ID NO: 1285801 - DNA, 15 bp, Homo sapiens
tgttgtcagcaggca

SEQ ID NO: 1285802 - DNA, 20 bp, Homo sapiens
tgttgtcataacatttaaag

SEQ ID NO: 1285803 - DNA, 11 bp, Homo sapiens
tgttgtcattg

SEQ ID NO: 1285804 - DNA, 19 bp, Homo sapiens
tgttgtcattgtaaacaaa

SEQ ID NO: 1285805 - DNA, 23 bp, Homo sapiens
tgttgtccaacaataaacaggaa

SEQ ID NO: 1285806 - DNA, 16 bp, Homo sapiens
tgttgtcccatctgcc

SEQ ID NO: 1285807 - DNA, 18 bp, Homo sapiens
tgttgtcccatctgccct

SEQ ID NO: 1285808 - DNA, 14 bp, Homo sapiens
tgttgtccttgccc

SEQ ID NO: 1285809 - DNA, 17 bp, Homo sapiens
tgttgtccttttcatag

SEQ ID NO: 1285810 - DNA, 22 bp, Homo sapiens
tgttgtccttttcataggtctg

SEQ ID NO: 1285811 - DNA, 14 bp, Homo sapiens
tgttgtctccactt

SEQ ID NO: 1285812 - DNA, 17 bp, Homo sapiens
tgttgtctgtttgttct

SEQ ID NO: 1285813 - DNA, 13 bp, Homo sapiens
tgttgtgagcttt

SEQ ID NO: 1285814 - DNA, 20 bp, Homo sapiens
tgttgtgccccttcactcat

SEQ ID NO: 1285815 - DNA, 19 bp, Homo sapiens
tgttgtgtgtatatgtatt

SEQ ID NO: 1285816 - DNA, 17 bp, Homo sapiens
tgttgttaatgaaaatg

SEQ ID NO: 1285817 - DNA, 18 bp, Homo sapiens
tgttgttaatgaaaatgt

SEQ ID NO: 1285818 - DNA, 21 bp, Homo sapiens
tgttgttaatgaaaatgtcag

SEQ ID NO: 1285819 - DNA, 18 bp, Homo sapiens
tgttgttaatgaatatca

SEQ ID NO: 1285820 - DNA, 17 bp, Homo sapiens
tgttgttccattttatg

SEQ ID NO: 1285821 - DNA, 13 bp, Homo sapiens
tgttgttctgtta

SEQ ID NO: 1285822 - DNA, 13 bp, Homo sapiens
tgttgttggttgt

SEQ ID NO: 1285823 - DNA, 11 bp, Homo sapiens
tgttgttgtgt

SEQ ID NO: 1285824 - DNA, 17 bp, Homo sapiens
tgttgttgtgtgtatat

SEQ ID NO: 1285825 - DNA, 15 bp, Homo sapiens
tgttgttgttctttc

SEQ ID NO: 1285826 - DNA, 21 bp, Homo sapiens
tgttgtttataataaaaatat

SEQ ID NO: 1285827 - DNA, 15 bp, Homo sapiens
tgttgtttcttaaat

SEQ ID NO: 1285828 - DNA, 21 bp, Homo sapiens
tgttgtttcttaaataagaaa

SEQ ID NO: 1285829 - DNA, 21 bp, Homo sapiens
tgttgtttgtaaataagagat

SEQ ID NO: 1285830 - DNA, 18 bp, Homo sapiens
tgttgttttactaaagaa

SEQ ID NO: 1285831 - DNA, 16 bp, Homo sapiens
tgttgttttgtatgag

SEQ ID NO: 1285832 - DNA, 22 bp, Homo sapiens
tgttgttttttcatagtgcctt

SEQ ID NO: 1285833 - DNA, 19 bp, Homo sapiens
tgtttaaaaagtaagttaa

SEQ ID NO: 1285834 - DNA, 17 bp, Homo sapiens
tgtttaaaattcagttt

SEQ ID NO: 1285835 - DNA, 16 bp, Homo sapiens
tgtttaaaattctctt

SEQ ID NO: 1285836 - DNA, 19 bp, Homo sapiens
tgtttaaactttgacaaaa

SEQ ID NO: 1285837 - DNA, 19 bp, Homo sapiens
tgtttaaactttgtgcctt

SEQ ID NO: 1285838 - DNA, 13 bp, Homo sapiens
tgtttaaagttca

SEQ ID NO: 1285839 - DNA, 16 bp, Homo sapiens
tgtttaaataaagacc

SEQ ID NO: 1285840 - DNA, 20 bp, Homo sapiens
tgtttaaataaagtatcatg

SEQ ID NO: 1285841 - DNA, 22 bp, Homo sapiens
tgtttaaataaagtatcatgca

SEQ ID NO: 1285842 - DNA, 17 bp, Homo sapiens
tgtttaaatagcctaaa

SEQ ID NO: 1285843 - DNA, 14 bp, Homo sapiens
tgtttaaatcatgt

SEQ ID NO: 1285844 - DNA, 15 bp, Homo sapiens
tgtttaaatgccaaa

SEQ ID NO: 1285845 - DNA, 16 bp, Homo sapiens
tgtttaaatgccaaaa

SEQ ID NO: 1285846 - DNA, 22 bp, Homo sapiens
tgtttaacacttctgtatgcat

SEQ ID NO: 1285847 - DNA, 18 bp, Homo sapiens
tgtttaacattcacagcc

SEQ ID NO: 1285848 - DNA, 20 bp, Homo sapiens
tgtttaagccagagtgtatt

SEQ ID NO: 1285849 - DNA, 14 bp, Homo sapiens
tgtttaagctgagc

SEQ ID NO: 1285850 - DNA, 12 bp, Homo sapiens
ttaaaaatacat

SEQ ID NO: 1285851 - DNA, 23 bp, Homo sapiens
ttaaaaataccaatcacaaggat

SEQ ID NO: 1285852 - DNA, 23 bp, Homo sapiens
ttaaaaataccttctatgtatta

SEQ ID NO: 1285853 - DNA, 13 bp, Homo sapiens
ttaaaaatataaa

SEQ ID NO: 1285854 - DNA, 16 bp, Homo sapiens
ttaaaaatataaaact

SEQ ID NO: 1285855 - DNA, 17 bp, Homo sapiens
ttaaaaatatttcagat

SEQ ID NO: 1285856 - DNA, 20 bp, Homo sapiens
ttaaaaatggctcaagtaga

SEQ ID NO: 1285857 - DNA, 21 bp, Homo sapiens
ttaaaaatggctcaagtagaa

SEQ ID NO: 1285858 - DNA, 19 bp, Homo sapiens
ttaaaaatggtatcaaaat

SEQ ID NO: 1285859 - DNA, 13 bp, Homo sapiens
ttaaaaatgtaaa

SEQ ID NO: 1285860 - DNA, 12 bp, Homo sapiens
ttaaaaatgtgg

SEQ ID NO: 1285861 - DNA, 16 bp, Homo sapiens
ttaaaaatgttctcaa

SEQ ID NO: 1285862 - DNA, 20 bp, Homo sapiens
ttaaaaattacctttaattt

SEQ ID NO: 1285863 - DNA, 13 bp, Homo sapiens
ttaaaaattgttt

SEQ ID NO: 1285864 - DNA, 15 bp, Homo sapiens
ttaaaacaaaagggt

SEQ ID NO: 1285865 - DNA, 18 bp, Homo sapiens
ttaaaacaaaggaactaa

SEQ ID NO: 1285866 - DNA, 20 bp, Homo sapiens
ttaaaacaaaggaactaact

SEQ ID NO: 1285867 - DNA, 17 bp, Homo sapiens
ttaaaacaaatatacat

SEQ ID NO: 1285868 - DNA, 13 bp, Homo sapiens
ttaaaacaatttt

SEQ ID NO: 1285869 - DNA, 15 bp, Homo sapiens
ttaaaacactaaaag

SEQ ID NO: 1285870 - DNA, 12 bp, Homo sapiens
ttaaaacacttt

SEQ ID NO: 1285871 - DNA, 21 bp, Homo sapiens
ttaaaacagctgcattagaaa

SEQ ID NO: 1285872 - DNA, 15 bp, Homo sapiens
ttaaaacaggcaaag

SEQ ID NO: 1285873 - DNA, 17 bp, Homo sapiens
ttaaaacaggcaaagtt

SEQ ID NO: 1285874 - DNA, 18 bp, Homo sapiens
ttaaaacatactctgccg

SEQ ID NO: 1285875 - DNA, 17 bp, Homo sapiens
ttaaaacatatttcatt

SEQ ID NO: 1285876 - DNA, 14 bp, Homo sapiens
ttaaaaccaaagag

SEQ ID NO: 1285877 - DNA, 21 bp, Homo sapiens
ttaaaacgcgtctgcctgggc

SEQ ID NO: 1285878 - DNA, 13 bp, Homo sapiens
ttaaaactgagtc

SEQ ID NO: 1285879 - DNA, 22 bp, Homo sapiens
ttaaaactgagtccatgaaaat

SEQ ID NO: 1285880 - DNA, 23 bp, Homo sapiens
ttaaaactgagtccatgaaaata

SEQ ID NO: 1285881 - DNA, 22 bp, Homo sapiens
ttaaaactgcttttttttttcc

SEQ ID NO: 1285882 - DNA, 22 bp, Homo sapiens
ttaaaagaaaataaaaaaaaga

SEQ ID NO: 1285883 - DNA, 19 bp, Homo sapiens
ttaaaagaaatatacagtt

SEQ ID NO: 1285884 - DNA, 21 bp, Homo sapiens
ttaaaagaaatatacagtttg

SEQ ID NO: 1285885 - DNA, 12 bp, Homo sapiens
ttaaaagaatga

SEQ ID NO: 1285886 - DNA, 15 bp, Homo sapiens
ttaaaagacaagact

SEQ ID NO: 1285887 - DNA, 16 bp, Homo sapiens
ttaaaagacaagactt

SEQ ID NO: 1285888 - DNA, 14 bp, Homo sapiens
ttaaaagacactgt

SEQ ID NO: 1285889 - DNA, 12 bp, Homo sapiens
ttaaaagagacc

SEQ ID NO: 1285890 - DNA, 23 bp, Homo sapiens
ttaaaagagagagagagaaaaaa

SEQ ID NO: 1285891 - DNA, 23 bp, Homo sapiens
ttaaaagattatctcagaaagta

SEQ ID NO: 1285892 - DNA, 15 bp, Homo sapiens
ttaaaagcaaaaaga

SEQ ID NO: 1285893 - DNA, 14 bp, Homo sapiens
ttaaaagcattttt

SEQ ID NO: 1285894 - DNA, 17 bp, Homo sapiens
ttaaaagccatgtataa

SEQ ID NO: 1285895 - DNA, 23 bp, Homo sapiens
ttaaaaggaaagtcaagaagaat

SEQ ID NO: 1285896 - DNA, 20 bp, Homo sapiens
ttaaaaggatgtataaattt

SEQ ID NO: 1285897 - DNA, 11 bp, Homo sapiens
ttaaaaggcaa

SEQ ID NO: 1285898 - DNA, 13 bp, Homo sapiens
ttaaaaggcaact

SEQ ID NO: 1285899 - DNA, 14 bp, Homo sapiens
ttaaaaggggccca

SEQ ID NO: 1285900 - DNA, 15 bp, Homo sapiens
ttaaaagtaaaatgt

SEQ ID NO: 1285901 - DNA, 14 bp, Homo sapiens
ttaaaagtaaatgt

SEQ ID NO: 1285902 - DNA, 12 bp, Homo sapiens
ttaaaagtactt

SEQ ID NO: 1285903 - DNA, 20 bp, Homo sapiens
ttaaaagtatctttaacaat

SEQ ID NO: 1285904 - DNA, 23 bp, Homo sapiens
ttaaaagtcagtatcatattatt

SEQ ID NO: 1285905 - DNA, 16 bp, Homo sapiens
ttaaaagtttcaatgt

SEQ ID NO: 1285906 - DNA, 16 bp, Homo sapiens
ttaaaataaaaattct

SEQ ID NO: 1285907 - DNA, 20 bp, Homo sapiens
ttaaaataaaaattctgaat

SEQ ID NO: 1285908 - DNA, 13 bp, Homo sapiens
ttaaaataaaaca

SEQ ID NO: 1285909 - DNA, 14 bp, Homo sapiens
ttaaaataaaatga

SEQ ID NO: 1285910 - DNA, 17 bp, Homo sapiens
ttaaaataaaatgaaaa

SEQ ID NO: 1285911 - DNA, 15 bp, Homo sapiens
ttaaaataactagtg

SEQ ID NO: 1285912 - DNA, 12 bp, Homo sapiens
ttaaaataatat

SEQ ID NO: 1285913 - DNA, 17 bp, Homo sapiens
ttaaaatacaagactgc

SEQ ID NO: 1285914 - DNA, 14 bp, Homo sapiens
ttaaaatacttatt

SEQ ID NO: 1285915 - DNA, 21 bp, Homo sapiens
ttaaaatagaaattttgtaag

SEQ ID NO: 1285916 - DNA, 16 bp, Homo sapiens
ttaaaatatagagaca

SEQ ID NO: 1285917 - DNA, 14 bp, Homo sapiens
ttaaaatatatgta

SEQ ID NO: 1285918 - DNA, 14 bp, Homo sapiens
ttaaaatatcttcc

SEQ ID NO: 1285919 - DNA, 18 bp, Homo sapiens
ttaaaatatcttcctttg

SEQ ID NO: 1285920 - DNA, 18 bp, Homo sapiens
ttaaaatatgtgaagttt

SEQ ID NO: 1285921 - DNA, 21 bp, Homo sapiens
ttaaaatattatttgatatct

SEQ ID NO: 1285922 - DNA, 17 bp, Homo sapiens
ttaaaatatttaacttt

SEQ ID NO: 1285923 - DNA, 12 bp, Homo sapiens
ttaaaatatttt

SEQ ID NO: 1285924 - DNA, 17 bp, Homo sapiens
ttaaaatattttggatg

SEQ ID NO: 1285925 - DNA, 15 bp, Homo sapiens
ttaaaatcacatttt

SEQ ID NO: 1285926 - DNA, 20 bp, Homo sapiens
ttaaaatcacattttaagtg

SEQ ID NO: 1285927 - DNA, 23 bp, Homo sapiens
ttaaaatcacattttaagtgctt

SEQ ID NO: 1285928 - DNA, 16 bp, Homo sapiens
ttaaaatcatgatcct

SEQ ID NO: 1285929 - DNA, 13 bp, Homo sapiens
ttaaaatccagta

SEQ ID NO: 1285930 - DNA, 13 bp, Homo sapiens
ttaaaatcctcaa

SEQ ID NO: 1285931 - DNA, 13 bp, Homo sapiens
ttaaaatctactt

SEQ ID NO: 1285932 - DNA, 19 bp, Homo sapiens
ttaaaatctcttgattata

SEQ ID NO: 1285933 - DNA, 18 bp, Homo sapiens
ttaaaatctgatttaatg

SEQ ID NO: 1285934 - DNA, 14 bp, Homo sapiens
ttaaaatctggaaa

SEQ ID NO: 1285935 - DNA, 15 bp, Homo sapiens
ttaaaatctggaaat

SEQ ID NO: 1285936 - DNA, 13 bp, Homo sapiens
ttaaaatgcgaaa

SEQ ID NO: 1285937 - DNA, 14 bp, Homo sapiens
ttaaaatgcgaaat

SEQ ID NO: 1285938 - DNA, 21 bp, Homo sapiens
ttaaaatggtttgtcctgatg

SEQ ID NO: 1285939 - DNA, 13 bp, Homo sapiens
ttaaaatgtacac

SEQ ID NO: 1285940 - DNA, 16 bp, Homo sapiens
ttaaaatgtacactgg

SEQ ID NO: 1285941 - DNA, 14 bp, Homo sapiens
ttaaaatgtgattt

SEQ ID NO: 1285942 - DNA, 20 bp, Homo sapiens
ttaaaatgtgtatttttcaa

SEQ ID NO: 1285943 - DNA, 17 bp, Homo sapiens
ttaaaatgtttgagcac

SEQ ID NO: 1285944 - DNA, 17 bp, Homo sapiens
ttaaaattaagttgaaa

SEQ ID NO: 1285945 - DNA, 20 bp, Homo sapiens
ttaaaattaagttgaaaaag

SEQ ID NO: 1285946 - DNA, 12 bp, Homo sapiens
ttaaaattcaaa

SEQ ID NO: 1285947 - DNA, 13 bp, Homo sapiens
ttaaaattcagtt

SEQ ID NO: 1285948 - DNA, 12 bp, Homo sapiens
ttaaaattctct

SEQ ID NO: 1285949 - DNA, 15 bp, Homo sapiens
ttaaaattctgaatt

SEQ ID NO: 1285950 - DNA, 22 bp, Homo sapiens
ttaaaattgatttttctcttca

SEQ ID NO: 1285951 - DNA, 14 bp, Homo sapiens
ttaaaattggcacc

SEQ ID NO: 1285952 - DNA, 18 bp, Homo sapiens
ttaaaatttgtcttaaaa

SEQ ID NO: 1285953 - DNA, 18 bp, Homo sapiens
ttaaaattttacctctct

SEQ ID NO: 1285954 - DNA, 20 bp, Homo sapiens
ttaaaattttggaatatttg

SEQ ID NO: 1285955 - DNA, 16 bp, Homo sapiens
ttaaacaaagcagtat

SEQ ID NO: 1285956 - DNA, 14 bp, Homo sapiens
ttaaacaaaggttg

SEQ ID NO: 1285957 - DNA, 13 bp, Homo sapiens
ttaaacaaataaa

SEQ ID NO: 1285958 - DNA, 15 bp, Homo sapiens
ttaaacaaatatgaa

SEQ ID NO: 1285959 - DNA, 21 bp, Homo sapiens
ttaaacaatctttcatgtctt

SEQ ID NO: 1285960 - DNA, 14 bp, Homo sapiens
ttaaacaatgtata

SEQ ID NO: 1285961 - DNA, 16 bp, Homo sapiens
ttaaacaatgtataaa

SEQ ID NO: 1285962 - DNA, 14 bp, Homo sapiens
ttaaacaattttgt

SEQ ID NO: 1285963 - DNA, 14 bp, Homo sapiens
ttaaacacaaagtg

SEQ ID NO: 1285964 - DNA, 14 bp, Homo sapiens
ttaaacactgtaat

SEQ ID NO: 1285965 - DNA, 15 bp, Homo sapiens
ttaaacactgtaatc

SEQ ID NO: 1285966 - DNA, 16 bp, Homo sapiens
ttaaacagatttttac

SEQ ID NO: 1285967 - DNA, 15 bp, Homo sapiens
ttaaacaggcccagc

SEQ ID NO: 1285968 - DNA, 16 bp, Homo sapiens
ttaaacaggcccagca

SEQ ID NO: 1285969 - DNA, 21 bp, Homo sapiens
ttaaacagggtctcactctgt

SEQ ID NO: 1285970 - DNA, 23 bp, Homo sapiens
ttaaacagtgagcctgaattttg

SEQ ID NO: 1285971 - DNA, 18 bp, Homo sapiens
ttaaacatgtaaatacaa

SEQ ID NO: 1285972 - DNA, 23 bp, Homo sapiens
ttaaacattaatagcagcctttc

SEQ ID NO: 1285973 - DNA, 16 bp, Homo sapiens
ttaactgaataccact

SEQ ID NO: 1285974 - DNA, 20 bp, Homo sapiens
ttaactgaataccactctgt

SEQ ID NO: 1285975 - DNA, 21 bp, Homo sapiens
ttaactgaataccactctgta

SEQ ID NO: 1285976 - DNA, 21 bp, Homo sapiens
ttaactgatttaacacttttt

SEQ ID NO: 1285977 - DNA, 22 bp, Homo sapiens
ttaactgcactcatagggtgct

SEQ ID NO: 1285978 - DNA, 15 bp, Homo sapiens
ttaactggcatggat

SEQ ID NO: 1285979 - DNA, 21 bp, Homo sapiens
ttaactgggtaatgaaacaaa

SEQ ID NO: 1285980 - DNA, 23 bp, Homo sapiens
ttaactggtgcactttgtaaatt

SEQ ID NO: 1285981 - DNA, 15 bp, Homo sapiens
ttaactgtaaacttg

SEQ ID NO: 1285982 - DNA, 16 bp, Homo sapiens
ttaactgtaaacttgg

SEQ ID NO: 1285983 - DNA, 21 bp, Homo sapiens
ttaactgtagtgcctcctaat

SEQ ID NO: 1285984 - DNA, 15 bp, Homo sapiens
ttaacttaaatagta

SEQ ID NO: 1285985 - DNA, 18 bp, Homo sapiens
ttaacttaacattctgta

SEQ ID NO: 1285986 - DNA, 22 bp, Homo sapiens
ttaacttcagagggaaagtaaa

SEQ ID NO: 1285987 - DNA, 16 bp, Homo sapiens
ttaacttcttcataat

SEQ ID NO: 1285988 - DNA, 21 bp, Homo sapiens
ttaacttcttgcttctttcta

SEQ ID NO: 1285989 - DNA, 15 bp, Homo sapiens
ttaacttgagtttta

SEQ ID NO: 1285990 - DNA, 19 bp, Homo sapiens
ttaacttgttaccattgta

SEQ ID NO: 1285991 - DNA, 16 bp, Homo sapiens
ttaactttaagactga

SEQ ID NO: 1285992 - DNA, 14 bp, Homo sapiens
ttaactttaatgtt

SEQ ID NO: 1285993 - DNA, 18 bp, Homo sapiens
ttaactttatcacattat

SEQ ID NO: 1285994 - DNA, 17 bp, Homo sapiens
ttaacttttataaactt

SEQ ID NO: 1285995 - DNA, 20 bp, Homo sapiens
ttaagaaaaaataacacaca

SEQ ID NO: 1285996 - DNA, 20 bp, Homo sapiens
ttaagaaaaaggatgcacag

SEQ ID NO: 1285997 - DNA, 22 bp, Homo sapiens
ttaagaaaaatgaaaacttttg

SEQ ID NO: 1285998 - DNA, 14 bp, Homo sapiens
ttaagaaaagagat

SEQ ID NO: 1285999 - DNA, 17 bp, Homo sapiens
ttaagaaaatacaataa

SEQ ID NO: 1286000 - DNA, 18 bp, Homo sapiens
ttaagaaaatacaataaa

SEQ ID NO: 1286001 - DNA, 14 bp, Homo sapiens
ttaagaaacactga

SEQ ID NO: 1286002 - DNA, 9 bp, Homo sapiens
ttaagaaag

SEQ ID NO: 1286003 - DNA, 13 bp, Homo sapiens
ttaagaaagagaa

SEQ ID NO: 1286004 - DNA, 19 bp, Homo sapiens
ttaagaaaggatataaaag

SEQ ID NO: 1286005 - DNA, 21 bp, Homo sapiens
ttaagaaaggatataaaagga

SEQ ID NO: 1286006 - DNA, 17 bp, Homo sapiens
ttaagaaccttattttg

SEQ ID NO: 1286007 - DNA, 13 bp, Homo sapiens
ttaagaactgtgt

SEQ ID NO: 1286008 - DNA, 16 bp, Homo sapiens
ttaagaactgtgtctg

SEQ ID NO: 1286009 - DNA, 13 bp, Homo sapiens
ttaagaagaaact

SEQ ID NO: 1286010 - DNA, 12 bp, Homo sapiens
ttaagaaggcaa

SEQ ID NO: 1286011 - DNA, 18 bp, Homo sapiens
ttaagaaggcaaaaatgt

SEQ ID NO: 1286012 - DNA, 20 bp, Homo sapiens
ttaagaatatgtttccttgt

SEQ ID NO: 1286013 - DNA, 16 bp, Homo sapiens
ttaagaatttcacaag

SEQ ID NO: 1286014 - DNA, 16 bp, Homo sapiens
ttaagacactgtgaga

SEQ ID NO: 1286015 - DNA, 16 bp, Homo sapiens
ttaagacagtgtacaa

SEQ ID NO: 1286016 - DNA, 16 bp, Homo sapiens
ttaagacatgatttcc

SEQ ID NO: 1286017 - DNA, 18 bp, Homo sapiens
ttaagacatgatttcctt

SEQ ID NO: 1286018 - DNA, 15 bp, Homo sapiens
ttaagaccagcctgg

SEQ ID NO: 1286019 - DNA, 13 bp, Homo sapiens
ttaagacgtgttt

SEQ ID NO: 1286020 - DNA, 16 bp, Homo sapiens
ttaagactgaatgttt

SEQ ID NO: 1286021 - DNA, 22 bp, Homo sapiens
ttaagactgataattttacaat

SEQ ID NO: 1286022 - DNA, 23 bp, Homo sapiens
ttaagacttaatgagactttaaa

SEQ ID NO: 1286023 - DNA, 13 bp, Homo sapiens
ttaagacttgaca

SEQ ID NO: 1286024 - DNA, 17 bp, Homo sapiens
ttaagacttgacagtgg

SEQ ID NO: 1286025 - DNA, 22 bp, Homo sapiens
ttaagagaagacctagctatgt

SEQ ID NO: 1286026 - DNA, 16 bp, Homo sapiens
ttaagagacagtttcg

SEQ ID NO: 1286027 - DNA, 15 bp, Homo sapiens
ttaagagactcttta

SEQ ID NO: 1286028 - DNA, 22 bp, Homo sapiens
ttaagagatcccttaagaagtt

SEQ ID NO: 1286029 - DNA, 17 bp, Homo sapiens
ttaagagcttgatctgt

SEQ ID NO: 1286030 - DNA, 12 bp, Homo sapiens
ttaagaggcttt

SEQ ID NO: 1286031 - DNA, 14 bp, Homo sapiens
ttaagagtccaact

SEQ ID NO: 1286032 - DNA, 22 bp, Homo sapiens
ttaagagtggcatataattttc

SEQ ID NO: 1286033 - DNA, 21 bp, Homo sapiens
ttaagataatagtttacatgt

SEQ ID NO: 1286034 - DNA, 14 bp, Homo sapiens
ttaagataattata

SEQ ID NO: 1286035 - DNA, 16 bp, Homo sapiens
ttaagataattataat

SEQ ID NO: 1286036 - DNA, 15 bp, Homo sapiens
ttaagatacaaatta

SEQ ID NO: 1286037 - DNA, 20 bp, Homo sapiens
ttaagatacaaattaatttt

SEQ ID NO: 1286038 - DNA, 17 bp, Homo sapiens
ttaagatggattctcag

SEQ ID NO: 1286039 - DNA, 22 bp, Homo sapiens
ttaagatggattctcagatatt

SEQ ID NO: 1286040 - DNA, 18 bp, Homo sapiens
ttaagatgtacatttaat

SEQ ID NO: 1286041 - DNA, 17 bp, Homo sapiens
ttaagatttctttatgt

SEQ ID NO: 1286042 - DNA, 23 bp, Homo sapiens
ttaagcaaaggggacagctgtgt

SEQ ID NO: 1286043 - DNA, 21 bp, Homo sapiens
ttaagcaaattttgtattatt

SEQ ID NO: 1286044 - DNA, 20 bp, Homo sapiens
ttaagcactacataaactga

SEQ ID NO: 1286045 - DNA, 17 bp, Homo sapiens
ttaagcactttgaaaat

SEQ ID NO: 1286046 - DNA, 18 bp, Homo sapiens
ttaagcactttgaaaata

SEQ ID NO: 1286047 - DNA, 17 bp, Homo sapiens
ttaagcagaacaaatgt

SEQ ID NO: 1286048 - DNA, 16 bp, Homo sapiens
ttaagcagaagcatta

SEQ ID NO: 1286049 - DNA, 17 bp, Homo sapiens
ttaagcaggcattgctt

SEQ ID NO: 1286050 - DNA, 20 bp, Homo sapiens
ttaagcattgggtgggtaaa

SEQ ID NO: 1286051 - DNA, 12 bp, Homo sapiens
ttaagcattgtt

SEQ ID NO: 1286052 - DNA, 19 bp, Homo sapiens
ttaagcattgtttgcttat

SEQ ID NO: 1286053 - DNA, 15 bp, Homo sapiens
ttaagcatttgtata

SEQ ID NO: 1286054 - DNA, 16 bp, Homo sapiens
ttaagcatttgtatat

SEQ ID NO: 1286055 - DNA, 18 bp, Homo sapiens
ttaagcatttgtatatta

SEQ ID NO: 1286056 - DNA, 20 bp, Homo sapiens
ttaagcatttgtatattaaa

SEQ ID NO: 1286057 - DNA, 13 bp, Homo sapiens
ttaagccactgcc

SEQ ID NO: 1286058 - DNA, 16 bp, Homo sapiens
ttaagccactgcctct

SEQ ID NO: 1286059 - DNA, 17 bp, Homo sapiens
ttaagccaggaaacatg

SEQ ID NO: 1286060 - DNA, 13 bp, Homo sapiens
ttaagcccaatct

SEQ ID NO: 1286061 - DNA, 22 bp, Homo sapiens
ttaagcctcatatttaaagaca

SEQ ID NO: 1286062 - DNA, 15 bp, Homo sapiens
ttaagccttcatttg

SEQ ID NO: 1286063 - DNA, 15 bp, Homo sapiens
ttaagctatcagcaa

SEQ ID NO: 1286064 - DNA, 17 bp, Homo sapiens
ttaagctttgtgaaaga

SEQ ID NO: 1286065 - DNA, 14 bp, Homo sapiens
ttaagctttttgga

SEQ ID NO: 1286066 - DNA, 13 bp, Homo sapiens
ttaaggaattttg

SEQ ID NO: 1286067 - DNA, 19 bp, Homo sapiens
ttaaggacaaaaatgaact

SEQ ID NO: 1286068 - DNA, 14 bp, Homo sapiens
ttaaggataaatca

SEQ ID NO: 1286069 - DNA, 19 bp, Homo sapiens
ttaaggatgcttgtacata

SEQ ID NO: 1286070 - DNA, 20 bp, Homo sapiens
ttaaggatgcttgtacataa

SEQ ID NO: 1286071 - DNA, 20 bp, Homo sapiens
ttaaggattgtgatattttt

SEQ ID NO: 1286072 - DNA, 17 bp, Homo sapiens
ttaaggcacagtgggag

SEQ ID NO: 1286073 - DNA, 11 bp, Homo sapiens
ttaaggcctga

SEQ ID NO: 1286074 - DNA, 15 bp, Homo sapiens
ttaaggcctgaatca

SEQ ID NO: 1286075 - DNA, 13 bp, Homo sapiens
ttaaggcttcccc

SEQ ID NO: 1286076 - DNA, 15 bp, Homo sapiens
ttaagggaaaaatat

SEQ ID NO: 1286077 - DNA, 21 bp, Homo sapiens
ttaagggatggaaaaggaaga

SEQ ID NO: 1286078 - DNA, 23 bp, Homo sapiens
ttaaggggggcagggagtgatga

SEQ ID NO: 1286079 - DNA, 15 bp, Homo sapiens
ttaagggttaagaaa

SEQ ID NO: 1286080 - DNA, 18 bp, Homo sapiens
ttaaggtaactactgcta

SEQ ID NO: 1286081 - DNA, 14 bp, Homo sapiens
ttaaggtcccccga

SEQ ID NO: 1286082 - DNA, 14 bp, Homo sapiens
ttaagtaaaaaaga

SEQ ID NO: 1286083 - DNA, 16 bp, Homo sapiens
ttaagtaacttaagga

SEQ ID NO: 1286084 - DNA, 15 bp, Homo sapiens
ttaagtaatcttttt

SEQ ID NO: 1286085 - DNA, 15 bp, Homo sapiens
ttaagtacccgaggc

SEQ ID NO: 1286086 - DNA, 22 bp, Homo sapiens
ttaagtagaaaagttgcagatg

SEQ ID NO: 1286087 - DNA, 13 bp, Homo sapiens
ttaagtagatttc

SEQ ID NO: 1286088 - DNA, 21 bp, Homo sapiens
ttaagtatacaacaggagaga

SEQ ID NO: 1286089 - DNA, 14 bp, Homo sapiens
ttaagtatatagta

SEQ ID NO: 1286090 - DNA, 21 bp, Homo sapiens
ttaagtatatagtatatttat

SEQ ID NO: 1286091 - DNA, 14 bp, Homo sapiens
ttaagtatcttttt

SEQ ID NO: 1286092 - DNA, 18 bp, Homo sapiens
ttaagtatggaatattca

SEQ ID NO: 1286093 - DNA, 15 bp, Homo sapiens
ttaagtattgcatct

SEQ ID NO: 1286094 - DNA, 19 bp, Homo sapiens
ttaagtattgcatctgtat

SEQ ID NO: 1286095 - DNA, 20 bp, Homo sapiens
ttaccaataggcaaattaat

SEQ ID NO: 1286096 - DNA, 23 bp, Homo sapiens
ttaccactctaccaaataatttc

SEQ ID NO: 1286097 - DNA, 17 bp, Homo sapiens
ttaccagaagcttccat

SEQ ID NO: 1286098 - DNA, 15 bp, Homo sapiens
ttaccagacaaaaaa

SEQ ID NO: 1286099 - DNA, 20 bp, Homo sapiens
ttaccagagcctctttgctg

SEQ ID NO: 1286100 - DNA, 19 bp, Homo sapiens
ttaccagataatgctactt

SEQ ID NO: 1286101 - DNA, 19 bp, Homo sapiens
ttaccagatgctgactggc

SEQ ID NO: 1286102 - DNA, 22 bp, Homo sapiens
ttaccagcaagaataaaaaaga

SEQ ID NO: 1286103 - DNA, 14 bp, Homo sapiens
ttaccagtctgatt

SEQ ID NO: 1286104 - DNA, 15 bp, Homo sapiens
ttaccagtctgatta

SEQ ID NO: 1286105 - DNA, 18 bp, Homo sapiens
ttaccagtgccttaaact

SEQ ID NO: 1286106 - DNA, 19 bp, Homo sapiens
ttaccagttgccttttatc

SEQ ID NO: 1286107 - DNA, 17 bp, Homo sapiens
ttaccataaagccttta

SEQ ID NO: 1286108 - DNA, 14 bp, Homo sapiens
ttaccataatctta

SEQ ID NO: 1286109 - DNA, 22 bp, Homo sapiens
ttaccatactgtctctggagtg

SEQ ID NO: 1286110 - DNA, 23 bp, Homo sapiens
ttaccatactgtctctggagtga

SEQ ID NO: 1286111 - DNA, 11 bp, Homo sapiens
ttaccatgaga

SEQ ID NO: 1286112 - DNA, 23 bp, Homo sapiens
ttaccattaattacatacagatt

SEQ ID NO: 1286113 - DNA, 23 bp, Homo sapiens
ttaccatttgtaataaagtatat

SEQ ID NO: 1286114 - DNA, 21 bp, Homo sapiens
ttacccagagaatatatacat

SEQ ID NO: 1286115 - DNA, 21 bp, Homo sapiens
ttacccagtgggacagaggag

SEQ ID NO: 1286116 - DNA, 23 bp, Homo sapiens
ttaccccataccccttattgctg

SEQ ID NO: 1286117 - DNA, 14 bp, Homo sapiens
ttaccccttagcct

SEQ ID NO: 1286118 - DNA, 16 bp, Homo sapiens
ttaccccttagcctcc

SEQ ID NO: 1286119 - DNA, 12 bp, Homo sapiens
ttaccctgtgtc

SEQ ID NO: 1286120 - DNA, 16 bp, Homo sapiens
ttaccctttagactgt

SEQ ID NO: 1286121 - DNA, 17 bp, Homo sapiens
ttaccgagtatctgtaa

SEQ ID NO: 1286122 - DNA, 15 bp, Homo sapiens
ttaccgcgttgtaaa

SEQ ID NO: 1286123 - DNA, 20 bp, Homo sapiens
ttaccgtgtgttatataact

SEQ ID NO: 1286124 - DNA, 16 bp, Homo sapiens
ttaccgtttcttccct

SEQ ID NO: 1286125 - DNA, 16 bp, Homo sapiens
ttacctaaacagatat

SEQ ID NO: 1286126 - DNA, 13 bp, Homo sapiens
ttacctaaactga

SEQ ID NO: 1286127 - DNA, 11 bp, Homo sapiens
ttacctaaaga

SEQ ID NO: 1286128 - DNA, 21 bp, Homo sapiens
ttacctactgtgtcttggaat

SEQ ID NO: 1286129 - DNA, 23 bp, Homo sapiens
ttacctactttgactttttgcat

SEQ ID NO: 1286130 - DNA, 18 bp, Homo sapiens
ttacctagctaattattt

SEQ ID NO: 1286131 - DNA, 19 bp, Homo sapiens
ttacctattaggtggaaat

SEQ ID NO: 1286132 - DNA, 17 bp, Homo sapiens
ttacctcaacaagaaga

SEQ ID NO: 1286133 - DNA, 18 bp, Homo sapiens
ttacctcaggtgtgcctg

SEQ ID NO: 1286134 - DNA, 15 bp, Homo sapiens
ttacctcatccatgc

SEQ ID NO: 1286135 - DNA, 20 bp, Homo sapiens
ttacctcatccatgcacttt

SEQ ID NO: 1286136 - DNA, 11 bp, Homo sapiens
ttacctcctga

SEQ ID NO: 1286137 - DNA, 12 bp, Homo sapiens
ttacctcctgcc

SEQ ID NO: 1286138 - DNA, 14 bp, Homo sapiens
ttacctctctctgg

SEQ ID NO: 1286139 - DNA, 16 bp, Homo sapiens
ttacctctctgggacc

SEQ ID NO: 1286140 - DNA, 17 bp, Homo sapiens
ttacctctctgtcatgt

SEQ ID NO: 1286141 - DNA, 11 bp, Homo sapiens
ttacctctgat

SEQ ID NO: 1286142 - DNA, 12 bp, Homo sapiens
ttacctctggaa

SEQ ID NO: 1286143 - DNA, 13 bp, Homo sapiens
ttacctctggaac

SEQ ID NO: 1286144 - DNA, 21 bp, Homo sapiens
ttacctctggaaccccccagg

SEQ ID NO: 1286145 - DNA, 23 bp, Homo sapiens
ttacctctggaaccccccaggcc

SEQ ID NO: 1286146 - DNA, 20 bp, Homo sapiens
ttacctcttaacaatttctg

SEQ ID NO: 1286147 - DNA, 23 bp, Homo sapiens
ttacctcttgcccttgggtgcta

SEQ ID NO: 1286148 - DNA, 12 bp, Homo sapiens
ttacctctttaa

SEQ ID NO: 1286149 - DNA, 18 bp, Homo sapiens
ttacctgaaaacactgtg

SEQ ID NO: 1286150 - DNA, 18 bp, Homo sapiens
ttacctgacctcttgctg

SEQ ID NO: 1286151 - DNA, 19 bp, Homo sapiens
ttacctgacctcttgctgt

SEQ ID NO: 1286152 - DNA, 21 bp, Homo sapiens
ttacctgacctcttgctgtct

SEQ ID NO: 1286153 - DNA, 13 bp, Homo sapiens
ttacctggtgctc

SEQ ID NO: 1286154 - DNA, 13 bp, Homo sapiens
ttacctgtacctg

SEQ ID NO: 1286155 - DNA, 19 bp, Homo sapiens
ttacctgtatacagtgcag

SEQ ID NO: 1286156 - DNA, 20 bp, Homo sapiens
ttacctgtcttgctcctggg

SEQ ID NO: 1286157 - DNA, 20 bp, Homo sapiens
ttacctgttatttatcaatt

SEQ ID NO: 1286158 - DNA, 19 bp, Homo sapiens
ttaccttagattagctctg

SEQ ID NO: 1286159 - DNA, 22 bp, Homo sapiens
ttaccttagattagctctggac

SEQ ID NO: 1286160 - DNA, 12 bp, Homo sapiens
ttaccttgaaaa

SEQ ID NO: 1286161 - DNA, 21 bp, Homo sapiens
ttaccttgaaaaaaagaaaag

SEQ ID NO: 1286162 - DNA, 16 bp, Homo sapiens
ttaccttgtatactgt

SEQ ID NO: 1286163 - DNA, 20 bp, Homo sapiens
ttacctttatctttcacctt

SEQ ID NO: 1286164 - DNA, 12 bp, Homo sapiens
ttacctttcctg

SEQ ID NO: 1286165 - DNA, 18 bp, Homo sapiens
ttaccttttcagggctgg

SEQ ID NO: 1286166 - DNA, 13 bp, Homo sapiens
ttaccttttccta

SEQ ID NO: 1286167 - DNA, 14 bp, Homo sapiens
ttaccttttcctat

SEQ ID NO: 1286168 - DNA, 16 bp, Homo sapiens
ttaccttttctataag

SEQ ID NO: 1286169 - DNA, 16 bp, Homo sapiens
ttacggacaccccctc

SEQ ID NO: 1286170 - DNA, 12 bp, Homo sapiens
ttacgtactgta

SEQ ID NO: 1286171 - DNA, 16 bp, Homo sapiens
ttacgtataatgcttt

SEQ ID NO: 1286172 - DNA, 19 bp, Homo sapiens
ttacgtgcaaacaacctga

SEQ ID NO: 1286173 - DNA, 21 bp, Homo sapiens
ttacgtgcaaacaacctgaat

SEQ ID NO: 1286174 - DNA, 19 bp, Homo sapiens
ttacgtgtatgtttcttct

SEQ ID NO: 1286175 - DNA, 17 bp, Homo sapiens
ttacgtgtttaaaaaaa

SEQ ID NO: 1286176 - DNA, 21 bp, Homo sapiens
ttacgttcatcacctgctaga

SEQ ID NO: 1286177 - DNA, 18 bp, Homo sapiens
ttactaaaaaaaagatga

SEQ ID NO: 1286178 - DNA, 15 bp, Homo sapiens
ttactaaaaagtata

SEQ ID NO: 1286179 - DNA, 21 bp, Homo sapiens
ttactaaacattttgttattg

SEQ ID NO: 1286180 - DNA, 18 bp, Homo sapiens
ttactaaagaaagattac

SEQ ID NO: 1286181 - DNA, 20 bp, Homo sapiens
ttactaaatggtgttacatt

SEQ ID NO: 1286182 - DNA, 15 bp, Homo sapiens
ttactaaattgtata

SEQ ID NO: 1286183 - DNA, 15 bp, Homo sapiens
ttactaactaaactc

SEQ ID NO: 1286184 - DNA, 20 bp, Homo sapiens
ttactaactaaactctcttt

SEQ ID NO: 1286185 - DNA, 15 bp, Homo sapiens
ttactaagaagaaaa

SEQ ID NO: 1286186 - DNA, 21 bp, Homo sapiens
ttactaagatgaaattgccaa

SEQ ID NO: 1286187 - DNA, 20 bp, Homo sapiens
ttactaagccacaagaaatt

SEQ ID NO: 1286188 - DNA, 23 bp, Homo sapiens
ttactaagttttcaaatttgtaa

SEQ ID NO: 1286189 - DNA, 19 bp, Homo sapiens
ttactaattctatttctct

SEQ ID NO: 1286190 - DNA, 21 bp, Homo sapiens
ttactaattctatttctctat

SEQ ID NO: 1286191 - DNA, 20 bp, Homo sapiens
ttactacaaaatttgaaatt

SEQ ID NO: 1286192 - DNA, 19 bp, Homo sapiens
ttactacactggtgtgtcc

SEQ ID NO: 1286193 - DNA, 16 bp, Homo sapiens
ttactaccctcaccct

SEQ ID NO: 1286194 - DNA, 21 bp, Homo sapiens
ttactaccttattttccccga

SEQ ID NO: 1286195 - DNA, 14 bp, Homo sapiens
ttactactcctttg

SEQ ID NO: 1286196 - DNA, 21 bp, Homo sapiens
ttactactgattttaaaatga

SEQ ID NO: 1286197 - DNA, 12 bp, Homo sapiens
ttactactgtac

SEQ ID NO: 1286198 - DNA, 14 bp, Homo sapiens
ttactactgtggaa

SEQ ID NO: 1286199 - DNA, 21 bp, Homo sapiens
ttactagagaatgttcccaat

SEQ ID NO: 1286200 - DNA, 20 bp, Homo sapiens
ttactagggatccctcatct

SEQ ID NO: 1286201 - DNA, 20 bp, Homo sapiens
ttactataatttgacttgaa

SEQ ID NO: 1286202 - DNA, 15 bp, Homo sapiens
ttactatagcaaagt

SEQ ID NO: 1286203 - DNA, 16 bp, Homo sapiens
ttactatagtctcttg

SEQ ID NO: 1286204 - DNA, 15 bp, Homo sapiens
ttactatagtggtga

SEQ ID NO: 1286205 - DNA, 14 bp, Homo sapiens
ttactattgaactg

SEQ ID NO: 1286206 - DNA, 21 bp, Homo sapiens
ttactattttctacaattaat

SEQ ID NO: 1286207 - DNA, 21 bp, Homo sapiens
ttactattttgacagttattt

SEQ ID NO: 1286208 - DNA, 21 bp, Homo sapiens
ttactcaccaccttagagcaa

SEQ ID NO: 1286209 - DNA, 17 bp, Homo sapiens
ttactcagaatagctgt

SEQ ID NO: 1286210 - DNA, 12 bp, Homo sapiens
ttactcagccct

SEQ ID NO: 1286211 - DNA, 19 bp, Homo sapiens
ttactcaggggatgtttac

SEQ ID NO: 1286212 - DNA, 12 bp, Homo sapiens
ttactcagtgtt

SEQ ID NO: 1286213 - DNA, 19 bp, Homo sapiens
ttactcatcgggcccaggg

SEQ ID NO: 1286214 - DNA, 20 bp, Homo sapiens
ttactcattaaaaataatag

SEQ ID NO: 1286215 - DNA, 17 bp, Homo sapiens
ttactcattatcgcctt

SEQ ID NO: 1286216 - DNA, 21 bp, Homo sapiens
ttactccaaggtttataaagc

SEQ ID NO: 1286217 - DNA, 21 bp, Homo sapiens
ttagcttagacctcagcctgt

SEQ ID NO: 1286218 - DNA, 18 bp, Homo sapiens
ttagcttattgatcccac

SEQ ID NO: 1286219 - DNA, 14 bp, Homo sapiens
ttagcttcagttgt

SEQ ID NO: 1286220 - DNA, 15 bp, Homo sapiens
ttagcttcagttgtt

SEQ ID NO: 1286221 - DNA, 18 bp, Homo sapiens
ttagcttcagttgttctt

SEQ ID NO: 1286222 - DNA, 19 bp, Homo sapiens
ttagcttcagttgttcttt

SEQ ID NO: 1286223 - DNA, 18 bp, Homo sapiens
ttagcttcctccagagga

SEQ ID NO: 1286224 - DNA, 16 bp, Homo sapiens
ttagctttttctcaga

SEQ ID NO: 1286225 - DNA, 21 bp, Homo sapiens
ttaggaaaatcactttgtcta

SEQ ID NO: 1286226 - DNA, 13 bp, Homo sapiens
ttaggaaaatgag

SEQ ID NO: 1286227 - DNA, 18 bp, Homo sapiens
ttaggaaataaaaccttt

SEQ ID NO: 1286228 - DNA, 20 bp, Homo sapiens
ttaggaaataaaacctttca

SEQ ID NO: 1286229 - DNA, 18 bp, Homo sapiens
ttaggaaggcagcattcc

SEQ ID NO: 1286230 - DNA, 13 bp, Homo sapiens
ttaggaagtgtaa

SEQ ID NO: 1286231 - DNA, 14 bp, Homo sapiens
ttaggaataataaa

SEQ ID NO: 1286232 - DNA, 16 bp, Homo sapiens
ttaggaataataaatt

SEQ ID NO: 1286233 - DNA, 15 bp, Homo sapiens
ttaggaatctcttca

SEQ ID NO: 1286234 - DNA, 19 bp, Homo sapiens
ttaggaattgtttatacac

SEQ ID NO: 1286235 - DNA, 21 bp, Homo sapiens
ttaggagatttaccacttttt

SEQ ID NO: 1286236 - DNA, 20 bp, Homo sapiens
ttaggaggctgcatgctctg

SEQ ID NO: 1286237 - DNA, 21 bp, Homo sapiens
ttaggaggctgcatgctctgg

SEQ ID NO: 1286238 - DNA, 20 bp, Homo sapiens
ttaggagtggttctcatttg

SEQ ID NO: 1286239 - DNA, 21 bp, Homo sapiens
ttaggatttaacagtcattta

SEQ ID NO: 1286240 - DNA, 16 bp, Homo sapiens
ttaggcattatttaat

SEQ ID NO: 1286241 - DNA, 17 bp, Homo sapiens
ttaggcattatttaatg

SEQ ID NO: 1286242 - DNA, 19 bp, Homo sapiens
ttaggcatttcctgctgaa

SEQ ID NO: 1286243 - DNA, 15 bp, Homo sapiens
ttaggctattcacaa

SEQ ID NO: 1286244 - DNA, 19 bp, Homo sapiens
ttaggctatttgtaaatct

SEQ ID NO: 1286245 - DNA, 17 bp, Homo sapiens
ttaggctggtggcccag

SEQ ID NO: 1286246 - DNA, 17 bp, Homo sapiens
ttaggctgtaactactt

SEQ ID NO: 1286247 - DNA, 15 bp, Homo sapiens
ttaggctgttggttc

SEQ ID NO: 1286248 - DNA, 14 bp, Homo sapiens
ttagggaagggcct

SEQ ID NO: 1286249 - DNA, 22 bp, Homo sapiens
ttagggagcagatgactgagaa

SEQ ID NO: 1286250 - DNA, 17 bp, Homo sapiens
ttagggcaccaggggtt

SEQ ID NO: 1286251 - DNA, 15 bp, Homo sapiens
ttagggcactgggct

SEQ ID NO: 1286252 - DNA, 17 bp, Homo sapiens
ttagggcttttattttt

SEQ ID NO: 1286253 - DNA, 15 bp, Homo sapiens
ttaggggaactgggt

SEQ ID NO: 1286254 - DNA, 16 bp, Homo sapiens
ttagggggtgggaggg

SEQ ID NO: 1286255 - DNA, 11 bp, Homo sapiens
ttagggtacag

SEQ ID NO: 1286256 - DNA, 21 bp, Homo sapiens
ttagggtgaaacttaaaaaaa

SEQ ID NO: 1286257 - DNA, 15 bp, Homo sapiens
ttagggtgggtaaga

SEQ ID NO: 1286258 - DNA, 16 bp, Homo sapiens
ttagggtgtgtgttca

SEQ ID NO: 1286259 - DNA, 13 bp, Homo sapiens
ttagggttttgca

SEQ ID NO: 1286260 - DNA, 20 bp, Homo sapiens
ttaggtcgttttccaaagag

SEQ ID NO: 1286261 - DNA, 12 bp, Homo sapiens
ttaggtctggtt

SEQ ID NO: 1286262 - DNA, 18 bp, Homo sapiens
ttaggtggcaagctgtga

SEQ ID NO: 1286263 - DNA, 19 bp, Homo sapiens
ttaggtgtgggggaagcac

SEQ ID NO: 1286264 - DNA, 22 bp, Homo sapiens
ttaggttccatcctttacgtgt

SEQ ID NO: 1286265 - DNA, 13 bp, Homo sapiens
ttaggttgttacc

SEQ ID NO: 1286266 - DNA, 14 bp, Homo sapiens
ttagtaaataaaat

SEQ ID NO: 1286267 - DNA, 12 bp, Homo sapiens
ttagtaacatgt

SEQ ID NO: 1286268 - DNA, 19 bp, Homo sapiens
ttagtaatagtccaatatt

SEQ ID NO: 1286269 - DNA, 15 bp, Homo sapiens
ttagtaatctgtata

SEQ ID NO: 1286270 - DNA, 21 bp, Homo sapiens
ttagtagaaattttacaatag

SEQ ID NO: 1286271 - DNA, 13 bp, Homo sapiens
ttagtagcatgtt

SEQ ID NO: 1286272 - DNA, 19 bp, Homo sapiens
ttagtataatatttcttaa

SEQ ID NO: 1286273 - DNA, 19 bp, Homo sapiens
ttagtatagctttatactc

SEQ ID NO: 1286274 - DNA, 13 bp, Homo sapiens
ttagtatcttttg

SEQ ID NO: 1286275 - DNA, 13 bp, Homo sapiens
ttagtattatctt

SEQ ID NO: 1286276 - DNA, 20 bp, Homo sapiens
ttagtattgttgtccttttc

SEQ ID NO: 1286277 - DNA, 23 bp, Homo sapiens
ttagtattgttgtccttttcata

SEQ ID NO: 1286278 - DNA, 20 bp, Homo sapiens
ttagtcacaccatcttaaat

SEQ ID NO: 1286279 - DNA, 15 bp, Homo sapiens
ttagtcatccaacaa

SEQ ID NO: 1286280 - DNA, 16 bp, Homo sapiens
ttagtcattgatagaa

SEQ ID NO: 1286281 - DNA, 18 bp, Homo sapiens
ttagtcattgatagaact

SEQ ID NO: 1286282 - DNA, 18 bp, Homo sapiens
ttagtctatcaaatgaaa

SEQ ID NO: 1286283 - DNA, 21 bp, Homo sapiens
ttagtctcagtttgtgtgtct

SEQ ID NO: 1286284 - DNA, 23 bp, Homo sapiens
ttagtctcagtttgtgtgtctta

SEQ ID NO: 1286285 - DNA, 15 bp, Homo sapiens
ttagtctgcaaaatg

SEQ ID NO: 1286286 - DNA, 14 bp, Homo sapiens
ttagtcttctcata

SEQ ID NO: 1286287 - DNA, 18 bp, Homo sapiens
ttagtcttctcatagcat

SEQ ID NO: 1286288 - DNA, 15 bp, Homo sapiens
ttagtgaaacataat

SEQ ID NO: 1286289 - DNA, 16 bp, Homo sapiens
ttagtgatatagtgct

SEQ ID NO: 1286290 - DNA, 16 bp, Homo sapiens
ttagtgattgtgtctg

SEQ ID NO: 1286291 - DNA, 19 bp, Homo sapiens
ttagtgcggacaagtttta

SEQ ID NO: 1286292 - DNA, 23 bp, Homo sapiens
ttagtggctcaacattgtgttcc

SEQ ID NO: 1286293 - DNA, 19 bp, Homo sapiens
ttagtggtttatcagcaaa

SEQ ID NO: 1286294 - DNA, 11 bp, Homo sapiens
ttagtgtatta

SEQ ID NO: 1286295 - DNA, 14 bp, Homo sapiens
ttagtgtcacttac

SEQ ID NO: 1286296 - DNA, 17 bp, Homo sapiens
ttagtgtccccccttga

SEQ ID NO: 1286297 - DNA, 14 bp, Homo sapiens
ttagtgtctgtcca

SEQ ID NO: 1286298 - DNA, 14 bp, Homo sapiens
ttagtgtgaatatt

SEQ ID NO: 1286299 - DNA, 22 bp, Homo sapiens
ttagtgtgacagtttccaaatt

SEQ ID NO: 1286300 - DNA, 14 bp, Homo sapiens
ttagtgtgtgtgca

SEQ ID NO: 1286301 - DNA, 17 bp, Homo sapiens
ttagtgtgtgtgcatgt

SEQ ID NO: 1286302 - DNA, 21 bp, Homo sapiens
ttagtgtgtgtgcatgtgtgt

SEQ ID NO: 1286303 - DNA, 22 bp, Homo sapiens
ttagtgtgtgtgcatgtgtgtg

SEQ ID NO: 1286304 - DNA, 17 bp, Homo sapiens
ttagttaaaacacatat

SEQ ID NO: 1286305 - DNA, 13 bp, Homo sapiens
ttagttaatatat

SEQ ID NO: 1286306 - DNA, 17 bp, Homo sapiens
ttagttaccgagacatg

SEQ ID NO: 1286307 - DNA, 18 bp, Homo sapiens
ttagttaccttatagtta

SEQ ID NO: 1286308 - DNA, 22 bp, Homo sapiens
ttagttaccttatagttactgt

SEQ ID NO: 1286309 - DNA, 15 bp, Homo sapiens
ttagttatagtgttt

SEQ ID NO: 1286310 - DNA, 17 bp, Homo sapiens
ttagttcaatacagtga

SEQ ID NO: 1286311 - DNA, 16 bp, Homo sapiens
ttagttcatatataca

SEQ ID NO: 1286312 - DNA, 12 bp, Homo sapiens
ttagttcccaac

SEQ ID NO: 1286313 - DNA, 22 bp, Homo sapiens
ttagttctgttgacctgtgcac

SEQ ID NO: 1286314 - DNA, 16 bp, Homo sapiens
ttagttcttgaattgt

SEQ ID NO: 1286315 - DNA, 20 bp, Homo sapiens
ttagttcttgaattgttatg

SEQ ID NO: 1286316 - DNA, 15 bp, Homo sapiens
ttagttctttgttat

SEQ ID NO: 1286317 - DNA, 19 bp, Homo sapiens
ttagttgaaaaatctagtt

SEQ ID NO: 1286318 - DNA, 22 bp, Homo sapiens
ttagttgacaacctagaatgtc

SEQ ID NO: 1286319 - DNA, 13 bp, Homo sapiens
ttagttggctgga

SEQ ID NO: 1286320 - DNA, 15 bp, Homo sapiens
ttagttggctttgcc

SEQ ID NO: 1286321 - DNA, 20 bp, Homo sapiens
ttagttgtatctcttttgaa

SEQ ID NO: 1286322 - DNA, 13 bp, Homo sapiens
ttagtttagtgtg

SEQ ID NO: 1286323 - DNA, 14 bp, Homo sapiens
ttagtttagtgtgt

SEQ ID NO: 1286324 - DNA, 18 bp, Homo sapiens
ttagtttgcctgcagttt

SEQ ID NO: 1286325 - DNA, 14 bp, Homo sapiens
ttagtttggattct

SEQ ID NO: 1286326 - DNA, 16 bp, Homo sapiens
ttagtttgtgtgttgt

SEQ ID NO: 1286327 - DNA, 15 bp, Homo sapiens
ttagttttagttgca

SEQ ID NO: 1286328 - DNA, 17 bp, Homo sapiens
ttagttttagttgcaga

SEQ ID NO: 1286329 - DNA, 21 bp, Homo sapiens
ttagttttatggcatgattta

SEQ ID NO: 1286330 - DNA, 16 bp, Homo sapiens
ttagtttttgatcaag

SEQ ID NO: 1286331 - DNA, 19 bp, Homo sapiens
ttagtttttgtaatttatt

SEQ ID NO: 1286332 - DNA, 14 bp, Homo sapiens
ttataaaaaatggt

SEQ ID NO: 1286333 - DNA, 15 bp, Homo sapiens
ttataaaaaatggtt

SEQ ID NO: 1286334 - DNA, 12 bp, Homo sapiens
ttataaaaagat

SEQ ID NO: 1286335 - DNA, 14 bp, Homo sapiens
ttataaaaagataa

SEQ ID NO: 1286336 - DNA, 21 bp, Homo sapiens
ttataaaaatattaagacaat

SEQ ID NO: 1286337 - DNA, 12 bp, Homo sapiens
ttataaaagtgt

SEQ ID NO: 1286338 - DNA, 16 bp, Homo sapiens
ttataaaattaagcaa

SEQ ID NO: 1286339 - DNA, 18 bp, Homo sapiens
ttataaaatttaacttct

SEQ ID NO: 1286340 - DNA, 22 bp, Homo sapiens
ttatgaaaaacatcccaaactt

SEQ ID NO: 1286341 - DNA, 13 bp, Homo sapiens
ttatgaaaaagat

SEQ ID NO: 1286342 - DNA, 13 bp, Homo sapiens
ttatgaaaataat

SEQ ID NO: 1286343 - DNA, 11 bp, Homo sapiens
ttatgaaacat

SEQ ID NO: 1286344 - DNA, 16 bp, Homo sapiens
ttatgaaacatatcat

SEQ ID NO: 1286345 - DNA, 14 bp, Homo sapiens
ttatgaaataaaga

SEQ ID NO: 1286346 - DNA, 14 bp, Homo sapiens
ttatgaacagctgt

SEQ ID NO: 1286347 - DNA, 15 bp, Homo sapiens
ttatgaacagctgtg

SEQ ID NO: 1286348 - DNA, 17 bp, Homo sapiens
ttatgaacagctgtgtc

SEQ ID NO: 1286349 - DNA, 18 bp, Homo sapiens
ttatgaacagctgtgtct

SEQ ID NO: 1286350 - DNA, 18 bp, Homo sapiens
ttatgaacattgtactgt

SEQ ID NO: 1286351 - DNA, 22 bp, Homo sapiens
ttatgaacattgtactgttgct

SEQ ID NO: 1286352 - DNA, 13 bp, Homo sapiens
ttatgaagcagat

SEQ ID NO: 1286353 - DNA, 16 bp, Homo sapiens
ttatgaaggaatttga

SEQ ID NO: 1286354 - DNA, 17 bp, Homo sapiens
ttatgaatatttataac

SEQ ID NO: 1286355 - DNA, 13 bp, Homo sapiens
ttatgaattcaca

SEQ ID NO: 1286356 - DNA, 14 bp, Homo sapiens
ttatgacagttata

SEQ ID NO: 1286357 - DNA, 22 bp, Homo sapiens
ttatgacctaagtcaggtaata

SEQ ID NO: 1286358 - DNA, 16 bp, Homo sapiens
ttatgactatgtaaac

SEQ ID NO: 1286359 - DNA, 13 bp, Homo sapiens
ttatgagaaactg

SEQ ID NO: 1286360 - DNA, 22 bp, Homo sapiens
ttatgagaaacttaaatgttat

SEQ ID NO: 1286361 - DNA, 15 bp, Homo sapiens
ttatgagaaattagt

SEQ ID NO: 1286362 - DNA, 22 bp, Homo sapiens
ttatgagaaattagtcacttaa

SEQ ID NO: 1286363 - DNA, 16 bp, Homo sapiens
ttatgagatctaatgt

SEQ ID NO: 1286364 - DNA, 17 bp, Homo sapiens
ttatgatattgtttaaa

SEQ ID NO: 1286365 - DNA, 22 bp, Homo sapiens
ttatgatattgtttaaaattca

SEQ ID NO: 1286366 - DNA, 15 bp, Homo sapiens
ttatgatcagtgttg

SEQ ID NO: 1286367 - DNA, 20 bp, Homo sapiens
ttatgatgagccatattaat

SEQ ID NO: 1286368 - DNA, 16 bp, Homo sapiens
ttatgatgcatacagt

SEQ ID NO: 1286369 - DNA, 16 bp, Homo sapiens
ttatgatgtatattta

SEQ ID NO: 1286370 - DNA, 18 bp, Homo sapiens
ttatgatgttagaagaag

SEQ ID NO: 1286371 - DNA, 15 bp, Homo sapiens
ttatgattttattac

SEQ ID NO: 1286372 - DNA, 18 bp, Homo sapiens
ttatgatttttttttcat

SEQ ID NO: 1286373 - DNA, 19 bp, Homo sapiens
ttatgatttttttttcata

SEQ ID NO: 1286374 - DNA, 15 bp, Homo sapiens
ttatgcaaaagcagc

SEQ ID NO: 1286375 - DNA, 17 bp, Homo sapiens
ttatgcaaggaaggaaa

SEQ ID NO: 1286376 - DNA, 22 bp, Homo sapiens
ttatgcacagcctagttatcaa

SEQ ID NO: 1286377 - DNA, 12 bp, Homo sapiens
ttatgcactgtg

SEQ ID NO: 1286378 - DNA, 20 bp, Homo sapiens
ttatgcactgtggtttcaga

SEQ ID NO: 1286379 - DNA, 21 bp, Homo sapiens
ttatgcacttttagaaatgca

SEQ ID NO: 1286380 - DNA, 22 bp, Homo sapiens
ttatgcacttttagaaatgcat

SEQ ID NO: 1286381 - DNA, 15 bp, Homo sapiens
ttatgcagacagtct

SEQ ID NO: 1286382 - DNA, 17 bp, Homo sapiens
ttatgcagacagtctgt

SEQ ID NO: 1286383 - DNA, 15 bp, Homo sapiens
ttatgcatttcattc

SEQ ID NO: 1286384 - DNA, 17 bp, Homo sapiens
ttatgccggatgtgctt

SEQ ID NO: 1286385 - DNA, 20 bp, Homo sapiens
ttatgccggatgtgcttttc

SEQ ID NO: 1286386 - DNA, 19 bp, Homo sapiens
ttatgcggttaattttgaa

SEQ ID NO: 1286387 - DNA, 23 bp, Homo sapiens
ttatgcgtgtgacagtgtatggg

SEQ ID NO: 1286388 - DNA, 14 bp, Homo sapiens
ttatgctgagtatg

SEQ ID NO: 1286389 - DNA, 16 bp, Homo sapiens
ttatgctgctgtgaat

SEQ ID NO: 1286390 - DNA, 21 bp, Homo sapiens
ttatgctgtattttaacactt

SEQ ID NO: 1286391 - DNA, 13 bp, Homo sapiens
ttatgctttgaac

SEQ ID NO: 1286392 - DNA, 14 bp, Homo sapiens
ttatgctttgaact

SEQ ID NO: 1286393 - DNA, 15 bp, Homo sapiens
ttatggaaaaataaa

SEQ ID NO: 1286394 - DNA, 17 bp, Homo sapiens
ttatggaaaaataaaac

SEQ ID NO: 1286395 - DNA, 14 bp, Homo sapiens
ttatggaacaggga

SEQ ID NO: 1286396 - DNA, 23 bp, Homo sapiens
ttatggaagatagttttctcctt

SEQ ID NO: 1286397 - DNA, 19 bp, Homo sapiens
ttatggaagattttaaatt

SEQ ID NO: 1286398 - DNA, 12 bp, Homo sapiens
ttatggaattaa

SEQ ID NO: 1286399 - DNA, 19 bp, Homo sapiens
ttatggaattaaccattta

SEQ ID NO: 1286400 - DNA, 21 bp, Homo sapiens
ttatggaattaaccatttaat

SEQ ID NO: 1286401 - DNA, 19 bp, Homo sapiens
ttatggaattgatttgcat

SEQ ID NO: 1286402 - DNA, 21 bp, Homo sapiens
ttatggaattgatttgcattg

SEQ ID NO: 1286403 - DNA, 21 bp, Homo sapiens
ttatggacactgccttagcct

SEQ ID NO: 1286404 - DNA, 16 bp, Homo sapiens
ttatggagtcttgtgc

SEQ ID NO: 1286405 - DNA, 21 bp, Homo sapiens
ttatggagtttgtgggaaata

SEQ ID NO: 1286406 - DNA, 15 bp, Homo sapiens
ttatggcatttctat

SEQ ID NO: 1286407 - DNA, 15 bp, Homo sapiens
ttatggcctcagctg

SEQ ID NO: 1286408 - DNA, 23 bp, Homo sapiens
ttatggcgtttttctcgtccccc

SEQ ID NO: 1286409 - DNA, 24 bp, Homo sapiens
ttatgggagctgtcaagcatgtat

SEQ ID NO: 1286410 - DNA, 19 bp, Homo sapiens
ttatgggatcatttttcca

SEQ ID NO: 1286411 - DNA, 21 bp, Homo sapiens
ttatggtaactgctttctgtt

SEQ ID NO: 1286412 - DNA, 13 bp, Homo sapiens
ttatggtccagaa

SEQ ID NO: 1286413 - DNA, 16 bp, Homo sapiens
ttatggttatgttttt

SEQ ID NO: 1286414 - DNA, 15 bp, Homo sapiens
ttatggtttaatgtt

SEQ ID NO: 1286415 - DNA, 17 bp, Homo sapiens
ttatgtaacatccagaa

SEQ ID NO: 1286416 - DNA, 18 bp, Homo sapiens
ttatgtaatatattgtac

SEQ ID NO: 1286417 - DNA, 12 bp, Homo sapiens
ttatgtacaacc

SEQ ID NO: 1286418 - DNA, 16 bp, Homo sapiens
ttatgtacaaccctga

SEQ ID NO: 1286419 - DNA, 17 bp, Homo sapiens
ttatgtacaaccctgac

SEQ ID NO: 1286420 - DNA, 14 bp, Homo sapiens
ttatgtactgctgt

SEQ ID NO: 1286421 - DNA, 15 bp, Homo sapiens
ttatgtagatgtgca

SEQ ID NO: 1286422 - DNA, 16 bp, Homo sapiens
ttatgtagatgtgcat

SEQ ID NO: 1286423 - DNA, 19 bp, Homo sapiens
ttatgtatcagctctctgc

SEQ ID NO: 1286424 - DNA, 14 bp, Homo sapiens
ttatgtatctctat

SEQ ID NO: 1286425 - DNA, 20 bp, Homo sapiens
ttatgtattctttctgcctt

SEQ ID NO: 1286426 - DNA, 18 bp, Homo sapiens
ttatgtattttgaaaaag

SEQ ID NO: 1286427 - DNA, 16 bp, Homo sapiens
ttatgtcatcagtaaa

SEQ ID NO: 1286428 - DNA, 17 bp, Homo sapiens
ttatgtcctgtgagatg

SEQ ID NO: 1286429 - DNA, 22 bp, Homo sapiens
ttatgtcctgtgagatgtgtat

SEQ ID NO: 1286430 - DNA, 22 bp, Homo sapiens
ttatgtctcatgtaatttgcat

SEQ ID NO: 1286431 - DNA, 15 bp, Homo sapiens
ttatgtctcttctga

SEQ ID NO: 1286432 - DNA, 13 bp, Homo sapiens
ttatgtctcttga

SEQ ID NO: 1286433 - DNA, 19 bp, Homo sapiens
ttatgtctcttgagcatca

SEQ ID NO: 1286434 - DNA, 21 bp, Homo sapiens
ttatgtctcttgagcatcaat

SEQ ID NO: 1286435 - DNA, 11 bp, Homo sapiens
ttatgtctggg

SEQ ID NO: 1286436 - DNA, 16 bp, Homo sapiens
ttatgtgaaaaattaa

SEQ ID NO: 1286437 - DNA, 18 bp, Homo sapiens
ttatgtgaaaaattaact

SEQ ID NO: 1286438 - DNA, 17 bp, Homo sapiens
ttatgtgaatttttaag

SEQ ID NO: 1286439 - DNA, 19 bp, Homo sapiens
ttatgtgacattttacatt

SEQ ID NO: 1286440 - DNA, 12 bp, Homo sapiens
ttatgtgacttg

SEQ ID NO: 1286441 - DNA, 13 bp, Homo sapiens
ttatgtgagagaa

SEQ ID NO: 1286442 - DNA, 14 bp, Homo sapiens
ttatgtgagatttc

SEQ ID NO: 1286443 - DNA, 13 bp, Homo sapiens
ttatgtgatgcca

SEQ ID NO: 1286444 - DNA, 12 bp, Homo sapiens
ttatgtgcagcg

SEQ ID NO: 1286445 - DNA, 20 bp, Homo sapiens
ttatgtgcagcgacccttgg

SEQ ID NO: 1286446 - DNA, 21 bp, Homo sapiens
ttatgtgctattaatatttgt

SEQ ID NO: 1286447 - DNA, 15 bp, Homo sapiens
ttatgtgtaaataca

SEQ ID NO: 1286448 - DNA, 23 bp, Homo sapiens
ttatgttcagaaatgtaaatgtt

SEQ ID NO: 1286449 - DNA, 20 bp, Homo sapiens
ttatgttcctcaaggtccat

SEQ ID NO: 1286450 - DNA, 15 bp, Homo sapiens
ttatgttgaaaaaat

SEQ ID NO: 1286451 - DNA, 16 bp, Homo sapiens
ttatgttgtatgattc

SEQ ID NO: 1286452 - DNA, 21 bp, Homo sapiens
ttatgttgttcaaatgcattt

SEQ ID NO: 1286453 - DNA, 16 bp, Homo sapiens
ttatgtttattacaat

SEQ ID NO: 1286454 - DNA, 22 bp, Homo sapiens
ttatgttttcgaaaatcaaatg

SEQ ID NO: 1286455 - DNA, 19 bp, Homo sapiens
ttatgttttgtttctgaaa

SEQ ID NO: 1286456 - DNA, 21 bp, Homo sapiens
ttatgttttttgtaagataaa

SEQ ID NO: 1286457 - DNA, 16 bp, Homo sapiens
ttattaaaaatgttct

SEQ ID NO: 1286458 - DNA, 15 bp, Homo sapiens
ttattaaaacaaaag

SEQ ID NO: 1286459 - DNA, 17 bp, Homo sapiens
ttattaaacaattttgt

SEQ ID NO: 1286460 - DNA, 22 bp, Homo sapiens
ttattaaacgatttctaaaatc

SEQ ID NO: 1286461 - DNA, 22 bp, Homo sapiens
ttattaaacgtatgcatgtgaa

SEQ ID NO: 1286462 - DNA, 17 bp, Homo sapiens
ttcaatcccaattctgt

SEQ ID NO: 1286463 - DNA, 20 bp, Homo sapiens
ttcaatctcccgctgctgct

SEQ ID NO: 1286464 - DNA, 12 bp, Homo sapiens
ttcaatctctgt

SEQ ID NO: 1286465 - DNA, 16 bp, Homo sapiens
ttcaatctgtaaactg

SEQ ID NO: 1286466 - DNA, 17 bp, Homo sapiens
ttcaatctgtaaactgt

SEQ ID NO: 1286467 - DNA, 18 bp, Homo sapiens
ttcaatgaatccccgacc

SEQ ID NO: 1286468 - DNA, 12 bp, Homo sapiens
ttcaatgcaaag

SEQ ID NO: 1286469 - DNA, 16 bp, Homo sapiens
ttcaatgcatacaata

SEQ ID NO: 1286470 - DNA, 18 bp, Homo sapiens
ttcaatgcatacaataaa

SEQ ID NO: 1286471 - DNA, 21 bp, Homo sapiens
ttcaatgcatacaataaaaga

SEQ ID NO: 1286472 - DNA, 21 bp, Homo sapiens
ttcaatgcgttttgttgtaga

SEQ ID NO: 1286473 - DNA, 18 bp, Homo sapiens
ttcaatgggaagactcag

SEQ ID NO: 1286474 - DNA, 16 bp, Homo sapiens
ttcaatggttctgaaa

SEQ ID NO: 1286475 - DNA, 15 bp, Homo sapiens
ttcaatgtaattaaa

SEQ ID NO: 1286476 - DNA, 22 bp, Homo sapiens
ttcaatgtgaaacacatgccag

SEQ ID NO: 1286477 - DNA, 15 bp, Homo sapiens
ttcaatgtgattctt

SEQ ID NO: 1286478 - DNA, 13 bp, Homo sapiens
ttcaatgttccat

SEQ ID NO: 1286479 - DNA, 13 bp, Homo sapiens
ttcaattaatgct

SEQ ID NO: 1286480 - DNA, 21 bp, Homo sapiens
ttcaattacaaagcagttact

SEQ ID NO: 1286481 - DNA, 14 bp, Homo sapiens
ttcaattcctgggc

SEQ ID NO: 1286482 - DNA, 13 bp, Homo sapiens
ttcaattctcaaa

SEQ ID NO: 1286483 - DNA, 14 bp, Homo sapiens
ttcaattgtcactt

SEQ ID NO: 1286484 - DNA, 16 bp, Homo sapiens
ttcaatttattcaaga

SEQ ID NO: 1286485 - DNA, 17 bp, Homo sapiens
ttcaatttattcaagaa

SEQ ID NO: 1286486 - DNA, 19 bp, Homo sapiens
ttcaatttattcaagaaaa

SEQ ID NO: 1286487 - DNA, 20 bp, Homo sapiens
ttcaatttgtcatgttacta

SEQ ID NO: 1286488 - DNA, 23 bp, Homo sapiens
ttcaatttgtcatgttactaaat

SEQ ID NO: 1286489 - DNA, 16 bp, Homo sapiens
ttcaattttttaatgt

SEQ ID NO: 1286490 - DNA, 19 bp, Homo sapiens
ttcacaaactacctctgga

SEQ ID NO: 1286491 - DNA, 14 bp, Homo sapiens
ttcacaaactgtga

SEQ ID NO: 1286492 - DNA, 15 bp, Homo sapiens
ttcacaaacttttat

SEQ ID NO: 1286493 - DNA, 16 bp, Homo sapiens
ttcacaaagtaatttg

SEQ ID NO: 1286494 - DNA, 18 bp, Homo sapiens
ttcacaaagtaatttgga

SEQ ID NO: 1286495 - DNA, 19 bp, Homo sapiens
ttcacaaatgtcattgtct

SEQ ID NO: 1286496 - DNA, 18 bp, Homo sapiens
ttcacaacctcaccaaac

SEQ ID NO: 1286497 - DNA, 15 bp, Homo sapiens
ttcacaagcctcctg

SEQ ID NO: 1286498 - DNA, 13 bp, Homo sapiens
ttcacaatagaaa

SEQ ID NO: 1286499 - DNA, 16 bp, Homo sapiens
ttcacaattattccaa

SEQ ID NO: 1286500 - DNA, 23 bp, Homo sapiens
ttcacacactcacaatttaaaat

SEQ ID NO: 1286501 - DNA, 14 bp, Homo sapiens
ttcacacagataga

SEQ ID NO: 1286502 - DNA, 23 bp, Homo sapiens
ttcacacatctgggtgccctgaa

SEQ ID NO: 1286503 - DNA, 23 bp, Homo sapiens
ttcacacctcacgctctggacat

SEQ ID NO: 1286504 - DNA, 17 bp, Homo sapiens
ttcacactgtcttcccg

SEQ ID NO: 1286505 - DNA, 18 bp, Homo sapiens
ttcacagaaaaagcatga

SEQ ID NO: 1286506 - DNA, 12 bp, Homo sapiens
ttcacagaagga

SEQ ID NO: 1286507 - DNA, 12 bp, Homo sapiens
ttcacagagcac

SEQ ID NO: 1286508 - DNA, 19 bp, Homo sapiens
ttcacagagcacgcctgcc

SEQ ID NO: 1286509 - DNA, 21 bp, Homo sapiens
ttcacagcaccaaaggctcag

SEQ ID NO: 1286510 - DNA, 13 bp, Homo sapiens
ttcacagcccaga

SEQ ID NO: 1286511 - DNA, 22 bp, Homo sapiens
ttcacagcccagaaccacagat

SEQ ID NO: 1286512 - DNA, 12 bp, Homo sapiens
ttcacagctcct

SEQ ID NO: 1286513 - DNA, 15 bp, Homo sapiens
ttcacagctcctccc

SEQ ID NO: 1286514 - DNA, 13 bp, Homo sapiens
ttcacaggcactc

SEQ ID NO: 1286515 - DNA, 23 bp, Homo sapiens
ttcacaggtggacaaatgttgtc

SEQ ID NO: 1286516 - DNA, 23 bp, Homo sapiens
ttcacagttggctggatgaaatt

SEQ ID NO: 1286517 - DNA, 13 bp, Homo sapiens
ttcacagtttttc

SEQ ID NO: 1286518 - DNA, 18 bp, Homo sapiens
ttcacataagctcagaat

SEQ ID NO: 1286519 - DNA, 23 bp, Homo sapiens
ttcacatagcccacttacattta

SEQ ID NO: 1286520 - DNA, 15 bp, Homo sapiens
ttcacatagctgtct

SEQ ID NO: 1286521 - DNA, 22 bp, Homo sapiens
ttcacatagtcctcagggctca

SEQ ID NO: 1286522 - DNA, 17 bp, Homo sapiens
ttcacatattgatttcc

SEQ ID NO: 1286523 - DNA, 19 bp, Homo sapiens
ttcacatgagctatttcca

SEQ ID NO: 1286524 - DNA, 18 bp, Homo sapiens
ttcacattaggctgttgg

SEQ ID NO: 1286525 - DNA, 15 bp, Homo sapiens
ttcacatttgatgta

SEQ ID NO: 1286526 - DNA, 20 bp, Homo sapiens
ttcacatttgatgtacatgt

SEQ ID NO: 1286527 - DNA, 19 bp, Homo sapiens
ttcacattttccttttcaa

SEQ ID NO: 1286528 - DNA, 23 bp, Homo sapiens
ttcacatttttacaaataggtag

SEQ ID NO: 1286529 - DNA, 14 bp, Homo sapiens
ttcaccaaaaccaa

SEQ ID NO: 1286530 - DNA, 16 bp, Homo sapiens
ttcaccaaaattatcc

SEQ ID NO: 1286531 - DNA, 16 bp, Homo sapiens
ttcaccaagtgcaata

SEQ ID NO: 1286532 - DNA, 22 bp, Homo sapiens
ttcaccaccaaatgccaagaaa

SEQ ID NO: 1286533 - DNA, 18 bp, Homo sapiens
ttcaccaccccctgtccc

SEQ ID NO: 1286534 - DNA, 12 bp, Homo sapiens
ttcaccagagca

SEQ ID NO: 1286535 - DNA, 19 bp, Homo sapiens
ttcaccagtctgtctactg

SEQ ID NO: 1286536 - DNA, 20 bp, Homo sapiens
ttcaccagtgttcctgaagc

SEQ ID NO: 1286537 - DNA, 22 bp, Homo sapiens
ttcaccagtgttcctgaagctg

SEQ ID NO: 1286538 - DNA, 12 bp, Homo sapiens
ttcaccatggcc

SEQ ID NO: 1286539 - DNA, 17 bp, Homo sapiens
ttcaccatggccccctc

SEQ ID NO: 1286540 - DNA, 22 bp, Homo sapiens
ttcaccatgttggccaggctgg

SEQ ID NO: 1286541 - DNA, 21 bp, Homo sapiens
ttcaccatgttggtcaggctg

SEQ ID NO: 1286542 - DNA, 13 bp, Homo sapiens
ttcaccccaccct

SEQ ID NO: 1286543 - DNA, 14 bp, Homo sapiens
ttcaccccaccctt

SEQ ID NO: 1286544 - DNA, 21 bp, Homo sapiens
ttcaccccctgagatcccctg

SEQ ID NO: 1286545 - DNA, 14 bp, Homo sapiens
ttcacccctgcact

SEQ ID NO: 1286546 - DNA, 17 bp, Homo sapiens
ttcacccctgcacttca

SEQ ID NO: 1286547 - DNA, 13 bp, Homo sapiens
ttcaccctccact

SEQ ID NO: 1286548 - DNA, 13 bp, Homo sapiens
ttcacctcagcct

SEQ ID NO: 1286549 - DNA, 16 bp, Homo sapiens
ttcacctcagcctgga

SEQ ID NO: 1286550 - DNA, 21 bp, Homo sapiens
ttcacctccaagcatttcatg

SEQ ID NO: 1286551 - DNA, 18 bp, Homo sapiens
ttcacctctatccaaaga

SEQ ID NO: 1286552 - DNA, 14 bp, Homo sapiens
ttcacctcttcctc

SEQ ID NO: 1286553 - DNA, 15 bp, Homo sapiens
ttcacctcttcctct

SEQ ID NO: 1286554 - DNA, 18 bp, Homo sapiens
ttcacctgggccctggag

SEQ ID NO: 1286555 - DNA, 13 bp, Homo sapiens
ttcacctgtaaaa

SEQ ID NO: 1286556 - DNA, 14 bp, Homo sapiens
ttcacctgtaaaac

SEQ ID NO: 1286557 - DNA, 19 bp, Homo sapiens
ttcacctgtttttaagctg

SEQ ID NO: 1286558 - DNA, 13 bp, Homo sapiens
ttcaccttccctc

SEQ ID NO: 1286559 - DNA, 12 bp, Homo sapiens
ttcaccttggaa

SEQ ID NO: 1286560 - DNA, 17 bp, Homo sapiens
ttcacctttcctctccc

SEQ ID NO: 1286561 - DNA, 15 bp, Homo sapiens
ttcacctttggtgca

SEQ ID NO: 1286562 - DNA, 22 bp, Homo sapiens
ttcacgacaatgttgagaagtt

SEQ ID NO: 1286563 - DNA, 13 bp, Homo sapiens
ttcacggaagagc

SEQ ID NO: 1286564 - DNA, 17 bp, Homo sapiens
ttcacggaagagccttg

SEQ ID NO: 1286565 - DNA, 13 bp, Homo sapiens
ttcacggaagttt

SEQ ID NO: 1286566 - DNA, 16 bp, Homo sapiens
ttcacggcagaccaga

SEQ ID NO: 1286567 - DNA, 13 bp, Homo sapiens
ttcacgggcccca

SEQ ID NO: 1286568 - DNA, 13 bp, Homo sapiens
ttcactaaagcag

SEQ ID NO: 1286569 - DNA, 21 bp, Homo sapiens
ttcactaccctgattcttgat

SEQ ID NO: 1286570 - DNA, 19 bp, Homo sapiens
ttcactagagacaaatctt

SEQ ID NO: 1286571 - DNA, 20 bp, Homo sapiens
ttcactataatgatctaaga

SEQ ID NO: 1286572 - DNA, 21 bp, Homo sapiens
ttcactataatgatctaagaa

SEQ ID NO: 1286573 - DNA, 13 bp, Homo sapiens
ttcactccagcct

SEQ ID NO: 1286574 - DNA, 17 bp, Homo sapiens
ttcactccccctaaacc

SEQ ID NO: 1286575 - DNA, 13 bp, Homo sapiens
ttcactccctctt

SEQ ID NO: 1286576 - DNA, 13 bp, Homo sapiens
ttcactcctgctt

SEQ ID NO: 1286577 - DNA, 23 bp, Homo sapiens
ttcactcctgcttctctcagcca

SEQ ID NO: 1286578 - DNA, 19 bp, Homo sapiens
ttcactctaagtcatgtat

SEQ ID NO: 1286579 - DNA, 12 bp, Homo sapiens
ttcactctctga

SEQ ID NO: 1286580 - DNA, 14 bp, Homo sapiens
ttcactcttccaga

SEQ ID NO: 1286581 - DNA, 15 bp, Homo sapiens
ttcactcttccagaa

SEQ ID NO: 1286582 - DNA, 16 bp, Homo sapiens
ttcactgaacatgcct

SEQ ID NO: 1286583 - DNA, 15 bp, Homo sapiens
ttcactgacacagta

SEQ ID NO: 1286584 - DNA, 17 bp, Homo sapiens
ttcactgagagctgcct

SEQ ID NO: 1286585 - DNA, 15 bp, Homo sapiens
ttcatactccttttg

SEQ ID NO: 1286586 - DNA, 16 bp, Homo sapiens
ttcatactccttttgg

SEQ ID NO: 1286587 - DNA, 22 bp, Homo sapiens
ttcatactgtaacattcaggaa

SEQ ID NO: 1286588 - DNA, 14 bp, Homo sapiens
ttcatacttaaaaa

SEQ ID NO: 1286589 - DNA, 18 bp, Homo sapiens
ttcatacttaaaaattta

SEQ ID NO: 1286590 - DNA, 13 bp, Homo sapiens
ttcatagaagtgt

SEQ ID NO: 1286591 - DNA, 15 bp, Homo sapiens
ttcatagaagtgttg

SEQ ID NO: 1286592 - DNA, 17 bp, Homo sapiens
ttcatagctccttggag

SEQ ID NO: 1286593 - DNA, 22 bp, Homo sapiens
ttcatagggaaaggttttgtat

SEQ ID NO: 1286594 - DNA, 20 bp, Homo sapiens
ttcataggtaacacattata

SEQ ID NO: 1286595 - DNA, 14 bp, Homo sapiens
ttcataggtcactg

SEQ ID NO: 1286596 - DNA, 17 bp, Homo sapiens
ttcataggtctgaaatt

SEQ ID NO: 1286597 - DNA, 22 bp, Homo sapiens
ttcataggtctgaaatttttct

SEQ ID NO: 1286598 - DNA, 23 bp, Homo sapiens
ttcatagtatccatattttatta

SEQ ID NO: 1286599 - DNA, 19 bp, Homo sapiens
ttcatagtgacctgtgttt

SEQ ID NO: 1286600 - DNA, 21 bp, Homo sapiens
ttcatagtgacctgtgtttca

SEQ ID NO: 1286601 - DNA, 14 bp, Homo sapiens
ttcatagttcagaa

SEQ ID NO: 1286602 - DNA, 16 bp, Homo sapiens
ttcatagttcagaatt

SEQ ID NO: 1286603 - DNA, 17 bp, Homo sapiens
ttcatatactataattg

SEQ ID NO: 1286604 - DNA, 20 bp, Homo sapiens
ttcatatgtaccatgtacat

SEQ ID NO: 1286605 - DNA, 16 bp, Homo sapiens
ttcatatgttgctcag

SEQ ID NO: 1286606 - DNA, 15 bp, Homo sapiens
ttcatatttctttgg

SEQ ID NO: 1286607 - DNA, 16 bp, Homo sapiens
ttcatattttaaatct

SEQ ID NO: 1286608 - DNA, 19 bp, Homo sapiens
ttcatcatattatacagac

SEQ ID NO: 1286609 - DNA, 19 bp, Homo sapiens
ttcatcattccctctcatc

SEQ ID NO: 1286610 - DNA, 15 bp, Homo sapiens
ttcatcattgtttct

SEQ ID NO: 1286611 - DNA, 12 bp, Homo sapiens
ttcatcatttca

SEQ ID NO: 1286612 - DNA, 14 bp, Homo sapiens
ttcatcatttcagc

SEQ ID NO: 1286613 - DNA, 20 bp, Homo sapiens
ttcatccaacttatgttttt

SEQ ID NO: 1286614 - DNA, 20 bp, Homo sapiens
ttcatccaatcctcactggg

SEQ ID NO: 1286615 - DNA, 21 bp, Homo sapiens
ttcatccaatcctcactgggt

SEQ ID NO: 1286616 - DNA, 14 bp, Homo sapiens
ttcatccatttgtt

SEQ ID NO: 1286617 - DNA, 19 bp, Homo sapiens
ttcatcccatgatgtagtg

SEQ ID NO: 1286618 - DNA, 13 bp, Homo sapiens
ttcatcccctccc

SEQ ID NO: 1286619 - DNA, 15 bp, Homo sapiens
ttcatcccctccccg

SEQ ID NO: 1286620 - DNA, 21 bp, Homo sapiens
ttcatcccgtatcacagtgtt

SEQ ID NO: 1286621 - DNA, 20 bp, Homo sapiens
ttcatcctcattgcctcctg

SEQ ID NO: 1286622 - DNA, 14 bp, Homo sapiens
ttcatcctggcctc

SEQ ID NO: 1286623 - DNA, 16 bp, Homo sapiens
ttcatcctggcctcct

SEQ ID NO: 1286624 - DNA, 17 bp, Homo sapiens
ttcatcctggcctcctt

SEQ ID NO: 1286625 - DNA, 18 bp, Homo sapiens
ttcatcctgtgtcccctg

SEQ ID NO: 1286626 - DNA, 22 bp, Homo sapiens
ttcatcctgtgtcccctgacct

SEQ ID NO: 1286627 - DNA, 17 bp, Homo sapiens
ttcatccttttttctct

SEQ ID NO: 1286628 - DNA, 20 bp, Homo sapiens
ttcatcgaatctactaattc

SEQ ID NO: 1286629 - DNA, 16 bp, Homo sapiens
ttcatcggtgcctggt

SEQ ID NO: 1286630 - DNA, 16 bp, Homo sapiens
ttcatcgtaaagtgct

SEQ ID NO: 1286631 - DNA, 23 bp, Homo sapiens
ttcatctatttttggcagtctga

SEQ ID NO: 1286632 - DNA, 19 bp, Homo sapiens
ttcatctcatttaagggaa

SEQ ID NO: 1286633 - DNA, 14 bp, Homo sapiens
ttcatctccctgcc

SEQ ID NO: 1286634 - DNA, 16 bp, Homo sapiens
ttcatctcctgagtat

SEQ ID NO: 1286635 - DNA, 14 bp, Homo sapiens
ttcatctccttttg

SEQ ID NO: 1286636 - DNA, 18 bp, Homo sapiens
ttcatctctctacctcca

SEQ ID NO: 1286637 - DNA, 20 bp, Homo sapiens
ttcatctctctacctccacc

SEQ ID NO: 1286638 - DNA, 18 bp, Homo sapiens
ttcatctgggaaagacat

SEQ ID NO: 1286639 - DNA, 13 bp, Homo sapiens
ttcatctgtaact

SEQ ID NO: 1286640 - DNA, 19 bp, Homo sapiens
ttcatctgtaactctaaaa

SEQ ID NO: 1286641 - DNA, 18 bp, Homo sapiens
ttcatcttaaactaatac

SEQ ID NO: 1286642 - DNA, 13 bp, Homo sapiens
ttcatcttctgga

SEQ ID NO: 1286643 - DNA, 22 bp, Homo sapiens
ttcatcttggtcacatacaatt

SEQ ID NO: 1286644 - DNA, 13 bp, Homo sapiens
ttcatcttttcat

SEQ ID NO: 1286645 - DNA, 16 bp, Homo sapiens
ttcatgaatctttcat

SEQ ID NO: 1286646 - DNA, 20 bp, Homo sapiens
ttcatgaatctttcatacat

SEQ ID NO: 1286647 - DNA, 19 bp, Homo sapiens
ttcatgaatgtgctggtga

SEQ ID NO: 1286648 - DNA, 21 bp, Homo sapiens
ttcatgaatgtgctggtgaac

SEQ ID NO: 1286649 - DNA, 17 bp, Homo sapiens
ttcatgacaacatgaaa

SEQ ID NO: 1286650 - DNA, 15 bp, Homo sapiens
ttcatgacagcctcc

SEQ ID NO: 1286651 - DNA, 16 bp, Homo sapiens
ttcatgacagcctcca

SEQ ID NO: 1286652 - DNA, 16 bp, Homo sapiens
ttcatgattatagcaa

SEQ ID NO: 1286653 - DNA, 21 bp, Homo sapiens
ttcatgattggcttaaagtga

SEQ ID NO: 1286654 - DNA, 23 bp, Homo sapiens
ttcatgatttcatttcaactgtt

SEQ ID NO: 1286655 - DNA, 14 bp, Homo sapiens
ttcatgcaatgaca

SEQ ID NO: 1286656 - DNA, 15 bp, Homo sapiens
ttcatgcaatgacat

SEQ ID NO: 1286657 - DNA, 23 bp, Homo sapiens
ttcatgcacttaaagaagtattt

SEQ ID NO: 1286658 - DNA, 19 bp, Homo sapiens
ttcatgccaccatggccag

SEQ ID NO: 1286659 - DNA, 19 bp, Homo sapiens
ttcatgccatctgttttca

SEQ ID NO: 1286660 - DNA, 15 bp, Homo sapiens
ttcatgcctttgtaa

SEQ ID NO: 1286661 - DNA, 17 bp, Homo sapiens
ttcatgctatctctgtg

SEQ ID NO: 1286662 - DNA, 14 bp, Homo sapiens
ttcatgctcagccc

SEQ ID NO: 1286663 - DNA, 13 bp, Homo sapiens
ttcatgctccaag

SEQ ID NO: 1286664 - DNA, 23 bp, Homo sapiens
ttcatgctccaagactttagtta

SEQ ID NO: 1286665 - DNA, 14 bp, Homo sapiens
ttcatgcttgacat

SEQ ID NO: 1286666 - DNA, 18 bp, Homo sapiens
ttcatgcttgacatacct

SEQ ID NO: 1286667 - DNA, 19 bp, Homo sapiens
ttcatggaatggacatcct

SEQ ID NO: 1286668 - DNA, 22 bp, Homo sapiens
ttcatggaatggacatcctgta

SEQ ID NO: 1286669 - DNA, 16 bp, Homo sapiens
ttcatggacactttga

SEQ ID NO: 1286670 - DNA, 20 bp, Homo sapiens
ttcatggacactttgaaatg

SEQ ID NO: 1286671 - DNA, 21 bp, Homo sapiens
ttcatggcatgcttaaatttt

SEQ ID NO: 1286672 - DNA, 17 bp, Homo sapiens
ttcatgtaaactgtgca

SEQ ID NO: 1286673 - DNA, 19 bp, Homo sapiens
ttcatgtaaactgtgcacc

SEQ ID NO: 1286674 - DNA, 13 bp, Homo sapiens
ttcatgtaacagt

SEQ ID NO: 1286675 - DNA, 17 bp, Homo sapiens
ttcatgtaacagttgtg

SEQ ID NO: 1286676 - DNA, 18 bp, Homo sapiens
ttcatgtaatcctcaaga

SEQ ID NO: 1286677 - DNA, 17 bp, Homo sapiens
ttcatgtacaagatgaa

SEQ ID NO: 1286678 - DNA, 17 bp, Homo sapiens
ttcatgtatgtatataa

SEQ ID NO: 1286679 - DNA, 16 bp, Homo sapiens
ttcatgtcccagaact

SEQ ID NO: 1286680 - DNA, 16 bp, Homo sapiens
ttcatgtcttgtcata

SEQ ID NO: 1286681 - DNA, 16 bp, Homo sapiens
ttcatgtgagaaagct

SEQ ID NO: 1286682 - DNA, 15 bp, Homo sapiens
ttcatgttcactgtg

SEQ ID NO: 1286683 - DNA, 16 bp, Homo sapiens
ttcatgttcactgtga

SEQ ID NO: 1286684 - DNA, 20 bp, Homo sapiens
ttcatgttggtttattttca

SEQ ID NO: 1286685 - DNA, 14 bp, Homo sapiens
ttcatgtttgcttc

SEQ ID NO: 1286686 - DNA, 15 bp, Homo sapiens
ttcattaaaagctac

SEQ ID NO: 1286687 - DNA, 12 bp, Homo sapiens
ttcattaaactt

SEQ ID NO: 1286688 - DNA, 14 bp, Homo sapiens
ttcattaaacttga

SEQ ID NO: 1286689 - DNA, 15 bp, Homo sapiens
ttcattaaacttgaa

SEQ ID NO: 1286690 - DNA, 13 bp, Homo sapiens
ttcattaaataaa

SEQ ID NO: 1286691 - DNA, 16 bp, Homo sapiens
ttcattaacaaaatgt

SEQ ID NO: 1286692 - DNA, 15 bp, Homo sapiens
ttcattaagtaatct

SEQ ID NO: 1286693 - DNA, 23 bp, Homo sapiens
ttcattagcagttgctcacatgt

SEQ ID NO: 1286694 - DNA, 16 bp, Homo sapiens
ttcattagtcatgttt

SEQ ID NO: 1286695 - DNA, 23 bp, Homo sapiens
ttcattataatttgggtgactag

SEQ ID NO: 1286696 - DNA, 19 bp, Homo sapiens
ttcattatctgagttgcat

SEQ ID NO: 1286697 - DNA, 16 bp, Homo sapiens
ttcattatgttcatgt

SEQ ID NO: 1286698 - DNA, 13 bp, Homo sapiens
ttcattattctct

SEQ ID NO: 1286699 - DNA, 13 bp, Homo sapiens
ttcattattggaa

SEQ ID NO: 1286700 - DNA, 15 bp, Homo sapiens
ttcattattttgtgg

SEQ ID NO: 1286701 - DNA, 19 bp, Homo sapiens
ttcattcaaatcagtgatc

SEQ ID NO: 1286702 - DNA, 24 bp, Homo sapiens
ttcattcaagctatttaatatctg

SEQ ID NO: 1286703 - DNA, 17 bp, Homo sapiens
ttcattcaatattgaca

SEQ ID NO: 1286704 - DNA, 9 bp, Homo sapiens
ttcattcag

SEQ ID NO: 1286705 - DNA, 16 bp, Homo sapiens
ttcattcatacttaaa

SEQ ID NO: 1286706 - DNA, 14 bp, Homo sapiens
ttcattcattcact

SEQ ID NO: 1286707 - DNA, 16 bp, Homo sapiens
ttccatggcttcctga

SEQ ID NO: 1286708 - DNA, 17 bp, Homo sapiens
ttccatggcttcctgag

SEQ ID NO: 1286709 - DNA, 17 bp, Homo sapiens
ttccatgtatcttttga

SEQ ID NO: 1286710 - DNA, 19 bp, Homo sapiens
ttccatgtcgcctctgcat

SEQ ID NO: 1286711 - DNA, 20 bp, Homo sapiens
ttccatgtcgcctctgcatt

SEQ ID NO: 1286712 - DNA, 18 bp, Homo sapiens
ttccatgtgaacagcata

SEQ ID NO: 1286713 - DNA, 14 bp, Homo sapiens
ttccatgtggagaa

SEQ ID NO: 1286714 - DNA, 12 bp, Homo sapiens
ttccatgtgtgg

SEQ ID NO: 1286715 - DNA, 18 bp, Homo sapiens
ttccattaaatcaatcag

SEQ ID NO: 1286716 - DNA, 13 bp, Homo sapiens
ttccattacaagt

SEQ ID NO: 1286717 - DNA, 23 bp, Homo sapiens
ttccattacaagtatttttaatt

SEQ ID NO: 1286718 - DNA, 15 bp, Homo sapiens
ttccattatgattct

SEQ ID NO: 1286719 - DNA, 16 bp, Homo sapiens
ttccattccagaatat

SEQ ID NO: 1286720 - DNA, 16 bp, Homo sapiens
ttccattccattgttt

SEQ ID NO: 1286721 - DNA, 14 bp, Homo sapiens
ttccattctttcag

SEQ ID NO: 1286722 - DNA, 17 bp, Homo sapiens
ttccattggatctcatt

SEQ ID NO: 1286723 - DNA, 24 bp, Homo sapiens
ttccattggttcttcctttccctg

SEQ ID NO: 1286724 - DNA, 22 bp, Homo sapiens
ttccattgtgtggcctggtggg

SEQ ID NO: 1286725 - DNA, 15 bp, Homo sapiens
ttccattgtttgaaa

SEQ ID NO: 1286726 - DNA, 17 bp, Homo sapiens
ttccattgtttgaaaca

SEQ ID NO: 1286727 - DNA, 23 bp, Homo sapiens
ttccatttacagtctctttcttc

SEQ ID NO: 1286728 - DNA, 12 bp, Homo sapiens
ttccatttacta

SEQ ID NO: 1286729 - DNA, 19 bp, Homo sapiens
ttccatttacttaagactt

SEQ ID NO: 1286730 - DNA, 14 bp, Homo sapiens
ttccatttattgtt

SEQ ID NO: 1286731 - DNA, 17 bp, Homo sapiens
ttccatttatttatgaa

SEQ ID NO: 1286732 - DNA, 13 bp, Homo sapiens
ttccatttctcaa

SEQ ID NO: 1286733 - DNA, 14 bp, Homo sapiens
ttccatttctcaat

SEQ ID NO: 1286734 - DNA, 12 bp, Homo sapiens
ttccatttctga

SEQ ID NO: 1286735 - DNA, 14 bp, Homo sapiens
ttccatttctgatg

SEQ ID NO: 1286736 - DNA, 16 bp, Homo sapiens
ttccatttcttcagag

SEQ ID NO: 1286737 - DNA, 18 bp, Homo sapiens
ttccatttcttcagaggg

SEQ ID NO: 1286738 - DNA, 17 bp, Homo sapiens
ttccatttgcaagggaa

SEQ ID NO: 1286739 - DNA, 16 bp, Homo sapiens
ttccattttatgcaga

SEQ ID NO: 1286740 - DNA, 20 bp, Homo sapiens
ttccatttttcctctgttca

SEQ ID NO: 1286741 - DNA, 21 bp, Homo sapiens
ttccatttttcctctgttcac

SEQ ID NO: 1286742 - DNA, 19 bp, Homo sapiens
ttcccaaaatgttgaaata

SEQ ID NO: 1286743 - DNA, 21 bp, Homo sapiens
ttcccaaacccagtctcctct

SEQ ID NO: 1286744 - DNA, 13 bp, Homo sapiens
ttcccaaagcact

SEQ ID NO: 1286745 - DNA, 21 bp, Homo sapiens
ttcccaaagtcctctgctcca

SEQ ID NO: 1286746 - DNA, 12 bp, Homo sapiens
ttcccaaatgta

SEQ ID NO: 1286747 - DNA, 14 bp, Homo sapiens
ttcccaacagcctt

SEQ ID NO: 1286748 - DNA, 17 bp, Homo sapiens
ttcccaacagccttagc

SEQ ID NO: 1286749 - DNA, 16 bp, Homo sapiens
ttcccaacctgctcat

SEQ ID NO: 1286750 - DNA, 17 bp, Homo sapiens
ttcccaactctagctgg

SEQ ID NO: 1286751 - DNA, 22 bp, Homo sapiens
ttcccaaggaagctccttcctg

SEQ ID NO: 1286752 - DNA, 23 bp, Homo sapiens
ttcccaaggaagctccttcctgt

SEQ ID NO: 1286753 - DNA, 11 bp, Homo sapiens
ttcccaaggac

SEQ ID NO: 1286754 - DNA, 13 bp, Homo sapiens
ttcccaaggacat

SEQ ID NO: 1286755 - DNA, 19 bp, Homo sapiens
ttcccaagtatgccttaag

SEQ ID NO: 1286756 - DNA, 16 bp, Homo sapiens
ttcccaagtattgcga

SEQ ID NO: 1286757 - DNA, 12 bp, Homo sapiens
ttcccaataaaa

SEQ ID NO: 1286758 - DNA, 16 bp, Homo sapiens
ttcccaataaaagtga

SEQ ID NO: 1286759 - DNA, 12 bp, Homo sapiens
ttcccaataaat

SEQ ID NO: 1286760 - DNA, 23 bp, Homo sapiens
ttcccaatctctacccctttctt

SEQ ID NO: 1286761 - DNA, 15 bp, Homo sapiens
ttcccacatctttcc

SEQ ID NO: 1286762 - DNA, 16 bp, Homo sapiens
ttcccacattaaagaa

SEQ ID NO: 1286763 - DNA, 12 bp, Homo sapiens
ttcccaccaaca

SEQ ID NO: 1286764 - DNA, 21 bp, Homo sapiens
ttcccacccaattcaaaacat

SEQ ID NO: 1286765 - DNA, 12 bp, Homo sapiens
ttcccaccccca

SEQ ID NO: 1286766 - DNA, 15 bp, Homo sapiens
ttcccacccccaggc

SEQ ID NO: 1286767 - DNA, 19 bp, Homo sapiens
ttcccaccctccacctctc

SEQ ID NO: 1286768 - DNA, 21 bp, Homo sapiens
ttcccaccctccacctctcac

SEQ ID NO: 1286769 - DNA, 18 bp, Homo sapiens
ttcccactggcctcaagt

SEQ ID NO: 1286770 - DNA, 14 bp, Homo sapiens
ttcccagactctgc

SEQ ID NO: 1286771 - DNA, 22 bp, Homo sapiens
ttcccagagacaggaaaatcct

SEQ ID NO: 1286772 - DNA, 22 bp, Homo sapiens
ttcccagagtcagaggagaaga

SEQ ID NO: 1286773 - DNA, 21 bp, Homo sapiens
ttcccagagtgtgaaacttcc

SEQ ID NO: 1286774 - DNA, 21 bp, Homo sapiens
ttcccagcagtgggggtcaga

SEQ ID NO: 1286775 - DNA, 12 bp, Homo sapiens
ttcccagccctc

SEQ ID NO: 1286776 - DNA, 18 bp, Homo sapiens
ttcccagctctccctctg

SEQ ID NO: 1286777 - DNA, 20 bp, Homo sapiens
ttcccagctctccctctggc

SEQ ID NO: 1286778 - DNA, 15 bp, Homo sapiens
ttcccaggagaccat

SEQ ID NO: 1286779 - DNA, 12 bp, Homo sapiens
ttcccaggcctt

SEQ ID NO: 1286780 - DNA, 19 bp, Homo sapiens
ttcccagggaccagcacct

SEQ ID NO: 1286781 - DNA, 18 bp, Homo sapiens
ttcccaggttctgtttat

SEQ ID NO: 1286782 - DNA, 23 bp, Homo sapiens
ttcccagtataagatttttgaaa

SEQ ID NO: 1286783 - DNA, 18 bp, Homo sapiens
ttcccataattttcttca

SEQ ID NO: 1286784 - DNA, 22 bp, Homo sapiens
ttcccatagtggggcctgggag

SEQ ID NO: 1286785 - DNA, 13 bp, Homo sapiens
ttcccatcctacc

SEQ ID NO: 1286786 - DNA, 14 bp, Homo sapiens
ttcccatcctaccc

SEQ ID NO: 1286787 - DNA, 15 bp, Homo sapiens
ttcccatcgctgtca

SEQ ID NO: 1286788 - DNA, 18 bp, Homo sapiens
ttcccatctccagggaag

SEQ ID NO: 1286789 - DNA, 16 bp, Homo sapiens
ttcccatctttactcc

SEQ ID NO: 1286790 - DNA, 17 bp, Homo sapiens
ttcccatgactcttgga

SEQ ID NO: 1286791 - DNA, 13 bp, Homo sapiens
ttcccatgactgc

SEQ ID NO: 1286792 - DNA, 16 bp, Homo sapiens
ttcccatgactgcacc

SEQ ID NO: 1286793 - DNA, 19 bp, Homo sapiens
ttcccatgcctgtctctgt

SEQ ID NO: 1286794 - DNA, 17 bp, Homo sapiens
ttcccatggtggcctca

SEQ ID NO: 1286795 - DNA, 16 bp, Homo sapiens
ttcccatggtgtatgt

SEQ ID NO: 1286796 - DNA, 19 bp, Homo sapiens
ttcccattattatttctgt

SEQ ID NO: 1286797 - DNA, 13 bp, Homo sapiens
ttcccattttgga

SEQ ID NO: 1286798 - DNA, 15 bp, Homo sapiens
ttccccaaaaattga

SEQ ID NO: 1286799 - DNA, 21 bp, Homo sapiens
ttccccaaaggatggtcacac

SEQ ID NO: 1286800 - DNA, 21 bp, Homo sapiens
ttccccaacggggtggggagg

SEQ ID NO: 1286801 - DNA, 15 bp, Homo sapiens
ttccccaagggccaa

SEQ ID NO: 1286802 - DNA, 16 bp, Homo sapiens
ttccccacacagggca

SEQ ID NO: 1286803 - DNA, 22 bp, Homo sapiens
ttccccacacagggcactgact

SEQ ID NO: 1286804 - DNA, 17 bp, Homo sapiens
ttccccactgacagcct

SEQ ID NO: 1286805 - DNA, 14 bp, Homo sapiens
ttccccactgcctg

SEQ ID NO: 1286806 - DNA, 17 bp, Homo sapiens
ttccccagactcagctc

SEQ ID NO: 1286807 - DNA, 16 bp, Homo sapiens
ttccccagagagcagg

SEQ ID NO: 1286808 - DNA, 22 bp, Homo sapiens
ttccccagcatgcaccacgggc

SEQ ID NO: 1286809 - DNA, 14 bp, Homo sapiens
ttccccagccctta

SEQ ID NO: 1286810 - DNA, 16 bp, Homo sapiens
ttccccaggcccacca

SEQ ID NO: 1286811 - DNA, 17 bp, Homo sapiens
ttccccagggaaggaaa

SEQ ID NO: 1286812 - DNA, 18 bp, Homo sapiens
ttccccaggggaaaatga

SEQ ID NO: 1286813 - DNA, 19 bp, Homo sapiens
ttccccatcagctcccaac

SEQ ID NO: 1286814 - DNA, 15 bp, Homo sapiens
ttccccatctctgtc

SEQ ID NO: 1286815 - DNA, 19 bp, Homo sapiens
ttccccatctctgtctggg

SEQ ID NO: 1286816 - DNA, 17 bp, Homo sapiens
ttccccatctttgatcc

SEQ ID NO: 1286817 - DNA, 22 bp, Homo sapiens
ttccccatctttgatccttctg

SEQ ID NO: 1286818 - DNA, 17 bp, Homo sapiens
ttcccccaacctcagac

SEQ ID NO: 1286819 - DNA, 18 bp, Homo sapiens
ttcccccaccggtccagc

SEQ ID NO: 1286820 - DNA, 22 bp, Homo sapiens
ttcccccaccggtccagctggc

SEQ ID NO: 1286821 - DNA, 18 bp, Homo sapiens
ttcccccactactgcagc

SEQ ID NO: 1286822 - DNA, 15 bp, Homo sapiens
ttcccccactgatca

SEQ ID NO: 1286823 - DNA, 13 bp, Homo sapiens
ttcccccagccca

SEQ ID NO: 1286824 - DNA, 20 bp, Homo sapiens
ttcccccatcccctttcctc

SEQ ID NO: 1286825 - DNA, 15 bp, Homo sapiens
ttcccccatccctac

SEQ ID NO: 1286826 - DNA, 17 bp, Homo sapiens
ttcccccatccctacca

SEQ ID NO: 1286827 - DNA, 12 bp, Homo sapiens
ttccccccactc

SEQ ID NO: 1286828 - DNA, 18 bp, Homo sapiens
ttccccccactctcccca

SEQ ID NO: 1286829 - DNA, 21 bp, Homo sapiens
ttccccccactctccccacac

SEQ ID NO: 1286830 - DNA, 18 bp, Homo sapiens
ttcctgctctctgctcat

SEQ ID NO: 1286831 - DNA, 18 bp, Homo sapiens
ttcctgctgcaccctgcg

SEQ ID NO: 1286832 - DNA, 22 bp, Homo sapiens
ttcctgctgcaccctgcgcctc

SEQ ID NO: 1286833 - DNA, 12 bp, Homo sapiens
ttcctgctgctg

SEQ ID NO: 1286834 - DNA, 23 bp, Homo sapiens
ttcctgctgctgtaactgctgag

SEQ ID NO: 1286835 - DNA, 11 bp, Homo sapiens
ttcctgctgta

SEQ ID NO: 1286836 - DNA, 13 bp, Homo sapiens
ttcctgcttccga

SEQ ID NO: 1286837 - DNA, 14 bp, Homo sapiens
ttcctgctttccat

SEQ ID NO: 1286838 - DNA, 14 bp, Homo sapiens
ttcctggaaacagc

SEQ ID NO: 1286839 - DNA, 20 bp, Homo sapiens
ttcctggaaacagcatgaat

SEQ ID NO: 1286840 - DNA, 16 bp, Homo sapiens
ttcctggacacactct

SEQ ID NO: 1286841 - DNA, 15 bp, Homo sapiens
ttcctggacactcag

SEQ ID NO: 1286842 - DNA, 19 bp, Homo sapiens
ttcctggacatcaccagtc

SEQ ID NO: 1286843 - DNA, 20 bp, Homo sapiens
ttcctggacatcctcttctg

SEQ ID NO: 1286844 - DNA, 17 bp, Homo sapiens
ttcctggagtgccctgc

SEQ ID NO: 1286845 - DNA, 20 bp, Homo sapiens
ttcctggagtgccctgcagg

SEQ ID NO: 1286846 - DNA, 23 bp, Homo sapiens
ttcctggagtgccctgcaggcac

SEQ ID NO: 1286847 - DNA, 22 bp, Homo sapiens
ttcctggagttttgatttggtg

SEQ ID NO: 1286848 - DNA, 14 bp, Homo sapiens
ttcctggcagctgc

SEQ ID NO: 1286849 - DNA, 16 bp, Homo sapiens
ttcctggcagctgctg

SEQ ID NO: 1286850 - DNA, 19 bp, Homo sapiens
ttcctggcagctgctgtgg

SEQ ID NO: 1286851 - DNA, 16 bp, Homo sapiens
ttcctggcatttgctg

SEQ ID NO: 1286852 - DNA, 16 bp, Homo sapiens
ttcctggcccaggcct

SEQ ID NO: 1286853 - DNA, 14 bp, Homo sapiens
ttcctggccccctc

SEQ ID NO: 1286854 - DNA, 19 bp, Homo sapiens
ttcctggccccctcattca

SEQ ID NO: 1286855 - DNA, 10 bp, Homo sapiens
ttcctggcct

SEQ ID NO: 1286856 - DNA, 20 bp, Homo sapiens
ttcctggcctcactggctgg

SEQ ID NO: 1286857 - DNA, 14 bp, Homo sapiens
ttcctggccttctg

SEQ ID NO: 1286858 - DNA, 17 bp, Homo sapiens
ttcctggccttctgaac

SEQ ID NO: 1286859 - DNA, 18 bp, Homo sapiens
ttcctggctctaccctgt

SEQ ID NO: 1286860 - DNA, 23 bp, Homo sapiens
ttcctggctctaccctgtctgtc

SEQ ID NO: 1286861 - DNA, 12 bp, Homo sapiens
ttcctggctctg

SEQ ID NO: 1286862 - DNA, 16 bp, Homo sapiens
ttcctggctctggggg

SEQ ID NO: 1286863 - DNA, 17 bp, Homo sapiens
ttcctgggaaatattcc

SEQ ID NO: 1286864 - DNA, 21 bp, Homo sapiens
ttcctgggaaatattccctag

SEQ ID NO: 1286865 - DNA, 16 bp, Homo sapiens
ttcctgggaacatcac

SEQ ID NO: 1286866 - DNA, 16 bp, Homo sapiens
ttcctgggaatggaat

SEQ ID NO: 1286867 - DNA, 21 bp, Homo sapiens
ttcctgggaatggaataacta

SEQ ID NO: 1286868 - DNA, 17 bp, Homo sapiens
ttcctgggaggacaggc

SEQ ID NO: 1286869 - DNA, 20 bp, Homo sapiens
ttcctgggcagcctttccag

SEQ ID NO: 1286870 - DNA, 12 bp, Homo sapiens
ttcctgggcctg

SEQ ID NO: 1286871 - DNA, 23 bp, Homo sapiens
ttcctggggatgtcatagccaaa

SEQ ID NO: 1286872 - DNA, 14 bp, Homo sapiens
ttcctggggccgcc

SEQ ID NO: 1286873 - DNA, 19 bp, Homo sapiens
ttcctggggccgcctgccc

SEQ ID NO: 1286874 - DNA, 20 bp, Homo sapiens
ttcctggggccgcctgccct

SEQ ID NO: 1286875 - DNA, 18 bp, Homo sapiens
ttcctggtacccagccat

SEQ ID NO: 1286876 - DNA, 23 bp, Homo sapiens
ttcctggttaagcaggcattgct

SEQ ID NO: 1286877 - DNA, 22 bp, Homo sapiens
ttcctgtaacacaagccacaga

SEQ ID NO: 1286878 - DNA, 17 bp, Homo sapiens
ttcctgtagcatcttct

SEQ ID NO: 1286879 - DNA, 17 bp, Homo sapiens
ttcctgtcattcctcta

SEQ ID NO: 1286880 - DNA, 13 bp, Homo sapiens
ttcctgtccctga

SEQ ID NO: 1286881 - DNA, 14 bp, Homo sapiens
ttcctgtccctgag

SEQ ID NO: 1286882 - DNA, 11 bp, Homo sapiens
ttcctgtccta

SEQ ID NO: 1286883 - DNA, 16 bp, Homo sapiens
ttcctgtcctgcctcc

SEQ ID NO: 1286884 - DNA, 18 bp, Homo sapiens
ttcctgtcctgcctcctc

SEQ ID NO: 1286885 - DNA, 13 bp, Homo sapiens
ttcctgtccttgt

SEQ ID NO: 1286886 - DNA, 16 bp, Homo sapiens
ttcctgtctgtttata

SEQ ID NO: 1286887 - DNA, 17 bp, Homo sapiens
ttcctgtctgtttatat

SEQ ID NO: 1286888 - DNA, 17 bp, Homo sapiens
ttcctgtgatacatttc

SEQ ID NO: 1286889 - DNA, 19 bp, Homo sapiens
ttcctgtgatacatttctg

SEQ ID NO: 1286890 - DNA, 15 bp, Homo sapiens
ttcctgtgccaacct

SEQ ID NO: 1286891 - DNA, 14 bp, Homo sapiens
ttcctgtggccagg

SEQ ID NO: 1286892 - DNA, 19 bp, Homo sapiens
ttcctgtggccaggaggtt

SEQ ID NO: 1286893 - DNA, 21 bp, Homo sapiens
ttcctgtgtgtccaaaactgc

SEQ ID NO: 1286894 - DNA, 22 bp, Homo sapiens
ttcctgtgtgtccaaaactgcc

SEQ ID NO: 1286895 - DNA, 19 bp, Homo sapiens
ttcctgtgtttgtcctggg

SEQ ID NO: 1286896 - DNA, 21 bp, Homo sapiens
ttcctgtgtttgtcctgggtt

SEQ ID NO: 1286897 - DNA, 17 bp, Homo sapiens
ttcctgttacctgtctt

SEQ ID NO: 1286898 - DNA, 23 bp, Homo sapiens
ttcctgttaggtattagaaagtg

SEQ ID NO: 1286899 - DNA, 13 bp, Homo sapiens
ttcctgttccctc

SEQ ID NO: 1286900 - DNA, 17 bp, Homo sapiens
ttcctgttccctcctgg

SEQ ID NO: 1286901 - DNA, 20 bp, Homo sapiens
ttcctgttcttaagacgtga

SEQ ID NO: 1286902 - DNA, 14 bp, Homo sapiens
ttcctgtttactga

SEQ ID NO: 1286903 - DNA, 19 bp, Homo sapiens
ttcctgtttcagacccccc

SEQ ID NO: 1286904 - DNA, 21 bp, Homo sapiens
ttcctgtttgaaatatcatgt

SEQ ID NO: 1286905 - DNA, 22 bp, Homo sapiens
ttcctgttttgtacatagattt

SEQ ID NO: 1286906 - DNA, 21 bp, Homo sapiens
ttccttaaaattaagttgaaa

SEQ ID NO: 1286907 - DNA, 15 bp, Homo sapiens
ttccttaaactgtgt

SEQ ID NO: 1286908 - DNA, 17 bp, Homo sapiens
ttccttaaactgtgtgg

SEQ ID NO: 1286909 - DNA, 17 bp, Homo sapiens
ttccttaaatgactttt

SEQ ID NO: 1286910 - DNA, 13 bp, Homo sapiens
ttccttaagagct

SEQ ID NO: 1286911 - DNA, 20 bp, Homo sapiens
ttccttaagtcagaacagca

SEQ ID NO: 1286912 - DNA, 13 bp, Homo sapiens
ttccttacttgca

SEQ ID NO: 1286913 - DNA, 22 bp, Homo sapiens
ttccttagactcttttccttcc

SEQ ID NO: 1286914 - DNA, 23 bp, Homo sapiens
ttccttagcttagacctcagcct

SEQ ID NO: 1286915 - DNA, 12 bp, Homo sapiens
ttccttagtcat

SEQ ID NO: 1286916 - DNA, 16 bp, Homo sapiens
ttccttcactgcccca

SEQ ID NO: 1286917 - DNA, 12 bp, Homo sapiens
ttccttcagatt

SEQ ID NO: 1286918 - DNA, 14 bp, Homo sapiens
ttccttcaggtttt

SEQ ID NO: 1286919 - DNA, 14 bp, Homo sapiens
ttccttcagtttgt

SEQ ID NO: 1286920 - DNA, 20 bp, Homo sapiens
ttccttcagtttgtaaagtc

SEQ ID NO: 1286921 - DNA, 12 bp, Homo sapiens
ttccttcctaaa

SEQ ID NO: 1286922 - DNA, 14 bp, Homo sapiens
ttccttccttccct

SEQ ID NO: 1286923 - DNA, 19 bp, Homo sapiens
ttccttcgaaaggccttca

SEQ ID NO: 1286924 - DNA, 13 bp, Homo sapiens
ttccttctcccat

SEQ ID NO: 1286925 - DNA, 10 bp, Homo sapiens
ttccttctct

SEQ ID NO: 1286926 - DNA, 14 bp, Homo sapiens
ttccttctctgggt

SEQ ID NO: 1286927 - DNA, 17 bp, Homo sapiens
ttccttctgttaagaaa

SEQ ID NO: 1286928 - DNA, 21 bp, Homo sapiens
ttccttctgttaagaaaggat

SEQ ID NO: 1286929 - DNA, 23 bp, Homo sapiens
ttccttctgttaagaaaggatat

SEQ ID NO: 1286930 - DNA, 14 bp, Homo sapiens
ttccttcttcagca

SEQ ID NO: 1286931 - DNA, 13 bp, Homo sapiens
ttccttgaatctt

SEQ ID NO: 1286932 - DNA, 15 bp, Homo sapiens
ttccttgaggacaga

SEQ ID NO: 1286933 - DNA, 21 bp, Homo sapiens
ttccttgagttgattcagctc

SEQ ID NO: 1286934 - DNA, 12 bp, Homo sapiens
ttccttgcctta

SEQ ID NO: 1286935 - DNA, 15 bp, Homo sapiens
ttccttgcgcctcag

SEQ ID NO: 1286936 - DNA, 18 bp, Homo sapiens
ttccttgcgcctcagccc

SEQ ID NO: 1286937 - DNA, 15 bp, Homo sapiens
ttccttgctatttca

SEQ ID NO: 1286938 - DNA, 13 bp, Homo sapiens
ttccttgctcaac

SEQ ID NO: 1286939 - DNA, 15 bp, Homo sapiens
ttccttgctcaacca

SEQ ID NO: 1286940 - DNA, 11 bp, Homo sapiens
ttccttgctct

SEQ ID NO: 1286941 - DNA, 14 bp, Homo sapiens
ttccttgctctccc

SEQ ID NO: 1286942 - DNA, 12 bp, Homo sapiens
ttccttgctttt

SEQ ID NO: 1286943 - DNA, 16 bp, Homo sapiens
ttccttgggcgtctcc

SEQ ID NO: 1286944 - DNA, 19 bp, Homo sapiens
ttccttgggcgtctccccc

SEQ ID NO: 1286945 - DNA, 10 bp, Homo sapiens
ttccttgggg

SEQ ID NO: 1286946 - DNA, 12 bp, Homo sapiens
ttccttgggggg

SEQ ID NO: 1286947 - DNA, 12 bp, Homo sapiens
ttccttgtctct

SEQ ID NO: 1286948 - DNA, 13 bp, Homo sapiens
ttccttgtctctg

SEQ ID NO: 1286949 - DNA, 18 bp, Homo sapiens
ttccttgtgcctgctcct

SEQ ID NO: 1286950 - DNA, 15 bp, Homo sapiens
ttcctttaaaaaact

SEQ ID NO: 1286951 - DNA, 16 bp, Homo sapiens
ttcctttaaaatatat

SEQ ID NO: 1286952 - DNA, 18 bp, Homo sapiens
ttcctttacaactaaata

SEQ ID NO: 1286953 - DNA, 15 bp, Homo sapiens
ttctcctccccacct

SEQ ID NO: 1286954 - DNA, 16 bp, Homo sapiens
ttctcctccccacctg

SEQ ID NO: 1286955 - DNA, 21 bp, Homo sapiens
ttctcctccccacctgtagct

SEQ ID NO: 1286956 - DNA, 22 bp, Homo sapiens
ttctcctcttgtaaataaagcc

SEQ ID NO: 1286957 - DNA, 23 bp, Homo sapiens
ttctcctgaaacccaaagccctg

SEQ ID NO: 1286958 - DNA, 18 bp, Homo sapiens
ttctcctgacccagtccc

SEQ ID NO: 1286959 - DNA, 15 bp, Homo sapiens
ttctcctgcctgtgc

SEQ ID NO: 1286960 - DNA, 21 bp, Homo sapiens
ttctcctgcctgtgctgtgac

SEQ ID NO: 1286961 - DNA, 10 bp, Homo sapiens
ttctcctgga

SEQ ID NO: 1286962 - DNA, 22 bp, Homo sapiens
ttctcctggagatagctggggc

SEQ ID NO: 1286963 - DNA, 16 bp, Homo sapiens
ttctcctggtgactca

SEQ ID NO: 1286964 - DNA, 20 bp, Homo sapiens
ttctcctgtgaatggaggca

SEQ ID NO: 1286965 - DNA, 12 bp, Homo sapiens
ttctcctgtgct

SEQ ID NO: 1286966 - DNA, 15 bp, Homo sapiens
ttctccttagtcttc

SEQ ID NO: 1286967 - DNA, 22 bp, Homo sapiens
ttctccttcattaatgatgatc

SEQ ID NO: 1286968 - DNA, 17 bp, Homo sapiens
ttctccttctccttccc

SEQ ID NO: 1286969 - DNA, 23 bp, Homo sapiens
ttctccttgatatcattcagcat

SEQ ID NO: 1286970 - DNA, 18 bp, Homo sapiens
ttctcctttcacaacctt

SEQ ID NO: 1286971 - DNA, 14 bp, Homo sapiens
ttctcgtccccctc

SEQ ID NO: 1286972 - DNA, 20 bp, Homo sapiens
ttctcgtccccctccctgcc

SEQ ID NO: 1286973 - DNA, 19 bp, Homo sapiens
ttctctaagagaacaatgt

SEQ ID NO: 1286974 - DNA, 20 bp, Homo sapiens
ttctctaagttccactgagc

SEQ ID NO: 1286975 - DNA, 21 bp, Homo sapiens
ttctctaagttccactgagct

SEQ ID NO: 1286976 - DNA, 23 bp, Homo sapiens
ttctctaagttccactgagctcc

SEQ ID NO: 1286977 - DNA, 13 bp, Homo sapiens
ttctctaataata

SEQ ID NO: 1286978 - DNA, 14 bp, Homo sapiens
ttctctaataataa

SEQ ID NO: 1286979 - DNA, 17 bp, Homo sapiens
ttctctaataataaata

SEQ ID NO: 1286980 - DNA, 19 bp, Homo sapiens
ttctctaataataaatagt

SEQ ID NO: 1286981 - DNA, 12 bp, Homo sapiens
ttctctaatatg

SEQ ID NO: 1286982 - DNA, 21 bp, Homo sapiens
ttctctaatatggcaaccatt

SEQ ID NO: 1286983 - DNA, 17 bp, Homo sapiens
ttctctagctctctagg

SEQ ID NO: 1286984 - DNA, 16 bp, Homo sapiens
ttctctcagccagctg

SEQ ID NO: 1286985 - DNA, 12 bp, Homo sapiens
ttctctcagtga

SEQ ID NO: 1286986 - DNA, 17 bp, Homo sapiens
ttctctccacttctggt

SEQ ID NO: 1286987 - DNA, 12 bp, Homo sapiens
ttctctccagct

SEQ ID NO: 1286988 - DNA, 19 bp, Homo sapiens
ttctctccagctgactaaa

SEQ ID NO: 1286989 - DNA, 22 bp, Homo sapiens
ttctctccccaacccccattct

SEQ ID NO: 1286990 - DNA, 20 bp, Homo sapiens
ttctctccccctatttattg

SEQ ID NO: 1286991 - DNA, 12 bp, Homo sapiens
ttctctccctcc

SEQ ID NO: 1286992 - DNA, 19 bp, Homo sapiens
ttctctcccttcctctctc

SEQ ID NO: 1286993 - DNA, 21 bp, Homo sapiens
ttctctcccttcctctctcct

SEQ ID NO: 1286994 - DNA, 23 bp, Homo sapiens
ttctctccgacttcccctgggca

SEQ ID NO: 1286995 - DNA, 12 bp, Homo sapiens
ttctctcctcag

SEQ ID NO: 1286996 - DNA, 19 bp, Homo sapiens
ttctctcctcagtttacat

SEQ ID NO: 1286997 - DNA, 20 bp, Homo sapiens
ttctctcctcagtttacatc

SEQ ID NO: 1286998 - DNA, 22 bp, Homo sapiens
ttctctcctcagtttacatctt

SEQ ID NO: 1286999 - DNA, 12 bp, Homo sapiens
ttctctcctggc

SEQ ID NO: 1287000 - DNA, 19 bp, Homo sapiens
ttctctcctgtacctcttg

SEQ ID NO: 1287001 - DNA, 22 bp, Homo sapiens
ttctctcctgtacctcttgagc

SEQ ID NO: 1287002 - DNA, 14 bp, Homo sapiens
ttctctccttgccc

SEQ ID NO: 1287003 - DNA, 11 bp, Homo sapiens
ttctctccttt

SEQ ID NO: 1287004 - DNA, 22 bp, Homo sapiens
ttctctcctttctccctgcagc

SEQ ID NO: 1287005 - DNA, 17 bp, Homo sapiens
ttctctcggctccccat

SEQ ID NO: 1287006 - DNA, 12 bp, Homo sapiens
ttctctctatgc

SEQ ID NO: 1287007 - DNA, 15 bp, Homo sapiens
ttctctctatgcaaa

SEQ ID NO: 1287008 - DNA, 10 bp, Homo sapiens
ttctctctcc

SEQ ID NO: 1287009 - DNA, 15 bp, Homo sapiens
ttctctctccagggt

SEQ ID NO: 1287010 - DNA, 18 bp, Homo sapiens
ttctctctccagggtgct

SEQ ID NO: 1287011 - DNA, 13 bp, Homo sapiens
ttctctctcctgg

SEQ ID NO: 1287012 - DNA, 14 bp, Homo sapiens
ttctctctcctggt

SEQ ID NO: 1287013 - DNA, 16 bp, Homo sapiens
ttctctctcctgtcca

SEQ ID NO: 1287014 - DNA, 17 bp, Homo sapiens
ttctctctggagcccct

SEQ ID NO: 1287015 - DNA, 19 bp, Homo sapiens
ttctctcttcaatctctgg

SEQ ID NO: 1287016 - DNA, 21 bp, Homo sapiens
ttctctctttatacagctgta

SEQ ID NO: 1287017 - DNA, 20 bp, Homo sapiens
ttctctcttttaaagtattt

SEQ ID NO: 1287018 - DNA, 22 bp, Homo sapiens
ttctctgaatcagaaaagctat

SEQ ID NO: 1287019 - DNA, 11 bp, Homo sapiens
ttctctgactt

SEQ ID NO: 1287020 - DNA, 16 bp, Homo sapiens
ttctctgacttctgcc

SEQ ID NO: 1287021 - DNA, 16 bp, Homo sapiens
ttctctgagctgtgca

SEQ ID NO: 1287022 - DNA, 14 bp, Homo sapiens
ttctctgatgcaga

SEQ ID NO: 1287023 - DNA, 15 bp, Homo sapiens
ttctctgatgcagaa

SEQ ID NO: 1287024 - DNA, 21 bp, Homo sapiens
ttctctgcagtaaaacacatt

SEQ ID NO: 1287025 - DNA, 14 bp, Homo sapiens
ttctctgcccgggc

SEQ ID NO: 1287026 - DNA, 22 bp, Homo sapiens
ttctctgccgctacctccctcc

SEQ ID NO: 1287027 - DNA, 21 bp, Homo sapiens
ttctctgcctccctaagttgc

SEQ ID NO: 1287028 - DNA, 12 bp, Homo sapiens
ttctctgcctct

SEQ ID NO: 1287029 - DNA, 15 bp, Homo sapiens
ttctctgcctctggg

SEQ ID NO: 1287030 - DNA, 16 bp, Homo sapiens
ttctctgcctctgggc

SEQ ID NO: 1287031 - DNA, 11 bp, Homo sapiens
ttctctgctcc

SEQ ID NO: 1287032 - DNA, 10 bp, Homo sapiens
ttctctgctg

SEQ ID NO: 1287033 - DNA, 11 bp, Homo sapiens
ttctctgctgc

SEQ ID NO: 1287034 - DNA, 21 bp, Homo sapiens
ttctctgctgcctctgtggaa

SEQ ID NO: 1287035 - DNA, 22 bp, Homo sapiens
ttctctggaaaggggggagctg

SEQ ID NO: 1287036 - DNA, 17 bp, Homo sapiens
ttctctggagccaagtc

SEQ ID NO: 1287037 - DNA, 19 bp, Homo sapiens
ttctctgggagaaaatcat

SEQ ID NO: 1287038 - DNA, 19 bp, Homo sapiens
ttctctggtaatattgact

SEQ ID NO: 1287039 - DNA, 18 bp, Homo sapiens
ttctctggtttcaccagc

SEQ ID NO: 1287040 - DNA, 18 bp, Homo sapiens
ttctctgtacttttcatt

SEQ ID NO: 1287041 - DNA, 17 bp, Homo sapiens
ttctctgtagggaactc

SEQ ID NO: 1287042 - DNA, 14 bp, Homo sapiens
ttctctgtcctact

SEQ ID NO: 1287043 - DNA, 18 bp, Homo sapiens
ttctctgtcctacttctg

SEQ ID NO: 1287044 - DNA, 19 bp, Homo sapiens
ttctctgtcctacttctga

SEQ ID NO: 1287045 - DNA, 13 bp, Homo sapiens
ttctctgtctcat

SEQ ID NO: 1287046 - DNA, 20 bp, Homo sapiens
ttctctgttgtcgtaaagat

SEQ ID NO: 1287047 - DNA, 22 bp, Homo sapiens
ttctctgttgtcgtaaagattt

SEQ ID NO: 1287048 - DNA, 17 bp, Homo sapiens
ttctcttaaaatgacaa

SEQ ID NO: 1287049 - DNA, 17 bp, Homo sapiens
ttctcttaaatattctg

SEQ ID NO: 1287050 - DNA, 19 bp, Homo sapiens
ttctcttaagattaatttt

SEQ ID NO: 1287051 - DNA, 21 bp, Homo sapiens
ttctcttaatcactactgtat

SEQ ID NO: 1287052 - DNA, 15 bp, Homo sapiens
ttctcttaatttaat

SEQ ID NO: 1287053 - DNA, 13 bp, Homo sapiens
ttctcttacattt

SEQ ID NO: 1287054 - DNA, 13 bp, Homo sapiens
ttctcttacctgt

SEQ ID NO: 1287055 - DNA, 18 bp, Homo sapiens
ttctcttatcctctctct

SEQ ID NO: 1287056 - DNA, 14 bp, Homo sapiens
ttctcttcccaggc

SEQ ID NO: 1287057 - DNA, 17 bp, Homo sapiens
ttctcttcccaggcctt

SEQ ID NO: 1287058 - DNA, 18 bp, Homo sapiens
ttctcttccccttcctgt

SEQ ID NO: 1287059 - DNA, 23 bp, Homo sapiens
ttctcttccccttcctgtttcag

SEQ ID NO: 1287060 - DNA, 13 bp, Homo sapiens
ttctcttcctgta

SEQ ID NO: 1287061 - DNA, 16 bp, Homo sapiens
ttctcttgacagtctg

SEQ ID NO: 1287062 - DNA, 17 bp, Homo sapiens
ttctcttgacagtctga

SEQ ID NO: 1287063 - DNA, 18 bp, Homo sapiens
ttctcttgagctggcctc

SEQ ID NO: 1287064 - DNA, 19 bp, Homo sapiens
ttctcttgaggcctgtgct

SEQ ID NO: 1287065 - DNA, 15 bp, Homo sapiens
ttctcttgggcaggc

SEQ ID NO: 1287066 - DNA, 15 bp, Homo sapiens
ttctcttgggctgag

SEQ ID NO: 1287067 - DNA, 17 bp, Homo sapiens
ttctcttggtgaaataa

SEQ ID NO: 1287068 - DNA, 13 bp, Homo sapiens
ttctcttgtcctt

SEQ ID NO: 1287069 - DNA, 21 bp, Homo sapiens
ttctcttgtgatttggttgca

SEQ ID NO: 1287070 - DNA, 20 bp, Homo sapiens
ttctctttaattttaactga

SEQ ID NO: 1287071 - DNA, 14 bp, Homo sapiens
ttctctttccccca

SEQ ID NO: 1287072 - DNA, 16 bp, Homo sapiens
ttctctttctctcctt

SEQ ID NO: 1287073 - DNA, 12 bp, Homo sapiens
ttctctttgact

SEQ ID NO: 1287074 - DNA, 22 bp, Homo sapiens
ttctctttgacttaggttttta

SEQ ID NO: 1287075 - DNA, 18 bp, Homo sapiens
ttcttcgttctttttaag

SEQ ID NO: 1287076 - DNA, 12 bp, Homo sapiens
ttcttctaagaa

SEQ ID NO: 1287077 - DNA, 14 bp, Homo sapiens
ttcttctaagaaga

SEQ ID NO: 1287078 - DNA, 15 bp, Homo sapiens
ttcttctaagaagac

SEQ ID NO: 1287079 - DNA, 19 bp, Homo sapiens
ttcttctaagaagacattt

SEQ ID NO: 1287080 - DNA, 20 bp, Homo sapiens
ttcttctaagaagacatttt

SEQ ID NO: 1287081 - DNA, 21 bp, Homo sapiens
ttcttctaagaagacattttg

SEQ ID NO: 1287082 - DNA, 22 bp, Homo sapiens
ttcttctaagaagacattttgt

SEQ ID NO: 1287083 - DNA, 18 bp, Homo sapiens
ttcttctcctatgtgtaa

SEQ ID NO: 1287084 - DNA, 15 bp, Homo sapiens
ttcttctctctgttc

SEQ ID NO: 1287085 - DNA, 20 bp, Homo sapiens
ttcttctctctgttcccttc

SEQ ID NO: 1287086 - DNA, 13 bp, Homo sapiens
ttcttctgaactc

SEQ ID NO: 1287087 - DNA, 21 bp, Homo sapiens
ttcttctgccacttctgcggg

SEQ ID NO: 1287088 - DNA, 12 bp, Homo sapiens
ttcttctgcccc

SEQ ID NO: 1287089 - DNA, 14 bp, Homo sapiens
ttcttctgtaatat

SEQ ID NO: 1287090 - DNA, 13 bp, Homo sapiens
ttcttctgtattt

SEQ ID NO: 1287091 - DNA, 13 bp, Homo sapiens
ttcttctgtgtta

SEQ ID NO: 1287092 - DNA, 13 bp, Homo sapiens
ttcttcttcctgg

SEQ ID NO: 1287093 - DNA, 14 bp, Homo sapiens
ttcttcttcctggt

SEQ ID NO: 1287094 - DNA, 12 bp, Homo sapiens
ttcttctttcta

SEQ ID NO: 1287095 - DNA, 14 bp, Homo sapiens
ttcttcttttcctt

SEQ ID NO: 1287096 - DNA, 17 bp, Homo sapiens
ttcttctttttgcttca

SEQ ID NO: 1287097 - DNA, 14 bp, Homo sapiens
ttcttgaaaaagat

SEQ ID NO: 1287098 - DNA, 13 bp, Homo sapiens
ttcttgaaaagcc

SEQ ID NO: 1287099 - DNA, 17 bp, Homo sapiens
ttcttgaaaagccttgg

SEQ ID NO: 1287100 - DNA, 13 bp, Homo sapiens
ttcttgaaagctg

SEQ ID NO: 1287101 - DNA, 14 bp, Homo sapiens
ttcttgaataaaag

SEQ ID NO: 1287102 - DNA, 14 bp, Homo sapiens
ttcttgaattgtta

SEQ ID NO: 1287103 - DNA, 21 bp, Homo sapiens
ttcttgaattgttatgaaaat

SEQ ID NO: 1287104 - DNA, 20 bp, Homo sapiens
ttcttgacaaaacctaactt

SEQ ID NO: 1287105 - DNA, 21 bp, Homo sapiens
ttcttgacaaaacctaacttg

SEQ ID NO: 1287106 - DNA, 22 bp, Homo sapiens
ttcttgacaagctgacttggca

SEQ ID NO: 1287107 - DNA, 18 bp, Homo sapiens
ttcttgattaaagtgatt

SEQ ID NO: 1287108 - DNA, 15 bp, Homo sapiens
ttcttgattcctggc

SEQ ID NO: 1287109 - DNA, 19 bp, Homo sapiens
ttcttgattttcaagcttt

SEQ ID NO: 1287110 - DNA, 12 bp, Homo sapiens
ttcttgcaaagt

SEQ ID NO: 1287111 - DNA, 22 bp, Homo sapiens
ttcttgcataggctcttaagca

SEQ ID NO: 1287112 - DNA, 22 bp, Homo sapiens
ttcttgcctctgtgctgtgtgt

SEQ ID NO: 1287113 - DNA, 13 bp, Homo sapiens
ttcttgctagcta

SEQ ID NO: 1287114 - DNA, 20 bp, Homo sapiens
ttcttgctctctctccctgc

SEQ ID NO: 1287115 - DNA, 19 bp, Homo sapiens
ttcttgctgccatgatgta

SEQ ID NO: 1287116 - DNA, 12 bp, Homo sapiens
ttcttgctgccc

SEQ ID NO: 1287117 - DNA, 14 bp, Homo sapiens
ttcttgctgccctg

SEQ ID NO: 1287118 - DNA, 15 bp, Homo sapiens
ttcttgctgttcagt

SEQ ID NO: 1287119 - DNA, 19 bp, Homo sapiens
ttcttgcttcccgtccccc

SEQ ID NO: 1287120 - DNA, 17 bp, Homo sapiens
ttcttgcttctttctag

SEQ ID NO: 1287121 - DNA, 22 bp, Homo sapiens
ttcttggcttaatcattttcat

SEQ ID NO: 1287122 - DNA, 14 bp, Homo sapiens
ttcttgggaaacac

SEQ ID NO: 1287123 - DNA, 17 bp, Homo sapiens
ttcttgggaaagagaca

SEQ ID NO: 1287124 - DNA, 20 bp, Homo sapiens
ttcttgggagtatgttgtca

SEQ ID NO: 1287125 - DNA, 18 bp, Homo sapiens
ttcttggggattcaaaaa

SEQ ID NO: 1287126 - DNA, 20 bp, Homo sapiens
ttcttggggccctacacctt

SEQ ID NO: 1287127 - DNA, 16 bp, Homo sapiens
ttcttgggtctgccct

SEQ ID NO: 1287128 - DNA, 21 bp, Homo sapiens
ttcttgggtctgccctgccca

SEQ ID NO: 1287129 - DNA, 15 bp, Homo sapiens
ttcttgggtggttcc

SEQ ID NO: 1287130 - DNA, 21 bp, Homo sapiens
ttcttggtgcttacacatctc

SEQ ID NO: 1287131 - DNA, 17 bp, Homo sapiens
ttcttggttcataaatg

SEQ ID NO: 1287132 - DNA, 15 bp, Homo sapiens
ttcttggtttcagcc

SEQ ID NO: 1287133 - DNA, 18 bp, Homo sapiens
ttcttggtttcagccaag

SEQ ID NO: 1287134 - DNA, 17 bp, Homo sapiens
ttcttggtttggggaga

SEQ ID NO: 1287135 - DNA, 17 bp, Homo sapiens
ttcttggtttgtaaatt

SEQ ID NO: 1287136 - DNA, 18 bp, Homo sapiens
ttcttggtttgtaaatta

SEQ ID NO: 1287137 - DNA, 14 bp, Homo sapiens
ttcttgtaaatctt

SEQ ID NO: 1287138 - DNA, 11 bp, Homo sapiens
ttcttgtaatt

SEQ ID NO: 1287139 - DNA, 21 bp, Homo sapiens
ttcttgtaatttaaacaggcc

SEQ ID NO: 1287140 - DNA, 23 bp, Homo sapiens
ttcttgtaatttaaacaggccca

SEQ ID NO: 1287141 - DNA, 14 bp, Homo sapiens
ttcttgtcaaaaaa

SEQ ID NO: 1287142 - DNA, 16 bp, Homo sapiens
ttcttgtcacaataaa

SEQ ID NO: 1287143 - DNA, 17 bp, Homo sapiens
ttcttgtccacattcta

SEQ ID NO: 1287144 - DNA, 23 bp, Homo sapiens
ttcttgtccacattctacttcag

SEQ ID NO: 1287145 - DNA, 11 bp, Homo sapiens
ttcttgtctat

SEQ ID NO: 1287146 - DNA, 14 bp, Homo sapiens
ttcttgtctataaa

SEQ ID NO: 1287147 - DNA, 14 bp, Homo sapiens
ttcttgtctttatt

SEQ ID NO: 1287148 - DNA, 16 bp, Homo sapiens
ttcttgtcttttcaga

SEQ ID NO: 1287149 - DNA, 13 bp, Homo sapiens
ttcttgtgccctg

SEQ ID NO: 1287150 - DNA, 17 bp, Homo sapiens
ttcttgtgccctgggcc

SEQ ID NO: 1287151 - DNA, 13 bp, Homo sapiens
ttcttgtgtagat

SEQ ID NO: 1287152 - DNA, 17 bp, Homo sapiens
ttcttgtgtttgagaac

SEQ ID NO: 1287153 - DNA, 18 bp, Homo sapiens
ttcttgttggtagcatgt

SEQ ID NO: 1287154 - DNA, 14 bp, Homo sapiens
ttcttgtttgaatt

SEQ ID NO: 1287155 - DNA, 16 bp, Homo sapiens
ttctttaaaagaatga

SEQ ID NO: 1287156 - DNA, 12 bp, Homo sapiens
ttctttaaacaa

SEQ ID NO: 1287157 - DNA, 20 bp, Homo sapiens
ttctttaaacaaatatgaaa

SEQ ID NO: 1287158 - DNA, 14 bp, Homo sapiens
ttctttaaccagtc

SEQ ID NO: 1287159 - DNA, 12 bp, Homo sapiens
ttctttaactgc

SEQ ID NO: 1287160 - DNA, 18 bp, Homo sapiens
ttctttaatgcttttata

SEQ ID NO: 1287161 - DNA, 21 bp, Homo sapiens
ttctttaccaaaaccatccat

SEQ ID NO: 1287162 - DNA, 17 bp, Homo sapiens
ttctttactattaaaat

SEQ ID NO: 1287163 - DNA, 18 bp, Homo sapiens
ttctttactattaaaata

SEQ ID NO: 1287164 - DNA, 11 bp, Homo sapiens
ttctttagaac

SEQ ID NO: 1287165 - DNA, 13 bp, Homo sapiens
ttctttagaattt

SEQ ID NO: 1287166 - DNA, 20 bp, Homo sapiens
ttctttagaatttttaccca

SEQ ID NO: 1287167 - DNA, 14 bp, Homo sapiens
ttctttagagatta

SEQ ID NO: 1287168 - DNA, 16 bp, Homo sapiens
ttctttagatgccaaa

SEQ ID NO: 1287169 - DNA, 16 bp, Homo sapiens
ttctttataaaatgta

SEQ ID NO: 1287170 - DNA, 15 bp, Homo sapiens
ttctttatactgtaa

SEQ ID NO: 1287171 - DNA, 16 bp, Homo sapiens
ttctttatactgtaat

SEQ ID NO: 1287172 - DNA, 13 bp, Homo sapiens
ttctttattcttt

SEQ ID NO: 1287173 - DNA, 15 bp, Homo sapiens
ttctttattgcacta

SEQ ID NO: 1287174 - DNA, 14 bp, Homo sapiens
ttctttccaaagta

SEQ ID NO: 1287175 - DNA, 12 bp, Homo sapiens
ttctttccagag

SEQ ID NO: 1287176 - DNA, 15 bp, Homo sapiens
ttctttccatttgca

SEQ ID NO: 1287177 - DNA, 10 bp, Homo sapiens
ttctttcccc

SEQ ID NO: 1287178 - DNA, 22 bp, Homo sapiens
ttctttccccagaggctcccaa

SEQ ID NO: 1287179 - DNA, 24 bp, Homo sapiens
ttctttccccagaggctcccaatc

SEQ ID NO: 1287180 - DNA, 19 bp, Homo sapiens
ttctttccgtcaccctggg

SEQ ID NO: 1287181 - DNA, 14 bp, Homo sapiens
ttctttcctcccag

SEQ ID NO: 1287182 - DNA, 16 bp, Homo sapiens
ttctttcctctttctg

SEQ ID NO: 1287183 - DNA, 21 bp, Homo sapiens
ttctttcctctttctgctctg

SEQ ID NO: 1287184 - DNA, 14 bp, Homo sapiens
ttctttcctgccct

SEQ ID NO: 1287185 - DNA, 17 bp, Homo sapiens
ttctttctaactgtagc

SEQ ID NO: 1287186 - DNA, 12 bp, Homo sapiens
ttctttctagaa

SEQ ID NO: 1287187 - DNA, 20 bp, Homo sapiens
ttctttctcataaaactgtg

SEQ ID NO: 1287188 - DNA, 15 bp, Homo sapiens
ttctttctggactgg

SEQ ID NO: 1287189 - DNA, 11 bp, Homo sapiens
ttctttcttcc

SEQ ID NO: 1287190 - DNA, 14 bp, Homo sapiens
ttctttcttgctgg

SEQ ID NO: 1287191 - DNA, 22 bp, Homo sapiens
ttctttcttttaagcagaccca

SEQ ID NO: 1287192 - DNA, 17 bp, Homo sapiens
ttctttctttttctgga

SEQ ID NO: 1287193 - DNA, 18 bp, Homo sapiens
ttctttgaccagatcttt

SEQ ID NO: 1287194 - DNA, 14 bp, Homo sapiens
ttctttgcaccaaa

SEQ ID NO: 1287195 - DNA, 23 bp, Homo sapiens
ttctttgctgcagtcatctactt

SEQ ID NO: 1287196 - DNA, 17 bp, Homo sapiens
ttctttgctgcccctgt

SEQ ID NO: 1287197 - DNA, 11 bp, Homo sapiens
ttctttgtgtt

SEQ ID NO: 1287198 - DNA, 11 bp, Homo sapiens
ttctttgttct

SEQ ID NO: 1287199 - DNA, 13 bp, Homo sapiens
ttgacatatttaa

SEQ ID NO: 1287200 - DNA, 17 bp, Homo sapiens
ttgacatatttaatgtt

SEQ ID NO: 1287201 - DNA, 16 bp, Homo sapiens
ttgacatccaaatcta

SEQ ID NO: 1287202 - DNA, 15 bp, Homo sapiens
ttgacatgaccctct

SEQ ID NO: 1287203 - DNA, 15 bp, Homo sapiens
ttgacatgatataca

SEQ ID NO: 1287204 - DNA, 19 bp, Homo sapiens
ttgacatgtgcaattgtga

SEQ ID NO: 1287205 - DNA, 11 bp, Homo sapiens
ttgacattcct

SEQ ID NO: 1287206 - DNA, 14 bp, Homo sapiens
ttgacattgaaatc

SEQ ID NO: 1287207 - DNA, 18 bp, Homo sapiens
ttgacatttacaggaggg

SEQ ID NO: 1287208 - DNA, 17 bp, Homo sapiens
ttgacatttagaacttt

SEQ ID NO: 1287209 - DNA, 18 bp, Homo sapiens
ttgaccaagaactgcatg

SEQ ID NO: 1287210 - DNA, 17 bp, Homo sapiens
ttgaccacggctgttcc

SEQ ID NO: 1287211 - DNA, 22 bp, Homo sapiens
ttgaccagataaatagaactat

SEQ ID NO: 1287212 - DNA, 19 bp, Homo sapiens
ttgaccagatctttctctt

SEQ ID NO: 1287213 - DNA, 17 bp, Homo sapiens
ttgaccatctgctttta

SEQ ID NO: 1287214 - DNA, 18 bp, Homo sapiens
ttgacccaggtggctagc

SEQ ID NO: 1287215 - DNA, 15 bp, Homo sapiens
ttgaccccagtttct

SEQ ID NO: 1287216 - DNA, 12 bp, Homo sapiens
ttgaccctgcac

SEQ ID NO: 1287217 - DNA, 17 bp, Homo sapiens
ttgaccctttcctcccc

SEQ ID NO: 1287218 - DNA, 21 bp, Homo sapiens
ttgaccctttcctcccccagc

SEQ ID NO: 1287219 - DNA, 16 bp, Homo sapiens
ttgaccgtactctcac

SEQ ID NO: 1287220 - DNA, 18 bp, Homo sapiens
ttgacctcagctgcacat

SEQ ID NO: 1287221 - DNA, 15 bp, Homo sapiens
ttgacctctgcagca

SEQ ID NO: 1287222 - DNA, 19 bp, Homo sapiens
ttgacctctgtgaccaact

SEQ ID NO: 1287223 - DNA, 18 bp, Homo sapiens
ttgacctgaggagacatc

SEQ ID NO: 1287224 - DNA, 21 bp, Homo sapiens
ttgacctgctccgctgctcct

SEQ ID NO: 1287225 - DNA, 19 bp, Homo sapiens
ttgacctgtttctctttgt

SEQ ID NO: 1287226 - DNA, 17 bp, Homo sapiens
ttgaccttcccaaggtt

SEQ ID NO: 1287227 - DNA, 15 bp, Homo sapiens
ttgacgcttgcttag

SEQ ID NO: 1287228 - DNA, 17 bp, Homo sapiens
ttgacggccttcttggt

SEQ ID NO: 1287229 - DNA, 22 bp, Homo sapiens
ttgacgggagcattggcccctg

SEQ ID NO: 1287230 - DNA, 22 bp, Homo sapiens
ttgacgtcactttttggccatg

SEQ ID NO: 1287231 - DNA, 19 bp, Homo sapiens
ttgacgtttcttctttcta

SEQ ID NO: 1287232 - DNA, 20 bp, Homo sapiens
ttgacgtttcttctttctag

SEQ ID NO: 1287233 - DNA, 15 bp, Homo sapiens
ttgactaaataaaaa

SEQ ID NO: 1287234 - DNA, 21 bp, Homo sapiens
ttgactaagaattttgtttta

SEQ ID NO: 1287235 - DNA, 21 bp, Homo sapiens
ttgactagggattcaggctgc

SEQ ID NO: 1287236 - DNA, 17 bp, Homo sapiens
ttgactatcaaactgaa

SEQ ID NO: 1287237 - DNA, 14 bp, Homo sapiens
ttgactcacctgtt

SEQ ID NO: 1287238 - DNA, 14 bp, Homo sapiens
ttgactcagtgata

SEQ ID NO: 1287239 - DNA, 14 bp, Homo sapiens
ttgactcagttcca

SEQ ID NO: 1287240 - DNA, 22 bp, Homo sapiens
ttgactcatggcagctgtttct

SEQ ID NO: 1287241 - DNA, 19 bp, Homo sapiens
ttgactcccaagtttccat

SEQ ID NO: 1287242 - DNA, 16 bp, Homo sapiens
ttgactcctttccaat

SEQ ID NO: 1287243 - DNA, 14 bp, Homo sapiens
ttgactctaaatgc

SEQ ID NO: 1287244 - DNA, 16 bp, Homo sapiens
ttgactcttccgtgca

SEQ ID NO: 1287245 - DNA, 17 bp, Homo sapiens
ttgactcttccgtgcat

SEQ ID NO: 1287246 - DNA, 23 bp, Homo sapiens
ttgactcttccgtgcatcccaga

SEQ ID NO: 1287247 - DNA, 15 bp, Homo sapiens
ttgactctttcaaag

SEQ ID NO: 1287248 - DNA, 21 bp, Homo sapiens
ttgactcttttgccattaaac

SEQ ID NO: 1287249 - DNA, 12 bp, Homo sapiens
ttgactgctgct

SEQ ID NO: 1287250 - DNA, 15 bp, Homo sapiens
ttgactgctgctccc

SEQ ID NO: 1287251 - DNA, 17 bp, Homo sapiens
ttgactgggtttctctg

SEQ ID NO: 1287252 - DNA, 13 bp, Homo sapiens
ttgactgtacaga

SEQ ID NO: 1287253 - DNA, 17 bp, Homo sapiens
ttgactgtacagagact

SEQ ID NO: 1287254 - DNA, 17 bp, Homo sapiens
ttgactgtagccacagc

SEQ ID NO: 1287255 - DNA, 15 bp, Homo sapiens
ttgactgtgattaga

SEQ ID NO: 1287256 - DNA, 17 bp, Homo sapiens
ttgactgtgattagatc

SEQ ID NO: 1287257 - DNA, 23 bp, Homo sapiens
ttgacttagatattaaaatttgg

SEQ ID NO: 1287258 - DNA, 18 bp, Homo sapiens
ttgacttcagctgcctga

SEQ ID NO: 1287259 - DNA, 16 bp, Homo sapiens
ttgacttgcatgaaga

SEQ ID NO: 1287260 - DNA, 13 bp, Homo sapiens
ttgactttaattt

SEQ ID NO: 1287261 - DNA, 14 bp, Homo sapiens
ttgactttaattta

SEQ ID NO: 1287262 - DNA, 23 bp, Homo sapiens
ttgactttacgcccatctcagga

SEQ ID NO: 1287263 - DNA, 12 bp, Homo sapiens
ttgactttcagg

SEQ ID NO: 1287264 - DNA, 14 bp, Homo sapiens
ttgactttcaggta

SEQ ID NO: 1287265 - DNA, 14 bp, Homo sapiens
ttgactttgctcct

SEQ ID NO: 1287266 - DNA, 16 bp, Homo sapiens
ttgactttttgcattt

SEQ ID NO: 1287267 - DNA, 11 bp, Homo sapiens
ttgagaaaaat

SEQ ID NO: 1287268 - DNA, 23 bp, Homo sapiens
ttgagaaaaatagagcaaaatca

SEQ ID NO: 1287269 - DNA, 19 bp, Homo sapiens
ttgagaactgcatatgttt

SEQ ID NO: 1287270 - DNA, 21 bp, Homo sapiens
ttgagaactgcatatgtttcg

SEQ ID NO: 1287271 - DNA, 22 bp, Homo sapiens
ttgagaagacctcacctagaaa

SEQ ID NO: 1287272 - DNA, 20 bp, Homo sapiens
ttgagaaggaaaattttagc

SEQ ID NO: 1287273 - DNA, 16 bp, Homo sapiens
ttgagaaggaaataaa

SEQ ID NO: 1287274 - DNA, 20 bp, Homo sapiens
ttgagaatcccttaaaatta

SEQ ID NO: 1287275 - DNA, 18 bp, Homo sapiens
ttgagaatggttacaaag

SEQ ID NO: 1287276 - DNA, 19 bp, Homo sapiens
ttgagacaagccctggcaa

SEQ ID NO: 1287277 - DNA, 20 bp, Homo sapiens
ttgagacactggtttacact

SEQ ID NO: 1287278 - DNA, 16 bp, Homo sapiens
ttgagacttcaagctt

SEQ ID NO: 1287279 - DNA, 14 bp, Homo sapiens
ttgagactttcttc

SEQ ID NO: 1287280 - DNA, 23 bp, Homo sapiens
ttgagactttcttctagtgcttt

SEQ ID NO: 1287281 - DNA, 18 bp, Homo sapiens
ttgagagaagccacgctg

SEQ ID NO: 1287282 - DNA, 23 bp, Homo sapiens
ttgagagaagccacgctgtcctc

SEQ ID NO: 1287283 - DNA, 15 bp, Homo sapiens
ttgagagttcacaga

SEQ ID NO: 1287284 - DNA, 17 bp, Homo sapiens
ttgagatactattttca

SEQ ID NO: 1287285 - DNA, 20 bp, Homo sapiens
ttgagatactattttcattt

SEQ ID NO: 1287286 - DNA, 18 bp, Homo sapiens
ttgagatagaagaactgc

SEQ ID NO: 1287287 - DNA, 17 bp, Homo sapiens
ttgagatagttttcatc

SEQ ID NO: 1287288 - DNA, 19 bp, Homo sapiens
ttgagatctggggaggcag

SEQ ID NO: 1287289 - DNA, 21 bp, Homo sapiens
ttgagatgagtttctggggaa

SEQ ID NO: 1287290 - DNA, 17 bp, Homo sapiens
ttgagattagagggagg

SEQ ID NO: 1287291 - DNA, 15 bp, Homo sapiens
ttgagcaatttcccc

SEQ ID NO: 1287292 - DNA, 22 bp, Homo sapiens
ttgagcagtggcctacaaatca

SEQ ID NO: 1287293 - DNA, 19 bp, Homo sapiens
ttgagcagtggctggtcca

SEQ ID NO: 1287294 - DNA, 19 bp, Homo sapiens
ttgagcatcaatcttgtta

SEQ ID NO: 1287295 - DNA, 20 bp, Homo sapiens
ttgagcatgacagcctgcag

SEQ ID NO: 1287296 - DNA, 20 bp, Homo sapiens
ttgagcatgcacagctgctt

SEQ ID NO: 1287297 - DNA, 17 bp, Homo sapiens
ttgagcatttttaaggg

SEQ ID NO: 1287298 - DNA, 22 bp, Homo sapiens
ttgagccaggcctgggtctgtg

SEQ ID NO: 1287299 - DNA, 17 bp, Homo sapiens
ttgagccaggtggatgt

SEQ ID NO: 1287300 - DNA, 23 bp, Homo sapiens
ttgagccagtaatctttatactg

SEQ ID NO: 1287301 - DNA, 17 bp, Homo sapiens
ttgagcccattcttctg

SEQ ID NO: 1287302 - DNA, 17 bp, Homo sapiens
ttgagccccagtgctgg

SEQ ID NO: 1287303 - DNA, 14 bp, Homo sapiens
ttgagccctggctg

SEQ ID NO: 1287304 - DNA, 15 bp, Homo sapiens
ttgagccctggctgt

SEQ ID NO: 1287305 - DNA, 19 bp, Homo sapiens
ttgagccttgaactttgac

SEQ ID NO: 1287306 - DNA, 21 bp, Homo sapiens
ttgagccttgcatgtacttga

SEQ ID NO: 1287307 - DNA, 16 bp, Homo sapiens
ttgagctattcacctc

SEQ ID NO: 1287308 - DNA, 20 bp, Homo sapiens
ttgagctattcacctcagta

SEQ ID NO: 1287309 - DNA, 15 bp, Homo sapiens
ttgagctattgctgt

SEQ ID NO: 1287310 - DNA, 23 bp, Homo sapiens
ttgagctcagacccccactctca

SEQ ID NO: 1287311 - DNA, 17 bp, Homo sapiens
ttgagctctgtaactta

SEQ ID NO: 1287312 - DNA, 14 bp, Homo sapiens
ttgagctgaaatgc

SEQ ID NO: 1287313 - DNA, 12 bp, Homo sapiens
ttgagctgcctt

SEQ ID NO: 1287314 - DNA, 16 bp, Homo sapiens
ttgagctgccttccct

SEQ ID NO: 1287315 - DNA, 11 bp, Homo sapiens
ttgagctggcc

SEQ ID NO: 1287316 - DNA, 12 bp, Homo sapiens
ttgagctggcct

SEQ ID NO: 1287317 - DNA, 13 bp, Homo sapiens
ttgagctggcctc

SEQ ID NO: 1287318 - DNA, 20 bp, Homo sapiens
ttgagctgttgtgagctttg

SEQ ID NO: 1287319 - DNA, 13 bp, Homo sapiens
ttgaggaaaacaa

SEQ ID NO: 1287320 - DNA, 14 bp, Homo sapiens
ttgaggaagttttg

SEQ ID NO: 1287321 - DNA, 22 bp, Homo sapiens
ttgccaagacaaatcaacagaa

SEQ ID NO: 1287322 - DNA, 23 bp, Homo sapiens
ttgccaagggcccaaagaaagag

SEQ ID NO: 1287323 - DNA, 18 bp, Homo sapiens
ttgccaatttttgttttc

SEQ ID NO: 1287324 - DNA, 15 bp, Homo sapiens
ttgccacaaccctgt

SEQ ID NO: 1287325 - DNA, 21 bp, Homo sapiens
ttgccacaccaatcagagagc

SEQ ID NO: 1287326 - DNA, 14 bp, Homo sapiens
ttgccacagctttt

SEQ ID NO: 1287327 - DNA, 15 bp, Homo sapiens
ttgccaccaggagaa

SEQ ID NO: 1287328 - DNA, 14 bp, Homo sapiens
ttgccaccccaacc

SEQ ID NO: 1287329 - DNA, 15 bp, Homo sapiens
ttgccacccccagtt

SEQ ID NO: 1287330 - DNA, 12 bp, Homo sapiens
ttgccactaatt

SEQ ID NO: 1287331 - DNA, 18 bp, Homo sapiens
ttgccactgcctcttcct

SEQ ID NO: 1287332 - DNA, 14 bp, Homo sapiens
ttgccactttggct

SEQ ID NO: 1287333 - DNA, 15 bp, Homo sapiens
ttgccactttggctt

SEQ ID NO: 1287334 - DNA, 22 bp, Homo sapiens
ttgccagacatgtggtgggaca

SEQ ID NO: 1287335 - DNA, 12 bp, Homo sapiens
ttgccagactct

SEQ ID NO: 1287336 - DNA, 24 bp, Homo sapiens
ttgccagactctaggttatacaat

SEQ ID NO: 1287337 - DNA, 14 bp, Homo sapiens
ttgccagacttaaa

SEQ ID NO: 1287338 - DNA, 12 bp, Homo sapiens
ttgccagagcag

SEQ ID NO: 1287339 - DNA, 15 bp, Homo sapiens
ttgccagagcaggag

SEQ ID NO: 1287340 - DNA, 13 bp, Homo sapiens
ttgccagcctcct

SEQ ID NO: 1287341 - DNA, 24 bp, Homo sapiens
ttgccagcctccttgctgacccca

SEQ ID NO: 1287342 - DNA, 15 bp, Homo sapiens
ttgccagctgctgct

SEQ ID NO: 1287343 - DNA, 18 bp, Homo sapiens
ttgccagcttttcctccc

SEQ ID NO: 1287344 - DNA, 19 bp, Homo sapiens
ttgccagcttttcctccct

SEQ ID NO: 1287345 - DNA, 20 bp, Homo sapiens
ttgccagcttttcctccctt

SEQ ID NO: 1287346 - DNA, 22 bp, Homo sapiens
ttgccagcttttcctcccttgg

SEQ ID NO: 1287347 - DNA, 15 bp, Homo sapiens
ttgccagggcagggt

SEQ ID NO: 1287348 - DNA, 13 bp, Homo sapiens
ttgccaggggcat

SEQ ID NO: 1287349 - DNA, 21 bp, Homo sapiens
ttgccagtcttttgtcctgca

SEQ ID NO: 1287350 - DNA, 15 bp, Homo sapiens
ttgccagtgaagact

SEQ ID NO: 1287351 - DNA, 17 bp, Homo sapiens
ttgccatcaatgatcat

SEQ ID NO: 1287352 - DNA, 23 bp, Homo sapiens
ttgccatcccctatggaccagaa

SEQ ID NO: 1287353 - DNA, 20 bp, Homo sapiens
ttgccatgacatttcatctg

SEQ ID NO: 1287354 - DNA, 14 bp, Homo sapiens
ttgccatgggcctg

SEQ ID NO: 1287355 - DNA, 14 bp, Homo sapiens
ttgccatttctctg

SEQ ID NO: 1287356 - DNA, 15 bp, Homo sapiens
ttgccatttctctgc

SEQ ID NO: 1287357 - DNA, 23 bp, Homo sapiens
ttgccatttttctataaatcagt

SEQ ID NO: 1287358 - DNA, 21 bp, Homo sapiens
ttgcccacccctcactcccca

SEQ ID NO: 1287359 - DNA, 17 bp, Homo sapiens
ttgcccagagatgcctc

SEQ ID NO: 1287360 - DNA, 20 bp, Homo sapiens
ttgcccaggctagagtgcaa

SEQ ID NO: 1287361 - DNA, 18 bp, Homo sapiens
ttgcccaggctggtctca

SEQ ID NO: 1287362 - DNA, 17 bp, Homo sapiens
ttgcccagggctcagcc

SEQ ID NO: 1287363 - DNA, 20 bp, Homo sapiens
ttgcccagggctcagcctgg

SEQ ID NO: 1287364 - DNA, 18 bp, Homo sapiens
ttgcccagggtcctgtgc

SEQ ID NO: 1287365 - DNA, 20 bp, Homo sapiens
ttgcccagggtcctgtgcct

SEQ ID NO: 1287366 - DNA, 15 bp, Homo sapiens
ttgcccagtcctggg

SEQ ID NO: 1287367 - DNA, 16 bp, Homo sapiens
ttgcccatcagccatt

SEQ ID NO: 1287368 - DNA, 14 bp, Homo sapiens
ttgcccatccatct

SEQ ID NO: 1287369 - DNA, 14 bp, Homo sapiens
ttgcccatcctgac

SEQ ID NO: 1287370 - DNA, 15 bp, Homo sapiens
ttgcccatgatataa

SEQ ID NO: 1287371 - DNA, 14 bp, Homo sapiens
ttgccccactcctc

SEQ ID NO: 1287372 - DNA, 20 bp, Homo sapiens
ttgccccactctgcctgcct

SEQ ID NO: 1287373 - DNA, 17 bp, Homo sapiens
ttgccccagacctggaa

SEQ ID NO: 1287374 - DNA, 14 bp, Homo sapiens
ttgccccagagccc

SEQ ID NO: 1287375 - DNA, 12 bp, Homo sapiens
ttgccccaggac

SEQ ID NO: 1287376 - DNA, 19 bp, Homo sapiens
ttgccccaggactctggca

SEQ ID NO: 1287377 - DNA, 13 bp, Homo sapiens
ttgccccaggcca

SEQ ID NO: 1287378 - DNA, 13 bp, Homo sapiens
ttgccccagtttg

SEQ ID NO: 1287379 - DNA, 14 bp, Homo sapiens
ttgcccccatccct

SEQ ID NO: 1287380 - DNA, 12 bp, Homo sapiens
ttgccccccacc

SEQ ID NO: 1287381 - DNA, 23 bp, Homo sapiens
ttgccccgactccgcttcccctg

SEQ ID NO: 1287382 - DNA, 22 bp, Homo sapiens
ttgccccggccccggccccagc

SEQ ID NO: 1287383 - DNA, 23 bp, Homo sapiens
ttgcccgccagcctcagtgccac

SEQ ID NO: 1287384 - DNA, 14 bp, Homo sapiens
ttgcccgctcccac

SEQ ID NO: 1287385 - DNA, 17 bp, Homo sapiens
ttgcccttcacagtgtt

SEQ ID NO: 1287386 - DNA, 16 bp, Homo sapiens
ttgcccttgccctgac

SEQ ID NO: 1287387 - DNA, 23 bp, Homo sapiens
ttgccctttccttttaaaaggcc

SEQ ID NO: 1287388 - DNA, 18 bp, Homo sapiens
ttgccgagcctaatgaaa

SEQ ID NO: 1287389 - DNA, 21 bp, Homo sapiens
ttgccgcgtcgccctcccagg

SEQ ID NO: 1287390 - DNA, 22 bp, Homo sapiens
ttgcctataatacttgcaacta

SEQ ID NO: 1287391 - DNA, 20 bp, Homo sapiens
ttgcctatggatcaaagaaa

SEQ ID NO: 1287392 - DNA, 15 bp, Homo sapiens
ttgcctcatttccct

SEQ ID NO: 1287393 - DNA, 16 bp, Homo sapiens
ttgcctcatttcccta

SEQ ID NO: 1287394 - DNA, 21 bp, Homo sapiens
ttgcctcatttcttcctctgc

SEQ ID NO: 1287395 - DNA, 17 bp, Homo sapiens
ttgcctccccatttccc

SEQ ID NO: 1287396 - DNA, 12 bp, Homo sapiens
ttgcctcctccc

SEQ ID NO: 1287397 - DNA, 12 bp, Homo sapiens
ttgcctctactt

SEQ ID NO: 1287398 - DNA, 19 bp, Homo sapiens
ttgcctctgtgctgtgtgt

SEQ ID NO: 1287399 - DNA, 13 bp, Homo sapiens
ttgcctctttctc

SEQ ID NO: 1287400 - DNA, 23 bp, Homo sapiens
ttgcctgaacatccttccttccc

SEQ ID NO: 1287401 - DNA, 17 bp, Homo sapiens
ttgcctgaactccagag

SEQ ID NO: 1287402 - DNA, 19 bp, Homo sapiens
ttgcctgaactcctgccat

SEQ ID NO: 1287403 - DNA, 13 bp, Homo sapiens
ttgcctgaagctt

SEQ ID NO: 1287404 - DNA, 21 bp, Homo sapiens
ttgcctgagaagaagtggctg

SEQ ID NO: 1287405 - DNA, 15 bp, Homo sapiens
ttgcctgaggctgta

SEQ ID NO: 1287406 - DNA, 16 bp, Homo sapiens
ttgcctgatataaatg

SEQ ID NO: 1287407 - DNA, 15 bp, Homo sapiens
ttgcctgcagagaga

SEQ ID NO: 1287408 - DNA, 23 bp, Homo sapiens
ttgcctgcaggtcagttgtaata

SEQ ID NO: 1287409 - DNA, 12 bp, Homo sapiens
ttgcctgcagtt

SEQ ID NO: 1287410 - DNA, 14 bp, Homo sapiens
ttgcctgccctcct

SEQ ID NO: 1287411 - DNA, 11 bp, Homo sapiens
ttgcctgcctc

SEQ ID NO: 1287412 - DNA, 12 bp, Homo sapiens
ttgcctgcctcc

SEQ ID NO: 1287413 - DNA, 15 bp, Homo sapiens
ttgcctgcctcctag

SEQ ID NO: 1287414 - DNA, 16 bp, Homo sapiens
ttgcctgcctcctagg

SEQ ID NO: 1287415 - DNA, 17 bp, Homo sapiens
ttgcctgcctcctaggc

SEQ ID NO: 1287416 - DNA, 14 bp, Homo sapiens
ttgcctgctgtatt

SEQ ID NO: 1287417 - DNA, 11 bp, Homo sapiens
ttgcctggcct

SEQ ID NO: 1287418 - DNA, 11 bp, Homo sapiens
ttgcctggctg

SEQ ID NO: 1287419 - DNA, 19 bp, Homo sapiens
ttgcctggctgtggaggcc

SEQ ID NO: 1287420 - DNA, 17 bp, Homo sapiens
ttgcctgggctgggcag

SEQ ID NO: 1287421 - DNA, 19 bp, Homo sapiens
ttgcctgggctgggcagcc

SEQ ID NO: 1287422 - DNA, 20 bp, Homo sapiens
ttgcctgggctgggcagcct

SEQ ID NO: 1287423 - DNA, 13 bp, Homo sapiens
ttgcctggtacag

SEQ ID NO: 1287424 - DNA, 11 bp, Homo sapiens
ttgcctgttct

SEQ ID NO: 1287425 - DNA, 13 bp, Homo sapiens
ttgccttaaaata

SEQ ID NO: 1287426 - DNA, 20 bp, Homo sapiens
ttgccttaataaatatgtaa

SEQ ID NO: 1287427 - DNA, 22 bp, Homo sapiens
ttgccttaataaatatgtaata

SEQ ID NO: 1287428 - DNA, 22 bp, Homo sapiens
ttgccttatttctcattgcctc

SEQ ID NO: 1287429 - DNA, 19 bp, Homo sapiens
ttgccttatttgtctgtaa

SEQ ID NO: 1287430 - DNA, 21 bp, Homo sapiens
ttgccttcctcgtgcagagct

SEQ ID NO: 1287431 - DNA, 22 bp, Homo sapiens
ttgccttcctcgtgcagagctg

SEQ ID NO: 1287432 - DNA, 22 bp, Homo sapiens
ttgccttcctttctccaggacc

SEQ ID NO: 1287433 - DNA, 17 bp, Homo sapiens
ttgccttctacttttaa

SEQ ID NO: 1287434 - DNA, 18 bp, Homo sapiens
ttgccttgaaccacttcc

SEQ ID NO: 1287435 - DNA, 14 bp, Homo sapiens
ttgccttgagttta

SEQ ID NO: 1287436 - DNA, 19 bp, Homo sapiens
ttgccttgcagaactgcca

SEQ ID NO: 1287437 - DNA, 16 bp, Homo sapiens
ttgccttgctgtttgt

SEQ ID NO: 1287438 - DNA, 13 bp, Homo sapiens
ttgccttgcttct

SEQ ID NO: 1287439 - DNA, 19 bp, Homo sapiens
ttgccttgcttctcccatt

SEQ ID NO: 1287440 - DNA, 22 bp, Homo sapiens
ttgccttgcttctcccatttcc

SEQ ID NO: 1287441 - DNA, 22 bp, Homo sapiens
ttgcctttaatattttgtaata

SEQ ID NO: 1287442 - DNA, 23 bp, Homo sapiens
ttgcctttaatattttgtaatat

SEQ ID NO: 1287443 - DNA, 19 bp, Homo sapiens
ttggaatggaactactgta

SEQ ID NO: 1287444 - DNA, 17 bp, Homo sapiens
ttggaattaacctggtg

SEQ ID NO: 1287445 - DNA, 18 bp, Homo sapiens
ttggaattaacctggtgc

SEQ ID NO: 1287446 - DNA, 19 bp, Homo sapiens
ttggaattaacctggtgct

SEQ ID NO: 1287447 - DNA, 17 bp, Homo sapiens
ttggaattggtgtatat

SEQ ID NO: 1287448 - DNA, 20 bp, Homo sapiens
ttggacaaatcacatatttt

SEQ ID NO: 1287449 - DNA, 14 bp, Homo sapiens
ttggacagacactg

SEQ ID NO: 1287450 - DNA, 17 bp, Homo sapiens
ttggacagacactgttg

SEQ ID NO: 1287451 - DNA, 23 bp, Homo sapiens
ttggacagatttcagtaatgtct

SEQ ID NO: 1287452 - DNA, 13 bp, Homo sapiens
ttggacagcaaaa

SEQ ID NO: 1287453 - DNA, 18 bp, Homo sapiens
ttggacagcaaaaccatt

SEQ ID NO: 1287454 - DNA, 13 bp, Homo sapiens
ttggacagctgct

SEQ ID NO: 1287455 - DNA, 16 bp, Homo sapiens
ttggacagtctccctg

SEQ ID NO: 1287456 - DNA, 15 bp, Homo sapiens
ttggacagtggcctc

SEQ ID NO: 1287457 - DNA, 17 bp, Homo sapiens
ttggacatctctctggc

SEQ ID NO: 1287458 - DNA, 18 bp, Homo sapiens
ttggacatggaaagaaaa

SEQ ID NO: 1287459 - DNA, 18 bp, Homo sapiens
ttggaccactcctgtccc

SEQ ID NO: 1287460 - DNA, 14 bp, Homo sapiens
ttggaccagatcta

SEQ ID NO: 1287461 - DNA, 15 bp, Homo sapiens
ttggacccagggcct

SEQ ID NO: 1287462 - DNA, 17 bp, Homo sapiens
ttggacccagggcctga

SEQ ID NO: 1287463 - DNA, 15 bp, Homo sapiens
ttggaccccagctgg

SEQ ID NO: 1287464 - DNA, 15 bp, Homo sapiens
ttggacccttggaaa

SEQ ID NO: 1287465 - DNA, 19 bp, Homo sapiens
ttggacctaaatggcctca

SEQ ID NO: 1287466 - DNA, 14 bp, Homo sapiens
ttggacctctgctc

SEQ ID NO: 1287467 - DNA, 18 bp, Homo sapiens
ttggacctctgctctgag

SEQ ID NO: 1287468 - DNA, 15 bp, Homo sapiens
ttggactcttgctct

SEQ ID NO: 1287469 - DNA, 17 bp, Homo sapiens
ttggactcttgctcttt

SEQ ID NO: 1287470 - DNA, 22 bp, Homo sapiens
ttggactgttcaagcaaaaaag

SEQ ID NO: 1287471 - DNA, 17 bp, Homo sapiens
ttggacttgagaaagat

SEQ ID NO: 1287472 - DNA, 18 bp, Homo sapiens
ttggacttttcgttaaca

SEQ ID NO: 1287473 - DNA, 15 bp, Homo sapiens
ttggagaaattattt

SEQ ID NO: 1287474 - DNA, 18 bp, Homo sapiens
ttggagaagtctcagcta

SEQ ID NO: 1287475 - DNA, 17 bp, Homo sapiens
ttggagagcagctggct

SEQ ID NO: 1287476 - DNA, 13 bp, Homo sapiens
ttggagagggaag

SEQ ID NO: 1287477 - DNA, 17 bp, Homo sapiens
ttggagagtaaaaactg

SEQ ID NO: 1287478 - DNA, 18 bp, Homo sapiens
ttggagagtaaaaactga

SEQ ID NO: 1287479 - DNA, 15 bp, Homo sapiens
ttggagcaaaccatt

SEQ ID NO: 1287480 - DNA, 20 bp, Homo sapiens
ttggagcaaagaaggagctg

SEQ ID NO: 1287481 - DNA, 15 bp, Homo sapiens
ttggagcacaaaatt

SEQ ID NO: 1287482 - DNA, 13 bp, Homo sapiens
ttggagcacctgg

SEQ ID NO: 1287483 - DNA, 19 bp, Homo sapiens
ttggagcactagtttgatt

SEQ ID NO: 1287484 - DNA, 22 bp, Homo sapiens
ttggagcaggcaaaaaagggac

SEQ ID NO: 1287485 - DNA, 23 bp, Homo sapiens
ttggagcattaactaaatgctca

SEQ ID NO: 1287486 - DNA, 20 bp, Homo sapiens
ttggagccactcctgtcccg

SEQ ID NO: 1287487 - DNA, 15 bp, Homo sapiens
ttggagcccagggca

SEQ ID NO: 1287488 - DNA, 20 bp, Homo sapiens
ttggagcgagcatcccccaa

SEQ ID NO: 1287489 - DNA, 16 bp, Homo sapiens
ttggagcgtggactgg

SEQ ID NO: 1287490 - DNA, 16 bp, Homo sapiens
ttggagctattcaaga

SEQ ID NO: 1287491 - DNA, 21 bp, Homo sapiens
ttggaggaggggtatgaagta

SEQ ID NO: 1287492 - DNA, 17 bp, Homo sapiens
ttggaggcctttcatcc

SEQ ID NO: 1287493 - DNA, 20 bp, Homo sapiens
ttggagggaaccaccagcgt

SEQ ID NO: 1287494 - DNA, 15 bp, Homo sapiens
ttggaggggggagcc

SEQ ID NO: 1287495 - DNA, 23 bp, Homo sapiens
ttggagtaaatatatatgtcaat

SEQ ID NO: 1287496 - DNA, 14 bp, Homo sapiens
ttggagtgagccag

SEQ ID NO: 1287497 - DNA, 14 bp, Homo sapiens
ttggagtgtaaacc

SEQ ID NO: 1287498 - DNA, 18 bp, Homo sapiens
ttggagtgttatgtattt

SEQ ID NO: 1287499 - DNA, 21 bp, Homo sapiens
ttggagttttatttttaagaa

SEQ ID NO: 1287500 - DNA, 13 bp, Homo sapiens
ttggataaatcat

SEQ ID NO: 1287501 - DNA, 19 bp, Homo sapiens
ttggataaatcatttcagt

SEQ ID NO: 1287502 - DNA, 22 bp, Homo sapiens
ttggataagtagggctaagcca

SEQ ID NO: 1287503 - DNA, 14 bp, Homo sapiens
ttggatacagctgc

SEQ ID NO: 1287504 - DNA, 15 bp, Homo sapiens
ttggatacagctgct

SEQ ID NO: 1287505 - DNA, 17 bp, Homo sapiens
ttggatacatctgctgt

SEQ ID NO: 1287506 - DNA, 17 bp, Homo sapiens
ttggataccagctcagg

SEQ ID NO: 1287507 - DNA, 18 bp, Homo sapiens
ttggatatttttgtactt

SEQ ID NO: 1287508 - DNA, 16 bp, Homo sapiens
ttggatcttgaatgtg

SEQ ID NO: 1287509 - DNA, 19 bp, Homo sapiens
ttggatcttttactttaaa

SEQ ID NO: 1287510 - DNA, 14 bp, Homo sapiens
ttggatctttttaa

SEQ ID NO: 1287511 - DNA, 20 bp, Homo sapiens
ttggatgcgagcttggcctt

SEQ ID NO: 1287512 - DNA, 21 bp, Homo sapiens
ttggatggagtccagggaaga

SEQ ID NO: 1287513 - DNA, 22 bp, Homo sapiens
ttggatgggactagagctttct

SEQ ID NO: 1287514 - DNA, 23 bp, Homo sapiens
ttggatgggagtgggcacctcag

SEQ ID NO: 1287515 - DNA, 17 bp, Homo sapiens
ttggatgttgtaaataa

SEQ ID NO: 1287516 - DNA, 15 bp, Homo sapiens
ttggattaaattagt

SEQ ID NO: 1287517 - DNA, 13 bp, Homo sapiens
ttggattattcat

SEQ ID NO: 1287518 - DNA, 17 bp, Homo sapiens
ttggattattcatttaa

SEQ ID NO: 1287519 - DNA, 20 bp, Homo sapiens
ttggattattcatttaaaat

SEQ ID NO: 1287520 - DNA, 23 bp, Homo sapiens
ttggattctcttagctactgtat

SEQ ID NO: 1287521 - DNA, 21 bp, Homo sapiens
ttggattgcgcctttgtatta

SEQ ID NO: 1287522 - DNA, 14 bp, Homo sapiens
ttggatttcctaat

SEQ ID NO: 1287523 - DNA, 21 bp, Homo sapiens
ttggatttcctaatactgtca

SEQ ID NO: 1287524 - DNA, 20 bp, Homo sapiens
ttggatttgaacttgctctt

SEQ ID NO: 1287525 - DNA, 22 bp, Homo sapiens
ttggatttgacattgcgtttga

SEQ ID NO: 1287526 - DNA, 14 bp, Homo sapiens
ttggatttgctgtg

SEQ ID NO: 1287527 - DNA, 19 bp, Homo sapiens
ttggatttgtgtgtatgtg

SEQ ID NO: 1287528 - DNA, 12 bp, Homo sapiens
ttggcaaaatgt

SEQ ID NO: 1287529 - DNA, 17 bp, Homo sapiens
ttggcaaattttaaaac

SEQ ID NO: 1287530 - DNA, 14 bp, Homo sapiens
ttggcaacagaagc

SEQ ID NO: 1287531 - DNA, 15 bp, Homo sapiens
ttggcaacagaagca

SEQ ID NO: 1287532 - DNA, 13 bp, Homo sapiens
ttggcaagctgca

SEQ ID NO: 1287533 - DNA, 13 bp, Homo sapiens
ttggcaaggaaag

SEQ ID NO: 1287534 - DNA, 21 bp, Homo sapiens
ttggcaatgactcaaagtctg

SEQ ID NO: 1287535 - DNA, 17 bp, Homo sapiens
ttggcaccaccagggtg

SEQ ID NO: 1287536 - DNA, 22 bp, Homo sapiens
ttggcaccccagctaccccttc

SEQ ID NO: 1287537 - DNA, 19 bp, Homo sapiens
ttggcacccccatgctgcc

SEQ ID NO: 1287538 - DNA, 21 bp, Homo sapiens
ttggcacccccatgctgcctt

SEQ ID NO: 1287539 - DNA, 12 bp, Homo sapiens
ttggcactggat

SEQ ID NO: 1287540 - DNA, 20 bp, Homo sapiens
ttggcacttaagtgcacttt

SEQ ID NO: 1287541 - DNA, 18 bp, Homo sapiens
ttggcacttattgaatat

SEQ ID NO: 1287542 - DNA, 19 bp, Homo sapiens
ttggcacttgccattccaa

SEQ ID NO: 1287543 - DNA, 16 bp, Homo sapiens
ttggcacttgtattta

SEQ ID NO: 1287544 - DNA, 20 bp, Homo sapiens
ttggcactttgttttcaaga

SEQ ID NO: 1287545 - DNA, 19 bp, Homo sapiens
ttggcagaccgggcccccc

SEQ ID NO: 1287546 - DNA, 23 bp, Homo sapiens
ttggcagccaaggaatgtgtcca

SEQ ID NO: 1287547 - DNA, 17 bp, Homo sapiens
ttggcagctttttctgt

SEQ ID NO: 1287548 - DNA, 14 bp, Homo sapiens
ttggcaggcccact

SEQ ID NO: 1287549 - DNA, 19 bp, Homo sapiens
ttggcaggcccactcccca

SEQ ID NO: 1287550 - DNA, 12 bp, Homo sapiens
ttggcaggctgg

SEQ ID NO: 1287551 - DNA, 14 bp, Homo sapiens
ttggcaggctggcc

SEQ ID NO: 1287552 - DNA, 14 bp, Homo sapiens
ttggcagtctgaat

SEQ ID NO: 1287553 - DNA, 16 bp, Homo sapiens
ttggcatacaaaatat

SEQ ID NO: 1287554 - DNA, 21 bp, Homo sapiens
ttggcatggaaatttaaagca

SEQ ID NO: 1287555 - DNA, 14 bp, Homo sapiens
ttggcatggcttta

SEQ ID NO: 1287556 - DNA, 22 bp, Homo sapiens
ttggcatgggcgcaggcccagt

SEQ ID NO: 1287557 - DNA, 17 bp, Homo sapiens
ttggcattggaattcta

SEQ ID NO: 1287558 - DNA, 12 bp, Homo sapiens
ttggccacagac

SEQ ID NO: 1287559 - DNA, 20 bp, Homo sapiens
ttggccaccaggtgcctttc

SEQ ID NO: 1287560 - DNA, 19 bp, Homo sapiens
ttggccactgggtctcact

SEQ ID NO: 1287561 - DNA, 22 bp, Homo sapiens
ttggccagccaactctgggaat

SEQ ID NO: 1287562 - DNA, 12 bp, Homo sapiens
ttggccaggagg

SEQ ID NO: 1287563 - DNA, 18 bp, Homo sapiens
ttggccagggaggcgcag

SEQ ID NO: 1287564 - DNA, 20 bp, Homo sapiens
ttggccagggaggcgcaggg

SEQ ID NO: 1287565 - DNA, 18 bp, Homo sapiens
ttgtaccattccttcaaa

SEQ ID NO: 1287566 - DNA, 20 bp, Homo sapiens
ttgtaccattccttcaaata

SEQ ID NO: 1287567 - DNA, 23 bp, Homo sapiens
ttgtaccattccttcaaataaag

SEQ ID NO: 1287568 - DNA, 21 bp, Homo sapiens
ttgtacgtaaagcttaaattg

SEQ ID NO: 1287569 - DNA, 16 bp, Homo sapiens
ttgtactaagccagga

SEQ ID NO: 1287570 - DNA, 17 bp, Homo sapiens
ttgtactccagcctggg

SEQ ID NO: 1287571 - DNA, 21 bp, Homo sapiens
ttgtactgaatttttttgtaa

SEQ ID NO: 1287572 - DNA, 19 bp, Homo sapiens
ttgtacttctgtgttcatt

SEQ ID NO: 1287573 - DNA, 13 bp, Homo sapiens
ttgtacttcttat

SEQ ID NO: 1287574 - DNA, 19 bp, Homo sapiens
ttgtactttatatcttgtt

SEQ ID NO: 1287575 - DNA, 19 bp, Homo sapiens
ttgtactttatttttctga

SEQ ID NO: 1287576 - DNA, 12 bp, Homo sapiens
ttgtagaaacac

SEQ ID NO: 1287577 - DNA, 19 bp, Homo sapiens
ttgtagaataaatggtttc

SEQ ID NO: 1287578 - DNA, 18 bp, Homo sapiens
ttgtagatgctaacgtgt

SEQ ID NO: 1287579 - DNA, 14 bp, Homo sapiens
ttgtagcactgagg

SEQ ID NO: 1287580 - DNA, 19 bp, Homo sapiens
ttgtagcagattgtttcct

SEQ ID NO: 1287581 - DNA, 23 bp, Homo sapiens
ttgtagcagctatatatttcccc

SEQ ID NO: 1287582 - DNA, 17 bp, Homo sapiens
ttgtagcatttaaaatg

SEQ ID NO: 1287583 - DNA, 16 bp, Homo sapiens
ttgtagccttcctcca

SEQ ID NO: 1287584 - DNA, 19 bp, Homo sapiens
ttgtaggaatctgccttcc

SEQ ID NO: 1287585 - DNA, 22 bp, Homo sapiens
ttgtaggatttttttcctcccc

SEQ ID NO: 1287586 - DNA, 23 bp, Homo sapiens
ttgtaggctgtggggtctggctg

SEQ ID NO: 1287587 - DNA, 16 bp, Homo sapiens
ttgtagggttacagag

SEQ ID NO: 1287588 - DNA, 18 bp, Homo sapiens
ttgtagtaaagaaattta

SEQ ID NO: 1287589 - DNA, 23 bp, Homo sapiens
ttgtagttaatttattaagtctg

SEQ ID NO: 1287590 - DNA, 19 bp, Homo sapiens
ttgtagttctgtgtacttt

SEQ ID NO: 1287591 - DNA, 19 bp, Homo sapiens
ttgtagttcttgtgcatgt

SEQ ID NO: 1287592 - DNA, 13 bp, Homo sapiens
ttgtagtttacct

SEQ ID NO: 1287593 - DNA, 17 bp, Homo sapiens
ttgtagtttacctcttt

SEQ ID NO: 1287594 - DNA, 16 bp, Homo sapiens
ttgtataaaaaggaaa

SEQ ID NO: 1287595 - DNA, 14 bp, Homo sapiens
ttgtataaaataga

SEQ ID NO: 1287596 - DNA, 15 bp, Homo sapiens
ttgtataaaatccat

SEQ ID NO: 1287597 - DNA, 23 bp, Homo sapiens
ttgtataaaatccatagatttat

SEQ ID NO: 1287598 - DNA, 21 bp, Homo sapiens
ttgtataaagcattactcttt

SEQ ID NO: 1287599 - DNA, 19 bp, Homo sapiens
ttgtataaataataaagaa

SEQ ID NO: 1287600 - DNA, 21 bp, Homo sapiens
ttgtataaatgacaaagtgtt

SEQ ID NO: 1287601 - DNA, 22 bp, Homo sapiens
ttgtataaatgacaaagtgttg

SEQ ID NO: 1287602 - DNA, 22 bp, Homo sapiens
ttgtataaattaaataaactgt

SEQ ID NO: 1287603 - DNA, 14 bp, Homo sapiens
ttgtataacttctt

SEQ ID NO: 1287604 - DNA, 21 bp, Homo sapiens
ttgtataattggatttcctaa

SEQ ID NO: 1287605 - DNA, 13 bp, Homo sapiens
ttgtatacaagta

SEQ ID NO: 1287606 - DNA, 16 bp, Homo sapiens
ttgtatacaagtactg

SEQ ID NO: 1287607 - DNA, 16 bp, Homo sapiens
ttgtatagaccaaagc

SEQ ID NO: 1287608 - DNA, 22 bp, Homo sapiens
ttgtataggccatctgtaaata

SEQ ID NO: 1287609 - DNA, 15 bp, Homo sapiens
ttgtatagtgtaaaa

SEQ ID NO: 1287610 - DNA, 16 bp, Homo sapiens
ttgtatagtgtaaaat

SEQ ID NO: 1287611 - DNA, 13 bp, Homo sapiens
ttgtatagttaac

SEQ ID NO: 1287612 - DNA, 19 bp, Homo sapiens
ttgtatagttgcttgcctg

SEQ ID NO: 1287613 - DNA, 15 bp, Homo sapiens
ttgtatatatgtgtg

SEQ ID NO: 1287614 - DNA, 22 bp, Homo sapiens
ttgtatatattttatatgttca

SEQ ID NO: 1287615 - DNA, 16 bp, Homo sapiens
ttgtatatgatctaat

SEQ ID NO: 1287616 - DNA, 14 bp, Homo sapiens
ttgtatattaaaat

SEQ ID NO: 1287617 - DNA, 18 bp, Homo sapiens
ttgtatattatggaagat

SEQ ID NO: 1287618 - DNA, 21 bp, Homo sapiens
ttgtatattatggaagatttt

SEQ ID NO: 1287619 - DNA, 22 bp, Homo sapiens
ttgtatattccaccattcacat

SEQ ID NO: 1287620 - DNA, 17 bp, Homo sapiens
ttgtatattctggaaaa

SEQ ID NO: 1287621 - DNA, 19 bp, Homo sapiens
ttgtatattgggtgtagat

SEQ ID NO: 1287622 - DNA, 15 bp, Homo sapiens
ttgtatattgtgttt

SEQ ID NO: 1287623 - DNA, 19 bp, Homo sapiens
ttgtatattgtgtttgtgt

SEQ ID NO: 1287624 - DNA, 20 bp, Homo sapiens
ttgtatctctgaagcatgtt

SEQ ID NO: 1287625 - DNA, 21 bp, Homo sapiens
ttgtatctctgaagcatgttt

SEQ ID NO: 1287626 - DNA, 14 bp, Homo sapiens
ttgtatctcttttg

SEQ ID NO: 1287627 - DNA, 14 bp, Homo sapiens
ttgtatctgtcttt

SEQ ID NO: 1287628 - DNA, 16 bp, Homo sapiens
ttgtatctgtctttcc

SEQ ID NO: 1287629 - DNA, 13 bp, Homo sapiens
ttgtatcttcctt

SEQ ID NO: 1287630 - DNA, 15 bp, Homo sapiens
ttgtatctttatgct

SEQ ID NO: 1287631 - DNA, 19 bp, Homo sapiens
ttgtatctttatgctgtat

SEQ ID NO: 1287632 - DNA, 12 bp, Homo sapiens
ttgtatgaaaat

SEQ ID NO: 1287633 - DNA, 22 bp, Homo sapiens
ttgtatgaaagatggctgtgcc

SEQ ID NO: 1287634 - DNA, 15 bp, Homo sapiens
ttgtatgacttctgc

SEQ ID NO: 1287635 - DNA, 16 bp, Homo sapiens
ttgtatgagatggtta

SEQ ID NO: 1287636 - DNA, 16 bp, Homo sapiens
ttgtatgatgtgttgt

SEQ ID NO: 1287637 - DNA, 22 bp, Homo sapiens
ttgtatgcctttaaatctgtga

SEQ ID NO: 1287638 - DNA, 23 bp, Homo sapiens
ttgtatgcctttaaatctgtgat

SEQ ID NO: 1287639 - DNA, 15 bp, Homo sapiens
ttgtatgctgaattt

SEQ ID NO: 1287640 - DNA, 16 bp, Homo sapiens
ttgtatgtaaatgtgc

SEQ ID NO: 1287641 - DNA, 17 bp, Homo sapiens
ttgtatgtgtgtagaca

SEQ ID NO: 1287642 - DNA, 19 bp, Homo sapiens
ttgtatgtgtgtagactgt

SEQ ID NO: 1287643 - DNA, 14 bp, Homo sapiens
ttgtattaataaag

SEQ ID NO: 1287644 - DNA, 15 bp, Homo sapiens
ttgtattaataaagc

SEQ ID NO: 1287645 - DNA, 19 bp, Homo sapiens
ttgtattaataaagcattc

SEQ ID NO: 1287646 - DNA, 16 bp, Homo sapiens
ttgtattaatttctga

SEQ ID NO: 1287647 - DNA, 14 bp, Homo sapiens
ttgtattacatcta

SEQ ID NO: 1287648 - DNA, 21 bp, Homo sapiens
ttgtattagcccgttttcaca

SEQ ID NO: 1287649 - DNA, 22 bp, Homo sapiens
ttgtattattacaaatattgtc

SEQ ID NO: 1287650 - DNA, 22 bp, Homo sapiens
ttgtattcaaaaattatctata

SEQ ID NO: 1287651 - DNA, 21 bp, Homo sapiens
ttgtattctctcctgtacctc

SEQ ID NO: 1287652 - DNA, 16 bp, Homo sapiens
ttgtattctctgagct

SEQ ID NO: 1287653 - DNA, 20 bp, Homo sapiens
ttgtattctctgagctgtgc

SEQ ID NO: 1287654 - DNA, 17 bp, Homo sapiens
ttgtattgaaaacactt

SEQ ID NO: 1287655 - DNA, 20 bp, Homo sapiens
ttgtattgagggccagtgat

SEQ ID NO: 1287656 - DNA, 15 bp, Homo sapiens
ttgtattgcttcctg

SEQ ID NO: 1287657 - DNA, 12 bp, Homo sapiens
ttgtattgtaaa

SEQ ID NO: 1287658 - DNA, 13 bp, Homo sapiens
ttgtattgttgaa

SEQ ID NO: 1287659 - DNA, 18 bp, Homo sapiens
ttgtattgttgaaaaagt

SEQ ID NO: 1287660 - DNA, 14 bp, Homo sapiens
ttgtattgttttct

SEQ ID NO: 1287661 - DNA, 18 bp, Homo sapiens
ttgtatttaacagaaatt

SEQ ID NO: 1287662 - DNA, 22 bp, Homo sapiens
ttgtatttaacagaaattgtat

SEQ ID NO: 1287663 - DNA, 18 bp, Homo sapiens
ttgtatttagtagttatt

SEQ ID NO: 1287664 - DNA, 16 bp, Homo sapiens
ttgtatttatgtgtat

SEQ ID NO: 1287665 - DNA, 15 bp, Homo sapiens
ttgtatttctatatt

SEQ ID NO: 1287666 - DNA, 20 bp, Homo sapiens
ttgtatttggaatatttgaa

SEQ ID NO: 1287667 - DNA, 22 bp, Homo sapiens
ttgtatttggaatatttgaata

SEQ ID NO: 1287668 - DNA, 14 bp, Homo sapiens
ttgtattttaactc

SEQ ID NO: 1287669 - DNA, 23 bp, Homo sapiens
ttgtattttgtgtgaccaactgt

SEQ ID NO: 1287670 - DNA, 15 bp, Homo sapiens
ttgtattttgttaaa

SEQ ID NO: 1287671 - DNA, 18 bp, Homo sapiens
ttgtattttgttaaagct

SEQ ID NO: 1287672 - DNA, 19 bp, Homo sapiens
ttgtattttgttaaagctg

SEQ ID NO: 1287673 - DNA, 14 bp, Homo sapiens
ttgtatttttaatg

SEQ ID NO: 1287674 - DNA, 15 bp, Homo sapiens
ttgtatttttaatgg

SEQ ID NO: 1287675 - DNA, 20 bp, Homo sapiens
ttgtatttttagtagagatg

SEQ ID NO: 1287676 - DNA, 15 bp, Homo sapiens
ttgtattttttcctt

SEQ ID NO: 1287677 - DNA, 17 bp, Homo sapiens
ttgtattttttccttaa

SEQ ID NO: 1287678 - DNA, 22 bp, Homo sapiens
ttgtcaaactgtagaaatgatg

SEQ ID NO: 1287679 - DNA, 13 bp, Homo sapiens
ttgtcaaagaagc

SEQ ID NO: 1287680 - DNA, 14 bp, Homo sapiens
ttgtcaaagaagct

SEQ ID NO: 1287681 - DNA, 23 bp, Homo sapiens
ttgtcaaatgcccactctccatc

SEQ ID NO: 1287682 - DNA, 20 bp, Homo sapiens
ttgtcaacactatataaata

SEQ ID NO: 1287683 - DNA, 21 bp, Homo sapiens
ttgtcaaggaagaagaaatct

SEQ ID NO: 1287684 - DNA, 23 bp, Homo sapiens
ttgtcaaggatggttttgggact

SEQ ID NO: 1287685 - DNA, 18 bp, Homo sapiens
ttgtcaatattaaataca

SEQ ID NO: 1287686 - DNA, 16 bp, Homo sapiens
ttgttttcagtgtaca

SEQ ID NO: 1287687 - DNA, 14 bp, Homo sapiens
ttgttttccactgt

SEQ ID NO: 1287688 - DNA, 18 bp, Homo sapiens
ttgttttctgactaatta

SEQ ID NO: 1287689 - DNA, 11 bp, Homo sapiens
ttgttttctgt

SEQ ID NO: 1287690 - DNA, 15 bp, Homo sapiens
ttgttttgaaaataa

SEQ ID NO: 1287691 - DNA, 14 bp, Homo sapiens
ttgttttgaaagtt

SEQ ID NO: 1287692 - DNA, 15 bp, Homo sapiens
ttgttttgcactttt

SEQ ID NO: 1287693 - DNA, 22 bp, Homo sapiens
ttgttttggctgaaattctcct

SEQ ID NO: 1287694 - DNA, 13 bp, Homo sapiens
ttgttttgtttta

SEQ ID NO: 1287695 - DNA, 17 bp, Homo sapiens
ttgtttttaaaaagcaa

SEQ ID NO: 1287696 - DNA, 19 bp, Homo sapiens
ttgtttttaaactgtacag

SEQ ID NO: 1287697 - DNA, 18 bp, Homo sapiens
ttgtttttattttcaaga

SEQ ID NO: 1287698 - DNA, 21 bp, Homo sapiens
ttgtttttccttgtatttaaa

SEQ ID NO: 1287699 - DNA, 19 bp, Homo sapiens
ttgtttttcgtttttttgg

SEQ ID NO: 1287700 - DNA, 21 bp, Homo sapiens
ttgtttttgagtactgtacta

SEQ ID NO: 1287701 - DNA, 16 bp, Homo sapiens
ttgtttttgcatgaaa

SEQ ID NO: 1287702 - DNA, 17 bp, Homo sapiens
ttgtttttgcatttttg

SEQ ID NO: 1287703 - DNA, 17 bp, Homo sapiens
ttgtttttgtaatgcac

SEQ ID NO: 1287704 - DNA, 16 bp, Homo sapiens
ttgttttttaaagcaa

SEQ ID NO: 1287705 - DNA, 18 bp, Homo sapiens
ttgttttttaaagcaagt

SEQ ID NO: 1287706 - DNA, 23 bp, Homo sapiens
ttgttttttaaagcaagtcacct

SEQ ID NO: 1287707 - DNA, 21 bp, Homo sapiens
ttgttttttcaaaatagaaaa

SEQ ID NO: 1287708 - DNA, 13 bp, Homo sapiens
ttgttttttcata

SEQ ID NO: 1287709 - DNA, 18 bp, Homo sapiens
ttgttttttcttgccagg

SEQ ID NO: 1287710 - DNA, 15 bp, Homo sapiens
ttgtttttttcctca

SEQ ID NO: 1287711 - DNA, 14 bp, Homo sapiens
ttgtttttttgcca

SEQ ID NO: 1287712 - DNA, 19 bp, Homo sapiens
ttgttttttttttccactt

SEQ ID NO: 1287713 - DNA, 16 bp, Homo sapiens
tttaaaaaaactgaag

SEQ ID NO: 1287714 - DNA, 14 bp, Homo sapiens
tttaaaaaaatttt

SEQ ID NO: 1287715 - DNA, 23 bp, Homo sapiens
tttaaaaaacaaaaaccagcagg

SEQ ID NO: 1287716 - DNA, 21 bp, Homo sapiens
tttaaaaaactaaaaactaga

SEQ ID NO: 1287717 - DNA, 20 bp, Homo sapiens
tttaaaaaataactaccaag

SEQ ID NO: 1287718 - DNA, 23 bp, Homo sapiens
tttaaaaaataccattgaaatca

SEQ ID NO: 1287719 - DNA, 24 bp, Homo sapiens
tttaaaaaataccattgaaatcag

SEQ ID NO: 1287720 - DNA, 13 bp, Homo sapiens
tttaaaaaatatt

SEQ ID NO: 1287721 - DNA, 22 bp, Homo sapiens
tttaaaaaatattttaagaaag

SEQ ID NO: 1287722 - DNA, 16 bp, Homo sapiens
tttaaaaaatattttc

SEQ ID NO: 1287723 - DNA, 17 bp, Homo sapiens
tttaaaaaatcaatcaa

SEQ ID NO: 1287724 - DNA, 20 bp, Homo sapiens
tttaaaaaccaatcatttta

SEQ ID NO: 1287725 - DNA, 16 bp, Homo sapiens
tttaaaaactcttcag

SEQ ID NO: 1287726 - DNA, 17 bp, Homo sapiens
tttaaaaagaaatctgg

SEQ ID NO: 1287727 - DNA, 14 bp, Homo sapiens
tttaaaaagctcac

SEQ ID NO: 1287728 - DNA, 12 bp, Homo sapiens
tttaaaaagtaa

SEQ ID NO: 1287729 - DNA, 23 bp, Homo sapiens
tttaaaaagttgtagcagattgt

SEQ ID NO: 1287730 - DNA, 20 bp, Homo sapiens
tttaaaaataagtcaacagt

SEQ ID NO: 1287731 - DNA, 22 bp, Homo sapiens
tttaaaaataagtcaacagtaa

SEQ ID NO: 1287732 - DNA, 23 bp, Homo sapiens
tttaaaaatacagatagatatat

SEQ ID NO: 1287733 - DNA, 19 bp, Homo sapiens
tttaaaaatggtatcaaaa

SEQ ID NO: 1287734 - DNA, 11 bp, Homo sapiens
tttaaaaatgt

SEQ ID NO: 1287735 - DNA, 12 bp, Homo sapiens
tttaaaaatgtc

SEQ ID NO: 1287736 - DNA, 14 bp, Homo sapiens
tttaaaacaaaaga

SEQ ID NO: 1287737 - DNA, 13 bp, Homo sapiens
tttaaaacatttt

SEQ ID NO: 1287738 - DNA, 14 bp, Homo sapiens
tttaaaacccattt

SEQ ID NO: 1287739 - DNA, 21 bp, Homo sapiens
tttaaaacccatttaaatttt

SEQ ID NO: 1287740 - DNA, 21 bp, Homo sapiens
tttaaaacctcttaataatct

SEQ ID NO: 1287741 - DNA, 21 bp, Homo sapiens
tttaaaacgcgtctgcctggg

SEQ ID NO: 1287742 - DNA, 10 bp, Homo sapiens
tttaaaactc

SEQ ID NO: 1287743 - DNA, 14 bp, Homo sapiens
tttaaaagacactg

SEQ ID NO: 1287744 - DNA, 22 bp, Homo sapiens
tttaaaagagagagagagaaaa

SEQ ID NO: 1287745 - DNA, 18 bp, Homo sapiens
tttaaaagagtagaataa

SEQ ID NO: 1287746 - DNA, 22 bp, Homo sapiens
tttaaaagcacaatcactaaac

SEQ ID NO: 1287747 - DNA, 15 bp, Homo sapiens
tttaaaagcatgaaa

SEQ ID NO: 1287748 - DNA, 17 bp, Homo sapiens
tttaaaagccatgtata

SEQ ID NO: 1287749 - DNA, 14 bp, Homo sapiens
tttaaaagcctgct

SEQ ID NO: 1287750 - DNA, 23 bp, Homo sapiens
tttaaaaggcaactcaaagatga

SEQ ID NO: 1287751 - DNA, 18 bp, Homo sapiens
tttaaaaggtagagtctt

SEQ ID NO: 1287752 - DNA, 19 bp, Homo sapiens
tttaaaaggtattttgaat

SEQ ID NO: 1287753 - DNA, 17 bp, Homo sapiens
tttaaaagtatctttaa

SEQ ID NO: 1287754 - DNA, 17 bp, Homo sapiens
tttaaaagtttcaatgt

SEQ ID NO: 1287755 - DNA, 13 bp, Homo sapiens
tttaaaagttttg

SEQ ID NO: 1287756 - DNA, 18 bp, Homo sapiens
tttaaaataaaatgaaaa

SEQ ID NO: 1287757 - DNA, 22 bp, Homo sapiens
tttaaaatagaaattttgtaag

SEQ ID NO: 1287758 - DNA, 19 bp, Homo sapiens
tttaaaatagaatgataga

SEQ ID NO: 1287759 - DNA, 17 bp, Homo sapiens
tttaaaatagcgttctt

SEQ ID NO: 1287760 - DNA, 20 bp, Homo sapiens
tttaaaatagcgttcttgta

SEQ ID NO: 1287761 - DNA, 14 bp, Homo sapiens
tttaaaatatatgt

SEQ ID NO: 1287762 - DNA, 18 bp, Homo sapiens
tttaaaatatttaacttt

SEQ ID NO: 1287763 - DNA, 19 bp, Homo sapiens
tttaaaatatttaactttt

SEQ ID NO: 1287764 - DNA, 14 bp, Homo sapiens
tttaaaatatttgt

SEQ ID NO: 1287765 - DNA, 18 bp, Homo sapiens
tttaaaatcagctatttt

SEQ ID NO: 1287766 - DNA, 22 bp, Homo sapiens
tttaaaatcagctattttgtga

SEQ ID NO: 1287767 - DNA, 21 bp, Homo sapiens
tttaaaatctgagggaaatgt

SEQ ID NO: 1287768 - DNA, 16 bp, Homo sapiens
tttaaaatctgattta

SEQ ID NO: 1287769 - DNA, 21 bp, Homo sapiens
tttaaaatgctcaatttcagc

SEQ ID NO: 1287770 - DNA, 14 bp, Homo sapiens
tttaaaatgctgct

SEQ ID NO: 1287771 - DNA, 20 bp, Homo sapiens
tttaaaatggtttgtcctga

SEQ ID NO: 1287772 - DNA, 22 bp, Homo sapiens
tttaaaattaagtagaacaaaa

SEQ ID NO: 1287773 - DNA, 14 bp, Homo sapiens
tttaaaattctctt

SEQ ID NO: 1287774 - DNA, 20 bp, Homo sapiens
tttaaaatttatattgtaaa

SEQ ID NO: 1287775 - DNA, 16 bp, Homo sapiens
tttaaacaaaatttca

SEQ ID NO: 1287776 - DNA, 20 bp, Homo sapiens
tttaaacaaatatgaaaaat

SEQ ID NO: 1287777 - DNA, 23 bp, Homo sapiens
tttaaacaatctttcatgtcttg

SEQ ID NO: 1287778 - DNA, 23 bp, Homo sapiens
tttaaacacacagatacacacac

SEQ ID NO: 1287779 - DNA, 13 bp, Homo sapiens
tttaaacagcagt

SEQ ID NO: 1287780 - DNA, 16 bp, Homo sapiens
tttaaacaggcccagc

SEQ ID NO: 1287781 - DNA, 21 bp, Homo sapiens
tttaaacaggcccagcattgc

SEQ ID NO: 1287782 - DNA, 17 bp, Homo sapiens
tttaaacagtatttcat

SEQ ID NO: 1287783 - DNA, 12 bp, Homo sapiens
tttaaacatatc

SEQ ID NO: 1287784 - DNA, 19 bp, Homo sapiens
tttaaacccaatcagatgc

SEQ ID NO: 1287785 - DNA, 17 bp, Homo sapiens
tttaaaccgctaaaaga

SEQ ID NO: 1287786 - DNA, 23 bp, Homo sapiens
tttaaaccgctaaaagaaacttt

SEQ ID NO: 1287787 - DNA, 21 bp, Homo sapiens
tttaaacctttaatgagaaaa

SEQ ID NO: 1287788 - DNA, 14 bp, Homo sapiens
tttaaactaaatta

SEQ ID NO: 1287789 - DNA, 17 bp, Homo sapiens
tttaaactaagatctgt

SEQ ID NO: 1287790 - DNA, 19 bp, Homo sapiens
tttaaactaagatctgtta

SEQ ID NO: 1287791 - DNA, 21 bp, Homo sapiens
tttaaactacatcttgaaaat

SEQ ID NO: 1287792 - DNA, 15 bp, Homo sapiens
tttaaactgattcat

SEQ ID NO: 1287793 - DNA, 15 bp, Homo sapiens
tttaaactgtacagt

SEQ ID NO: 1287794 - DNA, 16 bp, Homo sapiens
tttaaactgtacagtg

SEQ ID NO: 1287795 - DNA, 14 bp, Homo sapiens
tttaaactgtgtac

SEQ ID NO: 1287796 - DNA, 22 bp, Homo sapiens
tttaaactgtgtacataactga

SEQ ID NO: 1287797 - DNA, 13 bp, Homo sapiens
tttaaacttgaaa

SEQ ID NO: 1287798 - DNA, 20 bp, Homo sapiens
tttaaacttgaaatatataa

SEQ ID NO: 1287799 - DNA, 19 bp, Homo sapiens
tttaaagaaaaaaattgaa

SEQ ID NO: 1287800 - DNA, 15 bp, Homo sapiens
tttaaagaacagtga

SEQ ID NO: 1287801 - DNA, 15 bp, Homo sapiens
tttaaagaataaagt

SEQ ID NO: 1287802 - DNA, 18 bp, Homo sapiens
tttaaagaatgagaaaca

SEQ ID NO: 1287803 - DNA, 19 bp, Homo sapiens
tttaaagaatgagaaacat

SEQ ID NO: 1287804 - DNA, 13 bp, Homo sapiens
tttaaagaatgct

SEQ ID NO: 1287805 - DNA, 15 bp, Homo sapiens
tttaaagaatgttag

SEQ ID NO: 1287806 - DNA, 13 bp, Homo sapiens
tttaaagaattgt

SEQ ID NO: 1287807 - DNA, 11 bp, Homo sapiens
tttaaagacag

SEQ ID NO: 1287808 - DNA, 21 bp, Homo sapiens
tttagcctggtacctagcaca

SEQ ID NO: 1287809 - DNA, 16 bp, Homo sapiens
tttagccttaaatttt

SEQ ID NO: 1287810 - DNA, 23 bp, Homo sapiens
tttagcgattgattgatgtacag

SEQ ID NO: 1287811 - DNA, 19 bp, Homo sapiens
tttagctacctttttatat

SEQ ID NO: 1287812 - DNA, 21 bp, Homo sapiens
tttagctctgaagcaagagtg

SEQ ID NO: 1287813 - DNA, 21 bp, Homo sapiens
tttagctgatgaacttattct

SEQ ID NO: 1287814 - DNA, 16 bp, Homo sapiens
tttagctgtatcaaac

SEQ ID NO: 1287815 - DNA, 16 bp, Homo sapiens
tttagcttcagttgtt

SEQ ID NO: 1287816 - DNA, 13 bp, Homo sapiens
tttagcttcctcc

SEQ ID NO: 1287817 - DNA, 15 bp, Homo sapiens
tttagcttcctccag

SEQ ID NO: 1287818 - DNA, 22 bp, Homo sapiens
tttagctttacatattcctttg

SEQ ID NO: 1287819 - DNA, 16 bp, Homo sapiens
tttagctttgtgttta

SEQ ID NO: 1287820 - DNA, 13 bp, Homo sapiens
tttaggaaaatca

SEQ ID NO: 1287821 - DNA, 13 bp, Homo sapiens
tttaggaaaatga

SEQ ID NO: 1287822 - DNA, 22 bp, Homo sapiens
tttaggaaaatgagaggagaac

SEQ ID NO: 1287823 - DNA, 13 bp, Homo sapiens
tttaggaagtgtt

SEQ ID NO: 1287824 - DNA, 14 bp, Homo sapiens
tttaggaataataa

SEQ ID NO: 1287825 - DNA, 15 bp, Homo sapiens
tttaggaataataaa

SEQ ID NO: 1287826 - DNA, 13 bp, Homo sapiens
tttaggagcagtg

SEQ ID NO: 1287827 - DNA, 16 bp, Homo sapiens
tttaggcctcatttct

SEQ ID NO: 1287828 - DNA, 18 bp, Homo sapiens
tttaggctatttgtaaat

SEQ ID NO: 1287829 - DNA, 18 bp, Homo sapiens
tttaggctggtggcccag

SEQ ID NO: 1287830 - DNA, 16 bp, Homo sapiens
tttagggaagcaggga

SEQ ID NO: 1287831 - DNA, 13 bp, Homo sapiens
tttagggcagctt

SEQ ID NO: 1287832 - DNA, 16 bp, Homo sapiens
tttagggccaggcagg

SEQ ID NO: 1287833 - DNA, 16 bp, Homo sapiens
tttagggccttttctg

SEQ ID NO: 1287834 - DNA, 15 bp, Homo sapiens
tttagggctgtagac

SEQ ID NO: 1287835 - DNA, 16 bp, Homo sapiens
tttagggctgttgcta

SEQ ID NO: 1287836 - DNA, 22 bp, Homo sapiens
tttaggggagttttgttttttg

SEQ ID NO: 1287837 - DNA, 18 bp, Homo sapiens
tttaggggtgttgacaca

SEQ ID NO: 1287838 - DNA, 22 bp, Homo sapiens
tttaggtttttgtttgtttcct

SEQ ID NO: 1287839 - DNA, 12 bp, Homo sapiens
tttagtaaatgt

SEQ ID NO: 1287840 - DNA, 20 bp, Homo sapiens
tttagtaatagtccaatatt

SEQ ID NO: 1287841 - DNA, 16 bp, Homo sapiens
tttagtaatttcctag

SEQ ID NO: 1287842 - DNA, 18 bp, Homo sapiens
tttagtacactatgttct

SEQ ID NO: 1287843 - DNA, 21 bp, Homo sapiens
tttagtacctgaaaagtaact

SEQ ID NO: 1287844 - DNA, 22 bp, Homo sapiens
tttagtagcagtgattgtctta

SEQ ID NO: 1287845 - DNA, 19 bp, Homo sapiens
tttagtatacgtataaata

SEQ ID NO: 1287846 - DNA, 22 bp, Homo sapiens
tttagtgccggctgtggagcaa

SEQ ID NO: 1287847 - DNA, 21 bp, Homo sapiens
tttagtgctcttaacttgtta

SEQ ID NO: 1287848 - DNA, 24 bp, Homo sapiens
tttagtggtagcatatagattgtc

SEQ ID NO: 1287849 - DNA, 14 bp, Homo sapiens
tttagtgtgaatat

SEQ ID NO: 1287850 - DNA, 21 bp, Homo sapiens
tttagtgtttttttatttcta

SEQ ID NO: 1287851 - DNA, 21 bp, Homo sapiens
tttagttaccgagacatgaat

SEQ ID NO: 1287852 - DNA, 22 bp, Homo sapiens
tttagttacgtataatgctttc

SEQ ID NO: 1287853 - DNA, 16 bp, Homo sapiens
tttagttactttagat

SEQ ID NO: 1287854 - DNA, 21 bp, Homo sapiens
tttagttatagtgtttaactg

SEQ ID NO: 1287855 - DNA, 14 bp, Homo sapiens
tttagttgaaaaat

SEQ ID NO: 1287856 - DNA, 16 bp, Homo sapiens
tttagttgccaacagt

SEQ ID NO: 1287857 - DNA, 17 bp, Homo sapiens
tttagttggcatttgtt

SEQ ID NO: 1287858 - DNA, 17 bp, Homo sapiens
tttagtttgatcagaca

SEQ ID NO: 1287859 - DNA, 15 bp, Homo sapiens
tttagttttacacta

SEQ ID NO: 1287860 - DNA, 16 bp, Homo sapiens
tttagttttgtaactt

SEQ ID NO: 1287861 - DNA, 15 bp, Homo sapiens
tttagtttttcatta

SEQ ID NO: 1287862 - DNA, 14 bp, Homo sapiens
tttataaaaatata

SEQ ID NO: 1287863 - DNA, 13 bp, Homo sapiens
tttataaaacttc

SEQ ID NO: 1287864 - DNA, 17 bp, Homo sapiens
tttataaaatgtataaa

SEQ ID NO: 1287865 - DNA, 17 bp, Homo sapiens
tttataaaattttgctt

SEQ ID NO: 1287866 - DNA, 22 bp, Homo sapiens
tttataaacagacaatatgtga

SEQ ID NO: 1287867 - DNA, 18 bp, Homo sapiens
tttataaactttaccttt

SEQ ID NO: 1287868 - DNA, 19 bp, Homo sapiens
tttataaagcagattacct

SEQ ID NO: 1287869 - DNA, 21 bp, Homo sapiens
tttataaatattaggcataaa

SEQ ID NO: 1287870 - DNA, 12 bp, Homo sapiens
tttataaatgag

SEQ ID NO: 1287871 - DNA, 15 bp, Homo sapiens
tttataaatgagcaa

SEQ ID NO: 1287872 - DNA, 16 bp, Homo sapiens
tttataaattaaatat

SEQ ID NO: 1287873 - DNA, 17 bp, Homo sapiens
tttataaattaaatata

SEQ ID NO: 1287874 - DNA, 16 bp, Homo sapiens
tttataacatgttaaa

SEQ ID NO: 1287875 - DNA, 16 bp, Homo sapiens
tttataaccccagcct

SEQ ID NO: 1287876 - DNA, 16 bp, Homo sapiens
tttataactcatcata

SEQ ID NO: 1287877 - DNA, 21 bp, Homo sapiens
tttataactcatcataaaata

SEQ ID NO: 1287878 - DNA, 16 bp, Homo sapiens
tttataactctaggga

SEQ ID NO: 1287879 - DNA, 18 bp, Homo sapiens
tttataagaaaaactttt

SEQ ID NO: 1287880 - DNA, 13 bp, Homo sapiens
tttataaggtctg

SEQ ID NO: 1287881 - DNA, 19 bp, Homo sapiens
tttataagtcattgtatgt

SEQ ID NO: 1287882 - DNA, 16 bp, Homo sapiens
tttataataaaaatat

SEQ ID NO: 1287883 - DNA, 19 bp, Homo sapiens
tttataataaaaatatatt

SEQ ID NO: 1287884 - DNA, 18 bp, Homo sapiens
tttataataggaatttgt

SEQ ID NO: 1287885 - DNA, 19 bp, Homo sapiens
tttataataggaatttgta

SEQ ID NO: 1287886 - DNA, 12 bp, Homo sapiens
tttataatctga

SEQ ID NO: 1287887 - DNA, 21 bp, Homo sapiens
tttataatgaaaagaaacaag

SEQ ID NO: 1287888 - DNA, 12 bp, Homo sapiens
tttataatgtat

SEQ ID NO: 1287889 - DNA, 20 bp, Homo sapiens
tttataattaaagatgccat

SEQ ID NO: 1287890 - DNA, 17 bp, Homo sapiens
tttataattctcattaa

SEQ ID NO: 1287891 - DNA, 23 bp, Homo sapiens
tttataattggtgctatttgaag

SEQ ID NO: 1287892 - DNA, 19 bp, Homo sapiens
tttatacaaattagaaaat

SEQ ID NO: 1287893 - DNA, 16 bp, Homo sapiens
tttatacaatatcatc

SEQ ID NO: 1287894 - DNA, 21 bp, Homo sapiens
tttatacaatggaataaatta

SEQ ID NO: 1287895 - DNA, 20 bp, Homo sapiens
tttatacataaacaagacca

SEQ ID NO: 1287896 - DNA, 19 bp, Homo sapiens
tttatactccatacataac

SEQ ID NO: 1287897 - DNA, 20 bp, Homo sapiens
tttatactctttctgtatat

SEQ ID NO: 1287898 - DNA, 20 bp, Homo sapiens
tttatactgggtttcaagaa

SEQ ID NO: 1287899 - DNA, 14 bp, Homo sapiens
tttatactgtacat

SEQ ID NO: 1287900 - DNA, 15 bp, Homo sapiens
tttatactgtacatg

SEQ ID NO: 1287901 - DNA, 20 bp, Homo sapiens
tttatactgtatttctaaga

SEQ ID NO: 1287902 - DNA, 18 bp, Homo sapiens
tttatagcaagatattga

SEQ ID NO: 1287903 - DNA, 18 bp, Homo sapiens
tttatagccataaaagaa

SEQ ID NO: 1287904 - DNA, 20 bp, Homo sapiens
tttatagctattactgtctg

SEQ ID NO: 1287905 - DNA, 21 bp, Homo sapiens
tttataggaatagaggaagaa

SEQ ID NO: 1287906 - DNA, 18 bp, Homo sapiens
tttataggtgagaaaaaa

SEQ ID NO: 1287907 - DNA, 18 bp, Homo sapiens
tttatagtatgtgacttt

SEQ ID NO: 1287908 - DNA, 16 bp, Homo sapiens
tttatataaataaatg

SEQ ID NO: 1287909 - DNA, 23 bp, Homo sapiens
tttatataaataaatgtttctag

SEQ ID NO: 1287910 - DNA, 15 bp, Homo sapiens
tttatataaatatat

SEQ ID NO: 1287911 - DNA, 15 bp, Homo sapiens
tttatataagtctgt

SEQ ID NO: 1287912 - DNA, 17 bp, Homo sapiens
tttatataataaagtat

SEQ ID NO: 1287913 - DNA, 20 bp, Homo sapiens
tttatatacctggcttttac

SEQ ID NO: 1287914 - DNA, 23 bp, Homo sapiens
tttatatactgggttcttgtttt

SEQ ID NO: 1287915 - DNA, 14 bp, Homo sapiens
tttatatataaggt

SEQ ID NO: 1287916 - DNA, 15 bp, Homo sapiens
tttatatatggacat

SEQ ID NO: 1287917 - DNA, 14 bp, Homo sapiens
tttatatattgaaa

SEQ ID NO: 1287918 - DNA, 18 bp, Homo sapiens
tttatatcaggtgtataa

SEQ ID NO: 1287919 - DNA, 23 bp, Homo sapiens
tttatatcaggtgtataaatgta

SEQ ID NO: 1287920 - DNA, 19 bp, Homo sapiens
tttatatcatacagttttc

SEQ ID NO: 1287921 - DNA, 15 bp, Homo sapiens
tttatatcatgcaaa

SEQ ID NO: 1287922 - DNA, 13 bp, Homo sapiens
tttatatctgtct

SEQ ID NO: 1287923 - DNA, 19 bp, Homo sapiens
tttatatgaagataagtgt

SEQ ID NO: 1287924 - DNA, 13 bp, Homo sapiens
tttatatgtacat

SEQ ID NO: 1287925 - DNA, 14 bp, Homo sapiens
tttatatgtacatg

SEQ ID NO: 1287926 - DNA, 21 bp, Homo sapiens
tttatatgtaccgtaggcttt

SEQ ID NO: 1287927 - DNA, 13 bp, Homo sapiens
tttatatgttcat

SEQ ID NO: 1287928 - DNA, 13 bp, Homo sapiens
tttatatgttgta

SEQ ID NO: 1287929 - DNA, 14 bp, Homo sapiens
tttatattaatgta

SEQ ID NO: 1287930 - DNA, 21 bp, Homo sapiens
tttcacagagtgtgctgctat

SEQ ID NO: 1287931 - DNA, 22 bp, Homo sapiens
tttcacagcctttcgttctgct

SEQ ID NO: 1287932 - DNA, 13 bp, Homo sapiens
tttcacagttctg

SEQ ID NO: 1287933 - DNA, 19 bp, Homo sapiens
tttcacagttctgtaatgt

SEQ ID NO: 1287934 - DNA, 14 bp, Homo sapiens
tttcacatagatgt

SEQ ID NO: 1287935 - DNA, 21 bp, Homo sapiens
tttcacatagcccacttacat

SEQ ID NO: 1287936 - DNA, 18 bp, Homo sapiens
tttcacatagctgtctag

SEQ ID NO: 1287937 - DNA, 15 bp, Homo sapiens
tttcacattaatatt

SEQ ID NO: 1287938 - DNA, 15 bp, Homo sapiens
tttcacattgtttgc

SEQ ID NO: 1287939 - DNA, 14 bp, Homo sapiens
tttcacatttttaa

SEQ ID NO: 1287940 - DNA, 13 bp, Homo sapiens
tttcaccaatgag

SEQ ID NO: 1287941 - DNA, 15 bp, Homo sapiens
tttcaccagaagtta

SEQ ID NO: 1287942 - DNA, 20 bp, Homo sapiens
tttcaccagaatttctaaga

SEQ ID NO: 1287943 - DNA, 21 bp, Homo sapiens
tttcaccatgttggccaggct

SEQ ID NO: 1287944 - DNA, 21 bp, Homo sapiens
tttcaccccatccctccttaa

SEQ ID NO: 1287945 - DNA, 16 bp, Homo sapiens
tttcacctactttgta

SEQ ID NO: 1287946 - DNA, 17 bp, Homo sapiens
tttcacctgtaaacctg

SEQ ID NO: 1287947 - DNA, 22 bp, Homo sapiens
tttcacctgtttttaagctgtt

SEQ ID NO: 1287948 - DNA, 23 bp, Homo sapiens
tttcacctgtttttaagctgttt

SEQ ID NO: 1287949 - DNA, 14 bp, Homo sapiens
tttcaccttccctc

SEQ ID NO: 1287950 - DNA, 16 bp, Homo sapiens
tttcacgattcatttt

SEQ ID NO: 1287951 - DNA, 19 bp, Homo sapiens
tttcacggaagttttcaat

SEQ ID NO: 1287952 - DNA, 22 bp, Homo sapiens
tttcacgggaactctccaaata

SEQ ID NO: 1287953 - DNA, 22 bp, Homo sapiens
tttcacgtaaatattcatatta

SEQ ID NO: 1287954 - DNA, 12 bp, Homo sapiens
tttcactacttt

SEQ ID NO: 1287955 - DNA, 16 bp, Homo sapiens
tttcactagagacaaa

SEQ ID NO: 1287956 - DNA, 19 bp, Homo sapiens
tttcactaggactcagaaa

SEQ ID NO: 1287957 - DNA, 20 bp, Homo sapiens
tttcactataatgtgaaatg

SEQ ID NO: 1287958 - DNA, 16 bp, Homo sapiens
tttcactatttccttt

SEQ ID NO: 1287959 - DNA, 13 bp, Homo sapiens
tttcactccctct

SEQ ID NO: 1287960 - DNA, 13 bp, Homo sapiens
tttcactcctgct

SEQ ID NO: 1287961 - DNA, 19 bp, Homo sapiens
tttcactctaagtcatgta

SEQ ID NO: 1287962 - DNA, 14 bp, Homo sapiens
tttcactgctgctc

SEQ ID NO: 1287963 - DNA, 15 bp, Homo sapiens
tttcactgctgctcc

SEQ ID NO: 1287964 - DNA, 16 bp, Homo sapiens
tttcactgctgctcct

SEQ ID NO: 1287965 - DNA, 14 bp, Homo sapiens
tttcactgctggct

SEQ ID NO: 1287966 - DNA, 17 bp, Homo sapiens
tttcactgctggctgcc

SEQ ID NO: 1287967 - DNA, 17 bp, Homo sapiens
tttcactggagttacat

SEQ ID NO: 1287968 - DNA, 19 bp, Homo sapiens
tttcactggagttacatta

SEQ ID NO: 1287969 - DNA, 23 bp, Homo sapiens
tttcactggccacagttgtttga

SEQ ID NO: 1287970 - DNA, 12 bp, Homo sapiens
tttcactgtact

SEQ ID NO: 1287971 - DNA, 21 bp, Homo sapiens
tttcacttaatgtttcttaga

SEQ ID NO: 1287972 - DNA, 12 bp, Homo sapiens
tttcacttctgt

SEQ ID NO: 1287973 - DNA, 14 bp, Homo sapiens
tttcacttgatgtt

SEQ ID NO: 1287974 - DNA, 19 bp, Homo sapiens
tttcacttgatgtttgtta

SEQ ID NO: 1287975 - DNA, 19 bp, Homo sapiens
tttcacttgtctcctttct

SEQ ID NO: 1287976 - DNA, 13 bp, Homo sapiens
tttcacttgtctt

SEQ ID NO: 1287977 - DNA, 16 bp, Homo sapiens
tttcactttattgcta

SEQ ID NO: 1287978 - DNA, 21 bp, Homo sapiens
tttcactttcacatagatgtc

SEQ ID NO: 1287979 - DNA, 22 bp, Homo sapiens
tttcactttgctctcaattaaa

SEQ ID NO: 1287980 - DNA, 20 bp, Homo sapiens
tttcactttgtgtattaaat

SEQ ID NO: 1287981 - DNA, 16 bp, Homo sapiens
tttcagaaaaagaaat

SEQ ID NO: 1287982 - DNA, 23 bp, Homo sapiens
tttcagaaattccaactcctgat

SEQ ID NO: 1287983 - DNA, 18 bp, Homo sapiens
tttcagaacctcttcccc

SEQ ID NO: 1287984 - DNA, 19 bp, Homo sapiens
tttcagaacctcttcccca

SEQ ID NO: 1287985 - DNA, 20 bp, Homo sapiens
tttcagaacctcttccccag

SEQ ID NO: 1287986 - DNA, 20 bp, Homo sapiens
tttcagaagtgccacttaag

SEQ ID NO: 1287987 - DNA, 22 bp, Homo sapiens
tttcagaagttagtttgtatat

SEQ ID NO: 1287988 - DNA, 14 bp, Homo sapiens
tttcagacagggtc

SEQ ID NO: 1287989 - DNA, 10 bp, Homo sapiens
tttcagaccc

SEQ ID NO: 1287990 - DNA, 14 bp, Homo sapiens
tttcagaccccagc

SEQ ID NO: 1287991 - DNA, 20 bp, Homo sapiens
tttcagagactttttttata

SEQ ID NO: 1287992 - DNA, 14 bp, Homo sapiens
tttcagagagtcaa

SEQ ID NO: 1287993 - DNA, 17 bp, Homo sapiens
tttcagagcccccagcc

SEQ ID NO: 1287994 - DNA, 18 bp, Homo sapiens
tttcagatataaaagact

SEQ ID NO: 1287995 - DNA, 15 bp, Homo sapiens
tttcagatatatatc

SEQ ID NO: 1287996 - DNA, 17 bp, Homo sapiens
tttcagatatcaaaatt

SEQ ID NO: 1287997 - DNA, 18 bp, Homo sapiens
tttcagatatcaaaattc

SEQ ID NO: 1287998 - DNA, 14 bp, Homo sapiens
tttcagatgcttct

SEQ ID NO: 1287999 - DNA, 16 bp, Homo sapiens
tttcagatgcttctgg

SEQ ID NO: 1288000 - DNA, 20 bp, Homo sapiens
tttcagatgcttctgggaga

SEQ ID NO: 1288001 - DNA, 15 bp, Homo sapiens
tttcagatgctttag

SEQ ID NO: 1288002 - DNA, 16 bp, Homo sapiens
tttcagatgtaatgtt

SEQ ID NO: 1288003 - DNA, 17 bp, Homo sapiens
tttcagatgtaatgttt

SEQ ID NO: 1288004 - DNA, 18 bp, Homo sapiens
tttcagatgtaatgtttt

SEQ ID NO: 1288005 - DNA, 19 bp, Homo sapiens
tttcagatgtaatgttttc

SEQ ID NO: 1288006 - DNA, 12 bp, Homo sapiens
tttcagatgtct

SEQ ID NO: 1288007 - DNA, 21 bp, Homo sapiens
tttcagatgtcttctgcctgt

SEQ ID NO: 1288008 - DNA, 22 bp, Homo sapiens
tttcagatgtgcaataatttgt

SEQ ID NO: 1288009 - DNA, 22 bp, Homo sapiens
tttcagcaacaagactgccagg

SEQ ID NO: 1288010 - DNA, 20 bp, Homo sapiens
tttcagcacccccacccacc

SEQ ID NO: 1288011 - DNA, 23 bp, Homo sapiens
tttcagcacctacagtgtacagt

SEQ ID NO: 1288012 - DNA, 14 bp, Homo sapiens
tttcagcagactat

SEQ ID NO: 1288013 - DNA, 21 bp, Homo sapiens
tttcagccaaggggctgcgct

SEQ ID NO: 1288014 - DNA, 23 bp, Homo sapiens
tttcagccaatttgtctcctact

SEQ ID NO: 1288015 - DNA, 18 bp, Homo sapiens
tttcagcgactccgttgg

SEQ ID NO: 1288016 - DNA, 13 bp, Homo sapiens
tttcagctagttt

SEQ ID NO: 1288017 - DNA, 23 bp, Homo sapiens
tttcagctcttaaaaagacactt

SEQ ID NO: 1288018 - DNA, 11 bp, Homo sapiens
tttcaggaaaa

SEQ ID NO: 1288019 - DNA, 17 bp, Homo sapiens
tttcaggaatttaaaat

SEQ ID NO: 1288020 - DNA, 16 bp, Homo sapiens
tttcaggaccttttga

SEQ ID NO: 1288021 - DNA, 18 bp, Homo sapiens
tttcaggaggaatactga

SEQ ID NO: 1288022 - DNA, 21 bp, Homo sapiens
tttcaggaggaatactgaaca

SEQ ID NO: 1288023 - DNA, 16 bp, Homo sapiens
tttcaggatactctgt

SEQ ID NO: 1288024 - DNA, 20 bp, Homo sapiens
tttcaggatactctgtcaga

SEQ ID NO: 1288025 - DNA, 14 bp, Homo sapiens
tttcaggcagcagg

SEQ ID NO: 1288026 - DNA, 16 bp, Homo sapiens
tttcaggctacctttt

SEQ ID NO: 1288027 - DNA, 15 bp, Homo sapiens
tttcaggcttttatg

SEQ ID NO: 1288028 - DNA, 16 bp, Homo sapiens
tttcaggcttttatga

SEQ ID NO: 1288029 - DNA, 15 bp, Homo sapiens
tttcagggacctcag

SEQ ID NO: 1288030 - DNA, 17 bp, Homo sapiens
tttcagggacctcaggg

SEQ ID NO: 1288031 - DNA, 21 bp, Homo sapiens
tttcagggacctcaggggcac

SEQ ID NO: 1288032 - DNA, 23 bp, Homo sapiens
tttcagggcgataaaactaaata

SEQ ID NO: 1288033 - DNA, 13 bp, Homo sapiens
tttcagggctggc

SEQ ID NO: 1288034 - DNA, 18 bp, Homo sapiens
tttcaggtgtttagttgc

SEQ ID NO: 1288035 - DNA, 15 bp, Homo sapiens
tttcagtaatgtctt

SEQ ID NO: 1288036 - DNA, 19 bp, Homo sapiens
tttcagtacttttttaaat

SEQ ID NO: 1288037 - DNA, 18 bp, Homo sapiens
tttcagtatactgtgtgg

SEQ ID NO: 1288038 - DNA, 18 bp, Homo sapiens
tttcagtccccacagata

SEQ ID NO: 1288039 - DNA, 13 bp, Homo sapiens
tttcagtcccctc

SEQ ID NO: 1288040 - DNA, 15 bp, Homo sapiens
tttcagtcttgtagt

SEQ ID NO: 1288041 - DNA, 21 bp, Homo sapiens
tttcagtggctggaattaaaa

SEQ ID NO: 1288042 - DNA, 14 bp, Homo sapiens
tttcagtggcttcc

SEQ ID NO: 1288043 - DNA, 21 bp, Homo sapiens
tttcagtggggcagtcattat

SEQ ID NO: 1288044 - DNA, 13 bp, Homo sapiens
tttcagtgtacat

SEQ ID NO: 1288045 - DNA, 19 bp, Homo sapiens
tttcagtgtattgtttatt

SEQ ID NO: 1288046 - DNA, 17 bp, Homo sapiens
tttcagtgttacctgtg

SEQ ID NO: 1288047 - DNA, 21 bp, Homo sapiens
tttcagttgatcactggcaat

SEQ ID NO: 1288048 - DNA, 18 bp, Homo sapiens
tttcataaggcctgccct

SEQ ID NO: 1288049 - DNA, 16 bp, Homo sapiens
tttcatacatatatat

SEQ ID NO: 1288050 - DNA, 19 bp, Homo sapiens
tttcatactatttagattt

SEQ ID NO: 1288051 - DNA, 14 bp, Homo sapiens
tttcatagaagtgt

SEQ ID NO: 1288052 - DNA, 15 bp, Homo sapiens
tttcgacttgcattt

SEQ ID NO: 1288053 - DNA, 15 bp, Homo sapiens
tttcgagtaaacttg

SEQ ID NO: 1288054 - DNA, 22 bp, Homo sapiens
tttcgattcgttaagagagcaa

SEQ ID NO: 1288055 - DNA, 14 bp, Homo sapiens
tttcggggagggcg

SEQ ID NO: 1288056 - DNA, 15 bp, Homo sapiens
tttcgtaccttccca

SEQ ID NO: 1288057 - DNA, 13 bp, Homo sapiens
tttcgtggggagg

SEQ ID NO: 1288058 - DNA, 13 bp, Homo sapiens
tttcgttaacatt

SEQ ID NO: 1288059 - DNA, 13 bp, Homo sapiens
tttcgttctgctg

SEQ ID NO: 1288060 - DNA, 20 bp, Homo sapiens
tttcgttttttacacgagat

SEQ ID NO: 1288061 - DNA, 15 bp, Homo sapiens
tttctaaaaaggctg

SEQ ID NO: 1288062 - DNA, 14 bp, Homo sapiens
tttctaaaaagtca

SEQ ID NO: 1288063 - DNA, 20 bp, Homo sapiens
tttctaaaaagtcagatgtt

SEQ ID NO: 1288064 - DNA, 17 bp, Homo sapiens
tttctaaaaataaagct

SEQ ID NO: 1288065 - DNA, 20 bp, Homo sapiens
tttctaaaacattcccctcc

SEQ ID NO: 1288066 - DNA, 13 bp, Homo sapiens
tttctaaaactat

SEQ ID NO: 1288067 - DNA, 12 bp, Homo sapiens
tttctaaaatct

SEQ ID NO: 1288068 - DNA, 22 bp, Homo sapiens
tttctaaactcaataaggtaat

SEQ ID NO: 1288069 - DNA, 13 bp, Homo sapiens
tttctaaagtaaa

SEQ ID NO: 1288070 - DNA, 15 bp, Homo sapiens
tttctaaagtgttgg

SEQ ID NO: 1288071 - DNA, 21 bp, Homo sapiens
tttctaaataaggaatttcct

SEQ ID NO: 1288072 - DNA, 22 bp, Homo sapiens
tttctaaataaggaatttcctc

SEQ ID NO: 1288073 - DNA, 14 bp, Homo sapiens
tttctaacagtcct

SEQ ID NO: 1288074 - DNA, 16 bp, Homo sapiens
tttctaacatatgtat

SEQ ID NO: 1288075 - DNA, 15 bp, Homo sapiens
tttctaaccaagagg

SEQ ID NO: 1288076 - DNA, 13 bp, Homo sapiens
tttctaaccttga

SEQ ID NO: 1288077 - DNA, 15 bp, Homo sapiens
tttctaactatataa

SEQ ID NO: 1288078 - DNA, 15 bp, Homo sapiens
tttctaagaaaatgt

SEQ ID NO: 1288079 - DNA, 20 bp, Homo sapiens
tttctaagacagtttttata

SEQ ID NO: 1288080 - DNA, 11 bp, Homo sapiens
tttctaagaga

SEQ ID NO: 1288081 - DNA, 16 bp, Homo sapiens
tttctaagagaagtta

SEQ ID NO: 1288082 - DNA, 14 bp, Homo sapiens
tttctaagagagct

SEQ ID NO: 1288083 - DNA, 16 bp, Homo sapiens
tttctaagcatgtagc

SEQ ID NO: 1288084 - DNA, 13 bp, Homo sapiens
tttctaagtattt

SEQ ID NO: 1288085 - DNA, 18 bp, Homo sapiens
tttctaagtgtaacctca

SEQ ID NO: 1288086 - DNA, 23 bp, Homo sapiens
tttctaatgaggagagaaaatat

SEQ ID NO: 1288087 - DNA, 15 bp, Homo sapiens
tttctaatgtgtgaa

SEQ ID NO: 1288088 - DNA, 14 bp, Homo sapiens
tttctaatgtttct

SEQ ID NO: 1288089 - DNA, 15 bp, Homo sapiens
tttctaattaacctt

SEQ ID NO: 1288090 - DNA, 12 bp, Homo sapiens
tttctaattgta

SEQ ID NO: 1288091 - DNA, 13 bp, Homo sapiens
tttctaattgtaa

SEQ ID NO: 1288092 - DNA, 22 bp, Homo sapiens
tttctacacagtaaaaacttgt

SEQ ID NO: 1288093 - DNA, 23 bp, Homo sapiens
tttctacagagaaaatgaatttg

SEQ ID NO: 1288094 - DNA, 19 bp, Homo sapiens
tttctacagtggttttata

SEQ ID NO: 1288095 - DNA, 15 bp, Homo sapiens
tttctacatgactgg

SEQ ID NO: 1288096 - DNA, 23 bp, Homo sapiens
tttctacatgactgggcctccct

SEQ ID NO: 1288097 - DNA, 22 bp, Homo sapiens
tttctacgtcatgtattttatg

SEQ ID NO: 1288098 - DNA, 17 bp, Homo sapiens
tttctacttcccctggg

SEQ ID NO: 1288099 - DNA, 19 bp, Homo sapiens
tttctagaagcacatgtgt

SEQ ID NO: 1288100 - DNA, 19 bp, Homo sapiens
tttctagaattatttttca

SEQ ID NO: 1288101 - DNA, 21 bp, Homo sapiens
tttctagaatttatcacactt

SEQ ID NO: 1288102 - DNA, 13 bp, Homo sapiens
tttctagaccaat

SEQ ID NO: 1288103 - DNA, 20 bp, Homo sapiens
tttctagatacaataaattg

SEQ ID NO: 1288104 - DNA, 23 bp, Homo sapiens
tttctagatacaataaattgcta

SEQ ID NO: 1288105 - DNA, 21 bp, Homo sapiens
tttctagcaattttctttgtt

SEQ ID NO: 1288106 - DNA, 23 bp, Homo sapiens
tttctagcgaacgtatttctcca

SEQ ID NO: 1288107 - DNA, 19 bp, Homo sapiens
tttctagctagaaatatga

SEQ ID NO: 1288108 - DNA, 14 bp, Homo sapiens
tttctagggaaatg

SEQ ID NO: 1288109 - DNA, 15 bp, Homo sapiens
tttctagggaaatga

SEQ ID NO: 1288110 - DNA, 17 bp, Homo sapiens
tttctagggacatgaaa

SEQ ID NO: 1288111 - DNA, 21 bp, Homo sapiens
tttctaggtaggaaatgtggt

SEQ ID NO: 1288112 - DNA, 16 bp, Homo sapiens
tttctagtctgtcttc

SEQ ID NO: 1288113 - DNA, 16 bp, Homo sapiens
tttctagttctttcct

SEQ ID NO: 1288114 - DNA, 13 bp, Homo sapiens
tttctagttgaaa

SEQ ID NO: 1288115 - DNA, 14 bp, Homo sapiens
tttctagtttcagt

SEQ ID NO: 1288116 - DNA, 13 bp, Homo sapiens
tttctataaattt

SEQ ID NO: 1288117 - DNA, 11 bp, Homo sapiens
tttctataagt

SEQ ID NO: 1288118 - DNA, 20 bp, Homo sapiens
tttctatcccccttaaagaa

SEQ ID NO: 1288119 - DNA, 19 bp, Homo sapiens
tttctatcgttctctcttt

SEQ ID NO: 1288120 - DNA, 15 bp, Homo sapiens
tttctatgacaaatt

SEQ ID NO: 1288121 - DNA, 14 bp, Homo sapiens
tttctatgcaggca

SEQ ID NO: 1288122 - DNA, 21 bp, Homo sapiens
tttctatgtaaattattgtaa

SEQ ID NO: 1288123 - DNA, 22 bp, Homo sapiens
tttctatgtaaattattgtaaa

SEQ ID NO: 1288124 - DNA, 20 bp, Homo sapiens
tttctatgtcatttttaatg

SEQ ID NO: 1288125 - DNA, 13 bp, Homo sapiens
tttctattcctta

SEQ ID NO: 1288126 - DNA, 22 bp, Homo sapiens
tttctattctgtcagtgttaaa

SEQ ID NO: 1288127 - DNA, 13 bp, Homo sapiens
tttctattgttac

SEQ ID NO: 1288128 - DNA, 17 bp, Homo sapiens
tttctatttctcctcca

SEQ ID NO: 1288129 - DNA, 15 bp, Homo sapiens
tttctatttttgatt

SEQ ID NO: 1288130 - DNA, 23 bp, Homo sapiens
tttctattttttataaatatcat

SEQ ID NO: 1288131 - DNA, 18 bp, Homo sapiens
tttctcaagtgttttgga

SEQ ID NO: 1288132 - DNA, 19 bp, Homo sapiens
tttctcacactctaactgt

SEQ ID NO: 1288133 - DNA, 16 bp, Homo sapiens
tttctcactaaatctt

SEQ ID NO: 1288134 - DNA, 13 bp, Homo sapiens
tttctcactgaaa

SEQ ID NO: 1288135 - DNA, 15 bp, Homo sapiens
tttctcactgaactc

SEQ ID NO: 1288136 - DNA, 16 bp, Homo sapiens
tttctcagaagtactt

SEQ ID NO: 1288137 - DNA, 23 bp, Homo sapiens
tttctcagggtcactgtccttga

SEQ ID NO: 1288138 - DNA, 19 bp, Homo sapiens
tttctcatgtgtttgcata

SEQ ID NO: 1288139 - DNA, 21 bp, Homo sapiens
tttctcatgttccttttgaaa

SEQ ID NO: 1288140 - DNA, 20 bp, Homo sapiens
tttctcatttgtttttctca

SEQ ID NO: 1288141 - DNA, 20 bp, Homo sapiens
tttctccaacttggtctttc

SEQ ID NO: 1288142 - DNA, 20 bp, Homo sapiens
tttctccaatatcagtgctc

SEQ ID NO: 1288143 - DNA, 11 bp, Homo sapiens
tttctccagct

SEQ ID NO: 1288144 - DNA, 21 bp, Homo sapiens
tttctccagctcagaacccag

SEQ ID NO: 1288145 - DNA, 14 bp, Homo sapiens
tttctccatcccct

SEQ ID NO: 1288146 - DNA, 19 bp, Homo sapiens
tttctccatcccctccctg

SEQ ID NO: 1288147 - DNA, 15 bp, Homo sapiens
tttctcccaaggcca

SEQ ID NO: 1288148 - DNA, 13 bp, Homo sapiens
tttctccccctgg

SEQ ID NO: 1288149 - DNA, 15 bp, Homo sapiens
tttctccctcacccc

SEQ ID NO: 1288150 - DNA, 23 bp, Homo sapiens
tttctccctctcatgtccctcca

SEQ ID NO: 1288151 - DNA, 21 bp, Homo sapiens
tttctccctgtcccttccttt

SEQ ID NO: 1288152 - DNA, 19 bp, Homo sapiens
tttctccctttatgtatct

SEQ ID NO: 1288153 - DNA, 20 bp, Homo sapiens
tttctccgggtcctcctaag

SEQ ID NO: 1288154 - DNA, 14 bp, Homo sapiens
tttctcctccatgg

SEQ ID NO: 1288155 - DNA, 15 bp, Homo sapiens
tttctcctcccagga

SEQ ID NO: 1288156 - DNA, 13 bp, Homo sapiens
tttctcctcccca

SEQ ID NO: 1288157 - DNA, 17 bp, Homo sapiens
tttctcctccccacctg

SEQ ID NO: 1288158 - DNA, 15 bp, Homo sapiens
tttctcctcccttcc

SEQ ID NO: 1288159 - DNA, 23 bp, Homo sapiens
tttctcctgggaaacctgccttt

SEQ ID NO: 1288160 - DNA, 22 bp, Homo sapiens
tttctcctggtgactcaaataa

SEQ ID NO: 1288161 - DNA, 12 bp, Homo sapiens
tttctcctgtga

SEQ ID NO: 1288162 - DNA, 19 bp, Homo sapiens
tttctccttagtcttctca

SEQ ID NO: 1288163 - DNA, 13 bp, Homo sapiens
tttctccttgaaa

SEQ ID NO: 1288164 - DNA, 16 bp, Homo sapiens
tttctcgtccccctcc

SEQ ID NO: 1288165 - DNA, 19 bp, Homo sapiens
tttctcgtggtagaagcca

SEQ ID NO: 1288166 - DNA, 14 bp, Homo sapiens
tttctctacactaa

SEQ ID NO: 1288167 - DNA, 16 bp, Homo sapiens
tttctctattatgtta

SEQ ID NO: 1288168 - DNA, 15 bp, Homo sapiens
tttctctcctggctc

SEQ ID NO: 1288169 - DNA, 18 bp, Homo sapiens
tttctctctacagtgcca

SEQ ID NO: 1288170 - DNA, 14 bp, Homo sapiens
tttctctctcctgg

SEQ ID NO: 1288171 - DNA, 15 bp, Homo sapiens
tttctctctcctggt

SEQ ID NO: 1288172 - DNA, 11 bp, Homo sapiens
tttctctctgc

SEQ ID NO: 1288173 - DNA, 16 bp, Homo sapiens
tttctctcttccctca

SEQ ID NO: 1288174 - DNA, 17 bp, Homo sapiens
tttctctcttccctcag

SEQ ID NO: 1288175 - DNA, 20 bp, Homo sapiens
tttcttaggagcaagaagaa

SEQ ID NO: 1288176 - DNA, 21 bp, Homo sapiens
tttcttaggagcaagaagaaa

SEQ ID NO: 1288177 - DNA, 16 bp, Homo sapiens
tttcttagtgcctgtg

SEQ ID NO: 1288178 - DNA, 21 bp, Homo sapiens
tttcttataatactctgttgt

SEQ ID NO: 1288179 - DNA, 19 bp, Homo sapiens
tttcttattgaatttgtta

SEQ ID NO: 1288180 - DNA, 17 bp, Homo sapiens
tttcttattgcgctgct

SEQ ID NO: 1288181 - DNA, 18 bp, Homo sapiens
tttcttcaacatcaatgt

SEQ ID NO: 1288182 - DNA, 18 bp, Homo sapiens
tttcttcaacatgctcca

SEQ ID NO: 1288183 - DNA, 14 bp, Homo sapiens
tttcttcaccaagt

SEQ ID NO: 1288184 - DNA, 13 bp, Homo sapiens
tttcttcagaatt

SEQ ID NO: 1288185 - DNA, 18 bp, Homo sapiens
tttcttcagaattatcca

SEQ ID NO: 1288186 - DNA, 16 bp, Homo sapiens
tttcttcagggctgct

SEQ ID NO: 1288187 - DNA, 15 bp, Homo sapiens
tttcttcatccaact

SEQ ID NO: 1288188 - DNA, 12 bp, Homo sapiens
tttcttcatgag

SEQ ID NO: 1288189 - DNA, 16 bp, Homo sapiens
tttcttcatgcaatga

SEQ ID NO: 1288190 - DNA, 18 bp, Homo sapiens
tttcttcatgcaatgaca

SEQ ID NO: 1288191 - DNA, 22 bp, Homo sapiens
tttcttcatgcaatgacatctt

SEQ ID NO: 1288192 - DNA, 17 bp, Homo sapiens
tttcttcatttctctgc

SEQ ID NO: 1288193 - DNA, 14 bp, Homo sapiens
tttcttcccatcac

SEQ ID NO: 1288194 - DNA, 20 bp, Homo sapiens
tttcttcctttgaagcttta

SEQ ID NO: 1288195 - DNA, 14 bp, Homo sapiens
tttcttctctctgt

SEQ ID NO: 1288196 - DNA, 15 bp, Homo sapiens
tttcttctctctgtt

SEQ ID NO: 1288197 - DNA, 18 bp, Homo sapiens
tttcttctctctgttccc

SEQ ID NO: 1288198 - DNA, 19 bp, Homo sapiens
tttcttctcttatcctctc

SEQ ID NO: 1288199 - DNA, 23 bp, Homo sapiens
tttcttctcttatcctctctctc

SEQ ID NO: 1288200 - DNA, 13 bp, Homo sapiens
tttcttctgccct

SEQ ID NO: 1288201 - DNA, 14 bp, Homo sapiens
tttcttcttcctgg

SEQ ID NO: 1288202 - DNA, 16 bp, Homo sapiens
tttcttcttcctggta

SEQ ID NO: 1288203 - DNA, 18 bp, Homo sapiens
tttcttcttctaagaaga

SEQ ID NO: 1288204 - DNA, 17 bp, Homo sapiens
tttcttcttttccttta

SEQ ID NO: 1288205 - DNA, 21 bp, Homo sapiens
tttcttcttttttaagttgtc

SEQ ID NO: 1288206 - DNA, 16 bp, Homo sapiens
tttcttgaacatactt

SEQ ID NO: 1288207 - DNA, 14 bp, Homo sapiens
tttcttgacaagct

SEQ ID NO: 1288208 - DNA, 18 bp, Homo sapiens
tttcttgatcttaaagat

SEQ ID NO: 1288209 - DNA, 18 bp, Homo sapiens
tttcttgccccagtgtgg

SEQ ID NO: 1288210 - DNA, 11 bp, Homo sapiens
tttcttgctgg

SEQ ID NO: 1288211 - DNA, 11 bp, Homo sapiens
tttcttgggaa

SEQ ID NO: 1288212 - DNA, 18 bp, Homo sapiens
tttcttggttcataaatg

SEQ ID NO: 1288213 - DNA, 19 bp, Homo sapiens
tttcttggttcataaatga

SEQ ID NO: 1288214 - DNA, 20 bp, Homo sapiens
tttcttggtttctggataaa

SEQ ID NO: 1288215 - DNA, 15 bp, Homo sapiens
tttcttgtaaatgtt

SEQ ID NO: 1288216 - DNA, 14 bp, Homo sapiens
tttcttgtctgtta

SEQ ID NO: 1288217 - DNA, 17 bp, Homo sapiens
tttcttgtgccctgggc

SEQ ID NO: 1288218 - DNA, 17 bp, Homo sapiens
tttcttgttattaccaa

SEQ ID NO: 1288219 - DNA, 17 bp, Homo sapiens
tttcttgttgcatcttt

SEQ ID NO: 1288220 - DNA, 14 bp, Homo sapiens
tttctttaaagatg

SEQ ID NO: 1288221 - DNA, 15 bp, Homo sapiens
tttctttaagaaagt

SEQ ID NO: 1288222 - DNA, 20 bp, Homo sapiens
tttctttaagataatagttt

SEQ ID NO: 1288223 - DNA, 13 bp, Homo sapiens
tttctttaatgct

SEQ ID NO: 1288224 - DNA, 20 bp, Homo sapiens
tttctttacttaacatatct

SEQ ID NO: 1288225 - DNA, 21 bp, Homo sapiens
tttctttagtttttgtgaagt

SEQ ID NO: 1288226 - DNA, 21 bp, Homo sapiens
tttctttccccaaaaattgac

SEQ ID NO: 1288227 - DNA, 19 bp, Homo sapiens
tttctttcctgtaaagaaa

SEQ ID NO: 1288228 - DNA, 12 bp, Homo sapiens
tttctttctcga

SEQ ID NO: 1288229 - DNA, 13 bp, Homo sapiens
tttctttcttcca

SEQ ID NO: 1288230 - DNA, 15 bp, Homo sapiens
tttctttcttcccgt

SEQ ID NO: 1288231 - DNA, 23 bp, Homo sapiens
tttctttcttcccgtgtgtattt

SEQ ID NO: 1288232 - DNA, 16 bp, Homo sapiens
tttctttctttttctg

SEQ ID NO: 1288233 - DNA, 20 bp, Homo sapiens
tttctttgaaaaaaaataaa

SEQ ID NO: 1288234 - DNA, 22 bp, Homo sapiens
tttctttgaatgctttttgaat

SEQ ID NO: 1288235 - DNA, 14 bp, Homo sapiens
tttctttgaccaga

SEQ ID NO: 1288236 - DNA, 15 bp, Homo sapiens
tttctttgcaaagta

SEQ ID NO: 1288237 - DNA, 20 bp, Homo sapiens
tttctttgcaccaaagacat

SEQ ID NO: 1288238 - DNA, 22 bp, Homo sapiens
tttctttggcctacattcttta

SEQ ID NO: 1288239 - DNA, 18 bp, Homo sapiens
tttctttgtagaataaat

SEQ ID NO: 1288240 - DNA, 13 bp, Homo sapiens
tttctttgtttct

SEQ ID NO: 1288241 - DNA, 13 bp, Homo sapiens
tttcttttactct

SEQ ID NO: 1288242 - DNA, 16 bp, Homo sapiens
tttcttttctctggta

SEQ ID NO: 1288243 - DNA, 22 bp, Homo sapiens
tttcttttctggaatgtaatca

SEQ ID NO: 1288244 - DNA, 21 bp, Homo sapiens
tttcttttgttgtactttata

SEQ ID NO: 1288245 - DNA, 13 bp, Homo sapiens
tttctttttaaat

SEQ ID NO: 1288246 - DNA, 22 bp, Homo sapiens
tttctttttaaccctaatcttt

SEQ ID NO: 1288247 - DNA, 13 bp, Homo sapiens
tttctttttaatt

SEQ ID NO: 1288248 - DNA, 20 bp, Homo sapiens
tttctttttaattattttaa

SEQ ID NO: 1288249 - DNA, 15 bp, Homo sapiens
tttctttttctggaa

SEQ ID NO: 1288250 - DNA, 21 bp, Homo sapiens
tttctttttctggaaattttg

SEQ ID NO: 1288251 - DNA, 19 bp, Homo sapiens
tttctttttcttcttccct

SEQ ID NO: 1288252 - DNA, 18 bp, Homo sapiens
tttcttttttaaagtaaa

SEQ ID NO: 1288253 - DNA, 16 bp, Homo sapiens
tttcttttttaaatta

SEQ ID NO: 1288254 - DNA, 14 bp, Homo sapiens
tttctttttttggt

SEQ ID NO: 1288255 - DNA, 22 bp, Homo sapiens
tttgaaaaagagaacagaaaac

SEQ ID NO: 1288256 - DNA, 13 bp, Homo sapiens
tttgaaaaatatt

SEQ ID NO: 1288257 - DNA, 14 bp, Homo sapiens
tttgaaaaatattg

SEQ ID NO: 1288258 - DNA, 16 bp, Homo sapiens
tttgaaaaatattgct

SEQ ID NO: 1288259 - DNA, 19 bp, Homo sapiens
tttgaaaaatattgctaaa

SEQ ID NO: 1288260 - DNA, 22 bp, Homo sapiens
tttgaaaaatattgctaaaagt

SEQ ID NO: 1288261 - DNA, 23 bp, Homo sapiens
tttgaaaaatattgctaaaagtg

SEQ ID NO: 1288262 - DNA, 14 bp, Homo sapiens
tttgaaaacaaaaa

SEQ ID NO: 1288263 - DNA, 20 bp, Homo sapiens
tttgaaaacaattcagtggt

SEQ ID NO: 1288264 - DNA, 19 bp, Homo sapiens
tttgaaaacatgtttattt

SEQ ID NO: 1288265 - DNA, 18 bp, Homo sapiens
tttgaaaactgaatgtca

SEQ ID NO: 1288266 - DNA, 19 bp, Homo sapiens
tttgaaaacttcagaagca

SEQ ID NO: 1288267 - DNA, 23 bp, Homo sapiens
tttgaaaagcaatattgtatatt

SEQ ID NO: 1288268 - DNA, 16 bp, Homo sapiens
tttgaaaagcagacat

SEQ ID NO: 1288269 - DNA, 20 bp, Homo sapiens
tttgaaaagctgactgtttt

SEQ ID NO: 1288270 - DNA, 18 bp, Homo sapiens
tttgaaaatatttctatg

SEQ ID NO: 1288271 - DNA, 16 bp, Homo sapiens
tttgaaaatgctctta

SEQ ID NO: 1288272 - DNA, 11 bp, Homo sapiens
tttgaaaatgg

SEQ ID NO: 1288273 - DNA, 13 bp, Homo sapiens
tttgaaaatgtcc

SEQ ID NO: 1288274 - DNA, 23 bp, Homo sapiens
tttgaaaattacatgttttttca

SEQ ID NO: 1288275 - DNA, 18 bp, Homo sapiens
tttgaaaattatgcaaaa

SEQ ID NO: 1288276 - DNA, 16 bp, Homo sapiens
tttgaaaattgtatac

SEQ ID NO: 1288277 - DNA, 17 bp, Homo sapiens
tttgaaaattttacttc

SEQ ID NO: 1288278 - DNA, 16 bp, Homo sapiens
tttgaaactaactcat

SEQ ID NO: 1288279 - DNA, 21 bp, Homo sapiens
tttgaaactaactcatagatt

SEQ ID NO: 1288280 - DNA, 21 bp, Homo sapiens
tttgaaagaatagaacacagt

SEQ ID NO: 1288281 - DNA, 17 bp, Homo sapiens
tttgaaagattatgatg

SEQ ID NO: 1288282 - DNA, 17 bp, Homo sapiens
tttgaaagtctgtcctt

SEQ ID NO: 1288283 - DNA, 22 bp, Homo sapiens
tttgaaataaaaaaagattttt

SEQ ID NO: 1288284 - DNA, 20 bp, Homo sapiens
tttgaaatccagaagtttta

SEQ ID NO: 1288285 - DNA, 21 bp, Homo sapiens
tttgaaatgaggtctgtttaa

SEQ ID NO: 1288286 - DNA, 15 bp, Homo sapiens
tttgaaatgatatga

SEQ ID NO: 1288287 - DNA, 18 bp, Homo sapiens
tttgaaatgggcatttat

SEQ ID NO: 1288288 - DNA, 21 bp, Homo sapiens
tttgaacacgaaagaaatgta

SEQ ID NO: 1288289 - DNA, 22 bp, Homo sapiens
tttgaacatgtgccttttctga

SEQ ID NO: 1288290 - DNA, 14 bp, Homo sapiens
tttgaactcttcaa

SEQ ID NO: 1288291 - DNA, 17 bp, Homo sapiens
tttgaactgaaactttt

SEQ ID NO: 1288292 - DNA, 19 bp, Homo sapiens
tttgaactgataaagatga

SEQ ID NO: 1288293 - DNA, 17 bp, Homo sapiens
tttgaactgttagatgc

SEQ ID NO: 1288294 - DNA, 14 bp, Homo sapiens
tttgaactttttat

SEQ ID NO: 1288295 - DNA, 17 bp, Homo sapiens
tttgaagaacatgtgag

SEQ ID NO: 1288296 - DNA, 21 bp, Homo sapiens
tttgaagacgtggactcctct

SEQ ID NO: 1288297 - DNA, 14 bp, Homo sapiens
tttggggatatttt

SEQ ID NO: 1288298 - DNA, 20 bp, Homo sapiens
tttggggattttcaaaagat

SEQ ID NO: 1288299 - DNA, 17 bp, Homo sapiens
tttggggcatcctggat

SEQ ID NO: 1288300 - DNA, 18 bp, Homo sapiens
tttggggccatggtggag

SEQ ID NO: 1288301 - DNA, 22 bp, Homo sapiens
tttgggggaaaatttagaaata

SEQ ID NO: 1288302 - DNA, 23 bp, Homo sapiens
tttgggggaaacgggctccttcc

SEQ ID NO: 1288303 - DNA, 22 bp, Homo sapiens
tttgggggcgccctctctgctc

SEQ ID NO: 1288304 - DNA, 19 bp, Homo sapiens
tttggggggtgtgctgaca

SEQ ID NO: 1288305 - DNA, 15 bp, Homo sapiens
tttgggggtcaggca

SEQ ID NO: 1288306 - DNA, 20 bp, Homo sapiens
tttgggggtcaggcagccag

SEQ ID NO: 1288307 - DNA, 21 bp, Homo sapiens
tttggggtataggtctcatct

SEQ ID NO: 1288308 - DNA, 16 bp, Homo sapiens
tttgggtgcctcctgc

SEQ ID NO: 1288309 - DNA, 17 bp, Homo sapiens
tttgggttttttctgtt

SEQ ID NO: 1288310 - DNA, 19 bp, Homo sapiens
tttgggtttttttttttga

SEQ ID NO: 1288311 - DNA, 23 bp, Homo sapiens
tttggtaataacaaacgtgtttt

SEQ ID NO: 1288312 - DNA, 13 bp, Homo sapiens
tttggtacaaaaa

SEQ ID NO: 1288313 - DNA, 19 bp, Homo sapiens
tttggtagctgggaaagca

SEQ ID NO: 1288314 - DNA, 21 bp, Homo sapiens
tttggtagctgggaaagcata

SEQ ID NO: 1288315 - DNA, 15 bp, Homo sapiens
tttggtattgtaaaa

SEQ ID NO: 1288316 - DNA, 12 bp, Homo sapiens
tttggtatttat

SEQ ID NO: 1288317 - DNA, 14 bp, Homo sapiens
tttggtccaaaaaa

SEQ ID NO: 1288318 - DNA, 12 bp, Homo sapiens
tttggtcccctc

SEQ ID NO: 1288319 - DNA, 16 bp, Homo sapiens
tttggtcgaggagtaa

SEQ ID NO: 1288320 - DNA, 19 bp, Homo sapiens
tttggtcgagtctttgtgt

SEQ ID NO: 1288321 - DNA, 23 bp, Homo sapiens
tttggtctcatccttctctgact

SEQ ID NO: 1288322 - DNA, 21 bp, Homo sapiens
tttggtctttttttgtattat

SEQ ID NO: 1288323 - DNA, 21 bp, Homo sapiens
tttggtgcagaggtttcttga

SEQ ID NO: 1288324 - DNA, 20 bp, Homo sapiens
tttggtgccgatgttgaact

SEQ ID NO: 1288325 - DNA, 18 bp, Homo sapiens
tttggtgctggtctattt

SEQ ID NO: 1288326 - DNA, 12 bp, Homo sapiens
tttggtgctttt

SEQ ID NO: 1288327 - DNA, 20 bp, Homo sapiens
tttggtgctttttataaaaa

SEQ ID NO: 1288328 - DNA, 20 bp, Homo sapiens
tttggtgggggtagagctga

SEQ ID NO: 1288329 - DNA, 19 bp, Homo sapiens
tttggtggggtggcacctg

SEQ ID NO: 1288330 - DNA, 13 bp, Homo sapiens
tttggtgttcctg

SEQ ID NO: 1288331 - DNA, 18 bp, Homo sapiens
tttggttaaaaaaaagaa

SEQ ID NO: 1288332 - DNA, 20 bp, Homo sapiens
tttggttatgaatactttgc

SEQ ID NO: 1288333 - DNA, 13 bp, Homo sapiens
tttggttctaata

SEQ ID NO: 1288334 - DNA, 13 bp, Homo sapiens
tttggttgcactt

SEQ ID NO: 1288335 - DNA, 21 bp, Homo sapiens
tttggtttatattttttcagt

SEQ ID NO: 1288336 - DNA, 18 bp, Homo sapiens
tttggtttcaccttccct

SEQ ID NO: 1288337 - DNA, 16 bp, Homo sapiens
tttggttttaaaagca

SEQ ID NO: 1288338 - DNA, 18 bp, Homo sapiens
tttggttttaaaccttta

SEQ ID NO: 1288339 - DNA, 15 bp, Homo sapiens
tttgtaaaaactgaa

SEQ ID NO: 1288340 - DNA, 18 bp, Homo sapiens
tttgtaaaaatgagactt

SEQ ID NO: 1288341 - DNA, 23 bp, Homo sapiens
tttgtaaaagaacagtaaacatt

SEQ ID NO: 1288342 - DNA, 19 bp, Homo sapiens
tttgtaaaatcttgcagtt

SEQ ID NO: 1288343 - DNA, 13 bp, Homo sapiens
tttgtaaaatgta

SEQ ID NO: 1288344 - DNA, 15 bp, Homo sapiens
tttgtaaaatgtatt

SEQ ID NO: 1288345 - DNA, 21 bp, Homo sapiens
tttgtaaacaatctaattaaa

SEQ ID NO: 1288346 - DNA, 13 bp, Homo sapiens
tttgtaaaccatt

SEQ ID NO: 1288347 - DNA, 17 bp, Homo sapiens
tttgtaaactgtatcaa

SEQ ID NO: 1288348 - DNA, 14 bp, Homo sapiens
tttgtaaacttctg

SEQ ID NO: 1288349 - DNA, 15 bp, Homo sapiens
tttgtaaacttctga

SEQ ID NO: 1288350 - DNA, 15 bp, Homo sapiens
tttgtaaataagaga

SEQ ID NO: 1288351 - DNA, 12 bp, Homo sapiens
tttgtaaatatt

SEQ ID NO: 1288352 - DNA, 14 bp, Homo sapiens
tttgtaaatattct

SEQ ID NO: 1288353 - DNA, 15 bp, Homo sapiens
tttgtaaatctgcca

SEQ ID NO: 1288354 - DNA, 17 bp, Homo sapiens
tttgtaaatctgccaca

SEQ ID NO: 1288355 - DNA, 21 bp, Homo sapiens
tttgtaaatgattttaatttt

SEQ ID NO: 1288356 - DNA, 22 bp, Homo sapiens
tttgtaaattaacttttataaa

SEQ ID NO: 1288357 - DNA, 17 bp, Homo sapiens
tttgtaaattaatactt

SEQ ID NO: 1288358 - DNA, 17 bp, Homo sapiens
tttgtaaattattgatg

SEQ ID NO: 1288359 - DNA, 18 bp, Homo sapiens
tttgtaaattatttatgt

SEQ ID NO: 1288360 - DNA, 15 bp, Homo sapiens
tttgtaaattgtgtt

SEQ ID NO: 1288361 - DNA, 19 bp, Homo sapiens
tttgtaacattgtaaagta

SEQ ID NO: 1288362 - DNA, 10 bp, Homo sapiens
tttgtaacta

SEQ ID NO: 1288363 - DNA, 15 bp, Homo sapiens
tttgtaagacatttg

SEQ ID NO: 1288364 - DNA, 16 bp, Homo sapiens
tttgtaagacatttgt

SEQ ID NO: 1288365 - DNA, 15 bp, Homo sapiens
tttgtaagatgctgg

SEQ ID NO: 1288366 - DNA, 19 bp, Homo sapiens
tttgtaagcaacttgcttc

SEQ ID NO: 1288367 - DNA, 21 bp, Homo sapiens
tttgtaagcaacttgcttcta

SEQ ID NO: 1288368 - DNA, 22 bp, Homo sapiens
tttgtaagtaacaatatgtaat

SEQ ID NO: 1288369 - DNA, 14 bp, Homo sapiens
tttgtaataaagta

SEQ ID NO: 1288370 - DNA, 19 bp, Homo sapiens
tttgtaataataaagaata

SEQ ID NO: 1288371 - DNA, 21 bp, Homo sapiens
tttgtaataataaagaatagc

SEQ ID NO: 1288372 - DNA, 13 bp, Homo sapiens
tttgtaatacttt

SEQ ID NO: 1288373 - DNA, 19 bp, Homo sapiens
tttgtaatgcaaaaggctg

SEQ ID NO: 1288374 - DNA, 17 bp, Homo sapiens
tttgtaattcctgatct

SEQ ID NO: 1288375 - DNA, 16 bp, Homo sapiens
tttgtaatttgaattg

SEQ ID NO: 1288376 - DNA, 17 bp, Homo sapiens
tttgtaatttgaattgg

SEQ ID NO: 1288377 - DNA, 16 bp, Homo sapiens
tttgtaatttttttat

SEQ ID NO: 1288378 - DNA, 19 bp, Homo sapiens
tttgtacaaggtaattgtt

SEQ ID NO: 1288379 - DNA, 12 bp, Homo sapiens
tttgtacactta

SEQ ID NO: 1288380 - DNA, 18 bp, Homo sapiens
tttgtacaggactgtaaa

SEQ ID NO: 1288381 - DNA, 17 bp, Homo sapiens
tttgtacaggggccatg

SEQ ID NO: 1288382 - DNA, 16 bp, Homo sapiens
tttgtacatagattta

SEQ ID NO: 1288383 - DNA, 17 bp, Homo sapiens
tttgtaccatggtgtga

SEQ ID NO: 1288384 - DNA, 21 bp, Homo sapiens
tttgtaccattccttcaaata

SEQ ID NO: 1288385 - DNA, 14 bp, Homo sapiens
tttgtactgaatct

SEQ ID NO: 1288386 - DNA, 16 bp, Homo sapiens
tttgtactgaattttt

SEQ ID NO: 1288387 - DNA, 22 bp, Homo sapiens
tttgtactgaatttttttgtaa

SEQ ID NO: 1288388 - DNA, 18 bp, Homo sapiens
tttgtactgtttaatgtt

SEQ ID NO: 1288389 - DNA, 12 bp, Homo sapiens
tttgtactttat

SEQ ID NO: 1288390 - DNA, 20 bp, Homo sapiens
tttgtactttatcatgaatg

SEQ ID NO: 1288391 - DNA, 16 bp, Homo sapiens
tttgtagaataaatgg

SEQ ID NO: 1288392 - DNA, 18 bp, Homo sapiens
tttgtagaataaatggtt

SEQ ID NO: 1288393 - DNA, 16 bp, Homo sapiens
tttgtagatgaacttg

SEQ ID NO: 1288394 - DNA, 12 bp, Homo sapiens
tttgtagatggc

SEQ ID NO: 1288395 - DNA, 21 bp, Homo sapiens
tttgtagatggcgatgtgtta

SEQ ID NO: 1288396 - DNA, 18 bp, Homo sapiens
tttgtagcataactgtag

SEQ ID NO: 1288397 - DNA, 23 bp, Homo sapiens
tttgtagtaaaagtggtctctgc

SEQ ID NO: 1288398 - DNA, 12 bp, Homo sapiens
tttgtagttttt

SEQ ID NO: 1288399 - DNA, 23 bp, Homo sapiens
tttgtataaaatccatagattta

SEQ ID NO: 1288400 - DNA, 13 bp, Homo sapiens
tttgtataaaatg

SEQ ID NO: 1288401 - DNA, 14 bp, Homo sapiens
tttgtataaataat

SEQ ID NO: 1288402 - DNA, 23 bp, Homo sapiens
tttgtataaatgacaaagtgttg

SEQ ID NO: 1288403 - DNA, 23 bp, Homo sapiens
tttgtataaattaaataaactgt

SEQ ID NO: 1288404 - DNA, 19 bp, Homo sapiens
tttgtataacttcttaaaa

SEQ ID NO: 1288405 - DNA, 21 bp, Homo sapiens
tttgtataattggatttccta

SEQ ID NO: 1288406 - DNA, 14 bp, Homo sapiens
tttgtatagaccaa

SEQ ID NO: 1288407 - DNA, 14 bp, Homo sapiens
tttgtatatcatga

SEQ ID NO: 1288408 - DNA, 21 bp, Homo sapiens
tttgtatattaaaatagcata

SEQ ID NO: 1288409 - DNA, 14 bp, Homo sapiens
tttgtatatttgca

SEQ ID NO: 1288410 - DNA, 11 bp, Homo sapiens
tttgtatgaga

SEQ ID NO: 1288411 - DNA, 17 bp, Homo sapiens
tttgtatgagatggtta

SEQ ID NO: 1288412 - DNA, 21 bp, Homo sapiens
tttgtatgagatggttaaaaa

SEQ ID NO: 1288413 - DNA, 12 bp, Homo sapiens
tttgtatgtaaa

SEQ ID NO: 1288414 - DNA, 16 bp, Homo sapiens
tttgtatgtaaatgtg

SEQ ID NO: 1288415 - DNA, 17 bp, Homo sapiens
tttgtatgtaaatgtgc

SEQ ID NO: 1288416 - DNA, 18 bp, Homo sapiens
tttgtatgttttttttct

SEQ ID NO: 1288417 - DNA, 11 bp, Homo sapiens
tttgtattaat

SEQ ID NO: 1288418 - DNA, 13 bp, Homo sapiens
tttgtattaataa

SEQ ID NO: 1288419 - DNA, 19 bp, Homo sapiens
ttttaagaattgagtaatg

SEQ ID NO: 1288420 - DNA, 17 bp, Homo sapiens
ttttaagacagagtttc

SEQ ID NO: 1288421 - DNA, 15 bp, Homo sapiens
ttttaagatagtgta

SEQ ID NO: 1288422 - DNA, 15 bp, Homo sapiens
ttttaagcaaaatat

SEQ ID NO: 1288423 - DNA, 14 bp, Homo sapiens
ttttaagctatcag

SEQ ID NO: 1288424 - DNA, 21 bp, Homo sapiens
ttttaagctccatgtgcatat

SEQ ID NO: 1288425 - DNA, 21 bp, Homo sapiens
ttttaagctgcaaatctgatg

SEQ ID NO: 1288426 - DNA, 12 bp, Homo sapiens
ttttaagctgtt

SEQ ID NO: 1288427 - DNA, 14 bp, Homo sapiens
ttttaagcttttat

SEQ ID NO: 1288428 - DNA, 12 bp, Homo sapiens
ttttaaggaaac

SEQ ID NO: 1288429 - DNA, 15 bp, Homo sapiens
ttttaagggggaaaa

SEQ ID NO: 1288430 - DNA, 23 bp, Homo sapiens
ttttaagggtttgtggaaaatga

SEQ ID NO: 1288431 - DNA, 13 bp, Homo sapiens
ttttaaggtcttt

SEQ ID NO: 1288432 - DNA, 18 bp, Homo sapiens
ttttaaggtctttcagta

SEQ ID NO: 1288433 - DNA, 23 bp, Homo sapiens
ttttaaggtctttcagtactttt

SEQ ID NO: 1288434 - DNA, 19 bp, Homo sapiens
ttttaagtatttatatatt

SEQ ID NO: 1288435 - DNA, 21 bp, Homo sapiens
ttttaagtgcaacatttctgt

SEQ ID NO: 1288436 - DNA, 23 bp, Homo sapiens
ttttaagtgcaacatttctgtat

SEQ ID NO: 1288437 - DNA, 23 bp, Homo sapiens
ttttaagtgccttggatgagaag

SEQ ID NO: 1288438 - DNA, 16 bp, Homo sapiens
ttttaagtgctgcatt

SEQ ID NO: 1288439 - DNA, 21 bp, Homo sapiens
ttttaagtgctgcatttaaaa

SEQ ID NO: 1288440 - DNA, 18 bp, Homo sapiens
ttttaagtgcttcacatt

SEQ ID NO: 1288441 - DNA, 17 bp, Homo sapiens
ttttaagtgctttgtaa

SEQ ID NO: 1288442 - DNA, 15 bp, Homo sapiens
ttttaagttaataga

SEQ ID NO: 1288443 - DNA, 15 bp, Homo sapiens
ttttaagttgtcaaa

SEQ ID NO: 1288444 - DNA, 20 bp, Homo sapiens
ttttaagtttctctgcagaa

SEQ ID NO: 1288445 - DNA, 15 bp, Homo sapiens
ttttaataaaagatt

SEQ ID NO: 1288446 - DNA, 13 bp, Homo sapiens
ttttaataagaac

SEQ ID NO: 1288447 - DNA, 23 bp, Homo sapiens
ttttaataattatttttaattta

SEQ ID NO: 1288448 - DNA, 15 bp, Homo sapiens
ttttaatacattgat

SEQ ID NO: 1288449 - DNA, 23 bp, Homo sapiens
ttttaatagaaataaattcctaa

SEQ ID NO: 1288450 - DNA, 12 bp, Homo sapiens
ttttaatagcac

SEQ ID NO: 1288451 - DNA, 21 bp, Homo sapiens
ttttaatattaacttttaatg

SEQ ID NO: 1288452 - DNA, 22 bp, Homo sapiens
ttttaatattaacttttaatgg

SEQ ID NO: 1288453 - DNA, 23 bp, Homo sapiens
ttttaatcagcaatattgcctgt

SEQ ID NO: 1288454 - DNA, 14 bp, Homo sapiens
ttttaatcccctgc

SEQ ID NO: 1288455 - DNA, 22 bp, Homo sapiens
ttttaatgaaaaggaatcacgt

SEQ ID NO: 1288456 - DNA, 22 bp, Homo sapiens
ttttaatgatctcggatgacca

SEQ ID NO: 1288457 - DNA, 23 bp, Homo sapiens
ttttaatgatctcggatgaccaa

SEQ ID NO: 1288458 - DNA, 15 bp, Homo sapiens
ttttaatgatgacaa

SEQ ID NO: 1288459 - DNA, 16 bp, Homo sapiens
ttttaatgcagttgct

SEQ ID NO: 1288460 - DNA, 18 bp, Homo sapiens
ttttaatgctgtttctaa

SEQ ID NO: 1288461 - DNA, 21 bp, Homo sapiens
ttttaatgctgtttctaagaa

SEQ ID NO: 1288462 - DNA, 13 bp, Homo sapiens
ttttaatggcatt

SEQ ID NO: 1288463 - DNA, 22 bp, Homo sapiens
ttttaatgggggtagcagctgg

SEQ ID NO: 1288464 - DNA, 23 bp, Homo sapiens
ttttaatgggggtagcagctgga

SEQ ID NO: 1288465 - DNA, 14 bp, Homo sapiens
ttttaatgtacaag

SEQ ID NO: 1288466 - DNA, 20 bp, Homo sapiens
ttttaatgtacaagttttgt

SEQ ID NO: 1288467 - DNA, 18 bp, Homo sapiens
ttttaatgtatatttgct

SEQ ID NO: 1288468 - DNA, 19 bp, Homo sapiens
ttttaatgtatctatttgt

SEQ ID NO: 1288469 - DNA, 20 bp, Homo sapiens
ttttaatgtgaagacatttt

SEQ ID NO: 1288470 - DNA, 15 bp, Homo sapiens
ttttaattaaaaact

SEQ ID NO: 1288471 - DNA, 22 bp, Homo sapiens
ttttaattcaacatcaaaactt

SEQ ID NO: 1288472 - DNA, 20 bp, Homo sapiens
ttttaattcaccaaagtatt

SEQ ID NO: 1288473 - DNA, 12 bp, Homo sapiens
ttttaattcatt

SEQ ID NO: 1288474 - DNA, 19 bp, Homo sapiens
ttttaattccaatatgatg

SEQ ID NO: 1288475 - DNA, 21 bp, Homo sapiens
ttttaattccatgtcagataa

SEQ ID NO: 1288476 - DNA, 15 bp, Homo sapiens
ttttaattgattatt

SEQ ID NO: 1288477 - DNA, 10 bp, Homo sapiens
ttttaattta

SEQ ID NO: 1288478 - DNA, 17 bp, Homo sapiens
ttttaatttaacatgaa

SEQ ID NO: 1288479 - DNA, 12 bp, Homo sapiens
ttttaatttagt

SEQ ID NO: 1288480 - DNA, 15 bp, Homo sapiens
ttttaatttgatgaa

SEQ ID NO: 1288481 - DNA, 13 bp, Homo sapiens
ttttaattttgat

SEQ ID NO: 1288482 - DNA, 17 bp, Homo sapiens
ttttaattttttctctt

SEQ ID NO: 1288483 - DNA, 10 bp, Homo sapiens
ttttacaaaa

SEQ ID NO: 1288484 - DNA, 12 bp, Homo sapiens
ttttacaaaact

SEQ ID NO: 1288485 - DNA, 16 bp, Homo sapiens
ttttacaaaactgctt

SEQ ID NO: 1288486 - DNA, 21 bp, Homo sapiens
ttttacaagagagtgaaattt

SEQ ID NO: 1288487 - DNA, 18 bp, Homo sapiens
ttttacaagtaacaaaaa

SEQ ID NO: 1288488 - DNA, 18 bp, Homo sapiens
ttttacaagtataacagt

SEQ ID NO: 1288489 - DNA, 17 bp, Homo sapiens
ttttacaatctgtatct

SEQ ID NO: 1288490 - DNA, 15 bp, Homo sapiens
ttttacacagagaaa

SEQ ID NO: 1288491 - DNA, 23 bp, Homo sapiens
ttttacactaatatatggaccta

SEQ ID NO: 1288492 - DNA, 23 bp, Homo sapiens
ttttacactgataaaagttttga

SEQ ID NO: 1288493 - DNA, 21 bp, Homo sapiens
ttttacagcattgtctttgct

SEQ ID NO: 1288494 - DNA, 18 bp, Homo sapiens
ttttacattccatttcat

SEQ ID NO: 1288495 - DNA, 16 bp, Homo sapiens
ttttacatttcataca

SEQ ID NO: 1288496 - DNA, 13 bp, Homo sapiens
ttttacatttcta

SEQ ID NO: 1288497 - DNA, 11 bp, Homo sapiens
ttttaccaaag

SEQ ID NO: 1288498 - DNA, 14 bp, Homo sapiens
ttttaccaaagcat

SEQ ID NO: 1288499 - DNA, 15 bp, Homo sapiens
ttttaccaaagcatc

SEQ ID NO: 1288500 - DNA, 15 bp, Homo sapiens
ttttaccaagagtaa

SEQ ID NO: 1288501 - DNA, 22 bp, Homo sapiens
ttttaccactatttaagttatc

SEQ ID NO: 1288502 - DNA, 13 bp, Homo sapiens
ttttaccagctcc

SEQ ID NO: 1288503 - DNA, 22 bp, Homo sapiens
ttttaccatgcccctgagcaat

SEQ ID NO: 1288504 - DNA, 22 bp, Homo sapiens
ttttacccagacaactctagaa

SEQ ID NO: 1288505 - DNA, 18 bp, Homo sapiens
ttttaccgtttcttccct

SEQ ID NO: 1288506 - DNA, 14 bp, Homo sapiens
ttttacctctctct

SEQ ID NO: 1288507 - DNA, 21 bp, Homo sapiens
ttttacgtgcaaacaacctga

SEQ ID NO: 1288508 - DNA, 22 bp, Homo sapiens
ttttactaaagaaagattactt

SEQ ID NO: 1288509 - DNA, 20 bp, Homo sapiens
ttttactaagttttcaaatt

SEQ ID NO: 1288510 - DNA, 15 bp, Homo sapiens
ttttactaatagaca

SEQ ID NO: 1288511 - DNA, 14 bp, Homo sapiens
ttttactctgccta

SEQ ID NO: 1288512 - DNA, 12 bp, Homo sapiens
ttttactctttt

SEQ ID NO: 1288513 - DNA, 12 bp, Homo sapiens
ttttactgcctg

SEQ ID NO: 1288514 - DNA, 16 bp, Homo sapiens
ttttactgctctgaga

SEQ ID NO: 1288515 - DNA, 22 bp, Homo sapiens
ttttacttgcattgaatatatt

SEQ ID NO: 1288516 - DNA, 16 bp, Homo sapiens
ttttactttaaagtag

SEQ ID NO: 1288517 - DNA, 13 bp, Homo sapiens
ttttactttaaca

SEQ ID NO: 1288518 - DNA, 14 bp, Homo sapiens
ttttactttaacag

SEQ ID NO: 1288519 - DNA, 12 bp, Homo sapiens
ttttactttggt

SEQ ID NO: 1288520 - DNA, 12 bp, Homo sapiens
ttttacttttat

SEQ ID NO: 1288521 - DNA, 19 bp, Homo sapiens
ttttacttttataataaaa

SEQ ID NO: 1288522 - DNA, 12 bp, Homo sapiens
ttttactttttt

SEQ ID NO: 1288523 - DNA, 17 bp, Homo sapiens
ttttactttttttagta

SEQ ID NO: 1288524 - DNA, 17 bp, Homo sapiens
ttttagaaatattcaca

SEQ ID NO: 1288525 - DNA, 16 bp, Homo sapiens
ttttagaataagaatt

SEQ ID NO: 1288526 - DNA, 21 bp, Homo sapiens
ttttagaataagaatttgcat

SEQ ID NO: 1288527 - DNA, 22 bp, Homo sapiens
ttttagaataagaatttgcata

SEQ ID NO: 1288528 - DNA, 22 bp, Homo sapiens
ttttagaatcttttaaatacat

SEQ ID NO: 1288529 - DNA, 12 bp, Homo sapiens
ttttagagaaaa

SEQ ID NO: 1288530 - DNA, 21 bp, Homo sapiens
ttttagagaatgtgtttcaaa

SEQ ID NO: 1288531 - DNA, 23 bp, Homo sapiens
ttttagagaatgtgtttcaaaac

SEQ ID NO: 1288532 - DNA, 17 bp, Homo sapiens
ttttagagttgatacta

SEQ ID NO: 1288533 - DNA, 12 bp, Homo sapiens
ttttagatatct

SEQ ID NO: 1288534 - DNA, 17 bp, Homo sapiens
ttttagatgaccaaaac

SEQ ID NO: 1288535 - DNA, 19 bp, Homo sapiens
ttttagatgagattgtttt

SEQ ID NO: 1288536 - DNA, 20 bp, Homo sapiens
ttttagatgagattgtttta

SEQ ID NO: 1288537 - DNA, 21 bp, Homo sapiens
ttttagcaatttatacaatat

SEQ ID NO: 1288538 - DNA, 21 bp, Homo sapiens
ttttagccataattttgcata

SEQ ID NO: 1288539 - DNA, 22 bp, Homo sapiens
ttttagctggtggcaataaata

SEQ ID NO: 1288540 - DNA, 22 bp, Homo sapiens
ttttaggaaacttgtagaaacg

SEQ ID NO: 1288541 - DNA, 15 bp, Homo sapiens
ttttcatcactggga

SEQ ID NO: 1288542 - DNA, 22 bp, Homo sapiens
ttttcatcccgtatcacagtgt

SEQ ID NO: 1288543 - DNA, 14 bp, Homo sapiens
ttttcatcctggcc

SEQ ID NO: 1288544 - DNA, 22 bp, Homo sapiens
ttttcatccttttttctcttct

SEQ ID NO: 1288545 - DNA, 19 bp, Homo sapiens
ttttcatcttcagttgtct

SEQ ID NO: 1288546 - DNA, 21 bp, Homo sapiens
ttttcatgaatgtgctggtga

SEQ ID NO: 1288547 - DNA, 20 bp, Homo sapiens
ttttcatggcccttcaaatt

SEQ ID NO: 1288548 - DNA, 18 bp, Homo sapiens
ttttcatggtgaaaatgt

SEQ ID NO: 1288549 - DNA, 21 bp, Homo sapiens
ttttcatggtgaaaatgtact

SEQ ID NO: 1288550 - DNA, 14 bp, Homo sapiens
ttttcatgttatga

SEQ ID NO: 1288551 - DNA, 16 bp, Homo sapiens
ttttcattaaacttga

SEQ ID NO: 1288552 - DNA, 17 bp, Homo sapiens
ttttcattaaacttgaa

SEQ ID NO: 1288553 - DNA, 22 bp, Homo sapiens
ttttcattagcagttgctcaca

SEQ ID NO: 1288554 - DNA, 21 bp, Homo sapiens
ttttcattcaggtatttgtaa

SEQ ID NO: 1288555 - DNA, 13 bp, Homo sapiens
ttttcatttatct

SEQ ID NO: 1288556 - DNA, 18 bp, Homo sapiens
ttttcatttcatgaaaat

SEQ ID NO: 1288557 - DNA, 14 bp, Homo sapiens
ttttcatttgtaaa

SEQ ID NO: 1288558 - DNA, 19 bp, Homo sapiens
ttttcatttgtacaaggta

SEQ ID NO: 1288559 - DNA, 14 bp, Homo sapiens
ttttcatttgtttt

SEQ ID NO: 1288560 - DNA, 16 bp, Homo sapiens
ttttcatttgttttgc

SEQ ID NO: 1288561 - DNA, 17 bp, Homo sapiens
ttttcatttgttttgct

SEQ ID NO: 1288562 - DNA, 22 bp, Homo sapiens
ttttcatttgttttgcttttgt

SEQ ID NO: 1288563 - DNA, 15 bp, Homo sapiens
ttttccaaagaaaag

SEQ ID NO: 1288564 - DNA, 14 bp, Homo sapiens
ttttccaactacta

SEQ ID NO: 1288565 - DNA, 23 bp, Homo sapiens
ttttccaagtaaagtgatgtttg

SEQ ID NO: 1288566 - DNA, 19 bp, Homo sapiens
ttttccaatcacagtgtta

SEQ ID NO: 1288567 - DNA, 14 bp, Homo sapiens
ttttccaatgtttt

SEQ ID NO: 1288568 - DNA, 13 bp, Homo sapiens
ttttccactttgt

SEQ ID NO: 1288569 - DNA, 22 bp, Homo sapiens
ttttccagaaatacctgtctag

SEQ ID NO: 1288570 - DNA, 12 bp, Homo sapiens
ttttccagcaag

SEQ ID NO: 1288571 - DNA, 19 bp, Homo sapiens
ttttccagccttatgtgtt

SEQ ID NO: 1288572 - DNA, 13 bp, Homo sapiens
ttttccaggactc

SEQ ID NO: 1288573 - DNA, 13 bp, Homo sapiens
ttttccagtctgt

SEQ ID NO: 1288574 - DNA, 11 bp, Homo sapiens
ttttccatgaa

SEQ ID NO: 1288575 - DNA, 14 bp, Homo sapiens
ttttccatgaaaac

SEQ ID NO: 1288576 - DNA, 16 bp, Homo sapiens
ttttccatgaaaacgt

SEQ ID NO: 1288577 - DNA, 18 bp, Homo sapiens
ttttccattatgctgtag

SEQ ID NO: 1288578 - DNA, 17 bp, Homo sapiens
ttttccattatgttcat

SEQ ID NO: 1288579 - DNA, 14 bp, Homo sapiens
ttttcccaataaat

SEQ ID NO: 1288580 - DNA, 15 bp, Homo sapiens
ttttcccaggaaaga

SEQ ID NO: 1288581 - DNA, 14 bp, Homo sapiens
ttttcccagtattt

SEQ ID NO: 1288582 - DNA, 15 bp, Homo sapiens
ttttcccataagaca

SEQ ID NO: 1288583 - DNA, 21 bp, Homo sapiens
ttttcccatgactcttggagc

SEQ ID NO: 1288584 - DNA, 20 bp, Homo sapiens
ttttccccaaaccataaaac

SEQ ID NO: 1288585 - DNA, 19 bp, Homo sapiens
ttttccccaaccacagaga

SEQ ID NO: 1288586 - DNA, 18 bp, Homo sapiens
ttttccccccactctccc

SEQ ID NO: 1288587 - DNA, 19 bp, Homo sapiens
ttttcccccttttctgcat

SEQ ID NO: 1288588 - DNA, 19 bp, Homo sapiens
ttttccccggtcccttgag

SEQ ID NO: 1288589 - DNA, 19 bp, Homo sapiens
ttttcccctcttttgttaa

SEQ ID NO: 1288590 - DNA, 19 bp, Homo sapiens
ttttcccctgttaaacagt

SEQ ID NO: 1288591 - DNA, 16 bp, Homo sapiens
ttttcccctttcctgt

SEQ ID NO: 1288592 - DNA, 17 bp, Homo sapiens
ttttcccctttcctgtc

SEQ ID NO: 1288593 - DNA, 15 bp, Homo sapiens
ttttccctgtacagt

SEQ ID NO: 1288594 - DNA, 13 bp, Homo sapiens
ttttcccttaaat

SEQ ID NO: 1288595 - DNA, 10 bp, Homo sapiens
ttttcccttt

SEQ ID NO: 1288596 - DNA, 17 bp, Homo sapiens
ttttcctatcatgttaa

SEQ ID NO: 1288597 - DNA, 14 bp, Homo sapiens
ttttcctattctgt

SEQ ID NO: 1288598 - DNA, 18 bp, Homo sapiens
ttttcctattttcagccc

SEQ ID NO: 1288599 - DNA, 14 bp, Homo sapiens
ttttcctcaagcaa

SEQ ID NO: 1288600 - DNA, 21 bp, Homo sapiens
ttttcctcatcctttccctct

SEQ ID NO: 1288601 - DNA, 17 bp, Homo sapiens
ttttcctcatgtaacat

SEQ ID NO: 1288602 - DNA, 20 bp, Homo sapiens
ttttcctcatgtaacattgg

SEQ ID NO: 1288603 - DNA, 14 bp, Homo sapiens
ttttcctcccttct

SEQ ID NO: 1288604 - DNA, 17 bp, Homo sapiens
ttttcctcccttctgct

SEQ ID NO: 1288605 - DNA, 17 bp, Homo sapiens
ttttcctcctctgccta

SEQ ID NO: 1288606 - DNA, 19 bp, Homo sapiens
ttttcctctcattgtcttg

SEQ ID NO: 1288607 - DNA, 20 bp, Homo sapiens
ttttcctggacttaaagaaa

SEQ ID NO: 1288608 - DNA, 20 bp, Homo sapiens
ttttcctggcagctgctgtg

SEQ ID NO: 1288609 - DNA, 21 bp, Homo sapiens
ttttcctgtttactgattaga

SEQ ID NO: 1288610 - DNA, 20 bp, Homo sapiens
ttttccttcctttttattca

SEQ ID NO: 1288611 - DNA, 17 bp, Homo sapiens
ttttccttctgttaaaa

SEQ ID NO: 1288612 - DNA, 14 bp, Homo sapiens
ttttccttgcctgt

SEQ ID NO: 1288613 - DNA, 19 bp, Homo sapiens
ttttcctttatccactttt

SEQ ID NO: 1288614 - DNA, 13 bp, Homo sapiens
ttttcctttctta

SEQ ID NO: 1288615 - DNA, 16 bp, Homo sapiens
ttttcctttgtcatca

SEQ ID NO: 1288616 - DNA, 13 bp, Homo sapiens
ttttccttttcac

SEQ ID NO: 1288617 - DNA, 14 bp, Homo sapiens
ttttccttttcatc

SEQ ID NO: 1288618 - DNA, 16 bp, Homo sapiens
ttttccttttcatctg

SEQ ID NO: 1288619 - DNA, 18 bp, Homo sapiens
ttttccttttcttaaaac

SEQ ID NO: 1288620 - DNA, 16 bp, Homo sapiens
ttttcgaaaatcaaat

SEQ ID NO: 1288621 - DNA, 15 bp, Homo sapiens
ttttcgtaccttccc

SEQ ID NO: 1288622 - DNA, 21 bp, Homo sapiens
ttttctaaaacattcccctcc

SEQ ID NO: 1288623 - DNA, 22 bp, Homo sapiens
ttttctaaaacattcccctccc

SEQ ID NO: 1288624 - DNA, 14 bp, Homo sapiens
ttttctaaaagctt

SEQ ID NO: 1288625 - DNA, 14 bp, Homo sapiens
ttttctaaagaaat

SEQ ID NO: 1288626 - DNA, 15 bp, Homo sapiens
ttttctaaagaaata

SEQ ID NO: 1288627 - DNA, 14 bp, Homo sapiens
ttttctaaccttga

SEQ ID NO: 1288628 - DNA, 12 bp, Homo sapiens
ttttctaactgg

SEQ ID NO: 1288629 - DNA, 17 bp, Homo sapiens
ttttctaagaaaagcat

SEQ ID NO: 1288630 - DNA, 15 bp, Homo sapiens
ttttctaagtgtaac

SEQ ID NO: 1288631 - DNA, 15 bp, Homo sapiens
ttttctaatgtggtt

SEQ ID NO: 1288632 - DNA, 18 bp, Homo sapiens
ttttctacagtggtttta

SEQ ID NO: 1288633 - DNA, 16 bp, Homo sapiens
ttttctaccctagcca

SEQ ID NO: 1288634 - DNA, 17 bp, Homo sapiens
ttttctaccctagccat

SEQ ID NO: 1288635 - DNA, 20 bp, Homo sapiens
ttttctagaattatttttca

SEQ ID NO: 1288636 - DNA, 13 bp, Homo sapiens
ttttctagacttt

SEQ ID NO: 1288637 - DNA, 18 bp, Homo sapiens
ttttctagatacaataaa

SEQ ID NO: 1288638 - DNA, 22 bp, Homo sapiens
ttttctagcattttcagaaact

SEQ ID NO: 1288639 - DNA, 14 bp, Homo sapiens
ttttctataaatca

SEQ ID NO: 1288640 - DNA, 11 bp, Homo sapiens
ttttctatata

SEQ ID NO: 1288641 - DNA, 23 bp, Homo sapiens
ttttctatatagttccttgcctt

SEQ ID NO: 1288642 - DNA, 23 bp, Homo sapiens
ttttctatcccccttaaagaaaa

SEQ ID NO: 1288643 - DNA, 11 bp, Homo sapiens
ttttctatgaa

SEQ ID NO: 1288644 - DNA, 23 bp, Homo sapiens
ttttctattatggaaaactgtgt

SEQ ID NO: 1288645 - DNA, 18 bp, Homo sapiens
ttttctcagaacagctga

SEQ ID NO: 1288646 - DNA, 13 bp, Homo sapiens
ttttctccagctc

SEQ ID NO: 1288647 - DNA, 15 bp, Homo sapiens
ttttctccctctcat

SEQ ID NO: 1288648 - DNA, 14 bp, Homo sapiens
ttttctcctcccag

SEQ ID NO: 1288649 - DNA, 14 bp, Homo sapiens
ttttctcctctgct

SEQ ID NO: 1288650 - DNA, 19 bp, Homo sapiens
ttttctcgtccccctccct

SEQ ID NO: 1288651 - DNA, 20 bp, Homo sapiens
ttttctctatacatagagct

SEQ ID NO: 1288652 - DNA, 21 bp, Homo sapiens
ttttctctgtatgaatgtgat

SEQ ID NO: 1288653 - DNA, 21 bp, Homo sapiens
ttttctcttagaacattgtat

SEQ ID NO: 1288654 - DNA, 12 bp, Homo sapiens
ttttctcttctg

SEQ ID NO: 1288655 - DNA, 16 bp, Homo sapiens
ttttctcttgtaccat

SEQ ID NO: 1288656 - DNA, 22 bp, Homo sapiens
ttttctctttctccttagtctt

SEQ ID NO: 1288657 - DNA, 16 bp, Homo sapiens
ttttctgagcccgggc

SEQ ID NO: 1288658 - DNA, 23 bp, Homo sapiens
ttttctgaggatagtagttaaat

SEQ ID NO: 1288659 - DNA, 16 bp, Homo sapiens
ttttctgatttgtcct

SEQ ID NO: 1288660 - DNA, 21 bp, Homo sapiens
ttttctgcatcatctgtagat

SEQ ID NO: 1288661 - DNA, 13 bp, Homo sapiens
ttttctgccctgg

SEQ ID NO: 1288662 - DNA, 20 bp, Homo sapiens
ttttctggactctggacttt

SEQ ID NO: 1288663 - DNA, 16 bp, Homo sapiens
ttttctggtagataga

SEQ ID NO: 1288664 - DNA, 10 bp, Homo sapiens
tttttctcaa

SEQ ID NO: 1288665 - DNA, 17 bp, Homo sapiens
tttttctcatgtatctt

SEQ ID NO: 1288666 - DNA, 22 bp, Homo sapiens
tttttctcttctgtccatcagt

SEQ ID NO: 1288667 - DNA, 11 bp, Homo sapiens
tttttctcttt

SEQ ID NO: 1288668 - DNA, 11 bp, Homo sapiens
tttttctgaat

SEQ ID NO: 1288669 - DNA, 12 bp, Homo sapiens
tttttctgaata

SEQ ID NO: 1288670 - DNA, 22 bp, Homo sapiens
tttttctgaataaaaaagattc

SEQ ID NO: 1288671 - DNA, 16 bp, Homo sapiens
tttttctgatttgtcc

SEQ ID NO: 1288672 - DNA, 14 bp, Homo sapiens
tttttctgtaccag

SEQ ID NO: 1288673 - DNA, 16 bp, Homo sapiens
tttttcttaaaagtac

SEQ ID NO: 1288674 - DNA, 16 bp, Homo sapiens
tttttcttctgtattt

SEQ ID NO: 1288675 - DNA, 14 bp, Homo sapiens
tttttcttgatctt

SEQ ID NO: 1288676 - DNA, 18 bp, Homo sapiens
tttttctttttaaagttt

SEQ ID NO: 1288677 - DNA, 14 bp, Homo sapiens
tttttgaaaaatat

SEQ ID NO: 1288678 - DNA, 20 bp, Homo sapiens
tttttgaaaagcagacattt

SEQ ID NO: 1288679 - DNA, 14 bp, Homo sapiens
tttttgaaataata

SEQ ID NO: 1288680 - DNA, 16 bp, Homo sapiens
tttttgaacttttcat

SEQ ID NO: 1288681 - DNA, 22 bp, Homo sapiens
tttttgaaggcagaaagcaaaa

SEQ ID NO: 1288682 - DNA, 19 bp, Homo sapiens
tttttgaatttaaataaag

SEQ ID NO: 1288683 - DNA, 21 bp, Homo sapiens
tttttgaatttaaataaagtt

SEQ ID NO: 1288684 - DNA, 12 bp, Homo sapiens
tttttgactttt

SEQ ID NO: 1288685 - DNA, 20 bp, Homo sapiens
tttttgactttttttgtatg

SEQ ID NO: 1288686 - DNA, 23 bp, Homo sapiens
tttttgactttttttgtatgtgt

SEQ ID NO: 1288687 - DNA, 15 bp, Homo sapiens
tttttgagtgacagc

SEQ ID NO: 1288688 - DNA, 13 bp, Homo sapiens
tttttgatactaa

SEQ ID NO: 1288689 - DNA, 19 bp, Homo sapiens
tttttgatcatccctttct

SEQ ID NO: 1288690 - DNA, 14 bp, Homo sapiens
tttttgatggaatt

SEQ ID NO: 1288691 - DNA, 13 bp, Homo sapiens
tttttgcatgaaa

SEQ ID NO: 1288692 - DNA, 21 bp, Homo sapiens
tttttgcatgatatcttcaag

SEQ ID NO: 1288693 - DNA, 12 bp, Homo sapiens
tttttgccaaaa

SEQ ID NO: 1288694 - DNA, 22 bp, Homo sapiens
tttttgcccgttgaccagataa

SEQ ID NO: 1288695 - DNA, 14 bp, Homo sapiens
tttttgcgctgcta

SEQ ID NO: 1288696 - DNA, 12 bp, Homo sapiens
tttttgctaatt

SEQ ID NO: 1288697 - DNA, 11 bp, Homo sapiens
tttttgctata

SEQ ID NO: 1288698 - DNA, 18 bp, Homo sapiens
tttttgctataatcatta

SEQ ID NO: 1288699 - DNA, 14 bp, Homo sapiens
tttttgctgttagt

SEQ ID NO: 1288700 - DNA, 17 bp, Homo sapiens
tttttggaaagtcagaa

SEQ ID NO: 1288701 - DNA, 22 bp, Homo sapiens
tttttggaccaccgttcagtca

SEQ ID NO: 1288702 - DNA, 15 bp, Homo sapiens
tttttggaggtgctt

SEQ ID NO: 1288703 - DNA, 19 bp, Homo sapiens
tttttggagtgttatgtat

SEQ ID NO: 1288704 - DNA, 17 bp, Homo sapiens
tttttggcctgtttgat

SEQ ID NO: 1288705 - DNA, 20 bp, Homo sapiens
tttttggcctgtttgatgta

SEQ ID NO: 1288706 - DNA, 21 bp, Homo sapiens
tttttggggggttttcttgcc

SEQ ID NO: 1288707 - DNA, 22 bp, Homo sapiens
tttttggggggttttcttgcct

SEQ ID NO: 1288708 - DNA, 23 bp, Homo sapiens
tttttggtaaatttttgaaaaat

SEQ ID NO: 1288709 - DNA, 24 bp, Homo sapiens
tttttggtaataacaaacgtgttt

SEQ ID NO: 1288710 - DNA, 15 bp, Homo sapiens
tttttggtataatgt

SEQ ID NO: 1288711 - DNA, 19 bp, Homo sapiens
tttttggtataatgtttaa

SEQ ID NO: 1288712 - DNA, 18 bp, Homo sapiens
tttttggtggtggttaaa

SEQ ID NO: 1288713 - DNA, 21 bp, Homo sapiens
tttttggttaaaaaaaagaat

SEQ ID NO: 1288714 - DNA, 18 bp, Homo sapiens
tttttggttgtcaatatt

SEQ ID NO: 1288715 - DNA, 13 bp, Homo sapiens
tttttgtaaactg

SEQ ID NO: 1288716 - DNA, 22 bp, Homo sapiens
tttttgtaaactgtatcaaatc

SEQ ID NO: 1288717 - DNA, 14 bp, Homo sapiens
tttttgtaactaca

SEQ ID NO: 1288718 - DNA, 22 bp, Homo sapiens
tttttgtaataagcaatcaagg

SEQ ID NO: 1288719 - DNA, 12 bp, Homo sapiens
tttttgtacatc

SEQ ID NO: 1288720 - DNA, 21 bp, Homo sapiens
tttttgtagagagagctgtat

SEQ ID NO: 1288721 - DNA, 21 bp, Homo sapiens
tttttgtagctgctatatatt

SEQ ID NO: 1288722 - DNA, 20 bp, Homo sapiens
tttttgtagtgacctgttta

SEQ ID NO: 1288723 - DNA, 18 bp, Homo sapiens
tttttgtataaaatagac

SEQ ID NO: 1288724 - DNA, 12 bp, Homo sapiens
tttttgtatgtg

SEQ ID NO: 1288725 - DNA, 16 bp, Homo sapiens
tttttgtcaacattgt

SEQ ID NO: 1288726 - DNA, 12 bp, Homo sapiens
tttttgtcatca

SEQ ID NO: 1288727 - DNA, 13 bp, Homo sapiens
tttttgtgtatgt

SEQ ID NO: 1288728 - DNA, 15 bp, Homo sapiens
tttttgtgtgtattt

SEQ ID NO: 1288729 - DNA, 11 bp, Homo sapiens
tttttgttact

SEQ ID NO: 1288730 - DNA, 19 bp, Homo sapiens
tttttgttggagtgtttct

SEQ ID NO: 1288731 - DNA, 17 bp, Homo sapiens
ttttttaaaacaaaaga

SEQ ID NO: 1288732 - DNA, 13 bp, Homo sapiens
ttttttaaagaca

SEQ ID NO: 1288733 - DNA, 23 bp, Homo sapiens
ttttttaaaggggtctgttctgc

SEQ ID NO: 1288734 - DNA, 23 bp, Homo sapiens
ttttttaaatgattccaaataaa

SEQ ID NO: 1288735 - DNA, 12 bp, Homo sapiens
ttttttaacatc

SEQ ID NO: 1288736 - DNA, 12 bp, Homo sapiens
ttttttaagtga

SEQ ID NO: 1288737 - DNA, 12 bp, Homo sapiens
ttttttaatcta

SEQ ID NO: 1288738 - DNA, 12 bp, Homo sapiens
ttttttaattta

SEQ ID NO: 1288739 - DNA, 11 bp, Homo sapiens
ttttttacatt

SEQ ID NO: 1288740 - DNA, 13 bp, Homo sapiens
ttttttatgctaa

SEQ ID NO: 1288741 - DNA, 12 bp, Homo sapiens
ttttttcagttg

SEQ ID NO: 1288742 - DNA, 12 bp, Homo sapiens
ttttttcatctt

SEQ ID NO: 1288743 - DNA, 13 bp, Homo sapiens
ttttttcatcttc

SEQ ID NO: 1288744 - DNA, 13 bp, Homo sapiens
ttttttccaaaac

SEQ ID NO: 1288745 - DNA, 12 bp, Homo sapiens
ttttttccaaat

SEQ ID NO: 1288746 - DNA, 16 bp, Homo sapiens
ttttttccagagttgt

SEQ ID NO: 1288747 - DNA, 15 bp, Homo sapiens
ttttttcccataaga

SEQ ID NO: 1288748 - DNA, 14 bp, Homo sapiens
ttttttccttaaaa

SEQ ID NO: 1288749 - DNA, 15 bp, Homo sapiens
ttttttctaagagaa

SEQ ID NO: 1288750 - DNA, 11 bp, Homo sapiens
ttttttctgag

SEQ ID NO: 1288751 - DNA, 14 bp, Homo sapiens
ttttttcttttgta

SEQ ID NO: 1288752 - DNA, 16 bp, Homo sapiens
ttttttgaatccaaat

SEQ ID NO: 1288753 - DNA, 15 bp, Homo sapiens
ttttttgagacatgg

SEQ ID NO: 1288754 - DNA, 10 bp, Homo sapiens
ttttttgcag

SEQ ID NO: 1288755 - DNA, 17 bp, Homo sapiens
ttttttgcagtaactgt

SEQ ID NO: 1288756 - DNA, 16 bp, Homo sapiens
ttttttgggcagcaat

SEQ ID NO: 1288757 - DNA, 13 bp, Homo sapiens
ttttttgtaacta

SEQ ID NO: 1288758 - DNA, 14 bp, Homo sapiens
ttttttgtaccatt

SEQ ID NO: 1288759 - DNA, 15 bp, Homo sapiens
ttttttgtagatgaa

SEQ ID NO: 1288760 - DNA, 21 bp, Homo sapiens
ttttttgtatagaccaaagca

SEQ ID NO: 1288761 - DNA, 13 bp, Homo sapiens
ttttttgtattat

SEQ ID NO: 1288762 - DNA, 12 bp, Homo sapiens
ttttttgtcaac

SEQ ID NO: 1288763 - DNA, 12 bp, Homo sapiens
ttttttgtttca

SEQ ID NO: 1288764 - DNA, 13 bp, Homo sapiens
ttttttgtttgtt

SEQ ID NO: 1288765 - DNA, 13 bp, Homo sapiens
tttttttaagaca

SEQ ID NO: 1288766 - DNA, 14 bp, Homo sapiens
tttttttaagtgct

SEQ ID NO: 1288767 - DNA, 13 bp, Homo sapiens
tttttttatataa

SEQ ID NO: 1288768 - DNA, 15 bp, Homo sapiens
tttttttcaagtgct

SEQ ID NO: 1288769 - DNA, 12 bp, Homo sapiens
tttttttcagtt

SEQ ID NO: 1288770 - DNA, 13 bp, Homo sapiens
tttttttccaaat

SEQ ID NO: 1288771 - DNA, 13 bp, Homo sapiens
tttttttccagca

SEQ ID NO: 1288772 - DNA, 10 bp, Homo sapiens
tttttttccc

SEQ ID NO: 1288773 - DNA, 13 bp, Homo sapiens
tttttttctgaat

SEQ ID NO: 1288774 - DNA, 11 bp, Homo sapiens
tttttttgcag

SEQ ID NO: 1288775 - DNA, 12 bp, Homo sapiens
tttttttgtgtg

SEQ ID NO: 1288776 - DNA, 14 bp, Homo sapiens
ttttttttaaacta

SEQ ID NO: 1288777 - DNA, 12 bp, Homo sapiens
ttttttttaaga

SEQ ID NO: 1288778 - DNA, 11 bp, Homo sapiens
ttttttttcca

SEQ ID NO: 1288779 - DNA, 12 bp, Homo sapiens
ttttttttcctt

SEQ ID NO: 1288780 - DNA, 14 bp, Homo sapiens
ttttttttctgaat

SEQ ID NO: 1288781 - DNA, 13 bp, Homo sapiens
ttttttttttggt

SEQ ID NO: 1288782 - DNA, 16 bp, Homo sapiens
aaaaagaaacatttgg

SEQ ID NO: 1288783 - DNA, 11 bp, Homo sapiens
aaaagaatgat

SEQ ID NO: 1288784 - DNA, 20 bp, Homo sapiens
aaaataatttttatatttga

SEQ ID NO: 1288785 - DNA, 16 bp, Homo sapiens
aaaatctcaatatttc

SEQ ID NO: 1288786 - DNA, 17 bp, Homo sapiens
aaaatctcaatatttca

SEQ ID NO: 1288787 - DNA, 19 bp, Homo sapiens
aaacatatataacaatgct

SEQ ID NO: 1288788 - DNA, 21 bp, Homo sapiens
aaacatatataacaatgctgt

SEQ ID NO: 1288789 - DNA, 23 bp, Homo sapiens
aaacttcagcggtttatataagc

SEQ ID NO: 1288790 - DNA, 18 bp, Homo sapiens
aaataatttttatatttg

SEQ ID NO: 1288791 - DNA, 21 bp, Homo sapiens
aaataatttttatatttgaaa

SEQ ID NO: 1288792 - DNA, 23 bp, Homo sapiens
aaataatttttatatttgaaata

SEQ ID NO: 1288793 - DNA, 22 bp, Homo sapiens
aaatatcacttgtcaataaaat

SEQ ID NO: 1288794 - DNA, 20 bp, Homo sapiens
aaatatttattttaataatg

SEQ ID NO: 1288795 - DNA, 15 bp, Homo sapiens
aaatccatacatttg

SEQ ID NO: 1288796 - DNA, 18 bp, Homo sapiens
aaatggcttcctggcaat

SEQ ID NO: 1288797 - DNA, 17 bp, Homo sapiens
aacacaactatattgtt

SEQ ID NO: 1288798 - DNA, 17 bp, Homo sapiens
aacctagggtgatatta

SEQ ID NO: 1288799 - DNA, 21 bp, Homo sapiens
aactagagtttagctggaaaa

SEQ ID NO: 1288800 - DNA, 20 bp, Homo sapiens
aactgaaatcatacttctta

SEQ ID NO: 1288801 - DNA, 20 bp, Homo sapiens
aactgactcttaagaagact

SEQ ID NO: 1288802 - DNA, 18 bp, Homo sapiens
aacttcagcggtttatat

SEQ ID NO: 1288803 - DNA, 21 bp, Homo sapiens
aacttcagcggtttatataag

SEQ ID NO: 1288804 - DNA, 13 bp, Homo sapiens
aagaactgaaatc

SEQ ID NO: 1288805 - DNA, 20 bp, Homo sapiens
aagaagactgcattatattt

SEQ ID NO: 1288806 - DNA, 22 bp, Homo sapiens
aagaagcaccaatcatgaatta

SEQ ID NO: 1288807 - DNA, 16 bp, Homo sapiens
aagaatgattatgaat

SEQ ID NO: 1288808 - DNA, 14 bp, Homo sapiens
aagctccaggtaga

SEQ ID NO: 1288809 - DNA, 17 bp, Homo sapiens
aaggggaattgaggaca

SEQ ID NO: 1288810 - DNA, 14 bp, Homo sapiens
aaggtacttcaaat

SEQ ID NO: 1288811 - DNA, 18 bp, Homo sapiens
aagtatgttagtgcaaat

SEQ ID NO: 1288812 - DNA, 23 bp, Homo sapiens
aagtatgttagtgcaaattgtca

SEQ ID NO: 1288813 - DNA, 22 bp, Homo sapiens
aataaaatccatacatttgtgt

SEQ ID NO: 1288814 - DNA, 12 bp, Homo sapiens
aataatgtttca

SEQ ID NO: 1288815 - DNA, 17 bp, Homo sapiens
aataatttttatatttg

SEQ ID NO: 1288816 - DNA, 20 bp, Homo sapiens
aataatttttatatttgaaa

SEQ ID NO: 1288817 - DNA, 16 bp, Homo sapiens
aatagtcaaattgtgt

SEQ ID NO: 1288818 - DNA, 20 bp, Homo sapiens
aatatcacttgtcaataaaa

SEQ ID NO: 1288819 - DNA, 22 bp, Homo sapiens
aatatcacttgtcaataaaatc

SEQ ID NO: 1288820 - DNA, 12 bp, Homo sapiens
aatcatgaatta

SEQ ID NO: 1288821 - DNA, 19 bp, Homo sapiens
aatcatgaattagttttat

SEQ ID NO: 1288822 - DNA, 16 bp, Homo sapiens
aatccatacatttgtg

SEQ ID NO: 1288823 - DNA, 13 bp, Homo sapiens
aatccttgaagat

SEQ ID NO: 1288824 - DNA, 16 bp, Homo sapiens
aatgataactggaaac

SEQ ID NO: 1288825 - DNA, 17 bp, Homo sapiens
aatgataactggaaact

SEQ ID NO: 1288826 - DNA, 18 bp, Homo sapiens
aatgttgacatgggacat

SEQ ID NO: 1288827 - DNA, 13 bp, Homo sapiens
aattacatttgta

SEQ ID NO: 1288828 - DNA, 19 bp, Homo sapiens
aattttttctctaggaaat

SEQ ID NO: 1288829 - DNA, 13 bp, Homo sapiens
acaagactgcaca

SEQ ID NO: 1288830 - DNA, 21 bp, Homo sapiens
acaaggatgaattaagttttt

SEQ ID NO: 1288831 - DNA, 23 bp, Homo sapiens
acaatacatcccttacctgggaa

SEQ ID NO: 1288832 - DNA, 14 bp, Homo sapiens
acaatgctgtattt

SEQ ID NO: 1288833 - DNA, 13 bp, Homo sapiens
acacaactatatt

SEQ ID NO: 1288834 - DNA, 14 bp, Homo sapiens
acacaactatattg

SEQ ID NO: 1288835 - DNA, 14 bp, Homo sapiens
acactaagagagaa

SEQ ID NO: 1288836 - DNA, 20 bp, Homo sapiens
acagcccttctttccacaga

SEQ ID NO: 1288837 - DNA, 21 bp, Homo sapiens
acagcccttctttccacagaa

SEQ ID NO: 1288838 - DNA, 17 bp, Homo sapiens
acagtcacctcatggaa

SEQ ID NO: 1288839 - DNA, 21 bp, Homo sapiens
acagttacctctgcctcagaa

SEQ ID NO: 1288840 - DNA, 19 bp, Homo sapiens
acatatataacaatgctgt

SEQ ID NO: 1288841 - DNA, 18 bp, Homo sapiens
acatttgctcatggaatt

SEQ ID NO: 1288842 - DNA, 14 bp, Homo sapiens
acatttgtataaaa

SEQ ID NO: 1288843 - DNA, 16 bp, Homo sapiens
acatttgtataaaata

SEQ ID NO: 1288844 - DNA, 19 bp, Homo sapiens
acatttgtataaaataatt

SEQ ID NO: 1288845 - DNA, 18 bp, Homo sapiens
accacttgtgttttgcaa

SEQ ID NO: 1288846 - DNA, 19 bp, Homo sapiens
accacttgtgttttgcaag

SEQ ID NO: 1288847 - DNA, 16 bp, Homo sapiens
acctagggtgatatta

SEQ ID NO: 1288848 - DNA, 17 bp, Homo sapiens
acctctgcctcagaaaa

SEQ ID NO: 1288849 - DNA, 20 bp, Homo sapiens
acctctgcctcagaaaacaa

SEQ ID NO: 1288850 - DNA, 20 bp, Homo sapiens
actagagtttagctggaaaa

SEQ ID NO: 1288851 - DNA, 18 bp, Homo sapiens
actagtatttctatgaaa

SEQ ID NO: 1288852 - DNA, 19 bp, Homo sapiens
actagtatttctatgaaat

SEQ ID NO: 1288853 - DNA, 17 bp, Homo sapiens
actatattgtttgctaa

SEQ ID NO: 1288854 - DNA, 15 bp, Homo sapiens
actatctcatttcca

SEQ ID NO: 1288855 - DNA, 17 bp, Homo sapiens
actatctcatttccaag

SEQ ID NO: 1288856 - DNA, 21 bp, Homo sapiens
actccaaactgactcttaaga

SEQ ID NO: 1288857 - DNA, 20 bp, Homo sapiens
actcttaagaagactgcatt

SEQ ID NO: 1288858 - DNA, 12 bp, Homo sapiens
actgaagaagca

SEQ ID NO: 1288859 - DNA, 15 bp, Homo sapiens
actgactcttaagaa

SEQ ID NO: 1288860 - DNA, 16 bp, Homo sapiens
actgactcttaagaag

SEQ ID NO: 1288861 - DNA, 18 bp, Homo sapiens
actgactcttaagaagac

SEQ ID NO: 1288862 - DNA, 19 bp, Homo sapiens
actgatatgggtcttgata

SEQ ID NO: 1288863 - DNA, 17 bp, Homo sapiens
acttcaaatccttgaag

SEQ ID NO: 1288864 - DNA, 18 bp, Homo sapiens
acttcagcggtttatata

SEQ ID NO: 1288865 - DNA, 19 bp, Homo sapiens
acttcagcggtttatataa

SEQ ID NO: 1288866 - DNA, 16 bp, Homo sapiens
acttgtgttttgcaag

SEQ ID NO: 1288867 - DNA, 22 bp, Homo sapiens
actttttatggcactagtattt

SEQ ID NO: 1288868 - DNA, 16 bp, Homo sapiens
agaaacacaactatat

SEQ ID NO: 1288869 - DNA, 13 bp, Homo sapiens
agaagttgatatg

SEQ ID NO: 1288870 - DNA, 17 bp, Homo sapiens
agactgcattatattta

SEQ ID NO: 1288871 - DNA, 16 bp, Homo sapiens
agagacacactgaaga

SEQ ID NO: 1288872 - DNA, 16 bp, Homo sapiens
agagtttagctggaaa

SEQ ID NO: 1288873 - DNA, 17 bp, Homo sapiens
agagtttagctggaaaa

SEQ ID NO: 1288874 - DNA, 14 bp, Homo sapiens
agattttcctgaaa

SEQ ID NO: 1288875 - DNA, 15 bp, Homo sapiens
agattttcctgaaaa

SEQ ID NO: 1288876 - DNA, 16 bp, Homo sapiens
agattttcctgaaaac

SEQ ID NO: 1288877 - DNA, 16 bp, Homo sapiens
agcaccaatcatgaat

SEQ ID NO: 1288878 - DNA, 15 bp, Homo sapiens
agccagattttcctg

SEQ ID NO: 1288879 - DNA, 17 bp, Homo sapiens
agcccttctttccacag

SEQ ID NO: 1288880 - DNA, 20 bp, Homo sapiens
agccttggggctgatgcagt

SEQ ID NO: 1288881 - DNA, 13 bp, Homo sapiens
aggaaatatttat

SEQ ID NO: 1288882 - DNA, 23 bp, Homo sapiens
aggatggttcccttgatgaagaa

SEQ ID NO: 1288883 - DNA, 23 bp, Homo sapiens
aggccatgggcactgtgggtaga

SEQ ID NO: 1288884 - DNA, 15 bp, Homo sapiens
aggctagatgtatgt

SEQ ID NO: 1288885 - DNA, 17 bp, Homo sapiens
agggttatgattaagta

SEQ ID NO: 1288886 - DNA, 23 bp, Homo sapiens
aggtacttcaaatccttgaagat

SEQ ID NO: 1288887 - DNA, 21 bp, Homo sapiens
agtattagaataccacaggaa

SEQ ID NO: 1288888 - DNA, 16 bp, Homo sapiens
agtattgtccaggtct

SEQ ID NO: 1288889 - DNA, 15 bp, Homo sapiens
agtatttctatgaaa

SEQ ID NO: 1288890 - DNA, 17 bp, Homo sapiens
agtatttctatgaaata

SEQ ID NO: 1288891 - DNA, 18 bp, Homo sapiens
agtatttctatgaaatat

SEQ ID NO: 1288892 - DNA, 22 bp, Homo sapiens
agtatttctatgaaatattatg

SEQ ID NO: 1288893 - DNA, 17 bp, Homo sapiens
agtcaaattgtgtgaaa

SEQ ID NO: 1288894 - DNA, 19 bp, Homo sapiens
agtcaaattgtgtgaaagg

SEQ ID NO: 1288895 - DNA, 23 bp, Homo sapiens
agtcaaattgtgtgaaaggtact

SEQ ID NO: 1288896 - DNA, 14 bp, Homo sapiens
agtcaggaaagaga

SEQ ID NO: 1288897 - DNA, 21 bp, Homo sapiens
agtgagcagtcaggaaagaga

SEQ ID NO: 1288898 - DNA, 21 bp, Homo sapiens
agtgcaaattgtcacaggaca

SEQ ID NO: 1288899 - DNA, 22 bp, Homo sapiens
agtgcaaattgtcacaggacag

SEQ ID NO: 1288900 - DNA, 18 bp, Homo sapiens
agtgttggagaagaactg

SEQ ID NO: 1288901 - DNA, 15 bp, Homo sapiens
agttctgaagaagat

SEQ ID NO: 1288902 - DNA, 21 bp, Homo sapiens
agttgatatgccttttcccaa

SEQ ID NO: 1288903 - DNA, 16 bp, Homo sapiens
agttttatatgcttct

SEQ ID NO: 1288904 - DNA, 18 bp, Homo sapiens
ataaaatccatacatttg

SEQ ID NO: 1288905 - DNA, 14 bp, Homo sapiens
ataatctttcacag

SEQ ID NO: 1288906 - DNA, 13 bp, Homo sapiens
ataatgtttcaaa

SEQ ID NO: 1288907 - DNA, 21 bp, Homo sapiens
ataatttttatatttgaaata

SEQ ID NO: 1288908 - DNA, 14 bp, Homo sapiens
atagtcaaattgtg

SEQ ID NO: 1288909 - DNA, 17 bp, Homo sapiens
atagtcaaattgtgtga

SEQ ID NO: 1288910 - DNA, 12 bp, Homo sapiens
atataacaatgc

SEQ ID NO: 1288911 - DNA, 15 bp, Homo sapiens
atataacaatgctgt

SEQ ID NO: 1288912 - DNA, 19 bp, Homo sapiens
atatataacaatgctgtat

SEQ ID NO: 1288913 - DNA, 18 bp, Homo sapiens
atatcacttgtcaataaa

SEQ ID NO: 1288914 - DNA, 14 bp, Homo sapiens
atattatgttaaaa

SEQ ID NO: 1288915 - DNA, 14 bp, Homo sapiens
atatttattactgt

SEQ ID NO: 1288916 - DNA, 13 bp, Homo sapiens
atatttattttaa

SEQ ID NO: 1288917 - DNA, 15 bp, Homo sapiens
atatttattttaata

SEQ ID NO: 1288918 - DNA, 14 bp, Homo sapiens
atatttgaaatatt

SEQ ID NO: 1288919 - DNA, 22 bp, Homo sapiens
atcacttgtcaataaaatccat

SEQ ID NO: 1288920 - DNA, 17 bp, Homo sapiens
atcagggttagtattgt

SEQ ID NO: 1288921 - DNA, 17 bp, Homo sapiens
atcatgaattagtttta

SEQ ID NO: 1288922 - DNA, 13 bp, Homo sapiens
atctcaatatttc

SEQ ID NO: 1288923 - DNA, 21 bp, Homo sapiens
atctcatttccaagcaagtat

SEQ ID NO: 1288924 - DNA, 17 bp, Homo sapiens
atgaaatattatgttaa

SEQ ID NO: 1288925 - DNA, 23 bp, Homo sapiens
atgaagtccaagcatttagatgt

SEQ ID NO: 1288926 - DNA, 16 bp, Homo sapiens
atgaattacatttgta

SEQ ID NO: 1288927 - DNA, 18 bp, Homo sapiens
atgaattacatttgtata

SEQ ID NO: 1288928 - DNA, 22 bp, Homo sapiens
atgaattacatttgtataaaat

SEQ ID NO: 1288929 - DNA, 23 bp, Homo sapiens
atgaattagttttatatgcttct

SEQ ID NO: 1288930 - DNA, 14 bp, Homo sapiens
atgagagacacact

SEQ ID NO: 1288931 - DNA, 17 bp, Homo sapiens
atgagagacacactgaa

SEQ ID NO: 1288932 - DNA, 19 bp, Homo sapiens
atgagagacacactgaaga

SEQ ID NO: 1288933 - DNA, 14 bp, Homo sapiens
atgataactggaaa

SEQ ID NO: 1288934 - DNA, 14 bp, Homo sapiens
atgattaagtaatg

SEQ ID NO: 1288935 - DNA, 12 bp, Homo sapiens
atgattcccagc

SEQ ID NO: 1288936 - DNA, 13 bp, Homo sapiens
atgcagttctgaa

SEQ ID NO: 1288937 - DNA, 18 bp, Homo sapiens
atgcagttctgaagaaga

SEQ ID NO: 1288938 - DNA, 14 bp, Homo sapiens
atgccttttcccaa

SEQ ID NO: 1288939 - DNA, 22 bp, Homo sapiens
atgccttttcccaactccagaa

SEQ ID NO: 1288940 - DNA, 16 bp, Homo sapiens
atggcactagtatttc

SEQ ID NO: 1288941 - DNA, 23 bp, Homo sapiens
atggcttcctggcaatagtcaaa

SEQ ID NO: 1288942 - DNA, 16 bp, Homo sapiens
atgtcaatcagcctag

SEQ ID NO: 1288943 - DNA, 18 bp, Homo sapiens
atgtttcaaacatatata

SEQ ID NO: 1288944 - DNA, 15 bp, Homo sapiens
atgttttcaggctag

SEQ ID NO: 1288945 - DNA, 21 bp, Homo sapiens
atgttttcaggctagatgtat

SEQ ID NO: 1288946 - DNA, 13 bp, Homo sapiens
attacatttgtat

SEQ ID NO: 1288947 - DNA, 17 bp, Homo sapiens
attacatttgtataaaa

SEQ ID NO: 1288948 - DNA, 20 bp, Homo sapiens
attacatttgtataaaataa

SEQ ID NO: 1288949 - DNA, 16 bp, Homo sapiens
attactgtaagaaaat

SEQ ID NO: 1288950 - DNA, 14 bp, Homo sapiens
attatgaattacat

SEQ ID NO: 1288951 - DNA, 20 bp, Homo sapiens
attatgaattacatttgtat

SEQ ID NO: 1288952 - DNA, 21 bp, Homo sapiens
attatgttaaaactgggacag

SEQ ID NO: 1288953 - DNA, 22 bp, Homo sapiens
attgaggacactgatatgggtc

SEQ ID NO: 1288954 - DNA, 16 bp, Homo sapiens
attggagctcgtggaa

SEQ ID NO: 1288955 - DNA, 13 bp, Homo sapiens
attgtctagtgaa

SEQ ID NO: 1288956 - DNA, 20 bp, Homo sapiens
atttattactgtaagaaaat

SEQ ID NO: 1288957 - DNA, 17 bp, Homo sapiens
atttattttaataatgt

SEQ ID NO: 1288958 - DNA, 19 bp, Homo sapiens
atttattttaataatgttt

SEQ ID NO: 1288959 - DNA, 20 bp, Homo sapiens
atttattttaataatgtttc

SEQ ID NO: 1288960 - DNA, 21 bp, Homo sapiens
atttattttaataatgtttca

SEQ ID NO: 1288961 - DNA, 18 bp, Homo sapiens
atttctatgaaatattat

SEQ ID NO: 1288962 - DNA, 14 bp, Homo sapiens
atttgaaatattga

SEQ ID NO: 1288963 - DNA, 19 bp, Homo sapiens
atttgtagtgttggagaag

SEQ ID NO: 1288964 - DNA, 22 bp, Homo sapiens
atttgtagtgttggagaagaac

SEQ ID NO: 1288965 - DNA, 18 bp, Homo sapiens
attttaaaagaatgatta

SEQ ID NO: 1288966 - DNA, 12 bp, Homo sapiens
attttaataatg

SEQ ID NO: 1288967 - DNA, 14 bp, Homo sapiens
attttaataatgtt

SEQ ID NO: 1288968 - DNA, 15 bp, Homo sapiens
atttttatatttgaa

SEQ ID NO: 1288969 - DNA, 21 bp, Homo sapiens
caaaattttttctctaggaaa

SEQ ID NO: 1288970 - DNA, 17 bp, Homo sapiens
caaacatatataacaat

SEQ ID NO: 1288971 - DNA, 21 bp, Homo sapiens
caagccagattttcctgaaaa

SEQ ID NO: 1288972 - DNA, 20 bp, Homo sapiens
caagtattagaataccacag

SEQ ID NO: 1288973 - DNA, 23 bp, Homo sapiens
caataaaatccatacatttgtgt

SEQ ID NO: 1288974 - DNA, 23 bp, Homo sapiens
caatacatcccttacctgggaaa

SEQ ID NO: 1288975 - DNA, 17 bp, Homo sapiens
caatcagcctagttgat

SEQ ID NO: 1288976 - DNA, 16 bp, Homo sapiens
caatgctgtattttaa

SEQ ID NO: 1288977 - DNA, 17 bp, Homo sapiens
caatgctgtattttaaa

SEQ ID NO: 1288978 - DNA, 22 bp, Homo sapiens
cacacatgaagtccaagcattt

SEQ ID NO: 1288979 - DNA, 17 bp, Homo sapiens
cacagcctcttagatgc

SEQ ID NO: 1288980 - DNA, 19 bp, Homo sapiens
cacaggaaccacaagactg

SEQ ID NO: 1288981 - DNA, 20 bp, Homo sapiens
cacaggaaccacaagactgc

SEQ ID NO: 1288982 - DNA, 14 bp, Homo sapiens
cactagtatttcta

SEQ ID NO: 1288983 - DNA, 11 bp, Homo sapiens
cactgaagaag

SEQ ID NO: 1288984 - DNA, 23 bp, Homo sapiens
cactgaagaagcaccaatcatga

SEQ ID NO: 1288985 - DNA, 19 bp, Homo sapiens
cactgtgggtagacacaca

SEQ ID NO: 1288986 - DNA, 16 bp, Homo sapiens
cacttgtcaataaaat

SEQ ID NO: 1288987 - DNA, 14 bp, Homo sapiens
cagataatcacaat

SEQ ID NO: 1288988 - DNA, 22 bp, Homo sapiens
cagcacagcctcttagatgcag

SEQ ID NO: 1288989 - DNA, 19 bp, Homo sapiens
cagcccttctttccacaga

SEQ ID NO: 1288990 - DNA, 20 bp, Homo sapiens
cagcccttctttccacagaa

SEQ ID NO: 1288991 - DNA, 14 bp, Homo sapiens
cagcttattgtcta

SEQ ID NO: 1288992 - DNA, 20 bp, Homo sapiens
cagcttattgtctagtgaaa
